United States Patent 6,551,795 (NUCLEIC ACID AND AMINO ACID SEQUENCES RELATING TO PSEUDOMONAS AERUGINOSA FOR DIAGNOSTICS AND THERAPEUTICS) - sequence listing, part 2

SEQ ID NO: 1539 - DNA, 1671 bp, Pseudomonas aeruginosa
catgctgctcggcctgctggacctggagaaggtcacggtcaacgacctgatgatcccgcgcaacgaaatcgaaggcatcgacctcgacgacgaactcgaggtcatcgtcgagcagttgcgcaccaccagccacacccgcctgccggtctaccgcgacgacgtcaaccagatcgaaggggtcgtgcacatgcgccagatcgcgcgcctgctgacccagggccgcctgaccaaggagaatctccgccaggcctgcatggagccgtatttcgtgccggaaagcacgccgctgtcgacccagttggtgaacttccagaaggagaagcgccgtatcggcgtggtggtcgacgaatatggcgaggtgatcggcatcgtcacgctggaggacatcctcgaagagatcgtcggcgacttcaacgacctcgacagcctcgacaacccggatatccatgcccaggaggacggcagcttcgtcatcgacggcagcgccaacctgcgcgagctgaacaagtcgcttggctggcaattaccctgcgacggcccgaagaccctcaacggcctggtcaccgaagccctggagcagatccccgattgcgcggtgtgcctgcgcatcggcccctactgcctggaaatccagcagtcggcggaaaaccgtgtgaaaagcgtgcgcgcctggcatccccgcgcgctgaccccgctggtcgaaagcgacgccagcgtctgatccgggattgccgaaccggccccgcggcgctctataatcgaccccagcttatccagccctgccgccggttccgccgctacccgcagcccgagccccggccagtcacccgccagtcccgcctgcccgcccggccccgatgccgacggtaccagccggcgcacggcgcgcatccccatcctccctgcgcgaccgatctcgtccgccccacccgggcgccgcgccgccgcatcggcgcactggccataaccatccggccgcacggaagcactccgtcgtgccccgattgccagggaccttcccaccatgaccgccgccaccgtcgccgcggactccgctccggaaccggccaactcgaccacccgggtcgcagtcgccagcttcatcggcaccgccatcgagttctacgatttgtacgtctatgccactgccgccgccctggtgatcggtccggtattcatcccgcagacatccggcaccgcgcagatgatcagcgccttcctcacctttggcatcgcattcctcgcccgtccgctgggctcggcgctgttcggccatttcggcgaccgcatcgggcgcaagtcaaccctggtcgcctcgctgctgctgatgggggtgtccaccaccctgatcggcgtcctccccggttacgacagcatcggctactgggcgccgttgctgctctgcgtgctgcgcttcggccagggcctgcggcctcggcggcgagtggggcggcgccgcgctgctggccacggagaacgcgccggccggcaagcgcgcctggttcggcatgtttccccagctcggcccgtcgatcggcttcctcgccgccaacggcctgttcctggccctggcgatgctgctcagcgaggagcagttccgtgagtggggctggcggatcccgttcctgctcagcgcggcgctggttgtggtcggcctctacgtacgcctga

SEQ ID NO: 1540 - DNA, 687 bp, Pseudomonas aeruginosa
caagcgttcgcgcgcctcgccgctggtgataccgttctcgcccagcgcctgccatgccaccgggcgccgcatacgctcgccgagcgccgcggccaggcggccggccagggcgtaatccaggcaactggcgccgaccccggccactgtcgactcaccgaacaacagcaagcgcagcggctcttcggcaccggccccaccgaccagcccttcgcgaggtcccgccgcgggcgccaggcgcaaggctcggcggcgggtgcggatagccagcggcaccgccagcggcagcaacggcagagccgccgcccaccaggccagcgatgccagccggcgcatctcagagttcgacgcgaaccgcctgggcggcccgggtcgccttggcgcgggcggcgtcgatcgactcgtcgcgcgccagggccacgcccatccgccgctggccatccacttccggcttgccgaacaggcgtagcgccgtatccgcctcgctcagcgcggcgccgaggttggcgaaagcgacctgccgggacttgccttccaccaggatcaccgccgaggccgacgggccgagctggcggatcaccgggatcggcaggccgaggatcgcccgcgcgtgcagcgcgaactcggaaagatcctgggaaatcagggtcaccaggccggtatcgtgcggacgcggcgacacctcgctga

SEQ ID NO: 1541 - DNA, 411 bp, Pseudomonas aeruginosa
gcctttccccgaagaagaacctggcatgaaattctgcagcctgtgcggcgccacggtggtccagcgcatcccggacggcgacaaccgcctgcgctacgtctgcgacgcctgccacaccgtgcactaccagaacccgcgtatcgtcgccggcagcctgccggtgtgggacggccaggtcctgctctgccgtcgcgccattgcgccgcgcctgggctactggacgctgccggccggcttcatggagaacggcgagaccctcgcccaggcggcggcccgcgagacagaggaagaagccaacgcgcggatcggcgacctgcagctctatacccttttcgacctgccgcacatcagccaggtctacctgttcttccgcgccgagctgctcgacctggatttctccgccggcgatga

SEQ ID NO: 1542 - DNA, 573 bp, Pseudomonas aeruginosa
gaaagactgaacgccaaacactcgaacaccgccgccgttgcggctcaagggaacatcagggatttcacttccatgcgctggttgcttgctttgctgtgcttgaccttcgccagtctgacccaggccaatgccgcgccgagcctggaaggcaaggtggacaaggtcctggtgctcaagtccgagcgaaaactgctgctcctcaacaaaggcaacgtcctgaaaagctaccgtgtctcgctgggcaagcgcccgaccggcccgaagctggccgaaggcgacaaccgcaccccggaaggcttctactggatcgactggcgcaagaccagcaacaactacaacctctccatgcacatttcctaccccaacgcccgcgacgtggccaaggcccgggaaaagggcctgccggccggtggcatgatcatgatccacggcaccccgctggatgacgaatacccggagtggtacttctccaccctggactggaccaatggctgtatcgccatgaacaacaccgacatgcgcgaagtctggagcgtggtgaaagacggcacgctgatcgagatccgcccctga

SEQ ID NO: 1543 - DNA, 1164 bp, Pseudomonas aeruginosa
ccgacacctactgccgcaacgactactacgacttcgtcgccgaactgcgacgctgaccgacacggagccgccatgctcgaaggcaacattctcaccccgcaaggctgggtcctcggccgcctacacatccaggacgggcgtatccagcggatcgaaggcgagccctgcgacccggccggcaacgccgatccgtacctgctgccaggcttcatcgacctgcatgtgcacggcggcggcggccgcgacatcatggaaggcggcgacgccttcgccaccatcgcccgcacccaccggcgcttcggcacgacctcgctgctggccaccaccatgaccgcaccgcgcgaggagatcgccgacatcctcagccagctcggcgcttactgccgccgctcgctggagggcggttcacggatactcggcgtgcacctggaaggcccctacatcaactccggcaagctcggcgcgcagcccaacttcgcccatgccgcggtgctcgaggaagtcgaggactacctgcgccgcgcgccgatccgggtgatcaccatcgcccccgagatcgccggacaccggccgctgatccgcgccctcgccgagcgcggcgtacgcctgcagatcggccataccctgggcagctacgaggacggcgtggccgcactggaagccggcgccagcagcttcacccacctctacaacgcgatgaccggcctgcaccaccgcgaaccgggtatcgtcggcgcggccctggcccacgcacgctacgccgagctgatccccgacctgctgcatgtccatcccggcgccatcagggtggccctgcgttcgatcccgtgcctgtactgcgtgaccgactccaccgccgccgccggcatgcccgacggccagtacaagctcggcagccacacggtgaccaagtgcctgggcggcgtgcgcctgcccgacggcaccctggccggcagcaccctgaccatggaccaggcactgcgcaacctggtgaagatcggcctgcccctggccgaagcctcgcaacgcctttcgcaattccccgccgattacctcggcctcgccgagcgcggccgcctggcgcccgcagcctgggccgatgtggtgcgcctggatcgctccctggaactcgacgccgtgatggtggaaggagaactcgaatga

SEQ ID NO: 1544 - DNA, 2061 bp, Pseudomonas aeruginosa
gcaaagtcacccgaacccactgagcctgagcgcgcgcccatgaacaacaagaatctcgccctcaaagcgcccctgagcggccccgtgatgccgctcaaccgagtacccgacccggtgttttccagcggcaccctgggcgaaggcatcgccatcgacccactcaacgactgcctgcacgcgccctgcgccgggctggtcagccacctggcgcgaacccgccacgcgctcagcctgcgcgccgacaacggtgccgagctgctgctgcacgtcggcctcgataccgtacagctgcaaggcgaaggcttcgaggcgctggtcgaggaaggtgcgcgggtgatcgagggccagccgctgctgcgcttcgacctggaccgcgtcgcccgcggcagccgcagtctgatcacggtgatgatcctgaccaacggcgacggcttccaggtacgcccgctgaccaccaacccggtggaggtcggcgcgccgctcctgcaactgagtccggagaaggccgagcaacgtccggccaatcccgcgcctggcgaaggctccgcgcagcgccaggtccgcgggcgggcgcgggtcgcccatcatggcggtctgcacgcacgcccggcagcgctgctacggaagaccgcgcagggcttttccagccaggccgaactgcacttcgccgggcaggtggccagcgtcgacagcctggtcggcatcatgggcctgggggtcgccgaacaggacgaggtagaggtgatctgtcgcggcgaagacagcgaggcggccctcgacgccctgctcgcggccctcgccagcgccaccgcgggggctccgaaggaggccccgcgcgccatcgccccgggcgagccggcgcgacctgcggctgtcgccggtaccctggccggcgtctgcgcttcgcccggcctggccagcggtcccctggcgcggctcggcgccatcagcctgccggcggatgacggccggcatcgtcccgaggaacagcacctcgccctggaccaggccctgcaacgggtgcgcgacgacgtacaggggagcctgcagcaggccaggctcggcggcgacgagaacgaagcggcgatcttttccgcgcatctcgcgctgctggaagacccgggtctgctggacgccgccgacatgctgatcgaccagggcgtcggcgccgcccacgcctggcaccgggcgattcaggcccagtgcgagattctccaggcgctgggcaacctgctgctggccgagcgcgccaacgacctgcgcgacctggaaaaacgcgtgctgcgggtactgctcggcgacaccgcgccattgcgggtgcctgctggcgccatcgtcgccgcccgggagatcactccctccgacctcgcgccgctggtggatgccggcgcggctggcctgtgcatggccgaaggcggcgccacctcccacgtggccatcctcgcccgcagcaagggcctgccgtgcctggtggcgctcggcgccgggctgctggagctggaggaaggccggcaggtggtgctggacgccggccagggccggctggaactcagccccgacgctcgacgcctggagcaggtcgccttgcaagtggcgcagcgcgaggaacaacgccgccgccagcaggccgatgcgcagcgcgaggcgctcacccgcgacggccggcgcatcgagatcggcgccaacgtcgcctcgccgcgcgaggccgccgaagccttcgccaacggtgccgacggggtcggcctgctacgcaccgagtttctctttctcgagcgccgcgccgcgcccgacgaagaggagcagcgcaacgcctaccaggaggtcctggacgccatgggccagcgcaaggtgatcatccgcaccatcgatgtcggcggcgacaagcacccccaatacctggccgctgccggtggaagaaaaacccagcactggggcctgcgcggcatccgccccgggccaggcgcgcccggagctgctcgaccagcagttgcgcgcgctgctgagggtcgaaccactggaacgctgccggatactgctgccgatggtcagcgaggtcgatga

SEQ ID NO: 1545 - DNA, 456 bp, Pseudomonas aeruginosa
atgccgccgccacgcccaggcgctactggacctgggcagcgcccgggcggtgcgcgacgcctgcctgcaacactggccgctggcctgacaagaacaatcggagaccaccgccatgcccccgttcctgatcgaaagcctgcaacgcctgggccgcgccctgatgctgccgatcgcgatcgtgccgatcgccggcctgctgctgcgcctgggcgacgtcgacctgctcgacattccgctggtccacgacgccggcaaggcgatcttcgccaacctggcgctgatcttcgccatcggcatcgccgtcggtttcgctcgcgacaacaatggcaccgccggcctcgccggcgccatcggctacctggtgatgatctcggtgctcaaggtgatcgatccgggcatcgacatgggcgtgctctccggcatcatcagcggcctggtggctggcgccctgtataa

SEQ ID NO: 1546 - DNA, 1068 bp, Pseudomonas aeruginosa
cttcaccgacccggaaaccgggcgcgtcgtcaccggcgacctggcgcgctatttcgccggcgacccgaagggcggccagttcatggccgggatgttcccggtgatgatgttcggcctgcccgccgcctgcctggcgatgtaccgcaacgcccgtccggagcggcgcaagctgatcggcgggctgctcctgtcgatggccttgaccgccttcctcaccggcgtcaccgagccggtggagttcgccttcatgttcctcgcgccgctgctctacctgctgcatgcgctgctcaccggcctgtccatggccctcaccgacctgctcgatatccgcctcggcttcaccttctccggtggcgccatcgacctcgccctgggctggggccgttccacccacggctggatgctctggccgctgggcctgctctatgccggcatctattacctggtgttcgacttctgcatccgccgcttcaacctgaagaccccgggccgcgaagacgacgcgagcagcgaatcgggcgacaacgccgaagccgagcgcgccccggcattcatccgcgccctgggtggcgcagccaacctcgaagtggtggacgcctgcaccacgcgcctgcgtctgcgcctggtcgaccgcgacaaggcctcggacgcccagctcaaggccctcggtgcgatggccgtggtacgtccgggcaaggccggcagcctgcaggtggtggtcggcccacaggccgacagcatcgccgacgagatccgccgcgccctgcccttcgatacgcaaccgggcgaagccgtaccgccgctgggcagtccgaacgcagccgaagaggtggtgtcgatgcaggccaccgtcgacgccgccgaagcccaggcctggctcggcgccctcggcggcgccggcaacctgcgcgaggtacgggacgtcgcactgacccgcctgcgggtcagcgtggcggacgaacgcaagctggccaccgagcaactgcgtcgtctcggcggacagggcgtcagctccctcgccggcggcatctgccatatcctggtgggcccccgcgccgcgggccctga

SEQ ID NO: 1547 - DNA, 4359 bp, Pseudomonas aeruginosa
catgatgaatatttgacgctgcctttacgacagataagcgcaacatttgttcgctcgtcacaacaccttcgtgcgggcgttcacagatttacgctcaggccgcggaaacgccgccacctggccttcagcccggaggcggaaggcgcatggctgccgtcgcaatacggcaggtcggcggagcgcccgcagcggcacaacagcaacaggcgctcgcgggtcgcgtggagcgtcaggccgttgcggcagtcggcgggacaatcgggaagcgaagccgaagccccgcaggtacagagccgcaaggtgtcgccgggagagacccggcgaacctcggggaagaaggtcggggcgacgagttggagtccgcatcgcccgccatgccggatcagtccacccagacccgggcgttgggggaacatgcgcagccagccgccgtcttcctgccagtcgtccggacgccaggaatttctgcacggcgcggaacacccgctcggggtgcggcatcatgatggtgacccggccgtcgcggctgctcagcccggtgatgccgcgcggcgacccgttggggttggccgggtaggcttcggtgaccttgccgtggttgtcgacgaaacgcagcgacacgcagccggaaaggtcggcctcgagcaacgcttcctccgactcgaactccgcatggccttcgccatgggcgatggcgatcggcaggcgcgaaccggccatgccctgcaggaagatcgacgacgactcctgcacctggaccatcgccacccgcgcctcgaactgctcggaacggttgcgcacgaagtgcggccagaactcggtgccgggaatcagctcgtgcaggttggacatcatctggcagccgttgcagacgccgagggcgaagctgtccttgcgcgcgaagaacgcctggaagccgtcgcgggcgcgggcgttgaagaggatcgacttggcccagccctcgccggcgccgagcacgtcgccgtaggagaagccaccgcaggccaccaggcccttgaaggcgtccaggtcgacccgcccggcgaggatgtcgctcatgtgcacgtcgatcgcggcgaagccggcgcggtcgaacgccgcggccatctccacctggccgttgacgccctgctcgcggaggatcgccactttcggccgcacgcccttcttgatgtagggcgcggcgatgtcgtcgttgacgtcgtaactgagcttgatcgacagcccggggttgtcttcgtccagcagcgcatcgaactcctgctcggcgcagtcggcgttgtcgcgcagacgctggatctggtagctggtctcgctccagatgcgttgcaggatgcggcgctgggcgctgtagacggcctcgccgttgtagttcaggttgatctcgtagccgttgaccggctggccgatcaccgccacgcagtcgtcgagaccggcggcgctgaactgcgcgaggacttccggagtggcgccctcgcgaacctggatcaccgcgcccagttcctcgctgaacaacacggccgccaactcttcgcggctatcggccagggcatcgaggttcaactcgacgccgcagtgaccggcaaaggccatctccagcacgctggtgatcaggccgccgtcggaacggtcgtggtaggcgaggatatggccgtcggcattgagcccctggatcaccgcgaagaaggctttcaggtcctcggcgtcgtcgacgtccggcacggcgcggccgagcttgccgtggacctgggccaggatcgagccgccgagacggttcttgccgcggccgagatcgatcaggatcaggtcggtctcgcccttgtccaggcgcagttgcggggtcaggctctggcgcacgtcggcgaccggggcgaagccggtgacgatcagcgagaccggagaagtcacgctcttgtcctcgccattgtcctgccagcgggtcttcatggacatcgagtccttgcccaccgggatggtgatgcccagttccgggcacagttccatgcccacggccttgaccgtgtcatacaggcgcgcgtcctcgccggggtggccggcggcggccatccagttggcggaaagcttgatgtcggacagcttgccgatacgcgcggcagccaggttggtgaccgtctcgccgatggccatgcgtccggaagccggggcgtccagcagcgccagcggggtacgttcgcccatcgccatggcctcgccggtgtagacgtcgaagctggtggcggtgacggcgcagtcggccaccggcacctgccagggcccgaccatctggtcgcgggccaccagcccggtgatggtgcggtcgccgatggtgatcaggaagctcttgctggccacggcaggatggcgcaggacgcgctcgacgctttcctgcagctccagcccggcggcgtcgaaatcgtcgcccagctcggcctcgcgggtaaccgcgcggtgcatgcgcggcgccttgccgagcaggacttccagcggcatgtccaccggcttgttgtcgaaatggctgtcggcgacggtcagctggcgctgctcgatggcctcgccgaccaccgcgaacgggcagcgctcgcgctcgcagatggccttgaaggtctcgaagtcggcggcgtccaccgacagcacgtagcgctcctgcgactcgttgcaccagatttccagcgggctcatgcccggctcgtcgttgggcaccgcgcgcagctcgaagcgaccgccgcggccgccgtcgttgatcagttccggcagggcgttggacaggccgccggcaccgacgtcatggatgaagctgatcgggttgcgctcgccgagctgccagcagcggtcgatcacttcctggcaacgtcgctccatttccgggttgtcgcgctgcaccgaggcgaagtcgaggtcggcggagctggcgccggtggccatcgaagaggcggcgccgccgcccaggccgatcagcatggccgggccgccaaggacgatgagcttggcgccgacgctgatctcgcccttctgcacgtgttcgtcgcgaatgttgcccatgccgccggcgagcatgatcggcttgtggtagccgcgcacttcctcgccgtgaggggtagcgatcttctgctcgaaggtacggaagtagccggtcagcgccggacggccgaactcgttgttgaacgcggcgccgcccagcgggccctcgatcatgatgtccagcgcggtgacgatgcgctcgggcttgccgtagggcacttcccagggctgttcgaaaccggggatctgcaggttggacacggtgaagccggtcaggccggccttcggcttggcgccgcggccggtggcgccctcgtcgcggatctcgccgccggaaccggtggaggcaccggggaacggcgcgatggcggtcgggtggttgtgggtctccaccttcatcaggatctgcaccggctcgcggctggcggcgtattcgcgggtctgcggatcggggaagaaacgcccggcgacatggccgacgatgaccgcggcgttgtccttgtatgcggacagcacgccttcgcggttcatctcgtaggtgttcttgatcatgccgaacaggctcttgtcctgggcctgcccgtcgatgtcccaactggcattgaagatcttgtgccggcaatgctcggagttggcctgggcgaacatcatcagctcgacgtcgtgcgggttgcgccccagttcgccgaagctcttcagcaggtagtcgatctcgtcctcggccagggccaggcccaactcgacgttggccttctccagcgcggcgcgaccgccgccaagcacgtcgacggcggtgagcgggcggggctgcgcatggctgaacagctcggcggcgccttccaggcggtccagcaccagttgggtcatgcggtcatgcaggcgggcggcgacctgctgggcgtcgctctcggacagttcgccctgcacatagtaggcaatgccgcgctccagccggtcgatcttcgccaggccgcagttgcgggcgatgtcggaggccttgctcgaccacggcgagatggtgccgaagcgcggcaccaccaggaacagccgtccgctgggctcctgcaccggcacgctcgggccgtatttcagcagccgcgccagcacctgctcctcgtcggcggtgagcgcgccggtgacgtcggcgaaatgcgcgaactcagcgtacagcccggtaacggcaggtacgtgctgggtcagttgctcgagcagtttgccgtggcggaaagcggaaagggcgggagcgccgcgcaggatcagcattgtcggaacagcctctggagacgggaaggtgtgggggccggccgggccggcccgcagaggccgtgcattctaccgtaa

SEQ ID NO: 1548 - DNA, 1566 bp, Pseudomonas aeruginosa
cgaggcgaaagcccctaccgccctggagcgcgtgcagaaggagggcgtactgcgcgtgatcacccgcaacagcccggccacctacttccaggaccgcaacggcgaaaccggcttcgaatacgaactggccaagcgcttcgccgagcgcctcggcgtcgagctgaagatcgagaccgccgacaacctcgacgacctctatgcccagctttcccgcgagggcggcccggcgctcgccgcggccggcctgaccccgggacgcgaagacgacgccagcgtgcgctactcgcacacctacctcgacgtcaccccgcagatcatctaccgcaacggccagcagcgcccgacccgcccggaagacctggtcggcaagcgcatcatggtgctcaagggcagcagccacgcggagcagctcgccgagctgaagaagcagtatcccgaactgaagtacgaagaatccgatgctgtcgaagtggtcgacctgttgcgcatggtcgacgtcggcgacatcgacctgaccctggtcgactccaacgaactggcgatgaaccaggtgtacttccccaacgtccgcgtcgccttcgacttcggcgaagcccgcgggctggcctgggccttgccggggggcgacgacgacagcctgatgaacgaggtcaacgcgttcctcgaccaggccaagaaggaaggcctgctgcaacgcctgaaggaccgttactacgggcatgtcgacgtactcggctacgtcggcgcctacaccttcgcccagcacctgcagcaacgcctgccgcgctacgaaagccacttcaagcagagcggcaagcagctggataccgactggcgcctgctcgccgccatcggctaccaggaatcgctgtggcagcccggcgccacctccaagaccggcgtgcgcggcctgatgatgctgaccaaccggaccgcccaggcgatgggcgtgtccaaccggctcgacccgaagcagagcatccagggcggcagcaagtatttcgtgcagatccgcagcgaactgcccgagagcatcaaggaaccggaccgcagctggttcgccctggccgcctacaacatcggcggcgcgcacctggaagacgcgcgcaagatggccgagaaggaaggcctcaacccgaacaagtggctggacgtgaagaagatgctgccgcgcctggcgcagaagcagtggtacgccaagacccgctacggctatgcgcgcggcggcgagaccgtgcacttcgtacagaacgtgcggcgctactacgacatcctcacctgggtgacccagccgcagatggaaggcagccagatcgccgagagcgggttgcacctgcccggcgtgaacaagacgcgcccggaagaagacagcggcgacgagaaactctagccgccccctcccctcaggattctccgtcgcttgccagccaggcggcgtgctcgcgcacatcggtcggccagccggcgatccgctcggcgaagccctcgcgatccccggcgaacagcgcacgcgtcgcctcctcgaagcccggcaggtcgccggccatcgcattcatgaaatggtag

SEQ ID NO: 1549 - DNA, 1005 bp, Pseudomonas aeruginosa
attttctcatttcccagccgcgaaggcgagccatcgctccgtgcaaccgcctctttgctgatccggagcaaacgaaaagggcagccgaagctgccctttcctctcatcggcgcgagccgatcattcccactcgatagtcgccggcggcttgctcgacacgtcgtaggtgacccgggagataccggcgatctcgttgatgatgcggttcgagaccttctccagcagttcgtagggcaggtgcgcccagcgcgcggtcatgaagtcgatggtctccaccgcgcgcagggcgacgacccaggcgtagcgacggccgtcgccgaccacgccgaccgatttcactggctggaacaccacgaacgcctggctggtcttgtggtaccagtcgaaggcgcgcagttcctcgatgaagatgtggtcggcctggcgcagcaggtcggcgtactccttcttcacctcgccgaggatgcgcacgcccaggcccgggccggggaacgggtggcggtagaccatgtcgtagggcaggcccagctccaggccgatcttgcgcacttcgtccttgaacagttcgcgcagcggctcgaccagttcgaactgcatgtcctccggcaggccgccgacgttgtggtgcgacttgatcacgtgggccttgccggtcttggcgccggccgactcgatcacgtcggggtagatggtgccctgggcgaggaacttcacgtcctgcagcttggtggcttcttcgtcgaaaacttcgatgaaggtgcggccgatgatcttgcgcttctcttccgggtcggcgacgccggccaggcggccgaggaacttgtcctcggcgttggcgcggatcaccttcacgcccatgttctcggcgaacatggccatcacctggtcgccttcgtgcaggcgcagcaggccgttgtcgacgaacacgcaggtcagttggtcgccgatggccttgtgcagcagcgcggcgaccaccgaggagtccacgccgccggagaggcctag

SEQ ID NO: 1550 - DNA, 735 bp, Pseudomonas aeruginosa
caggaccttggaggaaccgacctgggcgcgcacggtggcgatggcgtcgtcgacgatgttcgagggggtccacagcgcggcgcaaccgcagatgtcgaggacgaagcgcgagagaatgcgcaggccctgcttggtgtgggtgacttccgggtggaattgcacgccgtagtaggcgcgggcatcgtcggccatggcggcgatcgggcagctcggggtgctggccaggatgtggaagccggccggcatctcggtgaccttgtcgccgtggctcatccacacgtcgaggccgagcacgccgtcgtcgtccacgtggtcctcgatgccgtccagcaggcgcgccttgccgaccacgtcgacgcgggcgtagccgaactcgcgcaggtcggagccctgcaccttgccgcccatctgctcggccatggtctgcatgccgtagcagatgccgaacagcggcaccttcaggtcgaacaccgcctgcggcgcgcgcgggctgtcggcttcgtgtaccgactcggggccaccggcgaggatgatgccgcgcggcgcgaaggcgatgatcgcctcgttgctcatgtcgaagggatggatttcgcaatacacgccgatctcgcgcacgcggcgagcgatcagttgggtgtactgggagccgaaatcgaggatcaggatacggtgggcgtgaatgtcttgggacatggccatctctcgctacggaattcgaaaacgacacggggctga

SEQ ID NO: 1551 - DNA, 1512 bp, Pseudomonas aeruginosa
tctggacgtcgtggacatggggactcggccatgcccgcgccggtgatccggacgaactgcggctggcgtgcgcatctgctggatgtcggcgctgccggtgtagcccatggcggcgcgcaggccgcccatcagctggtggacgatggcggacagggcacccttgtacggcacgcgaccctcgatgccttccggcaccagcttctcggcgccggcggaggcgtcctggaagtagcggtcggacgagccctgggagccggacatggcgcccagcgaacccatgccgcggtaggacttgtaggaacggccctggaacagctcgatctcgcccggcgcttcctcggtaccggcgaacatcgagcccatcatcacacagtaggcgccggcgaccatggccttggccaggtcgccggagaagcggatgccgccgtcggcgatcagcggtacgccggtgccttcgagagcggcggcgacgttggcgatggcggagatctgcggcacgccgacaccggcgacgatgcgggtggtgcagatcgagcccgggccgatgccgaccttgaccgcgtcggcgccagcctcggcgagggccttggcggcctcggcggtggcgatgttgccgccgatcacctggacgtccgggaaggtctgcttgacccagcgcacacgctcgatcacgcccttggagtggccgtgggcggtgtccaccaccaccacgtcgaccccggcggcgaccagcgcggcaacgcgctcgccggtatcggcgccggtgccgacggcggcgccgacgcgcaggcggccctgctcgtccttggacgccagcgggtaggtcttggccttctcgatgtcacggaaggtcaccaggccacgcaggtagaagttctcgtcgaccaccagcatcttctcgatgcggttctcgtaaagcttggccttcatctcttccagcggggtgccttcgcgggcggtgaccagcttgtccttcggggtcatgatcgcggcgacggtatcgccggcgttcggcttcacccgcaggtcgcgaccggtgacgataccgaccagctcgccctgctccaccaccgggaaaccggagaagccgtactcgcgggccatctgcagcagttcgatgatcttggtcgagggggtcacggtgaccgggtcgcggacgatggccgtttcgtgcttcttgaccttgcggacttccgcggcctgctgctcgatgcccatgttcttgtggatgatgccgatgccgccttcctgggccatggcgatggccaggcgggcttcggtcacggtatccatcgcggcggataccagcgggatgttcagttcgatgccgcgggtcaggcgagttttcaaactcacgtccttgggcaggacttcggaataaccggggatcagaaggacgtcgtcgaaagtcagggcttcttgactgattcgcagcatggcgggcgctcccagacgggaaaaatggaagcgcgacattatacccagccacgggcttccgctcaacgcagttga

SEQ ID NO: 1552 - DNA, 1272 bp, Pseudomonas aeruginosa
gttccacggaccggccgatcgcaacggcaaggccgaactcaagaccaacgcgatggcctaccgccaggtgttcttcagcgacatctgcggcactctctgcacgccgcagttcatcattcccttcgtcgacatcgatgcgcgcctgcccggcagcgccgggcataccggcgagaccggtttcggcgatccccaggtcggcggcaccctgttcttcatcaacgacccggaacggcgccgctacagcggcctgctgaccctgatcaccctgccgctgggcgagtaccacgcgaagaaccccgatgtctcgcccggcgccaaccgctggggcgccaccttcgtctacaactacacccagggcatcggccgcgactgggtgctggaagccaacctggaagcgcagttctacgcgaagaacgacgactacttcggcagcgacctggaacagaaaccgctctatcgcctgcaggccttcgcctcctacgacttcagccagagcacctacggcgccctcaagctggtgcacgccgatggcggcgaactgaagctgcagggccattccctcgacgacacccaccagcgctacacccaactcggcttcgagctaggccactggctggaccggcgcaacagcctgatgttcggtctctcgcgcaacgtcgccaccgacaatgctttccatggcagccaggccctgttgcgcctggtccatgtgttctgaggaggcgcagccatgagcgcttccgacaagactctcgccagcgcctctccggcgtccggcaacctcgcgctgctcgcggccatcgtggtgttcgccgcgatcaccccgaccatcctgatgaccgcccccgccatcgccgcgcaactggcgacccagtggcaactgagcccggcgcgggtcggcgacctgttttcggtggagctgggcgccatgagcctggcgacgctgccggccttccattggctgaaacgtgtcgattggcgccacgcggcgctgcctcgccggcctgctgttcatcgccgccaacctggcctcggcactggccggcagctacccgctgctgctcgccctgcgtttctgcagcgcccctcgccggcggctcgctgatgatcctctgcgtgtccagggccgccagcaccgccaccccgagcctggtctacgggctctgggtgatgggcccaactggtggtcggcgccgtcggcctggcactgctgccggcgctgttcgaacgcttcggtctggcccgcctgctacctgttgctggccggcctga

SEQ ID NO: 1553 - DNA, 1779 bp, Pseudomonas aeruginosa
acgcctccaacctggtcatcggcggcgggctggccatcggcccggcgctggcaggacgactcatcgaaggcagcggcggtttcctcccgctgctgccgatcgccgccggcctggccgccctctcgctgctgctggccctggcctgccggccacgctgaaaccctttcccgaaccacggatacccgccatgacccgacgtaccgctttcttcttcgacgaactctgcctctggcacgccgccggcccgcacgcgctgaccctgccggtcggcggctgggtgcaaccgcctgccgccgccggacacgccgaatcaccggaaaccaagcgccggctgaaaagcctgctcgacgtgtccggcctgaccgcccgcctgcaactgcgcagcgcaccgccggcgagcgacgaggacctgctgcgcgtgcatccggcgcactatctggaacgcttcaaggcgttgagcgacgccggcggcggcagcctcggccaggacgcgccgatcggcccgggcagctacgagatcgcccggctctccgccggcctggccatcgccgcgctggacgcggtgctcgccggcgaggcggacaacgcctactcgctgtcgcggccgccaggtcatcactgcctgccggaccaggcgatgggcttctgtttcttcgccaacatcgccgtggccatcgaggcggccaaggcgcgccacggcgtcgagcgggtcgcggtgctggactgggacgtccaccacggcaacggcacccaggcgatctactaccggcgcgacgacgtgctgagcatttccctgcaccaggacggctgcttcccgcctggctacagcggcgccgaagacatcggcgaggatcgcggtcgtggcttcaacctcaacgtgccgctgcttcccggcggcggtcacgacgcctacatgcaggccatgcaacgcatcgtgttgccagcgctggaacgcttccgcccgcaattgatcgtggtcgccagtggcttcgacgccaacgcggtggacccgctggcacgcatgcaactgcacagcgacagcttccgggcgatgaccgcgatgatccgcgacgcggccgagcggcatgccggcggacgcctggtggtggtccacgaaggcggctactcggaagcctacgtgccgttctgcggcttggctgtgatcgaagaactcagcggcgtgcgcagcgcggtgcgcgacccgctgcgcgacttcatcgagttgcagcagcccaacgcggcgttccgcgacttccagcgccagcgcctcgaagagctggccgcacagttcggcctgtgcccggcgcagccgcttcaagcggccaggtagcgcccgaccagcgccaggccgctgcacagcaccagccaggtgaccaggcggacgaaggcttcacgcgacagacgcagggtcacccgacggccgatccacaggcccagcgccatgcccggcagcaggcaggcggcgagcagccagggctcgcgcgcggcatacagcccggcgagcaggaacagccccaggcggacgaaggtgctacaaccgatcagcgcgctctgggtggcgcgcatctgctccttgctcgccaggcgtccgttcaggtacagcgaataaaggaagccgccgctgccgaacaacgcgccgaacagcccgccgaagacaccgaagggcaacgcccaggtcgcccgccagcgcggctggccgcgtggctggaggaacagcgcgtagagcgcatagaaactgacgaacacgccgagggccagcatcagcagctccgcgcgtag

SEQ ID NO: 1554 - DNA, 528 bp, Pseudomonas aeruginosa
tcctggcccgtggcggcggttccctggaagacctctggtgcttcaacgaagaagcggtggcgcgcgccgtggcggcctgcgccacgccgatcgtcagcgcggtcggccacgagaccgacgtatcgatcagcgacttcgtcgccgacgtgcgcgcgccgacgccttcggccgccgccgaactgctggcgcccaacgccggcgacctgcagcagcgtctcgacggcctgcgccggcgcctggtgctgcgcatgcgcgaccagttgctgcgcgaacgcctgcgcctggaaggcgtcgcccgccgcctgcgccatcccggcgaacgcctgcgccagcaggcgcagcgcctggacgacctggacatgcgcctgcgccgtgccttcgagcgccagctggcggtccgccacgaacgcctggtccgcctggagacgcgtctcgccgcacagcatccgggccgcaccctggcgctgctccggcagaagctcgacagcctcgccgcgcgcctgccgcgcgccgcccgcgaggtactga

SEQ ID NO: 1555 - DNA, 1158 bp, Pseudomonas aeruginosa
atagtcaacgagacaacggctagcgttgcttcgctttcgtgcgagcacccggccccgcgccccgacaagaagtgccgccgatcccccgaccgttcggactgccataaggaaaacaacatgcacacgaatccgcgccacggcctcgcccgccgcttcgccgccggactgctggccgccgccctgggcctgggcggcagcctcgcccaggccgccaccaccctcaacctgagctataacggcgccgccgacagcgagaagaacctggtgcacctgttcgccagcaacctcaagcgcctggccgaggaaaagagcggcggcgaactgcagttcaagctctaccccaacagcatgctcggcgaagaggagcagcgcatggaacaggtgatgaccggccccggcctgaacatcgcctccttcgccgggatcgccccgctgttcccggagatctacgtcagcgccacgcccttcatgttcaaggacgccgccgcggcccacgccttcttcgacagcggcagctactggcaggccgcccgcgaggccttccgcgagcgcaccggcaccgagctgctggcggtggtcgaggaaggcggcttcctcaacttcaccaacggcaagaagccgatccacggcccggcggacttccagggcctgcgcttccgcgccatggatcccagccaggtggcgctctacgaagccttcggcgcctccggcacgccgatcccctggaccgagttgtacatgggcctgcgcaccggcgtcgccgacggccagatgaacccgacctcctacatcatcctcggcagcctctaccaggtgcagaagtacctgaccctggccaacatccagtactccgaccagttcctggtggccaacggcgatctgctcgccagcctcccggcaaaggagcgccaggccctgctcgacgccgccgccgaagccacccggctgaaccgcgaggcggtcgccgcccagcaggagcgcgacctggcgttcctcaaggaaaagggcatgcagatcatccagccgtccgccgatgacctcgccgccttccgcgagaaaggccagccgtcctacctggcctggctgaagacccaggacatcgagccgcgctggaccgagatggccttccgcgacgccggtctcgccaccgccccctga

SEQ ID NO: 1556 - DNA, 1362 bp, Pseudomonas aeruginosa
ccctcatgctgttgctccaggggccctggccgcggcagccggccagcaccaccgtcgagggagggtcgcaggcatgatggccatcgccatgatcgcagccttcgtggtcaacctcctgctcggcctgccgctgttcctctgcctgctgctcaccgcgctggtggggttcctcttcgtcgacccggcgctgttcgccaacaccctgccgcagcgcttcttcggcggcatggacatcttctcgctgatggcgatcccgctgttcgtgctggccggcaacctgatgaaccattccggcatgaccccgcgcctgatgcgtctggccaacgccctggtcggccacttccgcggcggcctcggccacgtcaacgtggtcgccggggtgttcttcgccggggtcaacgggtccgccgcggccgacgcttcggcactcagcaccctgctggtgccggccatggaaaaggaaggctactcgcggcgcttcgccgccgggctgaccgcgggcagctcgctgatcggtccgatcatcccgccgagcatcttcatgatcctctactcctcgctgaccaacacctcggtgggcgagctgttcctcgccggggtgattcccggcctgctgctggccgccgccttcatgctgctgaacgcggtgtacgcctaccgcaacgggctgcaggcgcgccatgcggcgccggcctggggcgagatcctggcggcgctgtccggcgccctgaccgcgctgatcgcgccggtgatcatcgtcgccggaatcgtcctgggactggtcacgcccaccgagtcgggcgccttgatcgctctctacgtggcgctggtcggtctgctccagcgccaactgagcctggtcgggctgtggaactcgctgcgcgagacggtacgcctgaccgccagcatctacgtgatcatcgccgccgcttcggtggtcaactggttgctcaactacgcccaggtcgccagcgagttcgcccagttgctggagccgttcggccactcgccgaccctgatgctgttcatcatcagcgcagtgatcttcgtctgcggcatgctcatggaagaagtctcggtactgatgctgctgacgccgatagtcgctccggtggcgctggccgccggcgtggatccggtgcacctggggctgatcttcaccctgaacatcaccatcgccctgatcaccccgccaatgggcgcctgcctgttcatcgtggcgaccatcagccgcctcgatatcctggaaatgttcaagggtatctggccgttcatcctcgtggccctgggggtgctgtcgctgctgatcctgttcccgtccctgaccctgtggctgccacgcctgctcaattgacgccatga

SEQ ID NO: 1557 - DNA, 831 bp, Pseudomonas aeruginosa
gccgtgacttcagcgtctggccggcctaccacaagctcggcattcctcacgcgatcccggagtgccacgctcgcggcgaggtcttcgagcgtctcctgcgggtcgccgccgccctccccggcggcgtgcgcctggtggtgctggacgcctggcggccgttcgccgtgcagcagtatctctacgacagcctgtccagcgccctggccgcgcactacccacgggccggcgaagccgagctggaacggctcacccgccagttcgtctcgccgccgagcagcagccgcgaggcgcccagcccgcatctcaccggcggcgcggtggacgtcaccctgtgcgacgcccagggccgctggctggacatgggcagcgccttcgacgaagccgtgccggcctcctacaccgcctacttcgaacgcctggcggagcccgacgcgcgccagcgacgcgtccgcgatcatcgtcgcctgctctatcacgcgatgctcgacgccggtttcagcaacctgcccagcgaatggtggcactacgatttcggcgaccagctctgggcctggcacaccggcgcgacgcaggcgctgttcggcccggtgcagttgcaggcgatggacgcgctctggcgccagcagttgcagaagcgccctctggcggactaggaggcgaaggcgcgccggtagcccagcggcggcaggccgaacgcggcggagaactgctggcgcaacgacaccgccgaaccgaagccggccagcccggcgatcgcctgcaccgaatgctcggtggtttccagcaggcgctgggccagtgccaggcgttcggcctgcagccactggttga

SEQ ID NO: 1558 - DNA, 1554 bp, Pseudomonas aeruginosa
gcgggttggcccgattctagcgaaagttgtctctcaggccactcactcgctacgccgcgccgggaccagaatccgcctcacccactcaggaggaaacgccatgtccacacgtcaacccaaacgcgccttgctggtcatcgacgtacagaacgaatacgtcagcggcaacctgcgtatcgaatttcccgccatccaatcgtcgctggaacgtatcggcgccgccatggatgccgcctacgcggcgggcatcccgatcgtcgtggtgcagcacctggcgccggcggactcgccgttgttcgcgcgcggcagccggcaggccgagctgcacgaggtggtcgcctcgcggccctaccagcacaaggtggaaaagcaactggccagttccttcgtcggcaccgggctggccgactggctgcgcgagcgcgacatcgacaccctcgccgtggtcggctacatgacccagcactgcgacgactcgaccatccgccaggcgatccacgaaggctggcaggtggaatacctgcacgacgccagcggctcggtgccctaccgcaaccgcgccggccaggccagcgcggaagagatccaccggatcttcggcatcgtcctgcagtcctccttcgccgccgtgctcagcaccgaggagtggctggaaagcctcgccggccggcacgttccggaacgcgacaacatctacgactccaaccagcgagccctggccaaccgctgaaacggcgccgcccccccacgcggggcggcgagcgctcagccgaccagcgagccgcgcgccggcaacggcttccagcccgggaactcgcgcagccgcgggtcgggcaccgcgcaataggcgaatgtccagttcggcgccggcaggtccaggcgctccagcggcacacgcgtgccggcgccggcctgcggcgccttccagtcctgggtgatgtgcgcaccgccctggctggccaggaggatgccgcggttggcgctggtgtcgtccaccgtccagcgcgcggcggaggcgtccatcagcacctccagatgctcatcggtcaccttggcgccgaacggcgactgcaacagccagcagtacaggcgcaggtgcatcgcccagttccaggcggccttctgctcggccgcccattgcaggaaaccacggaggatggtcaggccatccggcggatcgatcttcagcagttccgggcaaaggtcgtagagatggtgccaggcgctgctcaggcgcttgttgagctggtccggacgcagggtggagttcttcggcggcaggccgggagccaccaccaggccggtctgcgccggcaagggatatctgttgctgttcatgctctgaacctcgcacgcaaaggcggggcgccgggcgcccctgctcgacacggcgctcagtggccgtgctgctcgtgcccgccctgttcggccggcgccttggactcgacgacgatttccaccggcacgtcgccggccttgcggaaatgcagcgtcagcgggaagcgctcgccggccaccagtggctgcttcaggcccatcagcatcaggtggtag

SEQ ID NO: 1559 - DNA, 489 bp, Pseudomonas aeruginosa
aatcgggccaacccgctcatacccaccgaggtgcgcatgtcccgccagtccgtggccgtggtggccttcgaccgcatcagtccgttccacctgtcggtgccctgcctggtgttcggccaggagtgctacgacccttgcgcgcaggccttcgacctgcgtgtctgcgccgccgagccgggccggctgcgaaccacggtggggttcaccatcgaggccgaggccgggctggaagcgctggccgaggcgcagaccgtgatcgtgccgagttggcgcgatccacacgagcgtccgccacaagcgctgctggatgcgttgatcgcggcccgtgcacgcggtgcgcaactggtgggcttgtgcctgggggccttcgtgctggccgaggccgggttgctcgacggtcgccgcgccaccacccactggatgtgggcggaggatttcgctgggcgcttccctgcggtgcgggtggagcccgacgtgctgtacatctag

SEQ ID NO: 1560 - DNA, 501 bp, Pseudomonas aeruginosa
gacgacggcctgctgacctcggcaggcaccgtcgccggcatcgactgctgcctgcacctggtccgccagcggctcggtgcgcagactaccaatcacctggcccggcgcctggtggtggcgccgcatcggcagggcggccaggcccagttcatcgagcagccgctgccggacagcgcccaggacggccgtctcggcgagctgctggtgtggctgcggcagaacctcgaccaggcgcacagcctggacagcctggcacagcgggtgctgatgagccggcggaccttcacccggcatttccgccagctcaccggcaccaccgtcaaccagtggctgcaggccgaacgcctggcactggcccagcgcctgctggaaaccaccgagcattcggtgcaggcgatcgccgggctggccggcttcggttcggcggtgtcgttgcgccagcagttctccgccgcgttcggcctgccgccgctgggctaccggcgcgccttcgcctcctag

SEQ ID NO: 1561 - DNA, 1587 bp, Pseudomonas aeruginosa
gccggccagacgctgaagtcacggctcagcccgagcgcctccagcggcgtgccggcatcgacgatggggatgccggccacggcgtgccagtcgggctccgggagaacggggatggcttgggtgaagtcggtcatggcgtcaattgagcaggcgtggcagccacagggtcagggacgggaacaggatcagcagcgacagcacccccagggccacgaggatgaacggccagatacccttgaacatttccaggatatcgaggcggctgatggtcgccacgatgaacaggcaggcgcccattggcggggtgatcagggcgatggtgatgttcagggtgaagatcagccccaggtgcaccggatccacgccggcggccagcgccaccggagcgactatcggcgtcagcagcatcagtaccgagacttcttccatgagcatgccgcagacgaagatcactgcgctgatgatgaacagcatcagggtcggcgagtggccgaacggctccagcaactgggcgaactcgctggcgacctgggcgtagttgagcaaccagttgaccaccgaagcggcggcgatgatcacgtagatgctggcggtcaggcgtaccgtctcgcgcagcgagttccacagcccgaccaggctcagttggcgctggagcagaccgaccagcgccacgtagagagcgatcaaggcgcccgactcggtgggcgtgaccagtcccaggacgattccggcgacgatgatcaccggcgcgatcagcgcggtcagggcgccggacagcgccgccaggatctcgccccaggccggcgccgcatggcgcgcctgcagcccgttgcggtaggcgtacaccgcgttcagcagcatgaaggcggcggccagcagcaggccgggaatcaccccggcgaggaacagctcgcccaccgaggtgttggtcagcgaggagtagaggatcatgaagatgctcggcgggatgatcggaccgatcagcgagctgcccgcggtcagcccggcggcgaagcgccgcgagtagccttccttttccatggccggcaccagcagggtgctgagtgccgaagcgtcggccgcggcggacccgttgaccccggcgaagaacaccccggcgaccacgttgacgtggccgaggccgccgcggaagtggccgaccagggcgttggccagacgcatcaggcgcggggtcatgccggaatggttcatcaggttgccggccagcacgaacagcgggatcgccatcagcgagaagatgtccatgccgccgaagaagcgctgcggcagggtgttggcgaacagcgccgggtcgacgaagaggaaccccaccagcgcggtgagcagcaggcagaggaacagcggcaggccgagcaggaggttgaccacgaaggctgcgatcatggcgatggccatcatgcctgcgaccctccctcgacggtggtgctggccggctgccgcggccagggcccctggagcaacagcatgagggtcagcaggccgaagccgagcggcaggctgagcaacggccaggtgcggctgacgcccaggccgaggctgcggaagcgcccggcgttcagcgcgtag

SEQ ID NO: 1562 - DNA, 858 bp, Pseudomonas aeruginosa
cgacgatccttcagtacctcgcgggcggcgcgcggcaggcgcgcggcgaggctgtcgagcttctgccggagcagcgccagggtgcggcccggatgctgtgcggcgagacgcgtctccaggcggaccaggcgttcgtggcggaccgccagctggcgctcgaaggcacggcgcaggcgcatgtccaggtcgtccaggcgctgcgcctgctggcgcaggcgttcgccgggatggcgcaggcggcgggcgacgccttccaggcgcaggcgttcgcgcagcaactggtcgcgcatgcgcagcaccaggcgccggcgcaggccgtcgagacgctgctgcaggtcgccggcgttgggcgccagcagttcggcggcggccgaaggcgtcggcgcgcgcacgtcggcgacgaagtcgctgatcgatacgtcggtctcgtggccgaccgcgctgacgatcggcgtggcgcaggccgccacggcgcgcgccaccgcttcttcgttgaagcaccagaggtcttccagggaaccgccgccacgggccaggatcagcgcgtcgaagccctgccggtcggccagttgcagcgcgcggacgatctgtgcgacggcctcgcggccctggactgcggtgggcaccagggtcagctcgacctgcggtgctcggcggcgaaacacgctgatgatgtcgcggatcaccgccccgctgggcgaactgacgataccgatgcggcgcggatgggcgggcagcggacgcttgcgttcgctggcgaacaggccttcgccggcgagtttttccttcaatgcctcgaaggccaggcgcagggcgccgtcgccggccggctcgacggtatcggcgatcaactggtag

SEQ ID NO: 1563 - DNA, 1080 bp, Pseudomonas aeruginosa
agccttcgtccgcctggtcacctggctggtgctgtgcagcggcctggcgctggtcgggcgctacctggccgcttgaagcggctgcgccgggcacaggccgaactgtgcggccagctcttcgaggcgctggcgctggaagtcgcggaacgccgcgttgggctgctgcaactcgatgaagtcgcgcagcgggtcgcgcaccgcgctgcgcacgccgctgagttcttcgatcacagccaagccgcagaacggcacgtaggcttccgagtagccgccttcgtggaccaccaccaggcgtccgccggcatgccgctcggccgcgtcgcggatcatcgcggtcatcgcccggaagctgtcgctgtgcagttgcatgcgtgccagcgggtccaccgcgttggcgtcgaagccactggcgaccacgatcaattgcgggcggaagcgttccagcgctggcaacacgatgcgttgcatggcctgcatgtaggcgtcgtgaccgccgccgggaagcagcggcacgttgaggttgaagccacgaccgcgatcctcgccgatgtcttcggcgccgctgtagccaggcgggaagcagccgtcctggtgcagggaaatgctcagcacgtcgtcgcgccggtagtagatcgcctgggtgccgttgccgtggtggacgtcccagtccagcaccgcgacccgctcgacgccgtggcgcgccttggccgcctcgatggccacggcgatgttggcgaagaaacagaagcccatcgcctggtccggcaggcagtgatgacctggcggccgcgacagcgagtaggcgttgtccgcctcgccggcgagcaccgcgtccagcgcggcgatggccaggccggcggagagccgggcgatctcgtagctgcccgggccgatcggcgcgtcctggccgaggctgccgccgccggcgtcgctcaacgccttgaagcgttccagatagtgcgccggatgcacgcgcagcaggtcctcgtcgctcgccggcggtgcgctgcgcagttgcaggcgggcggtcaggccggacacgtcgagcaggcttttcagccggcgcttggtttccggtga

SEQ ID NO: 1564 - DNA, 468 bp, Pseudomonas aeruginosa
ttcggcgtgtccggcggcggcaggcggttgcacccagccgccgaccggcagggtcagcgcgtgcgggccggcggcgtgccagaggcagagttcgtcgaagaagaaagcggtacgtcgggtcatggcgggtatccgtggttcgggaaagggtttcagcgtggccggcaggccagggccagcagcagcgagagggcggccaggccggcggcgatcggcagcagcgggaggaaaccgccgctgccttcgatgagtcgtcctgccagcgccgggccgatggccagcccgccgccgatgaccaggttggaggcgttcatcaggcggccggatcggtccaggtcggcgaggcaggcgaggatgaacggcagggcgaaggtccaggtgaacttgaacagcagcgcggccagggcgaagcgcgccagcggtggctggccgatcagcaggaggatcgccgcggccatcgccaggtag

SEQ ID NO: 1565 - DNA, 876 bp, Pseudomonas aeruginosa
catcgagaaggccaagacctacccgctggcgtccaaggacgagcagggccgcctgcgcgtcggcgccgccgtcggcaccggcgccgataccggcgagcgcgttgccgcgctggtcgccgccggggtcgacgtggtggtggtggacaccgcccacggccactccaagggcgtgatcgagcgtgtgcgctgggtcaagcagaccttcccggacgtccaggtgatcggcggcaacatcgccaccgccgaggccgccaaggccctcgccgaggctggcgccgacgcggtcaaggtcggcatcggcccgggctcgatctgcaccacccgcatcgtcgccggtgtcggcgtgccgcagatctccgccatcgccaacgtcgccgccgctctcgaaggcaccggcgtaccgctgatcgccgacggcggcatccgcttctccggcgacctggccaaggccatggtcgccggcgcctactgtgtgatgatgggctcgatgttcgccggtaccgaggaagcgccgggcgagatcgagctgttccagggccgttcctacaagtcctaccgcggcatgggttcgctgggcgccatgtccggctcccagggctcgtccgaccgctacttccaggacgcctccgccggcgccgagaagctggtgccggaaggcatcgagggtcgcgtgccgtacaagggtgccctgtccgccatcgtccaccagctgatgggcggcctgcgcgccgccatgggctacaccggcagcgccgacatccagcagatgcgcacgccagccgcagttcgtccggatcaccggcgcgggcatggccgagtccccatgtccacgacgtccagatcaccaaggaagcccccaactaccgggttggttga

SEQ ID NO: 1566 - DNA, 1659 bp, Pseudomonas aeruginosa
gtgctgcacggggctgttcgattcagccccgtgtcgttttcgaattccgtagcgagagatggccatgtcccaagacattcacgcccaccgtatcctgatcctcgatttcggctcccagtacacccaactgatcgctcgccgcgtgcgcgagatcggcgtgtattgcgaaatccatcccttcgacatgagcaacgaggcgatcatcgccttcgcgccgcgcggcatcatcctcgccggtggccccgagtcggtacacgaagccgacagcccgcgcgcgccgcaggcggtgttcgacctgaaggtgccgctgttcggcatctgctacggcatgcagaccatggccgagcagatgggcggcaaggtgcagggctccgacctgcgcgagttcggctacgcccgcgtcgacgtggtcggcaaggcgcgcctgctggacggcatcgaggaccacgtggacgacgacggcgtgctcggcctcgacgtgtggatgagccacggcgacaaggtcaccgagatgccggccggcttccacatcctggccagcaccccgagctgcccgatcgccgccatggccgacgatgcccgcgcctactacggcgtgcaattccacccggaagtcacccacaccaagcagggcctgcgcattctctcgcgcttcgtcctcgacatctgcggttgcgccgcgctgtggaccccctcgaacatcgtcgacgacgccatcgccaccgtgcgcgcccaggtcggttcctccaaggtcctgctaggcctctccggcggcgtggactcctcggtggtcgccgcgctgctgcacaaggccatcggcgaccaactgacctgcgtgttcgtcgacaacggcctgctgcgcctgcacgaaggcgaccaggtgatggccatgttcgccgagaacatgggcgtgaaggtgatccgcgccaacgccgaggacaagttcctcggccgcctggccggcgtcgccgacccggaagagaagcgcaagatcatcggccgcaccttcatcgaagttttcgacgaagaagccaccaagctgcaggacgtgaagttcctcgcccagggcaccatctaccccgacgtgatcgagtcggccggcgccaagaccggcaaggcccacgtgatcaagtcgcaccacaacgtcggcggcctgccggaggacatgcagttcgaactggtcgagccgctgcgcgaactgttcaaggacgaagtgcgcaagatcggcctggagctgggcctgccctacgacatggtctaccgccacccgttccccggcccgggcctgggcgtgcgcatcctcggcgaggtgaagaaggagtacgccgacctgctgcgccaggccgaccacatcttcatcgaggaactgcgcgccttcgactggtaccacaagaccagccaggcgttcgtggtgttccagccagtgaaatcggtcggcgtggtcggcgacggccgtcgctacgcctgggtcgtcgccctgcgcgcggtggagaccatcgacttcatgaccgcgcgctgggcgcacctgccctacgaactgctggagaaggtctcgaaccgcatcatcaacgagatcgccggtatctcccgggtcacctacgacgtgtcgagcaagccgccggcgactatcgagtgggaatgatcggctcgcgccgatga

SEQ ID NO: 1567 - DNA, 1536 bp, Pseudomonas aeruginosa
gaggaaagggcagcttcggctgcccttttcgtttgctccggatcagcaaagaggcggttgcacggagcgatggctcgccttcgcggctgggaaatgagaaaatctatcatttcccagccgcagtaccgcgaaggtgaaggctccatgacatttacccgtagacaagtgctcggcggcctcgccgggctggcggtggtcggcctcggcgccggcggcgcgcgcctctggctggcgcgtccgcaggtggcgcaggagtacgactacgaactgatcgccgcgccgctggacctggagatcgtcccgggcttcagcagtccggcgctggcctatggcggccagtgccccggcgtggagttgcgggcgaagcagggcgagtggctgcgggtgcgcttcaccaacaggctggacgaaccgaccaccatccactggcacggcatccgcctgccgatcgagatggacggcgtgccgtacatttcccagccgccggtgcagccgggcgagagcttcatctaccagttcaagacccaggacgccggcagctactggtaccacccgcacctgatgagcagcgagcagctcggccgcggactggtcggcccgctgatcatcgaggagcgtgaacccaccgggttccgccacgagaaggttctctgcctgaagacctggcacgtggacgagcagggcgccttcacccccttcagcgtgccgcgccaggccgcgcgtgaaggcacccgcgggcgctattcgacgatcaacggcaagcatgtgccgaccatcgacctgccggccgggcagatcgtccgggtgcgcctgctgaacgtcgacaacaccgtcacctaccgtctcaacctgcccaacggcgaggcgaggatctatgccatcgatggccatccggtggaaccacgcggcttcgaggggcagtactggatcggtcccgggatgcgcctggagctggcgctgaaggtgccggaagcgggcaccgagctgtccctgcgcgacgggccggtacgcctggcgacgatccgcagcgtggccagcgccgaggcacctgccggcgactggccgaagccgttgccggcgaatccggtgagcgaaccggacctggccaatgccgagaagatcggtttccgtttcgagtgggtcggggccatgtccgataccagcggcaagaatccctatccgtcgttctggcagatcaacggcaaggcctgggaaggcggcgaggagcacaagcacaacgcgccgccgctggccaagctcaaggaaggccagagctacatcttcgagctgcgcaacatggcgcagtaccagcacccgatccacctgcatgggatggccttcaaggtgctggattcggatcgccgggacatcatcccgtacttcaccgacacctacctgctgggcaagaacgagactgcccgcgtcgcgctggtggcggacaatccgggcctgtggatgttccactgccacgtcatcgaccatatggagaccggcctgatggggaccatcgcggtcggcgaggcctggtgcgggtga

SEQ ID NO: 1568 - DNA, 1479 bp, Pseudomonas aeruginosa
tattttgcacggccgcttgagcaagcggcccgcaggcaatggcttcaggtgagagcgagcccgcctgcggatacccccgccggaccgcgcagccgaaaagcgcggccggtccggaggcgtccgcgattcccggccctgcattgtcctcgaagaaggccatcggtacggcggtcctggccgcctcccgcacaatgccaattcgaaatgcagggagttgttgtcatgagtgatacccgggtccagcagtatcaggatcacgccggggcggaagccgtcgattcctcgggactggaggtcaagcgcctgacgttcctcgaggcggtggcgatgatcgtcggaaccaacatcggcgcaggcgtgctgtccatggcctacgccagccgcaaggccggcttcatgccattgctgctctggctggcggtggccggcctgttcaccaccatttccatgctctacgtctcggaaaccgccctgcgcacgcgcacccacaaccagttgagcggccttgcccagcgctatgtcggctccttcggcgcctgggcgatcttcctgtccgtagcggtcaacagcatcggcgcgctgatcgcctacatgagcggcagcggcaagatcctcagcgccttcttcggtatcagcccggccctgggcagcgtgctgttcttcattccggccgccggcgtgctgtacctggggctgagcgccatcggcaagggcgagaagttcatcagcatcggcatggtcagcatgatcctgatcctggtggcggccaccctgctcaacgacaataccgagttcgcccgtctgctcgacggcgactggatctacatggtgccggtattcaacatcgcggtgttctgcttctccgcccagtacatcgtcccggagatggcccgtggtttcagccacgccccggagcgcctgccgaaggcggtgatcaccgggatgctgaccaccttcgtcctgctcagcatcgtgccgctctcggtgatcgccctgaccggcctggagaaccagtccgaagtcgccaccctggcctggggcaaggcgctcggcgaatgggccttcttcaccgccaacaccttcgccctgtgcgccatgctgacgtcctactggggcctgggcggtagcttcctgaccaacatcttcgacaagttccacaagctcggtccggagaaccggccgaagacccgcctgctggtgctggcgatcgtcgcgctgccgccgttcgtcctggcctacagcgggctggtcggcttcgtcaacgcgttgtacttcgccggggccttcagcggggtgattctctcgatcatgccgatcctgatgctgcgctcggcgcgtaggaacggcgacttcgagccggcctggaaatgcggctggatcgcccatccggcgatccaggcggtgatcgtgacgatctacctggccagcgccgcctacgccatttgtagcgccatgaacctgctgccggccggctggtag

SEQ ID NO: 1569 - DNA, 1611 bp, Pseudomonas aeruginosa
atgcgatggccggcgacctgccgggcttcgaggaggcgacgcgtgcgctgttcgccggggatcgcgagggcttcgccgagcggatcgccggctggccgaccgatgtgcgcgagcacgccgcctggctggcaagcgacggagaatcctgaggggagggggcggctagagtttctcgtcgccgctgtcttcttccgggcgcgtcttgttcacgccgggcaggtgcaacccgctctcggcgatctggctgccttccatctgcggctgggtcacccaggtgaggatgtcgtagtagcgccgcacgttctgtacgaagtgcacggtctcgccgccgcgcgcatagccgtagcgggtcttggcgtaccactgcttctgcgccaggcgcggcagcatcttcttcacgtccagccacttgttcgggttgaggccttccttctcggccatcttgcgcgcgtcttccaggtgcgcgccgccgatgttgtaggcggccagggcgaaccagctgcggtccggttccttgatgctctcgggcagttcgctgcggatctgcacgaaatacttgctgccgccctggatgctctgcttcgggtcgagccggttggacacgcccatcgcctgggcggtccggttggtcagcatcatcaggccgcgcacgccggtcttggaggtggcgccgggctgccacagcgattcctggtagccgatggcggcgagcaggcgccagtcggtatccagctgcttgccgctctgcttgaagtggctttcgtagcgcggcaggcgttgctgcaggtgctgggcgaaggtgtaggcgccgacgtagccgagtacgtcgacatgcccgtagtaacggtccttcaggcgttgcagcaggccttccttcttggcctggtcgaggaacgcgttgacctcgttcatcaggctgtcgtcgtcgccccccggcaaggcccaggccagcccgcgggcttcgccgaagtcgaaggcgacgcggacgttggggaagtacacctggttcatcgccagttcgttggagtcgaccagggtcaggtcgatgtcgccgacgtcgaccatgcgcaacaggtcgaccacttcgacagcatcggattcttcgtacttcagttcgggatactgcttcttcagctcggcgagctgctccgcgtggctgctgcccttgagcaccatgatgcgcttgccgaccaggtcttccgggcgggtcgggcgctgctggccgttgcggtagatgatctgcggggtgacgtcgaggtaggtgtgcgagtagcgcacgctggcgtcgtcttcgcgtcccggggtcaggccggccgcggcgagcgccgggccgccctcgcgggaaagctgggcatagaggtcgtcgaggttgtcggcggtctcgatcttcagctcgacgccgaggcgctcggcgaagcgcttggccagttcgtattcgaagccggtttcgccgttgcggtcctggaagtaggtggccgggctgttgcgggtgatcacgcgcagtacgccctccttctgcacgcgctccagggcggtaggggctttcgcctcgctacagcccgcaagcagcagaaagatgccggtcgccaacagccaggcggcgcaacgtaa

SEQ ID NO: 1570 - DNA, 759 bp, Pseudomonas aeruginosa
cgtcggtgccggcggcctgtccaacgccctgccggaactgatcaacgacggcggccgcggcggtcgcttcgagctgcgcgcggtgcccaacgacgagccgggcatgagcccgctggaaatctggtgcaacgagtcgcaggagcgctacgtgctgtcggtggacgccgccgacttcgagaccttcaaggccatctgcgagcgcgagcgctgcccgttcgcggtggtcggcgaggccatcgagcagcgccagctgaccgtcgccgacagccatttcgacaacaagccggtggacatgccgctggaagtcctgctcggcaaggcgccgcgcatgcaccgcgcggttacccgcgaggccgagctgggcgacgatttcgacgccgccgggctggagctgcaggaaagcgtcgagcgcgtcctgcgccatcctgccgtggccagcaagagcttcctgatcaccatcggcgaccgcaccatcaccgggctggtggcccgcgaccagatggtcgggccctggcaggtgccggtggccgactgcgccgtcaccgccaccagcttcgacgtctacaccggcgaggccatggcgatgggcgaacgtaccccgctggcgctgctggacgccccggcttccggacgcatggccatcggcgagacggtcaccaacctggctgccgcgcgtatcggcaagctgtccgacatcaagctttccgccaactggatggccgccgccggccaccccggcgaggacgcgcgcctgtatga

SEQ ID NO: 1571 - DNA, 486 bp, Pseudomonas aeruginosa
cacggtcaaggccgtgggcatggaactgtgcccggaactgggcatcaccatcccggtgggcaaggactcgatgtccatgaagacccgctggcaggacaatggcgaggacaagagcgtgacttctccggtctcgctgatcgtcaccggcttcgccccggtcgccgacgtgcgccagagcctgaccccgcaactgcgcctggacaagggcgagaccgacctgatcctgatcgatctcggccgcggcaagaaccgtctcggcggctcgatcctggcccaggtccacggcaagctcggccgcgccgtgccggacgtcgacgacgccgaggacctgaaagccttcttcgcggtgatccaggggctcaatgccgacggccatatcctcgcctaccacgaccgttccgacggcggcctgatcaccagcgtgctggagatggcctttgccggtcactgcggcgtcgagttgaacctcgatgccctggccgatag

SEQ ID NO: 1572 - DNA, 1155 bp, Pseudomonas aeruginosa
ccgcgaagagttggcggccgtgttgttcagcgaggaactgggcgcggtgatccaggttcgcgagggcgccactccggaagtcctcgcgcagttcagcgccgccggtctcgacgactgcgtggcggtgatcggccagccggtcaacggctacgagatcaacctgaactacaacggcgaggccgtctacagcgcccagcgccgcatcctgcaacgcatctggagcgagaccagctaccagatccagcgtctgcgcgacaacgccgactgcgccgagcaggagttcgatgcgctgctggacgaagacaaccccgggctgtcgatcaagctcagttacgacgtcaacgacgacatcgccgcgccctacatcaagaagggcgtgcggccgaaagtggcgatcctccgcgagcagggcgtcaacggccaggtggagatggccgcggcgttcgaccgcgccggcttcgccgcgatcgacgtgcacatgagcgacatcctcgccgggcgggtcgacctggacgccttcaagggcctggtggcctgcggtggcttctcctacggcgacgtgctcggcgccggcgagggctgggccaagtcgatcctcttcaacgcccgcgcccgcgacggcttccaggcgttcttcgcgcgcaaggacagcttcgccctcggcgtctgcaacggctgccagatgatgtccaacctgcacgagctgattcccggcaccgagttctggccgcacttcgtgcgcaaccgttccgagcagttcgaggcgcgggtggcgatggtccaggtgcaggagtcgtcgtcgatcttcctgcagggcatggccggttcgcgcctgccgatcgccatcgcccatggcgaaggccatgcggagttcgagtcggaggaagcgttgctcgaggccgacctttccggctgcgtgtcgctgcgtttcgtcgacaaccacggcaaggtcaccgaagcctacccggccaaccccaacgggtcgccgcgcggcatcaccgggctgagcagccgcgacggccgggtcaccatcatgatgccgcaccccgagcgggtgttccgcgccgtgcagaaattcctggcgtccggacgactggcaggaagacggcggctggctgcgcatgttcccccaacgcccgggtctgggtggactga

SEQ ID NO: 1573 - DNA, 2022 bp, Pseudomonas aeruginosa
ccgacatggtcttctgagttttcctcggacaagcaagaagggcggccagttgccgcccttttcgttatccgcctcacggggagagtccgacccggggctgtggcgtggcgcgaacaaccgcttcgcgattatcgaacccgaacgggggagctgtggcgtagggcgaataaccgcttggcggttatccgccgattggccgaggtccagccctcctgccgtcagcgccgcagcagcggttgcagggcctggctcagggcccgcggcgcgggggcccaccaggatatggcagatgccgccggcgagggagctgacgccctgtccgccgagacgacgcagttgctcggtggccagcttgcgttcgtccgccacgctgacccgcaggcgggtcagtgcgacgtcccgtacctcgcgcaggttgccggcgccgccgagggcgccgagccaggcctgggcttcggcggcgtcgacggtggcctgcatcgacaccacctcttcggctgcgttcggactgcccagcggcggtacggcttcgcccggttgcgtatcgaagggcagggcgcggcggatctcgtcggcgatgctgtcggcctgtgggccgaccaccacctgcaggctgccggccttgcccggacgtaccacggccatcgcaccgagggccttgagctgggcgtccgaggccttgtcgcggtcgaccaggcgcagacgcaggcgcgtggtgcaggcgtccaccacttcgaggttggctgcgccacccagggcgcggatgaatgccggggcgcgctcggcttcggcgttgtcgcccgattcgctgctcgcgtcgtcttcgcggcccggggtcttcaggttgaagcggcggatgcagaagtcgaacaccaggtaatagatgccggcatagagcaggcccagcggccagagcatccagccgtgggtggaacggccccagcccagggcgaggtcgatggcgccaccggagaaggtgaagccgaggcggatatcgagcaggtcggtgagggccatggacaggccggtgagcagcgcatgcagcaggtagagcagcggcgcgaggaacatgaaggcgaactccaccggctcggtgacgccggtgaggaaggcggtcaaggccatcgacaggagcagcccgccgatcagcttgcgccgctccggacgggcgttgcggtacatcgccaggcaggcggcgggcaggccgaacatcatcaccgggaacatcccggccatgaactggccgcccttcgggtcgccggcgaaatagcgcgccaggtcgccggtgacgacgcgcccggtttccgggtcggtgaagctaccgaagacgaaccacaccaggttgttgaggatgtggtgcaacccggtgacgatcagcaggcggttcagcacgccgaaggcgaaggcgccgaagctgccgctttccagcatgagttggccgaggccgttgatgccctgttgcagcggtggccagatcaccccgaacagcaggcccaggcagaccgcgctgatcccggtggcgatcggcacgaagcggcggccgccgaagaacgccaggtattccggcagcttcacgtccttgaagcggttatacagggcgccagccaccaggccgctgatgatgccggagagcacgcccatgtcgatgcccggatcgatcaccttgagcaccgagatcatcaccaggtagccgatggcgccggcgaggccggcggtgccattgttgtcgcgagcgaaaccgacggcgatgccgatggcgaagatcagcgccaggttggcgaagatcgccttgccggcgtcgtggaccagcggaatgtcgagcaggtcgacgtcgcccaggcgcagcagcaggccggcgatcggcacgatcgcgatcggcagcatcagggcgcggcccaggcgttgcaggctttcgatcaggaacgggggcatggcggtggtctccgattgttcttgtcaggccagcggccagtgttgcaggcaggcgtcgcgcaccgcccgggcgctgcccaggtccagtag

SEQ ID NO: 1574 - DNA, 654 bp, Pseudomonas aeruginosa
cgcctgggcgtggcggcggcattcagcggcgtcgagctggcgcacccgggtcttgatctcgccgaccaggttcggcccgacggacaattcctcgaccccgaggccgaccagtaccggtgtcgccagcgggtccgaggccagcgcaccgcagacgccgacccatcggccgtggcgggctgctccggcgcaggtctgggcgatcagtcgcagcagcgccgggtgcagggcgtcgatgcggtcggccaggccggcgtggcaacggtccatggccagggcgtactgcgacaggtcgttggtgccgatggagaggaagtcggcgtgttcggccagttgatcggcgagcagggcggcggagggcacctcgatcatcaccccgagttcgggcaggcgctcgatccccaactgcgtggccagctcgccgaggcggccacggatggcgcgcagttcatcgacctcgctgaccatcggcagcagtatccggcagcgttccagtggttcgaccctcagcagcgcgcgcaactgctggtcgagcagctccgggcgcgcctggcccggggcggatgccgcgcaggccccagtgctgggtttttcttccaccggcagcggccaggtattgggggtgcttgtcgccgccgacatcgatggtgcggatga

SEQ ID NO: 1575 - DNA, 567 bp, Pseudomonas aeruginosa
gttgaccgacggggcgcagaccccggccatgaggagatcgcgatgaaataccgcctgggcgatgcccgcgtcgaaacccatcccgacagctggatcgcgcccagcgcagcggtgatcggcaaggttcgcctggatgccggcgccagcgtctggtttggcgcggtgctgcgcggcgacaacgagctgatccatatcggcgagcacagcaacgtccaggacggctcggtgatgcacaccgacatgggctatccgctgaccctcggcaagggcgtcaccgtcggccacaacgccatgctgcatggttgcagcgtgggcgactacagcctggtggggatcaacgcggtgatcctcaatggggcgaagatcggcaagtactgcatcatcggcgccaacgcgctgattcccgagggcaaggagattcccgacggctcgctggtgatgggctcgccgggcaaggtagtgcgcgagctgagcgagccgcagaagaagatgctcgaggccagcgccgcccactatgtgcacaatgcccgccgttacgcccgcgacctcgtcgaggacccggcgtga

SEQ ID NO: 1576 - DNA, 1299 bp, Pseudomonas aeruginosa
gcaacgacgagcgccgcgaggtgctcggtcgctgtttcgagcgcgccaaggcgcaagggctggtcagcggttccgcctgaagcggattccgttttctttcatttccgaggttcttccatgacccgtatcggtacccccctgtcgccgagcgcgacccgcgtccttctctgtggctccggcgagctgggcaaggaagtcgccatcgagctgcaacgcctgggttgcgaagtgatcgccgtcgatcgctatggcaacgcgccggccatgcaggtggcacatcgcagccacgtgatcagcatgctcgacggcgccgccctgcgcgcggtgatcgagcaggagaagccgcactacatcgtgccggagatcgaggccatcgccaccgcgaccctggtcgagctggaggccgaaggctacaccgtggtgcccaccgcccgcgccgcgcaactgaccatgaaccgcgagggtatccgccggctggctgccgaggagctcggcttgccgacctcgccctatcacttcgccgataccttcgaggactaccgccgtggcgtcgagtgcgtcggctacccctgcgtggtgaagccgatcatgagttcgtcgggcaagggccagagcgtcctgaaaggccccgacgacctgcaggcggcctgggactatgcccaggaaggcgggcgcgccggcaagggccgggtgatcgtcgagggcttcatcgatttcgactacgaaatcaccctgctcaccgtgcgccacgtcgacggcaccactttctgcgcgccaatcggtcaccgccaggtcaagggcgactaccacgagtcctggcagccgcaggcgatgagcgcgcaggccctggccgagtccgagcgggtcgcccgggcagtgaccgaggccctcggcggacgcgggctgttcggcgtcgaactgttcgtcaagggcgaccaggtgtggttcagcgaggtgtcgccgcgtccgcacgataccggcctggtgaccctgatttcccaggatctttccgagttcgcgctgcacgcgcgggcgatcctcggcctgccgatcccggtgatccgccagctcggcccgtcggcctcggcggtgatcctggtggaaggcaagtcccggcaggtcgctttcgccaacctcggcgccgcgctgagcgaggcggatacggcgctacgcctgttcggcaagccggaagtggatggccagcggcggatgggcgtggccctggcgcgcgacgagtcgatcgacgccgcccgcgccaaggcgacccgggccgcccaggcggttcgcgtcgaactctga

SEQ ID NO: 1577 - DNA, 477 bp, Pseudomonas aeruginosa
cttgcgcccgatgcggtcgccgaaatggccgaacagcgccgagcccagcggacgggcgaggaatgcgatgccaaaggtgaggaaggcgctgatcatctgcgcggtgccggatgtctgcgggatgaataccggaccgatcaccagggcggcggcagtggcatagacgtacaaatcgtagaactcgatggcggtgccgatgaagctggcgactgcgacccgggtggtcgagttggccggttccggagcggagtccgcggcgacggtggcggcggtcatggtgggaaggtccctggcaatcggggcacgacggagtgcttccgtgcggccggatggttatggccagtgcgccgatgcggcggcgcggcgcccgggtggggcggacgagatcggtcgcgcagggaggatggggatgcgcgccgtgcgccggctggtaccgtcggcatcggggccgggcgggcaggcgggactggcgggtga

SEQ ID NO: 1578 - DNA, 663 bp, Pseudomonas aeruginosa
ttgccagccaagcgacttgttcagctcgcgcaggttggcgctgccgtcgatgacgaagctgccgtcctcctgggcatggatatccgggttgtcgaggctgtcgaggtcgttgaagtcgccgacgatctcttcgaggatgtcctccagcgtgacgatgccgatcacctcgccatattcgtcgaccaccacgccgatacggcgcttctccttctggaagttcaccaactgggtcgacagcggcgtgctttccggcacgaaatacggctccatgcaggcctggcggagattctccttggtcaggcggccctgggtcagcaggcgcgcgatctggcgcatgtgcacgaccccttcgatctggttgacgtcgtcgcggtagaccggcaggcgggtgtggctggtggtgcgcaactgctcgacgatgacctcgagttcgtcgtcgaggtcgatgccttcgatttcgttgcgcgggatcatcaggtcgttgaccgtgaccttctccaggtccagcaggccgagcagcatgtcatgccggttgacctcgctggcctgggggttgtcggccggatgcagggcctcttcgtcgcggctgcgtccgctgtcgtcctgttccgccgcagcgacgccgagcaggcgcagcagcgcgttgctcagcagggtcagtag

SEQ ID NO: 1579 - DNA, 960 bp, Pseudomonas aeruginosa
ccacagcaggggccagcagaggcgctgcaggatcaggagcggcaggctgagcggcagggcgacgcgttccgagcgaagggcgccgtagcggcgcggcagcagggcgccgaacagcagcaggagcagggtcatgccggggatggcgacggccaggccgatgacgccccagtggcgcagcgcggcccaactggccagggcggcggcgctgacgttgaccagggtgcggccgaacaacagggtgccgcgcaggcggtcgtcgtgcagcagcagccaactgctgcgccgggccccgcgcaggccttgcttggcctgcaggcgcaggcggtaacggtcgaggttgagcagggcggtctcgacgcaggagaagaacgccgagcaggcgaccaggagaaccagcaggccgaccaggtacccggggtgcagctcatccatgaaggaggcccatcagatgtgcaggatgaattcccgcaccagcttgctgccgaagtacgccaacatcaacaggcagaaaccggccagggtccagcggatcgccttgtggccccgccagccgagctggtggcgaccccagaggagcacggcgaagaccacccaggcgaagcaggacaggatggtcttgtgcgccaggtgctgggcgaacaggttgtcgacgaacagccatccggacagcagcgacagcgaaagcagcgaccagccgccccagaggaagccgaacagcaggctttccatggtttgcaggggcgggaagttgcggatcagcccggacggatgcttgtgcttgaggcggtagtcctggagcagcagcaagagcgcctggaacaccgcgatggtgagcaggccgtaggccaggatcgagagcaggatgtgggccaggatgcccggctgttcgttgatcggctcgacggtgccgtgggggatgagtaccgccagcagggtggtgagggcgcccagcgggaatag

SEQ ID NO: 1580 - DNA, 1485 bp, Pseudomonas aeruginosa
ggctggcctccggtcgtcgccggacacacactccgtctttcatcgcgtgtcccgcgacgcgctcttggttataatccgccgcttgccgcaacccccgtggaaggatcgcgcatgttcgaaaaccttacagaccgcctctcgcagacgcttcgccatgtcaccggcaaggccaagctgaccgaggacaacatcaaggacactctgcgcgaagtgcgcatggccctgctcgaggccgacgtggccctgccggtggtcaaggacttcgtcaacaaggtcaaggagcgcgccgtcggtaccgaggtctcgaagagcctgaccccgggacaggcgttcgtgaagatcgtccgcgccgagctcgaggagctgatgggggcggccaacgaggacctggcgctgagcgtcgcgccgccggcggtgatcctgatggccggcctgcagggcgcgggcaagaccaccaccgcgggcaagctggcgcgcttccttaaggaacgcaagaagaagtcggtgatggtggtttccgccgacgtctaccgacccgccgctatcaagcagctggaaaccctggcgggcgaggtcggcgtaaccttcttcccttccgacgtcagccagaagccggtggccatcgccgaggcggcgatccgcgaggcgaggctgaagttcatcgacgtggtgatcgtcgataccgcaggccgcctgcacatcgatgccgacatgatggacgagatcaagcaggtgcacgcggcgatcaagccggcggaaaccctgttcgtggtcgatgccatgaccggccaggatgccgccaacaccgccaaggccttcaatgacgccttgccgctgaccggtgtggtcctgaccaaggtcgacggcgacgcgcgtggtggtgccgcgctctcggtgcgggcgatcaccggcaagccgatcaagttcctcggcatgggcgaaaagagcgaagcgctcgatccgttccatcccgaccgcgtggcctcgcgcatcctcggcatgggcgacgtgctcagcctgatcgaacaggccgagcagaacctcgaccgcgacaaggccgagaagctggcgaagaagatcaagaagggcaagggcttcgacctggaagacttccgcgaccagttgcaacagatgaagaacatgggcggcctcggcgggctcatggacaagctgccgatgctcggcggggtcaacctggcgcagatgggtaatgcccagggtgctgcggagaaacagttcaagcagatggaggcgatcatcaactcgatgacgcccggcgaacggcgcgatccggaaatgatcagcggctcgcgcaagcgccgcatcgcccttggctccggtacccaggtgcaggacgtcggccggctgatcaagcagcacaagcagatgcagaagatgatgaagaaggtcaccgccaagggcggcatggccaagatgatgcgaggcatgggcagtatgttcccggggggcatgcccaagctttga

SEQ ID NO: 1581 - DNA, 255 bp, Pseudomonas aeruginosa
aggtgtattcctttaccgacccgttggacaacctgctggactatcgccgctggacgctccggcgcgacggcgagattcggcaggccgagctggtcagggggcgcctgcatggcaaggtcctggccgccaagctcaaggggctcgacgatcgcgaagaggcccgcaccttcaccggttacgagatctgcatcccgcgtagcgagttgccctctctcgaggaaggtgagtactactggcaccagctggaaggcctga

SEQ ID NO: 1582 - DNA, 951 bp, Pseudomonas aeruginosa
cgcccaggctatgaaagactagccgcgctttcatttggttcgcagccttcatccatgagtaccctcgaacatcccctgatcgaccgtttcctcgatgccctgtggctggaaaaaggccttgccgacaactcccgcgaggcttatcgcaacgacctccagcagttcaacgcctggctcgatggccgccggctgcgcctgggagggatctgccgctacgccatcctcgattacctggcctggcgcctggaacagggctacaaggcccgctcgaccgcgcgcttcctctccggcctgcgtggcttctatccctattgcctgcgcgacggcctgatcgccgaggatcccaccttgcaggtggacctgccgcaaatgggcaagccgttgccgaaatccctctccgaagcggacgtcgaggcattgctggcggcgccggaagtcgacgacccgctgggcctgcgcgatcgcaccatgctcgaagtgctgtatgcctgcggcctgcgggtcagcgaactggtcggcctgaccctggagcaggtcaacctgcgccagggcgtggtcaaggtgttcggcaagggcagcaaggagcgcctggtgccgctcggcgaggaagccatcggctggctcgaacgctacctgcgcgaggcccgcggcgacctgctcggcgggcggcccagcgacgtgctgttccccagcctgcgcggcgaacagatgacccgccagaccttctggcatcgcatcaagcatcacgcgcaggtggcggcgatcggcacgtcgatttcgccgcacaccctgcgccacgccttcgccacccacctgctcaaccatggcgccgacctgcgggtggtgcagatgctgctcggccacagcgacctgtcgaccacccagatctatacccatatcgcccgggcccgcctccaggatctgcacgcacgccaccacccgcgaggctga

SEQ ID NO: 1583 - DNA, 732 bp, Pseudomonas aeruginosa
  unsure (639): Identity of nucleotide at the above locations are unknown.
cacatgcgcgtgacccgttttctggctgctgccgccctcggcctgatgagtaccctggccctggcagacaatgccgatcagaacatccgcaagaccctgcaggccctgcaaccggacctgcctatcgactccatcgccagcagcccgctgcaggggctctaccaggtgcagctgaagggcggccgggtgctctacgccagcgccgacggccagttcgtcatgcagggctacctctaccaggtgaaggacggcaagccggtcaacctgaccgagaaggccgagagccaggcgatcgccaaggcgatcaacggcgtgcccgccagcgagatggtggtgtatccggccaagggccaggccaaggcgcacatcacggtgttcaccgataccacctgcccgtactgccagaagctgcatgccgaggtgccggacctgaccgagcaggggatcgaggtgcgctacatggcgttcccgcgccaggggccgcagtcggcgggcgacaagcaactgcaggcggtctggtgtgcgaaggaaccgaccaaggcgatggacgccatgatgaacggcaaggagatcaagtcttccgagtgcaagaacccggtcgacaagcagttccagatgggccaaatggtcggggtgcanggaacgccggcgatcgtccttgccaatggccagttgctccccggctaccagccggccaagcagttggccaagctggcgctggaggccaaatag

SEQ ID NO: 1584 - DNA, 1473 bp, Pseudomonas aeruginosa
tgtgcggctcttttgttttcatcattggcgatttccgccgcccgctggcggaatccatcgccaggatgtgtcgtggcccgtacagtggtcgcgtcaacctcgattcgatcggggaaccatagcaggccggcgcgtccggccgtcgtaggtgagatggggagttccagcgtgaaaccggtcaaagtaggcatctgtgggttggggaccgtcggtggcggtaccttcaatgtactcaaacgcaacgccgaggagattgcccgccgtgccgggcgcggtatcgaggttgcgcagatcgccgcccgccggccgaacccgaagtgcgataccggtgcgacccccatcaccgccgatatcttcgacgtagcgtgcaatcccgagatcgacgtggtcgtcgagttgatcggcggctacaccctggcccacgagctggtgctcaaggccatcgagaacggcaagcacgtggtcaccgcgaacaaggcgctgatcgccgtgcacggcaacgagatcttcgccaaggcccgcgagaagggcgtgatcgtcgccttcgaggccgctgtcgccggcggcatcccggtgatcaaggcgatccgcgaggggctgtcggccaaccgcatcaactggctggccgggatcatcaacggtaccggcaacttcatcctcagcgaaatgcgcgagaagggccgtaccttccccgacgtgctcgccgaggcccaggccctgggctatgccgaggccgacccgaccttcgacgtggaaggcatcgacgccgcccacaagctgaccatcctcgcctcgatcgccttcggcattccgctgcagttcgacaaggcctacaccgaaggcatctcgaagctgaccagcgctgacgtcaactacgccgacgccctcggctatcgcatcaagcacctgggcgtggcgcgtcgcaccgagagcggcttcgagctgcgcgtgcacccgaccctgattccctcggatcgcctgatcgccaacgtcaacggcgtgatgaacgcggtgatggtcaacggcgacgccgtcggctcgaccctctactacggcgccggtgccggcatggaaccgaccgcttcctcggtggtggccgacctcgtcgacgtggtccgcgccatgacctccgatccggagaaccgcgtaccgcacctggcgttccagccggacgcgctgtccgaccacccgatcctgccgatcgaagcctgcgaaagcgcctactacctgcgcatccaggccaaggaccacccgggcgtactggcccaggtggccaccatcctgtccgagcgcggcatcaacatcgaatcgatcatgcagaaggaggccgaggaacaggacggcctggtgccgatgatcctggttacccaccgggtcatcgaacaacgcatcaacgatgccatcgccgccctggaagcgctggaaggcgtgtccgggccggtggtccgcatccgtgtcgaacaactgaattga

SEQ ID NO: 1585 - DNA, 630 bp, Pseudomonas aeruginosa
tgtgagtccatgcaacggaaatcatcagcccattatcagcgtgtctttcgccagcgcctgcgcgagcagggcctggtgaagaaggaagtctggatcttgccggagaacgccgcggcgctcgccggcatcgagcggatgctgcgtcgcccggctgccggagcggctcatttggagaaggaggaagacatgacggaagcccgggtatggaacgctcgctcgctggccgaggccctgagcggcaccgagctgttcagcagcggcgaggcccagatcgagctgatcgagggggcggaagcgagtctctatgtgatcatgcgcgaatacggcgacctgccggtgttcgtcgcgccccagggcgagcagatcatcgtcgaggcgctgctctggccggaaagcgacgttaccgacgcgaccgccttcaacgaagaggtcctgctcagccggcaactgttcccgctgtcgagcatcggcctgctcaacctgccgggcgaggagcgctgctacagcatgttcggcgcgttgagcacgacttcgtcgctggccagcgtgctgcacgaaatcgaaaccctggccggcaacgtgatccgcgccacggaagtctacgccggctacctgaaagcccgggcctga

SEQ ID NO: 1586 - DNA, 717 bp, Pseudomonas aeruginosa
aggaaaagggcaaggcctgataggcccgcggcccggcgaaggcgtccgggcccgtttttcagggatagagcgacaatggaaggtttcctgcagacggcgctgtcgttcccgaccgtgctgttcagctttcttctgatcctagcgatcatctactggggcatcgtcgccctgggcatggtcgagatcgatgtgctcgatctcgacgccgagtcggtcgtcgatggcgccggccaggccgaaggcctcgccgcgctgctggcgaagctgaaactcaacggcgtaccggtcaccctggtgctgaccctgctgtccttcttcgcctggttcctctgctacttcgtccagctgtggctgctcagcgcattgccgctcggctggctgcgctacccgttgggcgccgtggtggcggtgggcgcgctgttcctggcggcgccgctggcggccacgctgtgccggccgttgcggccgctgttccgcaagctggaaagcaccagcagcaagtcggtgctgggccaggtcgcggtggtgcgcagcgggcgggtcaccctgcaacatggcgaggcgttgctggaagacggcggcgccgggctgatcctgaaagttcgtgcggaagagaacaaaggcttcaagcgcggcgatcgcgtcgtgctgctggagtacctggaggcggagcacgcctatcgggtcgttaccgaggaagagttccgcggtatctga

SEQ ID NO: 1587 - DNA, 669 bp, Pseudomonas aeruginosa
tcgccgaagccaggggcgacgaggagcgcggcctggccgacgcccgggtgctcgaggcgcaggccgcggccaaggagaaggacggcctggcccgaagcccaaggtgctggccgagaagctcggcgcccaggcgcgcggcgaggagcagctcggcgcggccaaggccaaggccaccaaggaccagggcagcgcggaagcggaagtactgctgcagcgcctgaatgccgaggccgaggggcttggcaagaagttcggcgccctggatgccctcagcgacagcgctcgccagcacgaagagttccgcatgcagctggagaagagcttcgaggaggccatggcggccatcgccgcgaacaaggacatcgccaaggagcaggccgaggtgctcgccaccgcgctgggcaaggcgaacatcgagatcgtcggcggcgagggcgacttcttcaactccttcgccaagtcgctgtcggtgggcaaggccatcgaaggtgtggtcggcaagagcccggtggtgcaggacgtcctcgcccgcctgctcaacggccgtggcgcagccgctgcggtgatgccggaacgcaagagcggccacgagaacgagccggcggcggaagtctgagtcgacccgcagcctcctccgccaactgcggaggcgttccgcccgcgccctga

SEQ ID NO: 1588 - DNA, 5337 bp, Pseudomonas aeruginosa
gcggcgcagcccctggcgtggcctgttggctgcgcccggggcaggccgctcgggccggtttccatcgatgaccgccgtagacccaggaagaccaggatgtcggacactcaagccgcaactcccgcgcaggacgtattggacaaggccgttgccgagggcggcgcctacgaggtgctgcacaagcgcctgctggagcagggccagcgcctgcggcagaccgccgaaaggctcaacgccagtcgcctggaggagttcggcgacagccagatggatgtgatcggccgggtccgcatccgtaccgagaacaactgcatcgcccgcgatatcgtccaggtcggcgattgcctgctgttcggctacaacgtgttcatcggcctgcgcaaggaaaccggcgtggccgacgtattctccctctaccgcctggtggagggcagcgaaggctacgaggcggagcctgtgccactgggggacagctttctcgccgcgccgggcttcgtcaacgacttcaacgagctttacacctactacaagaacacccgcctgctgcaactggcgatccgcgacggcaagctgctggccagcttccagatcggcgagcggatcaccgacatccgcgtgttccgctggtcgatctccagcgacggcagcgaagtccgctacatcgacaaccgcggcgagcgcgacatcgccttgccggcaccgttcgacttcgaatggcagcgggctacccgcgagatggtggtggagggccgcttcccgcacctgaacatcctcgacaccctgttcgtcgagaccattggcggcgacctgaccatcaaggtcgagaacaacaccgaggtcggcctgggcatctatcgcgaagaggtgatggacaagacccagtcgctggacgacgcgcaggttgagttcgcccgcctcggcagcctgctgctgctcaaggtcctgccctatcgcgaggagcagtggcgctacctggtgttcaacagcctgaccggcaaggtcgagcgcatcgacgccatcggcctggcctgcatccagttgccggaggaccacgggatcatcttccccggcggctactacctgcagaacggcgagtaccgcaccttcgagcaatccatggaaggcatgcgcttcaagcgctcggtacgctcgcccaacggcgaggacgtgcagtacgttttctaccatcccgagcaggggcggaacgtgctgctcacctacaacctgatcaaccgccagttgcagaatccgctgttcggccacggctacgcgcgcctggaggacgggcgcatggtgatcttcgccgccgaaggcgaggaaccgacccgcatccatccgatgcaggtctggcagacgccgttctgcaccgaggagtacgcggcccgccaaccggcgcgtagcggttttctcgggcggatcggcaatgccgagctggtgcgcggcgtctccgacctctacgacctgtgccgggagatcgagaccccggcggtttcgatccagcgctactcgctgctgtgccagaacacccagcgcctgttcgacgtctaccactggctcggcagcgaccaactggacggcttggcgccgctgttgcgcgaagtggcggcgaccgccgagctggtgctcgacgagtacgagaaggtcgaaagtatccgccgccagtcggcccaggcgatgatcgacgcggaggagcggcacaaggcgctgctctccggcttgctgcccgacggctgggaccgggtgcagcagttcgtcgacgggctcaatggcatcaccgcccagcgtgggttgctgctgaccatccgcgagtaccgctacatcgacgtggcgcgactcgacgccatggaggccgaactgctcgcggcccacgagcgggtggccgccgccaccgcgaccttcctcgccagcgaacaggccctgcagcccttgctggagcgcctgcagagcctcgatggcgaggcgcagaaagccgagaccgtggcccagctcggcgagccgctggcggccttggaggcgatggccggcgacctcgacatgctgtcctcgctgatggcttcgctgcgcatcgacgacgcgacccagcggacccgcatcatcgagtcgatctcggagatctacgcccgcctgaaccaggccaaggcgcgcgccgagcagcggcgcaagggactcggttcgagcgagaccgtggcccagttcggcgcccagttcaaactgtttggccagggcatcaccaacgccctggcccaggcccaggaccccgagcgctgcgacgagcaactgtcgcgcctgctggtgcaactggaggaactggaaagccagttcggcgaccatgagcagttcctcggcgacatcctggccaagcgcgaggagctgctggaaaccttcgaagcgcacaagcagaccctgctcgacgagcgccagcgcaaggcccagggactgctcgacgccgcccggcgaatcctcgacagcctgcaacgacgcaccgcgcgcttcacccaggcggaggaactgaacgcgttcttcgccgccgacccgctgatcctcaagttgcgcgaactggccgaacgtcttcgcgaattgaaggacagcgtcaaggccgacgacgtcgaggcgcgcctgaaggccgcgcgcgaccaggcggtccgcgcattgcgcgacaagagcgagctgttcgaggagggcggcgacgtcatccgcctgggcccgcgccaccgcttcagcgtcaacacccaggaactcgacctgaccctgatgccgcgcggcgacgcgctgtacctgcacctgaccggcaccgatttcctcgaaccgctgcaggacccgcggctcaatgagttgcgcgagttctggcaggtgaacctggaatccgaatcggagacgctgtaccgcgccgaatatctcgccggcgaagtgctcgccgccgccgacgcgggccgcgatggcttcagcctggagcgcttgcaggcgctgctggcgcagccggacgagctggcgcgggcgatccgcgatttcgccgcaccgcgctacaaggagggctacgagaaaggcattcacgaccacgatgcggcggcgatcctggttcgcctgctgccgttgcgcgagagcgccggactgctacgctacgcaccctcggcgcgggccttcgccagcctgttctggagccgccggcgcgaggagcgggaagtcgccggctggcccgagcgggcacgcagcagccgcagcatccagcagatgttcggtcgtgacgacggcctgctcgcccttcgcggcgaagtggccgcggcgatgcgtgcgctgctcgccgaacagcccatcgcgctggacccgcagcatatcgacgaggcggccgagtacctggtctgggaattgtccgccgagcgtcccgaattcaccttcagcaaatatgcccggcaattgcaggaaggactcaagctgcgcctgcaaggcgcgcgtctatgggacgactaccggcagaccctggagcgtctcggcgagcggcccgccgcccagtgggaactggccggcaactggctgcgcggactatgtggcgacgccgagttccagccgctggcggcctacctggacgaggcggtggcgctctcgttgctggacgaggagatgccacgacggatcaccgaggtcgacctgcgcttccaggtcgacggcctgatgggcgagcatccgcgcatcttcgaacgcggcctggcgctggcggtggacgacttcttcggccgcctgcgtcgccatcgccagcaattcctgccggggctgcggcgctaccaggcgctgcgccaggagatcgtcgaacgcgagcgcgaggcattgcgcctggccgagttcaagccgcgaccgctgtcctcgttcgttcgcaacaagctgatcaatgacgtctacctgggtgtcatcggcgacaacctggccaagcagatggggacggtgggcgagaacaagcgcaccgacctgatgggcctgctgatgctgatctccccgccaggctacggcaagaccaccctgatggagtacgtggcgcatcgcctggggctgatcttcatgaagatcaacggtcctgccctcggccacgaggtgcgctcgctcgaccccgggcaggcgccggacgcgacttcgcggcaggaactggagaagctcaacctggcgctggagatgggcaacaacgtgatgctctatgtcgacgacatccagcacacccatccggagttcctgcagaagttcatctccctctgcgacggcacgcgccgggtggaaggggtgtggaagggccggaccaagacctacgacatgcgtgggcggaagttctgcgtggtgatggcgggcaacccctacaccgagtccggcgaggtcttccgcattcccgacatgctcgccaaccgcgccgacatctacaacctcggcgacaccctcagcggcatgcaggaggcgttctccctcagctacatcgagaacgccctgacctccaacccggttctcgcgccgctggccacccgcgacatggccgacgtctatcgcttcgtcgccaaggccgagggcaagccgttctccagcaacgagctggcccacggctacagcggtgccgagatcaacgagatcagcagcaccctgcaacgcctcatgcaggtgcgcgacgtggtgctcaaggtcaaccagcagtacatcgccagcgccgcccaggccgaccagtaccgcagcgagccgccgttcaagctgcagggcagctaccgcaacatgaacaagatggcggagaagatctccgcggtgatgaacgatgccgagctgctgcaactgatcgccgaccactaccagggcgagtcgcaactgctgaccaccggagccgaggagaacctgctgaagctcgccgaactgcgcggcaaccagagccccgagcaggccgagcgctgggcgcagatcaagcgtgacttcctgcgcaacaagtccatgggcggcagcgacgccgacgtcggcggacggctggttgcgcagctcaacgaccttgtggaaagcgtccgtggcctggctcgcgaaccccagccggtacaaccggcgccctgggacgagttgctggctggattgcgccagctcggccagggcgcgccggcgctgaacgtcgaggtgacggcgcctgcgcagccgggcgtgcagcaggtgctggagagccttgccgcctgcctgcaggacagtttcctgccgctgatcaaggtgatggaccgcaagatcgacgtcgacctgcgcacgcacaaccgcatcaacgagatatccagccgcctcgacgaactgggccggttgctgggcggcgagcagaggccgctggagaacgatcaaccctga

SEQ ID NO: 1589 - DNA, 711 bp, Pseudomonas aeruginosa
ggacacgaggagcgggaaatggacttcgacggattggaccgccaactgcgcgacagcctggccgacctgaagctgagcaacgaggaacgggacgaactacgccaactgggcagcgagctggcgcccgaccaggtgcgtttcctgcgcaaccgtgccttcgacctggtgcgtgagctggtcctcgtggaggagcagggcgaacggatagccgccctgaagtggctggagctggtggtgcgcaccctggaggttaccgcggcggcgccgcgcagccgcgccagcgcctatttcagtcccggcgaggagtgtcggcggaagatccgcgagctgtgccggcaggccaggcagagcctggacatctgcgtgttcaccatctccgacgaccagctcagtgcggaaatcctggcctgccatcggcgcggtgttccggtgcggatcatcagcgacgatgacaagcagttcgacgaaggcagcgacatccatgcgctgcgcgaggccggcgtgccgctgcgaatcgacgacagtcccttccacatgcaccacaagttcgccctggtggatggcgcctggctgctcaacggcagtttcaactggacccgcagcgccagcgtcaacaacgaagagaacctgctggtaaccgacgacgccgtgctgatcggcgcctatcggcgtgaattcgaggaactctggggccgctacgccccgcgctga

SEQ ID NO: 1590 - DNA, 1545 bp, Pseudomonas aeruginosa
gcgtcggccgagtacttcggcctgaaaaaaccaggagaactgaacaagatgaagaaggtttctacgcttgacctgttgttcgttgcgatcatgggtgtttcgccggccgcttttgccgccgacctgatcgacgtgtccaaactccccagcaaggctgcccagggcgcgcccggcccagtcaccttgcaagccgcggtcggcgctggcggtgccgacgaactgaaagcgatccgcagcacgaccctgcccaacggcaagcaggtcacccgctacgagcaattccacaacggcgtacgggtggtcggcgaagccatcaccgaagtcaagggtcccggcaagagcgtggcggcgcagcgcagcggccatttcgtcgccaacatcgctgccgacctgccgggcagcaccaccgcggcggtatccgccgagcaggtgctggcccaggccaagagcctgaaggcccagggccgcaagaccgagaatgacaaagtggaactggtgatccgcctgggcgagaacaacatcgcccaactggtctacaacgtctcctacctgattcccggcgagggactgtcgcggccgcatttcgtcatcgacgccaagaccggcgaagtgctcgatcagtgggaaggcctggcccacgccgaggcgggcggccccggcggcaaccagaagatcggcaagtacacctacggtagcgactacggtccgctgatcgtcaacgaccgctgcgagatggacgacggcaacgtcatcaccgtcgacatgaacggcagcaccgacgacagcaagaccacgccgttccgcttcgcctgcccgaccaacacctacaagcaggtcaacggcgcctattcgccgctgaacgacgcgcatttcttcggcggcgtggtgttcaaactgtaccgggactggttcggcaccagcccgctgacccacaagctgtacatgaaggtgcactacgggcgcagcgtggagaacgcctactgggacggcacggcgatgctcttcggcgacggcgccaccatgttctatccgctggtgtcgctggacgtggcggcccacgaggtcagccacggctttaccgagcagaactccgggctgatctaccgcgggcaatcaggcggaatgaacgaagcgttctccgacatggccggcgaggcagccgagttctacatgcgcggcaagaacgacttcctgatcggctacgacatcaagaagggcagcggtgcgctgcgctacatggaccagcccagccgcgacgggcgatccatcgacaacgcgtcgcagtactacaacggcatcgacgtgcaccactccagcggcgtgtacaaccgtgcgttctacctgttggccaattcgccgggctgggatacccgcaaggccttcgaggtgttcgtcgacgccaaccgctactactggaccgccaccagcaactacaacagcggcgcctgcggggtgattcgctcggcgcagaaccgcaactactcggcggctgacgtcacccgggcgttcagcaccgtcggcgtgacctgcccgagcgcgttgtaa

SEQ ID NO: 1591 - DNA, 1152 bp, Pseudomonas aeruginosa
agttcaggtgtgagctttattccaagaccgaccgggagtcctgccatgagtctgctgttcgagcctcttagcctgcgtcaaatcaccttgcccaaccgcatcgccgtatcgcccatgtgccagtactcggcgcaggagggcctggccaacgactggcatctcgtgcacctgggcagccgcgcggtgggcggcgccggcctggtgatagtcgaagccaccgcggtgttgcccgaggggcgcatcaccgctgacgacctcggcatctggagcgacgcgcatgtcgagccgttgcatcgcatcacccgtttcatcgagtcccagggcgcggtcgccggggtccagctggcccacgccgggcgcaaggcgagtacctggcggccgtggctgggcaagcacggcagcgtgccgatcagcgacggcggctggataccggtggcgccgtcggcgatcccgttcgatccccagcacacgacccccgaggccctgagcgaggcgcagatcgaggcgctggtgcaggccttcgtacgcgccgccgagcgctccctggctgccggcttcaaggtcgcggaggtgcatgcggcccacggctacctgttgcatcagttcctctcgccgctgtcgaaccagcgtcgcgaccagtacggcggctgcttcgagaaccgcatccgcctgcttctgcaggtcaccgccgcggtgcgcaaggcctggccgcaagagttgccgctattcgtgcggctgtccgccaccgactgggtggaggatggctggaaccccgacgagaccgtggaactggcccggcgcctgaaggacctgggcgtggacctgatcgacgtgtcttccggcggtaccgcggcgaatgcggaaatcccggtaggaccgggctaccagaccgagttcgccgaacgggtgaagaaggaagccggcatcgccagcggcacggtgggcatgatcaccgagcctgtgcaggccgagcatatcctgcgcaccggtcaggccgacctgatcctgcttgcccgtgaactgctgcgcgatccgtactggccgttgcacgccgccgacgaactgcgcaacgagcagatgccctggccgccgcagtacctgcgagccgctcatcgcagcacgccgccgcgcaaatccctggaaatgcagtga

SEQ ID NO: 1592 - DNA, 1308 bp, Pseudomonas aeruginosa
gctatcagaatccgcgcagagcgtctggcgatcttgccgggcgccactccatgcccggaggcaacgatggatagcccgtccactctcgctcgtccgcacccccaggccagcccgcgatggctggcagttgccaatgtgatcttcgccggcatcgccgctgccctgcatgtcggcaaggcgaccatcgccctgccgtcgctgcaacggagcttcggcggcgacctcgccgcgctgagctggatcatgtccgcctttccgttcgtcggcgtattcggcggcatcgccgccggcctcctggtgcgttgttggggagatcgccggctgctgaccgttgggctggcgattctcggcggggcgagcctgctcggtgcgtcgatgcaggacttcgcctggttgcttgccactcgcttcgtcgaggggctcggtttcctcatcgtggtagtggcggcgcccgccgtgttgcacaggatcaccagcgagacgcggcgcagcgtggtgttcggtctgtggagcaccttcatggcaggcggaatcgccctctcgatgctgttcgggccgctgctcgcggactggcgtgccgactggcaactgagcgcactgctggtactggtcgcggcgctgctgctgccgctcagcgtccctgccgacgatgggtgcagggcggcaggcgtgaggccggccggtcttggcgcgttgctcaaggttccggcgatcaccctgctggcgctcggcttcaccacctacaacctgcagttcttcgccctgatgacgttcctccccgtgttcctcatgcagcgcctgggcgtcgccctggagactgcgggactcatcggcgcggccatcgtcgcggcgaacgccctgggcaatgtcgcggcgggcttcatcctttcccgcggcatacgtcccggcgccttgctggcgagcaccgcgatcctgatgggactcaccggtgcggcgttcttccatgccgcgacgccgggactcctggcgattgcgctggggttcgtcttctcggcggtcgccggcatgcttcccaccaccgtgctggcgaccgcgccgctggcctcgcccgcgccttcgctgacgccactggccatcggctgggtaatgcagggcaactacctggggcaggtgatcggccccttgctgatcggcctgatcgtcagccgtttcgactggtcgggcgcgatcggcctgatgctggtcgcgggcgcggcgggggccgtcctggggttctgcctgctgcgtgcgctggacggcctgcctcgcgccattgccacgggttccgcggctcgccccgcggattag

SEQ ID NO: 1593 - DNA, 579 bp, Pseudomonas aeruginosa
ccacgcgatcctccaggccatcgtcggtgcggccaaggccgacggccacatcgacgagcgcgaacggcagatgatcgaaggcgaggtggccaagctgaccagcgaccgcgaggtgcagggctggctggagcgcgagctgaacaagccgctggacccggccgagatcgcccgtgccgcgagcaccccggagatcgccgcggagatgtacctggccagcctgctgatggtcgacgaggaaagcttcatggagcgctcctacctcgaggagctggcgcggcagctgcgcctggagccctcgttcaagctggagctggagaaccaggccagacaggcgctgcaacgcctggcctgagacggcggagtgtcgttccgcggataaccgccgccatcagggcggcggcgttgccgaagggccgagcagaacctctcgctcgcgctggcacagctccagcaggaagtcccagaccacccgcaggcgcaccgagcggtgcaactcccgccgagtgctcatccagtactcgcgctggatgctttcctcgggcagcaccggtaccagcaacggatcgcggctacccatga

SEQ ID NO: 1594 - DNA, 1521 bp, Pseudomonas aeruginosa
ggcgcgccgcgagatcgtcctgagcgccggcgcgatcggttcgccgtgcctgctgcaacgctccgggatcggcccgcgggacctgctggagcagctcggcgccggggtcgtccacgagttgcccggggtcggtggcaatctccaggatcacctgcagctgcgcatgatctacaaggtcgacggcgttcccaccctcaaccagatcgccggcagcctatggggcaagctgggcatgggtctgcgctacctggcgagccgcagcgggccgttgtcgatggcgccgagccaactgggcgccttcgcccgctccgatccgcagcagccctcggccaacctcgaataccacgtccagccgctctcgctggatcgcttcggcgagccgctgcatgccttccctgcgttcaccgcgtcggtctgcgacctgcgtccgcacagccggggaacggtgcgcatccgctcgctcgacccgggcgaggcgccgtcgatccagcccaactacctgagcgatccgcgcgacctgaaggtcgccgccgacgccatacgcctgacccgccgcatcgccgccgcaccggcgctggccgccttccgtccgcaggaatacaagcccggcccggaataccgcagcgaagaggatctgcagcgcgctgcggcggagatcggcaccaccatcttccaccctgccggcacctgccgcatgggccaggggccgcaagcggtggtggatgcgcaattgagggtgcacggaatccccggcctgcgcatcgccgatgcctcgatcatgcccagcctgacctccggcaacacctgttcgccggtgctggtgatcgccgagaaggcggcgcagatgattctcgccgagcgccgccgcgaggccgcgccgcaggtcgtcgaaagcgccatggcggccggcggcaaggaggcggtggaggcctgaggatcgctacaccccgtatcgcgtggcgcccggcgccgcagcggtcgacgctgaaaacggaaatggcagacaacaataagagcccccacaaggggcgggagagccgcaatgaccgagtacgcaacgaccccttcctacacagtgcctgcgaccacgccccagggggagcgcaaggtgatcttcgcctcctcgctgggcacggtcttcgagtggtacgacttcttcctctacggcgccctggcggcggtgatcagcaagcagttcttcgccggcgtcaacgacaccacggccttcatcttcgccctgatggccttcgccgccggcttcctggtgcggcccttcggcgcgctggtgttcggccgcatgggcgacatgatcgggcgcaagtacaccttcctggtgaccatcctgttgatggggttgtcgaccttcgctgtcggcctgctgcccacctatgcctcgatcggggtcgccgcgccgatcatcctggtcaccttgcgcatgctccagggcctggccctgggcggcgagtacggcggcgcggcgatctatgtcgccgagcacgccccggcgaacaagcgcggtag

SEQ ID NO: 1595 - DNA, 570 bp, Pseudomonas aeruginosa
acctggtggcgaacgggctgcgcaacggcgtatcccgcttcaaagtctgaggctgtgaccgtgtcccgctccaccggcgatcatcgacgcaccagcaagctgttcctgctgttccgcatggaaggcgaccgctatgccctggatgcccgcgaagtggtcgaagtgctgccgctgctgcgcctgaagcgcattccggaggcgccggaatgggtcgccggggtgttctcccatcgcggcgtcctggtcccggtgctcgacctctgcgcaatggccttcggccgcgcggcgctggcccgcaccagcacgcgcatcgtgctggtcgaataccgcgcccgccaggaccgggagccggtctggctcggactgatcctcgaacaggccaccgataccctgcgctgcgaaccgtcggcgttccgcgactatggcctggacaacggcggggcccgctatctcggtccggtctatgaaggaccacggggactggtgcaatgggtgcgggtcgaggcattgctgcccgacgaagtgcgcgccctgctgttcccgccggagtgcggcgaggggacggcatga

SEQ ID NO: 1596 - DNA, 696 bp, Pseudomonas aeruginosa
acaaagatggttgaggcgagcctgaccttgctcgatacccaacaggtggatgactgctggaaccgcatcggcgtgcatggcgacaagtcctgcgaacgcctggccgagcatgtccattgccgcaactgcgaggtttacgctgccgcggcgacctacttgctggaccgcatcgccctgcgccaggaccagctcgacagcgccgaaacgatggacagccagcgcgaacagagcgacctcggcgagacgcgttcgatcctggtgttccgcctgggcgaagagtggttcggcctggccaccggcagcctggtggaagtggcgccgatgaatcctatccattccctgccgcaccagcgctcgcgcgccctgcaaggggtgaccaacgtgcgcggcgcgctggtcgcctgcctttccctcggcgaactgctggatctcgaacccggcgccgcgccggtcagcgagcgccgggtggttccgcgcatgctgatcatttccgccgccggcggtccggtggtggcgccggtggaggaagtcgacggcatccatgcgattccgctggcgcggatactgccgcccaaccacgccgacggccaggcctcgcgccggcacgtggccggcgtgctgcaatggcgcgagcggagcatcaccctgctcgacgaaggccctctcctgcaagccgtagcgcggagcctggcatga

SEQ ID NO: 1597 - DNA, 1521 bp, Pseudomonas aeruginosa
ttggcgaatgccagcagatgctggtgcagcacatcgccgatctcgacgagttcgcctggcagggcggccagcgtgcccatgtgctctacgacgcggcgcctggcctcgcggatgcggccattcgccgacgtccttagcggccaggcgcggatggttcgcgacctgggccgctcgctgggcaagcaggtgcgcctgctggtcgagggcgaaagcacccaggtcgaccgggatgtcctggaaaaactcgaagcgccgctcacccacctgctacgcaatgccgtcgatcacggtatcgaggcgccggaaacccgcctcgccgccggcaagccggccgagggcaggatcaccatccgcgcccgccaccacgccggcatgctggtcctggaactgagcgacgacggcggcggcatcgatctgcagcgcctgcgcgagaccgtgctcaatcgccagttcgccaccgccgagaccgtggcgcaactgagcgaggaggaactcctggcgtttctcttcctgcccggcttcagcatgcgcgagcaggtcaccgaggtgtccggtcgcggcgtcggactggacgccgtgcagcacatggtccgccagttgcgcggcggcgtgcgcatggagcaacgccaggggcagggagcgctgtttcacgtcgaggtgccgctgaccctgtccgtggtgcgcagcctggtggtggagatcggcgaggaggcctacgccttcccgctggcgcacatcgagcgcatgtgcgagctggaagcggaggagatcgtccagctcgaaggtcgccagcacttctggtacgaaggtcgccatgtcggcctggtctcggctgcgcaactgctgcaacggcccgagagcagccgcaccgaaggggccatcccggtagtggtggtgcgcgaccgcgatgcggtctacagcgtctccgtggaacgtttcgtcggggagcgtaccctggtggtgatgcctctcgatccgcgcctgggcaaggtgcgcgacgtttccgccggcgccttgctggatgacggttcgccggtgctgatcctggacgtcgaggacctcctgcattcggtcggcaagctgctcagcagcggccgcctggagcgcatcgatcgcagccggcggcaggccggcggggcgcaacgcaagcgcatcctggtggtcgacgactcgctcacggtgcgtgagctggaacgcaagctcctgctcggccgcggctacgacgtggcagtggcggtggatggcatggacggctggaacgccctgcgctcggagcatttcgacctgctcatcaccgatatcgacatgccgcgcatggacggtatcgaactggtcaccctggtgcgtcgcgacagccgcctgcagtcgctgccggtgatggtggtgtcgtacaaggatcgtgaggaggaccgtcggcgcggtctcgacgccggcgccgactattatctggcgaaggccagtttccacgatgaggccttgctggatgccgtcgtcgtcctgatcggagaagcacagggttga

SEQ ID NO: 1598 - DNA, 1005 bp, Pseudomonas aeruginosa
tcaggccatgatcggagaggctgtgcgtcgctcgctggcgagcgaggcgggcatcgacttccacttctgttccgatccgcagcaggcggtggcggtggccaaccagatcaagccgacggtgatcctccaggacctggtgatgcccggcgtcgacggcctcacgctgctcgctgcctaccgcggcaacccggcgacccgcgacatcccgatcatcgtcctgtcgaccaaggaagagccgacggtgaagagcgcggcgttcgccgccggcgccaacgactacctggtcaagctgccggacgccatcgagctggtggcgcggatccgctaccactcgcgttcgtacatcgccctgcagcaacgcgacgaggcctatcgggcgctgcgcgagagccagcagcagttgctggagaccaacctggtgctgcagcggctgatgaactccgacggcctgaccgggctctccaaccgtcgtcacttcgacgaatacctggagatggagtggcgccgctcgctgcgcgagcagtcgcaactgtcgctgctgatgatcgacgtggactatttcaagagctacaacgacaccttcggccacgtcgccggcgacgaggccctgcgccaggtcgccggggccatccgcgagggctgcagtcgctcctcggacctggcggctcggtacggcggcgaggagttcgccatggtcctcccgggcacctcgccgggcggcgcacggttgctggcggagaaggtccggcgcacggtggagagcctgcagatcagccacgaccagccacgcccgggctcgcacctgaccgtcagcatcggcgtcagcaccctggtgccgggcggcggcgggcaaaccttccgggttctcatcgagatggccgaccaggcgctctaccaggccaagaacaatggccgcaaccaggtgggcctgatggaacagccggtgccgccggccccggcgggctgagcggcgcgcggcggccatgcgtcgccggccggcattaa

SEQ ID NO: 1599 - DNA, 894 bp, Pseudomonas aeruginosa
actccgtgtcctcgccatttcccgccttgcctggccggcgttcgctacgcttttcgcccctgttgcgcaatccgtttccacaggcaagagagcctaaccaggaaccaccaagaccatgagcgaccaacaactcgaccagcacgaactgcaacaggaagaaaacaagctgatcgcccagcgcaaggaaaaacttgccgccgtgcgcgaagcccgggccatcgccttccccaacgacttccgccgcgacgcctacttcgcggacctgcagaaacagtacgccgacaagaccaaggaagagctggaagccgcagcgatcccggtcaaggtggccggtcggatcatgctcaaccgcggttccttcatcgtcctccaggacagcagcgagcgcctgcaggtctacgtcaaccgcaagaccctgccggaagaaaccctggccgagatcaagacctgggacctgggcgacatcatcggcgccgaaggcgtgctggcccgctcgggcaagggcgacctgtacgtcgacatgaccagcgtgcgcctgctgaccaagtcgctgcgtccgctgccggacaagcaccatggcctgaccgacaccgagcagcgctaccgccagcgctacgtcgacctgatggtcaacgaggaaacccgccacaccttccgcgtgcgttcccaggtcatcgcccacatccgccgtttcctcagcgagcgcggtttcctcgaagtggagaccccgatgctgcagaccatccccggcggcgccgcggccaagccgttcgagacccatcacaacgcgctggacatggccatgttcctgcgcatcgccccggagctgtacctcaagcgcctggtggtcggcggtttcgagaaggtcttcgagatcaaccgcaacttccgtaa

SEQ ID NO: 1600 - DNA, 813 bp, Pseudomonas aeruginosa
cgaaggcgtctcgacccggcacaaccccgagttcaccatgctcgagttctaccaggcctacgccgactacgaagacaacatggacctgaccgaggaactgttccgcgaactggcccaggcggtactcggtaccaccgacgtgccctacggcgacaaggtcttccacttcggcgagccgttcgtgcgcctgtcggtgttcgattcgatcctcaagtacaacccggagatcaccgccgccgacctcaacgacgtcgagaaggcgcgggccatcgccaagaaggccggcgccaaggtcctcggccacgaaggcctgggcaagctgcaggtgatgattttcgaggaactggtggagcacaagctggagcagccgcacttcatcacccgctaccccttcgaggtttcgccgctggcccgccgcaacgacgaagacccgagcgtcaccgaccgcttcgagctgttcatcggcggccgcgagatcgccaatgcctattccgagctgaacgacgccgaggaccaggccgagcgcttcatgttgcaggtcaaggagaaggacgccggcgacgacgaggcgatgcactacgacgccgacttcatcaatgccctggaatacggcatgccgccgaccgccggcgaaggcatcggcatcgaccgcctggtgatgctgctgaccaactcgccgtcgatccgcgacgtgatcctgttcccgcacatgcgcccgcaggcctgagcgccgcaacagtccatggaaagccgccttcgggcggttttttcatggccgcgcggtgtcccggccgccgggccaggggccgatag

SEQ ID NO: 1601 - DNA, 774 bp, Pseudomonas aeruginosa
ttccacgcgaaaaagtccgaacaatgccccatcgtccgcgagcggaggaaacaccgtgtcccgagtagctcccagagacagcgccgcgcaggccgccagcgcggtagccgaaagcgttcgttaccagggccgcaaggccagccgccagggcagcgagcagcggcgccaggcgattctcgatgccgccatgcgcctgatcgtccgcgacggcgtacgggccgtgcgccaccgcgcggtggccgccgaggcccaggtgccgttgtcggccaccacctactacttcaaggacatcgacgatctcatcaccgacaccttcgccctcttcgtcgagcgcaacgcagaggcgctgtcggcgttctggagcagcgtggagggcgacctccaggagatggccgcggtgctggccgacgaccccggcgcccgtggctcgctggtggaacggatcgtcgagcttgccgtgcagtatgtccaggtccagctcaccgagcgccgcgagcacctgctggccgagcaggccttccgccaggaggcgttgctcaacccgcgcctgcgcgaactggccgatgcccaccagcggattctctccctcggcgccgtgcatttcttccaagtgctcggttccgggcagcccgagcaggacgccaaggtgttgacgtcgattattctgcagatggaatatcagggcctcgtggacggggtcgagcaactggccgtggacgaaatgcgcgccatactcagacggtacctgaatctggtcatgggcctgtgacctga

SEQ ID NO: 1602 - DNA, 1509 bp, Pseudomonas aeruginosa
cgagctggtgatctacaacctcgacgtcgagcgcatcgtcgaggacctcggcgccggccagctcgacggcgagaccgtcgacagcgatcagggcaagggcgcgctggtgcgcagcccgttggcgaaggtcttcgcctacctgaacgatcccgccaattccgacgtgttcgtcgaggccgcccgcttccagcgggtcacccaatgagattgccgatgagccagcgcaaggcgcagaacgactaccagaagatcatccgctccctgtccgatcgcatcgtcgaggcgcagacgccgattcgcgtgctggatgcgatcaaatgggacgacgggatccgccaggacttcctcaagggccgcggcaagcatgcgccgaaggtcgatcgcggctactacgacagccgcccgctggccttcgacgccagcgccaagaagcaggaattccagaacatcgagcgcgacatcacccgccagttgggccagttcaacccggtcgggcagatcatgcggcggatgtgcaaggaataccgaatggtcattcgcatgctcgaggcgcgcggcaccccggacctcgggctgatctcccaggaactctacggctcggcctcggacgccttccatgccggcgatccgaccctggccgacctcggcctgatgctctccgactacctgaacaacatcgccgaccgcggcgatctcaaggacgaacccaagaccctgaccgccaaggaggtcgtaccgatcctccaggcgcggctgaacaccgtgttcggcgaggaggagggcaccatccgcgtgttcgagtccgacggcatcgtcgccgacgcggcggccggcgccgactacatcaaggtacgcgccgacgccctgttcaacgagcgcgacgtgcgcgcgctggaggtccacgagggcctggtgcacgtcggcaccaccctgaacggcctgagccagccgatctgcaccttcctcgccaagggaccgccgtcctccaccgtgacccaggaaggcctggcgatcctgatggaggtgatcgccttcgcctcctacccgacccgcctgcgcaagctgaccaatcgcacccgggcgatccacatggccgaggagggcgccgatttcctcgacgtgttccacttctaccgcgagcagggctacagcctggaggacagctaccagaacgccagccgggtcttccgcggctcgaccccggatggcctgccgttcaccaaggacctgtcctacctgaagggcttcatcctcatctacaactacatccagctcgccgtgcgcaagggcaagctcgaacagatccccctgctgttctgcggcaagaccaccctggaagacatgcgcaccctgcgccaactggtggacgagggcctggtggcgccgccgaagtacctgccgccgcagttccgcgacctcaacgcgctgtcggcctggatgtgcttctcgaacttcctcaaccacctcagcctggaccgcatcgaagcggactacgcgaacatcctctga

SEQ ID NO: 1603 - DNA, 1239 bp, Pseudomonas aeruginosa
ggaccaacaacggatgaagcgcctgctgatcccgctgctggtactcggcgcgctgttcctcggtggctgcagttcgctgctgttctatcccgagccggtggtgcagatcactccggcgcgcgccgggctggagtaccgcgacgtcaccctgaccaccgccgacggcgtgcgcctgcgcgcctggtggctgccggcgaagaaaggcgtgccggtgaaaggcaccgtgctctacctgcacggcaacggcggcaacctgtcctggcacctcggcggcacgtggtggctgcccgccgagggctaccaggtgctgatgctcgactatcgcggctacggccagtcggagggccagccgggactgccggaggtctaccgcgacatcgacgcggcgttcgcctggctcgaccaggcgccggaggtgaagggcaccgagcgcgtgctgctggggcagagtctcggcggcgcgctggcgatccactacctggccgagcatccgcagcgccagggccagttcaaggcgctggtgttcgacggggtaccggcgagctaccgcggcatcgcccggcacatgctggacggttcctggctgacctggccactgcaggtgccgctgtcctggctggtgcccgacgacgacagcgccatccattcggtggcgcggctttctggcgcacccatgctgttctttcacagcatcgacgataccattgtgcccctcgagaacggcatcgccctgtaccgccaggcgcggccgccgaaggtcctgcaactgacccgaggcggccacgtgcagaccttcgccgaagcgacctggcaggaagtgatgctgcgcttcctcgacgatccccatggcttcaccggcctgcgccggctggccgaaatcccgaaccgcgaatccgcgaaacccgaaggcaatccatgagcgaccgtaacgtactcccctgcatcctgaccggcatcggtaccatcttcgtcaccgtcggcgtgctctggtactacggctacctgcatttcgccaagccgcaggacgccctgttgctggccgacttcaccatgctgaagagcctgcccggcgaagatgtgaagctgtccctggagccggccaagcaggtcgcgcagtgcatcgatggcgtcctggtgctgttcgacaccgagcagaagggcctttccggcgtgctggtggacaacaggaagcacgccgtgcgctgcgccggacaggaagtcccgcaggaagtgaaatga

SEQ ID NO: 1604 - DNA, 801 bp, Pseudomonas aeruginosa
attccagcgactccactgccggctggcgaccgagggcgtcgcggatcaggcgttcctcggtcgggcagtccatcgcttcgatgcgcaggtcgctccagcgcaactcggcgttgccggccagggttccgatggcggccaccgccgggcgaggcgcgtggcggtgcccatgatcatgtccgtgaccgtgacagcaagtgtcggcgtgttcgtggctcatggaaacaattcccgtttgacgtgttgggtgcgattgcacaccctgtagcaactacagagtcaagcggtactgccaattcgggtagccgcgtcggcgattggaggagggttggcatgaagatcggtgagctggcgaagagaaccggttgcccggtggagaccatccgctactacgagcgcgaaggactgttgcccgagcccgcgcgtagcgaaggcaactatcggcaatacaccctggcgcacgtcgagcgcctgtcgttcatccgtcactgccgctcgctggacatgacccaggaggaaatccgtaccctgctggcgttgcgcgaccgtcccgaggcggattgcggcaccgccaaccggctgatcgacgagcacctgcatcacgtcgaggtgcgcatcgccgaactccaggcattgcgcgagcaactgcaggatctcggctcacgctgtacggtcgccggcaacagccaggcctgcggcatcctccgcgaactggagcagcccgcgccgctgtcgcctatccccgaggaatgcgccgaggccgggcacatgcacgttcccggcgtgcaccgccggcatggctga

SEQ ID NO: 1605 - DNA, 975 bp, Pseudomonas aeruginosa
gcgcgggggcgcctgagccaagctggtttcccacccgcagtggagacaggtcatgccggaaatcgatgcgcgcctgcgcgaggacgtccaccatctgggcgaattgctcggcgacaccatccgcgagcagtacggcccgcggttcctcgacaagatcgagctgatccgcaagggcgccaaggctgcccgccgcggttccgcggagggcgcccagcagctcaccgccaccctcgacgggctcgaggaagacgaactgctgccggtggcgcgggccttcaaccagttcctcaacctggccaatatcgccgagcaataccaccgtatccgccggcgccggccgaacgagccggaacccttcgagaacctggtgctggaggagctgctggggcgtctcaaggacgccgggcatgcccccgggcaactggctcgccagctcgccgggctggagatcgaactggtgctgaccgcccatcccaccgaggtggcgcggcgcacgctgatccagaaatacgatgcgatcaccgcgcaactggcggccaaggaccatgccgacctgctgccggaggagcgcagtcgcatccagcagcgcctgcagcggctggtggccgaggcctggcataccgacgagatccgcaaggtccggccgaccccggtggacgaggcgaaatggggcttcgcggtgatcgaacattctctctggcaggccttgccgaacgtccttcggcacgtcgacgaggtactcctgcgcagcaccggcgaacgcctgccgttgaccgccgcgccgctgcgcttcgcgtcctggatggggggcgaccgcgacggcaatcccaacgtcaccgccagcgtgacccgcgaggtcctgctgctggcgcgctggatggccgccgacctgtacctgcgcgatatcgaccgactggccgccgagctgtccatgcagcaggcctcgccgcagctgctggcgcgggtcggcgatag

SEQ ID NO: 1606 - DNA, 1542 bp, Pseudomonas aeruginosa
cgccgagccctatcgcgccctgctcaagcaattgcgcgagcgcctgcgcgtgacccgcaactggacccaccaggccctggccggcgaggtgccggccgcggagggcgtcctggagcacaaccgcgacctggtcgagccgctgcaactgtgccacgagtcgctgcacgcctgcggcatgggcgtgatcgccgatggcgcgttgctcgactgcctgcgccgcgccgccaccttcggcctgttcctggtacgcctggacgtgcgccaggactcggcccgccatgccgccgcgctgagcgagatcaccgagtacctggagctgggcagctacgacgagtgggacgagaagacccgcctggaattccttctcgaggaactgaacagccgccgccccctgctgccggcgcactaccagccttcggcggataccgccgaggtgctcgccacctgccgggcgatcgccgccgcaccaccggcgtcgctggggtcctacgtgatctcgatggccggccagccgtccgacgtgctggcggtgcaactgctgctaaaggaaagcggcgtcgactggccgatgcgcgtggtgccgctgttcgagaccctcgacgacctggacaacgccggcccctgcatggagcgcctgctgacgctgccgggctaccgttcgcggctgtccggggtgcaggaagtgatgatcggctactccgattcggccaaggacgccggtaccctcacggcggcctgggcgcagtaccgggcgcaggagaaactggtggagatctgccgccagcacgaggtcgagttgctgctcttccacggccgcggcggtactgtcggtcgcggcggcgggccggcccacgcggcgatcctgtcgcagccgccgggttcggtggccgggcgcttccgggtcaccgaacagggcgagatgatccgcttcaagttcggtctgccggacatcgccgaacagaacctcaatctctacctcgccgcggtgctggaagcgaccctgatgccgccgccggctcccgagccggcctggcgcgcgcagatggaccgcctggcgaaggacgcgctgctggcctaccgcagggtggtgcgcgacgatccgcagttcgtcgagtatttccgcctggccacgcccgagcaggaactgggtcgcctgccgctgggcagccgcccggccaagcgccgcgaaggcggggtggagagcctgcgggcgattccctggatcttcgcctggacccagacgcgcctgatgctgccggcatggcttggctgggagaccgccttgctgaacgccatcgagcgtggcgagggcgcgctgctcgggcagatgcgcgagcgatggccgttcttcaccacccgcatcgacatgctggaaatggtcctggccaaggccgacgcggatatcgcgcggctctacgacgaacgtctagttgtgaagctccaataggttgtatccggtgttcatccggattgggtttgagagactggaagtcgccaaacacccaatccactcaggacgcccaaccggatgaacacccataa

SEQ ID NO: 1607 - DNA, 1311 bp, Pseudomonas aeruginosa
cgctttctccgccaccgacctgcctcccctgcgttattggcgcctcgccaatccgcgcgcctctcctgtcgcctgactcctcccccgcgccttcgacaacctggaccttcgggtcggggcaggtcgcggcgcaataccctagcttcccccatggaatcgccggtccgacggaaaaagaccggtcatacgctactggagagtcaccatgcgcacatccttcttcgctgccgcggccctgctggccgtttccgctttcgcccaggcccacgagtacagcgccggccaactgcacatcgagcatccctgggcgctggccctgccgccgacctcgccgaacggcgcggcctacttcgtggtgcagaaccatggcaaggaaaacgacaccctgcttggcgccgacacgccgcgcgcggcttccgccgaggtgcacgagcatgtgcacaagaacggcatgatgagcatgcagaaagtcgacagcgtcgacgtcgcaccaggcaaggacctgcgcttcgctcccggcggctaccacctgatgctgatgggcctgaagcagccactggtggccggcgagcgcttcccgctgacgctgcatttccgcaaggccggcgacgtgccggtggaaatcgtcgtcgagtccaaggcgccggccgaacagggcgggcacgagcagcacggccactgagcgccgtgtcgagcaggggcgcccggcgccccgcctttgcgtgcgaggttcagagcatgaacagcaacagatatcccttgccggcgcagaccggcctggtggtggctcccggcctgccgccgaagaactccaccctgcgtccggaccagctcaacaagcgcctgagcagcgcctggcaccatctctacgacctttgcccggaactgctgaagatcgatccgccggatggcctgaccatcctccgtggtttcctgcaatgggcggccgagcagaaggccgcctggaactgggcgatgcacctgcgcctgtactgctggctgttgcagtcgccgttcggcgccaaggtgaccgatgagcatctggaggtgctgatggacgcctccgccgcgcgctggacggtggacgacaccagcgccaaccgcggcatcctcctggccagccagggcggtgcgcacatcacccaggactggaaggcgccgcaggccggcgccggcacgcgtgtgccgctggagcgcctggacctgccggcgccgaactggacattcgcctattgcgcggtgcccgacccgcggctgcgcgagttcccgggctggaagccgttgccggcgcgcggctcgctggtcggctga

SEQ ID NO: 1608 - DNA, 189 bp, Pseudomonas aeruginosa
tcgcggcccgtgcacgcggtgcgcaactggtgggcttgtgcctgggggccttcgtgctggccgaggccgggttgctcgacggtcgccgcgccaccacccactggatgtgggcggaggatttcgctgggcgcttccctgcggtgcgggtggagcccgacgtgctgtacatctaggacgacggcctgctga

SEQ ID NO: 1609 - DNA, 414 bp, Pseudomonas aeruginosa
agtcggtcatggcgtcaattgagcaggcgtggcagccacagggtcagggacgggaacaggatcagcagcgacagcacccccagggccacgaggatgaacggccagatacccttgaacatttccaggatatcgaggcggctgatggtcgccacgatgaacaggcaggcgcccattggcggggtgatcagggcgatggtgatgttcagggtgaagatcagccccaggtgcaccggatccacgccggcggccagcgccaccggagcgactatcggcgtcagcagcatcagtaccgagacttcttccatgagcatgccgcagacgaagatcactgcgctgatgatgaacagcatcagggtcggcgagtggccgaacggctccagcaactgggcgaactcgctggcgacctgggcgtag

SEQ ID NO: 1610 - DNA, 462 bp, Pseudomonas aeruginosa
ccttccttttccatggccggcaccagcagggtgctgagtgccgaagcgtcggccgcggcggacccgttgaccccggcgaagaacaccccggcgaccacgttgacgtggccgaggccgccgcggaagtggccgaccagggcgttggccagacgcatcaggcgcggggtcatgccggaatggttcatcaggttgccggccagcacgaacagcgggatcgccatcagcgagaagatgtccatgccgccgaagaagcgctgcggcagggtgttggcgaacagcgccgggtcgacgaagaggaaccccaccagcgcggtgagcagcaggcagaggaacagcggcaggccgagcaggaggttgaccacgaaggctgcgatcatggcgatggccatcatgcctgcgaccctccctcgacggtggtgctggccggctgccgcggccagggcccctggagcaacagcatga

SEQ ID NO: 1611 - DNA, 1314 bp, Pseudomonas aeruginosa
gcaatgacggcatgggaggtactccggaaagtcggacaggcgcgcccggccgacggcagcggccgtcgggggggcaacgcgcgaaggtcagggggcggtggcgagaccggcgtcgcggaaggccatctcggtccagcgcggctcgatgtcctgggtcttcagccaggccaggtaggacggctggcctttctcgcggaaggcggcgaggtcatcggcggacggctggatgatctgcatgcccttttccttgaggaacgccaggtcgcgctcctgctgggcggcgaccgcctcgcggttcagccgggtggcttcggcggcggcgtcgagcagggcctggcgctcctttgccgggaggctggcgagcagatcgccgttggccaccaggaactggtcggagtactggatgttggccagggtcaggtacttctgcacctggtagaggctgccgaggatgatgtaggaggtcgggttcatctggccgtcggcgacgccggtgcgcaggcccatgtacaactcggtccaggggatcggcgtgccggaggcgccgaaggcttcgtagagcgccacctggctgggatccatggcgcggaagcgcaggccctggaagtccgccgggccgtggatcggcttcttgccgttggtgaagttgaggaagccgccttcctcgaccaccgccagcagctcggtgccggtgcgctcgcggaaggcctcgcgggcggcctgccagtagctgccgctgtcgaagaaggcgtgggccgcggcggcgtccttgaacatgaagggcgtggcgctgacgtagatctccgggaacagcggggcgatcccggcgaaggaggcgatgttcaggccggggccggtcatcacctgttccatgcgctgctcctcttcgccgagcatgctgttggggtagagcttgaactgcagttcgccgccgctcttttcctcggccaggcgcttgaggttgctggcgaacaggtgcaccaggttcttctcgctgtcggcggcgccgttatagctcaggttgagggtggtggcggcctgggcgaggctgccgcccaggcccagggcggcggccagcagtccggcggcgaagcggcgggcgaggccgtggcgcggattcgtgtgcatgttgttttccttatggcagtccgaacggtcgggggatcggcggcacttcttgtcggggcgcggggccgggtgctcgcacgaaagcgaagcaacgctagccgttgtctcgttgactattcaagtccggacgtgatgcgaaaaagacaacgcctcagcgctgcgagagcccgggcgcgtcgccactga

SEQ ID NO: 1612 - DNA, 441 bp, Pseudomonas aeruginosa
gcgtctgcgccagtccttcgaggcgctgacgacgatccttcagtacctcgcgggcggcgcgcggcaggcgcgcggcgaggctgtcgagcttctgccggagcagcgccagggtgcggcccggatgctgtgcggcgagacgcgtctccaggcggaccaggcgttcgtggcggaccgccagctggcgctcgaaggcacggcgcaggcgcatgtccaggtcgtccaggcgctgcgcctgctggcgcaggcgttcgccgggatggcgcaggcggcgggcgacgccttccaggcgcaggcgttcgcgcagcaactggtcgcgcatgcgcagcaccaggcgccggcgcaggccgtcgagacgctgctgcaggtcgccggcgttgggcgccagcagttcggcggcggccgaaggcgtcggcgcgcgcacgtcggcgacgaagtcgctga

SEQ ID NO: 1613 - DNA, 522 bp, Pseudomonas aeruginosa
ggccgccgcgttgcaggtggggaatggagacgaaggtttctccggccagggcggccaaggccacgggggcttcacggcgggccagcggatggtcggcggcgagagccaggagcaacggctcgcggtacagggcgcgcaggtgcagccggggatgctggcgcagcaccggcaggcgcagcaggccaaggtccaggcgtccttcggcgagatcggcgagttgctgctcggaggattgctgggtcagttccaggcggacgccgctctgcaccgcgaggtagccgcgcagcgccgcttgcaggccgcccaccagcggcaccgagctggagtgccccaggcgcagcaggccatggccgccttcgccgacctcgcgagccaggcgccgggcggcctccaggtcgccgagcaggcgctgcgcgcgtggcaggaaggcgcgaccggccggcgtcagctcgacctggcgcggaccgcggcggagcagtggggtgccgatgctgtcctccagttcgcgcacctgccggctga

SEQ ID NO: 1614 - DNA, 813 bp, Pseudomonas aeruginosa
agtgcgcaggtcgtcgttccgggagtcgccatgtcctcgctcgatccgtcagtcctgttcgccgccctgccgttcagcctatggcaatggctgctggtcgaactggccatcgtcctcgcctatgtggtgttcggcatcgccggcttcggcaccgcgctggtcgccggcccgttgctggccggggtgctgccgctgtcgcagatcattccgctgctggtcctgctggatttcagcgcgtcgttcggcaactggctgccggcgcggcggcagatcgccgtcactgagctcaagcgtctgctgccctgcatgctgctgggctgtgcgctcggggcgtacggacttctggcgctacgcgcggagctgctgatgctggccctcggcgtgttcgtcagtttctatgcgctctacgcgctgttcctccagccacgcggccagccgcgctggcgggcgacctgggcgttgcccttcggtgtcttcggcgggctgttcggcgcgttgttcggcagcggcggcttcctttattcgctgtacctgaacggacgcctggcgagcaaggagcagatgcgcgccacccagagcgcgctgatcggttgtagcaccttcgtccgcctggggctgttcctgctcgccgggctgtatgccgcgcgcgagccctggctgctcgccgcctgcctgctgccgggcatggcgctgggcctgtggatcggccgtcgggtgaccctgcgtctgtcgcgtgaagccttcgtccgcctggtcacctggctggtgctgtgcagcggcctggcgctggtcgggcgctacctggccgcttga

SEQ ID NO: 1615 - DNA, 432 bp, Pseudomonas aeruginosa
acagcaggccggcgaggcagcgccgcgtggcgccaatcgacacgtttcagccaatggaaggccggcagcgtcgccaggctcatggcgcccagctccaccgaaaacaggtcgccgacccgcgccgggctcagttgccactgggtcgccagttgcgcggcgatggcgggggcggtcatcaggatggtcggggtgatcgcggcgaacaccacgatggccgcgagcagcgcgaggttgccggacgccggagaggcgctggcgagagtcttgtcggaagcgctcatggctgcgcctcctcagaacacatggaccaggcgcaacagggcctggctgccatggaaagcattgtcggtggcgacgttgcgcgagagaccgaacatcaggctgttgcgccggtccagccagtggcctagctcgaagccgagttgggtgtag

SEQ ID NO: 1616 - DNA, 1677 bp, Pseudomonas aeruginosa
cgtacgcagtatccggccatccgccgccgcgctgccatcctgcaaatgcgggataggacaggcggaacggggcctggcgggcgccttgcaagatatttgcccattcgccgttttcggcgatcaactgcgttgagcggaagcccgtggctgggtataatgtcgcgcttccatttttcccgtctgggagcgcccgccatgctgcgaatcagtcaagaagccctgactttcgacgacgtccttctgatccccggttattccgaagtcctgcccaaggacgtgagtttgaaaactcgcctgacccgcggcatcgaactgaacatcccgctggtatccgccgcgatggataccgtgaccgaagcccgcctggccatcgccatggcccaggaaggcggcatcggcatcatccacaagaacatgggcatcgagcagcaggccgcggaagtccgcaaggtcaagaagcacgaaacggccatcgtccgcgacccggtcaccgtgaccccctcgaccaagatcatcgaactgctgcagatggcccgcgagtacggcttctccggtttcccggtggtggagcagggcgagctggtcggtatcgtcaccggtcgcgacctgcgggtgaagccgaacgccggcgataccgtcgccgcgatcatgaccccgaaggacaagctggtcaccgcccgcgaaggcaccccgctggaagagatgaaggccaagctttacgagaaccgcatcgagaagatgctggtggtcgacgagaacttctacctgcgtggcctggtgaccttccgtgacatcgagaaggccaagacctacccgctggcgtccaaggacgagcagggccgcctgcgcgtcggcgccgccgtcggcaccggcgccgataccggcgagcgcgttgccgcgctggtcgccgccggggtcgacgtggtggtggtggacaccgcccacggccactccaagggcgtgatcgagcgtgtgcgctgggtcaagcagaccttcccggacgtccaggtgatcggcggcaacatcgccaccgccgaggccgccaaggccctcgccgaggctggcgccgacgcggtcaaggtcggcatcggcccgggctcgatctgcaccacccgcatcgtcgccggtgtcggcgtgccgcagatctccgccatcgccaacgtcgccgccgctctcgaaggcaccggcgtaccgctgatcgccgacggcggcatccgcttctccggcgacctggccaaggccatggtcgccggcgcctactgtgtgatgatgggctcgatgttcgccggtaccgaggaagcgccgggcgagatcgagctgttccagggccgttcctacaagtcctaccgcggcatgggttcgctgggcgccatgtccggctcccagggctcgtccgaccgctacttccaggacgcctccgccggcgccgagaagctggtgccggaaggcatcgagggtcgcgtgccgtacaagggtgccctgtccgccatcgtccaccagctgatgggcggcctgcgcgccgccatgggctacaccggcagcgccgacatccagcagatgcgcacgccagccgcagttcgtccggatcaccggcgcgggcatggccgagtccccatgtccacgacgtccagatcaccaaggaagcccccaactaccgggttggttgaggctgattga

SEQ ID NO: 1617 - DNA, 1590 bp, Pseudomonas aeruginosa
cgagagatggccatgtcccaagacattcacgcccaccgtatcctgatcctcgatttcggctcccagtacacccaactgatcgctcgccgcgtgcgcgagatcggcgtgtattgcgaaatccatcccttcgacatgagcaacgaggcgatcatcgccttcgcgccgcgcggcatcatcctcgccggtggccccgagtcggtacacgaagccgacagcccgcgcgcgccgcaggcggtgttcgacctgaaggtgccgctgttcggcatctgctacggcatgcagaccatggccgagcagatgggcggcaaggtgcagggctccgacctgcgcgagttcggctacgcccgcgtcgacgtggtcggcaaggcgcgcctgctggacggcatcgaggaccacgtggacgacgacggcgtgctcggcctcgacgtgtggatgagccacggcgacaaggtcaccgagatgccggccggcttccacatcctggccagcaccccgagctgcccgatcgccgccatggccgacgatgcccgcgcctactacggcgtgcaattccacccggaagtcacccacaccaagcagggcctgcgcattctctcgcgcttcgtcctcgacatctgcggttgcgccgcgctgtggaccccctcgaacatcgtcgacgacgccatcgccaccgtgcgcgcccaggtcggttcctccaaggtcctgctaggcctctccggcggcgtggactcctcggtggtcgccgcgctgctgcacaaggccatcggcgaccaactgacctgcgtgttcgtcgacaacggcctgctgcgcctgcacgaaggcgaccaggtgatggccatgttcgccgagaacatgggcgtgaaggtgatccgcgccaacgccgaggacaagttcctcggccgcctggccggcgtcgccgacccggaagagaagcgcaagatcatcggccgcaccttcatcgaagttttcgacgaagaagccaccaagctgcaggacgtgaagttcctcgcccagggcaccatctaccccgacgtgatcgagtcggccggcgccaagaccggcaaggcccacgtgatcaagtcgcaccacaacgtcggcggcctgccggaggacatgcagttcgaactggtcgagccgctgcgcgaactgttcaaggacgaagtgcgcaagatcggcctggagctgggcctgccctacgacatggtctaccgccacccgttccccggcccgggcctgggcgtgcgcatcctcggcgaggtgaagaaggagtacgccgacctgctgcgccaggccgaccacatcttcatcgaggaactgcgcgccttcgactggtaccacaagaccagccaggcgttcgtggtgttccagccagtgaaatcggtcggcgtggtcggcgacggccgtcgctacgcctgggtcgtcgccctgcgcgcggtggagaccatcgacttcatgaccgcgcgctgggcgcacctgccctacgaactgctggagaaggtctcgaaccgcatcatcaacgagatcgccggtatctcccgggtcacctacgacgtgtcgagcaagccgccggcgactatcgagtgggaatga

SEQ ID NO: 1618 - DNA, 591 bp, Pseudomonas aeruginosa
tccatacatccaatccttcacctgcttcgacggcacgcgccggctgctgacggcggcgctgccggaggtcgcgctggctttgaagcaagcgctcgccggcggtgcagccggaccgctgctggtattagacaatgccactgggcgctccgtcgatatagatatccgtggttccagcgaggaccggctggcgcgcatggtggtcgcaggcgagcggcaaccggcggaggaggccgcaccgcgcgggcgcgggcggcagaagctgggcgtggtggcgcgcgaggtgaccttgttgccgcgccactgggaatggctcgccgcgcagcccgggggcgcctcggtggcgatgcgcaagctggtcgaggaggcgcgccgcagccagtccgggcgtgcgcggcaggcgcaggagcgcgcctaccatttcatgaatgcgatggccggcgacctgccgggcttcgaggaggcgacgcgtgcgctgttcgccggggatcgcgagggcttcgccgagcggatcgccggctggccgaccgatgtgcgcgagcacgccgcctggctggcaagcgacggagaatcctgaggggagggggcggctag

SEQ ID NO: 1619 - DNA, 4293 bp, Pseudomonas aeruginosa
aatgcacggcctctgcgggccggcccggccggcccccacaccttcccgtctccagaggctgttccgacaatgctgatcctgcgcggcgctcccgccctttccgctttccgccacggcaaactgctcgagcaactgacccagcacgtacctgccgttaccgggctgtacgctgagttcgcgcatttcgccgacgtcaccggcgcgctcaccgccgacgaggagcaggtgctggcgcggctgctgaaatacggcccgagcgtgccggtgcaggagcccagcggacggctgttcctggtggtgccgcgcttcggcaccatctcgccgtggtcgagcaaggcctccgacatcgcccgcaactgcggcctggcgaagatcgaccggctggagcgcggcattgcctactatgtgcagggcgaactgtccgagagcgacgcccagcaggtcgccgcccgcctgcatgaccgcatgacccaactggtgctggaccgcctggaaggcgccgccgagctgttcagccatgcgcagccccgcccgctcaccgccgtcgacgtgcttggcggcggtcgcgccgcgctggagaaggccaacgtcgagttgggcctggccctggccgaggacgagatcgactacctgctgaagagcttcggcgaactggggcgcaacccgcacgacgtcgagctgatgatgttcgcccaggccaactccgagcattgccggcacaagatcttcaatgccagttgggacatcgacgggcaggcccaggacaagagcctgttcggcatgatcaagaacacctacgagatgaaccgcgaaggcgtgctgtccgcatacaaggacaacgccgcggtcatcgtcggccatgtcgccgggcgtttcttccccgatccgcagacccgcgaatacgccgccagccgcgagccggtgcagatcctgatgaaggtggagacccacaaccacccgaccgccatcgcgccgttccccggtgcctccaccggttccggcggcgagatccgcgacgagggcgccaccggccgcggcgccaagccgaaggccggcctgaccggcttcaccgtgtccaacctgcagatccccggtttcgaacagccctgggaagtgccctacggcaagcccgagcgcatcgtcaccgcgctggacatcatgatcgagggcccgctgggcggcgccgcgttcaacaacgagttcggccgtccggcgctgaccggctacttccgtaccttcgagcagaagatcgctacccctcacggcgaggaagtgcgcggctaccacaagccgatcatgctcgccggcggcatgggcaacattcgcgacgaacacgtgcagaagggcgagatcagcgtcggcgccaagctcatcgtccttggcggcccggccatgctgatcggcctgggcggcggcgccgcctcttcgatggccaccggcgccagctccgccgacctcgacttcgcctcggtgcagcgcgacaacccggaaatggagcgacgttgccaggaagtgatcgaccgctgctggcagctcggcgagcgcaacccgatcagcttcatccatgacgtcggtgccggcggcctgtccaacgccctgccggaactgatcaacgacggcggccgcggcggtcgcttcgagctgcgcgcggtgcccaacgacgagccgggcatgagcccgctggaaatctggtgcaacgagtcgcaggagcgctacgtgctgtcggtggacgccgccgacttcgagaccttcaaggccatctgcgagcgcgagcgctgcccgttcgcggtggtcggcgaggccatcgagcagcgccagctgaccgtcgccgacagccatttcgacaacaagccggtggacatgccgctggaagtcctgctcggcaaggcgccgcgcatgcaccgcgcggttacccgcgaggccgagctgggcgacgatttcgacgccgccgggctggagctgcaggaaagcgtcgagcgcgtcctgcgccatcctgccgtggccagcaagagcttcctgatcaccatcggcgaccgcaccatcaccgggctggtggcccgcgaccagatggtcgggccctggcaggtgccggtggccgactgcgccgtcaccgccaccagcttcgacgtctacaccggcgaggccatggcgatgggcgaacgtaccccgctggcgctgctggacgccccggcttccggacgcatggccatcggcgagacggtcaccaacctggctgccgcgcgtatcggcaagctgtccgacatcaagctttccgccaactggatggccgccgccggccaccccggcgaggacgcgcgcctgtatgacacggtcaaggccgtgggcatggaactgtgcccggaactgggcatcaccatcccggtgggcaaggactcgatgtccatgaagacccgctggcaggacaatggcgaggacaagagcgtgacttctccggtctcgctgatcgtcaccggcttcgccccggtcgccgacgtgcgccagagcctgaccccgcaactgcgcctggacaagggcgagaccgacctgatcctgatcgatctcggccgcggcaagaaccgtctcggcggctcgatcctggcccaggtccacggcaagctcggccgcgccgtgccggacgtcgacgacgccgaggacctgaaagccttcttcgcggtgatccaggggctcaatgccgacggccatatcctcgcctaccacgaccgttccgacggcggcctgatcaccagcgtgctggagatggcctttgccggtcactgcggcgtcgagttgaacctcgatgccctggccgatagccgcgaagagttggcggccgtgttgttcagcgaggaactgggcgcggtgatccaggttcgcgagggcgccactccggaagtcctcgcgcagttcagcgccgccggtctcgacgactgcgtggcggtgatcggccagccggtcaacggctacgagatcaacctgaactacaacggcgaggccgtctacagcgcccagcgccgcatcctgcaacgcatctggagcgagaccagctaccagatccagcgtctgcgcgacaacgccgactgcgccgagcaggagttcgatgcgctgctggacgaagacaaccccgggctgtcgatcaagctcagttacgacgtcaacgacgacatcgccgcgccctacatcaagaagggcgtgcggccgaaagtggcgatcctccgcgagcagggcgtcaacggccaggtggagatggccgcggcgttcgaccgcgccggcttcgccgcgatcgacgtgcacatgagcgacatcctcgccgggcgggtcgacctggacgccttcaagggcctggtggcctgcggtggcttctcctacggcgacgtgctcggcgccggcgagggctgggccaagtcgatcctcttcaacgcccgcgcccgcgacggcttccaggcgttcttcgcgcgcaaggacagcttcgccctcggcgtctgcaacggctgccagatgatgtccaacctgcacgagctgattcccggcaccgagttctggccgcacttcgtgcgcaaccgttccgagcagttcgaggcgcgggtggcgatggtccaggtgcaggagtcgtcgtcgatcttcctgcagggcatggccggttcgcgcctgccgatcgccatcgcccatggcgaaggccatgcggagttcgagtcggaggaagcgttgctcgaggccgacctttccggctgcgtgtcgctgcgtttcgtcgacaaccacggcaaggtcaccgaagcctacccggccaaccccaacgggtcgccgcgcggcatcaccgggctgagcagccgcgacggccgggtcaccatcatgatgccgcaccccgagcgggtgttccgcgccgtgcagaaattcctggcgtccggacgactggcaggaagacggcggctggctgcgcatgttcccccaacgcccgggtctgggtggactgatccggcatggcgggcgatgcggactccaactcgtcgccccgaccttcttccccgaggttcgccgggtctctcccggcgacaccttgcggctctgtacctgcggggcttcggcttcgcttcccgattgtcccgccgactgccgcaacggcctgacgctccacgcgacccgcgagcgcctgttgctgttgtgccgctgcgggcgctccgccgacctgccgtattgcgacggcagccatgcgccttccgcctccgggctgaaggccaggtggcggcgtttccgcggcctgagcgtaaatctgtgaacgcccgcacgaaggtgttgtga

SEQ ID NO: 1620 - DNA, 909 bp, Pseudomonas aeruginosa
gaccccggcctacgaagtctggcgcctgaccgacatggtcttctgagttttcctcggacaagcaagaagggcggccagttgccgcccttttcgttatccgcctcacggggagagtccgacccggggctgtggcgtggcgcgaacaaccgcttcgcgattatcgaacccgaacgggggagctgtggcgtagggcgaataaccgcttggcggttatccgccgattggccgaggtccagccctcctgccgtcagcgccgcagcagcggttgcagggcctggctcagggcccgcggcgcgggggcccaccaggatatggcagatgccgccggcgagggagctgacgccctgtccgccgagacgacgcagttgctcggtggccagcttgcgttcgtccgccacgctgacccgcaggcgggtcagtgcgacgtcccgtacctcgcgcaggttgccggcgccgccgagggcgccgagccaggcctgggcttcggcggcgtcgacggtggcctgcatcgacaccacctcttcggctgcgttcggactgcccagcggcggtacggcttcgcccggttgcgtatcgaagggcagggcgcggcggatctcgtcggcgatgctgtcggcctgtgggccgaccaccacctgcaggctgccggccttgcccggacgtaccacggccatcgcaccgagggccttgagctgggcgtccgaggccttgtcgcggtcgaccaggcgcagacgcaggcgcgtggtgcaggcgtccaccacttcgaggttggctgcgccacccagggcgcggatgaatgccggggcgcgctcggcttcggcgttgtcgcccgattcgctgctcgcgtcgtcttcgcggcccggggtcttcaggttgaagcggcggatgcagaagtcgaacaccaggtaa

SEQ ID NO: 1621 - DNA, 420 bp, Pseudomonas aeruginosa
cgcgccaggtcgccggtgacgacgcgcccggtttccgggtcggtgaagctaccgaagacgaaccacaccaggttgttgaggatgtggtgcaacccggtgacgatcagcaggcggttcagcacgccgaaggcgaaggcgccgaagctgccgctttccagcatgagttggccgaggccgttgatgccctgttgcagcggtggccagatcaccccgaacagcaggcccaggcagaccgcgctgatcccggtggcgatcggcacgaagcggcggccgccgaagaacgccaggtattccggcagcttcacgtccttgaagcggttatacagggcgccagccaccaggccgctgatgatgccggagagcacgcccatgtcgatgcccggatcgatcaccttgagcaccgagatcatcaccaggtag

SEQ ID NO: 1622 - DNA, 666 bp, Pseudomonas aeruginosa
ccgatggcgccggcgaggccggcggtgccattgttgtcgcgagcgaaaccgacggcgatgccgatggcgaagatcagcgccaggttggcgaagatcgccttgccggcgtcgtggaccagcggaatgtcgagcaggtcgacgtcgcccaggcgcagcagcaggccggcgatcggcacgatcgcgatcggcagcatcagggcgcggcccaggcgttgcaggctttcgatcaggaacgggggcatggcggtggtctccgattgttcttgtcaggccagcggccagtgttgcaggcaggcgtcgcgcaccgcccgggcgctgcccaggtccagtagcgcctgggcgtggcggcggcattcagcggcgtcgagctggcgcacccgggtcttgatctcgccgaccaggttcggcccgacggacaattcctcgaccccgaggccgaccagtaccggtgtcgccagcgggtccgaggccagcgcaccgcagacgccgacccatcggccgtggcgggctgctccggcgcaggtctgggcgatcagtcgcagcagcgccgggtgcagggcgtcgatgcggtcggccaggccggcgtggcaacggtccatggccagggcgtactgcgacaggtcgttggtgccgatggagaggaagtcggcgtgttcggccagttga

SEQ ID NO: 1623 - DNA, 612 bp, Pseudomonas aeruginosa
cagcgctgccgggcgtgcgtgcagaccgccatgatgggcgacccgcgcccgcccgcggacctggcgctgcgcggagccttcgccaggcgcgggattggccggacgttgctcggccttctccggactcagttgcaggagcggcgcgccgacctccaccgggttggtggtcagcgggcgtacctggaagccgtcgccgttggtcaggatcatcaccgtgatcagactgcggctgccgcgggcgacgcggtccaggtcgaagcgcagcagcggctggccctcgatcacccgcgcaccttcctcgaccagcgcctcgaagccttcgccttgcagctgtacggtatcgaggccgacgtgcagcagcagctcggcaccgttgtcggcgcgcaggctgagcgcgtggcgggttcgcgccaggtggctgaccagcccggcgcagggcgcgtgcaggcagtcgttgagtgggtcgatggcgatgccttcgcccagggtgccgctggaaaacaccgggtcgggtactcggttgagcggcatcacggggccgctcaggggcgctttgagggcgagattcttgttgttcatgggcgcgcgctcaggctcagtgggttcgggtga

SEQ ID NO: 1624 - DNA, 1209 bp, Pseudomonas aeruginosa
agctcttggtcgctgcgacgctgcgctcggtgccggcgcagagcggcacgacgaattcgctggcggcttccagcggcgaatcttcggcattcaccagggcgatgcccagggcgccgcgttcgcgcaggatgcgcaggctgtccacgagatcggggctctgtcctgactgcgagaaagcgaagacggcctgcccggcgacacgcagcggcgagcggttcagggtcactaccgacatgggcagcgaggccaccggcaagccggcgtgctgcatggccaggtaggcgaagtagctggcggcatggtcggagctgccgcgcgcgacggtcagcgccaggttcggatcgacctcccgcaggcgctggccaagcgccggcaggcaagcgtcgagcacggccagttgacggctcgccaccgcggcggcggagagcgcttcctcgagcatcagcgaagtcattcgagttctccttccaccatcacggcgtcgagttccagggagcgatccaggcgcaccacatcggcccaggctgcgggcgccaggcggccgcgctcggcgaggccgaggtaatcggcggggaattgcgaaaggcgttgcgaggcttcggccaggggcaggccgatcttcaccaggttgcgcagtgcctggtccatggtcagggtgctgccggccagggtgccgtcgggcaggcgcacgccgcccaggcacttggtcaccgtgtggctgccgagcttgtactggccgtcgggcatgccggcggcggcggtggagtcggtcacgcagtacaggcacgggatcgaacgcagggccaccctgatggcgccgggatggacatgcagcaggtcggggatcagctcggcgtagcgtgcgtgggccagggccgcgccgacgatacccggttcgcggtggtgcaggccggtcatcgcgttgtagaggtgggtgaagctgctggcgccggcttccagtgcggccacgccgtcctcgtagctgcccagggtatggccgatctgcaggcgtacgccgcgctcggcgagggcgcggatcagcggccggtgtccggcgatctcgggggcgatggtgatcacccggatcggcgcgcggcgcaggtagtcctcgacttcctcgagcaccgcggcatgggcgaagttgggctgcgcgccgagcttgccggagttgatgtaggggccttccaggtgcacgccgagtatccgtga

SEQ ID NO: 1625 - DNA, 861 bp, Pseudomonas aeruginosa
cgcaggcggttgtcgccgtccgggatgcgctggaccaccgtggcgccgcacaggctgcagaatttcatgccaggttcttcttcggggaaaggcctatcttgctcggctggccgggaggcgacaaggccccgtgcgggaggggtgggctggccggggctttcgtgccatgatctcggggaaacgacaagacctcggaaaccccggcagtatgaactgcacgctcgacgagctgcgccaacgcatcgaggcgcaccgcccccgccaactggataccgaccagcgcttcccccaagcggccgtgctggtgcccatcacccgcagcgacgatccggagctggtgctgaccctgcgcgccgccggtttgtccacccatggcggcgaggtcgccttccccggcgggcggcgcgacccggaagatgccgacctggtgcgcaccgccctgcgcgaggcggaggaggagatcgccttgccgccgggcctggtggaagtggtcgggccgctgagcaccctggtctcgcggcatggcatcgaggtcactccctatgtcgccttcattcccgacttcgtcgagtaccagcccaacgacggcgagatcgccgcggtgttcaacgtgccgctgagtttctttcgcgacgacccgcgcgaggtcacccaccgtatcgactacttcggccgcagctggtacgtgcccagctatcgcttcggcgagttcaagatctggggcctgacggccatcatggtggtggagctggtcaacctgctgtacgacgaccccatcgacctgcacacgccgccggcttcgttcatcaaactgagttgaccgacggggcgcagaccccggccatgaggagatcgcgatga

SEQ ID NO: 1626 - DNA, 900 bp, Pseudomonas aeruginosa
gcgaggcggatacggcgctacgcctgttcggcaagccggaagtggatggccagcggcggatgggcgtggccctggcgcgcgacgagtcgatcgacgccgcccgcgccaaggcgacccgggccgcccaggcggttcgcgtcgaactctgagatgcgccggctggcatcgctggcctggtgggcggcggctctgccgttgctgccgctggcggtgccgctggctatccgcacccgccgccgagccttgcgcctggcgcccgcggcgggacctcgcgaagggctggtcggtggggccggtgccgaagagccgctgcgcttgctgttgttcggtgagtcgacagtggccggggtcggcgccagttgcctggattacgccctggccggccgcctggccgcggcgctcggcgagcgtatgcggcgcccggtggcatggcaggcgctgggcgagaacggtatcaccagcggcgaggcgcgcgaacgcttgctaccgcaggtggcgggacgtttcttcgaccaggtgatcctggttttcggcgtcaatgacaccaccagcctgcgctccctcgaacgctggcgcgccgactgcgcggccctgatcgacggcttccaggcggccggcgcgcaggtgacctgcaccgcggtgccgccgctgcagcatttttccgccttgcccgggttgctgcgggccctgctggggtggcgcgggcggctgctcgacgaggcgctgtgcgatctcgctggcgcgaccggcgccggctactgcccgatctcgctggacctgcttccgggctacctggccatcgacggctttcatccgtcgcagctgggctaccaggtctgggccggggccctcgccgactggttggcggcgagggagaagggcggcgtcgcggtagcctga

SEQ ID NO: 1627 - DNA, 228 bp, Pseudomonas aeruginosa
ccggggaggacgccgatcagggtggtggacacccccatcagcagcagcgaggcgaccagggttgacttgcgcccgatgcggtcgccgaaatggccgaacagcgccgagcccagcggacgggcgaggaatgcgatgccaaaggtgaggaaggcgctgatcatctgcgcggtgccggatgtctgcgggatgaataccggaccgatcaccagggcggcggcagtggcatag

SEQ ID NO: 1628 - DNA, 507 bp, Pseudomonas aeruginosa
aactcgatggcggtgccgatgaagctggcgactgcgacccgggtggtcgagttggccggttccggagcggagtccgcggcgacggtggcggcggtcatggtgggaaggtccctggcaatcggggcacgacggagtgcttccgtgcggccggatggttatggccagtgcgccgatgcggcggcgcggcgcccgggtggggcggacgagatcggtcgcgcagggaggatggggatgcgcgccgtgcgccggctggtaccgtcggcatcggggccgggcgggcaggcgggactggcgggtgactggccggggctcgggctgcgggtagcggcggaaccggcggcagggctggataagctggggtcgattatagagcgccgcggggccggttcggcaatcccggatcagacgctggcgtcgctttcgaccagcggggtcagcgcgcggggatgccaggcgcgcacgcttttcacacggttttccgccgactgctggatttccaggcagtag

SEQ ID NO: 1629 - DNA, 360 bp, Pseudomonas aeruginosa
gagcacagcatgaccaacaagatcattcagcagatcgaagctgaacagatgaacaaagagatcccggcgttcgcccccggcgataccgtgatcgtccaggtcaaggtgaaggaaggcgaccgtcagcgtctgcaggccttcgaaggcgtcgttatcgccaagcgcaaccgtggcctgaacagcgccttcaccgtgcgcaagatctccaacggcgtgggcgtggaacgtaccttccagacctacagcccgatcgtcgacagcctgagcgtcaagcgtcgcggcgacgtgcgcaaggccaagctgtactacctccgcgccctgtccggcaaggccgcgcgcatcaaggaaaaactggtctaa

SEQ ID NO: 1630 - DNA, 480 bp, Pseudomonas aeruginosa
ccagtacaacatccgcggcacccaggcagccactccatccggtattcgtggcatgacccccagagagcaagaaatcctgcgtcgcaccgagctttccgaaacccgtgtgaccaaggcggtattcccgcccaccaccaatcaccacaacaccctgttcggcgggactgcgctggcctggatggacgaggtctcgttcatcaccgcgacccgtttctgccgcctgccgctggtgaccgtttccaccgatcgcatcgacttcaaccacccgatcccgggcggggctcgatcgtcgaactggtcggacgggtggtcaacgtcggcaacaccatcctcaaggtggaggtcgaggtgtacctggaaagcatgtacgccgacggtcgcgagaaggccatacacggcctgttcagcttcgttgccatcgacgacgaaaagcggccggttccggtcctgccggggttcccggtcagccaggcggcttga

SEQ ID NO: 1631 - DNA, 195 bp, Pseudomonas aeruginosa
cgttctggtccatcaaggattccttgtcagcgtcgctccgctcgtcctgagccggggcgaaccatcgagccacatggctccgctttttcccgcgggcacgggaagccggccgacctcctgtcgaccggcctgactaaccattacgtggcgatgacggccaacgctcgcgatagcgcccaggctatgaaagactag

SEQ ID NO: 1632 - DNA, 1467 bp, Pseudomonas aeruginosa
attgatcgaacgccgggcgccgctcgcgggcccgcgtcaacagcgaaggttttgaacatgcgttacatcagcacccgcggccaagcgcccgccctgaacttcgaagatgtcctcctcgccggcctggccagcgacggcggcctctacgtcccggaaaacctgccacgcttcaccctcgaggagatcgcctcctgggtcggcctgccctaccacgagctggccttccgggtgatgcgcccgttcgtcgccggcagcatcgccgataccgacttcaagaagatcctcgaggaaacctatggcgtcttcgcccatgacgcagtggcgccgctgcgccagttgaacggcaacgaatgggtgctggagctgttccacggcccgaccctggccttcaaggacttcgccctgcaactgctcggccgcctgctcgaccatgtgctggccaagcgcggcgagcgcgtggtgatcatgggggccacctccggcgataccggctccgcggccatcgaaggctgccgccgttgcgacaacgtcgacatcttcatcatgcacccgcacaaccgcgtgtccgaggtgcagcgccggcagatgaccaccatcctcggcgacaacatccacaacatcgccatcgaaggcaacttcgacgactgccaggagatggtcaaggccagcttcgccgaccagggcttcctcaagggtacccgcctggtagcggtgaactcgatcaactgggcgcggatcatggcccagatcgtctactacttccatgccgcgctgcagctcggcgcgccgcatcgctcggtggcgttctcggtgccgaccggcaacttcggcgacatcttcgccggctacctggcgcgcaacatgggcctgccggtcagccagctgatcgtcgcgaccaaccgcaacgacatcctgcaccgcttcatgagcggtaatcgctacgacaaggacaccctgcatccctcgctgtcgccgtcgatggatatcatggtctcgtccaacttcgaacgcctgctgttcgacctgcacggccgcaacggcaaggccgtcgccgaactgctggatgccttcaaggccagcggcaagctgtcggtggaagaccagcgctggaccgaggcgcgcaagctgttcgactccctggcggtcagcgacgagcagacctgcgagaccatcgccgaggtataccgctccagtggcgagttgctcgacccgcacaccgccattggcgtgcgtgccgcccgcgaatgccggcgcagcctgagcgtgccgatggtgaccctgggcactgcgcatccggtcaagttccccgaagcggtggagaaggccggcatcggccaggcgccggcgctgcctgcgcacctcgccgacctgttcgagcgcgaggagcgctgcaccgtattgccgaacgagctggccaaggtacaggccttcgtcagccagcacggcaatcgcggcaagccgctctga

SEQ ID NO: 1633 - DNA, 369 bp, Pseudomonas aeruginosa
tccggtaaatgcttgcatcgacgaaccctattcgcgttttttcggtctttgacgagtcttattcgtcgaaacaggagacctgatttggacagcctgaagcaacgactggccgatgccttcgctccccatcccttcaccctcagccagccccggcccgatggcggacgggtggtcacgctggtcgatccgcagggggaaaccctgttgcagcgggtcatcgccaaggtgcagttgaacgacgaaagctatctcgaggatgccgtgcagaccattcgccgggaattgcaggtgctggtcgggcggatggaggaagacgtgctggcgaccttccgcgagcgggatcacgtgctgctgtattcgtcgcgctag

SEQ ID NO: 1634 - DNA, 840 bp, Pseudomonas aeruginosa
aagcccgggcctgagggaggacaccatcatgacggtatggagcaagctgctgagcgccctgcgcggcggagccaacgaggttggcgaggcgatcgtcgacagccaggcgctgcgcatcctcgaccaggagatccgcgacgccgacgtcgaactgcgcaagtcgcgggaagcgctggcctcgatcatggcccgccaccgcctggcccaggagcgcgtcgagaagggcgcggcccaggtcgccgagtacgagcaatacgcgatcaaggcactggaggccggcaacgaggagctggcccgggaggtcgcggagaagatcgcgaccctggagaaccagctcgagggcgagcgtgcccaggtcgcggaattcgccgccagcgtagcccagttgcgcaagtcggtgagccaggccgagggcaacatccgccagctcaagcaacaggtggatacggtcaaggccaccgagagcgtgcagaaggcgcagatggccgttgcccagcgctacggcaactcgaagagcaagctgcagaccgcggtggactccctggagcggatcaagcagcgccaggccgaacgcgcggcgaccatggatgccgcggccgaactggccagcgcggcggcgccggacgatgcgctggacgccaagctgcgcgcggctgggatcaaggcctcgggcaacagcgtggatggcgtgctggcgcgcctgaaggaaaagggcaaggcctgataggcccgcggcccggcgaaggcgtccgggcccgtttttcagggatagagcgacaatggaaggtttcctgcagacggcgctgtcgttcccgaccgtgctgttcagctttcttctga

SEQ ID NO: 1635 - DNA, 1071 bp, Pseudomonas aeruginosa
ggtggagctgcagaagatcgagaaggaaaaggcgctggaagagcagcgcaagaacatcgccaatgtgattcgcgagcgcgtcgcggtggaaaagaccgtggcccaggaggaggagcggatcaaggaggtgcgcgaggtttccgaggccgagcgggtcaagcaggtgatcctgctgcaggcccaggcggaagccgagcaggagctggtacgccaggtcaagcaggcggaagccgacgaggcccgctccaagcacaaggcggtggaaatcaacaccatggcgcaggccgagctggaagcggcgtcgaagcaggccgaggcgaagaagcgtctggccgagggcatcgaggccgagcgcgcagcgccgggcctggccgatgcgcgggtgctggaagtcaccgccgcggcgaaggaaaaggatggcttggcagcggcgcgggtacgtgccgaacaactgatcgccgaagccaggggcgacgaggagcgcggcctggccgacgcccgggtgctcgaggcgcaggccgcggccaaggagaaggacggcctggcccgaagcccaaggtgctggccgagaagctcggcgcccaggcgcgcggcgaggagcagctcggcgcggccaaggccaaggccaccaaggaccagggcagcgcggaagcggaagtactgctgcagcgcctgaatgccgaggccgaggggcttggcaagaagttcggcgccctggatgccctcagcgacagcgctcgccagcacgaagagttccgcatgcagctggagaagagcttcgaggaggccatggcggccatcgccgcgaacaaggacatcgccaaggagcaggccgaggtgctcgccaccgcgctgggcaaggcgaacatcgagatcgtcggcggcgagggcgacttcttcaactccttcgccaagtcgctgtcggtgggcaaggccatcgaaggtgtggtcggcaagagcccggtggtgcaggacgtcctcgcccgcctgctcaacggccgtggcgcagccgctgcggtgatgccggaacgcaagagcggccacgagaacgagccggcggcggaagtctga

SEQ ID NO: 1636 - DNA, 489 bp, Pseudomonas aeruginosa
tcggccgggtccgcatccgtaccgagaacaactgcatcgcccgcgatatcgtccaggtcggcgattgcctgctgttcggctacaacgtgttcatcggcctgcgcaaggaaaccggcgtggccgacgtattctccctctaccgcctggtggagggcagcgaaggctacgaggcggagcctgtgccactgggggacagctttctcgccgcgccgggcttcgtcaacgacttcaacgagctttacacctactacaagaacacccgcctgctgcaactggcgatccgcgacggcaagctgctggccagcttccagatcggcgagcggatcaccgacatccgcgtgttccgctggtcgatctccagcgacggcagcgaagtccgctacatcgacaaccgcggcgagcgcgacatcgccttgccggcaccgttcgacttcgaatggcagcgggctacccgcgagatggtggtggagggccgcttcccgcacctga

SEQ ID NO: 1637 - DNA, 420 bp, Pseudomonas aeruginosa
agtggctggagctggtggtgcgcaccctggaggttaccgcggcggcgccgcgcagccgcgccagcgcctatttcagtcccggcgaggagtgtcggcggaagatccgcgagctgtgccggcaggccaggcagagcctggacatctgcgtgttcaccatctccgacgaccagctcagtgcggaaatcctggcctgccatcggcgcggtgttccggtgcggatcatcagcgacgatgacaagcagttcgacgaaggcagcgacatccatgcgctgcgcgaggccggcgtgccgctgcgaatcgacgacagtcccttccacatgcaccacaagttcgccctggtggatggcgcctggctgctcaacggcagtttcaactggacccgcagcgccagcgtcaacaacgaagagaacctgctggtaa

SEQ ID NO: 1638 - DNA, 702 bp, Pseudomonas aeruginosa
tcggcgcctatcggcgtgaattcgaggaactctggggccgctacgccccgcgctgagcggcagcgacgcgagaaaggcagggcaggcggtcggccggcggaccgcacgcgggcaggtttcaggttagacttgcgccctttcgcttcccacgccggtattcccatggccctgcaatccacgccctataaagccgatatttccctcaccgacctggaccgcggggtctacgagacgttacgcctgaccgtggcccggcacccctccgagaccgaggagcgcctggccgtgcgcttgctggcctacgtgctgtggtacggcgagcagatcgccttcgggcgtggcctgtcggacgtggacgaaccggcgctctgggaaaagagcctggacggccgggtcctgcactggatcgaagtcggccagccggacgccgagcgcatcacctggtgctcgcgtcgctgcgagcgcttcagcctgctcgcctatggcaacctgcgggtctggcagaccaaggtgctggacagcgtgcgcagcctgaagaacatcaacgtcgcggcagtgccccaggaacccctggagagcctgtcccgcgacctgccgcgttcgatcaactggaccgtgatgatcagcgagggcaccctgttcgtcaccgacgagaacggccagcacgagttgcagctggaatggctgcagggcgagcgttga

SEQ ID NO: 1639 - DNA, 1770 bp, Pseudomonas aeruginosa
cctgatgcgtatcgaaccccgccccctgcccgaaaccctgcccgatctcggcgaccttccgccattgctggcacgcctgtacgcagctcgtggcgtgcgttgcgccgaggagctggacaagggcctggcgcggctgattcccttccagcggctgaaaggcatcgaggagggcgtggcgctgctggtggatgccctggagggcggccagcggattctcatcgtcggcgacttcgacgccgacggcgccaccgccagcagcgtcggcgtgctggccctgcgcatgctcggcgcggcctgggtcgattacctggtgccgaaccgcttcgagtacggctacggcctgaccccggagatcgtcggcgtggccctggagaagcgtcccgacctgctggtgacggtggacaacggcatctccagcgtggacggcgtccaggcggcgaaagccgcggggctcaaggtgctggtcaccgaccaccacctgcctggcccggaactgccggcggcggatgcgatcatcaaccccaaccagccgggctgcgaattccccagcaaggccatggccggggtcggggtgatcttctatgtgatgctggcgttgcgggcgcgcctgcgcgagctggactggttcgcccggcgcgggctgaaggaaccgaacctcgccgagctgctcgacttggtggcgctgggcagcgtcgccgatgtggtgccgctcgatgccaacaaccgcatcctggtccaccagggcctcgcgcgcatccgcgccggccgcgcccggccgggcttgcgcgcgctgctggaggtggccgggcggcctccggtacggatcacctccaccgacctgggtttcatcctcggtccgcgcctgaacgcggcgggtcggctcgacgacatgtccctcggcatcgaatgcctgctctgcgacgacgaagcgctggcccgcgacatggcggtgcagctcgaccagttgaaccaggaccgcaaggccatcgagcagggtatgcagcgcgaggcgctggcgcagctcaaggagctgagcctggagcaactgccgttcggcttgtgcctgttcgacgccgactggcaccagggcgtgatcggaatcctcgcctcgcgcctgaaggagcgttaccaccggccgaccatcgccttcgccgatgccggcgacggcagcctgaaaggctcggcacggtcgattcccggcttccacatccgcgacgcgctggacgcggtagccgcccgtcatcccgggctgatcagcaagttcggcggccacgcgatggctgccggactatcgttgccgcaggaaaacttcggcgctttctccgccgccttcgatgccgaagtacgccgccaactggccgaggaggacctggccgggcgcctgctctccgatggccagttgagcatccaggagttccacctggagttggcgcgcgcgttgcgccaggccggtccctggggccagcactttcccgagccgatgttccacggggtgttccagctggtgcagcagcggatcgtcggcgagcgtcacctgaagctggtgctgaaaagcgaatgcggctcgctgcaactggatggcattgccttcaacatcgaccgcgagcagtggcccaaccctaccgtgcgctgggccgagctggcctacaagctcgacgtcaacgaattccgcggccaggaaagcgtgcaactgatgatcgtccacatggctcctcgctgaacgcgccacggggccacgggcaacctagctgccccctgcttttctgttag

SEQ ID NO: 1640 - DNA, 372 bp, Pseudomonas aeruginosa
cagcgatgtcgccctgctggccaatatcctggtcctggcgacacgcaacatgaacaacatgaccaccatgctggcgcacctttcggtggagctcagccagagcgaagagccacgcctgcaacgggtcggtcatcgggtcctgaacgaactctcggagctgggggccgccctggagacccagtgggacctgatcggcgcgctggcgcgtttctcacccctgctcgaacgtaccctgccgcgccaggaacccctggtcaccgagatccacctcaccgaactgccgggccaggcgctgccgccctccgcctgatcggcgcgtcgctcagccctgcgcggggcgctgcgacaggtgttccaggtagcaggcgatga

SEQ ID NO: 1641 - DNA, 567 bp, Pseudomonas aeruginosa
cggcaagagctacgattacctgggcaccccggccaacggcctggtcgcgttccgcgagaagtacgacagcccctgtggctacctcgactaccagggcaaggtggcgatcgccgcccagttcgccggttgcggcgccttcggcaagcagggcgggctggcccagcagcgcatggaagatggctcgtcgggcaagtacggcctgatcgatcgcagcggcgcctggaaggtgcagccgcagtacgattcggccgacagcgccggcctcaccgcgcttggctacaccgtcgacgtgcccggcctggctgccgtcggcgtgagcaccggcctgttcagcgccgacttcggcatcttcaacctcgacgaaggcagcgagtgggtgaagccgggttatgcgcagatcggcgcgctgggcaacgacctgttcgtcgtggcgaagaagggcgggccgcagaagaccgtcagcttcatgggttcggaaagccaggtgccggtggtgggcctgatggaccgcagcggcaagatgctgctggagccgggcgaactgatcagcatccagtctgcgtatga

SEQ ID NO: 1642 - DNA, 1332 bp, Pseudomonas aeruginosa
gaaatttcctatgtgttttccctaggttatttcgaggggaggccgagaaacatagggtctttgaacggctttcgtggagtaggggttgaaatcgctgtcagtacatttctgtcagtcttgctggacatcggaagggcgcgacggcagcgcgggttccgctgccgtcgccgtccttcaacccagttcgcggactgcccgcaccgcctggtcgatggcggcatgggcgtaggcatcccaggccgcatccgagttggcgatggcgacattgccgaccttgcttcgcgccagttccatcagcgcttcgctttccgcctcgtcgtcgtagagggtattcatgaagtaggagtagccgtgcgaccagcggttcacggtgatgccggtgatgtcgcggcggtggtcgaaacccgccgggccgagcatggcctggagctggtcgcggatgtccttttccagttgctcgaagctcatcgcgtagagcttgctgcggcctacgcgagcctgggtgcgggcgtccatgccggcgttcggggtggtcggcacgtagaccatgtgcacgccgatcggctgccgcgggtcgcgtggatgccggtagctgccgaggtcgaccgggaagtccagcttgatccgcgagtagggcagggtcggcgcgtaaatctcgtggatgccgagggtcttccaggcctgccagttgcgcagcaataccttggtgtacaccagcgggaacttgacgttctggctcagcgcgtgggcctgctcctcggagaggtcgcgcagcaggtacggcaccatcatgttgtagcaggccatcacgcagtgcttgccgcgtacccggtgcaggcggccggtgcggctgtagccgacatcgacgccgccggcgcggttgcgcacgctgacggcggtgctgttcaggcgcaggcgcaccgggtgcccggcgaggtccagcttcgagtagtcgaagcgggccatgacgatgtcctccatgcctcggcccggcgccaccgcggggatcaggtcgcgcaccatgagccgagccagcgaggcgttgccgtcggggaaatggtagatgtacggctcgtccatttccgcctgggcctcctcgctgggttgcggcaggccgagggcgtcgaagccgggaaagccggcggcgtatgcgtcggccgccggcagggcgtcggcgccgagggcagagaagtcgttgctgcggccctggaagtacttcaccgaggtttccgagagcccgacgttcttgagcaggtagtcgcggtagctggtcttcgccaggtaggtttccttctcttccacgctcttgccggcaagatagtcgcgaggtga

SEQ ID NO: 1643 - DNA, 828 bp, Pseudomonas aeruginosa
catgtgtcgcgctttgccacggtgtccggggaggccggcaatatctcgaagcaaactcccggcgggcagcgcggacgcgaagggctagagtcggtcgaatccggttgttaccgaacgtcctggaggttcctcatgaatacccgtggtttgctcgaccaattgctcaagtccgggcaggaaatgttgcagaacaagtccggcggcaagcccggcgccagcggcggcggacagctcggcagcctgctttccggcgccggcggcggagccctggcggccggcgccatcggcctgctgctgggaaacaagaaggcgcgcaagttcggcggcaaggcgatcacctacggcggcctcgccgcgctcggggtgatcgcctacaaggcctacaacaactggcagcagcaacagaacggcgccgcgccgcaggcgcagccgcagaccgtcgaccgcctgccggaagcccaggccgaagtgcatagccacgcgatcctccaggccatcgtcggtgcggccaaggccgacggccacatcgacgagcgcgaacggcagatgatcgaaggcgaggtggccaagctgaccagcgaccgcgaggtgcagggctggctggagcgcgagctgaacaagccgctggacccggccgagatcgcccgtgccgcgagcaccccggagatcgccgcggagatgtacctggccagcctgctgatggtcgacgaggaaagcttcatggagcgctcctacctcgaggagctggcgcggcagctgcgcctggagccctcgttcaagctggagctggagaaccaggccagacaggcgctgcaacgcctggcctga

SEQ ID NO: 1644 - DNA, 1758 bp, Pseudomonas aeruginosa
acgactagcctcaagccgttcgagacttgccggtcatccgcaggtccgacggcccatcacaagaacgacaagacgaggctcgccatgcccgaggtactggatacctacgactacctcatcgttggcgccggacctgccggctgcctgctggccaaccggctttccgccgaccctgccaaccgtgtcctgttgctggaagccggcggcccggacaactatccctggatccacattcccgtcggctacctctactgcatcggcaacccgcgtaccgactggtgcttcgacaccgacgaggtccccgggctcaacggtcgttccctgaagtacccgcgcggcaaggtgctcggaggatgctcctcgatcaatggcatgatctacatgcgtggccaggcccgcgactacgaccagtgggtggccgaaggcaatccgggctggagctggagagagctgctgccgctgttccgcaggatggaggaccatttcgccgggaccagcgaaatgcacggcgccggcggcgaatggcgggtagaacgccagcggctctcctggaagctgctcgatgccttccagcaggcggcggcgcagaccggcatcgccagcgtcgaggatttcaacggtggcgacaacgaaggctgcggctacttccaggtcaaccagcgcggcggggtgcgctggaatgcctcgaaaggcttcctgcgcggcatcgcccagcgcgccaacctgacggttctgacccatgccgaagtccagcgagtgctcctcgaggacggccgcgccagggccctgtcggtccgttggcagggccgcgaacagcgctttgaggcgcgccgcgagatcgtcctgagcgccggcgcgatcggttcgccgtgcctgctgcaacgctccgggatcggcccgcgggacctgctggagcagctcggcgccggggtcgtccacgagttgcccggggtcggtggcaatctccaggatcacctgcagctgcgcatgatctacaaggtcgacggcgttcccaccctcaaccagatcgccggcagcctatggggcaagctgggcatgggtctgcgctacctggcgagccgcagcgggccgttgtcgatggcgccgagccaactgggcgccttcgcccgctccgatccgcagcagccctcggccaacctcgaataccacgtccagccgctctcgctggatcgcttcggcgagccgctgcatgccttccctgcgttcaccgcgtcggtctgcgacctgcgtccgcacagccggggaacggtgcgcatccgctcgctcgacccgggcgaggcgccgtcgatccagcccaactacctgagcgatccgcgcgacctgaaggtcgccgccgacgccatacgcctgacccgccgcatcgccgccgcaccggcgctggccgccttccgtccgcaggaatacaagcccggcccggaataccgcagcgaagaggatctgcagcgcgctgcggcggagatcggcaccaccatcttccaccctgccggcacctgccgcatgggccaggggccgcaagcggtggtggatgcgcaattgagggtgcacggaatccccggcctgcgcatcgccgatgcctcgatcatgcccagcctgacctccggcaacacctgttcgccggtgctggtgatcgccgagaaggcggcgcagatgattctcgccgagcgccgccgcgaggccgcgccgcaggtcgtcgaaagcgccatggcggccggcggcaaggaggcggtggaggcctga

SEQ ID NO: 1645 - DNA, 1674 bp, Pseudomonas aeruginosa
aaacggaaatggcagacaacaataagagcccccacaaggggcgggagagccgcaatgaccgagtacgcaacgaccccttcctacacagtgcctgcgaccacgccccagggggagcgcaaggtgatcttcgcctcctcgctgggcacggtcttcgagtggtacgacttcttcctctacggcgccctggcggcggtgatcagcaagcagttcttcgccggcgtcaacgacaccacggccttcatcttcgccctgatggccttcgccgccggcttcctggtgcggcccttcggcgcgctggtgttcggccgcatgggcgacatgatcgggcgcaagtacaccttcctggtgaccatcctgttgatggggttgtcgaccttcgctgtcggcctgctgcccacctatgcctcgatcggggtcgccgcgccgatcatcctggtcaccttgcgcatgctccagggcctggccctgggcggcgagtacggcggcgcggcgatctatgtcgccgagcacgccccggcgaacaagcgcggtagctacaccagttggatccagtccaccgcgaccctcggcctgttgctctcgctgctggtgatcctggcctgtcgccagttgaccggcgacgagttcgagacctggggctggcgcctgccattcctgctgtccatcgtcctgctgggcatctccacctggatccgcctgtccatgcgcgagtcgccagcgttcctcaagatgaaggccgagggcaaggtcagcaaggcgccgctgcgcgagtccttcacccagtggggcaacctgaaggtggtgctgaccgcgctgttcagcatcaatgccggccaggcggtgaccttctacacggcgcagttctacgtgctgttcttccttacccaggtgctcaaggtcgatggcggcaccgccaacggtctgctgatcgtcgccctggtgcttggcgcgccgttcttcatcgtcgccggctggctgtccgaccgcatcggccgcaagccggtgctgctggccggcctgttgctcgccacgctgttctacttcccgctgttcaagggcctgacccactacgccaacccggccatcgaccaggccagccggcagtcgccgatcagcgtggtggccgacccggcgacctgcactttccagttcgacccggtaggcaaggcgaccttcgacagcccctgcgacaaggtcaagaccttcctggtcaaggccggcctgccctactcgacggtggcggcgcccgccggcagcgacgtcagggtgcggatcggcgagaccgagatcgccggcttcgacgccgaagcgatggcggccgcggtgaagacggcaggctatccgcagcaggccgacggcagccaggtgaacaagccgatggtgatcgccatcatcttcgccctggtactgatctccaccctctgctatggcccgctggcggcgctgatggtcgaactgttcccgacccgcatccgctattcctcgctgtccctgccgtaccatatcggcaacggctggttcggcggcttcctgcccacggtctcgttcgccctggtggtgtacaccggcgacatcttctacggcctctggtatccggtgctgatcaccggcggtagcctggtctgcgccttgctgttcctccgcgaaacccgccataccgacatccaccggtga

SEQ ID NO: 1646 - DNA, 843 bp, Pseudomonas aeruginosa
cgaattcggcgccatcgagaccggtttcaacggcatggccgaagagctcaagggcctggtgtcgcaggcccagcgttcttcggtgcaggtcaccacctcagtcaccgagatcgccgcgacctccaagcagcagcaggccaccgccaccgaaaccgccgcgaccaccacggagatcggcgccacttctcgcgagatcgccgccacctcgcgcgacctggtgcggaccatgagcgaagtctccggcgccgccgagcagacgtcgaccctggccggttccggccagttgggcctggcgcgcatggaggaaaccatgcaccacgtgatgggcgcggccgacctggtcaacgccaagctggcgatcctcaacgagaaggccggcaacatcaaccaggtggtcaccaccatcgtcaaggtcgccgaccagaccaacctgctctcgctgaacgccgccatcgaggcggagaaagccggcgagtacggccgcgggttcgccgtggtggccaccgaggtgcgccggctggcggaccagaccgcggtcgccacctacgacatcgagcagatggtgcgcgagatccagtcggcggtatcggccggggtgatgggcatggacaagttctccgaggaggtccgccgcggtatcgccgaggtcggccaggtcggcgagcaactgtcgcagatcattcagcaggtgcaggcgctggcgccgcgggtgcagatggtcaacgagggtatgcaggcccaggctaccggtgccgagcagatcaaccaggcgctggtgcaactgggcgaggccaccgggcagaccgtggagtcgctgcgccaggccagcttcgccatcgatga

SEQ ID NO: 1647 - DNA, 1479 bp, Pseudomonas aeruginosa
tcctcgaacaggccaccgataccctgcgctgcgaaccgtcggcgttccgcgactatggcctggacaacggcggggcccgctatctcggtccggtctatgaaggaccacggggactggtgcaatgggtgcgggtcgaggcattgctgcccgacgaagtgcgcgccctgctgttcccgccggagtgcggcgaggggacggcatgaacgatcgcttcgaacgcctgctcaagagcaggatcggcctggatgccagctcggtgggcagcgcggtgatcgagcgcgcggtacgccagcgcatgagcggcctcgcgctgcacgacgaggacgaatactggatgcgcctgaacggctcgccgggcgaggtgcaggcgctgatcgaagcggtggtggtgccggagacctggttcttccgctacccggagtcgttcaccaccctcgccaggctggccttcgagcgcctgccgagcctgggcggcggacgcgcgctaaggatcctcagcctgccctgttccaccggcgaggagccgtattccatcgtcatggccttgctcgatgccgggctctccgagtacctgttcgaggtcgacgccctcgacgtcagcgctcgggtgatcgagcgcgccagcctcggggtgtacggcaggaattccttccgcggcgacgaactggggtttcgcgaccgccatttcagcgaggttgccgagggctaccagttggccgagcaggttcgccgcaaggtgcgcttccgctgcggcaatttgctcgatcccgggctactggcgggcgaggcaccctacgatttcgtgttctgtcgcaacctgctgatctatttcgaccgcccgacccagagcgaggtggtcgaggtgctcaagcgcctgttgcggccggacggcgcgatgttcatcggaccagccgaggcgagcctgctcagccagcatggcatgcagccgatcggcgtgccgctgtctttcgtgttccgccggaccagcgaggcgccccgcggcgcgcggcccaaggcggtgagcgacggagcgcgcccggtggttgccgccgccgtggagcgtgcgagtattcggccttcgccgccgccaccggcgaaaccgcgccagcggctgtccagcctggttccaccagccagcggccagcccctcgccagtcccgtcggcgagttcgacgaaatcgcccgcctggcggatgccggccagcaccgcgaggcgcgcgccgcctgcgagcgccaactggccgcgcgtgggccgtcggccacggtcttctactggctcgggctgctcagcgatgtcgccgggcaggagcaggaagcccaggatttctaccgcaaggccctgtacctggagccgcagcacgccgaggcgctggcgcacctggcggcgctgctcgccgctcgcggcgaccatgccggcgcccggcgcctgcagcaacgtgcggcccgtggagtgaacaaagatggttgaggcgagcctga

SEQ ID NO: 1648 - DNA, 1194 bp, Pseudomonas aeruginosa
cgcggagcctggcatgaccccggaccagatgagagacgcgtcgctgctcgagctgttccggctcgaggcggaggcccagacccaggtgctcaacgccggcctgatggcgctggagcgcagcccgacccaggccgaccaactggaagcctgcatgcgcgccgcgcactcgctgaaaggcgcggcgcgtatcgtcgggctggacgccggcgtgcgcgtggcgcacgtcatggaggattgcctggtggaggcgcaggacggacgcctgctcctgcaatcggaacatatcgatgcgttgctccagggctgcgacctgttgctgcgtatcggcaccccgccagccggcgacgcaggctgggccgaaggcgccgggcgggaagagatcgacggcctggtgctgcgcctcgaaggcctggtgcgcagcggcctgccgctggcccgcgcggagctgccggcgacgactcccggtctgccggaagcggtccccgaggcgccgccagcggcgtcagcggccgccagcgacgacaacgacgaggagcccgccgggcaggcgggcggcgaacaggccgaggagcgccgcagccgggtcctgcgggtcaccgccgaacgcctggaccggctgctggatatctccagcaagtcgctggtggagttccagcgcatcaagccgctggccgattccctgcaacgcctgcgtcgcctgcagtccagcgccagccgcgcgctcgacgtggtacgcgagacggtccaggaaaccgccctcgacccgcaggcccaggccatgctcggcgaggcgcggcaactgattggcgaatgccagcagatgctggtgcagcacatcgccgatctcgacgagttcgcctggcagggcggccagcgtgcccatgtgctctacgacgcggcgcctggcctcgcggatgcggccattcgccgacgtccttagcggccaggcgcggatggttcgcgacctgggccgctcgctgggcaagcaggtgcgcctgctggtcgagggcgaaagcacccaggtcgaccgggatgtcctggaaaaactcgaagcgccgctcacccacctgctacgcaatgccgtcgatcacggtatcgaggcgccggaaacccgcctcgccgccggcaagccggccgagggcaggatcaccatccgcgcccgccaccacgccggcatgctggtcctggaactga

SEQ ID NO: 1649 - DNA, 1119 bp, Pseudomonas aeruginosa
gcgccggcgcccgccgcggcggtgcgtggaacagcattcaatttgatacgaggggccccggtcccggagagaaacatgcacaaccctcatgagagcaagaccgacctgggcgcccctctggacggcgcggtcatggtactgcttgtcgatgatcaggccatgatcggagaggctgtgcgtcgctcgctggcgagcgaggcgggcatcgacttccacttctgttccgatccgcagcaggcggtggcggtggccaaccagatcaagccgacggtgatcctccaggacctggtgatgcccggcgtcgacggcctcacgctgctcgctgcctaccgcggcaacccggcgacccgcgacatcccgatcatcgtcctgtcgaccaaggaagagccgacggtgaagagcgcggcgttcgccgccggcgccaacgactacctggtcaagctgccggacgccatcgagctggtggcgcggatccgctaccactcgcgttcgtacatcgccctgcagcaacgcgacgaggcctatcgggcgctgcgcgagagccagcagcagttgctggagaccaacctggtgctgcagcggctgatgaactccgacggcctgaccgggctctccaaccgtcgtcacttcgacgaatacctggagatggagtggcgccgctcgctgcgcgagcagtcgcaactgtcgctgctgatgatcgacgtggactatttcaagagctacaacgacaccttcggccacgtcgccggcgacgaggccctgcgccaggtcgccggggccatccgcgagggctgcagtcgctcctcggacctggcggctcggtacggcggcgaggagttcgccatggtcctcccgggcacctcgccgggcggcgcacggttgctggcggagaaggtccggcgcacggtggagagcctgcagatcagccacgaccagccacgcccgggctcgcacctgaccgtcagcatcggcgtcagcaccctggtgccgggcggcggcgggcaaaccttccgggttctcatcgagatggccgaccaggcgctctaccaggccaagaacaatggccgcaaccaggtgggcctgatggaacagccggtgccgccggccccggcgggctga

SEQ ID NO: 1650 - DNA, 1176 bp, Pseudomonas aeruginosa
aggccggcgtactgcctgtggggcgcaagtgcagtatacttcgcagcttttcgacgttttcccgcgagtgagcgccagccatggaaatcaacccgatcctcaacagcatcaaggacctctccgagcgcacccagaccattcgggggtatctttgactacgatcagaagcatgatcgcctggtcgaagtaaaccgcgagctcgaagaccccaacgtctggaacaaccccgaatacgcccagaacctcggccgcgagcgcgcccagctggcgcaggtggtggaaaccctggacgacctgaccagcggcctggccgactcccgcgacctgctggacatggcggtcgaggaagacgacgagggcgccgtcgacgacgttgccaacgaagtcgagcgtctgcgcgagatcctcgagaagctggagttccgccgcatgttcagcggcgagatggacccgaacaacgcctacctggacatccaggccggctccggcggcaccgaggcccaggactgggccaacatgctgctgcgcatgtacctgcgctgggccgacaagcacggcttcgacgccactatcatcgagctgtccgagggcgaggtcgccggcatcaagggcgccaccgtgcacatcaagggcgagtacgccttcggctggctgcgcaccgagatcggcgtgcaccgcctggtgcgcaagagtccgttcgactccggcaaccgtcgccacacctcgttcaccgcggtgttcgtatcgccggaaatcgacgacaacatcgagatcgagatcaacccggccgacctgcgcatcgatacctaccgctcctccggcgcgggcggtcagcacgtgaacaccaccgattcggcggtgcggatcacccacgtgccgaccaataccgtggtggcgtgccagaacgaacgctcccagcacgccaacaaggacaccgcgatgaagatgctgcgggccaagttgtacgagctggaaatgcagaagcgtaccgccgcgtcccaggccctggaggactccaagtccgacatcggctggggccaccagatccgctcctacgtgctcgaccagtcgcggatcaaggacctgcgtaccggtatcgagcgcagcgactgcgacaaggtgctcgacggcgatctagacgaatacctcgaagccagcctcaaacaggggctgtaa

SEQ ID NO: 1651 - DNA, 1524 bp, Pseudomonas aeruginosa
ccaggaaccaccaagaccatgagcgaccaacaactcgaccagcacgaactgcaacaggaagaaaacaagctgatcgcccagcgcaaggaaaaacttgccgccgtgcgcgaagcccgggccatcgccttccccaacgacttccgccgcgacgcctacttcgcggacctgcagaaacagtacgccgacaagaccaaggaagagctggaagccgcagcgatcccggtcaaggtggccggtcggatcatgctcaaccgcggttccttcatcgtcctccaggacagcagcgagcgcctgcaggtctacgtcaaccgcaagaccctgccggaagaaaccctggccgagatcaagacctgggacctgggcgacatcatcggcgccgaaggcgtgctggcccgctcgggcaagggcgacctgtacgtcgacatgaccagcgtgcgcctgctgaccaagtcgctgcgtccgctgccggacaagcaccatggcctgaccgacaccgagcagcgctaccgccagcgctacgtcgacctgatggtcaacgaggaaacccgccacaccttccgcgtgcgttcccaggtcatcgcccacatccgccgtttcctcagcgagcgcggtttcctcgaagtggagaccccgatgctgcagaccatccccggcggcgccgcggccaagccgttcgagacccatcacaacgcgctggacatggccatgttcctgcgcatcgccccggagctgtacctcaagcgcctggtggtcggcggtttcgagaaggtcttcgagatcaaccgcaacttccgtaacgaaggcgtctcgacccggcacaaccccgagttcaccatgctcgagttctaccaggcctacgccgactacgaagacaacatggacctgaccgaggaactgttccgcgaactggcccaggcggtactcggtaccaccgacgtgccctacggcgacaaggtcttccacttcggcgagccgttcgtgcgcctgtcggtgttcgattcgatcctcaagtacaacccggagatcaccgccgccgacctcaacgacgtcgagaaggcgcgggccatcgccaagaaggccggcgccaaggtcctcggccacgaaggcctgggcaagctgcaggtgatgattttcgaggaactggtggagcacaagctggagcagccgcacttcatcacccgctaccccttcgaggtttcgccgctggcccgccgcaacgacgaagacccgagcgtcaccgaccgcttcgagctgttcatcggcggccgcgagatcgccaatgcctattccgagctgaacgacgccgaggaccaggccgagcgcttcatgttgcaggtcaaggagaaggacgccggcgacgacgaggcgatgcactacgacgccgacttcatcaatgccctggaatacggcatgccgccgaccgccggcgaaggcatcggcatcgaccgcctggtgatgctgctgaccaactcgccgtcgatccgcgacgtgatcctgttcccgcacatgcgcccgcaggcctga

SEQ ID NO: 1652 - DNA, 780 bp, Pseudomonas aeruginosa
cggccgattgattccacgcgaaaaagtccgaacaatgccccatcgtccgcgagcggaggaaacaccgtgtcccgagtagctcccagagacagcgccgcgcaggccgccagcgcggtagccgaaagcgttcgttaccagggccgcaaggccagccgccagggcagcgagcagcggcgccaggcgattctcgatgccgccatgcgcctgatcgtccgcgacggcgtacgggccgtgcgccaccgcgcggtggccgccgaggcccaggtgccgttgtcggccaccacctactacttcaaggacatcgacgatctcatcaccgacaccttcgccctcttcgtcgagcgcaacgcagaggcgctgtcggcgttctggagcagcgtggagggcgacctccaggagatggccgcggtgctggccgacgaccccggcgcccgtggctcgctggtggaacggatcgtcgagcttgccgtgcagtatgtccaggtccagctcaccgagcgccgcgagcacctgctggccgagcaggccttccgccaggaggcgttgctcaacccgcgcctgcgcgaactggccgatgcccaccagcggattctctccctcggcgccgtgcatttcttccaagtgctcggttccgggcagcccgagcaggacgccaaggtgttgacgtcgattattctgcagatggaatatcagggcctcgtggacggggtcgagcaactggccgtggacgaaatgcgcgccatactcagacggtacctgaatctggtcatgggcctgtga

SEQ ID NO: 1653 - DNA, 648 bp, Pseudomonas aeruginosa
cctgagcgtcaaccccgccatggcggggtttttcatacccgaaccttccctcggccagccggtcgcaggttgcggagggttcctaaggagcgtgtgatgaaagcctggcgttgcctggtggtcctgagtttcctgctgttgggcggttgcctggtcaccttcaaggagccgataccgccgcgcgaggcggcgccgagccatctgctcgggacctggagccgcgagaacgagtggaaggaagaacaattcctggagatcacccgttccggcagcaatgtctaccgtgcgctcagctacgtggacagcaaggacaataccgagagcctggaagactacggcttcaccgtctcccaccagggcaagcgctggtacctgtcggccggcctgccgaagagcctgggcggcaacttcatcatcgccggcttcgagatcaccgacggtgacgagctggtgatctacaacctcgacgtcgagcgcatcgtcgaggacctcggcgccggccagctcgacggcgagaccgtcgacagcgatcagggcaagggcgcgctggtgcgcagcccgttggcgaaggtcttcgcctacctgaacgatcccgccaattccgacgtgttcgtcgaggccgcccgcttccagcgggtcacccaatga

SEQ ID NO: 1654 - DNA, 1986 bp, Pseudomonas aeruginosa
agggcttcatcctcatctacaactacatccagctcgccgtgcgcaagggcaagctcgaacagatccccctgctgttctgcggcaagaccaccctggaagacatgcgcaccctgcgccaactggtggacgagggcctggtggcgccgccgaagtacctgccgccgcagttccgcgacctcaacgcgctgtcggcctggatgtgcttctcgaacttcctcaaccacctcagcctggaccgcatcgaagcggactacgcgaacatcctctgaccgttccccgccgtgccggtctttcccggtgcgcgcgggcggtcggccggcaagcaaggagaacggcgatggccagccacgaactcgactaccgcatcctcggcgaatccatgcagaccgtggagatcgaactcgaccccggggaaaccgtgatcgccgaggccggggcgatgaactacatgaccggcgacatccgcttcaccgcgcggatgggcgacggctccgacggcagcctgctgggcaagctgtggagcgccggcaagcgcaagctcggtggcgagtcggtgttcatgacccacttcaccaacgaaggccagggcaagcagcacgtggcctttgccgcgccctatccgggcagcgtggtggcggtggacctggacgatgtcggcgggcgcctgttctgccagaaggactcgttcctctgcgcagcctatggcacccgggtcggcatcgccttcaccaagcgcctgggcgccggtttcttcggcggcgagggcttcatcctgcagaagctcgagggcgatggcctggtcttcgtccacgccggcggcacgctgatccgccgccagttgaatggcgagacgctgcgggtcgacaccggttgcctggtggccttcaccgacggcatcgactacgacgtgcaactggccggcggcctgaagagcatgctgttcggcggcgaaggattgctgctgaccaccctcaagggcagcggcaccgtctggctgcagagcctgccgttctcgcgcctggccgggcgcatctacgacgccacctttcgcgcccgcgaagaggtaaggaccaacaacggatgaagcgcctgctgatcccgctgctggtactcggcgcgctgttcctcggtggctgcagttcgctgctgttctatcccgagccggtggtgcagatcactccggcgcgcgccgggctggagtaccgcgacgtcaccctgaccaccgccgacggcgtgcgcctgcgcgcctggtggctgccggcgaagaaaggcgtgccggtgaaaggcaccgtgctctacctgcacggcaacggcggcaacctgtcctggcacctcggcggcacgtggtggctgcccgccgagggctaccaggtgctgatgctcgactatcgcggctacggccagtcggagggccagccgggactgccggaggtctaccgcgacatcgacgcggcgttcgcctggctcgaccaggcgccggaggtgaagggcaccgagcgcgtgctgctggggcagagtctcggcggcgcgctggcgatccactacctggccgagcatccgcagcgccagggccagttcaaggcgctggtgttcgacggggtaccggcgagctaccgcggcatcgcccggcacatgctggacggttcctggctgacctggccactgcaggtgccgctgtcctggctggtgcccgacgacgacagcgccatccattcggtggcgcggctttctggcgcacccatgctgttctttcacagcatcgacgataccattgtgcccctcgagaacggcatcgccctgtaccgccaggcgcggccgccgaaggtcctgcaactgacccgaggcggccacgtgcagaccttcgccgaagcgacctggcaggaagtgatgctgcgcttcctcgacgatccccatggcttcaccggcctgcgccggctggccgaaatcccgaaccgcgaatccgcgaaacccgaaggcaatccatga

SEQ ID NO: 1655 - DNA, 1293 bp, Pseudomonas aeruginosa
aattttctgactgaacagtcggcttccggcgtggtcgcagaacgccacctctgctcactaaagcccgtcctacagggctctagtccacgaaacgcacaactgccgcagcgctccaggacggaacactcgggcagaaaaaagccccacctgagtggggctggaggaggccagtggggccttttagaaacgcttgcgcaacagtcgcagaccgttgaacaccaccagcaggctggcgcccatgtcggcgaataccgccatccacagggtgccttcgcctgccagggtaagggcgaggaacaccgccttgatgcccagggccagggtgatgttctggaccaggatcgcgtgggtggtgcgcgacagccggacgaattgcggcaacttgcgcaggtcgtcgtccatcagcgcgacgccggcggtctcgatggccgtgtcggtgcccgccgcgcccatggcgaagccgatgtcggcgcgggccagggccggcgcgtcgttgatcccgtcgccgaccatgccgacccgcgagccgtcggcctggcgcgcttccacttcacgcagcttgtcctccggcaggaggttgccgcgagctgcgtcgatgcctacctgggcagcgatggcggctgcggtgtgcgggttgtcgccggtgagcatcagggtcttcacgtccagcgcgtgcagctcgcggatcgcctcgcggctgctgtccttgaccccgtcggcgacggcgaagagggcccgcacgcgctgcggatcgcacagcgcgatgaccgtcttgccctggcgctccagggcgtccaggcgctcttccagggccggcgagcagaggcccagttcctccaccaggcgatggttgccgaggtggtagaggacgccgtcgatgcgtccgctgacgcctcgtcccggcaaggcagcgaggtcctcgaccacgcccagggcaaggccatcctcttccgctgcgttggccacggcgcgcgataccgggtggtcggaacgcgcggccaggctggcggcgagcaggcgcgcatccgtcccgtcagcctccgcgatcggcaggtagtcggtctgttgcggtttgccatgggtgatggtgccggtcttgtcgagggcgacccaggacagcttgcgcccgagttcgaggaacaccccgcccttgatcaggatgcccaggcgcgccgcggcggaaaggccgctgacgatggtcaccggggtggagatcaccagcgcgcagggacaggcgatcaccagcagcaccagggcgcggtagatccagtccagccaggcgccgccgaatag

SEQ ID NO: 1656 - DNA, 1152 bp, Pseudomonas aeruginosa
cagcggcggcagcaccgcggtggcgagggcgatgaggaataccaccggggtgtagacgcgggcgaaactgtcgacgaaacgctgggtcggtgcgcgggaaccctgggcttcctccacggcgtggatgatccgggccagggtgctgtcgtcggcgcggcgggtgacgcggtactccagcgcgccctcgccgttgatgctgccggcgaacaccggctcgccgacctccttctccaccggcaggctttcgccggtgatcggcgcctggttgacgctggagcggccgctggtcacctcgccgtcgagtgcgatgcgttcgccgggcttcacgcgcacggtggcttccagttccacttgcttggccggcagttccttccattcgccgccgaccagcacggtggcctgttccggagccagttgcagcaggccgcggatggcgttgcgcgcgcgatccagggacttcgcctcgatcaactcggcgatggcgaacagcacgctgaccatcgccgcttccggccactggccgatgagcacggcgccggtcacggcgatactcatcagggcgttgatgttcaggttacggttcttcagtgcgatccagcccttgcggtaggtcggcaggccggcgccgaggatggccagcagggcgaggccggcgaccacccagtccggcgccaggccgaaccattcgacgatctccgaggccagcgccatcgcgccggccagggccagcggccaccagggtttcgccggcgcttgcgaggggccgtcggtattttcgccggcatccagcggcaccgcttgcatgccgaggccggcgatcagcttctgcagcggctcgacgctgtcgaagcgatgctggacgcgcagcaggcgctgcatcaggttgaattccagcgactccactgccggctggcgaccgagggcgtcgcggatcaggcgttcctcggtcgggcagtccatcgcttcgatgcgcaggtcgctccagcgcaactcggcgttgccggccagggttccgatggcggccaccgccgggcgaggcgcgtggcggtgcccatgatcatgtccgtgaccgtgacagcaagtgtcggcgtgttcgtggctcatggaaacaattcccgtttgacgtgttgggtgcgattgcacaccctgtag

SEQ ID NO: 1657 - DNA, 2406 bp, Pseudomonas aeruginosa
gccaagctggtttcccacccgcagtggagacaggtcatgccggaaatcgatgcgcgcctgcgcgaggacgtccaccatctgggcgaattgctcggcgacaccatccgcgagcagtacggcccgcggttcctcgacaagatcgagctgatccgcaagggcgccaaggctgcccgccgcggttccgcggagggcgcccagcagctcaccgccaccctcgacgggctcgaggaagacgaactgctgccggtggcgcgggccttcaaccagttcctcaacctggccaatatcgccgagcaataccaccgtatccgccggcgccggccgaacgagccggaacccttcgagaacctggtgctggaggagctgctggggcgtctcaaggacgccgggcatgcccccgggcaactggctcgccagctcgccgggctggagatcgaactggtgctgaccgcccatcccaccgaggtggcgcggcgcacgctgatccagaaatacgatgcgatcaccgcgcaactggcggccaaggaccatgccgacctgctgccggaggagcgcagtcgcatccagcagcgcctgcagcggctggtggccgaggcctggcataccgacgagatccgcaaggtccggccgaccccggtggacgaggcgaaatggggcttcgcggtgatcgaacattctctctggcaggccttgccgaacgtccttcggcacgtcgacgaggtactcctgcgcagcaccggcgaacgcctgccgttgaccgccgcgccgctgcgcttcgcgtcctggatggggggcgaccgcgacggcaatcccaacgtcaccgccagcgtgacccgcgaggtcctgctgctggcgcgctggatggccgccgacctgtacctgcgcgatatcgaccgactggccgccgagctgtccatgcagcaggcctcgccgcagctgctggcgcgggtcggcgatagcgccgagccctatcgcgccctgctcaagcaattgcgcgagcgcctgcgcgtgacccgcaactggacccaccaggccctggccggcgaggtgccggccgcggagggcgtcctggagcacaaccgcgacctggtcgagccgctgcaactgtgccacgagtcgctgcacgcctgcggcatgggcgtgatcgccgatggcgcgttgctcgactgcctgcgccgcgccgccaccttcggcctgttcctggtacgcctggacgtgcgccaggactcggcccgccatgccgccgcgctgagcgagatcaccgagtacctggagctgggcagctacgacgagtgggacgagaagacccgcctggaattccttctcgaggaactgaacagccgccgccccctgctgccggcgcactaccagccttcggcggataccgccgaggtgctcgccacctgccgggcgatcgccgccgcaccaccggcgtcgctggggtcctacgtgatctcgatggccggccagccgtccgacgtgctggcggtgcaactgctgctaaaggaaagcggcgtcgactggccgatgcgcgtggtgccgctgttcgagaccctcgacgacctggacaacgccggcccctgcatggagcgcctgctgacgctgccgggctaccgttcgcggctgtccggggtgcaggaagtgatgatcggctactccgattcggccaaggacgccggtaccctcacggcggcctgggcgcagtaccgggcgcaggagaaactggtggagatctgccgccagcacgaggtcgagttgctgctcttccacggccgcggcggtactgtcggtcgcggcggcgggccggcccacgcggcgatcctgtcgcagccgccgggttcggtggccgggcgcttccgggtcaccgaacagggcgagatgatccgcttcaagttcggtctgccggacatcgccgaacagaacctcaatctctacctcgccgcggtgctggaagcgaccctgatgccgccgccggctcccgagccggcctggcgcgcgcagatggaccgcctggcgaaggacgcgctgctggcctaccgcagggtggtgcgcgacgatccgcagttcgtcgagtatttccgcctggccacgcccgagcaggaactgggtcgcctgccgctgggcagccgcccggccaagcgccgcgaaggcggggtggagagcctgcgggcgattccctggatcttcgcctggacccagacgcgcctgatgctgccggcatggcttggctgggagaccgccttgctgaacgccatcgagcgtggcgagggcgcgctgctcgggcagatgcgcgagcgatggccgttcttcaccacccgcatcgacatgctggaaatggtcctggccaaggccgacgcggatatcgcgcggctctacgacgaacgtctagttgtgaagctccaatag

SEQ ID NO: 1658 - DNA, 354 bp, Pseudomonas aeruginosa
gagactggaagtcgccaaacacccaatccactcaggacgcccaaccggatgaacacccataagcatgcccgacttacctttgcccgccgactcgagatggtcaagcagatgacgctggaaggcttggatgccgtgcgagccgcagccgcgcacggcgtcactgcgccaacggccaggaagtggctcggtcgttacctggccggtggccaagccgccttggccgatgcctcttccaggccgctgcgatcgcccagggccatcgatgcgggcaaggctttgctcatcgtcgagctgcgcaaacgtccaatgctgcaggctcgcatcgcacgcagtgtgggcgtctccgaattcaac

SEQ ID NO: 1659 - DNA, 450 bp, Pseudomonas aeruginosa
agactgtccgtgcccatcgatgatcacgcaaggttggcgttcaccgccatgcatcccgatgagaagacggcgcaggcggtcctgttcctgcgcaatgccgtggcctattacgcccgcctgggcatcaccgtgcagcgactgctgacggacaacggcgcggcgttccgctcgcgtgagttcaggtcaacctgcgtcgagctgggcatcaagcacaacttcacgcgaccctatcgacctcaaacaaacggcaaggccgagaggttcatccagtcagcgttgcgcgagtgggcctacggctggacctaccagaactcagcccatcgaaccgatgccctggcaagctggcaacaccactacaactggcatcgcccgcacagcggcatcggcggcatcgcgcctatgtccagactcaactcgtcaagaaataacctcttgacgcttcacagctag

SEQ ID NO: 1660 - DNA, 573 bp, Pseudomonas aeruginosa
ggtgcggggcatcggcttctcgactcgtcgggcgtcaaagccgtctatgctggcggaagagcgcggcgggggaaagcccgcaagggttgcaaacgttttcacctgcggcactctgtcgcgcccggcgtttttacttttgccccgcgctcaggcataaagggcccattctccggagaaccgacgatgcccctgtcacggcgccccgtggcctggctggccagcctggccgtgctgatgaacctgttcgtggtgccgctttcgcaggcgctgacgacgcaggagcgcgcctcgttgctgctcggcggcttctgcagcacctcgtccgattcgctgctgcgcctgaagctgagcgccgcgttcaaggacatcgatcttcccgacgaccacgaaagcctggccccgcacctctgctgctgcgccggcgccgccggcacgcccggactggtcgcctcctggccggcattgccgctggcgccgctggccagcccggcccgtaacgctttctccgccaccgacctgcctcccctgcgttattggcgcctcgccaatccgcgcgcctctcctgtcgcctga

SEQ ID NO: 1661 - DNA, 540 bp, Pseudomonas aeruginosa
cttcccccatggaatcgccggtccgacggaaaaagaccggtcatacgctactggagagtcaccatgcgcacatccttcttcgctgccgcggccctgctggccgtttccgctttcgcccaggcccacgagtacagcgccggccaactgcacatcgagcatccctgggcgctggccctgccgccgacctcgccgaacggcgcggcctacttcgtggtgcagaaccatggcaaggaaaacgacaccctgcttggcgccgacacgccgcgcgcggcttccgccgaggtgcacgagcatgtgcacaagaacggcatgatgagcatgcagaaagtcgacagcgtcgacgtcgcaccaggcaaggacctgcgcttcgctcccggcggctaccacctgatgctgatgggcctgaagcagccactggtggccggcgagcgcttcccgctgacgctgcatttccgcaaggccggcgacgtgccggtggaaatcgtcgtcgagtccaaggcgccggccgaacagggcgggcacgagcagcacggccactga

SEQ ID NO: 1662 - DNA, 1821 bp, Pseudomonas aeruginosa
ggcggattctggtcccggcgcggcgtagcgagtgagtggcctgagagacaactttcgctagaatcgggccaacccgctcatacccaccgaggtgcgcatgtcccgccagtccgtggccgtggtggccttcgaccgcatcagtccgttccacctgtcggtgccctgcctggtgttcggccaggagtgctacgacccttgcgcgcaggccttcgacctgcgtgtctgcgccgccgagccgggccggctgcgaaccacggtggggttcaccatcgaggccgaggccgggctggaagcgctggccgaggcgcagaccgtgatcgtgccgagttggcgcgatccacacgagcgtccgccacaagcgctgctggatgcgttgatcgcggcccgtgcacgcggtgcgcaactggtgggcttgtgcctgggggccttcgtgctggccgaggccgggttgctcgacggtcgccgcgccaccacccactggatgtgggcggaggatttcgctgggcgcttccctgcggtgcgggtggagcccgacgtgctgtacatctaggacgacggcctgctgacctcggcaggcaccgtcgccggcatcgactgctgcctgcacctggtccgccagcggctcggtgcgcagactaccaatcacctggcccggcgcctggtggtggcgccgcatcggcagggcggccaggcccagttcatcgagcagccgctgccggacagcgcccaggacggccgtctcggcgagctgctggtgtggctgcggcagaacctcgaccaggcgcacagcctggacagcctggcacagcgggtgctgatgagccggcggaccttcacccggcatttccgccagctcaccggcaccaccgtcaaccagtggctgcaggccgaacgcctggcactggcccagcgcctgctggaaaccaccgagcattcggtgcaggcgatcgccgggctggccggcttcggttcggcggtgtcgttgcgccagcagttctccgccgcgttcggcctgccgccgctgggctaccggcgcgccttcgcctcctagtccgccagagggcgcttctgcaactgctggcgccagagcgcgtccatcgcctgcaactgcaccgggccgaacagcgcctgcgtcgcgccggtgtgccaggcccagagctggtcgccgaaatcgtagtgccaccattcgctgggcaggttgctgaaaccggcgtcgagcatcgcgtgatagagcaggcgacgatgatcgcggacgcgtcgctggcgcgcgtcgggctccgccaggcgttcgaagtaggcggtgtaggaggccggcacggcttcgtcgaaggcgctgcccatgtccagccagcggccctgggcgtcgcacagggtgacgtccaccgcgccgccggtgagatgcgggctgggcgcctcgcggctgctgctcggcggcgagacgaactggcgggtgagccgttccagctcggcttcgccggcccgtgggtagtgcgcggccagggcgctggacaggctgtcgtagagatactgctgcacggcgaacggccgccaggcgtccagcaccaccaggcgcacgccgccggggagggcggcggcgacccgcaggagacgctcgaagacctcgccgcgagcgtggcactccgggatcgcgtgaggaatgccgagcttgtggtaggccggccagacgctgaagtcacggctcagcccgagcgcctccagcggcgtgccggcatcgacgatggggatgccggccacggcgtgccagtcgggctccgggagaacggggatggcttgggtgaagtcggtcatggcgtcaattga

SEQ ID NO: 1663 - DNA, 3429 bp, Pseudomonas aeruginosa
ctcgatgcgctccagttgggcggcgatcaccgccagttggcccatgccggtgctgttgtggatcaacgccagcgactcgttgcgcagcgcgcgcatcggcaccgcgccgcggtgtccggcgagggcatggttggcggggatgatcaggtcgaggggctggcgggtgtcgacgtgcacgtccagttcgccgtcctcgaccggggcgtagaccagggccaggtcgacggcgtcttccttgaccagcgccacgccttcgttggccccggccatgcggacctccagctcgatgccggggtagcgcaggatgaagctctgcaatggctgggagatcaggtcggcgatgaagccctcgccgaccgccaggcgcaccttgccctggcgcagcccctgcagggccgacagacgcgacagcacgccctcttcgttggcccgttgctggcggtagtgcgccaccagcagttcgccggcctcggtaggcgccacgccctgcggggtgcgttgcaggaggcgcacgccgagatgttcctccaggctggcgagctgccggctgatggccgaggggtcgatgttcaggtgctgggcggcgcggcgcagagaaccgtggtggatcacctcgttgaggtaggccagggcccgttggctgaggcggatcatcgcggctcagtccagcagcgacagggtcaccggcgtccggtggttgtcctcgacccgcacctccagttcgccttccgcgaggcgcgccttcaggcgctgtcccggctgggtctggccggcatcgcggatcgcccggccacgctcgtcgaggaggatgctgtagccgcggcccagggtcgccagcgggctgaccacgttgagcgtctgcgccagtccttcgaggcgctgacgacgatccttcagtacctcgcgggcggcgcgcggcaggcgcgcggcgaggctgtcgagcttctgccggagcagcgccagggtgcggcccggatgctgtgcggcgagacgcgtctccaggcggaccaggcgttcgtggcggaccgccagctggcgctcgaaggcacggcgcaggcgcatgtccaggtcgtccaggcgctgcgcctgctggcgcaggcgttcgccgggatggcgcaggcggcgggcgacgccttccaggcgcaggcgttcgcgcagcaactggtcgcgcatgcgcagcaccaggcgccggcgcaggccgtcgagacgctgctgcaggtcgccggcgttgggcgccagcagttcggcggcggccgaaggcgtcggcgcgcgcacgtcggcgacgaagtcgctgatcgatacgtcggtctcgtggccgaccgcgctgacgatcggcgtggcgcaggccgccacggcgcgcgccaccgcttcttcgttgaagcaccagaggtcttccagggaaccgccgccacgggccaggatcagcgcgtcgaagccctgccggtcggccagttgcagcgcgcggacgatctgtgcgacggcctcgcggccctggactgcggtgggcaccagggtcagctcgacctgcggtgctcggcggcgaaacacgctgatgatgtcgcggatcaccgccccgctgggcgaactgacgataccgatgcggcgcggatgggcgggcagcggacgcttgcgttcgctggcgaacaggccttcgccggcgagtttttccttcaatgcctcgaaggccaggcgcagggcgccgtcgccggccggctcgacggtatcggcgatcaactggtagtcgccgcgtccctcgaacagcgagatcttcccgcgcacctttaccgccagcccgtcgcgcaaggcctggcgtacgcgcagggcgttctgccggaacagcgcgcagcggatctgcgcgttgctgtccttgagggtgaagtagacatggccggaggccggccgggcgaggttggacagctcgccctcgacccagacctgcgggaacacgtcttccagcagcaggcgggcgcgctggttcagttggctgacggtcagcacctcgcgatcgaggccgagccgttggaagggatcgttacgcatgggcggcatgataaggcggcgcaccgggatgtgcgatcaatccttggcttcgttcggcagattctccaggaaatattcgacgaagccttccaccagggggctatcgtcgcgtcgccaggccagcgccacctcgctgtatgcctcggcctcggccagagacatgaagctcacggcgggcggtgcgatggcgcgcatcgaggcgggcaccagggcgacgccgaagccggcctcgatcagttgcaactggctggtcttgcgcgacagcgcgcgcgccgggcgtgggtagaaaccggcgccgaggcagagttcggcggcgcgatagctgaggccgccgcgttgcaggtggggaatggagacgaaggtttctccggccagggcggccaaggccacgggggcttcacggcgggccagcggatggtcggcggcgagagccaggagcaacggctcgcggtacagggcgcgcaggtgcagccggggatgctggcgcagcaccggcaggcgcagcaggccaaggtccaggcgtccttcggcgagatcggcgagttgctgctcggaggattgctgggtcagttccaggcggacgccgctctgcaccgcgaggtagccgcgcagcgccgcttgcaggccgcccaccagcggcaccgagctggagtgccccaggcgcagcaggccatggccgccttcgccgacctcgcgagccaggcgccgggcggcctccaggtcgccgagcaggcgctgcgcgcgtggcaggaaggcgcgaccggccggcgtcagctcgacctggcgcggaccgcggcggagcagtggggtgccgatgctgtcctccagttcgcgcacctgccggctgagcgccgactgggcgacgaacaggcgttcggcggcacggctgaagccgccggactcgacgatttcgacgaagtaatggagttgccgcaaagagatcatcggaagattccccatgccttttcgagatggctacagggctcggattgtattggctggcgcgccgttgcgctcgctagagtgcgcaggtcgtcgttccgggagtcgccatgtcctcgctcgatccgtcagtcctgttcgccgccctgccgttcagcctatggcaatggctgctggtcgaactggccatcgtcctcgcctatgtggtgttcggcatcgccggcttcggcaccgcgctggtcgccggcccgttgctggccggggtgctgccgctgtcgcagatcattccgctgctggtcctgctggatttcagcgcgtcgttcggcaactggctgccggcgcggcggcagatcgccgtcactgagctcaagcgtctgctgccctgcatgctgctgggctgtgcgctcggggcgtacggacttctggcgctacgcgcggagctgctga

SEQ ID NO: 1664 - DNA, 1350 bp, Pseudomonas aeruginosa
aggcacccgcgggcgctattcgacgatcaacggcaagcatgtgccgaccatcgacctgccggccgggcagatcgtccgggtgcgcctgctgaacgtcgacaacaccgtcacctaccgtctcaacctgcccaacggcgaggcgaggatctatgccatcgatggccatccggtggaaccacgcggcttcgaggggcagtactggatcggtcccgggatgcgcctggagctggcgctgaaggtgccggaagcgggcaccgagctgtccctgcgcgacgggccggtacgcctggcgacgatccgcagcgtggccagcgccgaggcacctgccggcgactggccgaagccgttgccggcgaatccggtgagcgaaccggacctggccaatgccgagaagatcggtttccgtttcgagtgggtcggggccatgtccgataccagcggcaagaatccctatccgtcgttctggcagatcaacggcaaggcctgggaaggcggcgaggagcacaagcacaacgcgccgccgctggccaagctcaaggaaggccagagctacatcttcgagctgcgcaacatggcgcagtaccagcacccgatccacctgcatgggatggccttcaaggtgctggattcggatcgccgggacatcatcccgtacttcaccgacacctacctgctgggcaagaacgagactgcccgcgtcgcgctggtggcggacaatccgggcctgtggatgttccactgccacgtcatcgaccatatggagaccggcctgatggggaccatcgcggtcggcgaggcctggtgcgggtgactaagctgatcagcaacggcaagggctacccgacggtaaaaggcgtgcgtccgatcatcgatcgcagccgggacccgcatttcatgcgcgaggccctggcagaggcggaaaaggccgcggccctcggcgaagtgccggtgggcgcggtcctggtgcgcgagggcgagatcatcgggcggggcttcaaccggccgatcagtagccacgatcccagtgcccacgccgaaatgctggcgatccgcatggcagcggcggaggcgggcaactaccggctgccaggcagcaccctgtatgtgaccctagaaccctgcagcatgtgttccggactgctggtgcacgcacgcatccagcgcctggtgtacggcacggtcgagcccaagtcgggcgcagtggaaagccgtgggcgattcttcgagcaggagcatctcaaccatagggtcatggtcgagggtggcgtgctggcggaagaatgcagccagacgctctcggcgttcttccgcgcgcggcgcgaagcggcgaagaagcctcgcgaagactga

SEQ ID NO: 1665 - DNA, 681 bp, Pseudomonas aeruginosa
ggcggcctttttcatgggatttattttatccggataatattgttgctctatttatatccgggtattattcgggcgttccatccatgggagcctgtcatggccaatgatccatacatccaatccttcacctgcttcgacggcacgcgccggctgctgacggcggcgctgccggaggtcgcgctggctttgaagcaagcgctcgccggcggtgcagccggaccgctgctggtattagacaatgccactgggcgctccgtcgatatagatatccgtggttccagcgaggaccggctggcgcgcatggtggtcgcaggcgagcggcaaccggcggaggaggccgcaccgcgcgggcgcgggcggcagaagctgggcgtggtggcgcgcgaggtgaccttgttgccgcgccactgggaatggctcgccgcgcagcccgggggcgcctcggtggcgatgcgcaagctggtcgaggaggcgcgccgcagccagtccgggcgtgcgcggcaggcgcaggagcgcgcctaccatttcatgaatgcgatggccggcgacctgccgggcttcgaggaggcgacgcgtgcgctgttcgccggggatcgcgagggcttcgccgagcggatcgccggctggccgaccgatgtgcgcgagcacgccgcctggctggcaagcgacggagaatcctga

SEQ ID NO: 1666 - DNA, 420 bp, Pseudomonas aeruginosa
tgccgcaccccgagcgggtgttccgcgccgtgcagaaattcctggcgtccggacgactggcaggaagacggcggctggctgcgcatgttcccccaacgcccgggtctgggtggactgatccggcatggcgggcgatgcggactccaactcgtcgccccgaccttcttccccgaggttcgccgggtctctcccggcgacaccttgcggctctgtacctgcggggcttcggcttcgcttcccgattgtcccgccgactgccgcaacggcctgacgctccacgcgacccgcgagcgcctgttgctgttgtgccgctgcgggcgctccgccgacctgccgtattgcgacggcagccatgcgccttccgcctccgggctgaaggccaggtggcggcgtttccgcggcctgagcgtaaatctgtga

SEQ ID NO: 1667 - DNA, 483 bp, Pseudomonas aeruginosa
acgcccgcacgaaggtgttgtgacgagcgaacaaatgttgcgcttatctgtcgtaaaggcagcgtcaaatattcatcatgtcaaggcaaagtgccattatttggcgtcggcagtcgcacaaccaccgaccgcctcgtgcagcattcgattcgtgcggagaaaacgatgtacaagctgtgtttctatgtgcctgagagccatctggatgtcgtcaagcaagcggtgttcgccgcaggtggcgggcgcatcggggcgtacgacagttgctgctggcagtcccttggccagggccagttccggcccctggacggtagccaaccctacctgggccaggtcggccaggtcgagcacgtggcggagtggaaagtggagctggtggtggccgacgagctcatccacgccagcgtcaaggcgctgaaggcggcgcatccctatgagaccccggcctacgaagtctggcgcctgaccgacatggtcttctga

SEQ ID NO: 1668 - DNA, 618 bp, Pseudomonas aeruginosa
gcgttgcgctgctcctcttcgtcgggcgcggcgcggcgctcgagaaagagaaactcggtgcgtagcaggccgaccccgtcggcaccgttggcgaaggcttcggcggcctcgcgcggcgaggcgacgttggcgccgatctcgatgcgccggccgtcgcgggtgagcgcctcgcgctgcgcatcggcctgctggcggcggcgttgttcctcgcgctgcgccacttgcaaggcgacctgctccaggcgtcgagcgtcggggctgagttccagccggccctggccggcgtccagcaccacctgccggccttcctccagctccagcagcccggcgccgagcgccaccaggcacggcaggcccttgctgcgggcgaggatggccacgtgggaggtggcgccgccttcggccatgcacaggccagccgcgccggcatccaccagcggcgcgaggtcggagggagtgatctcccgggcggcgacgatggcgccagcaggcacccgcaatggcgcggtgtcgccgagcagtacccgcagcacgcgtttttccaggtcgcgcaggtcgttggcgcgctcggccagcagcaggttgcccagcgcctggagaatctcgcactgggcctga

SEQ ID NO: 1669 - DNA, 609 bp, Pseudomonas aeruginosa
atcgcccggtgccaggcgtgggcggcgccgacgccctggtcgatcagcatgtcggcggcgtccagcagacccgggtcttccagcagcgcgagatgcgcggaaaagatcgccgcttcgttctcgtcgccgccgagcctggcctgctgcaggctcccctgtacgtcgtcgcgcacccgttgcagggcctggtccagggcgaggtgctgttcctcgggacgatgccggccgtcatccgccggcaggctgatggcgccgagccgcgccaggggaccgctggccaggccgggcgaagcgcagacgccggccagggtaccggcgacagccgcaggtcgcgccggctcgcccggggcgatggcgcgcggggcctccttcggagcccccgcggtggcgctggcgagggccgcgagcagggcgtcgagggccgcctcgctgtcttcgccgcgacagatcacctctacctcgtcctgttcggcgacccccaggcccatgatgccgaccaggctgtcgacgctggccacctgcccggcgaagtgcagttcggcctggctggaaaagccctgcgcggtcttccgtagcagcgctgccgggcgtgcgtgcagaccgccatga

SEQ ID NO: 1670 - DNA, 1296 bp, Pseudomonas aeruginosa
tgggcgacccgcgcccgcccgcggacctggcgctgcgcggagccttcgccaggcgcgggattggccggacgttgctcggccttctccggactcagttgcaggagcggcgcgccgacctccaccgggttggtggtcagcgggcgtacctggaagccgtcgccgttggtcaggatcatcaccgtgatcagactgcggctgccgcgggcgacgcggtccaggtcgaagcgcagcagcggctggccctcgatcacccgcgcaccttcctcgaccagcgcctcgaagccttcgccttgcagctgtacggtatcgaggccgacgtgcagcagcagctcggcaccgttgtcggcgcgcaggctgagcgcgtggcgggttcgcgccaggtggctgaccagcccggcgcagggcgcgtgcaggcagtcgttgagtgggtcgatggcgatgccttcgcccagggtgccgctggaaaacaccgggtcgggtactcggttgagcggcatcacggggccgctcaggggcgctttgagggcgagattcttgttgttcatgggcgcgcgctcaggctcagtgggttcgggtgactttgctcaggtgccgtggctggtccgggtccatgccgcgggcttcggccaggccggcggccatgacgtagaagctctggatcgccaggatcggatcgagcgccggatgcgcggcgcgctgcagcggcaggtcgcgttcggcgatgtcgtccggggcagcgagcaatacctgcgcaccgcgttggcgcatatcctcggcgagcgccagcaggccttcctgctccgggccgcggggagcgaacaccagcagcggatagcgctcctcgaccagcgccatcggtccatggcggacctcggcgctgctgaaggcctcggcctggatcgccgaggtttccttgaatttcagcgcggcctcctgggcgatggcgtagccggcgccgcgaccgatcaccatcagccgctggcagtcgcgcagggcctcgatggccggcgaccagtcgagcctggcggcctgctccagcccggccgccaggccctggccggcggccagcagggcattgtcgcgctgccagtgggcgagcaggcgggcgctggcgctgagcgtggcgatgaagctcttggtcgctgcgacgctgcgctcggtgccggcgcagagcggcacgacgaattcgctggcggcttccagcggcgaatcttcggcattcaccagggcgatgcccagggcgccgcgttcgcgcaggatgcgcaggctgtccacgagatcggggctctgtcctga

SEQ ID NO: 1671 - DNA, 1200 bp, Pseudomonas aeruginosa
gcgccgagctggctgaggatgtcggcgatctcctcgcgcggtgcggtcatggtggtggccagcagcgaggtcgtgccgaagcgccggtgggtgcgggcgatggtggcgaaggcgtcgccgccttccatgatgtcgcggccgccgccgccgtgcacatgcaggtcgatgaagcctggcagcaggtacggatcggcgttgccggccgggtcgcagggctcgccttcgatccgctggatacgcccgtcctggatgtgtaggcggccgaggacccagccttgcggggtgagaatgttgccttcgagcatggcggctccgtgtcggtcagcgtcgcagttcggcgacgaagtcgtagtagtcgttgcggcagtaggtgtcggtcagctcgatcggggtgttgtcctcgaggtagccgatccgggtcatcagcagcatcgcggtgcccggcgcgatgccgaccagcgcggcatcggacgcggacgcgttgatcgcgcgcacgtgctggagggcgcggaccactgggcgaccgatgccgtccaggtattcgtagagggaatcgccgaccgctgtcgggtccggcagcaggcgcgccggcagggtgctgttctcgatcgccatcactgtgccgtcggccttgcgcaggcgcttcatgcgcgtgaccttctcggtcggcgagaggccgaggcggatcagttcgtcgtgggtgggcagggcgatgccgcgctccagccaggtggagccgggggtgaagcctttcaggcggagcatctcgctgaagctggagagacgcgacagcggttgttcgagacgcggcgtaatgaaggtgccggagccctggttgcggcggatcagcccctgctcgaagagtacttcgagggccttgcgcgcggtgacgcgggaaatgttcagggtttcgctgaggttgcgttcggagggcagcgcttcctccgctttccactggccggcatggatcgcgctctcgagattgcgcgccagctgcagatagaggggggtgggttgcgcctcgtcgggacgcagggccaggagcaggtcgtgggctgtcttcatgagaggttccgatgcggattgtgttgttgtcgcccggtaatgctgggaaaactaataccacttgaataccacgtcaatgccagttgtgcgtcgcgcacgcgtcagccagccgtcccgtcgattgacttggcctga

SEQ ID NO: 1672 - DNA, 963 bp, Pseudomonas aeruginosa
agccggccggcagcgtccagtagcccaggcgcggcgcaatggcgcgacggcagagcaggacctggccgtcccacaccggcaggctgccggcgacgatacgcgggttctggtagtgcacggtgtggcaggcgtcgcagacgtagcgcaggcggttgtcgccgtccgggatgcgctggaccaccgtggcgccgcacaggctgcagaatttcatgccaggttcttcttcggggaaaggcctatcttgctcggctggccgggaggcgacaaggccccgtgcgggaggggtgggctggccggggctttcgtgccatgatctcggggaaacgacaagacctcggaaaccccggcagtatgaactgcacgctcgacgagctgcgccaacgcatcgaggcgcaccgcccccgccaactggataccgaccagcgcttcccccaagcggccgtgctggtgcccatcacccgcagcgacgatccggagctggtgctgaccctgcgcgccgccggtttgtccacccatggcggcgaggtcgccttccccggcgggcggcgcgacccggaagatgccgacctggtgcgcaccgccctgcgcgaggcggaggaggagatcgccttgccgccgggcctggtggaagtggtcgggccgctgagcaccctggtctcgcggcatggcatcgaggtcactccctatgtcgccttcattcccgacttcgtcgagtaccagcccaacgacggcgagatcgccgcggtgttcaacgtgccgctgagtttctttcgcgacgacccgcgcgaggtcacccaccgtatcgactacttcggccgcagctggtacgtgcccagctatcgcttcggcgagttcaagatctggggcctgacggccatcatggtggtggagctggtcaacctgctgtacgacgaccccatcgacctgcacacgccgccggcttcgttcatcaaactgagttga

SEQ ID NO: 1673 - DNA, 726 bp, Pseudomonas aeruginosa
ggagatcgcgatgaaataccgcctgggcgatgcccgcgtcgaaacccatcccgacagctggatcgcgcccagcgcagcggtgatcggcaaggttcgcctggatgccggcgccagcgtctggtttggcgcggtgctgcgcggcgacaacgagctgatccatatcggcgagcacagcaacgtccaggacggctcggtgatgcacaccgacatgggctatccgctgaccctcggcaagggcgtcaccgtcggccacaacgccatgctgcatggttgcagcgtgggcgactacagcctggtggggatcaacgcggtgatcctcaatggggcgaagatcggcaagtactgcatcatcggcgccaacgcgctgattcccgagggcaaggagattcccgacggctcgctggtgatgggctcgccgggcaaggtagtgcgcgagctgagcgagccgcagaagaagatgctcgaggccagcgccgcccactatgtgcacaatgcccgccgttacgcccgcgacctcgtcgaggacccggcgtgaacgagcgaccggtggcttcgccctgcgtgcatgtctgcgcgctggacgagcaggacatctgcatcggctgccagcgcacggcggccgagatcacccgctggggcctgatgagcaacgacgagcgccgcgaggtgctcggtcgctgtttcgagcgcgccaaggcgcaagggctggtcagcggttccgcctga

SEQ ID NO: 1674 - DNA, 1590 bp, Pseudomonas aeruginosa
agcggattccgttttctttcatttccgaggttcttccatgacccgtatcggtacccccctgtcgccgagcgcgacccgcgtccttctctgtggctccggcgagctgggcaaggaagtcgccatcgagctgcaacgcctgggttgcgaagtgatcgccgtcgatcgctatggcaacgcgccggccatgcaggtggcacatcgcagccacgtgatcagcatgctcgacggcgccgccctgcgcgcggtgatcgagcaggagaagccgcactacatcgtgccggagatcgaggccatcgccaccgcgaccctggtcgagctggaggccgaaggctacaccgtggtgcccaccgcccgcgccgcgcaactgaccatgaaccgcgagggtatccgccggctggctgccgaggagctcggcttgccgacctcgccctatcacttcgccgataccttcgaggactaccgccgtggcgtcgagtgcgtcggctacccctgcgtggtgaagccgatcatgagttcgtcgggcaagggccagagcgtcctgaaaggccccgacgacctgcaggcggcctgggactatgcccaggaaggcgggcgcgccggcaagggccgggtgatcgtcgagggcttcatcgatttcgactacgaaatcaccctgctcaccgtgcgccacgtcgacggcaccactttctgcgcgccaatcggtcaccgccaggtcaagggcgactaccacgagtcctggcagccgcaggcgatgagcgcgcaggccctggccgagtccgagcgggtcgcccgggcagtgaccgaggccctcggcggacgcgggctgttcggcgtcgaactgttcgtcaagggcgaccaggtgtggttcagcgaggtgtcgccgcgtccgcacgataccggcctggtgaccctgatttcccaggatctttccgagttcgcgctgcacgcgcgggcgatcctcggcctgccgatcccggtgatccgccagctcggcccgtcggcctcggcggtgatcctggtggaaggcaagtcccggcaggtcgctttcgccaacctcggcgccgcgctgagcgaggcggatacggcgctacgcctgttcggcaagccggaagtggatggccagcggcggatgggcgtggccctggcgcgcgacgagtcgatcgacgccgcccgcgccaaggcgacccgggccgcccaggcggttcgcgtcgaactctgagatgcgccggctggcatcgctggcctggtgggcggcggctctgccgttgctgccgctggcggtgccgctggctatccgcacccgccgccgagccttgcgcctggcgcccgcggcgggacctcgcgaagggctggtcggtggggccggtgccgaagagccgctgcgcttgctgttgttcggtgagtcgacagtggccggggtcggcgccagttgcctggattacgccctggccggccgcctggccgcggcgctcggcgagcgtatgcggcgcccggtggcatggcaggcgctgggcgagaacggtatcaccagcggcgaggcgcgcgaacgcttgctaccgcaggtggcgggacgtttcttcgaccaggtga

SEQ ID NO: 1675 - DNA, 1131 bp, Pseudomonas aeruginosa
cctgagcgagactcaggacactgcgccgaggtcgttgtcgcgggtttccttcaggcacagcaccgccagcaggctgagcagcgccgctgcggagacgtagccgccgacccagcccaggccgccgatgccgaccagcttctgggcgatatagggcgccaccgaggcgccgagaatgccgcccaggttgtaggccgccgacgcgccggtgtagcgcacgtgggtggggaatatttccggcagcagcgcgcccatcggggcgaaggtgacccccatcaggaacagctcgatgcagaggaacagggcgacgctgaacgtcgagccctggctgagcagcggctccatggcgaagccggaggcgatcgccgccaggctgccgagcagcagtaccggcttgcgtccgaagcggtcgctgagccaggccgacagcggcgtggcggcggccatgaagagcaccgcgaggcacagcagaccaaggaactcctcgcggctgaagccgaggctggccaccccgtagctcagcgagaacaccgtggagatatagaacagcgcataacacaccaccatcgccagggcgccgagcagggtcggccgccagtgctgggcgaacagctcggcgatcggcaggcggaccctctcgtgcttggccatggccttggcgaacaccggggtttccgccagcttcaggcgtacgtagaggccgaccacaaccagcgccgcgctgagcaggaacgggatccgccagccccactcacggaactgctcctcgctgagcagcatcgccagggccaggaacaggccgttggcggcgaggaagccgatcgacgggccgagctggggaaacatgccgaaccaggcgcgcttgccggccggcgcgttctccgtggccagcagcgcggcgccgccccactcgccgccgaggccgcaggccctggccgaagcgcagcacgcagagcagcaacggcgcccagtagccgatgctgtcgtaaccggggaggacgccgatcagggtggtggacacccccatcagcagcagcgaggcgaccagggttgacttgcgcccgatgcggtcgccgaaatggccgaacagcgccgagcccagcggacgggcgaggaatgcgatgccaaaggtga

SEQ ID NO: 1676 - DNA, 411 bp, Pseudomonas aeruginosa
tccgccgcttgccgcaacccccgtggaaggatcgcgcatgttcgaaaaccttacagaccgcctctcgcagacgcttcgccatgtcaccggcaaggccaagctgaccgaggacaacatcaaggacactctgcgcgaagtgcgcatggccctgctcgaggccgacgtggccctgccggtggtcaaggacttcgtcaacaaggtcaaggagcgcgccgtcggtaccgaggtctcgaagagcctgaccccgggacaggcgttcgtgaagatcgtccgcgccgagctcgaggagctgatgggggcggccaacgaggacctggcgctgagcgtcgcgccgccggcggtgatcctgatggccggcctgcagggcgcgggcaagaccaccaccgcgggcaagctggcgcgcttccttaa

SEQ ID NO: 1677 - DNA, 333 bp, Pseudomonas aeruginosa
tccttagaatatgcggcctttcgggccgtgggcccagcgtgcattcattttgcaagcaccgactacaggaacgaagttcacatggtaaccatccgtcttgctcgtggcggctccaaaaagcgccccttctaccacctgaccgtgaccaacagccgcaatgcgcgcgatggtcgcttcgtcgagcgcatcggtttcttcaacccggttgcgactggtggcgaagtgcgtctgtccgtcgaccaggagcgtgctacctactggctcggccagggtgcacagccgtctgagcgcgttgctcagctgctcaaggacgctgccaaggcaaacgcctaa

SEQ ID NO: 1678 - DNA, 543 bp, Pseudomonas aeruginosa
gccgtcatgagtgaaatgccgacacccgccgacgacctggtcgtgatcggcaagatcgtttcggtgtacggcatccgcggtgaggtgaaggtgtattcctttaccgacccgttggacaacctgctggactatcgccgctggacgctccggcgcgacggcgagattcggcaggccgagctggtcagggggcgcctgcatggcaaggtcctggccgccaagctcaaggggctcgacgatcgcgaagaggcccgcaccttcaccggttacgagatctgcatcccgcgtagcgagttgccctctctcgaggaaggtgagtactactggcaccagctggaaggcctgaaggtgatcgaccagggcgggcagttgctcggcgtgatcgaccatctgctggaaaccggtgccaacgatgtcatggtggtcaagccctgcgcgggcagcctggacgaccgcgagcgcctgttgccctacaccgggcagtgcgtgctgtcgatcgacctggccgctggcgagatgcgggtggactgggacgcggacttctga

SEQ ID NO: 1679 - DNA, 765 bp, Pseudomonas aeruginosa
tcatccatggacaagcgtttgtgggtgggcgtcgtcagcatctttccggagatgttccgcgcgatcagtgactatggcatcaccagccgtgcggtaaagcaggggttgctcacgctgacctgctggaatccacgggactacaccgaggaccgccaccagacggtggacgaccggcccttcggcggtggccctggcatggtgatgaagatcaagcctctggagggcgcgctggcggatgccaggcaagccgccgggggcaggaaggcgaaggtgatctacctttcgccgcaaggccgccagctgacgcaggcgggcgtacgcgaactggccgaagaggaagcgttgatcctcatcgccgggcgctacgaaggcatcgacgagcgcttcatcgaagagcacgtcgatgaagaatggtcgatcggcgattatgtcctgtccggcggtgagttgccggccatggtgctggtcgatgcagtgacgcggttgctgcccggtgcattgggtcatgcagattccgccgaggaggactccttcacggatggcctgctcgactgcccgcactacacccgacccgaggtgtacgcggacaaacgtgttcctgaagtgttgctcagtggcaaccatgaacacatccggcgttggcgtttgcagcaggcccttgggcggacctgggaacgacgcgccgatcttctggatagccgctcgctttctggagaagagcagaagctgctggcggaatatatccgtcagcgggacgatagttaa

SEQ ID NO: 1680 - DNA, 939 bp, Pseudomonas aeruginosa
gcgtcaagcgtcgcggcgacgtgcgcaaggccaagctgtactacctccgcgccctgtccggcaaggccgcgcgcatcaaggaaaaactggtctaatccggttcttctccgagaaaagcagcccgagggctgcttttttcatgtctggcggtcgcctttccggcggcgcttcctactgcccacggcagcgcataaccagtacaacatccgcggcacccaggcagccactccatccggtattcgtggcatgacccccagagagcaagaaatcctgcgtcgcaccgagctttccgaaacccgtgtgaccaaggcggtattcccgcccaccaccaatcaccacaacaccctgttcggcgggactgcgctggcctggatggacgaggtctcgttcatcaccgcgacccgtttctgccgcctgccgctggtgaccgtttccaccgatcgcatcgacttcaaccacccgatcccgggcggggctcgatcgtcgaactggtcggacgggtggtcaacgtcggcaacaccatcctcaaggtggaggtcgaggtgtacctggaaagcatgtacgccgacggtcgcgagaaggccatacacggcctgttcagcttcgttgccatcgacgacgaaaagcggccggttccggtcctgccggggttcccggtcagccaggcggcttgagacaggcagaaagaaggcacccacgggtgccttttccatatccccggacgatccggccctgggttgggatcagggccgcaggctgatcttcagggaggcctgggacaggtcgatctgttgcaggctgacgctgccgaacgtctgctcgcgcggcgcgccggcaatgcggatattgtcgaagcgcacctcgccgatactgctcggcaggcgcaggttgaccgagccgtcggggttgagcgtgctttgcgtcttgccggtttcgtag

SEQ ID NO: 1681 - DNA, 1248 bp, Pseudomonas aeruginosa
cggttccgcgtcgatcagcgacagcagcgtccagccggtgcccggcgccagcgtggactgtggcgtggcgacgtgcatcctgccgttcggatcgcgggcgaacagcaggatcgcggactcgccgtgcagcgcctggtagtcgttccagccgaaggtgtcggtgagcagggtggtgcggatttcggcgccgcgcgacagcaggctggcgaactgcgcgtaggtcagcggtcgctggccaagcggacggccacggtgttcgtcgctggagcggtgcttgtcggtacgcttggcttcctggctggtcggcaggccgaacagctggcgatggccgaactcgtggcggaagcgcatggccgccagggtattcagctcgccggctggagaaacccccagcaaatgcccgatgccgaccaggtcgaggtgggcttcggcgtgctgcgaggtgggattgccgaaataggtgggcaggttgtccatgcgggcggcgcggatgttttcccagctcgaatcagtcagcagcacgcggctgccgaggctcttcagggccttgccgatggcgcgcccgaccggattggcgccgacgatcaggtagccgctgggcgagggctcggcgaccttcagcaggcgcgccagggggcgggcggtggcgctttgcaggaccaccgtgccgatgatcaccagaaaggtcagcggcaccagcagcgccgcctgggcatggccttcggcgctcaggcggatggcgaagatcgccgagaccgccgcggcgacgatcccgcgcggggcgatccagctgagcagggcgcgctcgcgccagctcagcggcgaaccccaggtcgacagcgccacgttcagcggccgggcgacgaactggatcagcagcagcaccagcagcgccgccgggcccaggccgagcagggcattgatgtccaggcgcgcggccaggaggatgaacaggccggaaatcagcaggacgctgaggttttccttgaagtgcaggatctgccgtacgtcgacgcccttcatgttggccaggcccatgcccatcagggtgacggcgagcagcccggattcgtgcatcacccggttcgaggcgatgaatacgcccagcaccgcggccagcgtcgccaggttgtgcaggtagtccggcagccagtggcggcgcaggacgatgcccagcgcccagccgccgaggatgccgaacaggctgccgcagaggatcactccaccgaaggtctgcaggctgtgtag

SEQ ID NO: 1682 - DNA, 1020 bp, Pseudomonas aeruginosa
aagactagccgcgctttcatttggttcgcagccttcatccatgagtaccctcgaacatcccctgatcgaccgtttcctcgatgccctgtggctggaaaaaggccttgccgacaactcccgcgaggcttatcgcaacgacctccagcagttcaacgcctggctcgatggccgccggctgcgcctgggagggatctgccgctacgccatcctcgattacctggcctggcgcctggaacagggctacaaggcccgctcgaccgcgcgcttcctctccggcctgcgtggcttctatccctattgcctgcgcgacggcctgatcgccgaggatcccaccttgcaggtggacctgccgcaaatgggcaagccgttgccgaaatccctctccgaagcggacgtcgaggcattgctggcggcgccggaagtcgacgacccgctgggcctgcgcgatcgcaccatgctcgaagtgctgtatgcctgcggcctgcgggtcagcgaactggtcggcctgaccctggagcaggtcaacctgcgccagggcgtggtcaaggtgttcggcaagggcagcaaggagcgcctggtgccgctcggcgaggaagccatcggctggctcgaacgctacctgcgcgaggcccgcggcgacctgctcggcgggcggcccagcgacgtgctgttccccagcctgcgcggcgaacagatgacccgccagaccttctggcatcgcatcaagcatcacgcgcaggtggcggcgatcggcacgtcgatttcgccgcacaccctgcgccacgccttcgccacccacctgctcaaccatggcgccgacctgcgggtggtgcagatgctgctcggccacagcgacctgtcgaccacccagatctatacccatatcgcccgggcccgcctccaggatctgcacgcacgccaccacccgcgaggctgacgctttgtccgaaaaatccgtacctacccgaaaagaggcgctttcgtagcgttctgcgacaagcgtcgggcccgtcgggatag

SEQ ID NO: 1683 - DNA, 714 bp, Pseudomonas aeruginosa
gatggggagttccagcgtgaaaccggtcaaagtaggcatctgtgggttggggaccgtcggtggcggtaccttcaatgtactcaaacgcaacgccgaggagattgcccgccgtgccgggcgcggtatcgaggttgcgcagatcgccgcccgccggccgaacccgaagtgcgataccggtgcgacccccatcaccgccgatatcttcgacgtagcgtgcaatcccgagatcgacgtggtcgtcgagttgatcggcggctacaccctggcccacgagctggtgctcaaggccatcgagaacggcaagcacgtggtcaccgcgaacaaggcgctgatcgccgtgcacggcaacgagatcttcgccaaggcccgcgagaagggcgtgatcgtcgccttcgaggccgctgtcgccggcggcatcccggtgatcaaggcgatccgcgaggggctgtcggccaaccgcatcaactggctggccgggatcatcaacggtaccggcaacttcatcctcagcgaaatgcgcgagaagggccgtaccttccccgacgtgctcgccgaggcccaggccctgggctatgccgaggccgacccgaccttcgacgtggaaggcatcgacgccgcccacaagctgaccatcctcgcctcgatcgccttcggcattccgctgcagttcgacaaggcctacaccgaaggcatctcgaagctgaccagcgctga

SEQ ID NO: 1684 - DNA, 1353 bp, Pseudomonas aeruginosa
ccccctctccctggctggataggggagaggggccgccctgtccgcggagcaccgatgaagggctccgcgtaccgttcagatggcgcctttccggcgcagggcggcgatgccctcgctgtcgtagcccagctcggcgagcagggcatcggtatgctcgcccagttccgggcctacccaatccgccgagcctggcgtggcggacagcttgggcacgatgccaggcatgcggaatggcttgccgtccggcaagcgtgccgagaggaacatctcgcgggcaaggaattgcggatcgcggaacatgtcttcggcggagtagattcggctggccgggacttcggctcgcgccagcaccgccagcacttcctccaggggctgcgaggcgacccagcggtcgataaccccatagagttcgtcgcggcgcgcatcgcgcccgtcgttgctggccagttgcgggtcgctggccaggtcgtcgcggccgatggcctgcatgaagcggcggaagatcgcgtcgccgttggcgccgatctgtacgtggcggccatcggcgctggtgtggatggaggagggggtgatgcccggcatgatgttgccggtgcgctcgcggatgaaaccgaacacgtcgaattccggaaccatgctttccatcatggcgaagatcgcctcgtagagggcgacgtcgaccatctgtccctcgccgccgttgacctcgcggtgtcgcagcgccatcagcgcgccgatcacgccccacagggcggcgatcgagtcgccgatggaaatcccggtgcgaaccggcgggcggtcctcgaagccggtaatgtagcgcagtccgcccatcgactcgccgaccgcgccgaagcccggctggtccttgtaggggccggtctggccgaagcccgacaggcgcaccatcaccaggcgcgggttcagcgcgtggaggacatcccagcccaggccgagcttttccagtacgccggggcggaagttctcgatcaggatgtcggcatcgccgagcaggcgtttcaggatcgcctggccttcggcgtgcttgagattgagggtcagggatttcttgttgcgtgcctgaacgaaccaccacagcgaggtgccttcgtagagcttgcgccacttgcgcagtggatcgccgccgtcgggcgactcgatcttgatcacttcggcgccgaactcggcgcagatccgcgaggcgaaagggccggcgatcagggtgccgagctcgaccaccttcaggccggccagcggtttgggcgaatgttccatgcggtgtccgtcaggctgcagtgtgcgcatagcctagagcatttgccggcggtgcgggcgggtgccgcggtagggtga

SEQ ID NO: 1685 - DNA, 1335 bp, Pseudomonas aeruginosa
gtccatgcaacggaaatcatcagcccattatcagcgtgtctttcgccagcgcctgcgcgagcagggcctggtgaagaaggaagtctggatcttgccggagaacgccgcggcgctcgccggcatcgagcggatgctgcgtcgcccggctgccggagcggctcatttggagaaggaggaagacatgacggaagcccgggtatggaacgctcgctcgctggccgaggccctgagcggcaccgagctgttcagcagcggcgaggcccagatcgagctgatcgagggggcggaagcgagtctctatgtgatcatgcgcgaatacggcgacctgccggtgttcgtcgcgccccagggcgagcagatcatcgtcgaggcgctgctctggccggaaagcgacgttaccgacgcgaccgccttcaacgaagaggtcctgctcagccggcaactgttcccgctgtcgagcatcggcctgctcaacctgccgggcgaggagcgctgctacagcatgttcggcgcgttgagcacgacttcgtcgctggccagcgtgctgcacgaaatcgaaaccctggccggcaacgtgatccgcgccacggaagtctacgccggctacctgaaagcccgggcctgagggaggacaccatcatgacggtatggagcaagctgctgagcgccctgcgcggcggagccaacgaggttggcgaggcgatcgtcgacagccaggcgctgcgcatcctcgaccaggagatccgcgacgccgacgtcgaactgcgcaagtcgcgggaagcgctggcctcgatcatggcccgccaccgcctggcccaggagcgcgtcgagaagggcgcggcccaggtcgccgagtacgagcaatacgcgatcaaggcactggaggccggcaacgaggagctggcccgggaggtcgcggagaagatcgcgaccctggagaaccagctcgagggcgagcgtgcccaggtcgcggaattcgccgccagcgtagcccagttgcgcaagtcggtgagccaggccgagggcaacatccgccagctcaagcaacaggtggatacggtcaaggccaccgagagcgtgcagaaggcgcagatggccgttgcccagcgctacggcaactcgaagagcaagctgcagaccgcggtggactccctggagcggatcaagcagcgccaggccgaacgcgcggcgaccatggatgccgcggccgaactggccagcgcggcggcgccggacgatgcgctggacgccaagctgcgcgcggctgggatcaaggcctcgggcaacagcgtggatggcgtgctggcgcgcctgaaggaaaagggcaaggcctga

SEQ ID NO: 1686 - DNA, 1695 bp, Pseudomonas aeruginosa
gaatcaaggagaactgctgctatggatatgacgtcgctgatgcccctcctgctgggagtgggcctggtcgttctgctggtcgtgggcctgctggccctgttcaaggccttctacatcaaggtcccgcaaggcaccgcgctgatcgtcaacgacatgtcgtcgacgcccaaggtgcatttcaccggtgcgctggtctatccggtgatccacctgaaggagttcatgcgcatctcgctgatcaccctggaggtcgaccggcgcggcaaggacggcctgatctgccgcgacaacatgcgcgcggacatcaccgttgccttctacctgcgggtcaacgagacccaggacgacgtgctcaaggtggccaaggccatcggcgtcgaccgtgcttccgaccgttcggcggtgaacgagctgttcaatgccaagttctccgaggcgctgaagaccgtcggcaagcagttcgacttcgtccagctgttcgagaatcgccaggacttccgtgaccgcatcatcgaggtgatcggcaacgacctgaacggctacgtcctggaagacgtcgccatcgactacctggagcagaccgcgaagaactcgctggacccgagcaacatcctcgatgccgagggcatccgcaagatcaccgagctgaccgccacccagaacgtcatcaccaacgaactggagcgcaacgaagagctggcgatcaagaagaagaacgtcgagacccgcgaggcggccctggccctggagcgccagcaggctgacgccgaggcccggcagaagcgcgagatcgagaccatccgtgcccgcgaggaagcggaaaccgcgcgggtcaaggaagaggagcggctgaaggccgagcaggcgcggatccaggcgcagcaggaaatcgacgtgcgcaccgagaaccaccagcgcgaggtcgaggtggcgcagcagaaccgccagcgcgcggtggtcatcgaggtggagaaggtcacccgcgccaaggacctggagatcgtcgcccgcgagcgtgaggtggagctgcagaagatcgagaaggaaaaggcgctggaagagcagcgcaagaacatcgccaatgtgattcgcgagcgcgtcgcggtggaaaagaccgtggcccaggaggaggagcggatcaaggaggtgcgcgaggtttccgaggccgagcgggtcaagcaggtgatcctgctgcaggcccaggcggaagccgagcaggagctggtacgccaggtcaagcaggcggaagccgacgaggcccgctccaagcacaaggcggtggaaatcaacaccatggcgcaggccgagctggaagcggcgtcgaagcaggccgaggcgaagaagcgtctggccgagggcatcgaggccgagcgcgcagcgccgggcctggccgatgcgcgggtgctggaagtcaccgccgcggcgaaggaaaaggatggcttggcagcggcgcgggtacgtgccgaacaactgatcgccgaagccaggggcgacgaggagcgcggcctggccgacgcccgggtgctcgaggcgcaggccgcggccaaggagaaggacggcctggcccgaagcccaaggtgctggccgagaagctcggcgcccaggcgcgcggcgaggagcagctcggcgcggccaaggccaaggccaccaaggaccagggcagcgcggaagcggaagtactgctgcagcgcctga

SEQ ID NO: 1687 - DNA, 1839 bp, Pseudomonas aeruginosa
tcagcgagggcaccctgttcgtcaccgacgagaacggccagcacgagttgcagctggaatggctgcagggcgagcgttgatcgccgccgccgtttccttccgtcgagccgaacgagtgacctgatgcgtatcgaaccccgccccctgcccgaaaccctgcccgatctcggcgaccttccgccattgctggcacgcctgtacgcagctcgtggcgtgcgttgcgccgaggagctggacaagggcctggcgcggctgattcccttccagcggctgaaaggcatcgaggagggcgtggcgctgctggtggatgccctggagggcggccagcggattctcatcgtcggcgacttcgacgccgacggcgccaccgccagcagcgtcggcgtgctggccctgcgcatgctcggcgcggcctgggtcgattacctggtgccgaaccgcttcgagtacggctacggcctgaccccggagatcgtcggcgtggccctggagaagcgtcccgacctgctggtgacggtggacaacggcatctccagcgtggacggcgtccaggcggcgaaagccgcggggctcaaggtgctggtcaccgaccaccacctgcctggcccggaactgccggcggcggatgcgatcatcaaccccaaccagccgggctgcgaattccccagcaaggccatggccggggtcggggtgatcttctatgtgatgctggcgttgcgggcgcgcctgcgcgagctggactggttcgcccggcgcgggctgaaggaaccgaacctcgccgagctgctcgacttggtggcgctgggcagcgtcgccgatgtggtgccgctcgatgccaacaaccgcatcctggtccaccagggcctcgcgcgcatccgcgccggccgcgcccggccgggcttgcgcgcgctgctggaggtggccgggcggcctccggtacggatcacctccaccgacctgggtttcatcctcggtccgcgcctgaacgcggcgggtcggctcgacgacatgtccctcggcatcgaatgcctgctctgcgacgacgaagcgctggcccgcgacatggcggtgcagctcgaccagttgaaccaggaccgcaaggccatcgagcagggtatgcagcgcgaggcgctggcgcagctcaaggagctgagcctggagcaactgccgttcggcttgtgcctgttcgacgccgactggcaccagggcgtgatcggaatcctcgcctcgcgcctgaaggagcgttaccaccggccgaccatcgccttcgccgatgccggcgacggcagcctgaaaggctcggcacggtcgattcccggcttccacatccgcgacgcgctggacgcggtagccgcccgtcatcccgggctgatcagcaagttcggcggccacgcgatggctgccggactatcgttgccgcaggaaaacttcggcgctttctccgccgccttcgatgccgaagtacgccgccaactggccgaggaggacctggccgggcgcctgctctccgatggccagttgagcatccaggagttccacctggagttggcgcgcgcgttgcgccaggccggtccctggggccagcactttcccgagccgatgttccacggggtgttccagctggtgcagcagcggatcgtcggcgagcgtcacctgaagctggtgctgaaaagcgaatgcggctcgctgcaactggatggcattgccttcaacatcgaccgcgagcagtggcccaaccctaccgtgcgctgggccgagctggcctacaagctcgacgtcaacgaattccgcggccaggaaagcgtgcaactgatgatcgtccacatggctcctcgctga

SEQ ID NO: 1688 - DNA, 405 bp, Pseudomonas aeruginosa
tgttattctcccgcgacgttcgctccggaccgcacttcgagaaaggatgctcgcatgcacgccaacgccggttctccccacgcctccctgcctgacagcgatgtcgccctgctggccaatatcctggtcctggcgacacgcaacatgaacaacatgaccaccatgctggcgcacctttcggtggagctcagccagagcgaagagccacgcctgcaacgggtcggtcatcgggtcctgaacgaactctcggagctgggggccgccctggagacccagtgggacctgatcggcgcgctggcgcgtttctcacccctgctcgaacgtaccctgccgcgccaggaacccctggtcaccgagatccacctcaccgaactgccgggccaggcgctgccgccctccgcctga

SEQ ID NO: 1689 - DNA, 768 bp, Pseudomonas aeruginosa
accaccggcccgttctatcaccatgtccagggtggtgccttcgaaaccgtgttcgagaaaggcctgggtagcggcgtcgagcatggcgcggcggcgttgcctgccgcgttcggtcagacggggagaagcatcgttcatgagcggtatcgggcctcgcggggtggcggtcggaaggtgcgcatggtgggccgtcgggacggtccgttcaagcctccaggcggtttgctgagagcgtttctcgttagggttgacgctggtcatttaagaactgtatcgtacagtactgttttggcaagcacttccgctcattcctccgccttgcctccccgcaggagtccccccatgaatgcccccgctaagagcctgttggatatcgatgcctttcccctggtccaggtccgcgagatgccccgcgagctggccgatgtcgagcgctggttggaggaggtcgaggcgctgctggccgtcgagcgcgatttcgccctggtctatccgccgctcccgcaggaaacagctgaagacgaccagcaggcgcgcaagcgcctggtgttgtggctcaaggaaaatcgccagcgcttcgtcgagcattgccggggcatcctgctcagtgccaacggccagccggacaacctcgccgacctgcagcaactggcgccggtgctgcaggctgtctacggcccgccggtgagcgtggcgccggacctggcgtccgcccgcggcatggcgaaggcactgctgagcgggccggcgacggggatgaactggtga

SEQ ID NO: 1690 - DNA, 3591 bp, Pseudomonas aeruginosa
cccgtccactctcgctcgtccgcacccccaggccagcccgcgatggctggcagttgccaatgtgatcttcgccggcatcgccgctgccctgcatgtcggcaaggcgaccatcgccctgccgtcgctgcaacggagcttcggcggcgacctcgccgcgctgagctggatcatgtccgcctttccgttcgtcggcgtattcggcggcatcgccgccggcctcctggtgcgttgttggggagatcgccggctgctgaccgttgggctggcgattctcggcggggcgagcctgctcggtgcgtcgatgcaggacttcgcctggttgcttgccactcgcttcgtcgaggggctcggtttcctcatcgtggtagtggcggcgcccgccgtgttgcacaggatcaccagcgagacgcggcgcagcgtggtgttcggtctgtggagcaccttcatggcaggcggaatcgccctctcgatgctgttcgggccgctgctcgcggactggcgtgccgactggcaactgagcgcactgctggtactggtcgcggcgctgctgctgccgctcagcgtccctgccgacgatgggtgcagggcggcaggcgtgaggccggccggtcttggcgcgttgctcaaggttccggcgatcaccctgctggcgctcggcttcaccacctacaacctgcagttcttcgccctgatgacgttcctccccgtgttcctcatgcagcgcctgggcgtcgccctggagactgcgggactcatcggcgcggccatcgtcgcggcgaacgccctgggcaatgtcgcggcgggcttcatcctttcccgcggcatacgtcccggcgccttgctggcgagcaccgcgatcctgatgggactcaccggtgcggcgttcttccatgccgcgacgccgggactcctggcgattgcgctggggttcgtcttctcggcggtcgccggcatgcttcccaccaccgtgctggcgaccgcgccgctggcctcgcccgcgccttcgctgacgccactggccatcggctgggtaatgcagggcaactacctggggcaggtgatcggccccttgctgatcggcctgatcgtcagccgtttcgactggtcgggcgcgatcggcctgatgctggtcgcgggcgcggcgggggccgtcctggggttctgcctgctgcgtgcgctggacggcctgcctcgcgccattgccacgggttccgcggctcgccccgcggattagaagagaaaccggcttcgtgcagggcgggtagccgagcgactattcgtcctgcgcattggttcggcacgggcggccagaggccgccgccgtccctcggctcagtcgtcgcgggtgagcacttccagcagttcgatctcgaacagcaggttggagtggggcttgatgtgcgcgccgacctgccgttcgccgtaggccaggtgggaagggacgaacagccgtcgcttgccaccgaccttcatgcccatcaggccctggtcccaacccttgatcactcgtccggtgccgatcacgcactggaatggccggccgcgctcgtaggaggagtcgaacagcgtgccgtcttccagggtgcccttgtactgggtggtgatcagcgcacccttctctacctccttgccgtcgcccaggaggaggtcttcgatctgcagtcggtcgttcatggggcggtacctgcgcggtttgcggaaagccgcgattctgccagcaagcgcgccgcctgtcgccgagccgacggatcagggcattgccaggcggtccgcggcacgggcatcatgcccgcgcctttccgtcgggaaggctaccgcgttccgcgatgtcgcgcgcatcgcggctggacacatatctcagggatcatacgagaacatatccgcatgcaaagactgtcgcgtatcggccgcaacaccctcgccgtctccgtttccaccttgctcctcagcgcctgcaaccagggcgacgatgcgccgaagcctgcggcggtcgcgccgcaaccggccgcaccgagcatggctgcactgagcatcccgctatgcctcaacggccagtgcgcggtgatcgaccaggacgccaagctgctcgtgccgttcgacaacgactacgacaatatcgtcgccagcgcctaccagggcaccctgatggcggcgcgcgaggagcgctggaacctgatccaggcgaaggacggcaaggtgttgcgcgacgatatcggcgaagccctgtcgctgctcacccccaacctctatggcttcgtccgcgatggcaagtacggcgtggtcgacggccagggcaaggaagtccaggcgccgcgtttcgacgacatctaccccaacagtgccaacgaattcatcatctacgagatcgatggcaagcgcggcatcctcgatgccaagggcaagcagctcaccgaggcgctctacgacaccaccctggtcaacggcagcgtcgccgaacacggcggcttgatcagcgccgagcgtggcgaggagaagtggatcatcaacctcgctaccggcgaacagaaggccgtggcctacgagagcctgggcgacctccacgacggcgtgatgagcgccagcgtcatcggcaagggctcccaactggtggatgccaagggcgacgtggtcggtgacggcaagagctacgattacctgggcaccccggccaacggcctggtcgcgttccgcgagaagtacgacagcccctgtggctacctcgactaccagggcaaggtggcgatcgccgcccagttcgccggttgcggcgccttcggcaagcagggcgggctggcccagcagcgcatggaagatggctcgtcgggcaagtacggcctgatcgatcgcagcggcgcctggaaggtgcagccgcagtacgattcggccgacagcgccggcctcaccgcgcttggctacaccgtcgacgtgcccggcctggctgccgtcggcgtgagcaccggcctgttcagcgccgacttcggcatcttcaacctcgacgaaggcagcgagtgggtgaagccgggttatgcgcagatcggcgcgctgggcaacgacctgttcgtcgtggcgaagaagggcgggccgcagaagaccgtcagcttcatgggttcggaaagccaggtgccggtggtgggcctgatggaccgcagcggcaagatgctgctggagccgggcgaactgatcagcatccagtctgcgtatgacggtcgtttcctggaaggtctcgacggtatggaccacgctgcccacaccgtgttgctcgatcgccagggacgcacgctggttccagcgctctggcagaagctggaggtgaatccgcagcagggttacatcctgggctacgaagtcagcggcactggcgacgaggcgacggaaaccttgcgcgcactgtacgacctgaacggcaagccgcgcttcaccgtggccaccaccgattgcggcgccgaacagttgctcgacggcaatggcaaggcgatctggccgcaggacccgaccccgtattgccagtcggacgacgagcaggacgacgaaggcgagccggagcaggagccggcgcccgtcgaagagagcgaggaaaccagcgagagctga

SEQ ID NO: 1691 - DNA, 456 bp, Pseudomonas aeruginosa
aacgagtgccgggttgccgagcatggtgacgacgatgatcggcaggtccggatagcgccgccggaccttctgcaccaggcgcaagccgtcggcctgctggctgccgggcatcatcaggtcggtgatcagcaggtcgcaggggtgcgcttcgagctgcgccagcaagccatcggcgtcctgggcctgggcgacgatccgcaggtcgtcgtacgcactcagcagatagcgcatgccgatcagggtgagggcgtggtcgtcgacgaggatgacgcgtgttttcatgaaatcgaacccgatctaggtggaggtttccgcagcggctaccggcaacgccggcaggcggataatccgccaggaggcagctccggacgggctcgaattctagcgatggtgtctgtcggtttaatcaggacttttctgaatgctagtaggaaatttcctatgtgttttccctag

SEQ ID NO: 1692 - DNA, 360 bp, Pseudomonas aeruginosa
ctgccccgaaacgtttgtttttttatcgcgaatgaacgactagcctcaagccgttcgagacttgccggtcatccgcaggtccgacggcccatcacaagaacgacaagacgaggctcgccatgcccgaggtactggatacctacgactacctcatcgttggcgccggacctgccggctgcctgctggccaaccggctttccgccgaccctgccaaccgtgtcctgttgctggaagccggcggcccggacaactatccctggatccacattcccgtcggctacctctactgcatcggcaacccgcgtaccgactggtgcttcgacaccgacgaggtccccgggctcaacggtcgttccctga

SEQ ID NO: 1693 - DNA, 1962 bp, Pseudomonas aeruginosa
tcaccggcggtagcctggtctgcgccttgctgttcctccgcgaaacccgccataccgacatccaccggtgaaatcgcgccccgttcccggcatggggacggggcgcacattccctccgtgatgagcctgtcttctcagaaaagtctggcttgccagttttctttctctttctgccacacttctggcgtcaaaaaacgcctttccagcgcctacaatagcgggaaaaccctatggcgctgcttgccggtgccggggacggcctatacagtccgcgcgattgacgggccgttgtggcggcaggaacgaatccggactcgagtcttggggaaaaatgtgaagaactggactgttcgccagcgaatcctggcaagtttcgccgtgatcatcgcgatcatgctgctgatggccgctactgcgtacgtgaagatgttgacggtggaaaagggcgcctaccgtgtccaggacgacgccatgccggggatgtacttcatcacgctggtacgcagttcgtggaccgacaactacttgcagacccaggaactgttcggcatcaccgacgaccacgagctgagcaaggccgaggccgacagtatcctcgccagcgaggagcgcctggaccagcagatcgcctcctaccagaagaccatgaacccggacgaggcccgcgaccacgagttgctcgccggtttccaggccgtgcgcaagaactacctggagcagcacgacaaggtgctcgagctttaccgcgagaagcgcttcgaggaagccggcaagctcgtcgccggcccgttgaccgagcactggcgcgagggccgcaagtacctcaacgagatgatcgagctgaacaaggacatcgccgatcgcgcctcggacaacatcgtaaacgcggtggacgatgccgaactgagcatgctggtgaccctgctgctggcggtggtggtagccggcatctgcggtttcctgctgttgcgggcgatcacccagccgatccagaagatcgtccgcagcctcgacctgatggccggtggcgacctcaccgcacgcctgaacctcggccggcgtgacgaattcggcgccatcgagaccggtttcaacggcatggccgaagagctcaagggcctggtgtcgcaggcccagcgttcttcggtgcaggtcaccacctcagtcaccgagatcgccgcgacctccaagcagcagcaggccaccgccaccgaaaccgccgcgaccaccacggagatcggcgccacttctcgcgagatcgccgccacctcgcgcgacctggtgcggaccatgagcgaagtctccggcgccgccgagcagacgtcgaccctggccggttccggccagttgggcctggcgcgcatggaggaaaccatgcaccacgtgatgggcgcggccgacctggtcaacgccaagctggcgatcctcaacgagaaggccggcaacatcaaccaggtggtcaccaccatcgtcaaggtcgccgaccagaccaacctgctctcgctgaacgccgccatcgaggcggagaaagccggcgagtacggccgcgggttcgccgtggtggccaccgaggtgcgccggctggcggaccagaccgcggtcgccacctacgacatcgagcagatggtgcgcgagatccagtcggcggtatcggccggggtgatgggcatggacaagttctccgaggaggtccgccgcggtatcgccgaggtcggccaggtcggcgagcaactgtcgcagatcattcagcaggtgcaggcgctggcgccgcgggtgcagatggtcaacgagggtatgcaggcccaggctaccggtgccgagcagatcaaccaggcgctggtgcaactgggcgaggccaccgggcagaccgtggagtcgctgcgccaggccagcttcgccatcgatgagctgaacctggtggcgaacgggctgcgcaacggcgtatcccgcttcaaagtctga

SEQ ID NO: 1694 - DNA, 1368 bp, Pseudomonas aeruginosa
aggaccacggggactggtgcaatgggtgcgggtcgaggcattgctgcccgacgaagtgcgcgccctgctgttcccgccggagtgcggcgaggggacggcatgaacgatcgcttcgaacgcctgctcaagagcaggatcggcctggatgccagctcggtgggcagcgcggtgatcgagcgcgcggtacgccagcgcatgagcggcctcgcgctgcacgacgaggacgaatactggatgcgcctgaacggctcgccgggcgaggtgcaggcgctgatcgaagcggtggtggtgccggagacctggttcttccgctacccggagtcgttcaccaccctcgccaggctggccttcgagcgcctgccgagcctgggcggcggacgcgcgctaaggatcctcagcctgccctgttccaccggcgaggagccgtattccatcgtcatggccttgctcgatgccgggctctccgagtacctgttcgaggtcgacgccctcgacgtcagcgctcgggtgatcgagcgcgccagcctcggggtgtacggcaggaattccttccgcggcgacgaactggggtttcgcgaccgccatttcagcgaggttgccgagggctaccagttggccgagcaggttcgccgcaaggtgcgcttccgctgcggcaatttgctcgatcccgggctactggcgggcgaggcaccctacgatttcgtgttctgtcgcaacctgctgatctatttcgaccgcccgacccagagcgaggtggtcgaggtgctcaagcgcctgttgcggccggacggcgcgatgttcatcggaccagccgaggcgagcctgctcagccagcatggcatgcagccgatcggcgtgccgctgtctttcgtgttccgccggaccagcgaggcgccccgcggcgcgcggcccaaggcggtgagcgacggagcgcgcccggtggttgccgccgccgtggagcgtgcgagtattcggccttcgccgccgccaccggcgaaaccgcgccagcggctgtccagcctggttccaccagccagcggccagcccctcgccagtcccgtcggcgagttcgacgaaatcgcccgcctggcggatgccggccagcaccgcgaggcgcgcgccgcctgcgagcgccaactggccgcgcgtgggccgtcggccacggtcttctactggctcgggctgctcagcgatgtcgccgggcaggagcaggaagcccaggatttctaccgcaaggccctgtacctggagccgcagcacgccgaggcgctggcgcacctggcggcgctgctcgccgctcgcggcgaccatgccggcgcccggcgcctgcagcaacgtgcggcccgtggagtgaacaaagatggttga

SEQ ID NO: 1695 - DNA, 1566 bp, Pseudomonas aeruginosa
ctgctggaaccgcatcggcgtgcatggcgacaagtcctgcgaacgcctggccgagcatgtccattgccgcaactgcgaggtttacgctgccgcggcgacctacttgctggaccgcatcgccctgcgccaggaccagctcgacagcgccgaaacgatggacagccagcgcgaacagagcgacctcggcgagacgcgttcgatcctggtgttccgcctgggcgaagagtggttcggcctggccaccggcagcctggtggaagtggcgccgatgaatcctatccattccctgccgcaccagcgctcgcgcgccctgcaaggggtgaccaacgtgcgcggcgcgctggtcgcctgcctttccctcggcgaactgctggatctcgaacccggcgccgcgccggtcagcgagcgccgggtggttccgcgcatgctgatcatttccgccgccggcggtccggtggtggcgccggtggaggaagtcgacggcatccatgcgattccgctggcgcggatactgccgcccaaccacgccgacggccaggcctcgcgccggcacgtggccggcgtgctgcaatggcgcgagcggagcatcaccctgctcgacgaaggccctctcctgcaagccgtagcgcggagcctggcatgaccccggaccagatgagagacgcgtcgctgctcgagctgttccggctcgaggcggaggcccagacccaggtgctcaacgccggcctgatggcgctggagcgcagcccgacccaggccgaccaactggaagcctgcatgcgcgccgcgcactcgctgaaaggcgcggcgcgtatcgtcgggctggacgccggcgtgcgcgtggcgcacgtcatggaggattgcctggtggaggcgcaggacggacgcctgctcctgcaatcggaacatatcgatgcgttgctccagggctgcgacctgttgctgcgtatcggcaccccgccagccggcgacgcaggctgggccgaaggcgccgggcgggaagagatcgacggcctggtgctgcgcctcgaaggcctggtgcgcagcggcctgccgctggcccgcgcggagctgccggcgacgactcccggtctgccggaagcggtccccgaggcgccgccagcggcgtcagcggccgccagcgacgacaacgacgaggagcccgccgggcaggcgggcggcgaacaggccgaggagcgccgcagccgggtcctgcgggtcaccgccgaacgcctggaccggctgctggatatctccagcaagtcgctggtggagttccagcgcatcaagccgctggccgattccctgcaacgcctgcgtcgcctgcagtccagcgccagccgcgcgctcgacgtggtacgcgagacggtccaggaaaccgccctcgacccgcaggcccaggccatgctcggcgaggcgcggcaactgattggcgaatgccagcagatgctggtgcagcacatcgccgatctcgacgagttcgcctggcagggcggccagcgtgcccatgtgctctacgacgcggcgcctggcctcgcggatgcggccattcgccgacgtccttag

SEQ ID NO: 1696 - DNA, 888 bp, Pseudomonas aeruginosa
cggccaggcgcggatggttcgcgacctgggccgctcgctgggcaagcaggtgcgcctgctggtcgagggcgaaagcacccaggtcgaccgggatgtcctggaaaaactcgaagcgccgctcacccacctgctacgcaatgccgtcgatcacggtatcgaggcgccggaaacccgcctcgccgccggcaagccggccgagggcaggatcaccatccgcgcccgccaccacgccggcatgctggtcctggaactgagcgacgacggcggcggcatcgatctgcagcgcctgcgcgagaccgtgctcaatcgccagttcgccaccgccgagaccgtggcgcaactgagcgaggaggaactcctggcgtttctcttcctgcccggcttcagcatgcgcgagcaggtcaccgaggtgtccggtcgcggcgtcggactggacgccgtgcagcacatggtccgccagttgcgcggcggcgtgcgcatggagcaacgccaggggcagggagcgctgtttcacgtcgaggtgccgctgaccctgtccgtggtgcgcagcctggtggtggagatcggcgaggaggcctacgccttcccgctggcgcacatcgagcgcatgtgcgagctggaagcggaggagatcgtccagctcgaaggtcgccagcacttctggtacgaaggtcgccatgtcggcctggtctcggctgcgcaactgctgcaacggcccgagagcagccgcaccgaaggggccatcccggtagtggtggtgcgcgaccgcgatgcggtctacagcgtctccgtggaacgtttcgtcggggagcgtaccctggtggtgatgcctctcgatccgcgcctgggcaaggtgcgcgacgtttccgccggcgccttgctggatga

SEQ ID NO: 1697 - DNA, 1053 bp, Pseudomonas aeruginosa
ggccttgctggatgccgtcgtcgtcctgatcggagaagcacagggttgaggatcggaatcgtcaatgacatgccgttggccgtcgaggcgctgcgccgcgcgctggccttcgagccgcagcaccagatcgtctgggtcgccagcaacggtgccgaggcggtgacccagtgcgccgccgatacgcccgacgtggtgctgatggacctgctcatgccggtgatggacggcgtcgaggcaactcgtcggatcatggcggaaagtccttgcgcgatcgtgattgttaccgtcgatatcgagcagaatgtgcaccgggttttcgaagcgatgggatatggggcgctcgatgcggtgaacacgccggcgctgggcatcggcaacccgcaaacggcggcggcgccgttgttgcgcaagattcagaacgtcggctggctgatcggccagcgcgataaccgtggcaaggtccaggtggtgccgccgaaggccggcggggcgcgccagcgtctggtggcgatcggcgcctcggctggcggtccggcgtcgctcgcggtgttgctcaagcaactgccggccagtttcaatgccgcagtggtgctggtgcagcatgtcgacgaggtattcgccgccggcatggccgaatggctggccagcgaatcgaagctgccggtgcgcctggcgcgcgatggcgagccgccgataccggggcagatcctgctggcggggaccaacaatcacatccgcctgctgcgcaacggttcgctggtgtacaccgccgaaccgcgttctttcgtctaccggccgtccatcgacgtgtttttcgagagcgtggcgaattattggcgtggcgatgccgtgggcgtgctgctgaccggcatgggccgcgacggcgcccagggcctcaagcagatgcgcgagcgcggtttcctcaccatcgcccaggaccaggccagttgcgcggtctacgggatgccgaaggccgcggcggcgatcgatgcagcggtgcagatcctttccctggaaaagatcgccccgcgcctggcggaggtattcaattag

SEQ ID NO: 1698 - DNA, 543 bp, Pseudomonas aeruginosa
ccagcggcctggccgactcccgcgacctgctggacatggcggtcgaggaagacgacgagggcgccgtcgacgacgttgccaacgaagtcgagcgtctgcgcgagatcctcgagaagctggagttccgccgcatgttcagcggcgagatggacccgaacaacgcctacctggacatccaggccggctccggcggcaccgaggcccaggactgggccaacatgctgctgcgcatgtacctgcgctgggccgacaagcacggcttcgacgccactatcatcgagctgtccgagggcgaggtcgccggcatcaagggcgccaccgtgcacatcaagggcgagtacgccttcggctggctgcgcaccgagatcggcgtgcaccgcctggtgcgcaagagtccgttcgactccggcaaccgtcgccacacctcgttcaccgcggtgttcgtatcgccggaaatcgacgacaacatcgagatcgagatcaacccggccgacctgcgcatcgatacctaccgctcctccggcgcgggcggtcagcacgtga

SEQ ID NO: 1699 - DNA, 456 bp, Pseudomonas aeruginosa
tcgtccgcgacggcgtacgggccgtgcgccaccgcgcggtggccgccgaggcccaggtgccgttgtcggccaccacctactacttcaaggacatcgacgatctcatcaccgacaccttcgccctcttcgtcgagcgcaacgcagaggcgctgtcggcgttctggagcagcgtggagggcgacctccaggagatggccgcggtgctggccgacgaccccggcgcccgtggctcgctggtggaacggatcgtcgagcttgccgtgcagtatgtccaggtccagctcaccgagcgccgcgagcacctgctggccgagcaggccttccgccaggaggcgttgctcaacccgcgcctgcgcgaactggccgatgcccaccagcggattctctccctcggcgccgtgcatttcttccaagtgctcggttccgggcagcccgagcaggacgccaaggtgttga

SEQ ID NO: 1700 - DNA, 2181 bp, Pseudomonas aeruginosa
acgatcccgccaattccgacgtgttcgtcgaggccgcccgcttccagcgggtcacccaatgagattgccgatgagccagcgcaaggcgcagaacgactaccagaagatcatccgctccctgtccgatcgcatcgtcgaggcgcagacgccgattcgcgtgctggatgcgatcaaatgggacgacgggatccgccaggacttcctcaagggccgcggcaagcatgcgccgaaggtcgatcgcggctactacgacagccgcccgctggccttcgacgccagcgccaagaagcaggaattccagaacatcgagcgcgacatcacccgccagttgggccagttcaacccggtcgggcagatcatgcggcggatgtgcaaggaataccgaatggtcattcgcatgctcgaggcgcgcggcaccccggacctcgggctgatctcccaggaactctacggctcggcctcggacgccttccatgccggcgatccgaccctggccgacctcggcctgatgctctccgactacctgaacaacatcgccgaccgcggcgatctcaaggacgaacccaagaccctgaccgccaaggaggtcgtaccgatcctccaggcgcggctgaacaccgtgttcggcgaggaggagggcaccatccgcgtgttcgagtccgacggcatcgtcgccgacgcggcggccggcgccgactacatcaaggtacgcgccgacgccctgttcaacgagcgcgacgtgcgcgcgctggaggtccacgagggcctggtgcacgtcggcaccaccctgaacggcctgagccagccgatctgcaccttcctcgccaagggaccgccgtcctccaccgtgacccaggaaggcctggcgatcctgatggaggtgatcgccttcgcctcctacccgacccgcctgcgcaagctgaccaatcgcacccgggcgatccacatggccgaggagggcgccgatttcctcgacgtgttccacttctaccgcgagcagggctacagcctggaggacagctaccagaacgccagccgggtcttccgcggctcgaccccggatggcctgccgttcaccaaggacctgtcctacctgaagggcttcatcctcatctacaactacatccagctcgccgtgcgcaagggcaagctcgaacagatccccctgctgttctgcggcaagaccaccctggaagacatgcgcaccctgcgccaactggtggacgagggcctggtggcgccgccgaagtacctgccgccgcagttccgcgacctcaacgcgctgtcggcctggatgtgcttctcgaacttcctcaaccacctcagcctggaccgcatcgaagcggactacgcgaacatcctctgaccgttccccgccgtgccggtctttcccggtgcgcgcgggcggtcggccggcaagcaaggagaacggcgatggccagccacgaactcgactaccgcatcctcggcgaatccatgcagaccgtggagatcgaactcgaccccggggaaaccgtgatcgccgaggccggggcgatgaactacatgaccggcgacatccgcttcaccgcgcggatgggcgacggctccgacggcagcctgctgggcaagctgtggagcgccggcaagcgcaagctcggtggcgagtcggtgttcatgacccacttcaccaacgaaggccagggcaagcagcacgtggcctttgccgcgccctatccgggcagcgtggtggcggtggacctggacgatgtcggcgggcgcctgttctgccagaaggactcgttcctctgcgcagcctatggcacccgggtcggcatcgccttcaccaagcgcctgggcgccggtttcttcggcggcgagggcttcatcctgcagaagctcgagggcgatggcctggtcttcgtccacgccggcggcacgctgatccgccgccagttgaatggcgagacgctgcgggtcgacaccggttgcctggtggccttcaccgacggcatcgactacgacgtgcaactggccggcggcctgaagagcatgctgttcggcggcgaaggattgctgctgaccaccctcaagggcagcggcaccgtctggctgcagagcctgccgttctcgcgcctggccgggcgcatctacgacgccacctttcgcgcccgcgaagaggtaaggaccaacaacggatga

SEQ ID NO: 1701 - DNA, 828 bp, Pseudomonas aeruginosa
cgtactcccctgcatcctgaccggcatcggtaccatcttcgtcaccgtcggcgtgctctggtactacggctacctgcatttcgccaagccgcaggacgccctgttgctggccgacttcaccatgctgaagagcctgcccggcgaagatgtgaagctgtccctggagccggccaagcaggtcgcgcagtgcatcgatggcgtcctggtgctgttcgacaccgagcagaagggcctttccggcgtgctggtggacaacaggaagcacgccgtgcgctgcgccggacaggaagtcccgcaggaagtgaaatgaccgaggtccgcgtctggcagggagacatcacccgtcttgcggtggatgccatcgtcaacgcggcgaactcctcgctgctcggtgggggcggtgtcgacggcgccatccaccgcgccgccggtgccgaactggtggcggcctgccgcctgctgcacggttgcaagaccggcgaggcgaagatcacccgtgggttccgtctgccggcggcccacgtgatccacaccgtcggcccggtctggcgcggcggcgacaacggcgaagcggagctgctggccagctgctaccggcgcagcctggcgctggccgagcaggccggggcggccagcgtcgcgttccccgccatcagctgcggcatctacggctatcccttggagcaggccgcggccattgccgtcgaagaggtctgccggcaacgcccggcgcacagcagcctggaggaaatcgtcctggttgccttcgatagctcgatggccgagcgctaccagcgcttgctcggcgagcggcctgtggcccgctga

SEQ ID NO: 1702 - DNA, 807 bp, Pseudomonas aeruginosa
ggcttatcagccgctgacggaggagcgtggcgcgaccggcttggcgtcgttggaaatggtgacttccacccgacggttcatggcacggccggagctggtgccgttgctggccaccggatattccttgccgtagccacgggtggctacgcgttccgggctgatgccgcggctgagcagggccatgcgcaccgagtcggcacgacgctcggacaggcgctggttgtagttggcggaaccggtgctatcggtgtagccctctacgatcacctggcgctccgggttctgctggaggaactcggccagttgctggatgttgcgcatggcgccgggcttcaggtcggacttgtcgagatcgaacagaacgtcgccgaaggtcaccatggtgccgcgcgaggtctgcttggcattcagttggctacgcagcttgtccagttgcgcggtgcgcgcgtcgaggcgggcctgggcgcgctgggcggaggcgttctgcaactgcgcctcggcattgcgcaggacgatggtctgcttggccagttcgatgcgctggttggtcaggtaggccagttggtccacgtcgcgctggtcttcgccatcctggtaggccttgtcggccttggccagccagtcgccggcgtccttggtttccagggccgcgaccttggtcgcgtcgggctgcgactgcagcgcggagaagttgctgcgggcctgttccaggttggcgttcggcggcgtggagcaggcggccagcgccagggccagcagggatacggcggggagggcaatgtacttacgcataggggtcatccttaa

SEQ ID NO: 1703 - DNA, 681 bp, Pseudomonas aeruginosa
aaacgcttgcgcaacagtcgcagaccgttgaacaccaccagcaggctggcgcccatgtcggcgaataccgccatccacagggtgccttcgcctgccagggtaagggcgaggaacaccgccttgatgcccagggccagggtgatgttctggaccaggatcgcgtgggtggtgcgcgacagccggacgaattgcggcaacttgcgcaggtcgtcgtccatcagcgcgacgccggcggtctcgatggccgtgtcggtgcccgccgcgcccatggcgaagccgatgtcggcgcgggccagggccggcgcgtcgttgatcccgtcgccgaccatgccgacccgcgagccgtcggcctggcgcgcttccacttcacgcagcttgtcctccggcaggaggttgccgcgagctgcgtcgatgcctacctgggcagcgatggcggctgcggtgtgcgggttgtcgccggtgagcatcagggtcttcacgtccagcgcgtgcagctcgcggatcgcctcgcggctgctgtccttgaccccgtcggcgacggcgaagagggcccgcacgcgctgcggatcgcacagcgcgatgaccgtcttgccctggcgctccagggcgtccaggcgctcttccagggccggcgagcagaggcccagttcctccaccaggcgatggttgccgaggtggtag

SEQ ID NO: 1704 - DNA, 555 bp, Pseudomonas aeruginosa
acgcgggcgaaactgtcgacgaaacgctgggtcggtgcgcgggaaccctgggcttcctccacggcgtggatgatccgggccagggtgctgtcgtcggcgcggcgggtgacgcggtactccagcgcgccctcgccgttgatgctgccggcgaacaccggctcgccgacctccttctccaccggcaggctttcgccggtgatcggcgcctggttgacgctggagcggccgctggtcacctcgccgtcgagtgcgatgcgttcgccgggcttcacgcgcacggtggcttccagttccacttgcttggccggcagttccttccattcgccgccgaccagcacggtggcctgttccggagccagttgcagcaggccgcggatggcgttgcgcgcgcgatccagggacttcgcctcgatcaactcggcgatggcgaacagcacgctgaccatcgccgcttccggccactggccgatgagcacggcgccggtcacggcgatactcatcagggcgttgatgttcaggttacggttcttcagtgcgatccagcccttgcggtag

SEQ ID NO: 1705 - DNA, 447 bp, Pseudomonas aeruginosa
gtcggcaggccggcgccgaggatggccagcagggcgaggccggcgaccacccagtccggcgccaggccgaaccattcgacgatctccgaggccagcgccatcgcgccggccagggccagcggccaccagggtttcgccggcgcttgcgaggggccgtcggtattttcgccggcatccagcggcaccgcttgcatgccgaggccggcgatcagcttctgcagcggctcgacgctgtcgaagcgatgctggacgcgcagcaggcgctgcatcaggttgaattccagcgactccactgccggctggcgaccgagggcgtcgcggatcaggcgttcctcggtcgggcagtccatcgcttcgatgcgcaggtcgctccagcgcaactcggcgttgccggccagggttccgatggcggccaccgccgggcgaggcgcgtggcggtgcccatga

SEQ ID NO: 1706 - DNA, 1818 bp, Pseudomonas aeruginosa
ggaaacccccgagcagcccgcgccgttgcgcagcggatacaccaccggcagttgcgccaccgccaccagcctggcggcggcgcgcctgctgctgggcggcacgatcagcgacgcggtgcagatcgtcctgcccaagggccagcaggtgctgatgcgcctggaattctgccgcgcctgggaaaacggcgcggaagccggcaccctcaaggatgccggcgacgatcccgacgtcacccatggcgccctggtgttcgcccgggtgcgcctgagcgccgagcctggcgtgcgcttccatgccggccccggggtcggtacggtgacccgcccggggctgaccctggcggtcggcgagccggcgatcaatccggtgccgcgacagatgatcgaacgccacctcgcccagctcgccgccgaacggggctacgccggcggcttcgaggtcgccatcggcgtggagggcggcgccgagctggcgctgaagaccatgaacccgcgcctgggcatcctcggcgggctgtcgatcctcggcaccagcggcatcgtccggccgttctcctgctcggcctatatcgcctcgatccatcagggcatcgatgtcgctcgcgccaacggcgtccgtcacatcgccgcctgtaccggcaacgccagcgaggacgccatgcgccggcgctatgcgctgccggagatcgccctgatcgagatgggcgacttcgccggcgcggtgctcaagcacctgcgcagggcgccggtggaaaagctcagcctgtgcggcggcttcggcaagatcagcaagctcgccggcggccacctcgacctgcacagccgccattccagcatcgacctgccgcaattggccggctgggccgccgcgctcggtgccagcaccgcgctacaggacagcatgcgcgccgccaacaccagccagcaggcgctggcccaggcacacgccgaaggcgtggccctgggcgatgcggtctgcgcccacgccctgcgcttcgcccgcggcatcgtgcccaccgaggtggcgctggaagtcttcgccatcgaccgccagggcaacctggtcggccaggcctgcgaggagcgccgatgaagcgcctgttgctgctcggcgggatcggtgaggccctggccctcgcccgccggctcggtccggcgcatctctacagcctcgccgggctgggcaaggtgcccggcgacctggcctgccgggtccgggtcggcggctacggcggcgccgaagggctggcggcgttcatcgacgagcagggcttcgacctgctggtggacgccacccacccctacgccgcacggatcagccggaacgccgtgcgcgccgcgcgactggccggagtgccctgctgggcgctgcgccggcccggctggcaggccgggcccggcgacgactggcgcgaggtagccgactggcgcgagctgatcgccgccctcgcacccttccgccgtccgctgttcaccctcggccgcgaaccgctggagcatctcggccaggtcccgccgcaccagcactggaccgtgcgctgcctgcaaggccagccggccgcgccgcgcgccgaggtgatcggcgcgcgcgggccgttcagcctggatggcgaacgggcgttgttcgagcgcctcgcctgcgacgtgctggtgagcaagaacagcggtagccaggccaccgagccgaagctccaggtggcgcgggaaatgggcctgccggtgctggtcctggcgcgtccggcgctgccgccggcggaccgcgagttcgccgacggcgaggcgctgctgacggcgatccgcgattgggaaagcgcctga

SEQ ID NO: 1707 - DNA, 660 bp, Pseudomonas aeruginosa
agcgaacgcccacccactcgccgcgacctgtcccgcctccatctccggcgccgctcacgccgcgctgagatgctcgtagagaatggtcgcgccgaccaggatcagcaccaccccgccgaccatctccgcgcgcttgccggtcaccgcgccgagcgcccggccgagcatggtgccgagggtgaccatggtcatggtggccaggccgatggcaccggcggcgaggaagatgttgacgtcgacgaaggccaggccgacgcccaccgccagcgcgtcgatgctggtggccagcgccgtcaccgcgagaatccagaacgaatgctggccgggcttttcctgttccgtcgcatgatccgcgcgcaggccgttgtggatcatgtgcaggccgagcagcaccagcaggacgaaggcgatccagtgatcccagtcggcgacgaactggctggcggcctggccaagcagccagccgaccagaggggtgatggcctcgatcacgccgaagattatcccggtgcgcagcgcctccgacaggcgcggccgatccaggctggagcccttgccgatggccgcggcgaaggcatcggtggacatggcgaaggcgaggaagatcagggaaacgggattcacgcggatactccagccgggcatgagtcaacgacatga

SEQ ID NO: 1708 - DNA, 2172 bp, Pseudomonas aeruginosa
gatggaacgcccatgccccgcttcagccgtttgcgcaccgagcctttcgccctcggcctctccaccagcctgctgctggtaccgcccgccctcgccgaaaccgaggaagccgccctcgccctgcccagccagttggtcagcgttcgccaggatcccgccgaactcgaccacatcgacctcgccactccggtcagtgccggttcgcgcctgggcctcagcgccctggacaccccggcgagcaccagcagcatcagcggcgaggaagttcgccgacgcaacaaccccagcgtccaggccgccgtcacccgcagccccggcatcagcttcatcggcaccccaggagatggcggtaccggcctctcggcgcgcggcttcagcggccacgcatcggtgatgcaactgttcgacggcacgcgcctgtacaccggcatgggcacggtgaacttccccagcgatccgtggatggtcgagcgcatcgacgtgatccgcggcccggcctcggtgctgtacggcgaaggcgccaccggcgcggtgatcaacgtggtgccgaagaagcctttcgccggcgagatccgcaaccacctgcgcctcggctacggctcctacgacaaccgccagttggccctggacagcggcggctcgctgaccgacagcctcagctaccggctcaacctgaaccagcagcagagccacggctggatcgaccgtggcgactcgcgcaacctgggcatcagcgcggcgctgcgctggcaggccagcgacgatctggccttcaccctcgcccacgactatggcgaccaggagccgatgaacgacttcggcaccccgctggtcggcggcaagtaccacaagcgcctgcgcgagaagaactacaacgtgcgcaacgacgtgcagcgctacaacgaccagtggacccgcctgaccagcgactggagcctttccgacagcgtcaccgcgagcaaccagttgtactacatcaaggcccgccgccactggcgcaacgccgaaacctacgaatgggacgtcccgcgcgaagagctgttgcgcagggactacctgcgcatcagccacgagcaggagcagatcggcgaccgccagaccttcgccttccagcacgccctgttcggcctcgacagccgcaccctggtcggcgccgagtacaaccgcatccgcttccgcctgaccaacaacatatcgccctataccgatgtcggcggcgactacatcgacccctggcatcccgcgcccggctacttcgaaagccgctcgccctaccggccgcactcgcgcagccagacccgcaccttcgccctgttcgccgagaaccgcctgcagctcaacgagcgcctgtcgctggtgaccggggtgcgccgcgaccagaaccatatcgaccgcgacgacctgctcaccggcacccgcagcgaccgcagcctgcagggcggcaactggcgcgccgggatggtcttcgcgctgaccccggaactgtcgctgtacggccagtactccaccagcgaggacggtgtgagcaacctgatcaccctcaacgcggcccagcagcagatggacctgacccactcgaagcagaccgaggtcggcctcaagcagctgttcccggacggtcgcggcgaatggaccctggccgcctaccatatcgtcaagaagaagctgctcagcgccaacccgctgccgccgcacgacgcgcagcaggtcggccagcagagttcggacggcctggaggccagcctggaactgaacctggcccaggactggcggctgtcggcgaacgccgcgctggtgcgtgccgaatacgacgacttcgacgaaacgatcgacgggcagacctactcgcgcaacggcaatcgccccaggaacgtgccacggcgcaccgccaacctctggctggacaagtccttcgccgagaccctgcgcgtcggcgccgggctgcgctacgtcgaccggcgctacgccgacgccgccaaccaggccagcctgcccggctacacggtggtcgactccaacctgggctggcgggtacggccggacctgaccctcggccttgagctgtacaacctgttcgaccgccagtacgccctggctgacaacaacaacggccagcaatggatcatgggccagccacgctcgttcaacgtcaccgccgacttcagtttctga

SEQ ID NO: 1709 - DNA, 1764 bp, Pseudomonas aeruginosa
accaccggacctgcgagtagccatgtcgtcccttcacctcgatgccctgcactggtcgcccgacgcctccaccgagttgctgcgcggcgtgcatctggaagtcccggccagcagtttcgtcggcctgatcggccccaacggcagcggcaagaccagcctgctgcgctgcgccttccgctatgcgcgaccgcagcgcggccgggtggtgctcgacggcgacgacctctggcgccagccgccgcgctgggccgcccggcgtatcgcggtggtgttgcaggagttccccgaggacttcggccttgccgtcgaggacgtggtcgccatgggccgcacgccgcacaagggcctgttcgacggccacggcgcggacgaccgccagcgggtccgccaggcgctactccaggtcggtctcgaagggcgtgccgcgagccccttcgccagcctctccggtggcgagaagcagcgcgccctgctggctcgcgcgctggtccaggaaccgcgcctgctgatcctcgacgaaccgaccaaccacctcgacccgcgctaccagctggagcttctgcgcctgctgcgcggcctcggcctgagcaccctggcgagcttccacgacctcaacctggcggcggccttctgcgaccgcctctacgtgctcgacggcgggcgcatcgtcgcccagggcacgccgaccgaggtgctcgatgccgacctgctgtggcgggtgttcggcgtccgcgccctggtcgaccgccaccccctcgccgaccacccgcgcctgacctggattacccaagcatgaagcacccgatcctgcaccacctgctgctcggcgccctgctcgcctgcgccgatgccgcgctggccgagcgctacccgctcagcgtgcgcagctgcgagcgcgaagtgacgttcgagcgcgcgccgtcgcgcgcggtcagccacgacatcaacctcaccgagatgatggtcgccctcggtctgcagacgcgcatggtcggctataccggcatcagcggctggtggaagaatgccgatcccggattgatcgccgcgctcaagccgctgcccgagctggtggcgcgctaccccacggcggaaaccctgctcgatgtcgacgccgacttcttcttcgccggttggggctacggcatgcgcgtcggcggcgacctcactccggccagcctggagccgctgggggtgaaggtctacgagctgagcgaatcctgcgcgcagatcggcgagccgcgccgcgccagcctcgacgagctataccgcgacctgcgcaacctgggacggatcttcgacgtcgaaccgcgcgccgagcgcctggtcgccagcctccaggcacgcatcgagcgcgcccgcgccggcatcccggcgaacaccgaggcgccgcgggtgttcctctacgacagcggcgaggaccgccccttcacctctggccgcctgggcatgccgcaggcgctgatcgaggccgccggcggccgcagcgtgaccgacgacgtggcggccagttggacccaggtcaactgggaaagcgtggtcgcccgcgatccgcaggtcatcgtcatcgtcgactacggcgagaccagcgccgcgcagaagcagcgcttcctcgaagagaacccggcgctgcgcagcctgaccgcgatccgcgagcgacgcttcatcgtcctgccctataaccaggccacgccgggcatcggcaacgccgcggcgatagaaaccctggtcgccggcctccaccctcgggcgccacgtccatga

SEQ ID NO: 1710 - DNA, 1002 bp, Pseudomonas aeruginosa
tcgaggcgacgacggcgaacagcaggaagggcacgagggattgcatggacgggctcctgtggcgggggagccttcatcctggcgacgcgccgggcctcagtctggaagctgggtgcactgccggcggtaggccgccggggtcatcccgtaggcgcgccggaaccagcggccgagatggctctggtcggcgaaaccgagagcgctggcgaggtccgccggttgcccgccgacagcgagcatctgccgcgccttggccaggcgcaactggaccaggtaggcgtagggtggcaagccgtaggcggccttgaatgcacggttcaggcggaagcggtcggtgccgcaggcgctggccagctcgtccaggccgatgtcctggtagaagtgcgcatgcaggtagtcgcgggctttctgcgccaccagcggcaggcgcggatcgaatggcttcgcctcgcgccagccgaggtgcacgcgcagccgctccagcaccagctccagggcggtctgccgcagcagtcgcagctcgcggccatgcaggacgcggaaggcctgggcgatggccagggtcaggcgcgggtcttcggtgaggttggcgtggaagccggggtcgcggtcgctgggcgcatcgtcgaaggtcgcccgcagttcgcgccgcagccagtccggctgcaggtacagcatcgagtaggtgaagccgccggcgatcggcgcgcgaccgtcgtggatctcccccggttcgaccaggaatacctggccggcggtgctgtcgtgtcggcgtcggcggcagttgaattgctgcacgccgatctcggtgtagccgatcaggtagctgtcgtgccagtgcggatcgtaggcgtggccctcgaaatgggcgcgcagggtctcgatcccggtctcggcgtcgcgggccaggtcgatccagtctcggctccccatcgtgcgtcaggtcttcccactcgttggtttcgtcgccgcgactataacgcgcccgtcccggggttctag

SEQ ID NO: 1711 - DNA, 915 bp, Pseudomonas aeruginosa
aagattcgtgcaggcggctgcgctcctccggaggcgggaattgatcggcgtttctggacaatctatccaggccgccgcgattactccgcaaggccgccctccctagactgggttctccactcaccgcaggagaaacaccccatggtcgaccactccatcaaaggcaagaccgtcctcatcaccggcggcgccaagaacctgggcgggctgatcgcccgtgatctcgccgcccacggcgcgaaggcgatcgccatccactacaacagcgccgcgagcaaggccgatgccgacgccaccgtcgccgcgctgcaggcagccggagccaaggcggtagcgctgcagggcgatctcaccagcgccgcggccatggaaaagctgttcgccgacgccatcgccgcggtgggcaagccggacatcgccatcaacaccgtcggcaaggtgctgaagaaacccatcaccgagatcagcgagaccgaatacgacgagatgagcgcggtcaattccaagtctgcgttcttcttcctgcgcgaagccggcaagcacgtcaacgacaacggcaagatctgcaccctggtgacctccctgcttggcgcctataccccgtactacgccgcctatgccggcaccaaggcgccggtggagcacttcacccgtgccgcttccaaggagttcggcgcgcgcggcatctcggtcaccgcggtcggcccgggccccatggacacgcccttcttctaccccgccgaaggtgccgatgcggtggactacctgaagaacgccgcggccttgtcgccgttctccaaaaccggcctgaccgacatcgacgacgtggtgccgttcatccgccacctggtcagcgaaggttggtggatcaccggccagaccatcctcatcaacggcggcttctccaccaagtga

SEQ ID NO: 1712 - DNA, 519 bp, Pseudomonas aeruginosa
tcgccggcacccaggtgcacatgtcggcctgctccaccagggtctgcaggatcgccacggagtgcgcgcggacgatgcgccgctcgtcgatcaaggcgccgtggcgccagaacaactcgcgcatcagggcgtcgtggccgtcgccggtgtagttcaacgcccagtcctgttccagcagctcgtggatcgagccgcaacccgccagcggatgcccctggcggaccagcaccgcggtgtcgtagtcgagcagcttctcgcaggcgaactcctgggccgcctgggcgccgtgcagcgggccgatggcgaaatccatgctgccgtcgcgaagcaatggctgggccaccgccatcaggctttcgaaaagctccaggcgcacctccggcatgcgctcgcggaacgcctgcaccgcctccgagaggaaggtcagcgccacccaaggcgtcaccccgatgcacagccggccgctggcctggccacgcaggtggtcgagttcgacctgcgcgtgctccagttgcttga

SEQ ID NO: 1713 - DNA, 1071 bp, Pseudomonas aeruginosa
tcggcaatggccagggcgagagcggctgccagttgcacaaccccggctacgacttcaacgacgactgcctggccgtcggcgccagctactgggtgcgactggccgagcgcttcctggcctgagccagggttttcaacgggcgcgcggcctggcgcgcgcggatcgacagaggacaaccacaatgacaagaaccctcggcagcatcgccctctccctcctcctcgccgcaccggccggcgccgccgactggacaggcaaggtcctgcgcctgggcgtcgacccgacctacccgccgctcgaatacaagcagccggacggccgcctggcaggcttcggcatcgagatcggcgaagccctctgcgcggagctgcgagcccgctgcgaatgggtcgaaagcaactgggacggcatcatcccggcgctgctgtcgcgcaagatcgacgccatcgtctcgtcgatgaccatcacgccgaaacgcgcacagcacatcgccttcaccgaccgcgtctccaacgcgccgagccgcctggtggtacgccgtggctcggcgctcctgcccgacgccgagagcctgcgcggcaagcgcgtgggggtcggccagggctccaaccaggaggcctacgccaaggccgaatgggccgccaagggggtgcgggtcgtctcctaccagaaccaggaccaggtctacgccgacctcgtcatgggccgcctcgacgcctcgctgcaaggcgcggtgcaggccagctacggcttcctcgacaagccggtcggcaaggatttcgaactggccggagcggtgctggacgaccctcgctacttcggggtcggcgacggcatcggcctgcgcaaggaggacgtggcgctgcgcgaggacctgaacaaggcgctggcgacgatccgcgccaacggaacctacgcgcgaatcaacgcccgctacttcgacttcgacctctacggcacgccctgaacggcgtccggccgcttttcacctcgaccgacaacaacaagcaatggagagtgaaatgttcctcgacggcttcggcccgcagatactcgccggcaccctggtga

SEQ ID NO: 1714 - DNA, 432 bp, Pseudomonas aeruginosa
tccgcagcgtccccgacctggtcatcatgctgttgctgttcttcagcctgcagatcctcctcaaccgcgtcaccgacgccctcggcatcggccaggtcgacatcgacccgttcgccgccggctgcgtcaccctggcgttcatctatggcgcctacttcacggaaaccttccgcggcgccttccaggcggtcccggccggccaggtcgaagccgcgcaagcctacggcatggggcgctggcgagtgttccgccgggtactcctgccgcagatgctgcgctacgccctgccgggcatcggcaacaactggcaggtgctggtcaagtccaccgcgctggtctcgatcatcggtctcggcgacctggtcaaggccacccaggacgccggcaaaggcaccctgcagttcttccacttcaccctggtctgcgggctga

SEQ ID NO: 1715 - DNA, 1587 bp, Pseudomonas aeruginosa
tctacctggccatcaccgcaatctccaacgccgcgctgctgtggctggagcggcgcagctcgctgggcgtcaggaggccgctgccatgaacgcggtactcgacgaatactggcaggcctacctgtggaccgacggcctgcaactgaccggactggcgatgaccctgtggctgctgatcctcgccgtggcgcttggcttcctgctggccatcccgctggcggtggcgcggacctgcggcaacccgctgctgcgctacccggtctggctctacacctacgtgttccgcggcaccccgctgtacatccagttgctgttcttctacaccggcgtctacagcctgaatgccatacgcgcccaggactttctcaacgcgttcttccgcgacggcttcaactgcacggtgctggccttcgtcctcaacacctgcgcctacatgacggaaatcttcgccggcgcgatcaggaacacgccccacggcgaagtggaagcggcgcgcgcctacggcatgggcggcttcaccctctaccggcgcatcgtcctgccctcggcgctgcgccgggcactgccgtacttcagcaacgaagtgatcctgatgctgcattccacctcggtggcgttcaccgccacagtgccggacctgctcaaggtggcccgcgacgtcaattccgccacctatgcgccgttcctgtccttcggcatcgccggcgcgctctacgccggcaccgccttcctgctgatctggctgttccgccgcggcgagctgcgctggctggcctacctcagaccgcaaacccactgacctctcccggagacacgcgcatgtacagcctgcaggtcgaagacatccacaagcgctacggcagccatgaggtgctcaggggcgtttcgctcagggccgggaagggagacgtgatcagcatcatcggctcctccggctcgggcaagagcaccttcctgcgctgcgtcaacttcctggaaaagccctgtgccgggcgcatccgcgtcggcgacgaggaactgcgcacccgtcccggcaccctgggcgagctgcgcgccgccgatccccggcagttgcagaggatccgcagccggctggcgatggtcttccagcatttcaacctgtggagccacctgacggtgctggagaacgtggtcgagtgcccggtcaacgtcctgagaatgaaccgcgacgacgccgtggcccacgcgcgccactacctggccaaggtcggcctggcggagaaggtcgaacggcagtatccctgcgaactctccggcggccagcaacagcgcgtggcgatcgcccgcgccctggccatggagccgcaggtgatgctgttcgacgaaccgacctcggcgctcgatccggaactggtcggcgaagtgctgaaagtcatgcagcagttggccgaggaaggtcgcaccatggtcctggtcacccacgagatggccttcgcccgccaggtttccagccatgtgatcttcctccaccagggcgtgatcgaagagcaagggacgccggaccaggtgttcggcgcgccgcgcagcgaacgcctgcgccagttcctcgccggcaacctgaaatga

SEQ ID NO: 1716 - DNA, 1653 bp, Pseudomonas aeruginosa
gcctggggctcagcgcgacggcgcgaggaaacgcacgaagaccagctccggatcaccttcgtcgaggttgtcgatcaccccgctcggctggaatcccttgcgctccagcaggcgccgcatcggcaggttggagcggttgcaggaagtgaacaggcggtcgccgcgacagtcgtcccgcgcctgccgcagcaacgcgctggcgatgccgcgccggcggcagtcgggggcgaccgccgcatcctagacgttttcacaggtcagggcacgtcgccgcggcgcatgatctatagtcgcccggatcagccccagaggatgccggacatgccccgttcgatcgtcatcgtccacggctggagcgacgattcgaagtcgttccgccgcctcgccgagcagatggaagcctggttcggcagcgcgccgacgcagattcgcctcgccgactggatctccctgcaggacgacgtcacctacgccgacctcgccgccgccctggatcgcgcctggaccgcccagggactgtcgcgggcaccgcgcacggttgacgtggtggtgcacagcaccggcgccctggtgctgcgcgactggctgacccgccacttcgaccccgccagcgcgccggtcaagcgcttcctgatgctcgccccggccaacttcggctcgccgctggcgcacaagggacgctccttcatcggtcgcgtactgaaaggctggaaccgcttcgtcgggcagaccggcacccaggtgctgaagggactggagctgggctcgccgtactcctggcaactcgccgagcgcgacctgttcggcgccgaggcctggtacggcgccggccgcctgctcgccacggtgctggtgggcaatgccggctacagcggcgtcgaagccatcgccaacgaagccggcggcgacggcacggtgcggatcgccacggcgaacctcaacgcctgccgcctgagcctcgaactggatgtccgccagcgcgccaggcccggctggcgcctggaagaatcgcgcggcgagatcgccttcgccatcgtcgacggcgagaaccacgccagcgtggcgctgaaggaccgcggaccgaagaacccgcataccctggagctgatccgcgccgcgctggaggtcgaggacgccgattaccggagcagcggcgcaagcttcccctggcagcgccgcatcgatcagctcgaccccggcatcgagcgccgctcgccgcgctacctgaacctggtcagccacgtctgcgacgacctcgaccaggaggtgcgcgactacttcatccagttcttccgcaagctgaacagcgaccggcgtttcgaacagcgcttctacgagcaggtcatcgccgacgtccatccctacgaggacaaccccgcctaccgctcgctgtacctgtcgatcgagtccctcgacgacctgctcgccggtttcgccgtggacaccctgtcgctcagcgtgtcggcccagccgccgttcgatccgccgcgccagccggtcggctataccgcggtgggccccggcgacagcgaaggcctggcaattccgctggcgcaggtgccgcgcttcctcgcagcccaccgcaccctgctgctgcgcatccgcctgacgcgcctggtggacagcggcgtattcgtcttcaggaacccctga

SEQ ID NO: 1717 - DNA, 1737 bp, Pseudomonas aeruginosa
cctggagaaccgcgcgcggttcctgctggagatcgtcgacgcgctggtcgccgcggtcggtgccgagcgcgtcggcctgcgcctgtcgccctggggcacgatcaacgacatgcacgacgacgagccggaagcgatgaccctttaccttgccgaagccctgctgcgacgcggcatcgcctacctgcacctggccgagtgggaatggagcggcggcccggcctacccgcaaggcttccgcgagcgcctgcgcgaacgcttccgcgcgccgctgatcgtctgcggcaactacgacgccgagcgcgccgaagcgatactccaggccggactggccgacgcggtggcgatcggccggccgttcatcgccaaccccgacctggtcgagcggatccgtctcggcgcgccgctggccgaggccaaccaggcgcggttctacggtggcgacgctgccggctacaccgattacccgactctcggccagtccgctacggcctgattcccttccctcccatgcatcgttcccgggcgcggccacggctgcgctcgcggaggagtcttgccgtgctattgccgatcctcctgctggccgccgccggcttcaccatcctgaccaccgagttcgtcatcgtcggcctgctcccggcacttgccgcagacctccaggtcagcgtcgcccaggccggcctgctggtcagcctgttcgccttcagcgtcgccgccttcggtccgttcctcaccgccgcgctggcgggcgtcgaacgcaagcggctgttcgtcgcctgcctgctgctgttcgccgcggccaatgcgctggccgccgtggccggcgatatctggacgatggccgtggcgcgcttcgtcccggccctggcgctcccggtgttttgggccatggccagcgaaaccgccgcgcacctggccggcccctcgcgcgaagggcgcgccgtggcgctggtgttcttcggcatcgtcgccgccaccgtgcttggcattcccatcggcacgctgatcgccgacgcctggggttggcgcctggcattcgccgcactcgccgcgctggccctggccaaggcgctgctgctggccgcctggctgccgcgcattcccggacggccgggtatctcgctgcgcagccaggcgagcgtgttgcgccaaccgctggtgctcggccacctgttgctgtcgctgctggtcttcaccggcatgttcaccccctacacctacctggccgacatcctccagcgcctggccggcttcagcggttcgctggtcggctggacgctgatgggcttcggcgcggtaggcctgctcggcaactggctcggcgggcgcctggtggatcgcagcccgctgggcgcaaccctgctgttcgtcctgctgatggcgctgggcatgctcgccctggtgccgaccctcggcaacgcctggctgctcgccgccaccctggcgatctggggcgtggcccaggcagcactgttcatcgtcggccaggtgcgggtgatgaagtccgcgccgcgggccccggcgttcgccgcctcgctgaacatctccgcctgcaacgccgggatcggcatcggcgccctcgccggcagctgggtgatcgacggcagcggcctggcgccgctcggcgaggtcggcgcgctggtctgcctggcggcgatggccgtggccctgctgctgatgctggcgccacgccaagctgccaccgagccgtccctcggcggccaaatccctcactga

SEQ ID NO: 1718 - DNA, 981 bp, Pseudomonas aeruginosa
gcccaccaaggaagcacaaccatgatcctcgatagactctgccgcggcctcctggccggcatcgccctgaccttctccctgggcggcttcgccgccgaggaattccccgtcccgaatggcttcgaaagcgcctaccgggaagtcgacggcgtgaagctgcactacgtgaaaggcggccaggggccgctggtgatgctggtgcacggtttcggccagacctggtacgaatggcaccaactgatgccggaactggccaagcgcttcaccgtgatcgcgccggacctgcccggcctcggccagtccgagccgccgaagaccggctatagcggcgaacaggtcgccgtctacctgcacaagctggcccggcaattcagcccggatcgcccgttcgacctggtggcccacgacatcggtatctggaacacctacccgatggtggtgaagaaccaggccgacatcgcccgcctggtgtacatggaagcgccgatcccggacgcgcggatctaccgcttcccggccttcaccgcccagggcgagtcgctggtctggcacttcagtttcttcgccgccgacgaccgcctggcggaaaccctaatcgccggcaaggaacgcttcttcctcgagcacttcatcaagtcccatgccagcaacaccgaggtgttcagcgagcgcctgctggatctgtacgccaggtcgtacgccaagccgcacagcctgaacgcctcgttcgagtactaccgcgcgttgaacgagagcgtgcggcagaacgccgaactggcgaagacccgcctgcagatgccaaccatgaccctcgccggcggcggccacggcggcatgggcacgttccagctggagcagatgaaagcctatgcggaggacgtcgaaggccatgtcctgcccggctgcggccactggctgccggaagagtgcgccgcgccgatgaatcgcctggtgatcgacttcctcagccgcggtcgctga

SEQ ID NO: 1719 - DNA, 204 bp, Pseudomonas aeruginosa
gggtcagccgcgccccgccccaggctctgccggcgtggcgcgagtgccggggcgaaggaaaaaccaacttacaatgatcccgacccggaattattccgccaagtagcttccgcttcggaaaaaagcgactcgcagcactgtttcggtgcaataacgtcacatttgaaagtttcgattaagttttccgttatcgattatccataa

SEQ ID NO: 1720 - DNA, 726 bp, Pseudomonas aeruginosa
cggctcttgatcccggtcaccgccaccagaccgacgttctgggcgaaggcgctctgggtgaaggagccgaagatcggcgccagcatgctggagaacatgtccgcgcgcaggccgttgcccaggcgccgcgagtcgaccttggtgtcgatgatctcgcctaccgcgaggatgtccgccgaggtttccaccagggtcaccatgatcacgatgcacatcgagatgatcgcggcgacctggaaggtcggcatgccgaagtggaacggcgtgggaaacgccaccagcgggccttcggtgaccttggagaagtcggccatgccgaggaacaccgcgatgacggtgccgatgaccatcgccaggaggatcgacaggcgcgagatcgaggcgctgccgagcttgctcagcagcagcacgatgaccagggtgatcgccgccaggccgatgttggccatgctgccgaagtccggcgcgtggctgttgccgcccatcgcccagcgcgcggcgaccggcatcagggtcaggccgatggtggtgatgacgatgccggtcaccagcggcgggaagaatttggtgatgcgcgagaagatcggcgtgatcagcaacccgatcagcgaggccgccatcaccgcgccgagcactgcgggaatgccgccgctgccaccgctgccgatgatcgccaccatggtcgccacgccagcgaaggacaccccctggaccaacggcaactga

SEQ ID NO: 1721 - DNA, 1755 bp, Pseudomonas aeruginosa
aattcacatttcaggaattacgccaggacagcccggaaagcgctcctagtctggcagtcaggccgtgcccgaggcggcatttcgggcaatagcgccatgccatcaacggcttatcgatcatcgcctcacaaggaacggagtctcatgagcaacaagaacaatctcagatacgcactcggcgccctcgccctctcggtttccgccgcatccctggcggcaccttcggaagcgcaacagttcaccgagttctggacgcccggcaaacccaacccgtcgatctgcaaatcgccgttgctggtcagcaccccgcttggcctgccgcgctgcctgcaagccagcaacgtggtcaagcgcctgcagaagctggaggacatcgccagtctcaacgacggcaaccgcgccgccgccacgccgggctaccaggcctccgtcgactacgtgaagcagaccctgcagaaagccggctacaaggtcagcgtgcagcccttcccgttcaccgcctactacccgaaaggcccgggtagcctgagcgccaccgtgccgcagccggtcacctacgaatgggagaaggacttcacctacctgtcgcagaccgaggcaggcgacgtcaccgccaaggtggtcccggtggacctgtccctcggcgccggcaacacctccaccagcggttgcgaggcggaagacttcgccaacttcccggccggctcgatcgcgctgatccagcgcggcacctgcaacttcgagcagaaggccgagaacgccgcggccgccggcgccgccggggtgatcatcttcaaccagggcaacaccgacgaccgcaagggcctggagaacgtcaccgtgggcgagtcctacgagggcggcatcccggtgatcttcgccacctacgacaacggcgtggcctggtcgcagaccccggacctgcagttgcacctggtggtcgacgtggtacgcaagaagaccgagacctacaacgtggtcgccgagacccgtcgcggcaacccgaacaacgtggtgatggtcggcgcgcacctcgactcggtgttcgaaggccccggtatcaacgacaacggttcgggcagcgccgcccaactggagatggccgtgctgctggccaaggcgctgccggtcaacaaggtgcgcttcgcctggtggggcgccgaggaagccggcctggtgggctcgacccactacgtgcagaacctcgccccggaagagaagaagaagatcaaggcctacctgaacttcgacatgatcggctcgccgaacttcggcaacttcatctatgacggcgacggttccgacttcggcctccagggtccgcccggctcggccgccatcgagcgcctgttcgaagcctacttccgcctgcgcggccagcaatcggaaggcaccgagatcgacttccgctccgactacgccgagttcttcaacagcggcatcgccttcggcggcctgttcaccggcgccgagggcctgaagaccgaagagcaggcgcagaagtacggcggcaccgccggcaaggcctacgacgagtgctaccacagcaagtgcgacggcatcgccaacatcaaccaggacgccctggagatccacagcgacgccatggccttcgtgaccagttggctgtcgctgtcgaccaaggtggtcgacgacgagatcgccgccgccggccagaaagtacaatcgcggtcgctgcagatgcagaagagcgccagccagatcgaacgctggggtcacgacttcatcaagtaa

SEQ ID NO: 1722 - DNA, 522 bp, Pseudomonas aeruginosa
ccgatggccagggcgccgccatccaggttgatcctgtccatgtccagccccagttcgcggatgcaggcgatggattggctggcgaaggcctcgttgatctccaccaggtcgatgtcggcgatgcccagcccggcccgttgcagaaccttgcgcgtcgcctgcaccggccccatgcccatgatctccggcgcacaaccggccaccgccaccgccttgatccgcgccaggatcgccagcccgtggcggcgcgcgaagtcctcgctacagaccagcagcgcggcgctgccatcggtgagcggcgacgaggtggcggcggtgacgctgccgccgaacgccggcttcaactgggccaggctctccaggttggtacccgggcggatgcagccatcctcggcgacccggccggcgggggtgtcgatggcgacgatctcctggcgcagcaagccggcctcgcgcgcggcgactgccttggcgtgggagcgtacggccatctcttcctgctcgacgcggctgacggcgtag

SEQ ID NO: 1723 - DNA, 1482 bp, Pseudomonas aeruginosa
gatggattggctggatcgcaggaagatattacgcgcataatatttattgaattacagtcgaaatacaatttgaccgaaaaagccgcaggactcgccgaaacgccctcagacttcgttcaattcactgatatgccgatactcggcccccagttcccgggccaggcgctcggccttgcccaggcgcaacgggccgctttcgaggtcgaccagcaggctcgggcaggcagcctccggcagcgccggccagtcgcgcagacggccgtcggtaagcaccagcagacgctgatgctcggcgggtttctgccgctgtcggcgcgccagccagccagcggcctggtgcagggcgtcgagcagcggcgtaccgccgccggcgcccagctggcgcagccagtcctgcaactcccgcgaggccttctgcccctgccagagccattgcgcctgctgcccggtggcgtgcagcacggccaggcggatacgctgccgataggcctcctcgaacagcgtcgccaacacccccttggcctgggccagggcgccgtaccggcgggtgctggcggaggcatcgacgatcaccagccagagttcgcccgggcgccggctgcgcggctggcgaagcaggtcgcggcgctgtcggggacgtccacgcagcagggtcggcaaccattggatggcgccctccgcaccctggctcagggcgccgccaagaccgccgcgcagggctccgggtctgctcctggcatccgcacccatgaccgagcgcgggcggatgctcagggcttttttggccagcgcggcagctcgcgggcggtccccatggccaccggccgagccggcaattcaccccactgcccttcgccgttgccggtgcgctccgggagcgcgacaggggccgccgcgggcggtggcggtggattggccgccgatggtggcgggttcgactggcgacggcgatgcagcagggcgaaatgttccaccgcatcgatgtcctccgcctcgatccgctcgccgccgcgccaggccgcatgggcgcgcgccgcgcgcagccagaccaggtcggcgcgcaggccatcgacagccgcctcgaagcagcgtcgagcgatgctgtccagcgccgcatcgtccaggggaatccgcgccagccgccggcgcgcctcggcgcaacggcggcgcagggtgtcctgctggccttcccagcgttcggcgaaggcctgcgggtcggcatcgaaggccagccggcgacggatgatctctgcccgctcggccggcggcggctgggtgtcgagacgcacgttgaggccgaaacggtcgagcagttgcgggcgcagttcgccctcttccgggttcatcgtgccgatcagcacgaaacgcgccggatgccggtgggaaatgccatcgcgctcgaccaggttgacgccgctggcggcgacgtcgagcaacaagtccaccaggtggtccggcagcaggttcacttcgtcgacgtag

SEQ ID NO: 1724 - DNA, 216 bp, Pseudomonas aeruginosa
accagcccggcgtcctcgccagcgtgctggacccagcgcctggccggtgccagcgacctggtcggggtaatgctggaaagccacctgctcgacggttgccaggcgctcggcggcgaactgcgctacggcgtctcgatcaccgacggctgcctcggctgggaaggcaccgagcggattctccgcgacgccgcccggcggctcgccgagcggcgctga

SEQ ID NO: 1725 - DNA, 1404 bp, Pseudomonas aeruginosa
gcgtgcggatgcgcgggttgtccggctggctgtggtcgccgtggtaactggccaccggcgcgccgcgcagggtttccaccgccgccagcatgccgccctggaactggtagtagtcgttggaatcgagcaggtcgtgctcgcggttgtcctggttgtgcagcaccgcctgcaggcgttccaggcgctgggcgaagcgttcccgcgccggcgtgccgtcgtcggcggcaccgtaggcgtagccgccccagttcaggtagacctcggcaaggtcggcgcgggtctcccacagccgctcttcgattgcgccctgcacgccggcgccgtaggcacccggcttggcgccgaagatccgccagccggcctgccggcgcgcctccgccggcgccgtgccctgcgcctcgaggcgctggcgctccaagcgtacgcgagcggccagcgggttcagctcctccgcctcgtccagctcggcgaccgcctgcaccgccgcatcgaacaggcggatcaggttggcgaaggcgtcgcggaagaacccggagacccgcagcgtcacgtcgacccgcgggcggtccagcagggagaccgggaggatctcgaaatcggcgacgcgctggctgccggcctgccagaccggtcgcacgccgagcagggccagggcctgggcgatgtcgtcgccgccggtgcgcatggtcgccgtgccccacaccgagagaccgagctggcgcaggtgatcgccatgttcctgcaggtgacgctcgagcagcaggttggccgactggaagccgatgcgccaggcggtcggggtcggcaggttgcgcacgtccaccgagaagaagttgcgtccggtgggcagcacgtcgagtcgcccgcgactcggcgcgccgctcggaccggccggtacgaagcgcccttcgagggctgccagcagcccgtcgatctcggccccgccacaggcgtccagggtcggtgccacctgttcgcacaagccgcgcaacacctcgccgctggcacgccaggtggcaggcggcgattcgccgcccaggcagcgttctatccagtgcaacgccagcaattccaggcgttcgcgggtatccccgagagtacgccagggctccccgccccgctcttccaggcaggccggccgcgcgccctgccaggcctcgcccatgtcgcaggccagcggatcgaagcccaggccaaggtcgtccgccaggctcttcagcaacccggcgttggcgcccttgccatcgccgcgcggaacccgcagcagcgccagcagggtatccaggcgcaatcgcccgctcggcgactcgccgaacacatgcaggccgtcgcggatctgcgactccttcaggtcgcagagataggcgtccagctgcggcagccagctgtccggatcgtcgctga

SEQ ID NO: 1726 - DNA, 441 bp, Pseudomonas aeruginosa
acggatagatgttcggcagcggaccgagcaacgcgtccggccagcattcggcggacaggccgactcccttgcccggcagccattccaggttaccgtgcttgccgacgtgcagcagggcatcggcgcggtaggcgtggcgcagccagaagtagaacgccaggtagccgtgcggcggcaccaggtcgggatcgtggtagaccgccgccggatcgagctgatagccgcgcgccggctggatgccgacgaaggtcaggccatagcgcaggccggcgaccatcatccgtccgtcgcggaacatcgggtcctgttgcggctcgccccagcgcgccagcaccgcctggcgattgcgctccggcaggcgtgcgaagcaggccaggtagtcgtccagcgccaggctctgggcgcagggccgtaggtcgagatgctccaggtcgttgctga

SEQ ID NO: 1727 - DNA, 1281 bp, Pseudomonas aeruginosa
cgctccaccagctcgccgagggcctcgagcagcgcagcttcctccacctcggggagatcgacgtggaaggagtcgaactcgtcgtggtcgtggtcctcgtggccttcgtggtcgtggtgggtcggccggccgtcgatgtgcagctcggcctcggcgttgagtcccagcaagaccggcagcggcagctcgccccggctcgcctcgacgatcttcactgccgccggcagctccccggcgatctccgcgcggacccgcgccagggcctcggcgtcgagctggtcggccttgttcaggatcaccaggtcggcactggccaactggtcctcgaacagttcgtgcagcggcgattcatggtcgaggttggggtcctggcggcgttgctggtccacctgctcgggatgggcggcgaaggtaccggccgccaccgccggactgtcgaccacggtgatcaccgcgtcgaccgtgcaggcgttgcggatttccggccactggaaagcctgcaccagcggcttgggcagggccaggccgctggtctcgatgaggatctggtcaaggtcgccgcggcgcgccaccagctcgcgcatcaccgggaagaactcttcctgcacggtgcagcacaggcaaccgttggccagctcgaaaacgcggccctgcgcctcttcttcgctgcagccgatggaacattgcttgaggatctcgccgtcgatgccgagttcgccgaactcgttgacgatcaccgcgatgcgccggccttcggcgttgtccagcatgtgccggagcaaggtggtcttgccggcgccgaggaagccggtgacgatggtgacggggagtttcgccagggttttcatgggcagcccttgttcagctcggcgggcatgcggacgagtggcgcggacgcaggggccgcgcaacggattcgccaccggatcaccccgcccggttgtatggaagtcttgtccccgggcatcgcgccacgggatcgacgaggcaggtctcctggctcacggtctggcgtctccgccggttccccgccttcccgcgtcacgcagtggcattggggaacgatcgccgttcacagttgcgggggcagccgcggcatcgaccgcgttcccttttagccccgccgtcgccggcgaggaacctcgaaccggcaaggctacgcagtgcgcgggccagggtcaatcgggccggttgacgcccggcggtccttcatgctgtcctaggcgggttgtcccaggtgtctcgtgccggcgcgcacgaggtgaaacgggaagccggtga

SEQ ID NO: 1728 - DNA, 255 bp, Pseudomonas aeruginosa
agcgggccgtccgggcctgttcctcgtgcgtactcctctgccacgcccatgccaatccagagggaacgcaccatgtccagcagcaccctggcgcacgccagctccaccacctccctgtcgaagcgactgagcctggccatcggcgccggcctgctcggcgcgctgctggtctatttcgccggtttctcgcacatcgacgcggtacacaacgccgcccacgatacccggcacagctccggcttcccctgccactga

SEQ ID NO: 1729 - DNA, 708 bp, Pseudomonas aeruginosa
tcgccggcatcggctgccgccgaggctgtagcgccgagcatctgcgcgcgctgctggagcgaacgctgggcgaacacgggcgcagcctggccgagctggacgccctcgccagcatcgacggcaaacgcgacgaacccggcctgcggcaactggccacgctgctcgaacgccccgtgcatttcctcgcacccgccgtcctgcacgactacgagccgcgcctgctcagcccctccgccgtcgcgctgcgcgaaaccggctgctccagcgtcgccgaggccgccgccctggccctggccgaacgcctgggtggcggtcgcgccgatctgctcggggcgaaacgcagcaacgatcgggcgagcatcgccctggcacgtcttctcaccgaacgagaactcccatgaccgtctatttcatcggcgccggtcccggcgaccccgacctgatcaccgtcaaggggcagcgcctgatccgccagtgcccggtgatcctctacgccggctcgctggttccgcaagcgctgctcgaggggcaccaggccggccaggtggtgaacaccgccgagctggacctcgaacagatcgtcgagctactcgcgcaagcccatcgccgcggcttcgacgtagcccgcgtgcattccggcgatccctccctgtacggcgccatcggcgagcagatccgccacctgcgcgaactcggcatcccctatga

SEQ ID NO: 1730 - DNA, 963 bp, Pseudomonas aeruginosa
agccttcggacacccatgaaacgattcctcctcggtctggttctgctgctggcggtcgccgccggcgtcctctacttcgtcccggctaccctcctcgccagcgtacgcaccgtcgagcgcggtctcgccggtctcagcgagcacagcgtgcaggtcgacaacctggagatcgcctacctggaaggtggctcggagaagaacccgaccctgttgctgatccacggcttcggcgccgacaaggacaactggctgcgcttcgcccggccgctgaccgagcgctaccatgtggtcgccctcgacctgcccggcttcggcgacagcagcaagccgcaacaggccagctacgacgtcggcacccaggccgagcgagtcgccaatttcgccgccgccatcggcgtgcgccgcctgcacctggccggcaactccatgggcgggcacatcgccgcgctctacgcggcgcgccatccggaacaggtgctatcgctggcgctgatcgacaacgccggggtgatgccggcgcgcaagagcgaactgttcgaggacctggagcgcggcgagaatcccctggtggtgcgccagccggaagacttccagaagctgctcgacttcgtgttcgtccagcaaccgccgctgccggcgccgctcaagcgctacctcggcgagcgcgcggtagccgcgtcggcgttcaacgcgcagatattcgaacaactgcgccagcgctacatcccgctggagccggaactgccgaagatcgaggcaccgaccctgctgctatggggcgaccgcgaccgcgtgctggacgtctccagcatcgaggtgatgcgtccgctgctgaagcggcccagcgtggtgatcatggaaaactgcggacacgtgccgatggtcgaacgcccggaggaaaccgcgcagcactaccaggccttcctcgacggcgtacggaacgcccaggtggccggtcgctga

SEQ ID NO: 1731 - DNA, 1287 bp, Pseudomonas aeruginosa
aaacgcgaaccggcgcctgggcgccggttcgggggagcgggagccgtcgcgaggacggctcggatccaggcctcaggcctggatcaggttggcgatctgcacgtccgggttgacgtcctgctcgtagtcgaccccagcgacctcgaaaccgaacaggttgaggaactcgctcttgtagccagcgaagtcggtcaattcgtaaaggttctcgttggttaccttgtcccacagctcctcgacacgggactgcacttccggctgcagttccttgtagtcggcacgcaggcggccttcctcgtcgaggcgcggctcggcgccgtacaggctctcccggtacaggccgtcgacctgctcgatgcaaccttcgtgggtgccctgctccttcatcaccttgaacagcagcgacaggtacagcggcatcatcgggatcgccgagctggcctgggtcaccaccgccttgagcaccgacacgcgcgcgtcgccgcccagcggggcgagcttgtcgcggataccgaggaccttctggtcgagatccttcttggccgcgccgatggaaccgttccagtagatgtcgtgggtgatcttctcgcccaggtaggtgaacgcggtggtcttcgcgccgtcggccagcacgtcggcctccagcagcgcgtcgatccacatctgccagtcctcgccgcccatcaccgcaacggtatcggcgacctcctggtcgctggccgcctccaggaccacgtccttgatcacttccttgtcggtgtccaggccacggaagctgaccgacttgccgatcggcttgagggtcgaggagaacacttcgccgctcttcggatgggtacggcgcggcgcggccaggctgtagaccaccaggtcgaccttgccgagatcgcgcttgatggtctcgatggtcagccgcttcacctcgtcggagaaagcgtcgccattgatgctgcgggcatacaggcctttctcgtgggcgaacttctcgaaggccgccgagttgtaccagccggcggtgcccggcttgctctcgctgcccggacgctcgaagaacaccccgagggtatcggcgccggaaccgaacgcggcggtgatgcgggcagccaggccatagccggtggaggaaccgatgaccaggaccttcttcggtccgttgacgacggggcccttggcctcgacgtagtcgatctgttgcttgacgttggcctcgcagcctgccggatgggtagtgacgcagatgaagccacgcacgcgcggtttgatgatcatgaaaacctcggttgctag

SEQ ID NO: 1732 - DNA, 777 bp, Pseudomonas aeruginosa
ccattagattaccttcgcctcgttcttcagtttctctaccagttcagccacggacttgaccttgatgccagcggagcgtgcagccggcgcctcgaccttcagggtcttcacggtggaagcggtggaaacgcccagggcgtccggggtcaccacgtccagcggcttcttcttggctttcatgatgttcggcagcgacgcgtagcgcggctcgttcaggcgcaggtcggtggtgacgatggccggcaggttcagcgcgacggtctgcagaccgccatcgatctcgcgggtcacgttgaccttgtcgccagcgacctcgaccttggaggcgaaggtgccctgggcgtagccggtcagcgcggcgagcatctggccggtctggttgttgtcgctgtcgatggcctgcttgccgaggatcaccagctgcggctgctccttgtcgaccacggccttgagcagcttggccacggccagggagttcagctcgtcgttgctctccaccaggatcgcacggtcagcgcccagcgccagcgcggtgcgcagttgctcctgggcggcggtcgggccgacggagacagcgacgatctcggtagccacgcccttctctttcaggcgcacggcttcttccacggcgatttcgcagaaggggttcatggacatcttgacgttggcgaggtcgacgccggagttgtccgccttgacgcggaccttgacgttgtagtcgaccactcgtttgactgctacaagaaccttcatggattcctcgttattctccggtga

SEQ ID NO: 1733 - DNA, 1389 bp, Pseudomonas aeruginosa
agagcgccgagagcgctaccaaggtgcccaacttcttcgtgcccaagaccatgcacaacgagggcaactatatcatctccctgggcaacctctgccgctggctggccccaccaggccgaaggactgggcgtggagatctatccgggcttcgccgcccaggaagcgctgatcgacgagaacggcgtggtccgcggcatcgtcaccggcgacctcggcgtcgaccgcgaaggcaacccgaaagaaggctactacacccccggcatggagctgcgggccaagtacaccctgttcgccgaaggctgccgcgggcacatcggcaagcaactgatcaagaaatacaacctggacagcgaggccgatgcccagcactacggtatcggcatcaaggaaatctgggacatcgacccgtccaagcacaagcccggcctggtggtccataccgccggctggccgctgaacgacgaaaataccggcggctcgttcctctaccacctggagaacaaccaggtgttcgtcggcctgatcatcgacctgtcctacagcaacccgcacctgtcgccgttcgacgagttccagcgctacaagcaccacccggtggtcaagcagtacctggaaggcggcaagcgcgtggcctacggcgcccgggccatctgcaagggcggcctgaattcgctgccgaagatggtcttccccggcggcgcgctgatcggttgtgacctcggcaccctgaacttcgccaagatcaagggcagccacaccgcgatgaagtccggcatgctcgccgccgacgcgatcgccgaggccctggccgccggccgcgaaggcggcgacgagctgtccagctacgtcgatgcgttcaaggccagctggttgtacgacgaactgttccgcagccgcaacttcggcgcggccatccacaagttcggcgctatcggcggcggcgcgttcaacttcatcgaccagaacatcttcggcggcaagatccccgtcaccctgcatgacgacaagccggactacgcctgcctgaaaaaggccagcgaagcgccgaagatcgactacccgaagccggacggcaagctcagcttcgacaagctgtcctcggtgttcctctccaataccaaccacgaggaagaccagccgatccacctcaagctggccgatgcgagcattccgatcgagaagaacctgccgctctacgacgagccggcccagcgctactgcccggcaggcgtgtacgaagtggtggccaacgacgacggcagcaagcgcttccagatcaacgcgcagaactgcgtgcactgcaagacctgcgacatcaaggacccggcgcagaacatcacctgggtggcgccggaaggtaccggcgggccgaactaccccaacatgtaa

SEQ ID NO: 1734 - DNA, 1623 bp, Pseudomonas aeruginosa
tcctgtctagcgttacatcgtgtgggtcggccggtccgacttcagcgccccggccaggtaggtttcgatcttgttgcgggcggtgttgtcaccgtcgttgaactgcacgccgatgccagccgcacggttgccctgggcgcccttcggggtgatccagacgaccttgccggccaccgggatcttctccggctcttccatcaggttgagcagcatgaagacttcgtcgccgagcttgtagttcttgttggtgggaatgaacagcccgccgttcctgatgaacggcatgtaggcggcgtacagcacggacttgtccttgatggtcaaggacaggatgccgttacgcggccccagattgggtggcaaactcatgcaggttcctgccagtcgaatatcagcgggattctagcccggcccgggcaggcttgcccactgcaccagcagggcttcgagaagcaggacacggttgaggttggccttgttcaacactttctgccgctgttgcagcagccagtcctgcatggccagcaccttggcctgcccggatttgtcgcccaggtactggatcaccttgcgcatgtcggccaaccccagcccctcctcgtcgtgggtcaactggtagcgcaggatgcccagcgtccagtcgcagaaccagtcgaagagcaatggcaacggcacgctgttccagctttcggccagtgggctggcggcgatctgctgcttgagcagcttcttcaccccctcgaccacctgcgcgcgctgctcgcgcacgccctggccgtgcaggcgctgggcggtgagcggcgagccgccggaaagcgccaacagttcctccagggcctcggccggctcgtcgggcagggcccgcgccagccattccagactcgccgccgcgcccggcaaagggcaggcctgctgcacgcagcggctcttgatggtcggcaacaggcggctgggctggtggctgatcagcagcagcacagtatcgcccgacggctcttcaaggcttttcaacagggcgttggcggcgttcacgttcatcgcctcggcgggttcgagcaacacgaccttgcgcccgcccagttgcgcggtctgcaccacgaagccaaccaggtcgcggacctgatcgacccggatcggtttctccgcctcctccggctccagcacgaagtagtccggatgggtaccggcggccagcaactggcaggccttgcactcgccgcatgcgccagcggcggcaggccgctggcagagcagttgggcggcccaatgctcggccagggcacgcttgccgatcccggcgggaccgtagagcagataggcgtgggcgtgctgggcgcggccgcccagttggctccagagcgcctgctgccagggatagatatcagccattcagacgctccagcagattcggcagcagccgatccaggccagcctgcacctcggccagcggcaacccggcatcgagcacctggtaacgctccggggcctgcgcggcgcgctgcaggtaggtctgacgcacggcctcgaagaagcgtcggtcctcctgctcgaaacggtcgagccggccacgcgccgccgcccgcgccaggccgatttccaccggcaggtcgaagaccagcgtga

SEQ ID NO: 1735 - DNA, 1545 bp, Pseudomonas aeruginosa
cgatcagcttggcgacaccgtcgcccagcgccgcgcagaacgccagcaactcctggcgcaacgccgcggcgtcgagagggatcgccaggcgccgacacccctcttccaggcgcgccaggtggcgctccaggagacgcggcgtgccggcgcgcaccgccagggtctcgaacagcccgtcgccataggccagtccgcgatcgcgcacggacagctcggcggcgggccggccgtcgacccagtccagcatcagtcggcgaacctgcggaacaccagggtgccgttggtcccgccgaaaccgaacgagttcgacagggccacgtcgatcttgcgcggcttggcttcatgggccaccaggtcgagatcgcaaccttcgtccgggttgtccaggttgatggtcggcggggcgacctggtcgcgcagggccagcacgctgaagatcgcctccaccgcgccggcggcacccaacaggtggccggtcatcgacttggtcgaactcatcgacagcgcatgggcatgctcgccgaacacgctcttcaccgcggcgatctcggcgatgtcgccggccggggtggaggtgccatgggcgttgatgtaatcgacctggcgaggatccaggccggcatcgcgcagcgcgttcttcatgcagcgggcggcaccggcgccgtcttccggcggcgcggtcatgtggaaggcgtcgccgctcatgccgaagccaaccagctcggcatagatccgcgcgccgcgggcacgggcgtgctccagttcttcgagcaccagggcgccggaaccgtcggacaggacgaagccgtcgcgatcccggtcccacggacggctggcacgggtcggctcgtcgttgcgagtggagagcgcgcgagccgcgccgaaaccacccaggccgagaccgcaggcagccatttcggaaccgccggcgaccatcacgtcggcctcgccataggcgatgttgcgagcagccatgccgatgctgtgggtaccggtggtgcaggcggtggtgagggcgtagttgggcccctgcagacccaggtggatcgacaggaagccggaaaccatgttgatgatcgaaccgggcacgaagaacggcgagatgcgccgcggcccctgctcgaacagggatcggcagttgttctcgatattggtcaggccgccgataccggaacccatggatacgccgatacgctcacgattggcgtcggtgacctccaggccggaatcgcgaacggcctggaagctggcggcgagaccgtactggatgaacaggtcgagcttgcgggcttccttggcggacaggtattcctcgacattgaaacccttgaccgaaccaccgaagcgggtggaataggcggacaggtccatatgctcgatcggggcgatcccgctgcgaccggcgagaataccttcccaactgctcgggacatccaggcccagcggcgacagcatgcccatgccagtaatgacgacgcgtctacgcgacactacgacttcctctttctcatttcacggggttgcgccgacagactaccagagtag

SEQ ID NO: 1736 - DNA, 1314 bp, Pseudomonas aeruginosa
agactgttcaggttggtgttgaccacatcgaaccactcgtcgtctttcatgcgcaccagcagattatcgcgggtgatgccggcgttattgaccacgatcagcggttggccgagatgctgctggatgtgctccagggtcgcggctacggattcgtcgctggaaacgtccaggaccaggcccgcaccctcgacgccattggccttgagggtttcggcgatcttctcggcgccggacgcgctggtcgcggtgccgatgaccacggcacccaggcgccccagttccagcgcaatcgcctggccgatgccacggctggcgccggttaccaatgcgaccttaccttgcagactcatgggattctctcctttctctctctcaggccagggcggcgcgcgtggcggcgaacgcctcgacgccatccaggccatgggtattgatgcccttcgcgcagcgcctgttgaggcctgccaggaccttgcccggcccgcactcgaccagctcggtgacgcccttttccgccagcagctggatgctctccacccagcgaaccgggctgtacagctgtgccagcaggtcgcggcgcagcgtatcgagatcagccggcacggcggcgctgacgttctgcaccagcgcaatcttcggcgcctgccactgcaggctttcgaccgaggcggcgaactgctcggcggccggacgcatcagttcgcaatgcgacggcacgctgactggcagcgccaccgcgcgcttggcgccgcgtgccttgcatgcctcgatggcacgctcaacggcagccgcggcaccggcgatcactacctgccccggcgcgttgaagttgaccgcgctgaccacctcgccctgggccgcctcggcacaggccgccaatacatcggcgtcttccaggccaaggatcgcggccatgccgccctgccccgccggaaccgcctgctgcatcagttggcccctacgctcgaccagcttgaccgcatcggcgaacgccaggctttcggccgcgaccagcgcggaatattcgcccaagctgtgcccggcgacgaacgccgggcgcgcgccgccctcggccagccagaggcgccagagcgcgatcgaaaccgtgaggatggccggctgggtcttgtcggtctggttcaggtgctcttcaggaccattctggaccagcgcccaaaggtcgtaaccgagcgcctcggaggcctcggcgaaggtatcgcgcaccagcgcctgctgggcgcccagctcggccagcatgccgagggattgcgaaccctggccggggaagacgaatgcgagggatgcagacattga

SEQ ID NO: 1737 - DNA, 1026 bp, Pseudomonas aeruginosa
ccccggaaaccattggtactacatgaaaagaatgctgatcaacgcgactcaacccgaggagttgcgtgttgcactggtcgacggccaacgcctgttcgacctcgacatcgagtcgggcgcccgcgagcagaagaaggccaacatctacaaaggccgcatcactcgcgtcgaacccagcctcgaagccgccttcgtcgacttcggcgccgaacgccacggcttcctccccctcaaagaaatctcccgcgaatacttcaagaaatcccccgaaggccggatcaacatcaaggaagtcctgagcgaaggccaggaagtcatcgtccaggtcgagaaggaagagcgcggcaacaagggcgccgccctgaccaccttcatcagcctggccggccgttacctggtgctgatgccgaacaacccgcgcgccggcggcatctcccgccgtatcgaaggcgaagagcgcaacgagctgcgcgaggccctgaacggcctcaacgcaccggccgacatgggcctgatcgtgcgcaccgccggcctcggccgcagcaccgaggaactgcagtgggacctcgactacctgctgcaactgtggagcgcgatcaaggaagcgtccggcgaacgtggcgcgcccttcctgatctaccaggaaagcaacgtcatcatccgcgccatccgcgactacctgcgccaggacatcggcgaagtgctgatcgacagcatcgacgcccaggaagaagccctgaacttcatccgccaggtgatgccgcagtacgccagcaaggtgaagctgtaccaggacagcgttccgctgttcaatcgcttccagatcgagagccagatcgagaccgctttccagcgcgaagtgaagctgccgtccggcggctccatcgtcatcgacccgaccgaggccctggtttccatcgacatcaactcggcgcgcgccaccaagggcggcgacatcgaggaaaccgccctgcagaccaacctggaagcggccgaggaaatcgcccgccagctgcgcctgcgtga

SEQ ID NO: 1738 - DNA, 459 bp, Pseudomonas aeruginosa
catcggcggcctgatcgtcatcgacttcatcgacatgaccccggcgaagaaccagcgcgccgtggaagagcgtgtccgcgaagccctcgaggccgaccgcgcgcgcgtccaggtcggtcgcatctcgcgcttcggcctgctggaaatgtcccgccagcgcctgcgtccgtccctcggcgagaccagcggcatcgtctgcccgcgctgcaacggccagggcatcatccgcgacgtcgagtcgctgtcgctggccatcctgcgcctgatcgaggaagaagccctgaaggaccgcaccgcggaagtccgcgcccgcgtgcccttccaggtcgccgccttcctgctcaacgagaagcgcaacgccatcaccaagatcgaactgcgtacccgcgcgcgcatcttcatcctgccggacgatcatctggaaaccccgcatttcgaagtgcagcgtctgcgcgatga

SEQ ID NO: 1739 - DNA, 1344 bp, Pseudomonas aeruginosa
ggcttcagcgagcaatgctcttgcagttccaggctcacagtcgccccttggcttcgatcaacagacggtcgcaggcatgttcgatcaggtcgaggacctgctcgaagccttcttcgccgccatagtagggatcgggtacttcgtcccgctcggacccgtagcgacgcaggaacagatccagttcggcggcaccgcgcccggcacgcagggtctcgaggtcggccaggttggacaggtccatggccaggatcaggtcatggcaggagaaatcctcgatgccgacctggcgtccacgcagtgccgacagatcgtagccgcgcctttgcgcggccaggcgggtgcgctggtcaggtgccttgccgacatgccagccggcggtgccggcggaatcgacatggatacgggaggccagcccggcctcctcgaccttgcgccggaacacgccttcggcggtgggcgaccggcagatgttgcccaggcagacgaacaggacgcgcatcagccccccagcacgcggcgaacgcgttcgaggtcttccggcgtatccacgcccggaagcatggtttcgcgggcatcggccacatggattcgcaccccgtgccagagcgcgcgcaattgctcgaggctttcggcgttctccagccagcacggtccccaggcgacgaaatcggcaaggaaacccacgcgataggcgtagatgccgatgtggcgacgatagggcacgccctccggcaggctgtcgcgatcgcgggcgaaggcgtcgcgagcccagggcaagggcgcacgactgaaagtcagggccaggccgtcgatgtcggtggcgaccttgaccacgttcggattgaacagcgcggagacctcatggatcggctcggccagggtagcgatggcagcttccgggtgcgccgccaggttggccgccacctggtcgatgagcgccggggggatcagcggttcgtcgccctggacgttgaccacgatggcatcgctggccaggccgagccgggaagcgacttcctccaggcgatcggtgccggagttgtgctcggcacgcgtcagcagcgcctcggcgccgaacccctggcacgccgccaggatgcgttcgtcgtcggtggcgacgaccacgcggctggcggcgctcttgcgggcctggttccagacgcgctggatcattggctggccggcgatatcctgcaatggcttgccgggcaggcgagtggaggcgtagcgggcgggaatgacgacagtgaacgcctgggtcattacttgtccagccgctcgtccacgttcagggagcgagcctcgctctccagcatcaccgggatgccgtcgcggatcggatag

SEQ ID NO: 1740 - DNA, 993 bp, Pseudomonas aeruginosa
cgcctcgagcgtcctgaagaaacgctgcggattgccgatcccggccagggcatggacctcctggcccgcgggaaaatgctccagcggtcggcgctcgccgctctgcaggttgatcagcgcagtaggctgcaagcggaatgcgtaaccgccgtcaggatcctcgtcggcgccgttgtaaagcagcgcgtcgacgctttccagacgctccgccggttcgcgcaacggaccggccggcaggcaacgaccattgccgagaccgcgcgcggcatcgatcagcaccagttccagatcgcgcgccaggcgatagtgctgcaagccatcgtcgcagaggaccaggtccaactgctcttcggcgagcagcgcctgcagggcgcgcggacgatccgggtcgatcatcagcggcacgccgctgcgccggacgatcatcagcggttcgtcgccagcctccgcggcgtcctgctcggcccgcacccgccacggcgtggtgggcggccgggcaccatagccgcggctgatcacgccaacccgcaagccgcgagccctgcagtgctcgatcatccagaggatcatcggcgtcttgccggttccgccgacggtgatattgcctaccaccagcaccggcagcggtgcccggtaagcgggcttgcgcccggacaggaagtccgcccggcggccgttcgccacccgacgatagagagcctccagcggacgcagcagcgccagcgccggatgcccctggtaccaggcggcgagcagtcgctcggagaacgacatcagggcttggccgccgtgttctcgaccgtggtgatgcgcaggtggacgaagcccagcttgcccgctgcgtccatcgccgtgaccaccgactggtgggtggacttggcatcggcgctgatcaccaccggcaggttgttgtcgcccgccgattcacgctgcatcgccgccatcagggtggccaggtcgctcttggccagcgcctgcccgttcaaggcgtag

SEQ ID NO: 1741 - DNA, 534 bp, Pseudomonas aeruginosa
cacagcgacccttttccgccgaccgccacggttctcatttttcccgccagaagtgcgccgaatcacgctcccggcgtgcgccgccacggcttccgaggagaaacgtcagggcaccgtcgcgtgccgtgtcgtggacctgcgcggcgaccctcgcgtaacgctccatcacttcgccatggggatggccgaaggcgttgcgccaacctcgcgagaccagcacatggcgaggccgcgtacgcaacacgaaggcgactccggaggaactgcggctgccatgatgcggcgccagcaaccagtcgacccggggatcggcctgtcgcgccagccaggcatgctcggccgcacgcgagatgtccccggtcagcagcaggacttcgccatcggcctcgaccctcagcacacaggagcggtcgttgctgtcgccggcctgtgcccatgcccactgttcgaaaaccacgccatcccaggaccagctccgctcgtcgcagctgtccgcgaacaacggcgaaggcaggcgcgcgggttcgccgctga

SEQ ID NO: 1742 - DNA, 819 bp, Pseudomonas aeruginosa
gagcaccgcctgcatggtcgttgtcggcatggctcagcaacaggccgtccaggcgccgcaggtccaggctgcgcagcaccggcaccaccacccgttcgcccatgtcgaacgccccctgccgcgcaccgctgtcatagagcaagacatgctttcgggtacgcaccagcacggccagcccctggccgacgtccagcacccgcacttccgcccgcccccattcgacaggcggcgatgacggcaacaatgccggcagtagcaacgcggcaccgagggcacgcaacggcaagccagccggcgccagccagcagagcgcgccgagcatgcccagcgctacgctccaggccgctgcggcgggtggctgccaggcctcggccaggcccgccagcaggccaagcgcacgaaacagcaggtccagcgaaacgccagcggcgcgaagcagcccctcgcccagcccgggcacccacagcagcaggctccccgccagggccgggggcactaccagcagttcgatccaaggcaccgccagcaggttggccggcgctccgctcaggctcaacggcaggcccagcgccagcagcggcatcgccagccccagcgccatcccccactgcgcccgcccccaggccgcccaccagcgccagcgcccaaggcgcccggcgaacagccagagcagcagggcaaccgccaggaacgacagccagaaccccgcctgcaggctggccagcggctcgaccagcaagaccagcaccagcgttgccagcagcggggtcagcaagcccaggtggcggaaacgcaggcgccagaccagcgccaggctga

SEQ ID NO: 1743 - DNA, 405 bp, Pseudomonas aeruginosa
ccatcagatgcacggtgccggtgtcctggaacatgcgccactcggccgcgctcaaccccgagccatcccccagcaccagcgccgccagggcggcgccgcgcccctgtgcgtcgaccgccagcaggcgctggcgccaggcatcgcgccaggcatccaggccgctggccggctgcaggcgctggcccgccttcaccgtgcccacagcaccgacccgctgcgccaacaaccaggcctcgtagtcgaaacccgccgcgttcaccaggccgcgggggcgtttcagggtcaccgccaggcgccagcgttcgccgcccatcagcggcggcgcgccgcgccagctcaggcgcaaacgctcgggaagaagcacgccccgcgcagcgcggacctcctccagccggaagcgcgtga

SEQ ID NO: 1744 - DNA, 276 bp, Pseudomonas aeruginosa
cgccctcgccgctcgccggcagatcgaccacacgcccctccagccaaagggtgcgaccatccagctcggcggccaggcgtccgtccagggcgacttgcgccgagccgcaggcccaggcgaacccgagcaggaacaaccccagccagtacagccggccgaacagcagcaacagtccggcggcggccatgcccagcagccagccgaccgacggcaattccgccaggaagcgcagggccagcagccccgcggcgagggctggcaatcccaggcgcatga

SEQ ID NO: 1745 - DNA, 414 bp, Pseudomonas aeruginosa
ttgatgaagtacacatccgagctgaagaccttgtgtccgaccaaccgttcgatgcggtcgatcatcccggtgatgttcaacgccgcgaacaccccgagtaccccgccgatgaccgtcccgatcacgccgatgacggtgccctggaccatgaagatcgccatgatctgccgcggcgtggcgccgagggtacgaagaatcgcgatgtcggtgcgcttgtcggcgaccaccatgatcagggtggcgatgatgttgaaggcggcgaccgcgatgatcagcagcaggagcaggccgatcatggtcttttccatcttcatcgcgttgaacaggctgccctgggtcctggtccagtcgctggacctgaagccctgccccaactccttgaccaccttggcggcgacctgcggcgactggtag

SEQ ID NO: 1746 - DNA, 630 bp, Pseudomonas aeruginosa
agatccttcagctccaggcgcacgctcggcacctggcccggttgcaggcgcagcaactggccggcatcggcgatgtcgatcagcgccagcgagttgtccagttcggcaccgaccttgaacagggcgacgatggtgaagcgctgcatgcgcggagtgatgccgcccggcgcgctggtggcttccgggacgatcagggtcagcttgtcgccgacattgacatggaagcgccgcgcggtgatctcgccgaggacgatgccgaactcgccaggcttgaggtcgtccaggctgccctggacgatgtgctcaccgacgatggaaaccttgcgctcctcctgcgggtcgatgccgttgaccagcaccggcagcatattgcccttgtacgacagcatgccctgcagttcggcgaacggcgccgcgccgaccacctcgcggtgccgaagcgccgcgttggcgacggtctgccagtcgtccagcggctgcgccgcgctgatggtggcatgcggcaccatgccgaggatccgcgtgcgcatttccttctggaagccgttcatcaccgagagcacgatgatcatcgccagcacgcccagcgccaggccgatcatcgaggtcagcgagatgaacgagatgtag

SEQ ID NO: 1747 - DNA, 858 bp, Pseudomonas aeruginosa
cgcaggcctatgaagaacggtaacggtctgaacatgtcgcggatgcaccgagtcgatgggggattcgccggacgggagcggacggcgggcacgccgtcgccccgctacgcggcgatcagtcggccttcttccaggcgcaggatgcgatccatgtgcccggccagctggagatcgtgggttaccaccaggaacgaggtctgcaacgaacggctcagttccagcatcagctcctggataccctgggcggtatgctggtcgaggttgccggtgggctcgtcgagcagtaccagctgcggacggttgaccatcgcgcgggcgatcgccacccgctggcgctcgccgccggacagctcggccggcttgtgcgaacaggcgatgccccagcccgacccgctccagcagctcggccgcccgctggcgggcttccgcgatcggcgtgcggccgatcaacagcggcatgcagacgttctccagagcggtgaactccggcaacaggtggtggaactggtagacgaagcccagcgcgcggttgcgcggcagcccgcgggccgtctcgttcagcgccgagagttcctcgccggcgagccagacgctgccggcggagggcgtgtccaggccgccgagcatgttcagcaaggtgctcttgcccgaaccggagctgccgacgatagccacccgctccccaggcagcaggttcaactcgacgccggacagcacctgcaccgattgcggcccctcgtcgtagctcttgctcaggttgcggcaactcagcaccgacttgtcattcataacgcaaagcctccgcaggctgggtgcgcgccgcacgccaggctggatacaaagtggcgaagaagctga

SEQ ID NO: 1748 - DNA, 594 bp, Pseudomonas aeruginosa
ccgccgcgaatactaccgtatcgaagataccctcgcactggaatttcgccctgccggggccgtcgaagacggcctggagagcgagccgggggccaccctgttcagcctgctcagcgacctccacctgatggattacgagtcgcagcaccttctgcgccacatcagcgaacgcgaccgcacgctggccaactacctgaaggtgatgaacaagcgcatcgacctgcttggccaggtcatggtgcagagcctgctcaaggagatcggcgaaccgcgcaaggtcagcctgtccgaggggggagtcagcttccgccacgaccgcgcattgccggtcggccagttgctcgtcctgcgcatggtcctgttgccgcaggggttcggcctcgaactgcgggcccgggtaatccacgcccagccacacgacgacgaattcgagatcggcaccgagttcgaagcgttgagcgacgcacagcgccagttgctggcccggcatatcctccagaagcaggcccagcagcgccgcctggcacgggccggacagggcccgctcggcgagccgggccaaccttcttcgacctgaaaccttcttcgacctga

SEQ ID NO: 1749 - DNA, 318 bp, Pseudomonas aeruginosa
gatgtgccgatgctccgttcgctactgctgtgctccctcctcctcgccccgccgctgttcgccgacaccctgagcattccgctgggcgcccagggcgatacccgggtcgccctgcccgcgcacggcgaaagccgcgaagccgtgctgcaacgcttcggcctggccgacgaggaacatcccgcggtcggccagccgcccatcgtgcgctgggattaccgcgacttctcggtatatttcgaaagcggccgggtgctcgacagcgttcgccatcatcggccgcggaatcccgcgcaaccctcgaacaaggagccacagtga

SEQ ID NO: 1750 - DNA, 1368 bp, Pseudomonas aeruginosa
gtgctgcccatggtcgggccgccgaagctttccagggtgtcgccgcaaccggccaggaccagcgccagcgctgccagtccggccatggcaagcggacggaaacgctcagccaccgaaatcgtccagcaggatattctcgcgctccacgcccaggtcggtgagcatcttgatcaccgcggcattcatcatcggcgggccgcacatgtagaactcgcagtcctcgggcgccgggtggtccttcaggtagttctcgaacagcacgttgtggatgaaaccggtcaggccggtccagttgtcctccggctgcgggtcggacagcgccaggtgccactggaagttgggattctccgcctgcagctggtcgtactcctcggtatagaaggcctcgcgcagcgagcgcgcgccgtaccagaagctgatcttgcggttcgacttgagccggcgcaactggtcgaagatgtgcgaacgcatcggcgccatgccggcgccgccgccgatgaagaccatctcggcctcggtgtccttggcgaagaactcgccgaacggcccgtacacggtgaccttgtcgcccggcttgaggttgaacacccaggacgacatctgccccggcggcaggtcgctgcccggcggcggcgaggcgatgcggatgttgaacttgaccacgcccttctcttccgggtagttggccatcgagtaggcgcggatcaccgtctcgtcgaccttcgacacgtagcgccacatgttgaacttgtcccagtcgccgcgatattccggctggatatcgaagtccttgtactcgaccacgtgcggcgggcattccagctgcacgtagccgccggcacgaaagtccacgctctcgccgtccggcaggcgcagggtgagttccttgatgaaggtggcgacgttggggttggactccaccgtgcactcccatttcttcaccccgaagacctcttcaggcacgcggatctgcatatcctgcttgaccggcgtctggcacgacaggcgccagccttccttcgcctggcgccgggtgaagtgcgactcctcggtgggcagcatctcgccgccgccctcgaccaccacgcatttgcactgcgcgcaggtgccgccgccgccgcaggcggaagacaggaacacgttgttcgccgccagggtttgcagcagcttgccgccggccggcacggtcaggctgtgctcgccgttgatctggatggtcacgtcgccactcgacaccagcttggcgcgggcgaccaggatgatcgccaccaggcccaggacgatggcggtgaacatgccgatggccaggaaaatctcgaatccgatcacgggcctctccttacaactgcacgccggagaacgacatga

SEQ ID NO: 1751 - DNA, 882 bp, Pseudomonas aeruginosa
tgtagtgctccatcagtaagcctccttgctggatacctgcggggccatcttgtaggtcggggcctcgacctggtctttcttccaggtccgcagggcccagatgatcaggccgatcaggaagaacgccgaaggcggcagcaggagcaggccgttcggctggtaccagccgccatcgttgaccgtcggcaacacgctgatgccgtagagcttgccggcgccgaacagctcgcggacgaagcccagcaccagcagcatggcgctgtagccgagaccgttgccgatgccgtcgaagaacgacacgagcggcgggttggccatggcgaaggcttcggcgcggcccatcacgatgcagttggtgatgatcagcccgacgaacaccgagagctgcttgctcaggctataggcataggccttgagcacctggtcgacgacgatcaccagcgaggcgatgatcaccatctgcacgatcatccggatcgagctgggaatctgccggcggatcatcgagatgaacaggttggagaagccggtcaccagggtcagggcgatggccatgacggtagcggtcttcaggttcgaggttaccgccagcgccgagcagatcccgaggatctgcaggccgatcggattgttctggaagaccggattgaacaggacttcgcggatcgtgggttgagcagccatcacgcctcccctttgcgcagattggcgaggaaggcgtcgaaaccgtccttgccgagccagaaatgcagcaggttgtcgacacccttgctggtcagggtggcgccggccaggccgtcgacctggtgggtcgccttcgccgattgcgggtccaccgagcccttgatgatctgtacggcaagatcgccctgggcgtcgtag

SEQ ID NO: 1752 - DNA, 1029 bp, Pseudomonas aeruginosa
ttagccattgcgcgccagcctccgcttgatgttggcctgaacgacgaaatggtcgatcagcggtgcgaacaggttggcgaacaggatcgccagcatcatgccttccgggaacgccgggttgaccacccggatcagcatgaccatcactccgatcagggcgccgaacagccacttgccggtatcggtcatggacgccgagaccgggtcggtggccatgaagatcatgccgaaggcgaagccgccggtgaccaggtgccaataccagggcatggcgaacatcgggttgctggccgagccgatggcgttgaacaggtagctcatggcgaccatccccagcatcaccccggcgacgatgcgccaggaggcgatgcgggtcagcagcagcacggcgccgccgatgaagatcgccagggtgctggtctcgcccatcgaaccctgcatgtggccgaggaaggcatccatccaggtcaagccgtggccgaggatgttgtccacgccgccggcggcggccaggctcagcgaggtggcgccggcgaagccgtccaccgaggtccataccgcgtcgccggacatctgcgccgggtaggcgaagaacaggaaggcccggccgaccagtgccggattgaggaagttcttcccggtgccgccgaacacttccttgcccagcaccacgccgaagctgatccccagggctacctgccacaacgggacggacggcggcagggtcagggcgaacagcaccgaggtgacgaagaagccttcgttgacctcgtggcggcggatgctggcgaacagcacctcccagaaaccgccgacgatgaaggtggtcaggtacaccggcaggaagtacgcggcgccctggaccaggcaatcccacaagctgttcgggtcgaacccggccagcgcgccgatcagggcgaagcgccagccatcctgggcgctcaacaggtcggggctctgggcgaagatcaggttggcctggtggccgacgttgtacatgccgaagaacatcgccgggaaggtgcatag

SEQ ID NO: 1753 - DNA, 936 bp, Pseudomonas aeruginosa
ccagacgatgatcatcatgcgcttcaggtcgatgccgtcgcgcacgtgtgcagtggtgcgggtgacgctgccgggacgatagaggaaggtgtccacggcttcgtacagcgggtaccacttctcgtagcgcccgcccttctcgaaatgatgctcgaccttgtcgagcaggttacgcaaacccatggctcagccctcctgctcgatgcgtgccagattgtcccgcagaatcgggccgtattcgtacttgccggcgcagacgtagctgcacagcgccaggtcctcttcgtcgagttccagggcgccgagcttctgggccatttccgtgtcgccgacgatcaggtagcgcagcagttgagtcggcaggatatccagcggcatcaccgcctcgtagttacctaccggcaccatcgcccgtgggctgccgttggtgctggtggtgaaggcaaagcgcttgccgccgagcagcctggagacgaacacgttgagcagcgaatgcttttccaccccggcgcgcaggtagtggaggaactcgcgctggtcgccctccttgagacaggacaactgcaggtggtagcgccccaggtaggcgtaggcgccatgggcggtgcgaccgcccagcacggagccggagatcagtcggttgttgcccggctgcaactggccggcggccagttcgtcgaggttggcgcccaagcgggtgcgcaccagacgcggcttttccaccaccggaccggccagggcgatcacccgctcggtccacaattgcccggtcgtgaacagcttgccgatggcaatcacgtcctggtagttcaggttccacacgctcttgccggcacccaccgggtcgaggaagtggatatgggtgccgggcaggcccgccggatgcggaccggagaatgcttgcgcggtcacgccggagagcgcctcgccgggtag

SEQ ID NO: 1754 - DNA, 594 bp, Pseudomonas aeruginosa
cgaaacgccttccgccttgcacaggaacacccgggccaggcgcccgagcaccgtcagcccggcctggaaggcctcgccctgctccgcgataaccacctgcggatcggcggccagcggctgggtatcgatggcagtgacgaaaatcgaactggggctggactcgggatcgggcaccttgctgaacggccgggtccgcagcgcggtccacaggcccgactgcaacaggttgtcgcggacctgctcggcgctcagcgtggcgagtttgtcagcgggataacgggcgaactccagttgctcgtcgccgtcgagatcgatgaccaccgattgcaggacgcgcttctcgccacgatggatggcactgaccacaccggcgccgggtgcggtatagctgacggagggattcttcttgtcggtgaacagcacctgccccagcttcacccggtcgcctacctgcaccgccatggtcggcttcatgccgtggtagtcgaaaccgatcaacgccacgctgcgtaccgggcgtgctgcctcaatgcgctgttcgggggcgccgctgatgggcaggtccaggccacgttttatcttgatcatgtctag

SEQ ID NO: 1755 - DNA, 1545 bp, Pseudomonas aeruginosa
agagccacctccccgggagccacccaagccgcacaccgggtcttgaaacgcgtaacagaaaacgacagaaaaacatgcccgtgcgaaatgaaaaacgggagccgaagctcccgtcctgcgccacccgcaggctcaggcctgctggccgagcccgcgcctttccgccagcgacagcttgacccggtagcacaaccacatcagcagcagccagaatggaatggcgtacaccgagatgttgatcccggggatcatcagcatgatgccaaggatgaacaccacgaaggccaggcacaggtagttgctgaacggcgaccagagcgccttgaagaaggtgtccacgccctggcgcttcatcgccgcgcggaacttcaggtgcgacaggctgatcatcgcccagttgatcaccagcgccgccaccaccagcgacatcagcagctccagcgccttgtgcggcaatacgtagttgacgatcacgcagaggaaggtgatcagcgccgagaccaggatcgacagcaccggcacgccccggcggtccaccgacatcagcaccttcggcgcgtcaccctgggcggccaggccgtagagcatccggctgttgcagtagacgccgctgttgtagaccgacaatgccgcggtgagtactacgaagttgaggatgttggccgcggtgccgctgccgatcaacgagaagatctgcacgaacgggctgccgctgtagtcgtcgccggaagcgttgatggtctccaccaactggtcccatggatacagcgagagcagcaccgccagggcgccgatatagaagatcaggatccggtagatcacctggttgatcgccttcgggatcaccttccgcggctcggacgcctcggcggcggtgatacccaccagctccagccccccgaaggagaacatgatgatcgccagggtcatcaccaggccgctgagaccgttggggaagaagccgccgcggtcccacaggttgctcaccgaggcttgcggtccgccaccgccgccgaccagcaggtagataccgagcaggatcatgccgatgatcgccgctaccttgatgatcgcgaaccagaactcggtctcgccgaaggctttcacgttggccaggttgatcgcgttgatcagcacgaagaacgccgccgccgtcgcccaggtcggcacgtccggccaccaatactggatgtacttgcccaccgcggtcagctccgacatgcccaccaggatgtacagcacccagtagttccagccggaaaggaaaccggcgaatccgccccagtacttgtgtgcgaagtgactgaaggagccggccaccggctcctcgacgatcatctcgccgagctggcgcatgatcaggaaggcgatgaagccgccaatggcgtaaccgaggatcatcgacgggccggccgtcttgatgacgcccgccgagccgaggaacagcccggtgccgatcgccccgcccagcgcgatcaactggatgtggcgattcttcaggccacgcttcagctcgccctggtgcagatgttgaccatccattga

SEQ ID NO: 1756 - DNA, 423 bp, Pseudomonas aeruginosa
ccgaactcgttgtcgtaccacacgtacaggacgacacggttgtcgttgcagatggtcgcctcggcgtccaccacgccggcatggcgcgaaccgacgaagtcggtggaaaccacttcctgggagctgacgaagtcgatctgcttctgcaggtccgagtgcatggccatctggcgcaggtactcgttgatctcttcgcgggtggtggccttttccaggttcaggttgaggatcgccatggacacgttcggcgtcggcacgcggatcgcattgccggtcagcttgcctttcagcaccggcagggccttggccgcggcggtggcggcaccggtctcggtgatcaccatgttcagcggcgcgctgcggccacgacgactgcccttgtggaagttgtcgatcaggttctggtcgttggtgtacgagtga

SEQ ID NO: 1757 - DNA, 3558 bp, Pseudomonas aeruginosa
ccgcgccggccaggctcggcaatctgcagcagtcggaagactgacatccagcagtcgggaaagttacaatccggcgggtcaaattcccgaccggagcccagcttgcccgtgtccgtactgcgtcttcccagcctgccggccagcgccggcaagcaacactggggcaacctccccggtgccgcgctgagcctggctgtcgccgaggccgccagttccgccaagcgcttcaccctgctgctgaccgccgacagccagaatgccgaacgcctggaacaggaactgcggttcttcgcccccgacctgccggtattgcatttccccgattgggaaaccctgccctacgacgtcttttcgccgcaccaggacatcatttcccagcgcatcgccgccctctaccagttgccgcagctcaagcacggcgtgctggtggtgccgatctccaccgccttgcaccgcctggcgccgacccgcttcctgctcggcagcagcctggtcctcgacgtcggccagaaactcgacgtcgagcggatgcgcctgcgcctggaaggcgccggctaccgctgcgtcgacacggtctacgagcacggcgagttcgccgtccgcggcgcgctgatcgacctgttcccgatgggcagcgagttgcccttccgtatcgacctgttcgacgacgagatcgagaccctgcgcaccttcgacccggagacccagcgctccatcgacaaggtcgagtcgatccgcctgctgccggcacgcgaattccccctgaacaaggaagcggtcaccggcttccgcggccgcttccgcgagcgcttcgacgtcgactaccggcgctgcccgatctaccaggacctcgccagcggtttgacaccctcgggaatcgagtactacctgccgctgttcttcgaggaaaccgcgaccctcttcgactacctgccgcaagacacccaggtgttctccctgcccggcatcgaacaggccgcggagcagttctggaatgacgtacgcagccgctacgaggaccgccgggtcgatccggaacggccattgctgccgccggcggaagtgttccttccggtggaagactgcttcgcccggctgaagaactggccacgggtggtcgccagccaggaggacgtcgagccgggcgtcgggcgcgagcgcttcccggccctgccgctgccgaacctggcgatcgaagccaagaccgccgagccgctggccgcgctgcgccggttcatcgaggagttccccggccgcgtactgttctgcgccgaatcggccggacgccgggaagtcctgctggagctgctggcccgactgaagctgcgccccgaggaagtcgacggctggccggccttcctcgccagccaggcacgcctggcgatcagcatcgcgccgctggacgagggcctgctgctggaccatccggccctcgccctggtcgccgaaagcccgctgttcggccagcgcgtcatgcagcgccggcgccgggaaaagacccgcgacggcggcgacgcggtgatcaagaacctcaccgagctgcgcgaaggcgcgccggtggtgcacatcgaccatggcgtcggccgctacctgggcctgatcaccctcgaggtggacaaccagcaggcggaattcctcatgctgcaatacgccgaggacgccaagctctacgtgccggtcgccaacctgcacctgatcgcccgctacaccggcgccgacgacgccctggcgccgttgcaccggctcggctcggaaacctggcagaaggccaagcgcaaggccgccgagcaggtccgcgacgtcgccgccgagctgctcgacatctacgcccgccgcgccgcccgcgaaggcttcgcgttcaaggatccgcaggccgactacgcgaccttctcggccggcttcccgttcgaggagacgccggaccagcaaagcgccatcgaggcggtggtcgccgatatgctcgcgcccaggcccatggaccgcctggtctgcggcgacgtcggcttcggcaagaccgaagtggcgatgcgcgcggcgttcgtcgccgtgcatagcggcaagcaggtggcggtgctggtgcccaccaccctgctcgcccagcagcactacaacagcttccgcgaccgcttcgccgactggccggtgagcgtcgaggtgatgagccgcttcaagagcgccaaggaagtcgagaacgctgcgcggctactggccgaaggcaagatcgacatcctcatcgggacccacaagctgctccaggaagacgtgaagttcgccaacctggggttggtcgtgatcgacgaggaacaccgcttcggggtgcgccagaaggagcagctcaaggccctgcgcagcgaagtggacatcctcaccctcaccgccacgccgatcccgcggaccctgaacatggccgtctccggcatgcgcgacctgtccatcatcgccacgccgccggcgcgccgcctgtcggtgcgcaccttcgtcatggagcagcagaacgcggtgatcaaggaagcgctgctccgcgaactgctgcgcggcggccaggtgtactatctgcacaacgaagtgaagaccatcgagaagtgcgcccgcgacctagccgaactggtcccggaggcgcgcatcggcatcggccacggacagatgcacgagcgcgagctggaacaggtgatgagcgacttctaccacaagcgcttcaacgtgctggtggcctcgaccatcatcgagaccggcatcgacgtgcccagcgccaacaccatcctcatcgagcgcgccgacaagttcggcctggcccagttgcaccagttgcgcggccgcgtcggtcgcagccaccaccaggcctacgcctacctgctgacaccgccgcgccgtcagatgacgccggacgccgagaaacgcctggaagccatcgccaaacgcccaggacctgggcgccgggttccttcctcgccacccacgacttggagatccgcggcgcccggcgagttgctcggcgacggccagagcgggcagatccaggcggtcggcttcaccctctacatggaaatgctcgaacgggcggtgaagcccatccgcaagggcgagcaaccgaacctcgagcagccactgggcggcgggccggaggtcaacctgcgggtgcctgcgctgatccccgaggattacctgcccgacgtgcatgcccggctgatcctttacaagcgcatcgccaacgcccctgacgaggaaggtttgcgcgagttgcaggtggagatgatcgaccgcttcgggctcctgcccgatccggcgaagaacctgatgcgcctgacccttctgaaactgcaggcggaaaaacttggaatactcaaggtcgatgccggaccgcagggcggtcgtatagaattcgccgccgatacccaggtcgacccgctggtattgatcaagctgatccagggccaaccgaaccgctacaagttcgaaggcgcaaccctgttccgcttccaggtgcccatggaacgaccggaagaacgcttcaataccctggaggcgctgttcgagcgcctgacaccgcaaaccacctaa

SEQ ID NO: 1758 - DNA, 768 bp, Pseudomonas aeruginosa
ggattagcctatgcgcttgttccgttgccttgccctgctgctctcactggccgcccccgcggcattcgccggcggtccctaccaggtggaactggtggtgttccgccaggccggcgatgccgtgccgtccagccagccggccccggacgaatgggccaccggcgcacagccgctggccagcgacgccctgcgcgccaccgcgctcgacaaccagctcgccaagctcagccaggacaacggatacaccgtgctggtgcacaaggcctggcgccaggacatcggcgagaccccggtgaagatcgccctcagcgaaggccaggaacaggatcatcatttcccggtggaaggtacgctgaccctcagccaggtgcgcttcgtcgacatggaggccgatttctgggtcaatcgcttcggcgacgacggtttcctcgccggcagccagcacatcaggcagggcacgcggctgaagaatggcgaactgacctatctcgaccatccgagcctgggcatcctgatcaaggtggtgccggtcggcgcccgtcccgccgcccccaatcccatggaaatggaagaacagcaggcaccggcggacgcgccccccgtcgaaggcggcttcgacgccgcacctcctgcgcaatagcgaaaaaggccgcaatagcggcctttttttcgttgcgatggccgcctagccggccaggacccgcgccagcacctcgcgcaccttgccgatgccatcgtgcaacgcctgttcgatttcggccatggtga

SEQ ID NO: 1759 - DNA, 1944 bp, Pseudomonas aeruginosa
tcgcgtagacactcatcgacagctccctcaatcaatcagttgcgcggcgcgcaacgcggacagtgcttccagccagcgcggctgctggcgatagtcggtattcgcgtagcccttgccacgcatgcgttgcagacgcgacggcggggtcaccttcaggcattgcagggcagccagggccagctcggcggaagcccggtcgttgcacaccaggcccatgtcgcagcccgcggccagggcggcctcgatgcggctggcggcgtcgccgaccacatgggcgccggccatcgacaggtcgtcgctgaatatcaccccgtcgaacttcagctcgccgcgcaggatctcctgcaaccagcgccgggaaaagccggcgggctgcgggtcgacctgcggatagatgacatgggccggcatcagcgcgtcgagctgtccggccaggcgggcgaacggaaccaggtcgctgcgccggatttcctcgagactgcgcgcgtcttcgggaatcgccacatgggaatcggcctcggcccagccgtgaccgggaaaatgcttgccggtggcggccatcccggcggcatgcatgccgcgaatgaaagcaccggcaagcagcgcggcacgctccgggtcgccctcgaaggcgcggctaccgaccacggcgctgcgctggtggtcgagatccagcaccggcgcgaaactcaggtcgaggccgaccgcctgcacctcggtcgccatcagccagccacaatgctcggccagctcttcggcattggggttgtcggcgatcgcgcgcatcgccggcaggcgcacgaagccctggcgcaggcgctgcacgcgccctccttcctggtcgacggccagcaacaggtcgggacggatggcgcgaatggccgcacacagttcgcgaacctgggcaggatgctcgatgttgcgagcgaagatgatcagcccgcccacctcggggtggcgcaggatttggcggtcctcggcggtcagccaggtgccgccgatgtcgagcatcagagagccttgcatgaaaagtcctatggcctggaaatcagcgaagcccgccgtcacgggcctcagacagcgcacactgtactgcacccggcagaaagacttaagtcccggggcggtaccgcgcgcctgccaatggagccggcctggcgcatggagttccgcccggagcacagagaaaggagaaaggaaaacggcgccctggggcgccgtctgcgatcaggccttggcgggcgtcttgttccgcgggcgcagttgcgccccggccagcagcggatcgtcgatgccgctctcggcgcgcatgccggcagcgaagaacggcaccatcaggtgcatcacctgctcggtggaagtgttcacgccgaaatcggtttccgccatcgcccgcagggccttgatccccgacatgctgaaggcggccgcgccgagcatgaagtgcacgcgccagaacagctcgatgggcggcagcttcggcgcagcctcgttgaccagcagcatgtagcgccggaagaccttgccgtagacctcctccaggtacttgcgcaggtgcccctggctctggctgaaggccaggccgagcaagcgcatgaagatcgacaggtcgttgccgctgcgcggcttcaccgccatcgcctgggacaccagcaggtgcaggaggtcctccagggtggcgtgctgggcctcgggcttggcctggcgacgatccagctccttttccaggctggcgcagaatggcccgaggaagcgcgagaacaccgcctggatcagcgccttcttcgaaccgaagtgataattcaccgccgccaggttgaccccggccttgctggtgatcagacgcaacgaggtttcggcgaagcctttttccgcgaacagctgttccgccgcatcgagaatgcgttcgacggtttccgactgggccatggtttctccgcctga

SEQ ID NO: 1760 - DNA, 705 bp, Pseudomonas aeruginosa
cgcaggacgaaatgtcatgcggaaaatcattgccacgccccgctcactgtatataatcccagtcactggataaaaacacagagcgacgacatgcagaagctgacgccccgccaagccgagatcctctccttcatcaagcgctgcctggaagaccacggctttccgccgacccgggcggaaatcgcccaggaactcggcttcaagtcgccgaacgccgccgaggagcacctcaaggcgctggcacgcaagggcgccatcgaaatgactccgggcgcctctcgcggcatccgcattcccggcttcgaaccgcatgccgccaacgacgatgagggcctgccggtgatcggacgggtcgccgccggcgcaccgatcctcgccgaacagaacatcgaggaatcctgccgtatcaatcccgccttcttcaatcctcgcgccgactacctgttgcgcgtgcgcggcatgagcatgaaggacatcggcatcctcgacggcgacctgctggccgtccacgtcacccgcgaagcgcgcaacggccaggtggtggtcgcgcggatcggcgaggaggtcacggtgaaacgcttcaagcgcgaaggcagcaaggtctggctgctggcggaaaaccctgagttcgctccgatcgaagtcgatctgaaggagcaggaactgatcatcgaaggcttgagcgtcggcgtgatccggcgctga

SEQ ID NO: 1761 - DNA, 873 bp, Pseudomonas aeruginosa
cccatgatcgccgggtcgacacccgccacggccatggagcggatcaccgccatcggctggatgcccaggtcctgggcgcgctgggccgacatcacgatcatgcaggaggcaccgtcggtgatctgcgaggaggtccccgcggtcacggtgccgcctttcggattgaacgccggcttcaactcggccagggtctcgacggtggtttccggacgaatggtctcgtcgaagtcgaagactttcaggaaaccgttctcgtcatacccttccatcgggatgatctcgtccttgaacttgccttcctgggtggccttccaggccagttggtgcgaacgcgcgccgaacttgtcctgcgcctcacggctgataccgtgcatcttgccgagcatttccgcagtcaggcccatcatgcccgaggccttggcggcgtacagggacaggtgcgggttcgggtcgacgccatgcatcatgccgacgtggcccatgtgctccacgccgccgatgacgaatacatcgccattgccggtctggatcgcctgggcggcggtgtgcagcgcgctcatcgacgaaccgcacaggcggctgacggtctgcgcggcgctggtgtgcgggatctgggtcatcagcgacgccatgcgcgcgatgttccagccctgctccagggtctggttgacgcagccccagatcacgtcttccacttcggccgggtcgaccttcgggttacgctccagcagcttgctgatcaggtgcgccgacatggtctcggcgcgggtgttgcggtgcatgccacccttggaacgacccatcggggtgcggccgaagtcgacaatgacgacgtctctcggattcaggctcataaattcactctcgctctag

SEQ ID NO: 1762 - DNA, 429 bp, Pseudomonas aeruginosa
atgcccagcttgacttccggcaggccgaccttggcggtcgcgctcatcacgcggaagtctgcggccaggcacatctccaggccgccgccgagggcgatgccgttgatcgcggcaacggtgggtacgtccaggtcttcgaagtcgctgaagatcttgttggcttcgaggttgcccgccatcagttcctcgtcgggcagctggaagttgtcaacgaactcggtgatgtcggcaccaacgatgaacacgtccttgccgctggtcacgatcacgcccttgaccgatgcatcggccttgatcgcatcgactgccgcacgcaactcactgagggtgagacggttgaacttgttgacggactcgcccttgagatcgaaattcaactcgacgatgccgccctcaagaggcttaaccgtgatggctttaccttggtaa

SEQ ID NO: 1763 - DNA, 936 bp, Pseudomonas aeruginosa
tcggcgccgtgggcgcttgtcccggtgcggaaaggcaggctagagtcgccgcagatcgccatgcatgatcggccacgggccgttacaaaagaacaacaagaaggcctccagggccacatggagatggaacccatgatctgccgtccgttcactctttgtctggccctgctcggcctgctgagcctccccgtcttcgcggcagggaccgccgatgacctgctcgccctgcaccagatgcggctcgccacgcagaaatccctgaacgccttcttcatgtacgtcggccaggaaggcgatcaacgctacgccagcctgatcgaaagctcggcgcagacggcggaagcccgcctgcagcgactcgacggcgtgaacggcagcgaatcccggcgcctgctgggccagcttcgcgagcaatggcgggactatgcgcaagacctcgacaagctgaccggcgcggtgcgcaacaagggctacagcgacctgcaaccggtcgccgacctggcacgacgcaaccagcaactgatggacctcggcggccagttgtatcgcagcctgcaacgggaaaacgccgccacggtgccgacgctcaccgagcagagccgcgaacagagcctgctgatgcaggacattgctctggactatgcctcgcgcaacgcgtcggtgggcgccagcttcttcggcggcggcgaggagcgtccactggacgacctggccagccgcttttcggtcaacctgttgaagctgcagcaggcgccgcagaacgacgaggagatcgccagggcgctgcgcagcgtggcgatcaagtggcactacatcgagaagtccctgcgcaactacaaccagaacagcgtgccgttcctggtcaacaagaatgcagaccggatcatcgatggcctggagaaggtcgccgcgctgtatgccgcgcgcaaccaatga

SEQ ID NO: 1764 - DNA, 1206 bp, Pseudomonas aeruginosa
acgcctggatgccttcgccgtacgctatccggacctcggcagcgagcagcgccacctggtctacgggcaaccgcgccaggaaatccaccgcctcgccgcggaacaggcttgcgacctgatcgtggtcggcagccacggtcgccacggcctggcgctgctgctcggttccactgccaacgacgtgctgcacggcgcgccctgcgacgtgctcgcggtgcacctgaagaaagcctgatctctccccgctcggccggggcctgcgcctcagccgagcgtttcctcggcgctcatcaccagcgggcggatcttctgcaactgggtttccagcgaatagctgatgctcgacgacagcgagaagaaggtcaggaacgccttcaggttggaatcgctgacacaggtgtcgtggattcgctgccagaacgcctggttgaccagttgcaactgctggaacagccgcaccagccctttcagttcccaatcggcatgccgcccctcgcggaagttgaagtactggcgcatcaggtacagcggcaccacccgcagcacgaactcctggttgctggcgaacggcaggtgctgcatggccatcggcctcagcggcgccagcagcggacaggcgctgctggccatgatcaagccgatcagcgcgcgcagtccttcctccaggcccgcctgcttgatgtactcgcgctccggcgtgcgcacgcagatgccggccttgcggaacgccggcaggttgcggaaatcctcgatcaccccatgcaggtcgaccgccgccggacaatggctgtagcgttcgcgatcgagcgggcagttgctgcagcgattgtgttccaggcgcgtccagcgcggcgctgcggcagccgcctgcgggtcgtagtgccgctccagctcgatgcgatagttgagctgatgctggtcgtccagcgtgatgcggtactcgattgccatggactgatcctttctcgggagacggccggcccgtcaatgacgccagccagagggaccgacgggggactgcacccaccgccggcaaggcccgcaaggatcatcgagatgagccgctatcacattgatgcagctcactttttcgagatggatcagtcttccagttcggcccagcgctcgagcaaggcatcgagttcctgctgcaacgcgtccagccgcgccagggtttcgcgctgctcgtcctgcgggcgcagatag

SEQ ID NO: 1765 - DNA, 447 bp, Pseudomonas aeruginosa
gccacttccagcttggtgcccacctcgatcttgcccgaggtcggctgcaggtcgccaagcagcagcttgagcaaggtggtcttgccggtaccgttggcgccgagcaggccgatacggtcgccgcgctgcaggaccatggagaagtcgcgtaccagcggctggccgccgggatgggcgaagctgacgtgctccaccacgatcacctgcttgccggacttgtccgcgctttccagctggaagctggccttgccctggcgctcgcggcgctcggcgcgttcgcgacgcatttccttcagtgcccgaacccgcccttcgttgcgcgtgcggcgggccttgatgccctggcggatccacacttcttcctgggccaggcgcttgtcgaacaatgcgttggcagcttcttcggcggccagttgctgttccttgtgcaccaggaaactggcgtag

SEQ ID NO: 1766 - DNA, 873 bp, Pseudomonas aeruginosa
tcgccgttccagtcgatcaggtggccacgatccagctcgaggatgcgggtcgccagggattgcaggaaggcgcggtcgtgggtaatgaacagcaccgcgccgttgaagcccagcagcgcttcctcgagccaggcgatggcgccgatgtccaggtggttggtcggttcgtcgagcagcagcaggtccggctcggcgaccagcgcctgggccagcagcacgcgccgacgccagccgccggagagttcggcgagggtcttgtcggccggcaactgcaggcggctgagggtgctgtccaccagttgctgcaggcgccagccatcgcgcgcctcgagttcctgctggacccgcgagaggcgcgccaggtcatcgtcggtatggatgttcaggctcaggtggtggtactcggcgagcagcttgccgacttccgccagaccctcggccaccacgtcgaacactgtccgttcgtcggcacgcggcagttcctggggcaattcgccgatcttcagcgccggtgcgcgccagacttcgccgtcgtcggcctgctgttcgcccttgaccaccttgaacaggctggacttgccggtaccgttgcgcccgatcacgcagacccgctcgccacggccgatctgccacgacaccttgtccagcaagggagtggtgccaaaggcaagggatacatcggtgaacttgagcagggtcatgggcgcctccggaaacagggcgcgcattttacgccggataggcatcggatggcacggcgctttcaccgccatgccgcaacggctaagcttaggcaagccatccgcccggcttcgggcgcgccccgcgacagcggtcgcgcgccagtcccgcgagcggtcgaaacgcccgtag

SEQ ID NO: 1767 - DNA, 270 bp, Pseudomonas aeruginosa
acttcaccgaactcgactgcctgtatggccagtaccagctgggccacggccagaaggccgaaggctacgccaccagcgaacgcctgtggctggtcggcaagtcgcagccggctgcctgcgacaccctgttcggcctctggcagggcgaaggccagctcaccgaggaaaaggtctggaaacgcctcaagctggccgccgaagcgcgcaactacagcctcgcctcgcacctcgcgcagcgcctgccgaccctcggcaaccagggcgcgctga

SEQ ID NO: 1768 - DNA, 543 bp, Pseudomonas aeruginosa
aaaggacctcaagatgaacaagcccctcgccaccgccctgctcgccacctccagcctgctgctcgccgacggcgccctggccgccgacgcctgcggtacgccgcgcaacgccttcgacagcgtgtactgccgcagcggcgagttttcccaggccgaccgcgagctgaaccagcagttcggcaccctgcgcaagcacctgaacgacggccagaaagccctgctgaagaagagccagatcgcctggatcaaggagcgcgacgcggcctgcagcgaaagcaaggacaacggttatttcgtcaacctcgactgcgccaccgagaagacccgccagcgcctcgacttcctccgcgaacgcgagcgcgagtgcctgagcaccggttgcgtcgacgccaagctctgatcgccggcaatggccgcccgccgcaacggcgggcgaccgttcctcagtcgaggatttccaccggcatccccacctccaggctgccctgtcccagcgcaatcaggttctgcccgaacagcaccgcgccatccttttcccggtag

SEQ ID NO: 1769 - DNA, 300 bp, Pseudomonas aeruginosa
gtcttcagggtcgtcagcggctcgcggtcctcgttgcgctcgccggtcgccggatccagggtggtgaggatgcagcgggaacagggcttggccacgacgaactcgaccgagccgatgcggatgcgtttccagccgtcctcggcgaacgcggcgctgccttccaccaccaggttgggacggaagcgcagcatctccaacggccggccgacccgctggctgaggtcgtcgagcgaagcctggccgatcagcagcagcgggaaaccgtcggcgaaatgcaccttctgccccggttcggcgtag

SEQ ID NO: 1770 - DNA, 675 bp, Pseudomonas aeruginosa
gcccgcgatcgatgtccacctggtcccagagccgccgacaggcctcgccgagcatcgcccagtagtactcggggtcctgttcggcccagcccggatgcttcgagtagtaggcctccagctccaccttgcccttgcccagcaggttgccctgcaggtcgaacagcagggcgcgcacgctctgggtgccattgtcgatcgccagcagatagttcttgtcgttcatctcgttctcgtctcggctggtcagacgggcaggctgtattgccggcgccagaggtccagataggcctgttgctcacgttcccagcgcgggtcgtcccagcccaggcgcgcttggcagagtgcgcggatacgcggcaggtatgccgcgccgcctccgggcaacagcaggccgaggcgggtgcggcgcaacagcaggtcatcgagatgcagcaccatttccgcctcggcggcgaacgccagttcggcccagagcgtttcgctggcacccacgcagtccgttccgagggtgtccaccagccgcttgaggcggaccaggtcgcgtccgtagcgaccggccaggcggcgtcgctggccgctgccgagcccgtcgatgagcgggccttcgcaggcgccgaacaccgccgcgccatcgtccgtgaccgtgcgcccgagcagcggcgcgcaggcttgtag

SEQ ID NO: 1771 - DNA, 1011 bp, Pseudomonas aeruginosa
acgcctggatcgcccgcatccgcgcgctgcccggctacatcccgatgcccggcctgtagctcggcaggaggcagcatgagccaggaacagagtcccttccacaccggcgaactggcgatccaggaacgcgccggcgttcgcgaacaggtcgccggcttcggcagccgcgcgatccgcaccttcatgccggaccagcaccgggagttcttctccctgctatcgctgttgctggtgggcagcctcgacgccgacggctaccccagcgcctcggtgctctggggcccccccggcttcgcccgttcgccggaaccgacccgcctgcgcatcgacaacctgccgcaagcggacgatccgctggcggccaatctcgaggctggcacccgcctcggcatcctcggcctggaatggccgacccgccgccgcaaccgcatgaatggacgggtcctggcgcgggacggaaagggtttcacggtcggcgtcgagcaatccttcggaaactgtcccaagtacatccaggcgcgcagccatcagcccgtctccaggatcgcaagtcccgcgttgcagggcgaaggactcgatccacgctggctgtcgctggtctcgcgcagcgatacgctgttcatcgccagccagcatgccgacccgctcagaggcggcgtcgacgtctcccatcggggcgggccgccgggctttctccggctcggcgcggatggccgcctgtggttgcccgactatgccggcaaccgcctgttcaataccctcggcaacctgctccaggatcctcgctgcggcctcctgttcatcgatttcgacgctggcgaactgctgcacctgcacgccgaggccgagctgttctggccgggttcgcagccatccatcccctggcccgccggcgccgagcgcctgctggcgttgcgcccccgcagggctggcgctggcggcgcggccgcctgccgctggcattctggcgagccccacccatcccttttttttcctgccggtgaatcttga

SEQ ID NO: 1772 - DNA, 621 bp, Pseudomonas aeruginosa
tcgagcaccacgccgccaccctgctcttcgacactggcctggggcgcgacatcgacgcccagttccgtgccgacatgccttggtgggcagcgccgctgttcgcttaccagaaagtcgtcccggcgcgcgaccaactggacgcagccggtatccgcgtcgatcgcatcctgctgtcccacgcacactgggatcacgcctcgggcctggtcgacttccccgaagtaccggtctgggcaccctacgaggagatcgccttcagccgcatcgccaccccgccggccgccttccccagccaattccgccatggcgtgcgctggcgaccttacagcttcgatccgcggccgttcatgggcttcgacgaaagcctcgacctgtttggcgacggccgcctggtgctggtccccctgcccggccatacgcccggctcggtcggtctgttcgtcaccctcgacagcgggcgccggctgttcttcagcggcgacaccagttggcgactcgaaggcgtcgaaggcccacggcagaaattcttcgccggccgcgccctggtcgatcgcgatcccgcgcgcaccctcgcgcaactggcgaagatccgcctgctgctccgcagcgacccgcgcctga

SEQ ID NO: 1773 - DNA, 576 bp, Pseudomonas aeruginosa
tcgtcggcgatgaggatatgcaggcggcgagacggctccatggatgctgccagcgggtcctggccggattcaggcattttcggcccgcactggcgcaagagcaggtcgagcgacacccgggtgcctttgcccggctcgctgtgcatctcgacatcgccgcccatgaggtccaccaacttccgacagatcgccagcccaaggccggtcccgccctgcaccgtgcgtcccttggccacctggatgaaaggctggaataggcgcgcctggtccgccggagcgataccgataccggaatcctccacgtccacccggacgatcgccctcccctcgtccaggctcctttcctggagacggatcgtcacctgtccccgctcggtgaacttgatcgcattgctcaccaggttggagagcacctgcttgaagcgcaggggatcgatcagcacgtcccgtcccggggcatcgtccagctccacaacgagcctcaggcctttctgccgggccaggccttcgaacatgcggcgcaccgactccacgacatggcgcaggcgaacccgctcgggcgtgagggtcaggtga

SEQ ID NO: 1774 - DNA, 1512 bp, Pseudomonas aeruginosa
tgtccgtctcttttttcaggttcgcttcgtttttcatcttcatttcattttctaccctccgtcttcaagggttcttcattaatgttcaagtcgctgcgtactcttgccttcgccacgctcctgcctttcgcccttcccaccctcgcccaggtcaacgccaccctgccggccaacgtgcagaaagccctgcagaccaacaagctgaccggcaacgatctgtcgctggtgctgattccgctcgacggcccgggcaaccccacctactacaacgccgacgtatcggtgaacccggcctcgaccatgaagctgttcaccacctatgccgccctggaaatgctcggcccgacctaccagtggaagaccgagttctacaccgacggccagctcaagaacggagtgctcaacggcaacctctacctcaagggcggcggcgatccgaaactgaacatggagaagctctggctgctgatgcgcgacctgcgcgccaatggcgtgaccaaggtcacaggtgacctggtactcgaccgcagctacttcaacatcccgcagttgccggtattcaacgacgacggcggcgacgacaccaagccgttcctggtcggtccggactcgctgctggtcaacctgaagagcgtgcgcatggtggtgcgcaccgacggcaacaaggtcaacgtgcagatggacccgccgctggccaacgtacgcatcgacaaccaggtgaagatgaccgcgccggccacctgcccggcctggccgaagctgcgcttcagcccggtgacccagttcgacggcaccaccctgctggccaccggacagattccccagggctgtagcgcgcagacctacatgtcgctgctcgaccaccccggctacaccgccggcgcggtgcgcggcatctggcaggaactgggcggcagcatcctcggcaaggaccgccagggcagcgtaccgcgcaacgccacgctgatcgccaaggccttctcgccagacctggtcgagatcatccgcgacatcaacaaatacagtaacaacaccatggcccggcagttgttcctctccatcggcgcgcagttccgcaacagcgccgacggcgacgacgcccaggccgcgcagcgggtggtgcggcagtggctggcgcgcaagggcatcaccgcgccgcgcctggtgatggagaacggctcgggactgtcgcgccaggaacgggtcagcgcccgtgagatggcggcgatgctgcaagccgcctggcacagcccctatgcagcggagtacatctcctcgctgccgctggccggcctcgacggcaccatgcgcaaacgcctgcggcgcaccgcactggtcggcgaggcgcacgtgaagaccggcaccctcaacaccgtgcgcgccctcgccggcttcagccgcgacgccagcggccacaactgggtggtggtggcgatcctcaacagcccgcggccgtggggcgcttcggcgatcctcgaccaggtactgctgagcctgcacacgcggaaataa

SEQ ID NO: 1775 - DNA, 225 bp, Pseudomonas aeruginosa
gggcaacaccctatgagaagacttaagcgtgatccgttggaaagagccttcttgcgtggttatcagaacggcataaccggtaaatcccgtgatctttgtccgttcacccatcctacgacgcggcagtcctggctcaacggctggcgcgagggccgtggcgacaactgggacggcctcactggcacggccggcttacaacgtctcaatcaactccagcacgtgtaa

SEQ ID NO: 1776 - DNA, 1272 bp, Pseudomonas aeruginosa
gcgacaacacggatagcaccgatttccccaaggcacgccccatccgggcggcgggcgcaagcccaagggctccgcaaggagcccttttcaattccgccgcggcaaagcggcgatggcatccaccgcttcgcggatcaacgccggtcccttgtagatgaaacccgaatagatctgcaccaggctcgccccggcggcgatcttctccgccgcgtgcgcgccctcggtgataccgccggcggcgatgatcggcagccgtccgcccagctcgccggccagcaccttcaccgtgtgcgtgctcttctcccgcaccggcgcgccggacaggccacccgcctcgtcgccatgcggcaggccttccacgccttcgcggccgagagtggtattggtcgcgatcaccgcgtccatccccgcctcgaccagcgccgcggcgaccagcgcggtctcttcgtcggtcatgtccggggcgatcttgatcgccagcggtacccgccggccatgccgcagcgccagcgcttcctggcgctggcgcagtgcctccagcagttgcttgagcgaatcgccgaactgcaggctgcgcaggccgggcgtgttcggcgagctgacgttgacggtgacgtagctggcgtcggcgtagaccttgtccaggcagatcaggtagtcgtcgaccgcgcgctccaccggggtatcgaagttcttgccgatgttgatccccagtacgccgcgatacttcgccgcgcgcacccgtgccagcaggtggtcgacgccgtggttgttgaagcccatgcgattgatgatcgcgttggcttgcggcaggcggaacaggcgcggcttgggattgcccggctgcggtcgcggagtgacggtgccgatctcgatgaagccgaaaccgagctggccgaacccgtcgatggcgtcgccgttcttgtccaggcccgcggccagccccaccggattgggaaactccaggcccagcacagagaccggcaggctggccggcttgggcgtcagcaggcggttcaggcccaggcgaccgccggccccgatcaggtcgatggacagttcgtgggaggtttccggggacagtttgaacagcagctggcgggccagggtgtacatggtcgggtatcggtcggcagaatgaagggtgccgattatagccgtcgagcacccgctcaggcgaggcgttgcagcgccagcaggcggccgtcctcgctgaaatcgaggcggaacgtgccatgcacgccatcgtggccgatgaacggacgcaggtga

SEQ ID NO: 1777 - DNA, 429 bp, Pseudomonas aeruginosa
  unsure (356): Identity of nucleotide at the above locations are unknown.
caacagcaccttcaccggtcgcctttccgcactcgccaaccgcctgcgcctgggtgccgcgcgaagcgatggccgggagctgcgcgaacgggcggccgccctcgagctgccgttccagccattgcgactgccggagccgagcgtctggtggcaggccggaccgcccctgcacaccctggtcgatctgccgcgcggcgcgctgtccggcccggtccaggaagacaaggcggaagcccacgcggtcctcaagcgcctggtgcgggtcagtcactccaccctggagtcggtcgacctgaagaccatcgaaggcgtgtgcagccgggagatcctcgtccaggcaccttgcccacgcctgngaagacctggccacggccgaggtctgccggggcgtacggatcatcagctacaaggatttcgtcaaggccctga

SEQ ID NO: 1778 - DNA, 3111 bp, Pseudomonas aeruginosa
  unsure (1279): Identity of nucleotide at the above locations are unknown.
cgtgcatcctccagcagacccacacaggagcgatcgcatgtccctaccccgcctcagtatatgtttcgccctcgcctgcgggccggcgctggccagccaggcgccggtctacggcgaacgcctggaaggcttcgactacgcctatccggtgcattatctggacttcacctcccagggccagccgctgagcatggcctacctcgacgtcgcgccgaagaaagccaacggccgcaccatcctgctcatgcacggcaagaatttctgcgccgggacctgggagcgcaccatcgacgtgctcgccgacgccggctaccgggtgatcgccgtcgaccaggtcggtttctgcaagtcgagcaagccggcccattaccagtacagcttccagcaactggcagccaacacccacgccctgctggaacagctcggcgtcgcccgggccagcgtgatcggccactccatgggcggcatgctcgctacccgctacgccctgctctatccgcggcaggtcgaacgactggtgctggtcaaccccatcggtctggaggactggaaggccctgggcgtgccctggcgcagcgtcgacgactggtacaggcgcgacttgcagaccagcgccgaaggcattcgccaataccagcaagccacctactacgccggcgaatggcgccccgagttcgatcgctgggtacagatgcaggccggcatgtatcgcggcaaggggcgcgagtcggtggcctggaactcggcgctgacctacgacatgatcttcacccagccggtggtctacgaactggaccggttgcagatgccgaccctgctgctgatcggcgagaaagacaacaccgccatcggcaaggacgccgcgccggcggaactgaaagccaggctgggcaactacgcgcaactgggcaaggacgccgccagacggattccccaggcgaccctggtggaattccccgaccttggccataccccgcagatacaggctccggaacgcttccaccaggcactgctggagggtctgcaaacccagccctgaaccatccaccggcggcgctctcgccatcggcttcgccgcgccttgcccggcgtcatccccgatgcctgccgccggcgtttcactgcactggctgcgcgacgacgcgtggctcgcgtcgcgcaggcccgcccacgccgcggccgttcccatccacatggaggttcatcgtgttcccttgcctaccccgttcgctattcgccggcgtcatgctggcgagcgccatgcccgctcacgcggagntgccccacgcgcccgcctacatcgatgacagcgcctacccggccgcggcccgccagcgcatcctgccaccgatgttcgagcagaggctgggcagcctgcgctacctcgccaagcccggcgaccccttgatcacccaggccgagagcagcgactttcagcgcaccagcgactaccgtgagacccgcgcctacctggagaaactggtagccgcctcctccggccgcatcgccctgcgcgagttgcccgagcgcagcgccgagggtcacccgatgctgctggtgaccgcctccaccgaggccgacaagtccgccgccggcctgaagcgctccgccaagccgaccttgctggtggaagccgagatccatcccggcgaggccaacggcaaggacgccatgttcatgctgctgcgcgacatgagcgctgccgaccgcccgctcgccgggctactggagaagatcaacctgctgttcatcccggtggtcaacgtcgacggcgacctgcgccgcagcgcctacgggcggatcaaccagaacggcccgcaggagaccggctggcgggtgaacggccgcaatctcaatctcaaccgcgacttcaccaagctcgacagcgcggagatccgcaacgtcgcctgggtattcaaccactacgagctgagcttcttcgccgacacccactccaccgacggcgccatgtatccctacgacagctcctactgccacaacggcaacggctggtcaccggcgagcagcgcctggatggaccaggtcatgcgcaagccggtgtaccaggcgctggaaagcctcgggcacatggtccatgaatgcatcagcctgaacgacaaccaggatccgacccagggctactacccctaccgcaccgacctggcgcgcttctccaaccagtacggcgacatccgcaacgtgccgtcgatcctcatcgagcaacacgccctgcatccgtacaagacccaggtgctgggcaactacgtgatgctcaaggcgatgttcgaggtgatcggcgagcaggccgccagcctgcgccaggccatcgccagcgaccgcgagcgcctgctgcggcagaaggaggtgatcctcacctggaagccgggcgaggccgccgagacgccgttcgtggtcggcgactaccgctacgagcaatcgccggtcaccggggcccgcaccatcgtctggagcaaccggccgaagacgctgaagctaccggtgaccgacaacggcgtacccgacctggtggtgccgcgtccccagcgtttcatcgtcccggcgcagtggcacgaggtgatcgcccggatcaaggcccacggcatccgctatagcaccctggagcgtccgaccgaaatcgccgtgaccctgtaccgcatggacgacatcaagctcgccgatggcttcgaaccggatcgcgtgcaaggcaaccggattccgggctacgaaggtcgcctgctggtcagcggcacgccgaagccgttccagcgcttgcagaccttcccggccggctcgctgtcgatcgacaccgcccagccgctgggcgtcctggccatcgacctgctgcaaccgcagagtccggattccttctggtcctggggcttcttcaattccaccctggtggccgccgaggagccggaggaatacgtgatggagccgatggcgcgcaagatgctggcggaagacccggcgctgaaggccgccttcgacaaacgcctgcgcgaggacaaggccttcgccgccgatccgcaggcgcgcctgcaatggttctaccagcgcacgccgttctacgacgtgaacgccttcgtctatccggtaggagtggtgttctga

SEQ ID NO: 1779 - DNA, 420 bp, Pseudomonas aeruginosa
gttgctggcggcgatgcagccgcttggcccaggcgggttgttccggcttctgtgcagcggcttctcctgcggaggcttctcctgcggaggcttggccggttgacgcgccagcgtcggccgtcgagcgattccagccagcacggaacggagcggccatccgctgcccggcagcggaagcacgggatgctgcggcgcgtccggcggactgcgcgccggtcttggcgacgtggcccaggcccgccatcgcgccctttgcgccgccgccagcggcggcggaaccggcctgaaacgccgacttcgcattgctggccgccgacgtggcggcgcgcgcaccgctaccggccagctttgcggcggccggagccatacgcgcgccagcagccacggcgccacccacgcccgtcgcggcggcgccgatag

SEQ ID NO: 1780 - DNA, 1824 bp, Pseudomonas aeruginosa
cgatcgaggtcgatgcgaaagccggcaccagtatcccgggggagcgttgagatgcaggtaagccctgccatcgccgccgtgcctgcgggcgcgggcgaagacgctgccgtcgtcatcgaagacgtggacaagcatttcggcgacgtaaaggcgctgcggggcttgagcgcgcgcatccactatgggcggctgacgggtctggtcggccccgacggcgctggcaagacgacgctgatgcggattctgaccggcctcctggtgccgaacgccggccgcgtcaccttggcaggctatgacgtggtcaaggacaacgacgccattcatgtcgccagcggctacatgccgcaacgctttggcctgtacgaagacctgtcggtgatggagaacatgcgcctgtatgcgcagttgcgtggcatggacgcagaccgcaacgccgagctgtttgccgagctgctcgacttcacgcggctcggacccttcaccaagcgcctcgccggcaagctctctggcggcatgaagcaaaaactgggcctggcctgcgcgctcatggcgcggcccaaggtcctgctgctggacgaacctggagtgggcgttgatcccgtcagccgccaggacctgtggcgcatggtgcaggcgctgaccgatgagggcatggcggtggtctggtccaccgcctacctcgacgaggccgagcgctgcgagagcgtgctgttactgaaccaggggcagctcttgtttgatggtccgccgcaagagttgaccgcgcagcttgaaggccgcagcttccgcctggaaaacgtcggcgccgagcgccgggcggttctgaccgaggcgctcgatctgcccagcgtgagcgatggcgtgatccagggcgcaggggtgcgcgtggtactgcgcgagggtgcaccaacggagcaaatccaggcgctggccgatcgggcccaagtgcaactggctccagtgcccgcgcgtttcgaagacgcctttattgatttgctcggcggcgggccaggcggtacatcgaccctcgccgagcgcctgtcaccggtcgaactgggttccgacgtcgctgtgtcctgccgcaacctcacgaagcgcttcggcgaattcaccgccaccgaccaggtcagttttgaggtgcagaaaggtgaaatcttcggcctgctcggccccaacggcgccggcaagtccaccaccttcaagatgctgtgcggcctactgaaacctacggctggtgaagcgcatgtggtgggtcacgatctgcgccacgctaccggcgccgccaagagccagctcggctatatggcgcagaagttctcgctctatggcctgctttcggtgcggcaaaacctggagttctcggccggcgtttacgggctggaaggcaacgtccggcgcgagcgtatcgaggaaatgatcgccaccttcgatctcggcgactggttgtccgcgacgcccgactccctgccgctggggcacaaacagcgcctagcgctggcctgctcgctcatgcatcggccacccgtgctgttcctggatgaacctacttcgggcgtggatccgatcacccggcgcgaattctggacccacatcaatggcttggcacgcaagggcgtgaccatcatggtcaccacgcacttcatggacgaagccgaatactgcgaccgggtcgccatgctctcgcgtgcgcgcctgattgcactggacacgcccgacgcgctcaagcggattgcggccaattccgagcgccccgacccgaccatggaggacgccttcattcacctggtggagtctgccgatcgtgagatggaggctaccgcatga

SEQ ID NO: 1781 - DNA, 1158 bp, Pseudomonas aeruginosa
tcgccaagcgcgccacgcgcaagaacctggagtgaagcgatgttgacttccgcattctcgttcacccgcctgcgcgcccagttcatcaaggaagtgctcagcgtcctgcgcgacccgcgcagccgcatggtggtgttcgtgccaccgatcctgcagttgctggtgttcgcctttgccgcgacgctggaagtgcgcaacgtcgatatcgccgtttacgatcaggatgcggggcggtggtcgcacgagttggtacagcgcctagacagcgcacgcttcatcacccacgtccggcatgtcgacagccagcagcagcttcacgagctgatcgaccgtggcgaggtgatcgccgcgctcgctattcccgtcgatttctcgcgctccatcgccgccggcgaaagcggccgcgcgcaggtactggtcgatggccggcgcagcaactccgggcagatcaccgtggcctatctgtccaccatcgccgccgatatcggcgccgaggtcgtgcccgacgcacaagcaccgacgcccgtggtcgtgcgccactggttcaacccgaatctggtctaccgctggttcatcgtgcccggcctgacgggcatcctggcgctattcagcgcgctgctcatcacctcgctgtcgatcgcgcgcgaacgtgaactcgggaccttcgaccagttgctggtgtcgcccacctcgacgcccgagatcatcatttccaaatcactgccggcactcgcaattggcaccgcgctgggcctgttcatgatcagcgcgggcgtcttcctgttcggcatcccgtttacgggctcgtttgcgctcctgctcgccagtctggtgctgttcatcctgtcggtggtcggcatcggtctgatgatttccgcggtcagcatgacgcagcagcaggccatcctgggggcgttcgccatcggcgtgccggcggtgctgatgtccggctttgcgacgcctgtagaaaacatgcctgtcgtcctgcaatggctggctcaagccattccactgacccacttcctcatcatcgtcgaaggcagctttctcaaggccatgccacccagcgacattctcgccagcctgtggccgctggcggtcatcgccctcgccacgctgaccatggccaccgtattcgtccgaggacgcctgcaatga

SEQ ID NO: 1782 - DNA, 1122 bp, Pseudomonas aeruginosa
gctcgatccccggccttgacgccacgcagaccatctacgacgcgggcttcgacgcggcctgggaggccgacttgttcggggccaagcggcgcgcgctggaaggcgccagcgcccgcctgcaggcgaccgaagccgaggcgcagggcgtacgcatgcgcatcgtggccgaggtcgcgcgcacctggttcaccgccgtcggcgcccgctacgagttgcacgcacaacaggccacactggatacgctgcagcagaccttggaattggtgcgcctgcggcatgcgctgggcgacgcgtcggccgccgacgtggaggcggcgtacgcccaatggacagcagtccacgcgctcatcccggatatccaggcgcgtcagcgcgccgcgatactcagcctgggcgttctgctgggcgctccgccgtgagcgggagctggcactgctggatggccccttgacgccgagcacgctgcgggcgctgccggtgggcgagcgcgcagagatgctgcgccggcgcccggacgtgctggccgcggaacgtctcctggcagcgagttccgccgacatcggcgtggccacggccgaactgttccccaaactctccatcggtgtcggcggcgggttccaagcgctcagcacgggcgattggttcgatgcatccagctcgcgtttttccatcctgccgctgatttcctggcgcctgttcgacggtggccgtgtgcgagccgaaattcgggcacgcgaggcggccgagcggcaggccgcgctggcctatgagcaggcggtgctgacggcgctgggcgacgccgagcgcgcgctgggcgactaccacggcgggctggacacactggagcgccgtggcatggcactggatgcagcgcgcacaagctacggccacgcaaaggcgcgctatgcggcgggcgacattgcgctagtcgaactgctggctgcccagcgcagcctgcacgaggccgaaaccgccgccgcgcgcgcgcataccaacgcggccgtgcaattggtggcgctgtacaaggcactcggtggtggctgggacgcatccacggcggcatcgaccgcaacccatccgcttcggggcgctgccgcccccgtcgcgttttcaagccgctga

SEQ ID NO: 1783 - DNA, 1452 bp, Pseudomonas aeruginosa
acacttgcccgatacaaaagcaaaaaccggagtgagcatcccatgaaactgcattttctgggcgctgcgcgcgaagttaccgggtcgtgtttcctggtggaagcgctcaacgtacgcttcctggtggattgcggcatggttcaaggtgggcgtatagcagcagcacgcaaccacgagccattcccgttcgacccggcatcgattgatttcgtgctcctgacccatgcccacatcgaccacagcgggctattgccaaaactcacgcgcgcaggattcaaggggcctatctacgccacgccagccacggttgatctgctcggggtgatgctgcccgatagcgctcacatccaggaaagcgatgcgaagcgggatgtcaagcggttcaaagagaagaccgcgctgtcacccctgtataccctgcaggatgccagcgactgcttgcagcaggtgcgaggcatcgaatacgaccgggagttcgcgccccgcgtgggggtgcgcgcccgtttccgcgatgccgggcacattcttgggtcggccatcatcgaggtctgggtcaccgaatatggctacccgacaaagctcgttttcagtggcgacctcggccagccggggcgcccgatactgcgcgacccgacaaccatcgaggacgccgacatcctcgtcatcgagtccacctacggcaaccgccagcacaaggatttctcggcgaccgaagaggaaatgatcggcatcgtcgaaaagacattgttcgaacgcggcggcaatgtcatcgtgccggccttcgcggtcggccgaacccaggaaatcctttatcacctgcaccgactcacctgcgaggggcggctgcggcaaccgaaggtattcgtcgattcgccgatggccacgcaggccacgcgcatcacgcgcgagcatctcgaattgttcgacgaacaggcgaagcggttggccggctggcacgcgcgcggcgagaacctcccatacctgagtttcacagcgagcgctgaggagtccatggcgctgaaccggatccgctccggagccatcatcatttctgccagcggcatgtgcgatgcgggacgcatccggcaccacctgcggcacaacttgccacgccgcgaatgcagcatcttgtttcccggtttccaggcgcaggggacgcttggccggcgcctgatcgagggggccgaacgtgtacgcatcttcggcgaggacatcccggtacgtgcggcgatccacagcgtggacggcctctcggcgcatgccgaccagaaggcgctgctggattgggcccgtgctttcattcaagcaccggcgcaaaccttcgtggtgcatggggaatcgtcggccgcgcaaaccttcgctgacctcttgcagcagcaactcggctggcaggtcacggtgcccgagtatggccatgcgctgcgctggccggactttctggcgcacgagtga

SEQ ID NO: 1784 - DNA, 576 bp, Pseudomonas aeruginosa
cgatggcgaccaccacggccaccaggccgctgccgccggcgatcgcgcagccggtgtcgaagatgcgcgacgcgtaggcgtcgaaggagaatcaccactcgaagaggcgccagcggtgatagaccggcgtgccaagaagatcgaaccaggctgagccgaggcgtagctgatagcccagggcggcggctgtccattgggtggcgaaccatacgccggcaagcacgataccgaaggcgacacccacctgccccaacagcacgccttgaccttgcactgcggcctccgatttctcctgtgcggcatgcggcacagggacgtgccgcagccgtcagggtggaatccggatcagggccggtcaaagaccgttatcggaaggaatgtcgagaaagaagcaagagttcgcgctggggcgaaccggaagcaaccaccgcaagcggctgcgcactgccgcgagccgggcaagaagatgcgaagtcggtggcgcacaagccacgatcagaacttcggctgttccttctgtggcgtatagggcgtcttgccaccaccgaagaaccgccggttcgtcgcctcggctag

SEQ ID NO: 1785 - DNA, 1194 bp, Pseudomonas aeruginosa
cgcgaccgctgggcggtttcgacacctggcgccaggccttgccgatcaccctgctggaattgcgcaagcccgccgccaggaagcctccccgcgatgcgtgaggaaacccccgagcagcccgcgccgttgcgcagcggatacaccaccggcagttgcgccaccgccaccagcctggcggcggcgcgcctgctgctgggcggcacgatcagcgacgcggtgcagatcgtcctgcccaagggccagcaggtgctgatgcgcctggaattctgccgcgcctgggaaaacggcgcggaagccggcaccctcaaggatgccggcgacgatcccgacgtcacccatggcgccctggtgttcgcccgggtgcgcctgagcgccgagcctggcgtgcgcttccatgccggccccggggtcggtacggtgacccgcccggggctgaccctggcggtcggcgagccggcgatcaatccggtgccgcgacagatgatcgaacgccacctcgcccagctcgccgccgaacggggctacgccggcggcttcgaggtcgccatcggcgtggagggcggcgccgagctggcgctgaagaccatgaacccgcgcctgggcatcctcggcgggctgtcgatcctcggcaccagcggcatcgtccggccgttctcctgctcggcctatatcgcctcgatccatcagggcatcgatgtcgctcgcgccaacggcgtccgtcacatcgccgcctgtaccggcaacgccagcgaggacgccatgcgccggcgctatgcgctgccggagatcgccctgatcgagatgggcgacttcgccggcgcggtgctcaagcacctgcgcagggcgccggtggaaaagctcagcctgtgcggcggcttcggcaagatcagcaagctcgccggcggccacctcgacctgcacagccgccattccagcatcgacctgccgcaattggccggctgggccgccgcgctcggtgccagcaccgcgctacaggacagcatgcgcgccgccaacaccagccagcaggcgctggcccaggcacacgccgaaggcgtggccctgggcgatgcggtctgcgcccacgccctgcgcttcgcccgcggcatcgtgcccaccgaggtggcgctggaagtcttcgccatcgaccgccagggcaacctggtcggccaggcctgcgaggagcgccgatga

SEQ ID NO: 1786 - DNA, 402 bp, Pseudomonas aeruginosa
tcccagtcggcgacgaactggctggcggcctggccaagcagccagccgaccagaggggtgatggcctcgatcacgccgaagattatcccggtgcgcagcgcctccgacaggcgcggccgatccaggctggagcccttgccgatggccgcggcgaaggcatcggtggacatggcgaaggcgaggaagatcagggaaacgggattcacgcggatactccagccgggcatgagtcaacgacatgaccccgcggcccggcttcggcgcaggaatgtcgttggtctcaccaatccggttggatgcgctggccatggcaggttgccaagaatgttgaccagcgcgccgtcaacgggtgacggcaggctactccccaaggaaggccggcagcatagcagaccggcgtga

SEQ ID NO: 1787 - DNA, 639 bp, Pseudomonas aeruginosa
aacgggaagccggtgcgtcacttcggtgatcagtccggcgctgcccccgcaacggtaagcgagcgaaatcctcttcaggccactgtgctccggcatgggaaggcgaggatttcacgaccctcgcaagcccggagaccggcctgcaacgccctgttggcacacccgcggtgggcgggagcgagccggttgttcgaggcgctgtcgcgcctgcgatttcctgcgcgttccgtcctgcccggtcatgagatggaacgcccatgccccgcttcagccgtttgcgcaccgagcctttcgccctcggcctctccaccagcctgctgctggtaccgcccgccctcgccgaaaccgaggaagccgccctcgccctgcccagccagttggtcagcgttcgccaggatcccgccgaactcgaccacatcgacctcgccactccggtcagtgccggttcgcgcctgggcctcagcgccctggacaccccggcgagcaccagcagcatcagcggcgaggaagttcgccgacgcaacaaccccagcgtccaggccgccgtcacccgcagccccggcatcagcttcatcggcaccccaggagatggcggtaccggcctctcggcgcgcggcttcagcggccacgcatcggtga

SEQ ID NO: 1788 - DNA, 261 bp, Pseudomonas aeruginosa
ccagcgactggagcctttccgacagcgtcaccgcgagcaaccagttgtactacatcaaggcccgccgccactggcgcaacgccgaaacctacgaatgggacgtcccgcgcgaagagctgttgcgcagggactacctgcgcatcagccacgagcaggagcagatcggcgaccgccagaccttcgccttccagcacgccctgttcggcctcgacagccgcaccctggtcggcgccgagtacaaccgcatccgcttccgcctga

SEQ ID NO: 1789 - DNA, 294 bp, Pseudomonas aeruginosa
acctggcccaggactggcggctgtcggcgaacgccgcgctggtgcgtgccgaatacgacgacttcgacgaaacgatcgacgggcagacctactcgcgcaacggcaatcgccccaggaacgtgccacggcgcaccgccaacctctggctggacaagtccttcgccgagaccctgcgcgtcggcgccgggctgcgctacgtcgaccggcgctacgccgacgccgccaaccaggccagcctgcccggctacacggtggtcgactccaacctgggctggcgggtacggccggacctga

SEQ ID NO: 1790 - DNA, 951 bp, Pseudomonas aeruginosa
ccctcggccttgagctgtacaacctgttcgaccgccagtacgccctggctgacaacaacaacggccagcaatggatcatgggccagccacgctcgttcaacgtcaccgccgacttcagtttctgaagccggcgccgcggcaatcgtctctgctgaaccaccggacctgcgagtagccatgtcgtcccttcacctcgatgccctgcactggtcgcccgacgcctccaccgagttgctgcgcggcgtgcatctggaagtcccggccagcagtttcgtcggcctgatcggccccaacggcagcggcaagaccagcctgctgcgctgcgccttccgctatgcgcgaccgcagcgcggccgggtggtgctcgacggcgacgacctctggcgccagccgccgcgctgggccgcccggcgtatcgcggtggtgttgcaggagttccccgaggacttcggccttgccgtcgaggacgtggtcgccatgggccgcacgccgcacaagggcctgttcgacggccacggcgcggacgaccgccagcgggtccgccaggcgctactccaggtcggtctcgaagggcgtgccgcgagccccttcgccagcctctccggtggcgagaagcagcgcgccctgctggctcgcgcgctggtccaggaaccgcgcctgctgatcctcgacgaaccgaccaaccacctcgacccgcgctaccagctggagcttctgcgcctgctgcgcggcctcggcctgagcaccctggcgagcttccacgacctcaacctggcggcggccttctgcgaccgcctctacgtgctcgacggcgggcgcatcgtcgcccagggcacgccgaccgaggtgctcgatgccgacctgctgtggcgggtgttcggcgtccgcgccctggtcgaccgccaccccctcgccgaccacccgcgcctgacctggattacccaagcatga

SEQ ID NO: 1791 - DNA, 1152 bp, Pseudomonas aeruginosa
aaaccctggtcgccggcctccaccctcgggcgccacgtccatgaccctgttccgcagccctcgcgcctattgcctgttgctgggcagcctggtcatgttgctcggcctgtcctgcgtggtcgccctcggcttcggtccggcgcgactggacagcggcctggtcggccgcatcgtcctccagcgcctgttcggcgtggcggcggagcccggtgcctggagcgccggccaggagcacatcgtctggctgatccgcgccccacgggtactgctcggcgcctgcgtcggcgccggcctggcgctggtgggagcggccctgcaggcggtcacgcgcaatccgctggccgatccgcacctgctcggcgccacctccggcgcgaccctcggcgcggtgttggtggtgctctacatcggcgaggtgatcggcctgctgaccctgccgctggcggccttcctcggcgccctcggcagcatgctgctggtgctcggcgtggccagtcgcggcggccgcctgggcagcgaccggctgttgctggcgggggtcgcggtgtcgttcgtgctcctggcgctggccaacctgctgctgttcctcggcgaccaccgcgccgcctcctctgtgctgttctggatgctcggcggcctcggcctggcgcgctggtcgttgatctggctgccggcgctgtgcgtggccggcggcctgctggtactgctcgggctgggccgtgcgctgaacgcgctgatggccggcgaacagaccgccgtgaccctcggcctggacgcccgtcgcgtacgcctgtgggtcttcgtctgctgctcgctgctgaccggcgtgctggtctcggtgagcggcgccatcggcttcgtcggtctcatgctgccgcacgccgcgcgcctgctggtgggtgccgagcaccgccgactgctgccggtgtgcgccctgctcggcgcgctgttcctggtctggatggatgtcgccgcgcgcaccctgatcgccccccaggacctgcccatcggcatcgccaccgcggccatcggcgggctgttcttcattctcctgctgcgtcgccgcagctgatcagaacagatccagcgggatcttcaggtaacgcaccccgttgccttccaccggcggcaggttgccgccgcgcatgttga

SEQ ID NO: 1792 - DNA, 813 bp, Pseudomonas aeruginosa
tgtcgggtatcaacatggaggttccttgcgcggcgtgctgacggcgaccgcgccatggctacggatcgtcccaccatagccaacccgggcccggcgtaccaacccacaggtttgtcaggaagctaccggaccgcctcagagcagcagggcggcccaggccgatgccagcaacaacagcgccatgccctggttgaagcgtttcatcagcgacggcgagcgcagcagccgcgcgctgccgacgccgagcaaggcccaactggccaggcacggcagcgaaaccaggaagaacagcaatgccagcaggccgatccgcccggcctgtccggcgccttccccggcgaacagtgccagcgcggcgagggccatcatccaggccttgggattgaccagttgcaacgccgcgccgccgagcacgccgaggcgccgcggcggctccgcgccgtcgatgccgcccgcgctgcggaacaggctccaggccaggtagctgagccagccgacgccgagccaggcgagcccctgctggagcagcggatggcgtcgcagcaactcgcccaggccgagcccgagcagcaggatcagcgccgccaccgccgcgcaggcgccgagcacgatcggccaggcggcggccaggccgtggcgctggctgttgctcaggaccaggatgttggtcggtccgggggtgatcgaggcgacgacggcgaacagcaggaagggcacgagggattgcatggacgggctcctgtggcgggggagccttcatcctggcgacgcgccgggcctcagtctggaagctgggtgcactgccggcggtag

SEQ ID NO: 1793 - DNA, 1224 bp, Pseudomonas aeruginosa
ccgacatcgacgacgtggtgccgttcatccgccacctggtcagcgaaggttggtggatcaccggccagaccatcctcatcaacggcggcttctccaccaagtgagccacgcagcggccgccacggcggtcgctgcctgcctgcggaaacccttcatgcacgtgaccctggtaatcgccggcggcatcgtcctgctcggtctgttcctgctcttcggcaaactctgggatgccgggccggcgctcgctgccggcctgttcctgccgacctggctggccgtcgcgctggtcaacctgtgggtcggcgtccagcacgccggctacggcttgcgcgaagaactgccgatcctgctgctggtcttcctggtcccggcggcactggccggcgtggcgatctggctggcgccgcgctaggcggcggcgcttcagacgcggaaacggccgaccagccgcgccagttccgaggacagctcggacagccggcggctggccccggtaccctgctccgaatgttccgccgcctgggcggaaagctcgcgcacctcgctgatgttgcgggcgatttcgtcgattacccggctctgctcctcgcaggccgaggcgatctgcgcggcgaggtcgttgatccgccccaccgcgtcgccggtggcggccagcacgccgtcgaccccggcggcgcgctcgacgctgtcgcgcgccttgaggctgcccgactgcatggcccgcacggcgttctgcaccccggcctggaggcgctcgatgcgcgcctggatgtccttggtcgaatcctgggtgcgcgccgccagcgcccgcacctcgtcggccaccacggcgaaaccgcgaccctgctcgccggcccgcgcggcttcgatggcggcgttgagggcgagcaggttggtctgttcggcgatgcccttgatcaccgtcagcaccgcgtcgatgctggcggtttcctgggccagttgctggatgctctcggaactgctctccacttcctgcgccaactggcggatcacctcgatggtcgcttccaccacgttggcgccctcgcgcgcctgccggcgggcgtcatcggccacctgcgcggcgctctgggcattgcgcgccacctcgtggacggcgctgctcatctgcgtcgcggcggtgctgacctggtccaccgatgcgtgctcgctgttgatcagacgatcgttggcggcggtcatgccggccagcgaaccggctga

SEQ ID NO: 1794 - DNA, 3096 bp, Pseudomonas aeruginosa
caggcgcagggtttcgaacaggcgccggtcatccttcttcgccgagcgggcgtggcggcggatcacctgcagcaggcactcgacgaagcattgcgccggattgctgagggctccgccgcgccgggtgatgatgcccagccgtcgtggctcgaaggtttcccgcagcgccagcggcaccacccggccgagcaacggcggggcggcgcctatgatcgccggcacccaggtgcacatgtcggcctgctccaccagggtctgcaggatcgccacggagtgcgcgcggacgatgcgccgctcgtcgatcaaggcgccgtggcgccagaacaactcgcgcatcagggcgtcgtggccgtcgccggtgtagttcaacgcccagtcctgttccagcagctcgtggatcgagccgcaacccgccagcggatgcccctggcggaccagcaccgcggtgtcgtagtcgagcagcttctcgcaggcgaactcctgggccgcctgggcgccgtgcagcgggccgatggcgaaatccatgctgccgtcgcgaagcaatggctgggccaccgccatcaggctttcgaaaagctccaggcgcacctccggcatgcgctcgcggaacgcctgcaccgcctccgagaggaaggtcagcgccacccaaggcgtcaccccgatgcacagccggccgctggcctggccacgcaggtggtcgagttcgacctgcgcgtgctccagttgcttgagcaccagccgggcgtggatcagcagcgccttgccgtattcggtgaaggtcaggccgctgggcgtgcggacgaacagcggcagatgctgttcggtttccagttcgcgcagcgcgcgggtcacggccgcctgggaaatccccaggacgcgggcggcggcgcggatgccgccggcgtcggcactggcgaccagggcttgcaactggtggagtttcacgggcttaccgaggtgacaacgaaaggttgtcatcatagccaaagcgagcctccccgccagtcccccgcttgcctaccatcggcttcgacaacgccccgccgcccaccggtcggagcccttgaggagaacaagaagaatgaccgagcctgccgtcctgcccgccatcgcggcgctgcgggaagagatggttaccttgcgccgccatatccatgcccacccggagttgggtttcgaggaacggcgaaccgccacgctggtcgccgaatgcctggaggcctggggctaccaggtcagccgtggagtgggtcgcaccggcgtggtcggcaccctgtgccgcggcgagggcccagcgctgggcctgcgcgccgacatggacgcgctaccgatccaggaagccaccggcctgccctacgccagccaggtggacggcgtgatgcacgcctgcggccacgacggccacaccgcgatgctcctcgccgcggccaggcacctggtcgagtcgccgcactggcgcggcaccctgcaactgatcttccagcctgccgaagagggcctcggcggtgcccgcgcgatgctcgacgacgggctgctggagcgcttcccctgcgacgccatcttcgccatgcacaacgtcccgggataccccgtcggccacctcggcttccatcccggccccttcatggcctcggccgataccgtggtcatccgcgtgatcggcagtggcggccacggcgcggtgccgcagcgcaccgtcgacccggtggtggtctgctccgccatcgtgctggccttgcagagcatcgtctcgcgcaacgtcgacccgcaggacaccgcgatcgtcagcgtcggcgcgatccatgccgggacggtctccaacgtgatcccggccagcgccgaaatgatcctcagcgtccgggccctgaccgcggaaacccgtgccctgctggagcgccgcatcggcgaactggcccgcggccaggccgccagcttcggcgcgcgggcggaggtcgactaccggcattgccatccggtgctggtcaaccatcccgggcagaccgcgttcgcccgcgaggtggcccgcgactggctgggcgaggaatgcctgatcgacggactgcggccgttcaccgccagcgaggatttcgccttcatcctcgaacgctgtcccggcagctacctggtgatcggcaatggccagggcgagagcggctgccagttgcacaaccccggctacgacttcaacgacgactgcctggccgtcggcgccagctactgggtgcgactggccgagcgcttcctggcctgagccagggttttcaacgggcgcgcggcctggcgcgcgcggatcgacagaggacaaccacaatgacaagaaccctcggcagcatcgccctctccctcctcctcgccgcaccggccggcgccgccgactggacaggcaaggtcctgcgcctgggcgtcgacccgacctacccgccgctcgaatacaagcagccggacggccgcctggcaggcttcggcatcgagatcggcgaagccctctgcgcggagctgcgagcccgctgcgaatgggtcgaaagcaactgggacggcatcatcccggcgctgctgtcgcgcaagatcgacgccatcgtctcgtcgatgaccatcacgccgaaacgcgcacagcacatcgccttcaccgaccgcgtctccaacgcgccgagccgcctggtggtacgccgtggctcggcgctcctgcccgacgccgagagcctgcgcggcaagcgcgtgggggtcggccagggctccaaccaggaggcctacgccaaggccgaatgggccgccaagggggtgcgggtcgtctcctaccagaaccaggaccaggtctacgccgacctcgtcatgggccgcctcgacgcctcgctgcaaggcgcggtgcaggccagctacggcttcctcgacaagccggtcggcaaggatttcgaactggccggagcggtgctggacgaccctcgctacttcggggtcggcgacggcatcggcctgcgcaaggaggacgtggcgctgcgcgaggacctgaacaaggcgctggcgacgatccgcgccaacggaacctacgcgcgaatcaacgcccgctacttcgacttcgacctctacggcacgccctga

SEQ ID NO: 1795 - DNA, 1401 bp, Pseudomonas aeruginosa
aatgttcctcgacggcttcggcccgcagatactcgccggcaccctggtgaccctgaaactggcgctgggctccctgctcggcgccgtgctcatcggcctcctcggcgccagcgccaagctcgccgccaaccgcccgctgcgcgccctggccagcggctatacgacgctgatccgcagcgtccccgacctggtcatcatgctgttgctgttcttcagcctgcagatcctcctcaaccgcgtcaccgacgccctcggcatcggccaggtcgacatcgacccgttcgccgccggctgcgtcaccctggcgttcatctatggcgcctacttcacggaaaccttccgcggcgccttccaggcggtcccggccggccaggtcgaagccgcgcaagcctacggcatggggcgctggcgagtgttccgccgggtactcctgccgcagatgctgcgctacgccctgccgggcatcggcaacaactggcaggtgctggtcaagtccaccgcgctggtctcgatcatcggtctcggcgacctggtcaaggccacccaggacgccggcaaaggcaccctgcagttcttccacttcaccctggtctgcgggctgatctacctggccatcaccgcaatctccaacgccgcgctgctgtggctggagcggcgcagctcgctgggcgtcaggaggccgctgccatgaacgcggtactcgacgaatactggcaggcctacctgtggaccgacggcctgcaactgaccggactggcgatgaccctgtggctgctgatcctcgccgtggcgcttggcttcctgctggccatcccgctggcggtggcgcggacctgcggcaacccgctgctgcgctacccggtctggctctacacctacgtgttccgcggcaccccgctgtacatccagttgctgttcttctacaccggcgtctacagcctgaatgccatacgcgcccaggactttctcaacgcgttcttccgcgacggcttcaactgcacggtgctggccttcgtcctcaacacctgcgcctacatgacggaaatcttcgccggcgcgatcaggaacacgccccacggcgaagtggaagcggcgcgcgcctacggcatgggcggcttcaccctctaccggcgcatcgtcctgccctcggcgctgcgccgggcactgccgtacttcagcaacgaagtgatcctgatgctgcattccacctcggtggcgttcaccgccacagtgccggacctgctcaaggtggcccgcgacgtcaattccgccacctatgcgccgttcctgtccttcggcatcgccggcgcgctctacgccggcaccgccttcctgctgatctggctgttccgccgcggcgagctgcgctggctggcctacctcagaccgcaaacccactga

SEQ ID NO: 1796 - DNA, 207 bp, Pseudomonas aeruginosa
agggactggagctgggctcgccgtactcctggcaactcgccgagcgcgacctgttcggcgccgaggcctggtacggcgccggccgcctgctcgccacggtgctggtgggcaatgccggctacagcggcgtcgaagccatcgccaacgaagccggcggcgacggcacggtgcggatcgccacggcgaacctcaacgcctgccgcctga

SEQ ID NO: 1797 - DNA, 441 bp, Pseudomonas aeruginosa
cgcgcctggtggacagcggcgtattcgtcttcaggaacccctgaatcggcgcccggcccccccgctgggcagccacccaggccgggcgcaggcgatcacggttggccttcgggccactcgacccgctgcaatggcgcgccgccgcgcccgaggcgatggacgatgccgctgccccggcgcagatcgacccgcaccaaccgcccgccttcctctccacggccgctgagaagcaggttgtgggcatccaggcggaacagccgctcgggacgctcgatgggcagctccagggtccagagcaagctgccgtcgccagacaccgagctgagcagcagctcgctacgctcggccaggctgcgccggtgcagcaccagccagttgccgtcgactcgccagggacggcgcgccaacctggaatcgccgcccggcagcgccgaggcatag

SEQ ID NO: 1798 - DNA, 1020 bp, Pseudomonas aeruginosa
tggtcaggaaagctagcaactctgtcatgcctggaaggctccaaggtagaatggacgacacaatctaccggtctccagcgccgagcgagaacgatgaatactgacaatcatggtgaggaaaactcaccattcaggcgccgtcgcctgccctcgctgaacgccctgcgctgcttcgaggccgccgcccgcctggagaacttttcccgtgccgccgaggccctgtgcctgacccacggtgccatcagccgcgccgtgcggaccctggaggaggaactcggttgtgcgctcttcgaacgccgcagccagcgggttttcctcagcgaggccggcaggcgcctgctcgccggcaccggcccggccctcgacctgatcgagcgcaccggcgagaccctgcgcgcggaggccggccccaccgcgctggtgctgtcctgcgaaccgaccttgctgatgcgctggctgatcccgcggatcgccggattcatgcaggaacagccacgactgtcgatccagctggtcgccggcggcgggccgttcgccttcggccgcggcatcgacctggcgatccgccgcaacgacttcccctggccgcccggcagccatgcccactggctgttccaccatcaggtccggggggtctgccgggcgagcgacgtcgaacggcatttccacctcgatgcaggcccgcccgggcttcgcgccgtcgcaccgcgcctgcacacggcgacccgcccgcaagcctggaacacctggacccgtctcgccggacaggcgccggcgacgaccgaagggcagcgcttcgagcacttctacctgagcctgcaggcggccggcgccggactcggcgtggccatcggtccctggcaactggtgcgcgacgatctggccgccggcctgctggcggcgccactgggattcctcgccgacggcagcagctatcacctgctgaccccgcgaccgttgcaggccggagagcctgccacgctgctgctggaatggctgcgccgcagcgcggcggcctga

SEQ ID NO: 1799 - DNA, 1164 bp, Pseudomonas aeruginosa
cgaccgatacagatattcaagccatctccctgccgccttcgaaaggaaaagaccatgtccaacctgctcctctccccgctcgccgtaggcaacctggccttgcgcaaccgcatcgtcatggcgccgatgacccgctcccgggcgcaacagccgggcgacgtgccgaccgccctgaacgctctctactatgcgcagcgcgccggcgccgggctgatcgtcagcgagggcacgcagatttcccgcctcggccagggctacgcctacacccccggtatctacagcgaggcgcaactggccggctggcgccaggtcaccgaggcggtgcacgccgccggcggactgatcgccgcgcagctctggcatgtcgggcgcatgtcgcatcgctcgctgcaggccggcggcgaggcgccgatcgcgccctcgccgatccaggccaaggcccaggtgttcatcgccgatggccagggcggcgggtccatggcgcccgccgacgcgccgcgggaaatgaccctggaagacatccgccgggtccgcgacgaattcgtccgcgccgcacgcaacgcgctcgacgccggcttcgacctggtcgagctgcatggcgccaatggctacctgatcgaccagttcctcgccagcgccagcaaccggcgcagcgatgcctatggcggtagcctggagaaccgcgcgcggttcctgctggagatcgtcgacgcgctggtcgccgcggtcggtgccgagcgcgtcggcctgcgcctgtcgccctggggcacgatcaacgacatgcacgacgacgagccggaagcgatgaccctttaccttgccgaagccctgctgcgacgcggcatcgcctacctgcacctggccgagtgggaatggagcggcggcccggcctacccgcaaggcttccgcgagcgcctgcgcgaacgcttccgcgcgccgctgatcgtctgcggcaactacgacgccgagcgcgccgaagcgatactccaggccggactggccgacgcggtggcgatcggccggccgttcatcgccaaccccgacctggtcgagcggatccgtctcggcgcgccgctggccgaggccaaccaggcgcggttctacggtggcgacgctgccggctacaccgattacccgactctcggccagtccgctacggcctga

SEQ ID NO: 1800 - DNA, 687 bp, Pseudomonas aeruginosa
tcgctctccggacgtttcatagattgcacgccttcactctctgcgaggcattcccgtgacgcatccagcgaccgtctacagcctgtccacccgcctgctgcactggagcatggcgttctgtttcatcggcgcgatcgtgctggcctatttcgtcatctgggtgctcggccacgaccacccacagcgcctgccggtactcaacctgcactgggtgctgggcctgctggtcggcctgctgctgatccctcggatcgtctcgcggctgcgcgggccgcgcctgccagcggtccccgggacgccgctggagcaccgcctggcgcactacgcgcacctgtcgctgtataccttgatgctggtgatgccgctcaccggctacgtcggcacccgcctgcccaccgacttcggcctgttcgtggtacccagcttcaaggacaccgcgctgttcgcctggatttcgcaaacctggaacctgagctgggaggcattcgagaagcccttcgacgccgttcaccgcatggtcggcctgtggctgagcacctcggtggtgctgctccatgcgctcgccgccggctatcaccagtgggtccgccgcgacggcaccctggagcgcatgctcggccgtcgccagcgccgctgagcggggcccttcgtcggctctcgcggcggatcggcgacgatctgctatag

SEQ ID NO: 1801 - DNA, 348 bp, Pseudomonas aeruginosa
ggacacgcagggaaaacctcgccgccccgaggctcctccgtggcaaccacaggcgtcgcgcaggtagccgggtcggcctccgacagagaggagcatgccatggccagcctgcactgccagcaccgcagctacaccatcaccgccgacgtcgtcgagcatccgggcattcccacgccctgggccggcggctgccacatcaccgatcccgaaggccacaccagcaagcgcatcgccctgcccgtgcgcttcgccttcctcgccgacctggaaaacgcccagcgcgcctccatcgcccacggcaaatggctggtggaccagcgcctggaccgcggcaaggcgctgttctga

SEQ ID NO: 1802 - DNA, 759 bp, Pseudomonas aeruginosa
gcctcctcgaacagcgtcgccaacacccccttggcctgggccagggcgccgtaccggcgggtgctggcggaggcatcgacgatcaccagccagagttcgcccgggcgccggctgcgcggctggcgaagcaggtcgcggcgctgtcggggacgtccacgcagcagggtcggcaaccattggatggcgccctccgcaccctggctcagggcgccgccaagaccgccgcgcagggctccgggtctgctcctggcatccgcacccatgaccgagcgcgggcggatgctcagggcttttttggccagcgcggcagctcgcgggcggtccccatggccaccggccgagccggcaattcaccccactgcccttcgccgttgccggtgcgctccgggagcgcgacaggggccgccgcgggcggtggcggtggattggccgccgatggtggcgggttcgactggcgacggcgatgcagcagggcgaaatgttccaccgcatcgatgtcctccgcctcgatccgctcgccgccgcgccaggccgcatgggcgcgcgccgcgcgcagccagaccaggtcggcgcgcaggccatcgacagccgcctcgaagcagcgtcgagcgatgctgtccagcgccgcatcgtccaggggaatccgcgccagccgccggcgcgcctcggcgcaacggcggcgcagggtgtcctgctggccttcccagcgttcggcgaaggcctgcgggtcggcatcgaaggccagccggcgacggatga

SEQ ID NO: 1803 - DNA, 987 bp, Pseudomonas aeruginosa
ccgcataccgctaccgcactggctacccgctcaacacctggcgatttagcgacggccgccagccgctcgccaacccacgacattgccgaacacctcgatagggcacgacgcgcgcgggacgcccgccgccagcccaggaagccagaccatgaactcatccgtatccgcactgaccaccctttcgccgaacgtccaggccgtcgccctgcccagcgccaccgcccgtaccgccctggaacgcctgcccagcccgctcgaactcaaggcccgccagccgttgccgctggagctggccagccaggtcgccgccagccgcgacgccatccgcgccatcctcgacggcgacgacccgcgcctgctggtggtagtcggtccctgttcgatccacgatccccgctccgccctcgaatacgccgaacgcctcgccgcgctgagcgacgaactcgacggccagttgctcctggtgatgcgcgcctacgtggaaaagccacgcaccacggtgggctggaagggcctcgcctacgacccgcacctggatggcagcgacgacatggccgccggcctggcgctatcccggcaactgatgctggacatgctgcgcctcggcctgccgctggccaccgaactcctgcaaccgctggccgccggctacttcgacgacctgctgagctgggcggcgatcggcgcgcgcaccagcgaatcgcagatccaccgcgagctggtcagcggcctcggcctgccggtgggcttcaagaacggcaccgacggcggcgtcggcatcgcctgcgacgcgatccgttcggcggcccacggccaccgccatttcggcctcgacccgcacggtcacccggcgctgatcgagacccgcggcaatccggacacccatgtggtgctgcgcggcggccgccacggttcgaactacgggcccgagcaggtgcaggccgtgcgccaggccctgggaaagccaggcatcgccacgccggatga

SEQ ID NO: 1804 - DNA, 2586 bp, Pseudomonas aeruginosa
tgctggaaagccacctgctcgacggttgccaggcgctcggcggcgaactgcgctacggcgtctcgatcaccgacggctgcctcggctgggaaggcaccgagcggattctccgcgacgccgcccggcggctcgccgagcggcgctgaaagcggtgggagcggccatgccgctccgctattcctcttcgacgtccagcagcaggttctccagggcctcgcgataggcccccggctcctgccagagcccgcgccgctgcgcctccaccaggcgctcggccatgtcgcgcaaggcttgcggattgtgctggcggacgaactcgcgggtctccgcgtcgagcaggtaggcgtcggccagcagcgcgtactggtggtcgtcgatcagctcgctggtggcatcgaaggcgcacaggtagtccaccgtcgccgccagttcgaaggcgcccttgtagccgtggcgcttcatcccggcgatccacttcggattcaccgcccgcgcccgcaccacccggttgagctcttccttgagcgtgcggatgcgcgggttgtccggctggctgtggtcgccgtggtaactggccaccggcgcgccgcgcagggtttccaccgccgccagcatgccgccctggaactggtagtagtcgttggaatcgagcaggtcgtgctcgcggttgtcctggttgtgcagcaccgcctgcaggcgttccaggcgctgggcgaagcgttcccgcgccggcgtgccgtcgtcggcggcaccgtaggcgtagccgccccagttcaggtagacctcggcaaggtcggcgcgggtctcccacagccgctcttcgattgcgccctgcacgccggcgccgtaggcacccggcttggcgccgaagatccgccagccggcctgccggcgcgcctccgccggcgccgtgccctgcgcctcgaggcgctggcgctccaagcgtacgcgagcggccagcgggttcagctcctccgcctcgtccagctcggcgaccgcctgcaccgccgcatcgaacaggcggatcaggttggcgaaggcgtcgcggaagaacccggagacccgcagcgtcacgtcgacccgcgggcggtccagcagggagaccgggaggatctcgaaatcggcgacgcgctggctgccggcctgccagaccggtcgcacgccgagcagggccagggcctgggcgatgtcgtcgccgccggtgcgcatggtcgccgtgccccacaccgagagaccgagctggcgcaggtgatcgccatgttcctgcaggtgacgctcgagcagcaggttggccgactggaagccgatgcgccaggcggtcggggtcggcaggttgcgcacgtccaccgagaagaagttgcgtccggtgggcagcacgtcgagtcgcccgcgactcggcgcgccgctcggaccggccggtacgaagcgcccttcgagggctgccagcagcccgtcgatctcggccccgccacaggcgtccagggtcggtgccacctgttcgcacaagccgcgcaacacctcgccgctggcacgccaggtggcaggcggcgattcgccgcccaggcagcgttctatccagtgcaacgccagcaattccaggcgttcgcgggtatccccgagagtacgccagggctccccgccccgctcttccaggcaggccggccgcgcgccctgccaggcctcgcccatgtcgcaggccagcggatcgaagcccaggccaaggtcgtccgccaggctcttcagcaacccggcgttggcgcccttgccatcgccgcgcggaacccgcagcagcgccagcagggtatccaggcgcaatcgcccgctcggcgactcgccgaacacatgcaggccgtcgcggatctgcgactccttcaggtcgcagagataggcgtccagctgcggcagccagctgtccggatcgtcgctgagctgcaagccgatctcgcggtcgagacggttgtcgcgcaggaggacgagaatctcgccgcgcaactgttcggcgcggcgcgggtcgagcagcgaggcatcgtagaactcgtcggccaggcgctccaggtcgcgcagcgggccgtagctctcggcgcgggtcagcggcggcatcaggtggtcgatgatcaccgcctgggtgcggcgcttggcctgggcgccctcccccggatcgttgacgatgaacggatagatgttcggcagcggaccgagcaacgcgtccggccagcattcggcggacaggccgactcccttgcccggcagccattccaggttaccgtgcttgccgacgtgcagcagggcatcggcgcggtaggcgtggcgcagccagaagtagaacgccaggtagccgtgcggcggcaccaggtcgggatcgtggtagaccgccgccggatcgagctgatagccgcgcgccggctggatgccgacgaaggtcaggccatagcgcaggccggcgaccatcatccgtccgtcgcggaacatcgggtcctgttgcggctcgccccagcgcgccagcaccgcctggcgattgcgctccggcaggcgtgcgaagcaggccaggtagtcgtccagcgccaggctctgggcgcagggccgtag

SEQ ID NO: 1805 - DNA, 1353 bp, Pseudomonas aeruginosa
gtcgagatgctccaggtcgttgctgacgccgccgagcaactggcggatcagctcggttccgctggcgggcagtccgtcgaccggatagccctgctggcgcagggcacgaaggatgttcagcgccgccgccggggtgtccaggccgacgccattgccgatccggccatcgcgggtcgggtagttggccagcaccagcgccacccgtttttccgcgtttggcttgcgcgccagctcggcccagcgccgcgccagttcggcgacgaaatccatgcgctcgtcgtcggcgagatagcagaccacgtcgctctcgctgcgttcgctgcgccaggccaggcccttgaaactgatcggccgggtgacgatgcgcccgtccagctccggcagcgccacgtgcatggccaggtcgcgcggccccaggccttgcgggttgtccagccagagcgggcggttgtccagcgagcagatcgcctgcaataccggcacgtcgcgacggaacggacgcaactcgggcgcctccggattggactgggcgaaaccggtggtattgacgatcagcgcggcgtcgctgcgctccagccagtcttccacctgcgccaggcaggcgctttccttgaggctggccagcgcgatcggcaacgggttgagcccctgcgccgcgaggcgttcgcagaagcgcgcgatgaaggcggtgttggctgcctgcaggtgggtgcgatagaacagcaacgcgaccaccggacgcccggcctgccagtcggcacgccagtgttcccagggtcgcctcggcatgccgtggatggaacagcgccacccgcggcagcgcctgcggttcgcgccaggcgtagtcgcggccgaggcactggctggccaggcagcggtagaactgcccggcgttctccagcccgccctggcgcaagtattgccagaagcgctcggcctgctccgccggcaggttgccaagggcgctcagctccgggtcggggcggtcgtcgccgggcaccgggatcagcagcgcgccgcgctcggccagcgccaccagttgctccacgccgtagcgccagtagccgatgccgccgtgcagcgaaagcaggatcacccgcgcgtgccgcagcaattggtcgacgtagaggtccaccgaggcgtggttctgcaactgcatggggttggccaggcgcaggctcgggtagtcgtccggcagcgcacgggcggcctcggccagcaatgcgaggtgcgaatcgccgctgcagaggatcaccagctcggcgggagtctgggccaggtgggcgatgccgtcgtcgggaacgaagccgccgggttgggtgcgcaacaggtgcatggacgttctaccggtag

SEQ ID NO: 1806 - DNA, 1119 bp, Pseudomonas aeruginosa
cgccgagcatctgcgcgcgctgctggagcgaacgctgggcgaacacgggcgcagcctggccgagctggacgccctcgccagcatcgacggcaaacgcgacgaacccggcctgcggcaactggccacgctgctcgaacgccccgtgcatttcctcgcacccgccgtcctgcacgactacgagccgcgcctgctcagcccctccgccgtcgcgctgcgcgaaaccggctgctccagcgtcgccgaggccgccgccctggccctggccgaacgcctgggtggcggtcgcgccgatctgctcggggcgaaacgcagcaacgatcgggcgagcatcgccctggcacgtcttctcaccgaacgagaactcccatgaccgtctatttcatcggcgccggtcccggcgaccccgacctgatcaccgtcaaggggcagcgcctgatccgccagtgcccggtgatcctctacgccggctcgctggttccgcaagcgctgctcgaggggcaccaggccggccaggtggtgaacaccgccgagctggacctcgaacagatcgtcgagctactcgcgcaagcccatcgccgcggcttcgacgtagcccgcgtgcattccggcgatccctccctgtacggcgccatcggcgagcagatccgccacctgcgcgaactcggcatcccctatgagatcgtccccggggtcaccgccaccgccgcctgcgccgccctgttcgggtgcgagctgaccctgcccgaagtgtcccagacgctgatcctgacccgctacgccgcacgcacgaagatgccggaaggcgagagcctgggtgacctggcgcggcaccgggcgaccctggcgatccacctgggcgtcgcccacctggcgaagatcgtcgaggaactgctgccgcactacggcgccgactgcccggtcgcggtgatccaccgggccagttggcccgaccaggaacaggttcgcggcaccctcggcgacatcctgcccaaggtcgccgccaggaatttccgccgcaccgcgctgatcctggtcggcgaggtgctggccgccgaaggcttcgccgactcttcgctgtaccgcgccgagcatcgacatctctatcgacccggcgaatga

SEQ ID NO: 1807 - DNA, 978 bp, Pseudomonas aeruginosa
aaaaacccgctccggggagcgggtcttgtcggcttggaatcgggctcagacggccttttccagctccggtacggcgtcgaacaggtcggcgaccaggccgtagtcggcgacctggaagatcggagcctcttcgtccttattgatcgcgacgatcaccttcgagtccttcatgcccgccaggtgctggatggcaccggagatgcccaccgcgatgtacagctgcggggcgacgatcttgccggtctggccgacctgcatgtcgttcggcacgaaaccggcgtcgaccgcggcgcgggaagcgccgactgcggcacccagcttgtcggccagggcgtagaggatcttgaagttgtcgccgttctgcatgccgcggccgccggagaccacgatcttggcagcggtcagttccggacggtcggacttggccagctcttcgccgacgaaggcggacttgccggcatcggccgggccggaaacctgctcgacggcagccgaaccgccttcggcggcgacggcgtcgaagccggtggtacgcacggtgatcaccttgaccgcagccgaggactgcacggtagcgatggcgttaccggcgtagatcggacgcttgaaggtgtcggggctgaccacttcgacgatctcggagatctggtcgacgtccagcagcgcggcgacgcgcggcaggaagttcttgccgttggtggtagccggggccagcacgtggctgtagttcttgcccagctcggcgatcagcggtgcgacgttttccggcagttggtgggcgtaggcggcgttgtcggcgaccagcaccttggagacgccctcgaccttggcggcggcttcggccacggcggcaacgttctgtccggcgaccagcacgtggatgtcgccgccaatggccttggcagcggcaacggtgttcagggtggcagccgccagggccgcgttgttgtgctcagcgataaccaggatagccattag

SEQ ID NO: 1808 - DNA, 447 bp, Pseudomonas aeruginosa
gagatcgatagtggaacgcgaatacatggaattcgacgtcgtcatcgtcggcgccggccccgccggtctgtccgccgcatgccgactgaagcagaaggccgccgaagccggtcaagagatcagcgtctgcgtggtcgagaagggttccgaagtgggcgcccacatcctctccggcgcggtgttcgagccgcgcgcgctgaacgagctgttccccgactggaaggaactcggcgcgccgctcaataccccggtgaccggcgacgacatctacgtcctgaagagcgccgagagcgctaccaaggtgcccaacttcttcgtgcccaagaccatgcacaacgagggcaactatatcatctccctgggcaacctctgccgctggctggccccaccaggccgaaggactgggcgtggagatctatccgggcttcgccgcccaggaagcgctga

SEQ ID NO: 1809 - DNA, 516 bp, Pseudomonas aeruginosa
aaaaggccagcgaagcgccgaagatcgactacccgaagccggacggcaagctcagcttcgacaagctgtcctcggtgttcctctccaataccaaccacgaggaagaccagccgatccacctcaagctggccgatgcgagcattccgatcgagaagaacctgccgctctacgacgagccggcccagcgctactgcccggcaggcgtgtacgaagtggtggccaacgacgacggcagcaagcgcttccagatcaacgcgcagaactgcgtgcactgcaagacctgcgacatcaaggacccggcgcagaacatcacctgggtggcgccggaaggtaccggcgggccgaactaccccaacatgtaaggcaaacgaaaaaggctccctcgggagccttttttcatgctgcgcctgtcagtccggctgcgggccgaggggaaagaactcgccgtggctccagacgccgagccattcgatgccgtcgatccggcgcggcaccgccagctcgaccagctggtag

SEQ ID NO: 1810 - DNA, 1368 bp, Pseudomonas aeruginosa
atcgtgcctttgccgatgccgacggcatccgcgatcatctcgaccgttacgctgtcttccccctgttcgaggaacagcttgagggcggtatcgagaatctcctgttcacggcgacgaaattcacgaactttgcgaggctctttctgcataaaaagactgtcaggtcaaaatgagtcaaaaatcgaagccgcgtattatgcctattcagcacgaaaatgcacggaacatccgacgatgaattgttaccaggacgaattcgaccagaccaacggtctgcgctacctcaaccacgcagcggtcgcaccctggcctagacgcgccgccgacgcggtgagcgccttcgcccgggagaacgtcgcccacggcgccagcgactatccggaatggctgaagatagaacatcgcctgcgcgagcgccttgcccgactgctcaatgcgcgcgccggcagcgacctcgccctggtcaagaacacctccgaggcgctttccttcgtagccttcggcctggattggcgagagggcgaccaggtcgtcatcggcaacgaggagttcccctccaatagagtggtctgggaagccttgcgcccgcgcggcgtcgaagtggtcgaggtcggtctcgccggcgacgatcccgagagcgccctgctcgccgcctgcggcccgcgcacccgcctgctgtcgatcagcgcggtgcagtacgccagcggcctgcgccttgacctggagcgcatcggcgcgggatgtcgccgccgcggggtgctgttctgcatcgacgcgatccagcagctcggcgccctgcccttcgacgtacaggcctacgattgtgccttcgccatggccgatgggcacaagtggatgctcggccccgaagggctgggcgtcttctattgccatcccgagcagcgcgagcgcctggcgctgcacgaatatggctggcacatgctggaacatgccctcgattacgagcgtcgcgactggcggccggcgcgcagcgcccggcgcttcgaatgcggcagcccgaacatgctcggcgcgatggccctggaggccagcctggggctgttggaggaggtcggcatggagcgggtcggcagagacatcgccgagcgcgtccagtggctacaggacggtctgtcgggaattcccggggtacgcctgcacagcccgcggaacccgagccgacgcgcgggcatcctgaccttcagcctggacggccaggacaatcggacactcttcgaaacgcttcgccaggaacgggtcatttgcgcccagcgtggcggaggtatccgtttttccccgcacttctacacgagttcgacggtgatcgacgataccctggcgatcttgcgccaggtcgcaggcacctag

SEQ ID NO: 1811 - DNA, 837 bp, Pseudomonas aeruginosa
cccggattcatcccccagaacccgggttttttttatccgtgcgccggcctagcgggccaacggaaacagccgatggaaattggcggtagtctgctccgccagggtttccaggctgacgccacgcaacgtcgcgaggaattcggcgacatcgcgcacgtattccggcaggttcggcttgccgcgatggggaatcggcgccaggtagggcgagtcggtctccaccaacagccggtcggccggtacctggcgagccacctcgcgcagggcatcggcattgcggaaggtgacgatgccggacagggaaatgtagaagcccaggtccagcgccgatcgcgccatttcccagtcctcggtgaagcaatgcagcacgccggcctgcggcaacgccgcctcgcgcagcagcgccagcgtgtcggcgcgcgcctcgcgggtgtgcacgatcactggcttggcggtgatccgcgcggcttccaggtgcaggcgaaacgcctcctgttgcaactcggcggcttccggttcgtagtggtagtcgaggccggtctcgccgatcgccaccacccgcggatgcgccagttcgcccagcagccagtccagcgctggcgcgcttccgggctccaggtccagcgggtgcacgcccaccgaacagtgcacgtcggcatagcgctcggccagggccttcaccgcctgggcattgtcggcgctgacgccgatgcagaggaattgaccgacgccacgcgctcgcgcggcatccagcgccgcatcgagcgagccgccatgggcggccaggtcgaggcgatcgaggtggcagtgggaatcgaccagcatgatcctgtctag

SEQ ID NO: 1812 - DNA, 684 bp, Pseudomonas aeruginosa
atatcagccattcagacgctccagcagattcggcagcagccgatccaggccagcctgcacctcggccagcggcaacccggcatcgagcacctggtaacgctccggggcctgcgcggcgcgctgcaggtaggtctgacgcacggcctcgaagaagcgtcggtcctcctgctcgaaacggtcgagccggccacgcgccgccgcccgcgccaggccgatttccaccggcaggtcgaagaccagcgtgaggtcgggccgcaggtcgccctggacgaagctttccagcgcggcgatgcgcgcctccggcaaaccgcgcccgccgccctggtaggcataggtggcatcggtgaagcgatcgcagagcaccacggccccgcgcgccagcgccgggcggatgaccccggcgagatgctgggcccgcgcggcgaacatcagcaacagctcggtatcggcggccatcggctcgtcgctgggcgccagcagcagttcacggatgcgctcggcgagaggcgtgccgccaggctcgcgggtcaactgcacctcgatgccgcgctcgcgcaggcgctcggccaggtagtcgcggttggtgctcttgccggccccttccgggccctccagggtgacgaacaggccggtcacacggcactccttatcttggctgcgccgctcattgtggcggcggggtga

SEQ ID NO: 1813 - DNA, 753 bp, Pseudomonas aeruginosa
caggggctgctcggccaggcgcgtgcggcaagcgaacaggcgcacgccttgctgccagtggcgctcgggataggccggacgcggcgatccggagaggattcgccgcggcgaggcctcggcaggcggcgcgtagccacgcaaaccctcgccgcgggtgacgatcagcttggcgacaccgtcgcccagcgccgcgcagaacgccagcaactcctggcgcaacgccgcggcgtcgagagggatcgccaggcgccgacacccctcttccaggcgcgccaggtggcgctccaggagacgcggcgtgccggcgcgcaccgccagggtctcgaacagcccgtcgccataggccagtccgcgatcgcgcacggacagctcggcggcgggccggccgtcgacccagtccagcatcagtcggcgaacctgcggaacaccagggtgccgttggtcccgccgaaaccgaacgagttcgacagggccacgtcgatcttgcgcggcttggcttcatgggccaccaggtcgagatcgcaaccttcgtccgggttgtccaggttgatggtcggcggggcgacctggtcgcgcagggccagcacgctgaagatcgcctccaccgcgccggcggcacccaacaggtggccggtcatcgacttggtcgaactcatcgacagcgcatgggcatgctcgccgaacacgctcttcaccgcggcgatctcggcgatgtcgccggccggggtggaggtgccatgggcgttgatgtaa

SEQ ID NO: 1814 - DNA, 930 bp, Pseudomonas aeruginosa
ccacggcacccaggcgccccagttccagcgcaatcgcctggccgatgccacggctggcgccggttaccaatgcgaccttaccttgcagactcatgggattctctcctttctctctctcaggccagggcggcgcgcgtggcggcgaacgcctcgacgccatccaggccatgggtattgatgcccttcgcgcagcgcctgttgaggcctgccaggaccttgcccggcccgcactcgaccagctcggtgacgcccttttccgccagcagctggatgctctccacccagcgaaccgggctgtacagctgtgccagcaggtcgcggcgcagcgtatcgagatcagccggcacggcggcgctgacgttctgcaccagcgcaatcttcggcgcctgccactgcaggctttcgaccgaggcggcgaactgctcggcggccggacgcatcagttcgcaatgcgacggcacgctgactggcagcgccaccgcgcgcttggcgccgcgtgccttgcatgcctcgatggcacgctcaacggcagccgcggcaccggcgatcactacctgccccggcgcgttgaagttgaccgcgctgaccacctcgccctgggccgcctcggcacaggccgccaatacatcggcgtcttccaggccaaggatcgcggccatgccgccctgccccgccggaaccgcctgctgcatcagttggcccctacgctcgaccagcttgaccgcatcggcgaacgccaggctttcggccgcgaccagcgcggaatattcgcccaagctgtgcccggcgacgaacgccgggcgcgcgccgccctcggccagccagaggcgccagagcgcgatcgaaaccgtgaggatggccggctgggtcttgtcggtctggttcaggtgctcttcaggaccattctggaccagcgcccaaaggtcgtaa

SEQ ID NO: 1815 - DNA, 642 bp, Pseudomonas aeruginosa
ggacgagtcttttcgttaaaatcggccgttcgccatggagaacctcatgcccgacctgatcctcgcctccagctccccctaccgacgcgaactcctgacccgcctgcgccttcccttcgaaagcgccagccccgatatcgacgaaagccatcgcgccggggaaagtgccgaggaactggtgcgccgcctttccgccagcaaggccgaagcgctggccggacgctatccgcaacacctggtgatcggctccgaccaggtcgccgtactcgacggcgacatcctcggcaagccgcacacccccgaacgcgccatccagcagctacgggacgccagcggcaagagcgtgaccttcctcaccggactggccctcctcaacagcgccagccgacgcatccaggtggcatgcgtgccgttcaccgtgcacttccgccacctcgacgagagccgcatccgccgctacgtcgaagcggaacgcccgctggactgcgccggcagcttcaaggcggaaggcctgggcgtcagcctgttccgctccaccgaaggagaggacgccaccagcctggtgggactgcccctgatccgcctggtcgacatgctcctcgaggaaggcgtcgaaatcccctgagccggcattccatataa

SEQ ID NO: 1816 - DNA, 3228 bp, Pseudomonas aeruginosa
gagtcgtgtgtgccgatcgccgtttccggtagccccggaaaccattggtactacatgaaaagaatgctgatcaacgcgactcaacccgaggagttgcgtgttgcactggtcgacggccaacgcctgttcgacctcgacatcgagtcgggcgcccgcgagcagaagaaggccaacatctacaaaggccgcatcactcgcgtcgaacccagcctcgaagccgccttcgtcgacttcggcgccgaacgccacggcttcctccccctcaaagaaatctcccgcgaatacttcaagaaatcccccgaaggccggatcaacatcaaggaagtcctgagcgaaggccaggaagtcatcgtccaggtcgagaaggaagagcgcggcaacaagggcgccgccctgaccaccttcatcagcctggccggccgttacctggtgctgatgccgaacaacccgcgcgccggcggcatctcccgccgtatcgaaggcgaagagcgcaacgagctgcgcgaggccctgaacggcctcaacgcaccggccgacatgggcctgatcgtgcgcaccgccggcctcggccgcagcaccgaggaactgcagtgggacctcgactacctgctgcaactgtggagcgcgatcaaggaagcgtccggcgaacgtggcgcgcccttcctgatctaccaggaaagcaacgtcatcatccgcgccatccgcgactacctgcgccaggacatcggcgaagtgctgatcgacagcatcgacgcccaggaagaagccctgaacttcatccgccaggtgatgccgcagtacgccagcaaggtgaagctgtaccaggacagcgttccgctgttcaatcgcttccagatcgagagccagatcgagaccgctttccagcgcgaagtgaagctgccgtccggcggctccatcgtcatcgacccgaccgaggccctggtttccatcgacatcaactcggcgcgcgccaccaagggcggcgacatcgaggaaaccgccctgcagaccaacctggaagcggccgaggaaatcgcccgccagctgcgcctgcgtgacatcggcggcctgatcgtcatcgacttcatcgacatgaccccggcgaagaaccagcgcgccgtggaagagcgtgtccgcgaagccctcgaggccgaccgcgcgcgcgtccaggtcggtcgcatctcgcgcttcggcctgctggaaatgtcccgccagcgcctgcgtccgtccctcggcgagaccagcggcatcgtctgcccgcgctgcaacggccagggcatcatccgcgacgtcgagtcgctgtcgctggccatcctgcgcctgatcgaggaagaagccctgaaggaccgcaccgcggaagtccgcgcccgcgtgcccttccaggtcgccgccttcctgctcaacgagaagcgcaacgccatcaccaagatcgaactgcgtacccgcgcgcgcatcttcatcctgccggacgatcatctggaaaccccgcatttcgaagtgcagcgtctgcgcgatgacagccccgaactggttgccggccagaccagctacgaaatggccaccgtcgagcacgaagaagcccagccggtcagctcgacccgcaccctggtccgccaggaagcagcagtcaagaccgtcgctccccagcagcccgcaccgcaacacaccgaagcaccggtcgagccggccaagccgatgcccgagccgagcctgttccagggcctggtgaagtccctggtcggcctgttcgcaggcaaggatcaacctgccgccaagcctgctgaaaccagcaagccggctgccgagcgccaaacccgccaggacgagcgtcgcaacggccgccagcagaaccgccgccgcgatggccgcgatggcaatcgccgcgacgaagagcgcaaaccgcgcgaggagcgtgcagagcgtcaaccgcgcgaagagcgcgccgaacgcccgaaccgcgaagagcgcagcgaacgccgccgcgaagagcgcgccgagcgtccggctcgcgaggagcgccagccgcgcgaaggccgtgaagagcgcgccgagcggacaccccgcgaagagcgccaaccgcgcgaaggccgcgaaggtcgcgaggaacgcagcgaacgccgccgcgaagagcgcgccgaacgcccggcccgcgaagagcgccaaccccgcgaaggccgtgaagaacgcgtcgaacgcccggcccgcgaagagcgccagccgcgcgaggatcgccaggctcgcgacgccgcggccctggaagccgaggcattgccgaacgacgagagcctggagcaggacgagcaggacgataccgatggcgagcgcccgcgccgccgctcccgcggccagcgtcgtcgcagcaaccgccgcgaacgccagcgcgaggtcagcggcgaggtggaaggcagcgaggcgaccgataatgccgccgcgccgctgaacaccgtcgcagccgccgccgctgccggtatcgctgtcgccagcgaagccgtagaagcaaacgtggagcaagccccggccactaccagcgaggctgccagcgaaaccacggcaagcgatgagaccgacgcgtcgaccagcgaagccgtcgaaacccaggacgcggacagcgaggccaataccggcgaaaccgccgacatcgaagcgccggtgaccgtcagcgtggtccgggacgaagccgaccagagcaccctgctggtcgcgcaagccactgaagaagctcccttcgccagcgaaagcgtggaaagccgcgaagacgccgagagcgccgtgcaaccggcaacggaagcggccgaagaagttgccgctccggtgcccgtcgaagtagcagcccctagcgagcccgcagccaccgaggagccgaccccggccatcgcggcggtgccggccaacgcgactggccgtgccctcaacgacccacgggaaaaacgtcgcctgcaacgcgaagccgagcgtctggcacgcgaagccgcagcagcagccgaagcggcagctcaggccgctcccgccgtcgaggagatcccggctgtagcgagcgaggaagcgtcggcccaggaggaacctgctgcaccccaggctgaagaaatcacccaggccgacgttccgtcccaggcggacgaagcccaggaagcggtacaggccgagcctgaagcttccggcgaagacgccgccgacacggagcacgcgaaaaagaccgaggaaagcgaaacctcgcgcccgcatgcctga

SEQ ID NO: 1817 - DNA, 993 bp, Pseudomonas aeruginosa
gattttccagaccggccaggccccgttccaggctccattgcacgaatgggtcccaggcctcgcccgcctccgcctcgaccagcaccgaatccgcggcatcggaaacaattcgccgcccctggctggccatgcgcaataccagcgcctcgacgtcacgggtcagcagcaggttgctgccaccaccgatcaccagcagcggcaatccacgctcccgagccagggccagggcctcgcgcacatcagcctcgtcccgggcgtgggccagcaggcgggcgcgcacgtcgatgccgaaggtgttatagggcttcagcgagcaatgctcttgcagttccaggctcacagtcgccccttggcttcgatcaacagacggtcgcaggcatgttcgatcaggtcgaggacctgctcgaagccttcttcgccgccatagtagggatcgggtacttcgtcccgctcggacccgtagcgacgcaggaacagatccagttcggcggcaccgcgcccggcacgcagggtctcgaggtcggccaggttggacaggtccatggccaggatcaggtcatggcaggagaaatcctcgatgccgacctggcgtccacgcagtgccgacagatcgtagccgcgcctttgcgcggccaggcgggtgcgctggtcaggtgccttgccgacatgccagccggcggtgccggcggaatcgacatggatacgggaggccagcccggcctcctcgaccttgcgccggaacacgccttcggcggtgggcgaccggcagatgttgcccaggcagacgaacaggacgcgcatcagccccccagcacgcggcgaacgcgttcgaggtcttccggcgtatccacgcccggaagcatggtttcgcgggcatcggccacatggattcgcaccccgtgccagagcgcgcgcaattgctcgaggctttcggcgttctccagccagcacggtccccaggcgacgaaatcggcaaggaaacccacgcgatag

SEQ ID NO: 1818 - DNA, 510 bp, Pseudomonas aeruginosa
ggcacgccctccggcaggctgtcgcgatcgcgggcgaaggcgtcgcgagcccagggcaagggcgcacgactgaaagtcagggccaggccgtcgatgtcggtggcgaccttgaccacgttcggattgaacagcgcggagacctcatggatcggctcggccagggtagcgatggcagcttccgggtgcgccgccaggttggccgccacctggtcgatgagcgccggggggatcagcggttcgtcgccctggacgttgaccacgatggcatcgctggccaggccgagccgggaagcgacttcctccaggcgatcggtgccggagttgtgctcggcacgcgtcagcagcgcctcggcgccgaacccctggcacgccgccaggatgcgttcgtcgtcggtggcgacgaccacgcggctggcggcgctcttgcgggcctggttccagacgcgctggatcattggctggccggcgatatcctgcaatggcttgccgggcaggcgagtggaggcgtag

SEQ ID NO: 1819 - DNA, 1521 bp, Pseudomonas aeruginosa
agacgtcttcacgggcggcacccgcccgtctgcggcggaatttcacgctttgccttcctcgacgtagtcgacttcacgatcgccctgcaccacttccaccagcttgatggcctcctgctccatggcgatcaccagttcgtcgacccgccgcagcaggtagcgatggaagaacaccgccggaatcgccaccagcaggccggcggcggtggtgatcaatgccttggagatgcccgcggcgagcatcggcgagttggccatgccgttgtccatgaaggcgccgaagatctggatcatgccgaacaccgtacccagcaggcccagcagcggcgccatcgcggcgatggtgccgagggcgttgaggtagcgctccagctcgtggatgacaccggaagcagcctcctcgatgcactccttcatgatctcgcgaccgtgcttggagttggccagaccggcggcgaggatctctcccagcggcgagttggcgcgcaggtccttgagcttctgggcgctcagttgcttgcccttgatctgcttccacacctggccgagcagctcgggcggcgcgacgcggctcttgcgcagcgtccacaggcgctccgcgacgatggcggtggcggcgatcgaactcagaatgatcggcagcatcatccagccgccggcttgaaccagttcccacacagtggcatatccccgaaaaaaaagtggcgccactctagcacagcgacccttttccgccgaccgccacggttctcatttttcccgccagaagtgcgccgaatcacgctcccggcgtgcgccgccacggcttccgaggagaaacgtcagggcaccgtcgcgtgccgtgtcgtggacctgcgcggcgaccctcgcgtaacgctccatcacttcgccatggggatggccgaaggcgttgcgccaacctcgcgagaccagcacatggcgaggccgcgtacgcaacacgaaggcgactccggaggaactgcggctgccatgatgcggcgccagcaaccagtcgacccggggatcggcctgtcgcgccagccaggcatgctcggccgcacgcgagatgtccccggtcagcagcaggacttcgccatcggcctcgaccctcagcacacaggagcggtcgttgctgtcgccggcctgtgcccatgcccactgttcgaaaaccacgccatcccaggaccagctccgctcgtcgcagctgtccgcgaacaacggcgaaggcaggcgcgcgggttcgccgctgaccagccaaaccggcgggaatcgggaagcgaccgtaggagcaccgcctgcatggtcgttgtcggcatggctcagcaacaggccgtccaggcgccgcaggtccaggctgcgcagcaccggcaccaccacccgttcgcccatgtcgaacgccccctgccgcgcaccgctgtcatagagcaagacatgctttcgggtacgcaccagcacggccagcccctggccgacgtccagcacccgcacttccgcccgcccccattcgacaggcggcgatga

SEQ ID NO: 1820 - DNA, 2112 bp, Pseudomonas aeruginosa
caacgcggcaccgagggcacgcaacggcaagccagccggcgccagccagcagagcgcgccgagcatgcccagcgctacgctccaggccgctgcggcgggtggctgccaggcctcggccaggcccgccagcaggccaagcgcacgaaacagcaggtccagcgaaacgccagcggcgcgaagcagcccctcgcccagcccgggcacccacagcagcaggctccccgccagggccgggggcactaccagcagttcgatccaaggcaccgccagcaggttggccggcgctccgctcaggctcaacggcaggcccagcgccagcagcggcatcgccagccccagcgccatcccccactgcgcccgcccccaggccgcccaccagcgccagcgcccaaggcgcccggcgaacagccagagcagcagggcaaccgccaggaacgacagccagaaccccgcctgcaggctggccagcggctcgaccagcaagaccagcaccagcgttgccagcagcggggtcagcaagcccaggtggcggaaacgcaggcgccagaccagcgccaggctgaccatcaggcaggcgcgccgcaccgggacctcgaaacccgccatcaacccgtagctccaggcaccaagcaaacccagggcgcaggcacagggcagccagggcaggcgccgcggccagcagcccaggcgatgcaaggccgccaccaggccatagagcatccccgccagcaacgagatatgcgaaccggagatgaccatcagatgcacggtgccggtgtcctggaacatgcgccactcggccgcgctcaaccccgagccatcccccagcaccagcgccgccagggcggcgccgcgcccctgtgcgtcgaccgccagcaggcgctggcgccaggcatcgcgccaggcatccaggccgctggccggctgcaggcgctggcccgccttcaccgtgcccacagcaccgacccgctgcgccaacaaccaggcctcgtagtcgaaacccgccgcgttcaccaggccgcgggggcgtttcagggtcaccgccaggcgccagcgttcgccgcccatcagcggcggcgcgccgcgccagctcaggcgcaaacgctcgggaagaagcacgccccgcgcagcgcggacctcctccagccggaagcgcgtgacgccctcgccgctcgccggcagatcgaccacacgcccctccagccaaagggtgcgaccatccagctcggcggccaggcgtccgtccagggcgacttgcgccgagccgcaggcccaggcgaacccgagcaggaacaaccccagccagtacagccggccgaacagcagcaacagtccggcggcggccatgcccagcagccagccgaccgacggcaattccgccaggaagcgcagggccagcagccccgcggcgagggctggcaatcccaggcgcatgaacggttcctcccatccccgtggcgtgccctccgctccccgacatgtcacatggggtcatacaatgggcaacgaaatcctgtcatcttgcttggcataatacgcaagcctatatccaccgagagcccacatgccgcgtcgcctgttcaagcgctacatgcccgatccggaaagcatccgctcgcagaagtcgctgcgctttctcggcaagttgacgcacgatcccaacctttggcatctcaatcgccactcggtatcgcgcgccatggccgccgggctgttcgccgccttcatcccgatgccgatgcagatgctgctggcggccggtctggcggtgtggattcggagcaatctgccaatctccgtcggattggtctggctgaccaatccgatcacgatgcccccggtcttctattgcacctacaagctgggcgcctggttgatgcaggtgccgccgcgcaccctgccggaccatctcacctgggaatggatcagccaggagctgtccagcctctggcagcccttcctgctcggttcggtggtgtgcggcatcatcgccgccatcctcggctacgcgctgacgatgctctactggcgctggtgggtgcagcgcagttggagccgacgctgccggcaacgtcgcgaacgggtcgccgcgaagtgatccgccggacatga

SEQ ID NO: 1821 - DNA, 1989 bp, Pseudomonas aeruginosa
ctcttgctcaggttgcggcaactcagcaccgacttgtcattcataacgcaaagcctccgcaggctgggtgcgcgccgcacgccaggctggatacaaagtggcgaagaagctgaggaccagggccgcgccgcagaccagcacgacatcgtcgagcatcagttgcgacggcaggtaatcgatgaagtacacgtcggacgcgaggaactggtggcccagcagcttttccagggcggaaatccaggcgctgacgttgagtgccgcgaccaccccgaggaccccgccgaccagcgtgccgatcaccccgatcaccgtaccctggaccatgaaggtagccatgatctgccccggcgtggcgccgagggtacgaaggatggcgatgtccgacttcttgtcggtgaccaccatcaccagggtggaaatgatgttgaacgcggcgaccgcgacgatcagcagcagcaacaggccgatcatggtcttttccatgcggatggcctggtacaggttgccgtggctgcgcgtccagtcgcgggcgtagaagtcattgtcggtcagggtccgggcgatctcccaggccacccgcggcgcctggaacaggtcgtcgagcttcaggcgcagcccctgtacctggttggtcttccagcgctgcaggcgcgcggcgtcttccaggtggatcagcgacaggccgccatccagttcgccggcgccgacgcggaaggtgccgaccacggtgaaacgcttcatccgcgggaataccccggccggggtgaccgccacctcggggaggatcagggtgaccttatcgccgatgccgacgccgagcttctgcgccgccagttggccgatgacgatgccgaagccgccggccttgagttccgccagcgagccctgcttgaagaaatcgggaatgatcgagaccttggcctcttccagcggatcgaccgcatcgaccatcaccgtctgtaccgcgccattggcgctgagcatgccctgcatctgggtgaacggcgctaccgcggtgacatgctcgtgggccttgaccttctcggccagggcgcgccagtcatcgatgggctggtacgactcgacggtggcctgcggcaccatgccgaggatgcgggtacgcatttcgcgatcgaagccgttcatcaccgagagcaccacgatcatcaccagcacgcccagtgccaggccgatcatcgaggtcagcgaaatgaaggagacgaaatggctgcgacgtttggcccgcgtatagcgcgtgccgatgaaaacggacaggggtctgaacatgtcgcccttagctggcagaaaatggatgcgtcgggatggcgaagtggcgaggcatcgccggcggccttacactctgaccatcactgccgccgtgggttcgccatgtccactcgtgacgcggatgaccgccgcgaatactaccgtatcgaagataccctcgcactggaatttcgccctgccggggccgtcgaagacggcctggagagcgagccgggggccaccctgttcagcctgctcagcgacctccacctgatggattacgagtcgcagcaccttctgcgccacatcagcgaacgcgaccgcacgctggccaactacctgaaggtgatgaacaagcgcatcgacctgcttggccaggtcatggtgcagagcctgctcaaggagatcggcgaaccgcgcaaggtcagcctgtccgaggggggagtcagcttccgccacgaccgcgcattgccggtcggccagttgctcgtcctgcgcatggtcctgttgccgcaggggttcggcctcgaactgcgggcccgggtaatccacgcccagccacacgacgacgaattcgagatcggcaccgagttcgaagcgttgagcgacgcacagcgccagttgctggcccggcatatcctccagaagcaggcccagcagcgccgcctggcacgggccggacagggcccgctcggcgagccgggccaaccttcttcgacctga

SEQ ID NO: 1822 - DNA, 1122 bp, Pseudomonas aeruginosa
ccgccggcacgaaagtccacgctctcgccgtccggcaggcgcagggtgagttccttgatgaaggtggcgacgttggggttggactccaccgtgcactcccatttcttcaccccgaagacctcttcaggcacgcggatctgcatatcctgcttgaccggcgtctggcacgacaggcgccagccttccttcgcctggcgccgggtgaagtgcgactcctcggtgggcagcatctcgccgccgccctcgaccaccacgcatttgcactgcgcgcaggtgccgccgccgccgcaggcggaagacaggaacacgttgttcgccgccagggtttgcagcagcttgccgccggccggcacggtcaggctgtgctcgccgttgatctggatggtcacgtcgccactcgacaccagcttggcgcgggcgaccaggatgatcgccaccaggcccaggacgatggcggtgaacatgccgatggccaggaaaatctcgaatccgatcacgggcctctccttacaactgcacgccggagaacgacatgaagcccaacgacatcaggccgatggtgatgaaggtgatccccaggccctgcaggccctcggggacgtcgctgtacttgagcttctcgcggatacccgccagcgcggcgatcgccagcgcccaggaaaagcccgagccgacgccgtacaccgtgctctcggcaaggttgtagtcgcgctcgaccatgaacagcgagccggccatgatcgcgcagttcaccgtgatcagcggcaggaacacgcccagcgcgttgtagaggctgggtacgtacttgtcgaggagcatctcgaggatctgcacgatggcggcgatcaccccgatgtagctgagcaggccgaggaaactcaggtccacctcgggcagcccggcccaggccagcgcgccgtccttgagcaggtaggtgtagatcaggttgttggccggcacggtgatggtctgcaccacgatcaccgcgatacccaggccgatggcggtctccaccttcttcgagatggcgatgaaggtacacatgccgaggaagaacgccagcgccatgttctcgacgaacacggccttcacgaacaggctgatgtagtgctccatcagtaa

SEQ ID NO: 1823 - DNA, 270 bp, Pseudomonas aeruginosa
ctcatggcgaccatccccagcatcaccccggcgacgatgcgccaggaggcgatgcgggtcagcagcagcacggcgccgccgatgaagatcgccagggtgctggtctcgcccatcgaaccctgcatgtggccgaggaaggcatccatccaggtcaagccgtggccgaggatgttgtccacgccgccggcggcggccaggctcagcgaggtggcgccggcgaagccgtccaccgaggtccataccgcgtcgccggacatctgcgccgggtag

SEQ ID NO: 1824 - DNA, 525 bp, Pseudomonas aeruginosa
gcgaagaacaggaaggcccggccgaccagtgccggattgaggaagttcttcccggtgccgccgaacacttccttgcccagcaccacgccgaagctgatccccagggctacctgccacaacgggacggacggcggcagggtcagggcgaacagcaccgaggtgacgaagaagccttcgttgacctcgtggcggcggatgctggcgaacagcacctcccagaaaccgccgacgatgaaggtggtcaggtacaccggcaggaagtacgcggcgccctggaccaggcaatcccacaagctgttcgggtcgaacccggccagcgcgccgatcagggcgaagcgccagccatcctgggcgctcaacaggtcggggctctgggcgaagatcaggttggcctggtggccgacgttgtacatgccgaagaacatcgccgggaaggtgcatagccagacgatgatcatcatgcgcttcaggtcgatgccgtcgcgcacgtgtgcagtggtgcgggtgacgctgccgggacgatag

SEQ ID NO: 1825 - DNA, 405 bp, Pseudomonas aeruginosa
ttcaggttccacacgctcttgccggcacccaccgggtcgaggaagtggatatgggtgccgggcaggcccgccggatgcggaccggagaatgcttgcgcggtcacgccggagagcgcctcgccgggtagcgaaacgccttccgccttgcacaggaacacccgggccaggcgcccgagcaccgtcagcccggcctggaaggcctcgccctgctccgcgataaccacctgcggatcggcggccagcggctgggtatcgatggcagtgacgaaaatcgaactggggctggactcgggatcgggcaccttgctgaacggccgggtccgcagcgcggtccacaggcccgactgcaacaggttgtcgcggacctgctcggcgctcagcgtggcgagtttgtcagcgggataa

SEQ ID NO: 1826 - DNA, 450 bp, Pseudomonas aeruginosa
tcgcccgctacaccggcgccgacgacgccctggcgccgttgcaccggctcggctcggaaacctggcagaaggccaagcgcaaggccgccgagcaggtccgcgacgtcgccgccgagctgctcgacatctacgcccgccgcgccgcccgcgaaggcttcgcgttcaaggatccgcaggccgactacgcgaccttctcggccggcttcccgttcgaggagacgccggaccagcaaagcgccatcgaggcggtggtcgccgatatgctcgcgcccaggcccatggaccgcctggtctgcggcgacgtcggcttcggcaagaccgaagtggcgatgcgcgcggcgttcgtcgccgtgcatagcggcaagcaggtggcggtgctggtgcccaccaccctgctcgcccagcagcactacaacagcttccgcgaccgcttcgccgactggccggtga

SEQ ID NO: 1827 - DNA, 633 bp, Pseudomonas aeruginosa
cctatgcgcttgttccgttgccttgccctgctgctctcactggccgcccccgcggcattcgccggcggtccctaccaggtggaactggtggtgttccgccaggccggcgatgccgtgccgtccagccagccggccccggacgaatgggccaccggcgcacagccgctggccagcgacgccctgcgcgccaccgcgctcgacaaccagctcgccaagctcagccaggacaacggatacaccgtgctggtgcacaaggcctggcgccaggacatcggcgagaccccggtgaagatcgccctcagcgaaggccaggaacaggatcatcatttcccggtggaaggtacgctgaccctcagccaggtgcgcttcgtcgacatggaggccgatttctgggtcaatcgcttcggcgacgacggtttcctcgccggcagccagcacatcaggcagggcacgcggctgaagaatggcgaactgacctatctcgaccatccgagcctgggcatcctgatcaaggtggtgccggtcggcgcccgtcccgccgcccccaatcccatggaaatggaagaacagcaggcaccggcggacgcgccccccgtcgaaggcggcttcgacgccgcacctcctgcgcaatag

SEQ ID NO: 1828 - DNA, 2541 bp, Pseudomonas aeruginosa
agctcttgggccatgccggtactcccgattaaaactggaaggaatgcggagcgcaggccaggtcagcgcccggccttcgcgcagtataagcgcgccccatgcaagcgggcgcgccatccatcagcgcttgtcttcgaccttccacttgccgccatcgtagaaggcgcgccagccggtgggcttgccatcgacctcggactgcacgtattgctccttggtcttgcggctgaaacggatcaccgcgggacggccgtccgggtctttctgcggggcgtcgcagaggtaatggtacttgggatccagctcggccttgtgcgggatgatctcgctcaccaacggcgcgcgggtctcgcggttcttcgggaactggctggcggccaggaacatgcccgaagcgccgtcgcgcagcacgtagatatcgtccaccttctcgcacttcaattcaggcatgcggatggcgtccatcttcggcggcgccgcctcgccattcttcagcagcttgcgggtgttcttgcaggtcggattggtgcaaccgaagaacttgccgaaacggccggttttcaactgcatctcgctgccacacttgtcgcattccaggctcggcccttcgtagcccttgatccggtactggccttcctcgatctcgtagcccggacagtcggggttattgccgcagatatgcagcttgtgtttctcgtccagcaggtaggcgtccatcgcggtactgcagatcgggcagcgatgcttgccacgcaacacccgcgactcggactcgccctcgtcgtccgcggcgatctcgtcgccgggaatcaggttgacggtcgccttgcaacgttccttcggcggcaggctgtagcccgagcagccgaggaacacgccggtggaggcggtacgaatcatcatcggccggccgcactcgcggcagggaatgttggtcagggtcggctggttggcgcgcatccccttctcgctgacttcggccacctcgagcttcttcttgaaatcgccgtagaactcgtcgagcaggtgcttccagtcgcgctcgccctgggccacgtcgtcgagatgctcctccatcccggcggtgaaaccgtagtccatcaggttggcgaagctctcgttgagccgatcggtgacgatgtcgcccatcttctccgcatagaagcggcggttgtgggtggttacgtaaccgcgctcctggatggtggagatgatcgccgcgtaggtcgaggggcggccgataccgcgcttctccagttccttgaccaggctcgcttcggagtagcgcgccggcggcttggtgaagtgctggctcggatcgagcttgatcagcttgaggttctcgccttccttcatttccggcaggacgtcgtcctcgcccggcttgctctgctgcggcagtacccgggtataaccgtcgaacttgaggatgcggcccttggcgcgcagctcgaaatcgccggcggtgacgctcacgctggtcgagaggtattcggccggggtcatctggcacgccacgaactggcgccagatcaggtcgtacaggcgctcggcgtcacgctccatgccggacagctgggtcggcttgaggttgacgtcggaaggacggatcgcctcgtgcgcttcctgggcgccctccttgctcgagtagacgttggccttgcccggcaggtacttctggccgaactcgtcctcgatgaaaccgcggaccatgccaatggcatcggccgacaggttggtcgagtcggtacgcatgtaggtgatgtagccggcctcgtagagacgctgggccatcatcatggtcttcttcaccccgaagcccaggcggttgctcgccgcctgctgcagggtggaagtgatgaacggcgccgagggtcggctggaggtcggccggtcctcgcgcttggcgacgctataggccgaggccttgagcttttccagggccgccatggcctgggcttcgttgagcggcttgaaggcctcgcccttctcacgggtaacctcgaagcgcacgttggcgcccttggcggtaccgaggtcggcatgcacttcccagtactcttccgggacgaaggcgcgaatctcgcgttcgcgctccaccaccagcttcaccgccaccgactgcacgcggccggcggacaacccacgggcaatcttctgccagagcagcggcgagaccatgtagccgaccacgcggtcgaggaaacgccgcgcctgctgggcgttcacccggttgatatcgagctcgccgggctgggagaaggcctcctggatggccttcttggtgatttcgttgaataccacgcgcttgtagcggctttcgtcgccgccgatggcttcccgcaggtgccaggcgatggcctccccttcgcggtccaagtcggtcgcgagatagacggtgtcggcgtccttggccaggcggcgcagctcgtcgatgaccttttccttgccgggcaggatctcgtacttggccttccagccatgctcggggtcgacccccatgcgcgagaccagttggcgcctggccttctccttcggtga

SEQ ID NO: 1829 - DNA, 1293 bp, Pseudomonas aeruginosa
agctgcagcaggcgccgcagaacgacgaggagatcgccagggcgctgcgcagcgtggcgatcaagtggcactacatcgagaagtccctgcgcaactacaaccagaacagcgtgccgttcctggtcaacaagaatgcagaccggatcatcgatggcctggagaaggtcgccgcgctgtatgccgcgcgcaaccaatgaacctcggcgcgccgcctcaggcgcgctggcggagaaactcggcgatgcgcccgaggtcggcgctatcgccgcgctcgccccaatacagggcaaggaactgggcggtcgcctccaccttgtagacatccccggggaggctgcgcagggcgtccagcaactcatcgtccgcgcacggctcgcgccactggttcagccactggcccggggtattctgccaatagcaccaggcctcccggccgcgtcggcgcgggcagtggaactgcgcgcaggacgtcggcggagcgctctccagccaatgcggccaatcctggcgcgcgagctgcatggccaggccgagacggcgcgcctcgaggcgcagggccatcctgccgcgctgcctgttggacggcatcagccaggccaggggactgagcatgacagccagcagcaggatcaccagccaagtggtcataaggaacggacactcgaaaaacggttaaggcatttgcctcgatccgcgcgcgcaggcaggatcggtcgcagtcgccaagggaggcgcagtttacaggcgaatgcgaccacggcggagcagctttttgcccagcgcaacggaacaggttccacgcgcggcgcgaaagtccataatgaaaacactatccccttctgggaggagacgttcatgccctatcaacacattctggtcgccgtcgacctgaccgacgaatgcgacccggtgatgaagcgtgcggcggccctggccaccagcaaccaggcccggctctcggtggtgcatgtggtcgagcccatggccatggccttcggtggggacgtgccgatggacctgtcgatgttgcagcagcagcagttcgaccaggcccgtgaacgcctggatgccttcgccgtacgctatccggacctcggcagcgagcagcgccacctggtctacgggcaaccgcgccaggaaatccaccgcctcgccgcggaacaggcttgcgacctgatcgtggtcggcagccacggtcgccacggcctggcgctgctgctcggttccactgccaacgacgtgctgcacggcgcgccctgcgacgtgctcgcggtgcacctgaagaaagcctga

SEQ ID NO: 1830 - DNA, 2505 bp, Pseudomonas aeruginosa
gcaagccatccgcccggcttcgggcgcgccccgcgacagcggtcgcgcgccagtcccgcgagcggtcgaaacgcccgtaggcagccgttgcggacctgccgacgttacccgacatcacctgcccggataagtcatgcgcggtcgcctgttcactctcgtttcctgccttttgctcagtatttcctccgtcgacgcggtccacgccgcttccctgaccgaacaacgccgtctctacgaccaggccaaggccgccctggccaagggcaacagcgcgccctacatggcctcgcgcagcgccctgcgcgattacccgctggaaccctacctggcctacgacgaactgacccaccggctgaagtccgccagcaacgaggaggtcgagcgcttcctcaccgaacacggcgacctgccgcagatcggctggctgaaactgcgctggctgcgcctgctggccgaccgcggcgactggaagaccttcgtcaactactacgatccgaagctgaacttcaccgaactcgactgcctgtatggccagtaccagctgggccacggccagaaggccgaaggctacgccaccagcgaacgcctgtggctggtcggcaagtcgcagccggctgcctgcgacaccctgttcggcctctggcagggcgaaggccagctcaccgaggaaaaggtctggaaacgcctcaagctggccgccgaagcgcgcaactacagcctcgcctcgcacctcgcgcagcgcctgccgaccctcggcaaccagggcgcgctgatggtcagcgtggcgcagaaccccgcccagctgagccagaccggccgcttcagccagcgcgaccatgccaccgccgacgtggtcggtctcggcctgcgccgcctggcgcggcaggacccggaaaaggccctgagcctgctcgactactacagctcggcgctacccttctccagcgacgagaaggtcgccatcgcccgcgagatcggtctcagcctggccaagcgcttcgatccgcgtgcactgccgctgatgacccagtacgatcccggcctgcgcgacaataccgtcaccgaatggcgcacccgcctgctgctgcgcctgggccgctgggacgaagcctacgcgctgacccgcaagctgccccaggatctcgccgccaccagccgctggcgctattggcaggcacgcagcctgcaactggcacagccgaacagcaaggagccgatcgcgctgtaccagaagctcgccggcgagcgcgacttctatggcttcctcgccgccgaccgcctgagcgtgccgtacaagctcggcaaccgtcctgcgcacatcgacccgcgcgtcctgcaacgcgtacgcaacgccgccagtacgcgccgggccatggagttcttcaaccgtggcgaagtgatcaacgcccgccgcgagtggtaccacgccgcgcgcctgttcgatcgcgacgagctgatcgcccaggccaggctggcctacgacatgcagtggtatttcccggcgatccgctcgatcagccaggcgcagtactgggacgacctggacatccgcttcccgatggcgcaccgcgccaccctggtgcgcgaagcgaagaaccgcggcctgcactccagttggatcttcgccatcacccggcaggaaagcgcgttcatgtccgatgcccgttccggagtcggcgccaccgggctgatgcagctgatgcccggcaccgccaaggagacctcgcgcaagttcggcatcccgctggcctcgacccagcaactgatcgtgcccgacgtcaacatccgcctcggcgccgcctacctgagccaggtgcatggccagttcaacggcaaccgggtactcgcctcggccgcctacaacgccggtccgggccgcgtccgccagtggctgaaagatacccgccacctggccttcgacgtgtggatcgagaccattccgttcgacgagactcgccagtacgtgcagaacgtgctgtcctatgcggtgatctacgggcagaagctcaatgcgccgcagcccatcgtcgactggcacgaacgctacttcgacgatttctgacccccaacccggcccggacgcccgggcctttccaataccttgaaaaggacctcaagatgaacaagcccctcgccaccgccctgctcgccacctccagcctgctgctcgccgacggcgccctggccgccgacgcctgcggtacgccgcgcaacgccttcgacagcgtgtactgccgcagcggcgagttttcccaggccgaccgcgagctgaaccagcagttcggcaccctgcgcaagcacctgaacgacggccagaaagccctgctgaagaagagccagatcgcctggatcaaggagcgcgacgcggcctgcagcgaaagcaaggacaacggttatttcgtcaacctcgactgcgccaccgagaagacccgccagcgcctcgacttcctccgcgaacgcgagcgcgagtgcctgagcaccggttgcgtcgacgccaagctctga

SEQ ID NO: 1831 - DNA, 432 bp, Pseudomonas aeruginosa
ggaacagcttgccgttcacctcgcccaggtcgatcggccgcgccgtctggtcgagcagcgccagcgccgcggccggttccaggggaatcccggcggcgcgggcgaaatcgttggcggtgcccagcggcaggatcgccaggctcgcctcgcctcgcccgcgcgccagcgcttcggccacctcgcgcagcgtgccgtcgccaccgccggcgaccagcgtcgcatagccggccgccagcgcctcctcgacgatgcgccgggcgtcgccgtcctcccaggttactcgcaccgccagcgcccgtccggcctcgcgctgcgccgcgaccgcggcacgaacctcttcgttgcccgcctgcttgccatgcaggaccagcagaaccttgtccttgtccatcgaaccgaacccctcgtcgtggccttgtctttgcctattga

SEQ ID NO: 1832 - DNA, 1656 bp, Pseudomonas aeruginosa
ccgcgtatccgggacggaagtgcggcgcccggttcaggcagggtagccggtaatctcgcgaatgctgcggtagagcgggcgcaactggcgatacatgcgcaggtagacctcgccatagagccgctggtagatctgccgggcctccgcctggggcaggaaaacccggccgacgcgggtcatcccggccaccgcgctggcgacgtccggatagaggccgagccccaccgcgcagtcgatcgccgcacccaggccggacgcctcgtagacatgcgggcgctcggccggcaggccgaagatgtcggcggtgagctgcatcgccgcgtcgctctgcgagccgccgccggccacgcgcaggcgcacgatcggcgtgcccgaacgcttctcgatgcgctccttgccctggcgcagggcataggccaggccctcgaggatggcccggtagatgtgcgcccgggtatgcacgtcgccgaaaccgatcatcgcccccttggcctccagtcccggttcgcggattcccggcgaccagtagggttgcagggtcaggcccatcgagccgggcggcacgccgttgaccagttcgtcgaacagttgctccggctcgaccccctgctcgcgcgcctgctgcatctcgcgcaagccgaactcgcgcttgaaccagctgaccatccagtagccgcgatagatcatcacctcggtattgaaatgatcgggaatcgccgccggatagggtggaatcagcggcacggtttccaggtagcgggcgcgagtggtgttgatggtcgccgtggtgccataggagaggcaggcgatggtgggctccagcgcacctgcgccgagcacctcgcaggccttgtcggcccccgcagcgatcaacggcaggccttgcggaatgccggtgtgccggctggcctcggcgctgatctcgccgagccgctcgcccggcttgaacagctccggcaactgctcgcggcgtaccgccagtgcctgccatttccagtcgcgcggcgcggcccagcgcaggcgcttgtagtcgaacggcaggtaggccacgcagcaccccaccgagtcgacgaaacggccggtcaggcggtggctgagaaagccggaaagcagcaacaccttgtcggtcttcgcggcgatctccggctgctcctgggccacccagttgacctcggcctgggcgcggaaatgctccaccgcgccctcggcgccgaccagcttgaacagccagccccaaggccccctgatgcgctcgcggacctccgcccggcgctggtcgagccagaggatcgccggccgcaacggcctgccctcggcatcgacatggatcaccgtgccacgctgggtggtcagcgacaccccgcggatgagcccgcgatcgatgtccacctggtcccagagccgccgacaggcctcgccgagcatcgcccagtagtactcggggtcctgttcggcccagcccggatgcttcgagtagtaggcctccagctccaccttgcccttgcccagcaggttgccctgcaggtcgaacagcagggcgcgcacgctctgggtgccattgtcgatcgccagcagatagttcttgtcgttcatctcgttctcgtctcggctggtcagacgggcaggctgtattgccggcgccagaggtccagatag

SEQ ID NO: 1833 - DNA, 1098 bp, Pseudomonas aeruginosa
ccgatcaagacagccggcacgcacgccggacggcctgttccacccgccacgacaagaacaacgaccatgcagacccttggctccacctcggttccggccctgctgaaatacctgcgccatgccgaacggctcggcctggacatcgcccctgccctggccgccgccggcctccaggccgaccagctcaacgacaatcgccagcgcctgccgggcgaagcccacgagcgcctgctcggctatttctgcgagcattccggcgatcccctgttcggcctgcattcggcgcgtttcgtccagcccggctcctggagcgtgctcggctacatcgcgatgaactgcgccaccctgggcgaggccatgagccgcatcacgccctacgagaagctggtcggcgacatgggcaccagccgcatcgaggcggccggcgggcaggtccggctgatctggaactgccgccaccagacacccctggtacggcgccacatggtcgagcacgtcctggcttcctgggtcctctacgcgcgctggatcgccgacctggaaggttcgccggacgaggtctggctggaacacgacctgccggacggaacccgcgtggaagactacgagaccttcttcggctgtccggtgcgcttcgcccaaccctgttcggcgctgctggtaccgctggactacctggcgctgccgctgcgccaggccgacgcgacgctgctgcgcaccctggaggaacatgccctggcgctgatggccgagctagacgatgacgaaccgctgccgctgcgggtgaagaacgccctgcgccagctactcaaggacggcctgccgcgcaaggaacgggtggcggagaagttcggcatgaccgtacgcaccctgcaacgccacctgcagcaagccggcagcagctaccagcagaccctcgacgaactgcgccgcgaactggccgagcactacctgctgcatagcgagctgccgatccaggacatcgcccagtacctgggctttaccgagtcgcgctcgttccatcgcagtttcaagggttggaccgggcagacgcccggcgagtaccggcaacggcgcaaggagccggcggcgcaatga

SEQ ID NO: 1834 - DNA, 456 bp, Pseudomonas aeruginosa
gcgtttgcgcggccagttcgaggagccgttccagcgccgtctcgaccggcatcagccccggctgttcgcagcagccgctcacccgcggctctcgcagggcgccgcctgtttcaggtgcgggacgaagttgcacgggcgatgacgggcgtccagttgctcgacgaggatgccttcccaggcagtgcggcaggcgttggtggagcccggcaggcagcagaccagggtgccgttggaaagcccggccagggcccgcgactggatggtggaggtaccgatgtcggccagcgaaatctgccggaacagctcgccgaagccgtccacctgcttgtccagcaggcaggccaccgcttccggggtgctgtcgcggccggtgaaaccggtgccgccggtgatcagcacgacctgcacgctatcctcggcgatccaggtcgcgacctgtgcgcggatccggtatag

SEQ ID NO: 1835 - DNA, 636 bp, Pseudomonas aeruginosa
tcgcggtgttatatcacaggcccgacacggagaccccagatgcccgatagcgccctgcccccctgctccatccttctcctggcgggaggccgcggccagcgcatgggcggtcgcgacaagggcctgatcgagtggcagggcctgcccctgatcgcccacctgcatcgcctggtgcgcccgctcaccgatgacctgatcgtctcctgcaaccgcaaccaggaacgctatgcggcctatgccgaccgcctggtgagcgacgacagccgagacttccccggcccgctcgccggcatccgcgccggcctggcggtggcccggcatccctggctgctggtgctgccctgcgacgcgccgcgcatcgaccgcgccttgctggaaaccctgctgcaggccgccggccgcacaccggcgcgcccctggatgctgcgctgcggcggccagtgggaaccgctgttcagcctgatcccgacgcacctggccgaagagatagaacacgcctggcgccagggcgaccgtagcccacgccacgtcctgttgccgcttggcgcggaggccatcgagctggccgcgggcgatccgcggctggccaacctgaacacccccgagctgttggctaatcaccgcgaactgaagtaa

SEQ ID NO: 1836 - DNA, 861 bp, Pseudomonas aeruginosa
cgcgtctcgttcgggacgagaaggtcgctggttcgaatccagtcgctccgaccatatcccgaaaaacccgcctcaacggcgggttttttattgcctgcgattcggcctttctcacagggtacgcaggtaggccaccaggtcgcccttctcttccgcggacagcttgcgctccagcaccaggttgaagaactccacggtgtcctccagggtcagcaggcggtcgtcgtgcaggtacggcggcgaatccttgatcccgcgcaacgggaaggtcttgatcggcccgtcggcggacgccatcacgccattgaccagtttcggatcgtagaagcgctccaccttcaggttgtgcatcaggttgtcggtgaagtaaggcggcgcatggcacccggcgcaggccgccttgccgtagaacagcttttcgccacgcaattcctgctcgctggccttgcccggatcgagccgcccctccacatccagcttcggtgccggggggaagtccagcagcgcctggaactcacccatgaaatgcacttgactgccacgctcgagcacgttcacccccttcttggtggcgattaccggatcaccgtcgaagtaggcggcgcgctgctcgaactcggtgaagtcctcgacggtcttcagcgccctctgcgagccgaacaaccgctggatgttcaccccgcgcagcgtcggcgtgtcgatgcggtggcggaacggctgcgggcgcacatcgccggccaggtgggtagcggcattggtgtggccgttcgcatggcagtcgaagcaggctacgccgcggctcggatgctcgctacggcgatcgtcggtgaggttgaactgctgctgcggaaaggccgttag

SEQ ID NO: 1837 - DNA, 531 bp, Pseudomonas aeruginosa
ggaaggctgcgacctgctcggcctcgaacggccagttcagctcggcgccattgtcgcagcggcgcagcaccgggatccgcaggccatagtgctcgacccaggcttcgtcgtcggcgatgtccaccagttcgaccagcaggccatgttcgacgaagggcatcagcaccgcctccgcgacttcgcagaggtggcaaccgagggttccgaagagttggcattccgggggcatcgaaaggacctgtgcagtgtttcgcggcgatggtagcacccgcgctcagatgccagcgacctgcaacagactttcggccgcctgccaggcctcgcgagcctgatccgccggcccatggatgtgcgccatcaccagggcgccctccatcaggtattgcaactgccgcgcaagcagtgccgccgaacgcgcgcccaggcgctccagctggcgctggaaataggcttcaacgaaggccttttgctcggccgcctggcgatggatcggatgcgagcgctcatggaactcggcggcggcatggatga

SEQ ID NO: 1838 - DNA, 1506 bp, Pseudomonas aeruginosa
atggacgggtcctggcgcgggacggaaagggtttcacggtcggcgtcgagcaatccttcggaaactgtcccaagtacatccaggcgcgcagccatcagcccgtctccaggatcgcaagtcccgcgttgcagggcgaaggactcgatccacgctggctgtcgctggtctcgcgcagcgatacgctgttcatcgccagccagcatgccgacccgctcagaggcggcgtcgacgtctcccatcggggcgggccgccgggctttctccggctcggcgcggatggccgcctgtggttgcccgactatgccggcaaccgcctgttcaataccctcggcaacctgctccaggatcctcgctgcggcctcctgttcatcgatttcgacgctggcgaactgctgcacctgcacgccgaggccgagctgttctggccgggttcgcagccatccatcccctggcccgccggcgccgagcgcctgctggcgttgcgcccccgcagggctggcgctggcggcgcggccgcctgccgctggcattctggcgagccccacccatcccttttttttcctgccggtgaatcttgatgcctttcctgtatcgccttgcctcgttgttgatcgccctcctcgtcctgccggtgcaggcggcggaaatgcgagtcgccctgttgcgcacctcgggagtggaaaccctcgatgcgctcaccgtcgacggcggctcctgggtgcgccgggtgccgctcagccataccgcggtgctgatcgagcaccacgccgccaccctgctcttcgacactggcctggggcgcgacatcgacgcccagttccgtgccgacatgccttggtgggcagcgccgctgttcgcttaccagaaagtcgtcccggcgcgcgaccaactggacgcagccggtatccgcgtcgatcgcatcctgctgtcccacgcacactgggatcacgcctcgggcctggtcgacttccccgaagtaccggtctgggcaccctacgaggagatcgccttcagccgcatcgccaccccgccggccgccttccccagccaattccgccatggcgtgcgctggcgaccttacagcttcgatccgcggccgttcatgggcttcgacgaaagcctcgacctgtttggcgacggccgcctggtgctggtccccctgcccggccatacgcccggctcggtcggtctgttcgtcaccctcgacagcgggcgccggctgttcttcagcggcgacaccagttggcgactcgaaggcgtcgaaggcccacggcagaaattcttcgccggccgcgccctggtcgatcgcgatcccgcgcgcaccctcgcgcaactggcgaagatccgcctgctgctccgcagcgacccgcgcctgagcgtgattccggcgcacgatgcgcgggtccaggccgccctgggctacttcccgcactggctggaatagcgggaaagcccgtcctagacagggttcgtgccaattcgcggccaccctcgactaatgtctaa

SEQ ID NO: 1839 - DNA, 1362 bp, Pseudomonas aeruginosa
tttccgccaggaaggcgccagccagtccaaggccgaggaatgggctcagggcttcctcctgcgctacgaatccggctacaccgagggcaccatcggtttcggcgtcgacgccatcggcctgctcggggtgaagctcgactccagccccgaccgcagcggcaccggcctgctcaagcgcgaccgcgagaccggccgcgcccaggacgactatggcgaggcagggatcaccgccaagctgcgggcgtcgaagagcaccctgaagatcggcaccctgacccccaagctgccggtgatcatgcccaacgacagccgcctgctgccacagaccttccagggcggcgcgctgaactccatggagatcgacggcctgaccctcgacgccgggcgcctgaagaaggtcaaccagcgcgactcctcggacaacgaggacatgaccatcaccggtggcggcaagcgcaacatcgtggtccgttccgggctgacttcggacaagttcgacttcgccggcggcagctacaagtggaccgacagcctcagcaccagctaccactacggcaagctcgacaacttctacaagcagcattacctcggcctggtgcacaccctgccgatcgccgacaagcagtcgctgaaatccgacatccgctgggcgcgctccaccgacgacggttccagcaacgtcgacaacaaggcgctcaacgccatgttcacctacagcctcggctaccacgccttcggcgtcggctaccagaagatgagcggcgacaccggcttcgcctacatcaacggcgccgacccctacctggtgaacttcatccagatcggcgacttcgccaacaaggacgagaaatcctggcaggcgcgctacgactacaacttcgccggcgtcggcattcccggcctgaccttcatgacccgctacgtcaagggcgacaacatcgacctgctgaccacctcgggcgaaggcaaggaatgggaacgcgacatggacatcgcctacgtgttccagagcggcccgttgaagaacctcggggtgaagtggcgcaacgcgaccatgcgcaccaactacaccaacgactacgacgaaaatcgcctgatcgtcagctacacgctgccgctctggtaacggcaggccccgcggatagccgcgctacggccatccgcccctccccagagccccgcggcggaacgaagaggccacccttgggtggcctctttcatggcgggatgcctcgctcgcagcgtgcaggacggatagcgcctggggcgttatccgccgataccccaccggaccaaggaagtccgccccctcattcgtggctgatcgcgccgatcttgtggatcgacaggtccgcgccgtag

SEQ ID NO: 1840 - DNA, 345 bp, Pseudomonas aeruginosa
ccagaggagctcgtcatgccccgcaagaccactgcaaacgctgcaaaggatgaactgttggctgaattccaggcactggtcgccgataccgagaaactcctgcaaagcaccgccgacgtggcgggcgaccaggcggaagaaatccgcggcaagatccacgacagcctcaagcgcgctcgcgataccttgcgcgacaccaaggactcgctgaaggacaacgtccgcgaacgcagccaggccgcggtggacgccaccgaggtgtacgtcggcgaacacccctggcagagcatcggcatcgccgccggcgtcggcttcctgcttggcctgttggtcagccggcgctga

SEQ ID NO: 1841 - DNA, 384 bp, Pseudomonas aeruginosa
gccatgagcgaaggaaaggacccggcggacggccgcccctccctgcggcgcttcggcgccgccttcctcggcctgttgcacggtcacgtcgagctgttcggcatcgagctgcaggaacagaaggccaataccctgcgcctgctgctgttcgccgggctggccctggtattcgccctgctcctgctggtcggcctgtcgctgctggtgctgatcgtgttctgggacaccaaccggctcgcagcggcgctcgggttgtgcctgttctacgtgatcggctcgctgttctgcggctggcgcctgtaccagtcgatcaacgacgaaagctcgccgttcagcgccaccctggaagaactggccaacgaccgcgagcgactgctgccatga

SEQ ID NO: 1842 - DNA, 1392 bp, Pseudomonas aeruginosa
gcttgccaaggcaaaccgttagcgtgtccgcatcgcctcagcgcatccctggaattcccgatggactggcagaccctgctcacccgcgaacggctcggaaagccggtacacagcaacgatgaactgggccgcagcgccttccacaaggaccatgaccggatcatcttctccggcgcgtttcgccgcctcggacgcaagacccaggtccatccggtctccagcaacgatcacatccacacccgcctgacccactccctggaagtcgcctgcgtcggccgctcgctgggcatgcgggtcggcgagatcctccgcgaggaactacccgagtggtgcgaccccagcgacctcggggtcatcgtccagtcggcctgcctggcccacgacatcggcaacccaccattcgggcactccggcgaagacgcgatccgcaactggttccagcaagccgccggacgtggctggctggacgagatgagcgacgccgagcgttccgactttctccacttcgaaggcaacgcccagggcttccgggtcctcacccaactggaataccaccagttcgacggcggcacgcggttgacctacgccaccctgggtacctacctgaagtacccctggacctcgcgccacgccgaagcgctgggctacaagaagcacaagttcggctgctaccagagcgaactgccgctgctcgagcagatcacccataagctcggcatgccgcaactcgacgacgagcgctgggctcgccatccgctggtctacctgatggaagcggcggacgacatctgctatggcctgatcgacctcgaagacggcctggaaatggaactgctcgaatacagcgaggtcgaggcgctgctgctcggcctggtcggcgacgacctgcccgacacctatcgccaactcggccccagggactcccgccggcgtaaactggcgatcctccgcggcaaggccatcgagcacctgaccaatgccgccgcccgtgccttcgtcgaccagcagcaggccctgctcgccgggcagcttgccggcgacctggtggaacacatgcatggcccggccaagctctgcgtgcagcgggccaaggccatcgcgcgggaaaagatcttccaggacaagcgcaagaccctccacgagatcggcgcctacaccactctggagatcctcctcaacgccttctgtggcgccgcgctggagcaatatggcgggcatacgccgtcgttcaagaaccggcgcatcctcgacctgctcggacgcaacgcgcccgacccgcagtggccgctgtaccgcgccttcctccaggtgatcgatttcatcgccggcatgaccgacagctacgccacggaaatggcccgggaaatgaccggacgctcgagcccctcctga

SEQ ID NO: 1843 - DNA, 450 bp, Pseudomonas aeruginosa
atctgcaccaggctcgccccggcggcgatcttctccgccgcgtgcgcgccctcggtgataccgccggcggcgatgatcggcagccgtccgcccagctcgccggccagcaccttcaccgtgtgcgtgctcttctcccgcaccggcgcgccggacaggccacccgcctcgtcgccatgcggcaggccttccacgccttcgcggccgagagtggtattggtcgcgatcaccgcgtccatccccgcctcgaccagcgccgcggcgaccagcgcggtctcttcgtcggtcatgtccggggcgatcttgatcgccagcggtacccgccggccatgccgcagcgccagcgcttcctggcgctggcgcagtgcctccagcagttgcttgagcgaatcgccgaactgcaggctgcgcaggccgggcgtgttcggcgagctgacgttgacggtgacgtag

SEQ ID NO: 1844 - DNA, 483 bp, Pseudomonas aeruginosa
tcgtcgaccgcgcgctccaccggggtatcgaagttcttgccgatgttgatccccagtacgccgcgatacttcgccgcgcgcacccgtgccagcaggtggtcgacgccgtggttgttgaagcccatgcgattgatgatcgcgttggcttgcggcaggcggaacaggcgcggcttgggattgcccggctgcggtcgcggagtgacggtgccgatctcgatgaagccgaaaccgagctggccgaacccgtcgatggcgtcgccgttcttgtccaggcccgcggccagccccaccggattgggaaactccaggcccagcacagagaccggcaggctggccggcttgggcgtcagcaggcggttcaggcccaggcgaccgccggccccgatcaggtcgatggacagttcgtgggaggtttccggggacagtttgaacagcagctggcgggccagggtgtacatggtcgggtatcggtcggcagaatga

SEQ ID NO: 1845 - DNA, 2055 bp, Pseudomonas aeruginosa
  unsure (475): Identity of nucleotide at the above locations are unknown.
atgtcacgcccgaacctgtgcttcaatggacggaccgtcgccgtcccctcccgcccctttccgcgtcggtcgccgagcccgaggagccctccgtcgatcatgagttccaactcgcgtagcaacagcaccttcaccggtcgcctttccgcactcgccaaccgcctgcgcctgggtgccgcgcgaagcgatggccgggagctgcgcgaacgggcggccgccctcgagctgccgttccagccattgcgactgccggagccgagcgtctggtggcaggccggaccgcccctgcacaccctggtcgatctgccgcgcggcgcgctgtccggcccggtccaggaagacaaggcggaagcccacgcggtcctcaagcgcctggtgcgggtcagtcactccaccctggagtcggtcgacctgaagaccatcgaaggcgtgtgcagccgggagatcctcgtccaggcaccttgcccacgcctgngaagacctggccacggccgaggtctgccggggcgtacggatcatcagctacaaggatttcgtcaaggccctgagcctggccctgccgcgtttcaccaacggcgacagcatccgcctgcgccaggccgcctggcacggcgagcgcctgttctgggcgggcgaacgccaagcctgcgccttcgccgcggcgatcgtctacgcccgccgccgcgaactggaactgaagctgccggcacacctggaacgctacgaactggagcccggcgcgctggacgaactggaacggcgctaccacatgctgcggattccgacccaggcctggtccgagccgaccttcatgagcctgctgctggataccggcctgccctatgcgcgactcgccctgttcaccccggaaaccccggagtgcctgttgctgccccgcaacgacgaacgcgccgatgccctcggcgaaggtctgcgggcggctggcgcggcagacgtggtgaagtatctgaagcaactgtaggcaaccggccaggactggccagctcgcgccctgacgtgcatcctccagcagacccacacaggagcgatcgcatgtccctaccccgcctcagtatatgtttcgccctcgcctgcgggccggcgctggccagccaggcgccggtctacggcgaacgcctggaaggcttcgactacgcctatccggtgcattatctggacttcacctcccagggccagccgctgagcatggcctacctcgacgtcgcgccgaagaaagccaacggccgcaccatcctgctcatgcacggcaagaatttctgcgccgggacctgggagcgcaccatcgacgtgctcgccgacgccggctaccgggtgatcgccgtcgaccaggtcggtttctgcaagtcgagcaagccggcccattaccagtacagcttccagcaactggcagccaacacccacgccctgctggaacagctcggcgtcgcccgggccagcgtgatcggccactccatgggcggcatgctcgctacccgctacgccctgctctatccgcggcaggtcgaacgactggtgctggtcaaccccatcggtctggaggactggaaggccctgggcgtgccctggcgcagcgtcgacgactggtacaggcgcgacttgcagaccagcgccgaaggcattcgccaataccagcaagccacctactacgccggcgaatggcgccccgagttcgatcgctgggtacagatgcaggccggcatgtatcgcggcaaggggcgcgagtcggtggcctggaactcggcgctgacctacgacatgatcttcacccagccggtggtctacgaactggaccggttgcagatgccgaccctgctgctgatcggcgagaaagacaacaccgccatcggcaaggacgccgcgccggcggaactgaaagccaggctgggcaactacgcgcaactgggcaaggacgccgccagacggattccccaggcgaccctggtggaattccccgaccttggccataccccgcagatacaggctccggaacgcttccaccaggcactgctggagggtctgcaaacccagccctga

SEQ ID NO: 1846 - DNA, 1023 bp, Pseudomonas aeruginosa
cgtagccctcgcgcgtgggcgcgacgcgggcctcggcattggcgcgcgagacgcgcaccgtctcgtcggccggctccggcgtgggcttggcgtcctcggcttcgggcaatggcttcaactgcgccggcatcggcagcacctcgggcacggccaccacctccaccggcgcgggccgttcgggcagcggctgggcctgcaccggctcatcgagcgagatggtcggcggtggcttgccctgcgtggcgcagcccgccagggcaagcaagatcaccggcaaggcggatttacggaaaagatcattcatggcttggctccttcggaagaatccagttcgcggctccacgacaggccgttgacgtagatgcccagggggttcttgcgcaggcgttcttcggtgcgcggcggctggagcacgatggacaccacggccgtccaccgctccaagcccgccgcggcgccgttgacgtagcggcgttccgtccagcgcacgttgaaagacgtgtcgctggcgcgcacgacgctggtgatctgcacagtcaccgactctttaccgatgcgtgcgaacgggtcgttgacccgcgcgtagtcgttgagcacggccgcgcccttgtcggtcgtgtagtcgtaggcgtccagccagttctggcggacgacgatggggtcgatggacagcgagcgcaccagcgtcacgaagcgcgcgatgtggtgcgccgtctgtgcatcgttgggccggtagggcgtggcggcttcgcccacggcgcgcacctggcccgcgctgtccacttccaccacgtagggcgtcacgatggactgcgccgagcgccacaccaggccgccagccatcagcagcgcgagcgtcaggcacccgaaggccatcagccgccagttcttcgcctgcacgcgcggcgagccgatacggtcgtcccacacctggccggcagcttggtacggcgtggcaggctgcggcgtgtcggcatagcgcacctgcggttttctgaatcgcatggtcagttctccttgtga

SEQ ID NO: 1847 - DNA, 1536 bp, Pseudomonas aeruginosa
cgcgccagcgtcggccgtcgagcgattccagccagcacggaacggagcggccatccgctgcccggcagcggaagcacgggatgctgcggcgcgtccggcggactgcgcgccggtcttggcgacgtggcccaggcccgccatcgcgccctttgcgccgccgccagcggcggcggaaccggcctgaaacgccgacttcgcattgctggccgccgacgtggcggcgcgcgcaccgctaccggccagctttgcggcggccggagccatacgcgcgccagcagccacggcgccacccacgcccgtcgcggcggcgccgatagcgacggccgtgccggcagcgccgacagcagcaccggccatcgcgcccgcgccgagctgcggcgcaccggacacaaggcccgtcgcaatgccggggccgaagatcccgagcgccagcaaggtgagcgaggccagcatgatgaccagcgcgtggtcgatggacggctcggcgggatggatttggaactgagcgaacaagcccgagccgatcccgacgatcacggccagcaccagaaccttgacgccggaggccaccacgttgcccaagaccttttcggcgaggaacgcggtcttgttccagagtgcgaacggcaccaacacgaatccggcgagcgtggtcagcttgaactcgatcagcgtgatgaacagttggatcgccagcaccaagaagcgcaagaccgcgaccagccacgcgaggaacatcaccacgatggggtcgaggttcacgaacacttccggaaagcccgccatctcgccgatctgctccagaatcggcgccccggcatcgatgccggttttcgccagccggcccggctgcaagaagttctccatcgtgatggccgagccggtggcggtgatgcccaatcccgcaaacgagcggaacacgatgctggccagccagttgaagttattgatgatgtaggcgaaggcaccgacgtagagcaccttgcgcagcagcttggcgatcacgtcctcgccctggccggtggcatggctcatggcccagtacaggccggcgatcgtcatgtcgatgacgatcagcgtggccgtgaggaacgccacctcgccacgcagcagcccgaaacccgagtcgatataagcggcaaaggtgttgaggaattggtcgatgatggtcacatcattcatggcgtgtcctccggttcggcgggaaaggccggcgccatgccatcggccggttcctcgaagctcggcggaatcggcggcaggtcggccagcgtctggtattcgtccggcccggcctcgccggagaagaagcgccgccggaaggcttcggcggcggcgcggcaagcgtcctcgcccttggtctgccggtcggcggcgcattgcgcgcgcaatgccttgagccgcgcaggatcggcggccagagcatcggcaaggttgtcggccggctgcttgttgcaagcggccagcagcacgacaagcaccacaacagacggggcgaggacgcatcgcatggcggcctcccgtcagttgccgtag

SEQ ID NO: 1848 - DNA, 519 bp, Pseudomonas aeruginosa
ggtcgtccagaatccccggccaagtcgaggtcgggaagccccgcaccgacaccatgcgcaggtgctggtcgcccagcatgggcgccaggccaccgaccagtgcggaatcggtcagcagcgcgtcgatatggaacgccacttcgggcacgccgacgcgatagcgccgcgtcgagatggtggcgtgcaggtaggtcagtgtctggccgtcatcgagccaagcgatttccggcatcacgccatcgagcaggtcaaagacgcgatccgtctccgcgacgaaggcttgcagccgctcgcgccagtccacgccatcggtgggccggttctcgtacagcatccccgccgcgcgggcgcgcgattcctcgggcggcaggtacaccagcgtcaggtgatagccgctctcgaagtcgttgcccgattcctcgaaggtggcccggcgctcctcgtccaccagccacgacagcggctcgggaaactccgattgcggatagtcggcagcgggtcggcgctcggcctcgatga

SEQ ID NO: 1849 - DNA, 990 bp, Pseudomonas aeruginosa
cccacgccgtcgaagccgacgacgcgggcaatgctctcgatgcggcgtttgcgcccacgcccggcgatgtggatcaccacgttgaccgcctcggcgatcagcgcacgcggcgggttcacggccacttcgagaatcagttgctccaggcgcagcagcgcgcccagcgcggaacctgcgtggatcgtggcgatgccgccggggtgtcccgtgccccacaccttgatgagatccagcgcctcggcgccgcgcacctcgccgacgaatacgcgatcaggccgcaggcgcatggacgagcgcaccagctcggtcatggataccacgcctgcgcgcgtgcgcagcggaacgtggtcgcgggccgcgcattgcagttccaccgtgtcttcgagcaccagcacgcggtcgccggtggcggcgatttcggcgagcaaagcattggcgagcgtggtcttgccgctgctggtggcgccggcgatcagcacgttctgccgctcgcgcacggcgcgaacgagaaagcccgcctgcacgctggtcatcatcccgtcaatgacgtaccgctccaacgggatcacgccgatagcacgcttgcgcagcgcaaaggccggccccggcgctgccggcggcaagatgccctcgaagcgttcgccggtttcgggcagttcggcggatagcagcggctggccgcgatggatttccgcaccgacatgggccgcgaccaggcggatgattcgctcgccgtccgcctcgggcagttccacgcccatcggcgcgcgcccactggaaagccgatccacccaaagggtgcgatcaggattcagcatcacctccaccacgtccgggtcttcgagcgcggcggcgatcagcgaccccatcgctgtgcgcagcatctggattcggcggtcgagcgacgtggcgctcatggactgcggaacggcgctcatgacgcacgctcccgcgcttgcgcagccgccgccgcgtcctccattcgcatag

SEQ ID NO: 1850 - DNA, 1236 bp, Pseudomonas aeruginosa
cagcgggcgcgctgtttcttggcgcgacaccatcaaatgcccgagccacggcgcgagcctgtggcccgcatagttgcgctgcgcacgcagctcggtggcggtgccgagcgtttcggaaattcgtttggccgtgcgttcgtcgttggtggcgaacgtcacgcgcacatggcagttgtccagaatcgaatggttctggccgtaggctttgtcgatctggttcaggctctgagcgatgaggaagctgcgaatgccgtagcccgccatgaaggccaaggccgtctcgaagaagtccaggcggcccagcgccgggaattcgtcgagcatcagcagcagcttgtggcgccgctcgatgccgtcggagccatcaagcgattcggtgaggcgccggccgatctggttgaggatcaggcgaatgagcggcttcgtccgcgaaatgtccgagggcggcaccaccagatacagcgacaccggatgttccgcagcgatcaggtcggctatgcgccagtcgcagcgcgaagtgacttcggccaccgtgggatcgcggtacaggccgaggaacgacatggccgtgctcaacacgccggaacgctcgttgtccgacttgttgagcacttctcgcgccgccgaagcgacgacagggtgcggcccatcgcccaggtggggcgtggtcatcatccgatgcaaggtcagctcgaacgggctggccgggtcggagaggaagttggcgacgccgcgcagcgtcttgtcctcgcccgcgtagagcacatgcagaatggcgccgaccagcagcgcgtgcgaggtcttttcccaatggttgcgcttctccagcgcgccttcgggatcgaccagaatgtccgcgatgttctgcacgtcgcgcacttcatgcgcgccgcgccgaacctccagcagcgggttgtaggccgccgatttcgcatcggtcgggttgaacagcaggcaatgcgagaagcgcgagcgccagcctgcggtgatctgccagttctcgcccttgatgtcgtgaatgacggccgacgcgggccagctcaacaaggtgggcactaccaggcccacgcccttacccgagcgcgtgggcgcgaaggtcaggacgtgttccgggccttcatgccgcagatactggcgatcgtgctggcccaggaacacgccggccggctgtgtgaggccagccttgcgaatttcctgcgcgttggcccagcgcgcagagccgtaagtcgtgactag

SEQ ID NO: 1851 - DNA, 927 bp, Pseudomonas aeruginosa
tggcccgcgacagcggcgactgctcgatgtgcagccgctcggcggcgcgagcgaagtggagttcttcagcgacggcgacgaagcaccgaagatggcgcagttccacttacatcccgccgggcttgtgatgtgcctgttcccctccgccaacaaggcgcggagggcgacatttgcgcctgcccgaaatcgaccgttgccggtcgtctgagatcacggttctgttgtccattgcggcctccttttcgcgcttcccctcttgcggcaagcttgcatggtgctaagatagtaatagattactcacttttgaaggcgcaagcaatgagtggacactccaagcatctaccggccgatgagcggcgcgcggccacagtcgaggcggtggtcgacttggccgccgagcagaaccccagcgacatcacgaccacagccatcgcacagcgcatggggctgacccagggggcgctgtttcgtcacttcccgaccaaggacgccatcctgcaggcggtgatggcctgggtcacggaacgcctgctggctcgggtggacaaggcagcagaaggcactacgtctccggtcgcagcccttgaggcggtcttcatgacgcatatcgacttcgtgtccgagcacccgggtgtgccgaggacgctcttcggcgaattgcagcgacctggagagaccctgcccaagcgaatggtgcagaccttgattcatcactacggcgagcggttgcatcgcctgctcgaagccggcaaggcgcagggcgaactggatgcgggactggatgtggatgccgccgccgtgttgttcatcggcacgatccagggactggtcatgcagtcgctgttggcgggcacggtcagtcgcatcggccgtgaggcaccagccgtgttttccatctatcgccgtggcatcgaaagcaacacatga

SEQ ID NO: 1852 - DNA, 669 bp, Pseudomonas aeruginosa
ccggcgcgaagtggccgaccaactggtctcaggcgacctgcgcggctacgtggtgattccgcaggatttcgagcagcggctggcccagcgtggcagcgagccgctggtgcagatcgtcaccgatggctcctaccccaataccgccaactacgtcgagaactacgcccgcggcgtggtccagttctggcgcgccgggctggatgtcgcggcgcccgcgcaagccgtcatgctggagccgcgctactggttcaaccccgagctggaaagccgccgcgcactgattcccggcgccatcgccatcgtcatgaccatcatcggcaccatgctgactgcactggtggtggcgcgcgaatgggagcgcggcaccatggaggcagtgctgtccacgccagcctcggtggccgaaattctgatcggcaagctgctgccgtacttcgtactcggcatgctgtccacgctgggtgcggcggcgctggcggtgttcgtgttcggcgtcccgatgcgcggctccttgctgtccctgttgctcttgtcggccgtgttcatggtgccggcgctgggtcagggtctgctgatttcctcattggcgcgcaaccagttcctggccgcgcagatcgcgctgttcacgggttttctgccggctttcatgctgtcggggtttctatatga

SEQ ID NO: 1853 - DNA, 1335 bp, Pseudomonas aeruginosa
tttcgatcttctgctcgacgaaggctatgtctcttcatccgatctcgacttgttcacctgcgtagacgatgcggaggaaatcgtcagtgccctcgaacgcttttacgtcaacagggcggcaggcgatggggcaacatgattggcatcggcgggtatcgctggagcctgcgcggcaccaaggtgcggcagccgatgcagtgcgttatcttgttgattgcgggtgcattgttcagcccgatttctgcttttggttccgaagtctcactctctgcaaatcctccctcctgctcgccagagcaatccctgcgctggcggggcggcaccctgcgtctggagaacgatttgttcaccggctccgatcgcaactacaccaacggtgtcgcgctaacagcagtctcacgtgatctgcaaggcgggctccgtccggagtgcctgcctcagccgattggtttgtacgcccgcttcatcggctgggctgatccaggcttctggcacgacgccggcgcccactcgtcgtcgcagaacctcgttgtgcgctttggccaagccatgtacacgcccgagaacaagacgcgcaccgatgtgattccagatgaccgaccgtacgctggtttgctctacctgggtttggcgtggaatcgccgcatccacccacaagccgccagctacgaaatgcttgacgtgcgtgagctgaccctgggcgtgatcggcccctggtcgctggccgagcaatctcaggatctggtgcatcgggcacgcggcattgagcgctttcgcggctgggacaaccagttgcgcaacgagccggcatttcagatggccatggaacgcaagttcaagccgtacacggagggtgcggtccgccctggatggggcagcgacgtgatcggcggttatgccctgcgggttggaaacatcgaaaccgccgccagtaccggcgtggagtttcgcgcgggctggaacataccgaacgacttcggcagctatccgatccgccctggcgcggagaaccgcccgccctctggtgttgccgatctgcgcacgacaacgccgcaatcggtcctggcgcccaaacctggggcacatgtcttcctgaacctggagggtaaagccgtcgcctgggacttctcactcgacggaaacatgttccggaatagccaccatgtcagccggcggccttgggtcgcgcaagcagctctcggcatcagcagccaatggatcgttgctggacgtggtgtgcggcttgccgtgatgcgcgtttggagaacccgcgagttcgaccagcaggcgagctatcacgcattcggatcgatcgcgctgagcttggaattttga

SEQ ID NO: 1854 - DNA, 429 bp, Pseudomonas aeruginosa
tcgagatgggcgacttcgccggcgcggtgctcaagcacctgcgcagggcgccggtggaaaagctcagcctgtgcggcggcttcggcaagatcagcaagctcgccggcggccacctcgacctgcacagccgccattccagcatcgacctgccgcaattggccggctgggccgccgcgctcggtgccagcaccgcgctacaggacagcatgcgcgccgccaacaccagccagcaggcgctggcccaggcacacgccgaaggcgtggccctgggcgatgcggtctgcgcccacgccctgcgcttcgcccgcggcatcgtgcccaccgaggtggcgctggaagtcttcgccatcgaccgccagggcaacctggtcggccaggcctgcgaggagcgccgatgaagcgcctgttgctgctcggcgggatcggtga

SEQ ID NO: 1855 - DNA, 546 bp, Pseudomonas aeruginosa
ggccctggccctcgcccgccggctcggtccggcgcatctctacagcctcgccgggctgggcaaggtgcccggcgacctggcctgccgggtccgggtcggcggctacggcggcgccgaagggctggcggcgttcatcgacgagcagggcttcgacctgctggtggacgccacccacccctacgccgcacggatcagccggaacgccgtgcgcgccgcgcgactggccggagtgccctgctgggcgctgcgccggcccggctggcaggccgggcccggcgacgactggcgcgaggtagccgactggcgcgagctgatcgccgccctcgcacccttccgccgtccgctgttcaccctcggccgcgaaccgctggagcatctcggccaggtcccgccgcaccagcactggaccgtgcgctgcctgcaaggccagccggccgcgccgcgcgccgaggtgatcggcgcgcgcgggccgttcagcctggatggcgaacgggcgttgttcgagcgcctcgcctgcgacgtgctggtgagcaagaacagcggtag

SEQ ID NO: 1856 - DNA, 2247 bp, Pseudomonas aeruginosa
gcgagcgaaatcctcttcaggccactgtgctccggcatgggaaggcgaggatttcacgaccctcgcaagcccggagaccggcctgcaacgccctgttggcacacccgcggtgggcgggagcgagccggttgttcgaggcgctgtcgcgcctgcgatttcctgcgcgttccgtcctgcccggtcatgagatggaacgcccatgccccgcttcagccgtttgcgcaccgagcctttcgccctcggcctctccaccagcctgctgctggtaccgcccgccctcgccgaaaccgaggaagccgccctcgccctgcccagccagttggtcagcgttcgccaggatcccgccgaactcgaccacatcgacctcgccactccggtcagtgccggttcgcgcctgggcctcagcgccctggacaccccggcgagcaccagcagcatcagcggcgaggaagttcgccgacgcaacaaccccagcgtccaggccgccgtcacccgcagccccggcatcagcttcatcggcaccccaggagatggcggtaccggcctctcggcgcgcggcttcagcggccacgcatcggtgatgcaactgttcgacggcacgcgcctgtacaccggcatgggcacggtgaacttccccagcgatccgtggatggtcgagcgcatcgacgtgatccgcggcccggcctcggtgctgtacggcgaaggcgccaccggcgcggtgatcaacgtggtgccgaagaagcctttcgccggcgagatccgcaaccacctgcgcctcggctacggctcctacgacaaccgccagttggccctggacagcggcggctcgctgaccgacagcctcagctaccggctcaacctgaaccagcagcagagccacggctggatcgaccgtggcgactcgcgcaacctgggcatcagcgcggcgctgcgctggcaggccagcgacgatctggccttcaccctcgcccacgactatggcgaccaggagccgatgaacgacttcggcaccccgctggtcggcggcaagtaccacaagcgcctgcgcgagaagaactacaacgtgcgcaacgacgtgcagcgctacaacgaccagtggacccgcctgaccagcgactggagcctttccgacagcgtcaccgcgagcaaccagttgtactacatcaaggcccgccgccactggcgcaacgccgaaacctacgaatgggacgtcccgcgcgaagagctgttgcgcagggactacctgcgcatcagccacgagcaggagcagatcggcgaccgccagaccttcgccttccagcacgccctgttcggcctcgacagccgcaccctggtcggcgccgagtacaaccgcatccgcttccgcctgaccaacaacatatcgccctataccgatgtcggcggcgactacatcgacccctggcatcccgcgcccggctacttcgaaagccgctcgccctaccggccgcactcgcgcagccagacccgcaccttcgccctgttcgccgagaaccgcctgcagctcaacgagcgcctgtcgctggtgaccggggtgcgccgcgaccagaaccatatcgaccgcgacgacctgctcaccggcacccgcagcgaccgcagcctgcagggcggcaactggcgcgccgggatggtcttcgcgctgaccccggaactgtcgctgtacggccagtactccaccagcgaggacggtgtgagcaacctgatcaccctcaacgcggcccagcagcagatggacctgacccactcgaagcagaccgaggtcggcctcaagcagctgttcccggacggtcgcggcgaatggaccctggccgcctaccatatcgtcaagaagaagctgctcagcgccaacccgctgccgccgcacgacgcgcagcaggtcggccagcagagttcggacggcctggaggccagcctggaactgaacctggcccaggactggcggctgtcggcgaacgccgcgctggtgcgtgccgaatacgacgacttcgacgaaacgatcgacgggcagacctactcgcgcaacggcaatcgccccaggaacgtgccacggcgcaccgccaacctctggctggacaagtccttcgccgagaccctgcgcgtcggcgccgggctgcgctacgtcgaccggcgctacgccgacgccgccaaccaggccagcctgcccggctacacggtggtcgactccaacctgggctggcgggtacggccggacctgaccctcggccttga

SEQ ID NO: 1857 - DNA, 906 bp, Pseudomonas aeruginosa
cctggattacccaagcatgaagcacccgatcctgcaccacctgctgctcggcgccctgctcgcctgcgccgatgccgcgctggccgagcgctacccgctcagcgtgcgcagctgcgagcgcgaagtgacgttcgagcgcgcgccgtcgcgcgcggtcagccacgacatcaacctcaccgagatgatggtcgccctcggtctgcagacgcgcatggtcggctataccggcatcagcggctggtggaagaatgccgatcccggattgatcgccgcgctcaagccgctgcccgagctggtggcgcgctaccccacggcggaaaccctgctcgatgtcgacgccgacttcttcttcgccggttggggctacggcatgcgcgtcggcggcgacctcactccggccagcctggagccgctgggggtgaaggtctacgagctgagcgaatcctgcgcgcagatcggcgagccgcgccgcgccagcctcgacgagctataccgcgacctgcgcaacctgggacggatcttcgacgtcgaaccgcgcgccgagcgcctggtcgccagcctccaggcacgcatcgagcgcgcccgcgccggcatcccggcgaacaccgaggcgccgcgggtgttcctctacgacagcggcgaggaccgccccttcacctctggccgcctgggcatgccgcaggcgctgatcgaggccgccggcggccgcagcgtgaccgacgacgtggcggccagttggacccaggtcaactgggaaagcgtggtcgcccgcgatccgcaggtcatcgtcatcgtcgactacggcgagaccagcgccgcgcagaagcagcgcttcctcgaagagaacccggcgctgcgcagcctgaccgcgatccgcgagcgacgcttcatcgtcctgccctataa

SEQ ID NO: 1858 - DNA, 1110 bp, Pseudomonas aeruginosa
ccaggccacgccgggcatcggcaacgccgcggcgatagaaaccctggtcgccggcctccaccctcgggcgccacgtccatgaccctgttccgcagccctcgcgcctattgcctgttgctgggcagcctggtcatgttgctcggcctgtcctgcgtggtcgccctcggcttcggtccggcgcgactggacagcggcctggtcggccgcatcgtcctccagcgcctgttcggcgtggcggcggagcccggtgcctggagcgccggccaggagcacatcgtctggctgatccgcgccccacgggtactgctcggcgcctgcgtcggcgccggcctggcgctggtgggagcggccctgcaggcggtcacgcgcaatccgctggccgatccgcacctgctcggcgccacctccggcgcgaccctcggcgcggtgttggtggtgctctacatcggcgaggtgatcggcctgctgaccctgccgctggcggccttcctcggcgccctcggcagcatgctgctggtgctcggcgtggccagtcgcggcggccgcctgggcagcgaccggctgttgctggcgggggtcgcggtgtcgttcgtgctcctggcgctggccaacctgctgctgttcctcggcgaccaccgcgccgcctcctctgtgctgttctggatgctcggcggcctcggcctggcgcgctggtcgttgatctggctgccggcgctgtgcgtggccggcggcctgctggtactgctcgggctgggccgtgcgctgaacgcgctgatggccggcgaacagaccgccgtgaccctcggcctggacgcccgtcgcgtacgcctgtgggtcttcgtctgctgctcgctgctgaccggcgtgctggtctcggtgagcggcgccatcggcttcgtcggtctcatgctgccgcacgccgcgcgcctgctggtgggtgccgagcaccgccgactgctgccggtgtgcgccctgctcggcgcgctgttcctggtctggatggatgtcgccgcgcgcaccctgatcgccccccaggacctgcccatcggcatcgccaccgcggccatcggcgggctgttcttcattctcctgctgcgtcgccgcagctga

SEQ ID NO: 1859 - DNA, 507 bp, Pseudomonas aeruginosa
ctgagccagccgacgccgagccaggcgagcccctgctggagcagcggatggcgtcgcagcaactcgcccaggccgagcccgagcagcaggatcagcgccgccaccgccgcgcaggcgccgagcacgatcggccaggcggcggccaggccgtggcgctggctgttgctcaggaccaggatgttggtcggtccgggggtgatcgaggcgacgacggcgaacagcaggaagggcacgagggattgcatggacgggctcctgtggcgggggagccttcatcctggcgacgcgccgggcctcagtctggaagctgggtgcactgccggcggtaggccgccggggtcatcccgtaggcgcgccggaaccagcggccgagatggctctggtcggcgaaaccgagagcgctggcgaggtccgccggttgcccgccgacagcgagcatctgccgcgccttggccaggcgcaactggaccaggtaggcgtagggtggcaagccgtaggcggccttga

SEQ ID NO: 1860 - DNA, 1002 bp, Pseudomonas aeruginosa
tctcgccgcccacggcgcgaaggcgatcgccatccactacaacagcgccgcgagcaaggccgatgccgacgccaccgtcgccgcgctgcaggcagccggagccaaggcggtagcgctgcagggcgatctcaccagcgccgcggccatggaaaagctgttcgccgacgccatcgccgcggtgggcaagccggacatcgccatcaacaccgtcggcaaggtgctgaagaaacccatcaccgagatcagcgagaccgaatacgacgagatgagcgcggtcaattccaagtctgcgttcttcttcctgcgcgaagccggcaagcacgtcaacgacaacggcaagatctgcaccctggtgacctccctgcttggcgcctataccccgtactacgccgcctatgccggcaccaaggcgccggtggagcacttcacccgtgccgcttccaaggagttcggcgcgcgcggcatctcggtcaccgcggtcggcccgggccccatggacacgcccttcttctaccccgccgaaggtgccgatgcggtggactacctgaagaacgccgcggccttgtcgccgttctccaaaaccggcctgaccgacatcgacgacgtggtgccgttcatccgccacctggtcagcgaaggttggtggatcaccggccagaccatcctcatcaacggcggcttctccaccaagtgagccacgcagcggccgccacggcggtcgctgcctgcctgcggaaacccttcatgcacgtgaccctggtaatcgccggcggcatcgtcctgctcggtctgttcctgctcttcggcaaactctgggatgccgggccggcgctcgctgccggcctgttcctgccgacctggctggccgtcgcgctggtcaacctgtgggtcggcgtccagcacgccggctacggcttgcgcgaagaactgccgatcctgctgctggtcttcctggtcccggcggcactggccggcgtggcgatctggctggcgccgcgctag

SEQ ID NO: 1861 - DNA, 1200 bp, Pseudomonas aeruginosa
gcggcggcgcttcagacgcggaaacggccgaccagccgcgccagttccgaggacagctcggacagccggcggctggccccggtaccctgctccgaatgttccgccgcctgggcggaaagctcgcgcacctcgctgatgttgcgggcgatttcgtcgattacccggctctgctcctcgcaggccgaggcgatctgcgcggcgaggtcgttgatccgccccaccgcgtcgccggtggcggccagcacgccgtcgaccccggcggcgcgctcgacgctgtcgcgcgccttgaggctgcccgactgcatggcccgcacggcgttctgcaccccggcctggaggcgctcgatgcgcgcctggatgtccttggtcgaatcctgggtgcgcgccgccagcgcccgcacctcgtcggccaccacggcgaaaccgcgaccctgctcgccggcccgcgcggcttcgatggcggcgttgagggcgagcaggttggtctgttcggcgatgcccttgatcaccgtcagcaccgcgtcgatgctggcggtttcctgggccagttgctggatgctctcggaactgctctccacttcctgcgccaactggcggatcacctcgatggtcgcttccaccacgttggcgccctcgcgcgcctgccggcgggcgtcatcggccacctgcgcggcgctctgggcattgcgcgccacctcgtggacggcgctgctcatctgcgtcgcggcggtgctgacctggtccaccgatgcgtgctcgctgttgatcagacgatcgttggcggcggtcatgccggccagcgaaccggctgaatcggcgacctcgccggtgacccggccgacctcgcggatcagcggctgcaacttgtcgaggaaggcgttgaaggcgctgccgaggcggccgggttcgtcgcgcgaagtgacctccaggcgcacgcgcaggtcgccatcgccgttggcgatctcttccaggcgttgcagcagacgctgcaacggacgggtcaccaggccggggaacaccagcaccagcgacaggcacaccagcaggccgaacgccaccagcgccacctgctgccagcggtggcgctcgcccagcgcggaggacgcctcgccgtcggcggccgcggccgcctcttccatctcgtcgagctggttgatcacctcgcgcatcgccccgaactggcgatcgctgtcaccgtag

SEQ ID NO: 1862 - DNA, 1290 bp, Pseudomonas aeruginosa
caacgaaaggttgtcatcatagccaaagcgagcctccccgccagtcccccgcttgcctaccatcggcttcgacaacgccccgccgcccaccggtcggagcccttgaggagaacaagaagaatgaccgagcctgccgtcctgcccgccatcgcggcgctgcgggaagagatggttaccttgcgccgccatatccatgcccacccggagttgggtttcgaggaacggcgaaccgccacgctggtcgccgaatgcctggaggcctggggctaccaggtcagccgtggagtgggtcgcaccggcgtggtcggcaccctgtgccgcggcgagggcccagcgctgggcctgcgcgccgacatggacgcgctaccgatccaggaagccaccggcctgccctacgccagccaggtggacggcgtgatgcacgcctgcggccacgacggccacaccgcgatgctcctcgccgcggccaggcacctggtcgagtcgccgcactggcgcggcaccctgcaactgatcttccagcctgccgaagagggcctcggcggtgcccgcgcgatgctcgacgacgggctgctggagcgcttcccctgcgacgccatcttcgccatgcacaacgtcccgggataccccgtcggccacctcggcttccatcccggccccttcatggcctcggccgataccgtggtcatccgcgtgatcggcagtggcggccacggcgcggtgccgcagcgcaccgtcgacccggtggtggtctgctccgccatcgtgctggccttgcagagcatcgtctcgcgcaacgtcgacccgcaggacaccgcgatcgtcagcgtcggcgcgatccatgccgggacggtctccaacgtgatcccggccagcgccgaaatgatcctcagcgtccgggccctgaccgcggaaacccgtgccctgctggagcgccgcatcggcgaactggcccgcggccaggccgccagcttcggcgcgcgggcggaggtcgactaccggcattgccatccggtgctggtcaaccatcccgggcagaccgcgttcgcccgcgaggtggcccgcgactggctgggcgaggaatgcctgatcgacggactgcggccgttcaccgccagcgaggatttcgccttcatcctcgaacgctgtcccggcagctacctggtgatcggcaatggccagggcgagagcggctgccagttgcacaaccccggctacgacttcaacgacgactgcctggccgtcggcgccagctactgggtgcgactggccgagcgcttcctggcctga

SEQ ID NO: 1863 - DNA, 417 bp, Pseudomonas aeruginosa
ccatcacgccgaaacgcgcacagcacatcgccttcaccgaccgcgtctccaacgcgccgagccgcctggtggtacgccgtggctcggcgctcctgcccgacgccgagagcctgcgcggcaagcgcgtgggggtcggccagggctccaaccaggaggcctacgccaaggccgaatgggccgccaagggggtgcgggtcgtctcctaccagaaccaggaccaggtctacgccgacctcgtcatgggccgcctcgacgcctcgctgcaaggcgcggtgcaggccagctacggcttcctcgacaagccggtcggcaaggatttcgaactggccggagcggtgctggacgaccctcgctacttcggggtcggcgacggcatcggcctgcgcaaggaggacgtggcgctgcgcgaggacctga

SEQ ID NO: 1864 - DNA, 834 bp, Pseudomonas aeruginosa
acaaggcgctggcgacgatccgcgccaacggaacctacgcgcgaatcaacgcccgctacttcgacttcgacctctacggcacgccctgaacggcgtccggccgcttttcacctcgaccgacaacaacaagcaatggagagtgaaatgttcctcgacggcttcggcccgcagatactcgccggcaccctggtgaccctgaaactggcgctgggctccctgctcggcgccgtgctcatcggcctcctcggcgccagcgccaagctcgccgccaaccgcccgctgcgcgccctggccagcggctatacgacgctgatccgcagcgtccccgacctggtcatcatgctgttgctgttcttcagcctgcagatcctcctcaaccgcgtcaccgacgccctcggcatcggccaggtcgacatcgacccgttcgccgccggctgcgtcaccctggcgttcatctatggcgcctacttcacggaaaccttccgcggcgccttccaggcggtcccggccggccaggtcgaagccgcgcaagcctacggcatggggcgctggcgagtgttccgccgggtactcctgccgcagatgctgcgctacgccctgccgggcatcggcaacaactggcaggtgctggtcaagtccaccgcgctggtctcgatcatcggtctcggcgacctggtcaaggccacccaggacgccggcaaaggcaccctgcagttcttccacttcaccctggtctgcgggctgatctacctggccatcaccgcaatctccaacgccgcgctgctgtggctggagcggcgcagctcgctgggcgtcaggaggccgctgccatga

SEQ ID NO: 1865 - DNA, 867 bp, Pseudomonas aeruginosa
ggtgctcaggggcgtttcgctcagggccgggaagggagacgtgatcagcatcatcggctcctccggctcgggcaagagcaccttcctgcgctgcgtcaacttcctggaaaagccctgtgccgggcgcatccgcgtcggcgacgaggaactgcgcacccgtcccggcaccctgggcgagctgcgcgccgccgatccccggcagttgcagaggatccgcagccggctggcgatggtcttccagcatttcaacctgtggagccacctgacggtgctggagaacgtggtcgagtgcccggtcaacgtcctgagaatgaaccgcgacgacgccgtggcccacgcgcgccactacctggccaaggtcggcctggcggagaaggtcgaacggcagtatccctgcgaactctccggcggccagcaacagcgcgtggcgatcgcccgcgccctggccatggagccgcaggtgatgctgttcgacgaaccgacctcggcgctcgatccggaactggtcggcgaagtgctgaaagtcatgcagcagttggccgaggaaggtcgcaccatggtcctggtcacccacgagatggccttcgcccgccaggtttccagccatgtgatcttcctccaccagggcgtgatcgaagagcaagggacgccggaccaggtgttcggcgcgccgcgcagcgaacgcctgcgccagttcctcgccggcaacctgaaatgagcctggggctcagcgcgacggcgcgaggaaacgcacgaagaccagctccggatcaccttcgtcgaggttgtcgatcaccccgctcggctggaatcccttgcgctccagcaggcgccgcatcggcaggttggagcggttgcaggaagtga

SEQ ID NO: 1866 - DNA, 1293 bp, Pseudomonas aeruginosa
cgtggtggtgcacagcaccggcgccctggtgctgcgcgactggctgacccgccacttcgaccccgccagcgcgccggtcaagcgcttcctgatgctcgccccggccaacttcggctcgccgctggcgcacaagggacgctccttcatcggtcgcgtactgaaaggctggaaccgcttcgtcgggcagaccggcacccaggtgctgaagggactggagctgggctcgccgtactcctggcaactcgccgagcgcgacctgttcggcgccgaggcctggtacggcgccggccgcctgctcgccacggtgctggtgggcaatgccggctacagcggcgtcgaagccatcgccaacgaagccggcggcgacggcacggtgcggatcgccacggcgaacctcaacgcctgccgcctgagcctcgaactggatgtccgccagcgcgccaggcccggctggcgcctggaagaatcgcgcggcgagatcgccttcgccatcgtcgacggcgagaaccacgccagcgtggcgctgaaggaccgcggaccgaagaacccgcataccctggagctgatccgcgccgcgctggaggtcgaggacgccgattaccggagcagcggcgcaagcttcccctggcagcgccgcatcgatcagctcgaccccggcatcgagcgccgctcgccgcgctacctgaacctggtcagccacgtctgcgacgacctcgaccaggaggtgcgcgactacttcatccagttcttccgcaagctgaacagcgaccggcgtttcgaacagcgcttctacgagcaggtcatcgccgacgtccatccctacgaggacaaccccgcctaccgctcgctgtacctgtcgatcgagtccctcgacgacctgctcgccggtttcgccgtggacaccctgtcgctcagcgtgtcggcccagccgccgttcgatccgccgcgccagccggtcggctataccgcggtgggccccggcgacagcgaaggcctggcaattccgctggcgcaggtgccgcgcttcctcgcagcccaccgcaccctgctgctgcgcatccgcctgacgcgcctggtggacagcggcgtattcgtcttcaggaacccctgaatcggcgcccggcccccccgctgggcagccacccaggccgggcgcaggcgatcacggttggccttcgggccactcgacccgctgcaatggcgcgccgccgcgcccgaggcgatggacgatgccgctgccccggcgcagatcgacccgcaccaaccgcccgccttcctctccacggccgctga

SEQ ID NO: 1867 - DNA, 1113 bp, Pseudomonas aeruginosa
gcagcagctcgctacgctcggccaggctgcgccggtgcagcaccagccagttgccgtcgactcgccagggacggcgcgccaacctggaatcgccgcccggcagcgccgaggcatagcgacggtacaacgcctcctcccgcgtctgctcgtcgcgccggcgacggtactcggcatccgccgccgcctccaggtcggcgacccgttcccgccaggcatcgtgcgcggcaatccagcgtcgccgttcctggcggtaggcgtcacgcgccgcaaggaacgcacgggtactgggaaaacgctccacgcgctcgtcgaactcttccggcggctgcggctcgggcggcagcgacggatgctggcgctgccgctcggacggtcgatcgagcagccgctgcggctcttcggcagcggctggatcgggcagcaggccatcctgcaggaaggccgcgtcgagcagcggacgcagtcgattctccgccggcgaccgccaatccagggtgcccagtgacaggcgctggcgtcgcgcccgttggttcgctgccggcagcgcctcgccacgctccagcgctcgggcctcgtgatcgctggcgaggatcagcaggcgtccgtcgggcaggcgcgtcaggcccggcgcctgccagtcgatcccggcattcgccggcggcggcgggtcgccgtggaaataccgcgcggcatcgacttccggagcttcgcgcagggccaggctgtcgccgtcgaggaaccagacgcggccgtccagcgcgagcatcagcaatccgccccggccttcgtcgtagcgataggcgtccttcccccagggcgcccacttcaacggcagcccgccagtgcgccgctccagctcgtcaaacgccagcgcaggggcggcgtcgcgccggtcgagtacgtagagttcgttgcgcaggaagaacaggtagcgcgacgactggcccagcagttcgccggaaccccagtcgtcgccgcgctcgttgtcggcatccaggcgcatgctccagcgcaggctgccgtcctccaggtcgaccacctgggcatagctgcggctgctgccgtgtaccacgccgttgtccacttcgttggcgcgatagtcgtcgagggtga

SEQ ID NO: 1868 - DNA, 1500 bp, Pseudomonas aeruginosa
tcgtctgcggcaactacgacgccgagcgcgccgaagcgatactccaggccggactggccgacgcggtggcgatcggccggccgttcatcgccaaccccgacctggtcgagcggatccgtctcggcgcgccgctggccgaggccaaccaggcgcggttctacggtggcgacgctgccggctacaccgattacccgactctcggccagtccgctacggcctgattcccttccctcccatgcatcgttcccgggcgcggccacggctgcgctcgcggaggagtcttgccgtgctattgccgatcctcctgctggccgccgccggcttcaccatcctgaccaccgagttcgtcatcgtcggcctgctcccggcacttgccgcagacctccaggtcagcgtcgcccaggccggcctgctggtcagcctgttcgccttcagcgtcgccgccttcggtccgttcctcaccgccgcgctggcgggcgtcgaacgcaagcggctgttcgtcgcctgcctgctgctgttcgccgcggccaatgcgctggccgccgtggccggcgatatctggacgatggccgtggcgcgcttcgtcccggccctggcgctcccggtgttttgggccatggccagcgaaaccgccgcgcacctggccggcccctcgcgcgaagggcgcgccgtggcgctggtgttcttcggcatcgtcgccgccaccgtgcttggcattcccatcggcacgctgatcgccgacgcctggggttggcgcctggcattcgccgcactcgccgcgctggccctggccaaggcgctgctgctggccgcctggctgccgcgcattcccggacggccgggtatctcgctgcgcagccaggcgagcgtgttgcgccaaccgctggtgctcggccacctgttgctgtcgctgctggtcttcaccggcatgttcaccccctacacctacctggccgacatcctccagcgcctggccggcttcagcggttcgctggtcggctggacgctgatgggcttcggcgcggtaggcctgctcggcaactggctcggcgggcgcctggtggatcgcagcccgctgggcgcaaccctgctgttcgtcctgctgatggcgctgggcatgctcgccctggtgccgaccctcggcaacgcctggctgctcgccgccaccctggcgatctggggcgtggcccaggcagcactgttcatcgtcggccaggtgcgggtgatgaagtccgcgccgcgggccccggcgttcgccgcctcgctgaacatctccgcctgcaacgccgggatcggcatcggcgccctcgccggcagctgggtgatcgacggcagcggcctggcgccgctcggcgaggtcggcgcgctggtctgcctggcggcgatggccgtggccctgctgctgatgctggcgccacgccaagctgccaccgagccgtccctcggcggccaaatccctcactgagcccaccaaggaagcacaaccatgatcctcgatag

SEQ ID NO: 1869 - DNA, 615 bp, Pseudomonas aeruginosa
attgcacgccttcactctctgcgaggcattcccgtgacgcatccagcgaccgtctacagcctgtccacccgcctgctgcactggagcatggcgttctgtttcatcggcgcgatcgtgctggcctatttcgtcatctgggtgctcggccacgaccacccacagcgcctgccggtactcaacctgcactgggtgctgggcctgctggtcggcctgctgctgatccctcggatcgtctcgcggctgcgcgggccgcgcctgccagcggtccccgggacgccgctggagcaccgcctggcgcactacgcgcacctgtcgctgtataccttgatgctggtgatgccgctcaccggctacgtcggcacccgcctgcccaccgacttcggcctgttcgtggtacccagcttcaaggacaccgcgctgttcgcctggatttcgcaaacctggaacctgagctgggaggcattcgagaagcccttcgacgccgttcaccgcatggtcggcctgtggctgagcacctcggtggtgctgctccatgcgctcgccgccggctatcaccagtgggtccgccgcgacggcaccctggagcgcatgctcggccgtcgccagcgccgctga

SEQ ID NO: 1870 - DNA, 1965 bp, Pseudomonas aeruginosa
ccgggtcggcctccgacagagaggagcatgccatggccagcctgcactgccagcaccgcagctacaccatcaccgccgacgtcgtcgagcatccgggcattcccacgccctgggccggcggctgccacatcaccgatcccgaaggccacaccagcaagcgcatcgccctgcccgtgcgcttcgccttcctcgccgacctggaaaacgcccagcgcgcctccatcgcccacggcaaatggctggtggaccagcgcctggaccgcggcaaggcgctgttctgaagcgcacaacgaaaacggccctcgcaaggagggccgtcgttcatcgcggcgcggctcaggcgctgccggcttcagcggtttcgctgcgccgtcgcggcggcgcgccatggctgtcgtcgccggccagcggcacttcgttgccctgggcgtcgtacagcttgccgtcgaggaaatagtcgccttcgtgcagggcggcgatgtcctggtagcgcagggtccgctcgctggcggcgacgaacaccgactgctggtcggagttgccggcggtgaagtggttgaacgccaggttgagcaggatcgccatgatcgccgaggaactgatgccggaatggaagatggtggcgaaccaactggggaagtgatcgtagaaggtcggcgcggcgatcgggatcataccgaagccgatcgaagtggcgacgatgatcaggttcatgttgttgcggtagtccaccttcgacagggtgcggatgccgctggcggcgaccgtgccgaacaacacgatgccggcgccgccgagcacggcggtgggcaccgcggcgatcacccggcccatcaccggcagcaggccgaggatcaccaggaacaacccaccggtggcgaccacgtagcggctcttgatcccggtcaccgccaccagaccgacgttctgggcgaaggcgctctgggtgaaggagccgaagatcggcgccagcatgctggagaacatgtccgcgcgcaggccgttgcccaggcgccgcgagtcgaccttggtgtcgatgatctcgcctaccgcgaggatgtccgccgaggtttccaccagggtcaccatgatcacgatgcacatcgagatgatcgcggcgacctggaaggtcggcatgccgaagtggaacggcgtgggaaacgccaccagcgggccttcggtgaccttggagaagtcggccatgccgaggaacaccgcgatgacggtgccgatgaccatcgccaggaggatcgacaggcgcgagatcgaggcgctgccgagcttgctcagcagcagcacgatgaccagggtgatcgccgccaggccgatgttggccatgctgccgaagtccggcgcgtggctgttgccgcccatcgcccagcgcgcggcgaccggcatcagggtcaggccgatggtggtgatgacgatgccggtcaccagcggcgggaagaatttggtgatgcgcgagaagatcggcgtgatcagcaacccgatcagcgaggccgccatcaccgcgccgagcactgcgggaatgccgccgctgccaccgctgccgatgatcgccaccatggtcgccacgccagcgaaggacaccccctggaccaacggcaactgacagccgaagaacggagcgccgagggtttgcaacagggtcgccaggccgccggcgaacagcgaagcggcaatcagcaggccgatgtcgccgggcgcgaggccggcggcctggccgaggatcagggggaccgcgacgataccgccatacatggtcagcacatgttgcaggccgtaggccatgttggcgccgacaccgaggttctcgtcttcaggccgtggaacgggtggggttccggaggacgtcgttttcatggtgcgctgttctcgcttttattgttgtgcgcacactgtagacaattcgatccgaaaatatccagaaaaatgtatacaaaatttccgacaaatctgtga

SEQ ID NO: 1871 - DNA, 276 bp, Pseudomonas aeruginosa
cagcgctggtgccagccactccgctcgcgcgcttatccgcgcgccagacggtttccttcctgctgcaccatcctcccagccccgaccaacggccatgggcccgcgccgaagggcattaacgatagaaagccaccctccatcccgccagcgagctatcagcaattcttccacaaaaagttgatgaaattcacatttcaggaattacgccaggacagcccggaaagcgctcctagtctggcagtcaggccgtgcccgaggcggcatttcgggcaatag

SEQ ID NO: 1872 - DNA, 765 bp, Pseudomonas aeruginosa
cctgagcgccaccgtgccgcagccggtcacctacgaatgggagaaggacttcacctacctgtcgcagaccgaggcaggcgacgtcaccgccaaggtggtcccggtggacctgtccctcggcgccggcaacacctccaccagcggttgcgaggcggaagacttcgccaacttcccggccggctcgatcgcgctgatccagcgcggcacctgcaacttcgagcagaaggccgagaacgccgcggccgccggcgccgccggggtgatcatcttcaaccagggcaacaccgacgaccgcaagggcctggagaacgtcaccgtgggcgagtcctacgagggcggcatcccggtgatcttcgccacctacgacaacggcgtggcctggtcgcagaccccggacctgcagttgcacctggtggtcgacgtggtacgcaagaagaccgagacctacaacgtggtcgccgagacccgtcgcggcaacccgaacaacgtggtgatggtcggcgcgcacctcgactcggtgttcgaaggccccggtatcaacgacaacggttcgggcagcgccgcccaactggagatggccgtgctgctggccaaggcgctgccggtcaacaaggtgcgcttcgcctggtggggcgccgaggaagccggcctggtgggctcgacccactacgtgcagaacctcgccccggaagagaagaagaagatcaaggcctacctgaacttcgacatgatcggctcgccgaacttcggcaacttcatctatga

SEQ ID NO: 1873 - DNA, 1680 bp, Pseudomonas aeruginosa
cggcgacggttccgacttcggcctccagggtccgcccggctcggccgccatcgagcgcctgttcgaagcctacttccgcctgcgcggccagcaatcggaaggcaccgagatcgacttccgctccgactacgccgagttcttcaacagcggcatcgccttcggcggcctgttcaccggcgccgagggcctgaagaccgaagagcaggcgcagaagtacggcggcaccgccggcaaggcctacgacgagtgctaccacagcaagtgcgacggcatcgccaacatcaaccaggacgccctggagatccacagcgacgccatggccttcgtgaccagttggctgtcgctgtcgaccaaggtggtcgacgacgagatcgccgccgccggccagaaagtacaatcgcggtcgctgcagatgcagaagagcgccagccagatcgaacgctggggtcacgacttcatcaagtaaccgcgactaccctgcgccgggccgccggcgcaggttccccatccaggcccggctcatccaccgggccttttttcatcggcgcgcgatcactccaccgcttccagcagggtcgccacgccctggccgccggcgatgcactgggtggcgatggcatagcgcccgccggtgcgccgcagcaacgcagcggccttgccggtgatccgcgcgccggtggcgcccagcggatgaccgatggccagggcgccgccatccaggttgatcctgtccatgtccagccccagttcgcggatgcaggcgatggattggctggcgaaggcctcgttgatctccaccaggtcgatgtcggcgatgcccagcccggcccgttgcagaaccttgcgcgtcgcctgcaccggccccatgcccatgatctccggcgcacaaccggccaccgccaccgccttgatccgcgccaggatcgccagcccgtggcggcgcgcgaagtcctcgctacagaccagcagcgcggcgctgccatcggtgagcggcgacgaggtggcggcggtgacgctgccgccgaacgccggcttcaactgggccaggctctccaggttggtacccgggcggatgcagccatcctcggcgacccggccggcgggggtgtcgatggcgacgatctcctggcgcagcaagccggcctcgcgcgcggcgactgccttggcgtgggagcgtacggccatctcttcctgctcgacgcggctgacggcgtagcgctcggcgacattctcggcggtctgccccatgctcatgtataccgccggatagtcctgcagcaacgcgggattgggcgacaggttgaagccgcccatcggcacccgcgtcatcgactctaccccggcggcgatgaaggcttctccggcgcccagcaggacttgcccggcggcgtagtggacggcgctcatggacgaaccgcagaaacggttgagggtcgcaccgccgaggctctgcgggaagccggcacggaaactggcgatgcgcgcgatgttcatgccctgttccgcctccggataggcgcagcccatgaccacgtcctccagcagcgcagggtcgagatcgagtttctccaccagccccttgagcaccgcggcggccaggtcatccgggcggatatcgaccagcgcgcctttcctggcgaagtggaacggcgaacgggcgtaaccggcgataacgactga

SEQ ID NO: 1874 - DNA, 483 bp, Pseudomonas aeruginosa
gcaccagcagacgctgatgctcggcgggtttctgccgctgtcggcgcgccagccagccagcggcctggtgcagggcgtcgagcagcggcgtaccgccgccggcgcccagctggcgcagccagtcctgcaactcccgcgaggccttctgcccctgccagagccattgcgcctgctgcccggtggcgtgcagcacggccaggcggatacgctgccgataggcctcctcgaacagcgtcgccaacacccccttggcctgggccagggcgccgtaccggcgggtgctggcggaggcatcgacgatcaccagccagagttcgcccgggcgccggctgcgcggctggcgaagcaggtcgcggcgctgtcggggacgtccacgcagcagggtcggcaaccattggatggcgccctccgcaccctggctcagggcgccgccaagaccgccgcgcagggctccgggtctgctcctggcatccgcacccatga

SEQ ID NO: 1875 - DNA, 1506 bp, Pseudomonas aeruginosa
ccgagcgcgggcggatgctcagggcttttttggccagcgcggcagctcgcgggcggtccccatggccaccggccgagccggcaattcaccccactgcccttcgccgttgccggtgcgctccgggagcgcgacaggggccgccgcgggcggtggcggtggattggccgccgatggtggcgggttcgactggcgacggcgatgcagcagggcgaaatgttccaccgcatcgatgtcctccgcctcgatccgctcgccgccgcgccaggccgcatgggcgcgcgccgcgcgcagccagaccaggtcggcgcgcaggccatcgacagccgcctcgaagcagcgtcgagcgatgctgtccagcgccgcatcgtccaggggaatccgcgccagccgccggcgcgcctcggcgcaacggcggcgcagggtgtcctgctggccttcccagcgttcggcgaaggcctgcgggtcggcatcgaaggccagccggcgacggatgatctctgcccgctcggccggcggcggctgggtgtcgagacgcacgttgaggccgaaacggtcgagcagttgcgggcgcagttcgccctcttccgggttcatcgtgccgatcagcacgaaacgcgccggatgccggtgggaaatgccatcgcgctcgaccaggttgacgccgctggcggcgacgtcgagcaacaagtccaccaggtggtccggcagcaggttcacttcgtcgacgtagagcacgccgccgtcggccttggccagcacgcctggggaaaaccgcgcgcgaccttcgccgagggcggcgtccaggtcgaggctgccgacgatgcgctcctcgctggcgcccagcggcagggtaacgaactcgcccgccggcagcagttcggcgacgccccgcgccagggtcgacttggccattccgcgcggcccctcgatcagtaccccgccgatcgccggatcgaccgcggccaggcacagcgccagcttcagttcgtcggcggcgaccacggcggacagggggtaatgcacggtagcgctcatggggattcctgcggcggacggacggaaatacggaccgccaagtctatcaggccggcggcgccggtatcgaaccgtgaaacagtcgttgaaccggccgcctcgcttgcagtaagctcgggactcgttcacgggagaaacccatgccgcacacccgccatccgcacctgcattccagtgcctcgcgccctggcttgtcgttgcgcgcgcgtgcgccgcaggcaccccgtgccgcgtatttcttcgggtattggtttagccactccggcgcctgataccccaacggcgcccacggtatacgggacgcctaccctgcacacgcaaacccccggtcggctccccgaccgggggttttgtttttccggcccgtttttccggcccacaaggccacaaccacagaccaacgcacaggacatcgatcatgaccgcataccgctaccgcactggctacccgctcaacacctggcgatttag

SEQ ID NO: 1876 - DNA, 1272 bp, Pseudomonas aeruginosa
cgacggccgccagccgctcgccaacccacgacattgccgaacacctcgatagggcacgacgcgcgcgggacgcccgccgccagcccaggaagccagaccatgaactcatccgtatccgcactgaccaccctttcgccgaacgtccaggccgtcgccctgcccagcgccaccgcccgtaccgccctggaacgcctgcccagcccgctcgaactcaaggcccgccagccgttgccgctggagctggccagccaggtcgccgccagccgcgacgccatccgcgccatcctcgacggcgacgacccgcgcctgctggtggtagtcggtccctgttcgatccacgatccccgctccgccctcgaatacgccgaacgcctcgccgcgctgagcgacgaactcgacggccagttgctcctggtgatgcgcgcctacgtggaaaagccacgcaccacggtgggctggaagggcctcgcctacgacccgcacctggatggcagcgacgacatggccgccggcctggcgctatcccggcaactgatgctggacatgctgcgcctcggcctgccgctggccaccgaactcctgcaaccgctggccgccggctacttcgacgacctgctgagctgggcggcgatcggcgcgcgcaccagcgaatcgcagatccaccgcgagctggtcagcggcctcggcctgccggtgggcttcaagaacggcaccgacggcggcgtcggcatcgcctgcgacgcgatccgttcggcggcccacggccaccgccatttcggcctcgacccgcacggtcacccggcgctgatcgagacccgcggcaatccggacacccatgtggtgctgcgcggcggccgccacggttcgaactacgggcccgagcaggtgcaggccgtgcgccaggccctgggaaagccaggcatcgccacgccggatgatggtcgattgcagtcacgccaacagcggcaagaaccgctgaaccagcccggcgtcctcgccagcgtgctggacccagcgcctggccggtgccagcgacctggtcggggtaatgctggaaagccacctgctcgacggttgccaggcgctcggcggcgaactgcgctacggcgtctcgatcaccgacggctgcctcggctgggaaggcaccgagcggattctccgcgacgccgcccggcggctcgccgagcggcgctgaaagcggtgggagcggccatgccgctccgctattcctcttcgacgtccagcagcaggttctccagggcctcgcgatag

SEQ ID NO: 1877 - DNA, 402 bp, Pseudomonas aeruginosa
gcacccggcttggcgccgaagatccgccagccggcctgccggcgcgcctccgccggcgccgtgccctgcgcctcgaggcgctggcgctccaagcgtacgcgagcggccagcgggttcagctcctccgcctcgtccagctcggcgaccgcctgcaccgccgcatcgaacaggcggatcaggttggcgaaggcgtcgcggaagaacccggagacccgcagcgtcacgtcgacccgcgggcggtccagcagggagaccgggaggatctcgaaatcggcgacgcgctggctgccggcctgccagaccggtcgcacgccgagcagggccagggcctgggcgatgtcgtcgccgccggtgcgcatggtcgccgtgccccacaccgagagaccgagctggcgcaggtga

SEQ ID NO: 1878 - DNA, 615 bp, Pseudomonas aeruginosa
cgctcgagcagcaggttggccgactggaagccgatgcgccaggcggtcggggtcggcaggttgcgcacgtccaccgagaagaagttgcgtccggtgggcagcacgtcgagtcgcccgcgactcggcgcgccgctcggaccggccggtacgaagcgcccttcgagggctgccagcagcccgtcgatctcggccccgccacaggcgtccagggtcggtgccacctgttcgcacaagccgcgcaacacctcgccgctggcacgccaggtggcaggcggcgattcgccgcccaggcagcgttctatccagtgcaacgccagcaattccaggcgttcgcgggtatccccgagagtacgccagggctccccgccccgctcttccaggcaggccggccgcgcgccctgccaggcctcgcccatgtcgcaggccagcggatcgaagcccaggccaaggtcgtccgccaggctcttcagcaacccggcgttggcgcccttgccatcgccgcgcggaacccgcagcagcgccagcagggtatccaggcgcaatcgcccgctcggcgactcgccgaacacatgcaggccgtcgcggatctgcgactccttcaggtcgcagagatag

SEQ ID NO: 1879 - DNA, 2016 bp, Pseudomonas aeruginosa
aacagcaacgcgaccaccggacgcccggcctgccagtcggcacgccagtgttcccagggtcgcctcggcatgccgtggatggaacagcgccacccgcggcagcgcctgcggttcgcgccaggcgtagtcgcggccgaggcactggctggccaggcagcggtagaactgcccggcgttctccagcccgccctggcgcaagtattgccagaagcgctcggcctgctccgccggcaggttgccaagggcgctcagctccgggtcggggcggtcgtcgccgggcaccgggatcagcagcgcgccgcgctcggccagcgccaccagttgctccacgccgtagcgccagtagccgatgccgccgtgcagcgaaagcaggatcacccgcgcgtgccgcagcaattggtcgacgtagaggtccaccgaggcgtggttctgcaactgcatggggttggccaggcgcaggctcgggtagtcgtccggcagcgcacgggcggcctcggccagcaatgcgaggtgcgaatcgccgctgcagaggatcaccagctcggcgggagtctgggccaggtgggcgatgccgtcgtcgggaacgaagccgccgggttgggtgcgcaacaggtgcatggacgttctaccggtaggacgcaagaagctggggccggcgaatcgccatcgccggccccggccggggatcacggatcaggcaagcgctgtgcgcagctggttggcaatggcggcctggtccagctcctggccgatcaccaccagccgggtgctgcggacttcgtcggccagccacttgcggtcgaaatgcctgtcgaagcgcttgccgacgccctgtaccaacaggcgcatgggcttgcccggaatggcggcgaaacccttgatgcgaagtatgtcgtgacgctccaccagctcgccgagggcctcgagcagcgcagcttcctccacctcggggagatcgacgtggaaggagtcgaactcgtcgtggtcgtggtcctcgtggccttcgtggtcgtggtgggtcggccggccgtcgatgtgcagctcggcctcggcgttgagtcccagcaagaccggcagcggcagctcgccccggctcgcctcgacgatcttcactgccgccggcagctccccggcgatctccgcgcggacccgcgccagggcctcggcgtcgagctggtcggccttgttcaggatcaccaggtcggcactggccaactggtcctcgaacagttcgtgcagcggcgattcatggtcgaggttggggtcctggcggcgttgctggtccacctgctcgggatgggcggcgaaggtaccggccgccaccgccggactgtcgaccacggtgatcaccgcgtcgaccgtgcaggcgttgcggatttccggccactggaaagcctgcaccagcggcttgggcagggccaggccgctggtctcgatgaggatctggtcaaggtcgccgcggcgcgccaccagctcgcgcatcaccgggaagaactcttcctgcacggtgcagcacaggcaaccgttggccagctcgaaaacgcggccctgcgcctcttcttcgctgcagccgatggaacattgcttgaggatctcgccgtcgatgccgagttcgccgaactcgttgacgatcaccgcgatgcgccggccttcggcgttgtccagcatgtgccggagcaaggtggtcttgccggcgccgaggaagccggtgacgatggtgacggggagtttcgccagggttttcatgggcagcccttgttcagctcggcgggcatgcggacgagtggcgcggacgcaggggccgcgcaacggattcgccaccggatcaccccgcccggttgtatggaagtcttgtccccgggcatcgcgccacgggatcgacgaggcaggtctcctggctcacggtctggcgtctccgccggttccccgccttcccgcgtcacgcagtggcattggggaacgatcgccgttcacagttgcgggggcagccgcggcatcgaccgcgttcccttttag

SEQ ID NO: 1880 - DNA, 1107 bp, Pseudomonas aeruginosa
aacgggaagccggtgacgctttccgagccagtccggcgctgcccccgcaacggtaagcgcatcgcgcgcgagcccggagaccggcctggaacctttcgtttgattcacccgcggtgggcgggcgcaagcgtgaagcgggccgtccgggcctgttcctcgtgcgtactcctctgccacgcccatgccaatccagagggaacgcaccatgtccagcagcaccctggcgcacgccagctccaccacctccctgtcgaagcgactgagcctggccatcggcgccggcctgctcggcgcgctgctggtctatttcgccggtttctcgcacatcgacgcggtacacaacgccgcccacgatacccggcacagctccggcttcccctgccactgagtcgcgagggaaccagaatgatcaagcgcatcgcccagaccgccggcttcgccggcctgctcgccgccctgctgctgaccctgctgcagattctctgggtcaccccgctgatcctcgaggcggagacctacgagaagagcgagccggtcgcggcccagccccacgaacacacccccggcgtcgccgcccatgtccacgacgaggaggcctgggagccggaggacggctggcagcgtaccctctccaccaccggcggcaacctggtggtggcggtcggcttccccctgatgctcgccggcctcttcaccctgcgcgcgccgggccaaaactggctaggcctgctctggggcctggccggctactcggtgttctgcctggcgccgtcgctgggcctgccgccggagctgccgggtaccgccgcggccgacctggtgcaacgccagtactggtggatcgccaccgccgccgccaccgcggtgggcctggccctgctggtgttcggcggcaactggccgctgaagctggtcggcgccgtcctgctggcgctgccgcacctgttcggcgcgccgcagcccgaggtccatgccagcctggcgccggaagccctggcccagcgtttcgtggtcgcctcgctggtcagcaatgcgctgttctgggccgccctcggcctggccgctgcctggctgttccggcgcaaccggggcggcgtcgacgcctga

SEQ ID NO: 1881 - DNA, 501 bp, Pseudomonas aeruginosa
ccgcctgccacccgcgacccttgccggtcgcgggtccatagtgcctctccttccatttcctccggtgcgcgcatgcccctgcccatccccagcctgctgatcgccggcatcggctgccgccgaggctgtagcgccgagcatctgcgcgcgctgctggagcgaacgctgggcgaacacgggcgcagcctggccgagctggacgccctcgccagcatcgacggcaaacgcgacgaacccggcctgcggcaactggccacgctgctcgaacgccccgtgcatttcctcgcacccgccgtcctgcacgactacgagccgcgcctgctcagcccctccgccgtcgcgctgcgcgaaaccggctgctccagcgtcgccgaggccgccgccctggccctggccgaacgcctgggtggcggtcgcgccgatctgctcggggcgaaacgcagcaacgatcgggcgagcatcgccctggcacgtcttctcaccgaacgagaactcccatga

SEQ ID NO: 1882 - DNA, 1104 bp, Pseudomonas aeruginosa
cgttcagcgctggccccttttttcctgaagccttcggacacccatgaaacgattcctcctcggtctggttctgctgctggcggtcgccgccggcgtcctctacttcgtcccggctaccctcctcgccagcgtacgcaccgtcgagcgcggtctcgccggtctcagcgagcacagcgtgcaggtcgacaacctggagatcgcctacctggaaggtggctcggagaagaacccgaccctgttgctgatccacggcttcggcgccgacaaggacaactggctgcgcttcgcccggccgctgaccgagcgctaccatgtggtcgccctcgacctgcccggcttcggcgacagcagcaagccgcaacaggccagctacgacgtcggcacccaggccgagcgagtcgccaatttcgccgccgccatcggcgtgcgccgcctgcacctggccggcaactccatgggcgggcacatcgccgcgctctacgcggcgcgccatccggaacaggtgctatcgctggcgctgatcgacaacgccggggtgatgccggcgcgcaagagcgaactgttcgaggacctggagcgcggcgagaatcccctggtggtgcgccagccggaagacttccagaagctgctcgacttcgtgttcgtccagcaaccgccgctgccggcgccgctcaagcgctacctcggcgagcgcgcggtagccgcgtcggcgttcaacgcgcagatattcgaacaactgcgccagcgctacatcccgctggagccggaactgccgaagatcgaggcaccgaccctgctgctatggggcgaccgcgaccgcgtgctggacgtctccagcatcgaggtgatgcgtccgctgctgaagcggcccagcgtggtgatcatggaaaactgcggacacgtgccgatggtcgaacgcccggaggaaaccgcgcagcactaccaggccttcctcgacggcgtacggaacgcccaggtggccggtcgctgaaaacgcgaaccggcgcctgggcgccggttcgggggagcgggagccgtcgcgaggacggctcggatccaggcctcaggcctggatcaggttggcgatctgcacgtccgggttga

SEQ ID NO: 1883 - DNA, 1005 bp, Pseudomonas aeruginosa
gccttgagtaggagatcgatagtggaacgcgaatacatggaattcgacgtcgtcatcgtcggcgccggccccgccggtctgtccgccgcatgccgactgaagcagaaggccgccgaagccggtcaagagatcagcgtctgcgtggtcgagaagggttccgaagtgggcgcccacatcctctccggcgcggtgttcgagccgcgcgcgctgaacgagctgttccccgactggaaggaactcggcgcgccgctcaataccccggtgaccggcgacgacatctacgtcctgaagagcgccgagagcgctaccaaggtgcccaacttcttcgtgcccaagaccatgcacaacgagggcaactatatcatctccctgggcaacctctgccgctggctggccccaccaggccgaaggactgggcgtggagatctatccgggcttcgccgcccaggaagcgctgatcgacgagaacggcgtggtccgcggcatcgtcaccggcgacctcggcgtcgaccgcgaaggcaacccgaaagaaggctactacacccccggcatggagctgcgggccaagtacaccctgttcgccgaaggctgccgcgggcacatcggcaagcaactgatcaagaaatacaacctggacagcgaggccgatgcccagcactacggtatcggcatcaaggaaatctgggacatcgacccgtccaagcacaagcccggcctggtggtccataccgccggctggccgctgaacgacgaaaataccggcggctcgttcctctaccacctggagaacaaccaggtgttcgtcggcctgatcatcgacctgtcctacagcaacccgcacctgtcgccgttcgacgagttccagcgctacaagcaccacccggtggtcaagcagtacctggaaggcggcaagcgcgtggcctacggcgcccgggccatctgcaagggcggcctgaattcgctgccgaagatggtcttccccggcggcgcgctgatcggttgtga

SEQ ID NO: 1884 - DNA, 702 bp, Pseudomonas aeruginosa
ccttcggcctggattggcgagagggcgaccaggtcgtcatcggcaacgaggagttcccctccaatagagtggtctgggaagccttgcgcccgcgcggcgtcgaagtggtcgaggtcggtctcgccggcgacgatcccgagagcgccctgctcgccgcctgcggcccgcgcacccgcctgctgtcgatcagcgcggtgcagtacgccagcggcctgcgccttgacctggagcgcatcggcgcgggatgtcgccgccgcggggtgctgttctgcatcgacgcgatccagcagctcggcgccctgcccttcgacgtacaggcctacgattgtgccttcgccatggccgatgggcacaagtggatgctcggccccgaagggctgggcgtcttctattgccatcccgagcagcgcgagcgcctggcgctgcacgaatatggctggcacatgctggaacatgccctcgattacgagcgtcgcgactggcggccggcgcgcagcgcccggcgcttcgaatgcggcagcccgaacatgctcggcgcgatggccctggaggccagcctggggctgttggaggaggtcggcatggagcgggtcggcagagacatcgccgagcgcgtccagtggctacaggacggtctgtcgggaattcccggggtacgcctgcacagcccgcggaacccgagccgacgcgcgggcatcctga

SEQ ID NO: 1885 - DNA, 510 bp, Pseudomonas aeruginosa
tcagcagcagcacagtatcgcccgacggctcttcaaggcttttcaacagggcgttggcggcgttcacgttcatcgcctcggcgggttcgagcaacacgaccttgcgcccgcccagttgcgcggtctgcaccacgaagccaaccaggtcgcggacctgatcgacccggatcggtttctccgcctcctccggctccagcacgaagtagtccggatgggtaccggcggccagcaactggcaggccttgcactcgccgcatgcgccagcggcggcaggccgctggcagagcagttgggcggcccaatgctcggccagggcacgcttgccgatcccggcgggaccgtagagcagataggcgtgggcgtgctgggcgcggccgcccagttggctccagagcgcctgctgccagggatagatatcagccattcagacgctccagcagattcggcagcagccgatccaggccagcctgcacctcggccagcggcaacccggcatcgagcacctggtaa

SEQ ID NO: 1886 - DNA, 1629 bp, Pseudomonas aeruginosa
tcgcggttggtgctcttgccggccccttccgggccctccagggtgacgaacaggccggtcacacggcactccttatcttggctgcgccgctcattgtggcggcggggtgatgggcgcggggctggagcgatagtccgagcgacgcttcaactggtactcgcggaccgccttgttgtgttcgtccaggctgctggagaacacatggctgccatcgccgcgcgccacgaaatacagggtctcaccctcggccggatgcagcgcggcgcgaatcgcctcgcgcccggccagggcgatcggggtcggcggcatgcccggcaccacataggtattgtaaggggtcggttcgcgcaggtcggcgcgggtgatcttgccgttgtagcgctcgcccatgccatagatcaccgtcggatcagtctgcaacagcatgccgcgctgcaggcggcggacgaagacgccggcgatctgcgaacgctcttccggcacgccggtttccttttccaccagcgaggccatgatcagcgcctggtaggcgtcgcgataaggcaggtcctggctgcggccatcccattccttggcgaggatggtctgcatgcgctggtaggccttgcgcagtatgtcgatgtcgcgcatgccacgggtgtagcggtaggtatcggggaagaagcgcccttcggccacttcgtcgggcttgccgaggcgttgcatgatctcgccgtcgctcaggccggccagggtctgctccagcttgccctgcctggcgagcgcttcgcgcacctggcggaaactccagccctcgaccagggtcaggctgtactgcaccacctcgccttcacgccagagttccagcaggtcggcgcccttcatccccggcaagaggcggtattcgccgctgtgcatggcctggcccggcaggttgaaacgccagtagaggcgcagccagaacgcgccatggagcaccttttcctgctccagacgcgcgagcatgccgcccggcgtggagcccgaggaaacgtccagcaggcgctcctcggtcaattgcaggggctgctccagcgcccgctgctgctgccatgcagccaggccgacgcagaggccaacgaacaacaggccactctccagcagcaccagcagtttgcgcatcaaagtcagaaatccaggtcgtcgcgaagttggtcttgcagtttacgggtcagctcgccgaccggccagacgtgctcgtccaatgcccggaccggccagatgccgaactggctgttgcacagaaagacctcgtcggccgtcgccagttcagccatggaaacatcccgtatcgccagcgggacgccgattccttcggcgcgctcgagcaattccgcgcgcatcactccagcgacgccgcagcgccgcaggtcaggcgccacgagggtgccgtcgagaaccagcagcaggttgctgaacacgccctccactacccgctcgtgcacgtccagcatgagcccttcggcatgcccggcgtcgctccactcggcacgggcgaggacctgctccaggcgattgaggtgcttgaggccggctagcaggggctgctcggccaggcgcgtgcggcaagcgaacaggcgcacgccttgctgccagtggcgctcgggatag

SEQ ID NO: 1887 - DNA, 867 bp, Pseudomonas aeruginosa
acagcgcttatgacagacccgagaaaggtaacgtcacattcagctcatgtacatcccaccattgaccggcacggtggccccggtcacataggctgcgccgtccgaagcgaggaagccgaccaccttggcgatctcttccgcctgccccaggcgacccagcggaatctggcccagcagcgcttcgcgctgggcttccggcagctcgcgggtcatgtcggtgtcgatgaagcccggcgccaccgcattcacggtaatggcacgcgaaccgacttcccgggccagcgcacgggtgaagccctccaggccggccttcgccgcggcatagttggtttgcccggcattgcccatggcgccgaccacggaaccgatgttgatgatgcgcccccagcgggccttggtcataccgcgcagaacggctttcgacagacggtagagactgttcaggttggtgttgaccacatcgaaccactcgtcgtctttcatgcgcaccagcagattatcgcgggtgatgccggcgttattgaccacgatcagcggttggccgagatgctgctggatgtgctccagggtcgcggctacggattcgtcgctggaaacgtccaggaccaggcccgcaccctcgacgccattggccttgagggtttcggcgatcttctcggcgccggacgcgctggtcgcggtgccgatgaccacggcacccaggcgccccagttccagcgcaatcgcctggccgatgccacggctggcgccggttaccaatgcgaccttaccttgcagactcatgggattctctcctttctctctctcaggccagggcggcgcgcgtggcggcgaacgcctcgacgccatccaggccatgggtattga

SEQ ID NO: 1888 - DNA, 201 bp, Pseudomonas aeruginosa
ttggtgcggacaaggattactcgtcggagcccttgtctactaccttacggccgcgatagaagccgtccggggatacgtggtggcgcaggtggacttcaccggtgctcttttccacggacagagcattggactcgagcgcatcgtgggaacgacgcatgtcacgagcggaacgagactttttgttctgctgaacagccatga

SEQ ID NO: 1889 - DNA, 606 bp, Pseudomonas aeruginosa
aatcggccgttcgccatggagaacctcatgcccgacctgatcctcgcctccagctccccctaccgacgcgaactcctgacccgcctgcgccttcccttcgaaagcgccagccccgatatcgacgaaagccatcgcgccggggaaagtgccgaggaactggtgcgccgcctttccgccagcaaggccgaagcgctggccggacgctatccgcaacacctggtgatcggctccgaccaggtcgccgtactcgacggcgacatcctcggcaagccgcacacccccgaacgcgccatccagcagctacgggacgccagcggcaagagcgtgaccttcctcaccggactggccctcctcaacagcgccagccgacgcatccaggtggcatgcgtgccgttcaccgtgcacttccgccacctcgacgagagccgcatccgccgctacgtcgaagcggaacgcccgctggactgcgccggcagcttcaaggcggaaggcctgggcgtcagcctgttccgctccaccgaaggagaggacgccaccagcctggtgggactgcccctgatccgcctggtcgacatgctcctcgaggaaggcgtcgaaatcccctga

SEQ ID NO: 1890 - DNA, 711 bp, Pseudomonas aeruginosa
agtccctggtcggcctgttcgcaggcaaggatcaacctgccgccaagcctgctgaaaccagcaagccggctgccgagcgccaaacccgccaggacgagcgtcgcaacggccgccagcagaaccgccgccgcgatggccgcgatggcaatcgccgcgacgaagagcgcaaaccgcgcgaggagcgtgcagagcgtcaaccgcgcgaagagcgcgccgaacgcccgaaccgcgaagagcgcagcgaacgccgccgcgaagagcgcgccgagcgtccggctcgcgaggagcgccagccgcgcgaaggccgtgaagagcgcgccgagcggacaccccgcgaagagcgccaaccgcgcgaaggccgcgaaggtcgcgaggaacgcagcgaacgccgccgcgaagagcgcgccgaacgcccggcccgcgaagagcgccaaccccgcgaaggccgtgaagaacgcgtcgaacgcccggcccgcgaagagcgccagccgcgcgaggatcgccaggctcgcgacgccgcggccctggaagccgaggcattgccgaacgacgagagcctggagcaggacgagcaggacgataccgatggcgagcgcccgcgccgccgctcccgcggccagcgtcgtcgcagcaaccgccgcgaacgccagcgcgaggtcagcggcgaggtggaaggcagcgaggcgaccgataatgccgccgcgccgctga

SEQ ID NO: 1891 - DNA, 636 bp, Pseudomonas aeruginosa
ccagagccgccgaacacgcacaatgaaaaagggatgccgccggcatccctttttcattctccagccgcaccctcagtagagattgggttcaggctccaattcgacgccgaaacgccgacggacgtcctcctggatacgctcggccaatgcccggacctgggcaccagtggcgccgccatggttgaccaggaccagcgcctgctgcgcgtgtacccccaccgggccatcgcggaaacccttccagccgcccttgtcgatgagccagcctgcagccagcttcagccgaccgtccgcctgcggatagccgaccagatccgggaaggcctgacgcaagcgttcggcctgcgccgcatccaccagcgggttcttgaagaagctgccggcattgcccaatacggcggggtcgggcagcttctcccggcgaatggcgcagattacccggcttacgtccctggccgtcggactggcgatgccctcctcctccaggcgctggcgtaccggcccgtagtccaggtgcagcctctcccgccgcgtcaggcgcaggcgcacgcggaggatcagccagcgatccggctcctgcttgaacaggctatcgcggtagccgaaacggcaggcctggcgatcgaactcacgtag

SEQ ID NO: 1892 - DNA, 477 bp, Pseudomonas aeruginosa
ccgcgcctttgcgcggccaggcgggtgcgctggtcaggtgccttgccgacatgccagccggcggtgccggcggaatcgacatggatacgggaggccagcccggcctcctcgaccttgcgccggaacacgccttcggcggtgggcgaccggcagatgttgcccaggcagacgaacaggacgcgcatcagccccccagcacgcggcgaacgcgttcgaggtcttccggcgtatccacgcccggaagcatggtttcgcgggcatcggccacatggattcgcaccccgtgccagagcgcgcgcaattgctcgaggctttcggcgttctccagccagcacggtccccaggcgacgaaatcggcaaggaaacccacgcgataggcgtagatgccgatgtggcgacgatagggcacgccctccggcaggctgtcgcgatcgcgggcgaaggcgtcgcgagcccagggcaagggcgcacgactga

SEQ ID NO: 1893 - DNA, 636 bp, Pseudomonas aeruginosa
tattgcctaccaccagcaccggcagcggtgcccggtaagcgggcttgcgcccggacaggaagtccgcccggcggccgttcgccacccgacgatagagagcctccagcggacgcagcagcgccagcgccggatgcccctggtaccaggcggcgagcagtcgctcggagaacgacatcagggcttggccgccgtgttctcgaccgtggtgatgcgcaggtggacgaagcccagcttgcccgctgcgtccatcgccgtgaccaccgactggtgggtggacttggcatcggcgctgatcaccaccggcaggttgttgtcgcccgccgattcacgctgcatcgccgccatcagggtggccaggtcgctcttggccagcgcctgcccgttcaaggcgtagtgcccctcggcatccaccgagagttccagttgcttctgctcggtgccggcggtttcgccgctctccgccgatggcagctcgatgttgagctgctcggggcgggtgaaggtggtactgaccacgaagaacagcagcaggacgaagatcacgtcgatcagcgacgccaggttgatgaagacgtcttcacgggcggcacccgcccgtctgcggcggaatttcacgctttgccttcctcgacgtag

SEQ ID NO: 1894 - DNA, 735 bp, Pseudomonas aeruginosa
agcaagacatgctttcgggtacgcaccagcacggccagcccctggccgacgtccagcacccgcacttccgcccgcccccattcgacaggcggcgatgacggcaacaatgccggcagtagcaacgcggcaccgagggcacgcaacggcaagccagccggcgccagccagcagagcgcgccgagcatgcccagcgctacgctccaggccgctgcggcgggtggctgccaggcctcggccaggcccgccagcaggccaagcgcacgaaacagcaggtccagcgaaacgccagcggcgcgaagcagcccctcgcccagcccgggcacccacagcagcaggctccccgccagggccgggggcactaccagcagttcgatccaaggcaccgccagcaggttggccggcgctccgctcaggctcaacggcaggcccagcgccagcagcggcatcgccagccccagcgccatcccccactgcgcccgcccccaggccgcccaccagcgccagcgcccaaggcgcccggcgaacagccagagcagcagggcaaccgccaggaacgacagccagaaccccgcctgcaggctggccagcggctcgaccagcaagaccagcaccagcgttgccagcagcggggtcagcaagcccaggtggcggaaacgcaggcgccagaccagcgccaggctgaccatcaggcaggcgcgccgcaccgggacctcgaaacccgccatcaacccgtag

SEQ ID NO: 1895 - DNA, 540 bp, Pseudomonas aeruginosa
tcgaaacccgccgcgttcaccaggccgcgggggcgtttcagggtcaccgccaggcgccagcgttcgccgcccatcagcggcggcgcgccgcgccagctcaggcgcaaacgctcgggaagaagcacgccccgcgcagcgcggacctcctccagccggaagcgcgtgacgccctcgccgctcgccggcagatcgaccacacgcccctccagccaaagggtgcgaccatccagctcggcggccaggcgtccgtccagggcgacttgcgccgagccgcaggcccaggcgaacccgagcaggaacaaccccagccagtacagccggccgaacagcagcaacagtccggcggcggccatgcccagcagccagccgaccgacggcaattccgccaggaagcgcagggccagcagccccgcggcgagggctggcaatcccaggcgcatgaacggttcctcccatccccgtggcgtgccctccgctccccgacatgtcacatggggtcatacaatgggcaacgaaatcctgtcatcttgcttggcataa

SEQ ID NO: 1896 - DNA, 564 bp, Pseudomonas aeruginosa
tacgcaagcctatatccaccgagagcccacatgccgcgtcgcctgttcaagcgctacatgcccgatccggaaagcatccgctcgcagaagtcgctgcgctttctcggcaagttgacgcacgatcccaacctttggcatctcaatcgccactcggtatcgcgcgccatggccgccgggctgttcgccgccttcatcccgatgccgatgcagatgctgctggcggccggtctggcggtgtggattcggagcaatctgccaatctccgtcggattggtctggctgaccaatccgatcacgatgcccccggtcttctattgcacctacaagctgggcgcctggttgatgcaggtgccgccgcgcaccctgccggaccatctcacctgggaatggatcagccaggagctgtccagcctctggcagcccttcctgctcggttcggtggtgtgcggcatcatcgccgccatcctcggctacgcgctgacgatgctctactggcgctggtgggtgcagcgcagttggagccgacgctgccggcaacgtcgcgaacgggtcgccgcgaagtga

SEQ ID NO: 1897 - DNA, 1320 bp, Pseudomonas aeruginosa
tccgccggacatgaaaaagccgcctcgaaggcggctttttcgtgggccttgtccgccccgtgctgggactggcgcaggccttctcgctcactcgtagcgcagcgactcggccggttgtgtccgcgccgcgcgccaggatgggtacagggtggcgaggaagctcatcagcaatgcagcgctgcagatcagcaccacgtccagcacctgcagatcggaaggcaggtagttgatgaagtacacatccgagctgaagaccttgtgtccgaccaaccgttcgatgcggtcgatcatcccggtgatgttcaacgccgcgaacaccccgagtaccccgccgatgaccgtcccgatcacgccgatgacggtgccctggaccatgaagatcgccatgatctgccgcggcgtggcgccgagggtacgaagaatcgcgatgtcggtgcgcttgtcggcgaccaccatgatcagggtggcgatgatgttgaaggcggcgaccgcgatgatcagcagcaggagcaggccgatcatggtcttttccatcttcatcgcgttgaacaggctgccctgggtcctggtccagtcgctggacctgaagccctgccccaactccttgaccaccttggcggcgacctgcggcgactggtagagatccttcagctccaggcgcacgctcggcacctggcccggttgcaggcgcagcaactggccggcatcggcgatgtcgatcagcgccagcgagttgtccagttcggcaccgaccttgaacagggcgacgatggtgaagcgctgcatgcgcggagtgatgccgcccggcgcgctggtggcttccgggacgatcagggtcagcttgtcgccgacattgacatggaagcgccgcgcggtgatctcgccgaggacgatgccgaactcgccaggcttgaggtcgtccaggctgccctggacgatgtgctcaccgacgatggaaaccttgcgctcctcctgcgggtcgatgccgttgaccagcaccggcagcatattgcccttgtacgacagcatgccctgcagttcggcgaacggcgccgcgccgaccacctcgcggtgccgaagcgccgcgttggcgacggtctgccagtcgtccagcggctgcgccgcgctgatggtggcatgcggcaccatgccgaggatccgcgtgcgcatttccttctggaagccgttcatcaccgagagcacgatgatcatcgccagcacgcccagcgccaggccgatcatcgaggtcagcgagatgaacgagatgtagtggttgcggcgtttggcgcgggtgtagcgcaggcctatgaagaacggtaa

SEQ ID NO: 1898 - DNA, 459 bp, Pseudomonas aeruginosa
cggtctgaacatgtcgcggatgcaccgagtcgatgggggattcgccggacgggagcggacggcgggcacgccgtcgccccgctacgcggcgatcagtcggccttcttccaggcgcaggatgcgatccatgtgcccggccagctggagatcgtgggttaccaccaggaacgaggtctgcaacgaacggctcagttccagcatcagctcctggataccctgggcggtatgctggtcgaggttgccggtgggctcgtcgagcagtaccagctgcggacggttgaccatcgcgcgggcgatcgccacccgctggcgctcgccgccggacagctcggccggcttgtgcgaacaggcgatgccccagcccgacccgctccagcagctcggccgcccgctggcgggcttccgcgatcggcgtgcggccgatcaacagcggcatgcagacgttctccagagcggtga

SEQ ID NO: 1899 - DNA, 717 bp, Pseudomonas aeruginosa
aagtcattgtcggtcagggtccgggcgatctcccaggccacccgcggcgcctggaacaggtcgtcgagcttcaggcgcagcccctgtacctggttggtcttccagcgctgcaggcgcgcggcgtcttccaggtggatcagcgacaggccgccatccagttcgccggcgccgacgcggaaggtgccgaccacggtgaaacgcttcatccgcgggaataccccggccggggtgaccgccacctcggggaggatcagggtgaccttatcgccgatgccgacgccgagcttctgcgccgccagttggccgatgacgatgccgaagccgccggccttgagttccgccagcgagccctgcttgaagaaatcgggaatgatcgagaccttggcctcttccagcggatcgaccgcatcgaccatcaccgtctgtaccgcgccattggcgctgagcatgccctgcatctgggtgaacggcgctaccgcggtgacatgctcgtgggccttgaccttctcggccagggcgcgccagtcatcgatgggctggtacgactcgacggtggcctgcggcaccatgccgaggatgcgggtacgcatttcgcgatcgaagccgttcatcaccgagagcaccacgatcatcaccagcacgcccagtgccaggccgatcatcgaggtcagcgaaatgaaggagacgaaatggctgcgacgtttggcccgcgtatag

SEQ ID NO: 1900 - DNA, 1173 bp, Pseudomonas aeruginosa
gcgacgcacagcgccagttgctggcccggcatatcctccagaagcaggcccagcagcgccgcctggcacgggccggacagggcccgctcggcgagccgggccaaccttcttcgacctgaaaccttcttcgacctgagatgtgccgatgctccgttcgctactgctgtgctccctcctcctcgccccgccgctgttcgccgacaccctgagcattccgctgggcgcccagggcgatacccgggtcgccctgcccgcgcacggcgaaagccgcgaagccgtgctgcaacgcttcggcctggccgacgaggaacatcccgcggtcggccagccgcccatcgtgcgctgggattaccgcgacttctcggtatatttcgaaagcggccgggtgctcgacagcgttcgccatcatcggccgcggaatcccgcgcaaccctcgaacaaggagccacagtgactctcatctatggacatcgcggcgccaagggcgaagcgccggaaaacaccctggccagcttccagcgctgcctggagcatggcgtcaaccgttgcgaactggacctgcacctgtcccgcgacggcgaactgatggtgatccacgacccgaccctgaagcgcaccaccggccgccgcggcaaggtcgccgaacacgacgcggccaccctggtcacctacgacgcgcgcaagggcggccccggctgggtacggccgacgccgatcccgcggctggaggagttgttcgagaagtgcccgttcgagcactggcaactggaagtgaagagcgcctcgcgcgaacgcgcggcgcggacggtaacgcggatcagggagctgaccgagcgcttcggcaaccgcgacaaggtcaccgtcaccagcggttcgcggaccgtgctcaaggccctcaacgaactgaccccagagctgtcgcgcgggctggtcgccgaatacgcctggctcgacccgctgaaggtcgcccagcactatggctgtgccctgctcgccctgaactggaccctatgcaccccggaacgcctgctcaaggcccagcgccaggggcttcacgtctcggtgtggacggtcaacgaaccggcgctgatgcgccggctcgccgacttcggcgtggacagcctgatcacagactttcccggtttggccagcgccaccctcgggaatcgctga

SEQ ID NO: 1901 - DNA, 1779 bp, Pseudomonas aeruginosa
gcacatcccctccggccggctcaggccgccggccggagtccttcaaaaaagccggttgaggccgtcgaacgccgctacccgataggcttccgccatggtcgggtagttgaaggtggtgttgacgaagtacttcagggtattcagctcgcccggctggttcatgatcgcctgaccgatgtggacgatttccgaagcctggtcgccgaagcagtgcacgccgagaatctccagggtctcgcgatggaacaggatcttcagcatgcccaccggctcgttggaaatctgcgcccgggccatgcccttgaagaacgccttgcccacttcgtagggaatcttcgccgcggtcagttcgctttcgttcttgccgatcgagctgatctccggaatggtgtagatgccggtcggcacatcgttgacgaagcgccagctgtcgctctcgacgatgttgccggcggccgagcggccctggtcgtaggcagcgctggccaggctcggccagccgatcacgtcgccggcggcgaagatgttgctcaccgaagtgcggtagttctcgtccacctcgatctggccacggctgttgaccttgatgccgacgttctccaggccgagcttgtcggtgttgccggtccggccgttgcaccagagcagcgcgtccgccttgatcttcttgcccgacttcaggtgcaggatgacaccgttgtccagcccctcgacgcgctcgtactcctcgttgtggcggatcagcacgttgttgttgcgcaggtggtagctcagcgcatcggaaatctcgtcatcgaggaagctgagcaactggtcgcgcgtatcgatcaggtccaccagcacgcccaggccgctgaagatcgacgcgtattcgcagccgatcaccccggctccgtagatgatcagccggcgcggggtgtggctcagggacaggatggtgtcgctgtcgtagacccgcgggtggttgaaattgatgtccgaaggacgatacgggcgcgagccggtggcgatcacgaactggtcggcgaccaggcgctccaccgcgccgctcggcgtcaccacttcgacggtgcgttcgtcgacgaagctggcggtgccggtgaacatgtcgatgcgattgcgcgcgtagtagccggtacgcgaagcgacctgcttggagatcacccggtcggcgctcttcagcacgtcggggaaggagaaccagcgcggctcgccgatctggcggaacatcgggttggtgttgaactcgatgatctgcttcaccgagtggcgcagggccttggaaggaatggtgccgaggtgcgtgcagttgcctccgaccacgcgacggctgtcgactaccgccagcttgcgtccgtacttggaggcgttcatcgccgccccttcgcccgccggacccgtgcccaaaatcaccacgtcgtagttgtagacagccatgcgtactcctcagaacaggccgaggcgcccactggcgcctccggcaaagccgctgcacaacatgtgcgcggcggatcgattcgatcatcgggtcggtgcgaacgacggcattcgccgggcaaggctcggtccgacctcgaggcgggcatatgttacgccctgtgcgaaatgtcgcacattagcgtttggtcgcgtcgtaggcgagttttccgggcactacagattcgtcgcggttggcttcctcgcatttctgccggtcgccgccgcagatcgagcattccttctcgatccccaggttggcgatgccgccgcaggaaccggcgatcggcttgcggcccatga

SEQ ID NO: 1902 - DNA, 1095 bp, Pseudomonas aeruginosa
cgaagaccagtagccaggtcatggacgttctccttggttgccgaacagttgctcgtagcgtggcgtggtgcggctgtcgaaaccgttgccctggcgactgacgaacagcgccgccagtcggtgcttctcggcgaaacggtagccctcctccggaccgagcaccatcagcagggtcgacaggccgtcggcgttgcgcgtcgacggatcgatcaccgtgaccgaagccaggtgatggtcgatcggcgcgccggtgcgcgggtcgaaggtgtgcgaatagcgctggccgttctcttcgaaatagttgcggtaatcgcccgaggtcgagacgccgtagccgtccagcgccagtacctgctgggcgacccgctggccctcgcgcggcgcttcgatagcgatgcgccagggcgtgccgtccggcttgcgcccttcggctttcaactcgccggtgatttccgccaggtagctgcgcacgccgagctccttcaggcgttcgcctaccgcgtccaccgtatagccagcggcgatgctgtcgaagtccagctgtacggcggcgtccttgcacaggcgctggccgtcgatgcgcaggtgtcgatggccgacgtcacggcgcaccgcggcgatctgctcggcgctgggaaccttctccacccgcgcctgcggaccgaagccccagaggttcatcagcggctcgacggtcatgtcgaaggcgccctggctctgttccgacaactcgccgccgtagcgcagcaactccagcatcggtggcggcagctccatgcaggactgcgccggcagcgcattgaaacgcgagaccagggaatcgtcgcggtaggtggacatctgccggtcgacctcggcgaggatcgcctccaccgcggctttcgccgtctggacgtcgggcgccgaggcgccgcgcacgtacttgatcgaataggtgctgcccatggtcgggccgccgaagctttccagggtgtcgccgcaaccggccaggaccagcgccagcgctgccagtccggccatggcaagcggacggaaacgctcagccaccgaaatcgtccagcaggatattctcgcgctccacgcccaggtcggtga

SEQ ID NO: 1903 - DNA, 1587 bp, Pseudomonas aeruginosa
aaaacgggagcccgagagctcccgttttcctctacgccttgcgcatcaacgcgggaaggccggcgggttgaccccagccatgtcttccatcacgcgcactacctggcagctgtagccgaactcgttgtcgtaccacacgtacaggacgacacggttgtcgttgcagatggtcgcctcggcgtccaccacgccggcatggcgcgaaccgacgaagtcggtggaaaccacttcctgggagctgacgaagtcgatctgcttctgcaggtccgagtgcatggccatctggcgcaggtactcgttgatctcttcgcgggtggtggccttttccaggttcaggttgaggatcgccatggacacgttcggcgtcggcacgcggatcgcattgccggtcagcttgcctttcagcaccggcagggccttggccgcggcggtggcggcaccggtctcggtgatcaccatgttcagcggcgcgctgcggccacgacgactgcccttgtggaagttgtcgatcaggttctggtcgttggtgtacgagtgaacggtctcgacgtgaccgttgacgatgccgtactggtcgttgacggccttcagcaccggcacgatggcgttggtggtgcaggaggcggccgagatgatcttgtcgtcggcgccgatgtcggtgtggttgataccgtgcacgatgttcttcagcgcacccttgcccggagcggtaaggaccacgcgatcgatccccgggcacttcaggtgctggccgaggccttcggcgtcgcgccacttgccggtgttgtcgaccagcagggcgttcttgatgccgtactgggtgtagtcgatcgacgctggatcgttggagtagatcacctggatcaggttgccgttggcggtcagcgtgttgttttcttcgtcgatggtgatggtgccgtcgaacggaccgtgcaccgagtcccgacgcagcaggctggcccgcttgaccaggtcgttctcggcacccttgcgcacgacgatcgcgcgcaggcgcaggccgtcgccgccgccggtcttctcgatcaggatgcgcgccagcaggcggccgatgcggccgaagccgtagagcacgacgtcggtgccttcgcgggcatcgccgttctgcttgccgaccacctcggccagctcggccttgacgaagtcctcgatgctgcggccgttaccttctgccttgaacttggcgaccatcttgcccagatcgacggaagcggcgcccagcttgagctcgctcatcgccttgaggatcgggaacgtctcgtgaaccgacagctcggcgtcatcagccatgcgatgacgggcgaaacgatgcgccttcatgatcgcgatcaccgagcggttgatcagaccacggccatggatcgaggtcaccacattgttattgcggtagagctggccaatcagcgggatcatggcttccgcgatggcttcacgatcgatccattcaccgagacactggtcgggcttctgagtcacgggcaataccttccacatgtaggggatgaaaaaaggggctacattatgaccgcgccggccaggctcggcaatctgcagcagtcggaagactga

SEQ ID NO: 1904 - DNA, 954 bp, Pseudomonas aeruginosa
catccagcagtcgggaaagttacaatccggcgggtcaaattcccgaccggagcccagcttgcccgtgtccgtactgcgtcttcccagcctgccggccagcgccggcaagcaacactggggcaacctccccggtgccgcgctgagcctggctgtcgccgaggccgccagttccgccaagcgcttcaccctgctgctgaccgccgacagccagaatgccgaacgcctggaacaggaactgcggttcttcgcccccgacctgccggtattgcatttccccgattgggaaaccctgccctacgacgtcttttcgccgcaccaggacatcatttcccagcgcatcgccgccctctaccagttgccgcagctcaagcacggcgtgctggtggtgccgatctccaccgccttgcaccgcctggcgccgacccgcttcctgctcggcagcagcctggtcctcgacgtcggccagaaactcgacgtcgagcggatgcgcctgcgcctggaaggcgccggctaccgctgcgtcgacacggtctacgagcacggcgagttcgccgtccgcggcgcgctgatcgacctgttcccgatgggcagcgagttgcccttccgtatcgacctgttcgacgacgagatcgagaccctgcgcaccttcgacccggagacccagcgctccatcgacaaggtcgagtcgatccgcctgctgccggcacgcgaattccccctgaacaaggaagcggtcaccggcttccgcggccgcttccgcgagcgcttcgacgtcgactaccggcgctgcccgatctaccaggacctcgccagcggtttgacaccctcgggaatcgagtactacctgccgctgttcttcgaggaaaccgcgaccctcttcgactacctgccgcaagacacccaggtgttctccctgcccggcatcgaacaggccgcggagcagttctggaatga

SEQ ID NO: 1905 - DNA, 1056 bp, Pseudomonas aeruginosa
cgtacgcagccgctacgaggaccgccgggtcgatccggaacggccattgctgccgccggcggaagtgttccttccggtggaagactgcttcgcccggctgaagaactggccacgggtggtcgccagccaggaggacgtcgagccgggcgtcgggcgcgagcgcttcccggccctgccgctgccgaacctggcgatcgaagccaagaccgccgagccgctggccgcgctgcgccggttcatcgaggagttccccggccgcgtactgttctgcgccgaatcggccggacgccgggaagtcctgctggagctgctggcccgactgaagctgcgccccgaggaagtcgacggctggccggccttcctcgccagccaggcacgcctggcgatcagcatcgcgccgctggacgagggcctgctgctggaccatccggccctcgccctggtcgccgaaagcccgctgttcggccagcgcgtcatgcagcgccggcgccgggaaaagacccgcgacggcggcgacgcggtgatcaagaacctcaccgagctgcgcgaaggcgcgccggtggtgcacatcgaccatggcgtcggccgctacctgggcctgatcaccctcgaggtggacaaccagcaggcggaattcctcatgctgcaatacgccgaggacgccaagctctacgtgccggtcgccaacctgcacctgatcgcccgctacaccggcgccgacgacgccctggcgccgttgcaccggctcggctcggaaacctggcagaaggccaagcgcaaggccgccgagcaggtccgcgacgtcgccgccgagctgctcgacatctacgcccgccgcgccgcccgcgaaggcttcgcgttcaaggatccgcaggccgactacgcgaccttctcggccggcttcccgttcgaggagacgccggaccagcaaagcgccatcgaggcggtggtcgccgatatgctcgcgcccaggcccatggaccgcctggtctgcggcgacgtcggcttcggcaagaccgaagtggcgatgcgcgcggcgttcgtcgccgtgcatag

SEQ ID NO: 1906 - DNA, 1164 bp, Pseudomonas aeruginosa
cggcaagcaggtggcggtgctggtgcccaccaccctgctcgcccagcagcactacaacagcttccgcgaccgcttcgccgactggccggtgagcgtcgaggtgatgagccgcttcaagagcgccaaggaagtcgagaacgctgcgcggctactggccgaaggcaagatcgacatcctcatcgggacccacaagctgctccaggaagacgtgaagttcgccaacctggggttggtcgtgatcgacgaggaacaccgcttcggggtgcgccagaaggagcagctcaaggccctgcgcagcgaagtggacatcctcaccctcaccgccacgccgatcccgcggaccctgaacatggccgtctccggcatgcgcgacctgtccatcatcgccacgccgccggcgcgccgcctgtcggtgcgcaccttcgtcatggagcagcagaacgcggtgatcaaggaagcgctgctccgcgaactgctgcgcggcggccaggtgtactatctgcacaacgaagtgaagaccatcgagaagtgcgcccgcgacctagccgaactggtcccggaggcgcgcatcggcatcggccacggacagatgcacgagcgcgagctggaacaggtgatgagcgacttctaccacaagcgcttcaacgtgctggtggcctcgaccatcatcgagaccggcatcgacgtgcccagcgccaacaccatcctcatcgagcgcgccgacaagttcggcctggcccagttgcaccagttgcgcggccgcgtcggtcgcagccaccaccaggcctacgcctacctgctgacaccgccgcgccgtcagatgacgccggacgccgagaaacgcctggaagccatcgccaaacgcccaggacctgggcgccgggttccttcctcgccacccacgacttggagatccgcggcgcccggcgagttgctcggcgacggccagagcgggcagatccaggcggtcggcttcaccctctacatggaaatgctcgaacgggcggtgaagcccatccgcaagggcgagcaaccgaacctcgagcagccactgggcggcgggccggaggtcaacctgcgggtgcctgcgctgatccccgaggattacctgcccgacgtgcatgcccggctgatcctttacaagcgcatcgccaacgcccctga

SEQ ID NO: 1907 - DNA, 291 bp, Pseudomonas aeruginosa
gtcccggggcggtaccgcgcgcctgccaatggagccggcctggcgcatggagttccgcccggagcacagagaaaggagaaaggaaaacggcgccctggggcgccgtctgcgatcaggccttggcgggcgtcttgttccgcgggcgcagttgcgccccggccagcagcggatcgtcgatgccgctctcggcgcgcatgccggcagcgaagaacggcaccatcaggtgcatcacctgctcggtggaagtgttcacgccgaaatcggtttccgccatcgcccgcagggccttga

SEQ ID NO: 1908 - DNA, 576 bp, Pseudomonas aeruginosa
gttcgctccgatcgaagtcgatctgaaggagcaggaactgatcatcgaaggcttgagcgtcggcgtgatccggcgctgacaggagataccatgcagacctcccactcgctgcccagcgcccagttgccactgttccaggaagcgttctgggccagcaacggcgcacccttgctcgacgatgtcatcgacagcccttccagcgcctccatcgaggaacccgctgcctttagcgaactttcgctcagcggcctgccggggcactgcctgaccctgctcgcaccgattctccgcgagctcagcgaggaacaggatgcccgctggctgaccctgatcgctccgccggcgagcctgacccatgaatggctgcgccgcgccggcctgaaccgcgagcgcatcctgctactgcaggcgaaggacaacgccgctgccctggcgctcagttgcgaggccttgcgcctgggccgcagccacaccgtggtcagttggctggaaccgctgagccgggcggcgcgcaagcaactgtcccgcgccgcccaactgggccaagcacagagcctgaatattcgtctgggttga

SEQ ID NO: 1909 - DNA, 3546 bp, Pseudomonas aeruginosa
gcaaacccgcgctcccggggcgtcattcgctcgatacagccggaaacgactgacactgaaaaacgaaagccggggcacgaggccccggctttccccttcgacgaacgcttagatgcgctcgaagacggtggtgataccctgtcccaggcccacgcacatggtggacacgccaagggtaccgccgttctgcttcatcacgttcaacagggtgccggaaatgcgcgcaccggagcaaccgaacgggtgacccagggcgatggcgccgccgtggaggttgaccttctcgtccatcttgtcgagcagcttgaggtccttcagcacaggcagggcctgggcggcgaaggcttcgttgagttcgacgaaatcgatgtcggcgatggtcaggccggcacgcttgagcgccttgttggtcgacggcaccgggccgtagcccatgatcgccgggtcgacacccgccacggccatggagcggatcaccgccatcggctggatgcccaggtcctgggcgcgctgggccgacatcacgatcatgcaggaggcaccgtcggtgatctgcgaggaggtccccgcggtcacggtgccgcctttcggattgaacgccggcttcaactcggccagggtctcgacggtggtttccggacgaatggtctcgtcgaagtcgaagactttcaggaaaccgttctcgtcatacccttccatcgggatgatctcgtccttgaacttgccttcctgggtggccttccaggccagttggtgcgaacgcgcgccgaacttgtcctgcgcctcacggctgataccgtgcatcttgccgagcatttccgcagtcaggcccatcatgcccgaggccttggcggcgtacagggacaggtgcgggttcgggtcgacgccatgcatcatgccgacgtggcccatgtgctccacgccgccgatgacgaatacatcgccattgccggtctggatcgcctgggcggcggtgtgcagcgcgctcatcgacgaaccgcacaggcggctgacggtctgcgcggcgctggtgtgcgggatctgggtcatcagcgacgccatgcgcgcgatgttccagccctgctccagggtctggttgacgcagccccagatcacgtcttccacttcggccgggtcgaccttcgggttacgctccagcagcttgctgatcaggtgcgccgacatggtctcggcgcgggtgttgcggtgcatgccacccttggaacgacccatcggggtgcggccgaagtcgacaatgacgacgtctctcggattcaggctcataaattcactctcgctctagtcgttccgcgattaaccgaagaatttctgaccgttcttggccatttcacgcagcttcgcggtcgggtggtacagcgcgcccagctcggcgtacttgtcggccagggccacgaactcggcgacaccgatcgaatcgatgtagcgcagagcaccaccacggaagggcgggaagccgatgccgtagatcaggcccatatcggcctcggcagcggtctcgacgatgccgtcttccaggcaacgcacggtttccaggcacagcgggatcatcatgaagttgacgatgtcctcgtcggtcacttcgcgctgctcgaccacgatcggcttgagcacttcgtaggcctgcggatcggtgaccttcttcggcttgccgcgcttgtcggtctcgtaagcgtagaagcccttgccgttcttctggcccaggcggttggcctcgtacatcacgtcgacggcggtcttgccctcgaccgccatgcggtccgggaagccctcggccatgacgtcgcggccatggtggccggtgtcgatgccgaccacgtcggacaggtaggccgggcccatgggccagccgaacttctccatcaccttgtcgatgcgcacgaagtcgacgccgaagctcagcagcttggcgaagccgccgaagtacgggaacagcacacggttgaccaggaagccggggcaatcgttgaccacgatcgggctcttgcccatcttcttggcgtaggcgacggtggtggcgatggcggtttcaccggtcttctcgccacggatcacttccaccagcggcatcatgtgcaccgggttgaagaaatgcatgccgcagaagttttccggacgcttcagcgcctgggccagcaggctgatggagatggtcgaggtgttggaggcgatgatcgcgtcttccttcaccgcgccttccacttcggcgagcacggcttgcttgaccttggggttctcgacgacggcttcgacgacgatgtcgacgttgccgaagtcgccataggacatggtcggacggatgccattgagcgcctcggccatcttcgccggggtcaggcgacccttctcgacgcgcttgccgagcagcttggcggcctcgttcaggcccatctggataccctcttcgcggatatccttcatcaggatcggggtgcccttgagcgccgactgataggcgatgccgccgcccatgatgccggcgccgagcacggcggccagtttcacgtccttggcgacttcgtcgtatttcttggctttcttcttcagttcctggtcattcaggaacaggccgatcagactctgcgcgaccgaggtcttggccagcttgacgaagccggcggcttcgacttccagcgccttgtcgcggccgaagttggcggccttctggatgctcttgatggcttccaccggcgccgggtagttcggaccggcctggccggcgacgaagcccttggcggtttcgaaggccatcatctgctcgattgcattcagcttcagcttttccagcttcggctggcgccgtgccttgtggtccagctcgccggcgacggcgcgcttggccaggtcgagggcagcggcctgcagttgctcgggagcgaccacggcgtcgacggcgccgaccttcagggcgtcctcggccttgttttccttgcccgaggcgatccactcgacggcgttatcgcagccgatcaggcgcggcaggcggacggtgccgccgaagcccgggtagatgcccagcttgacttccggcaggccgaccttggcggtcgcgctcatcacgcggaagtctgcggccaggcacatctccaggccgccgccgagggcgatgccgttgatcgcggcaacggtgggtacgtccaggtcttcgaagtcgctgaagatcttgttggcttcgaggttgcccgccatcagttcctcgtcgggcagctggaagttgtcaacgaactcggtgatgtcggcaccaacgatgaacacgtccttgccgctggtcacgatcacgcccttgaccgatgcatcggccttgatcgcatcgactgccgcacgcaactcactgagggtgagacggttgaacttgttgacggactcgcccttgagatcgaaattcaactcgacgatgccgccctcaagaggcttaaccgtgatggctttaccttggtaaatcatcaactgatctccacgctattatggaagcttgaacttacacatcggacgccgtgtcgggaccctttcggcaaccgccgagcatag

SEQ ID NO: 1910 - DNA, 2169 bp, Pseudomonas aeruginosa
tgcagctcactttttcgagatggatcagtcttccagttcggcccagcgctcgagcaaggcatcgagttcctgctgcaacgcgtccagccgcgccagggtttcgcgctgctcgtcctgcgggcgcagatagaaatcctgctgcgcgatggtttcctggacacccgccagctccgcctcgaccgcgtcgatctgcccgggcaaagcctccagctcgcgctgcaacttgtagctgagctttttcttcgccggcgcctcgctcggcgccgcagcagccggcgcgggttcggcggcgggcgccagcgcggtattcagctcggccttgccgctcttcgactcgctcacgccgagcaggcgcggcgtgcccccttggcgcagccagtcctggtagccaccgacgaattcgcgaaccttgccctcgccctcgaagaccagggtgctggtcaccacgttgtcgaggaaggcccgatcgtggctgaccatcagcacggtgccctggaagccgagcaggacttcctccagcagttccagggtttccacgtcgaggtcgttggtcggttcgtcgagcaccagcaggttggccggcttgctgaacagcttggccagcaacaggcgcgcgcgctcgccgccggacaacgccttcaccggggtgcgggcgcgctgcggactgaacaggaagtcgccgagatagctgagcacatgccggttctggccgtcgatggtgatgaactcgcggccttcggagatattgtcgatcaccgtctgctcgggttcgagctgatggcgcaactggtcgaagtaggccacttccagcttggtgcccacctcgatcttgcccgaggtcggctgcaggtcgccaagcagcagcttgagcaaggtggtcttgccggtaccgttggcgccgagcaggccgatacggtcgccgcgctgcaggaccatggagaagtcgcgtaccagcggctggccgccgggatgggcgaagctgacgtgctccaccacgatcacctgcttgccggacttgtccgcgctttccagctggaagctggccttgccctggcgctcgcggcgctcggcgcgttcgcgacgcatttccttcagtgcccgaacccgcccttcgttgcgcgtgcggcgggccttgatgccctggcggatccacacttcttcctgggccaggcgcttgtcgaacaatgcgttggcagcttcttcggcggccagttgctgttccttgtgcaccaggaaactggcgtagtcgccgttccagtcgatcaggtggccacgatccagctcgaggatgcgggtcgccagggattgcaggaaggcgcggtcgtgggtaatgaacagcaccgcgccgttgaagcccagcagcgcttcctcgagccaggcgatggcgccgatgtccaggtggttggtcggttcgtcgagcagcagcaggtccggctcggcgaccagcgcctgggccagcagcacgcgccgacgccagccgccggagagttcggcgagggtcttgtcggccggcaactgcaggcggctgagggtgctgtccaccagttgctgcaggcgccagccatcgcgcgcctcgagttcctgctggacccgcgagaggcgcgccaggtcatcgtcggtatggatgttcaggctcaggtggtggtactcggcgagcagcttgccgacttccgccagaccctcggccaccacgtcgaacactgtccgttcgtcggcacgcggcagttcctggggcaattcgccgatcttcagcgccggtgcgcgccagacttcgccgtcgtcggcctgctgttcgcccttgaccaccttgaacaggctggacttgccggtaccgttgcgcccgatcacgcagacccgctcgccacggccgatctgccacgacaccttgtccagcaagggagtggtgccaaaggcaagggatacatcggtgaacttgagcagggtcatgggcgcctccggaaacagggcgcgcattttacgccggataggcatcggatggcacggcgctttcaccgccatgccgcaacggctaagcttaggcaagccatccgcccggcttcgggcgcgccccgcgacagcggtcgcgcgccagtcccgcgagcggtcgaaacgcccgtaggcagccgttgcggacctgccgacgttacccgacatcacctgcccggataa

SEQ ID NO: 1911 - DNA, 1932 bp, Pseudomonas aeruginosa
gtcatgcgcggtcgcctgttcactctcgtttcctgccttttgctcagtatttcctccgtcgacgcggtccacgccgcttccctgaccgaacaacgccgtctctacgaccaggccaaggccgccctggccaagggcaacagcgcgccctacatggcctcgcgcagcgccctgcgcgattacccgctggaaccctacctggcctacgacgaactgacccaccggctgaagtccgccagcaacgaggaggtcgagcgcttcctcaccgaacacggcgacctgccgcagatcggctggctgaaactgcgctggctgcgcctgctggccgaccgcggcgactggaagaccttcgtcaactactacgatccgaagctgaacttcaccgaactcgactgcctgtatggccagtaccagctgggccacggccagaaggccgaaggctacgccaccagcgaacgcctgtggctggtcggcaagtcgcagccggctgcctgcgacaccctgttcggcctctggcagggcgaaggccagctcaccgaggaaaaggtctggaaacgcctcaagctggccgccgaagcgcgcaactacagcctcgcctcgcacctcgcgcagcgcctgccgaccctcggcaaccagggcgcgctgatggtcagcgtggcgcagaaccccgcccagctgagccagaccggccgcttcagccagcgcgaccatgccaccgccgacgtggtcggtctcggcctgcgccgcctggcgcggcaggacccggaaaaggccctgagcctgctcgactactacagctcggcgctacccttctccagcgacgagaaggtcgccatcgcccgcgagatcggtctcagcctggccaagcgcttcgatccgcgtgcactgccgctgatgacccagtacgatcccggcctgcgcgacaataccgtcaccgaatggcgcacccgcctgctgctgcgcctgggccgctgggacgaagcctacgcgctgacccgcaagctgccccaggatctcgccgccaccagccgctggcgctattggcaggcacgcagcctgcaactggcacagccgaacagcaaggagccgatcgcgctgtaccagaagctcgccggcgagcgcgacttctatggcttcctcgccgccgaccgcctgagcgtgccgtacaagctcggcaaccgtcctgcgcacatcgacccgcgcgtcctgcaacgcgtacgcaacgccgccagtacgcgccgggccatggagttcttcaaccgtggcgaagtgatcaacgcccgccgcgagtggtaccacgccgcgcgcctgttcgatcgcgacgagctgatcgcccaggccaggctggcctacgacatgcagtggtatttcccggcgatccgctcgatcagccaggcgcagtactgggacgacctggacatccgcttcccgatggcgcaccgcgccaccctggtgcgcgaagcgaagaaccgcggcctgcactccagttggatcttcgccatcacccggcaggaaagcgcgttcatgtccgatgcccgttccggagtcggcgccaccgggctgatgcagctgatgcccggcaccgccaaggagacctcgcgcaagttcggcatcccgctggcctcgacccagcaactgatcgtgcccgacgtcaacatccgcctcggcgccgcctacctgagccaggtgcatggccagttcaacggcaaccgggtactcgcctcggccgcctacaacgccggtccgggccgcgtccgccagtggctgaaagatacccgccacctggccttcgacgtgtggatcgagaccattccgttcgacgagactcgccagtacgtgcagaacgtgctgtcctatgcggtgatctacgggcagaagctcaatgcgccgcagcccatcgtcgactggcacgaacgctacttcgacgatttctga

SEQ ID NO: 1912 - DNA, 1977 bp, Pseudomonas aeruginosa
gcaccggttgcgtcgacgccaagctctgatcgccggcaatggccgcccgccgcaacggcgggcgaccgttcctcagtcgaggatttccaccggcatccccacctccaggctgccctgtcccagcgcaatcaggttctgcccgaacagcaccgcgccatccttttcccggtaggtcttcagggtcgtcagcggctcgcggtcctcgttgcgctcgccggtcgccggatccagggtggtgaggatgcagcgggaacagggcttggccacgacgaactcgaccgagccgatgcggatgcgtttccagccgtcctcggcgaacgcggcgctgccttccaccaccaggttgggacggaagcgcagcatctccaacggccggccgacccgctggctgaggtcgtcgagcgaagcctggccgatcagcagcagcgggaaaccgtcggcgaaatgcaccttctgccccggttcggcgtagccggtatcgacctgccgcgcgcgcgcctcgggaatgtgcaccaggcgcgtcgggcggccgaggaagcgcgtcagccagtccgctgcggcgtcgccggcatccggcgcctgcaaggtatcgcgccagaccgtgacgccacgcaggttggcgtcggctgccggtacttcgaggctcagctcggacatccccggcgcattcagccgcaggacctccggcgccgcccagcgcgcctggatacgccccagctgcggcagcaggcgctgggtgaagaaacgtccggtttcggtgtccaccgccatccagcgtcggtcgccgaccacgcccagcgcatcgagcgcgacgcgctccagggactcggcggcggaagacttgatcggatagcggtacagcgcggagagacggaacatggaaccagcatccttggtggaaagatgctgttatacggtgtcgcgggaaaggccgacaagacacagacgccactccaggcagcggatcagtcggccccgccctcagtcctcgcgcggcggctcgcgcaacaacggcgaaccggccggcaagtgcacgcgcagcgcgcccggggaaaccgagaaacgcagcttgcgtccttccagcggctcgccgtcgagattgacgtcgagaccttccgccgcctccacttccagccatggcacccgcgcgcggacgaacaggctttccactccgttgccaccgccgagcagggtgcccagggtaccgaccatgtcctgcggcgtcggcaggatgctcacgtccagcaggccgtcgtccactcgcgcttgcggacacagtacgtgcccgccgccggcctggcgcccgttaccgatgcccagggcgaggaactcgccttcccactggaagtccggggcgctgaaacggccctgggcggcatgcacttcggaaaaacgggtcaacccggtcaacaggtaggcggcaccgccgagaaccttcttcaggtcctccgaggtattcgccgtgaccttcgaaccgaagccgccagtggccatgttgaggaacagcttgccgttcacctcgcccaggtcgatcggccgcgccgtctggtcgagcagcgccagcgccgcggccggttccaggggaatcccggcggcgcgggcgaaatcgttggcggtgcccagcggcaggatcgccaggctcgcctcgcctcgcccgcgcgccagcgcttcggccacctcgcgcagcgtgccgtcgccaccgccggcgaccagcgtcgcatagccggccgccagcgcctcctcgacgatgcgccgggcgtcgccgtcctcccaggttactcgcaccgccagcgcccgtccggcctcgcgctgcgccgcgaccgcggcacgaacctcttcgttgcccgcctgcttgccatgcaggaccagcagaaccttgtccttgtccatcgaaccgaacccctcgtcgtggccttgtctttgcctattgaccgcgtatccgggacggaagtgcggcgcccggttcaggcagggtag

SEQ ID NO: 1913 - DNA, 471 bp, Pseudomonas aeruginosa
atgcctcgccgccgtcgtgacgcgcctcggccagcacccgcagcaccaggcgcgcatcgtcggtcaccgcatcgaagaatcgcgtgccgccgagcagccgttgttccttcaggcccggcgccaggtagcgcaacgcggcggcgtcgtagaaacggtggttgcgccgcccggcaagggcgtcgtacacgctcagcaggccgccgaatagccgcgggccgggaaagccgccgcggtagtgggccatcacgaagctcaacggctccaccagcccaggcgcctcgccgagcaggcgctggcgctcgcgcaccgagtcgcgggtcagccgccactggcccttcgcgatgtagcgcaggccgccatggaccatcttcgacgagcggctcgaggtgccccaggcgaagtcccgctgctccagcagcaggcagcgccagccgcgccgcgcggcttcgcggaggatgccggcaccgctga

SEQ ID NO: 1914 - DNA, 1908 bp, Pseudomonas aeruginosa
tgccgccgccgaccacgatcaggtcccactcctgccccgccagcgccggcaggcggcggcgacgccactcctcgttccaggctgaagtcattccgctcagtcctgcagcagggtgccgcggttgagccgcccggccgggtcgaagtgaccggccatggcacgcagcgcggcgacgcccagttcgcccttctcgcggggcaggtagggtgcgtggtccttgccgacgccatgctggtggctgatggtgccgcgattgtcgacgatcgcctggctggccgcatgcttgagacgcttccagcgctccagcgtcgccgcatagctcgcggccggacggaacacgtaggtggtatagatgctcgacccctcgccatagacatgcgagaggtgggtgaacacatggaccctctcgccctcggccgccaggccgtcgcgcaggctggcctcgatcttctgcagcaggccgtcgacgttgctccagtcggtggcggtctccagggtgtccacggcgtagcccgcctgccacagggcctcgcgcaggtaggggaagcggaagcggttctgcgcccacttgcgccccagcagggttccggtgaagaccccgccgaagcgtttcagcaaggccttcgcctggctcagcgacaatccgttctgccggcggttgccggtcacgccgaaggtcagcatgcacttgccctcgcccgcgccgcgcagcgccaggtatttctccagccaggcgatctgtccgggatggccggccagggccagttgggtcatggtttccacggcgttggacagtcgcagcatcgacagcggcacgcgcgcctgtgccagctcgcgggtggcttgcagggcctgctgccagttcggcaggaagacgctgtagaagcgctcgtcctcggccagcggcgagacccgcaccttcaccgaggaaatgatcccgaagcgtccctcagagcccagcaccagttcgcgcaggtccggtcccgccgcggatgccgggaaggtagcgatttcaagcggcccggcgaaggtctccagggtcccgccggcgaaaagttgttcgatccgcccgtagcgcagcgactgctggccactggagcggctggcgacccagccaccgagggtcgacaactcccaggactgcgggaaatgcccgagcgtgtagcccagcgcacgcaactggctctccacctgcgggccggcggcgccggggccgaaggtcgcgaccaggctctcgcggtccagatcgatcaggcggttcatgcgctccagcgagaccgtcagtaccggccgccgcgaggcttgcggattgatatggccggccacggaagtaccgccgccatagggaatcagttgcaggtcgcgggagtcggccagggccagcaactcgcggatctgttcggcggtttccggataggccacggcgtccgggtagacgccgaagtcgccctcgcgcatcgccagccagtccggcaggctctgcccgcgggcatgcagcagacgctcacgggggtcgatgctgtagcgcggatcggcctccaggcgcgacgccgggaccttcgccagcgccgcctccaggctggcgtccggcaagcgtgcgccctgcccgaccagttccgccaggaacccacgggcgctgtccggcaattcgaccacggtgctttcttcgccccagccattccaacggcgcatgaacctctcccctcgcttgtcgcggcaacctgtttatcggaacctttctggctgcctatactagccagccgccctcgcctgtcactgtcggatcgagacactccctgtgaccgatcaagacagccggcacgcacgccggacggcctgttccacccgccacgacaagaacaacgaccatgcagacccttggctccacctcggttccggccctgctga

SEQ ID NO: 1915 - DNA, 1545 bp, Pseudomonas aeruginosa
ccgtacgcaccctgcaacgccacctgcagcaagccggcagcagctaccagcagaccctcgacgaactgcgccgcgaactggccgagcactacctgctgcatagcgagctgccgatccaggacatcgcccagtacctgggctttaccgagtcgcgctcgttccatcgcagtttcaagggttggaccgggcagacgcccggcgagtaccggcaacggcgcaaggagccggcggcgcaatgagaacggcggccatccggccaccgtcggctcagtcgagcagttcgctcagcggaatgaacgccacaccctcgccttccacgagggtacgtccctcgcggacctccaccagcccctcggcccaggaagcgctgcgcagtaccccggaactctggttcggatagagcaccgcgcggccctgctccaggcgaccacgcaggtactcgcgacgctgccccgccttggtccaggcaaagccggccggtacctccacccgcagcggcgcgacctgcgccacgccaagccggcgcagcaggtagggacgcgccagcagggcgaaggtgaccagggtcgaagccggattgcccggcaggccgatcaccgggatgccctggaactggccgacggtcagcggcttgccgggttttatcgccagcttccagagggtcagctcgccggcttcgcgcagcgccatgccgaggaagtcggcctcgcccaccgatacgccgccggtggacaggatcaggtccaccccggccaacccggccaggcgctcgcgagtacgtgccaggtcgtcgggaaggatgccggcgtcgagcacgtcgcagcccaggcgttgcagccaatccttgagcaacggacggttgctgttgtagatctgcccggcctgcagcggctggcccgcctcgaccagctcgtcgccggtggacagcagcgccacccgcggcttgcgtcgcacctccagggccgcgtagccgagcgaagccgccaaccccagttcgatggagcgcaggcgcgtgccggccggcaggaccaggtcgccctggcggatttcctggccacgcgggcgcacatgctggcccacgcgcaacggctgggtgaagcgcacgcggccatcgtcgagcgcttcggcgttttcctgcatctctaccagatcggcgccttcgggcagcggcgcaccggtgaagatccgcgcacaggtatccgcttgcagcggcttcggcgcctgtccggcaaagatcttctggctgaccggcagtggctcgccgttccagtcggcgaggcgcaaggcgtagccgtccatggcgctgttcggccacggcggcaggtccaggccggccagcaggtcgaccgccagcacgcggccgccagcctgctccaggggcacctgctcacacgtatcgataggcgtttgcgcggccagttcgaggagccgttccagcgccgtctcgaccggcatcagccccggctgttcgcagcagccgctcacccgcggctctcgcagggcgccgcctgtttcaggtgcgggacgaagttgcacgggcgatga

SEQ ID NO: 1916 - DNA, 255 bp, Pseudomonas aeruginosa
cttcaaagtctgaccgcacaggagaactgcgcaatgatcaagcggatgctacccgccctcctcctcgccgtaggcctcggcgccctcgcgggttgttccagccctaccgtgatcaccctcaacgacggacgtgaaatccaggccgtagacaccccttcctatgacgaggattccggcttctacgagttcgaacagctcgacggcaagcgcgcccgcgtgaacaaggaccaggtccgcaccgtcaaggaactctga

SEQ ID NO: 1917 - DNA, 654 bp, Pseudomonas aeruginosa
aatatacagacctgtctgtctaatatccaggcaccaatacccgcctggaaccctcagatgaaactgcatgacctggatctctccggcaacgcctacaaggtccgcctgttcctctccctcatcggccgcgaggcgacgctgcggccggtcgatttcctcaaccgcgagcacaagacccaggccttcctccgcatgaatccccgcggacagatcccggtgctggaagacggcgagctgcaactgggcgactcccacgccattctcgtctatctggcacgacgccatgccggtcccgagtggtatccgctcgaccccgtcagccagggccgcatcgcctactggctcagctattcggccaacgaggtgcagaacggcccggccagcgcccggctgatcactcgctttaacctgccgctggatcgcgagcaaacccaccagcgaggcctggaagtgctgcgcctggtcgaccggcacctggccgagcatcgctggctggcccagggcgaacagccgagcatcgccgacgtggccctctacccctacctggccctcgcccccgaaggcggcctggcgctggaccactacctggcgctgaacgcctggatcgcccgcatccgcgcgctgcccggctacatcccgatgcccggcctgtag

SEQ ID NO: 1918 - DNA, 945 bp, Pseudomonas aeruginosa
ctcggcaggaggcagcatgagccaggaacagagtcccttccacaccggcgaactggcgatccaggaacgcgccggcgttcgcgaacaggtcgccggcttcggcagccgcgcgatccgcaccttcatgccggaccagcaccgggagttcttctccctgctatcgctgttgctggtgggcagcctcgacgccgacggctaccccagcgcctcggtgctctggggcccccccggcttcgcccgttcgccggaaccgacccgcctgcgcatcgacaacctgccgcaagcggacgatccgctggcggccaatctcgaggctggcacccgcctcggcatcctcggcctggaatggccgacccgccgccgcaaccgcatgaatggacgggtcctggcgcgggacggaaagggtttcacggtcggcgtcgagcaatccttcggaaactgtcccaagtacatccaggcgcgcagccatcagcccgtctccaggatcgcaagtcccgcgttgcagggcgaaggactcgatccacgctggctgtcgctggtctcgcgcagcgatacgctgttcatcgccagccagcatgccgacccgctcagaggcggcgtcgacgtctcccatcggggcgggccgccgggctttctccggctcggcgcggatggccgcctgtggttgcccgactatgccggcaaccgcctgttcaataccctcggcaacctgctccaggatcctcgctgcggcctcctgttcatcgatttcgacgctggcgaactgctgcacctgcacgccgaggccgagctgttctggccgggttcgcagccatccatcccctggcccgccggcgccgagcgcctgctggcgttgcgcccccgcagggctggcgctggcggcgcggccgcctgccgctggcattctggcgagccccacccatcccttttttttcctgccggtga

SEQ ID NO: 1919 - DNA, 873 bp, Pseudomonas aeruginosa
atcttgatgcctttcctgtatcgccttgcctcgttgttgatcgccctcctcgtcctgccggtgcaggcggcggaaatgcgagtcgccctgttgcgcacctcgggagtggaaaccctcgatgcgctcaccgtcgacggcggctcctgggtgcgccgggtgccgctcagccataccgcggtgctgatcgagcaccacgccgccaccctgctcttcgacactggcctggggcgcgacatcgacgcccagttccgtgccgacatgccttggtgggcagcgccgctgttcgcttaccagaaagtcgtcccggcgcgcgaccaactggacgcagccggtatccgcgtcgatcgcatcctgctgtcccacgcacactgggatcacgcctcgggcctggtcgacttccccgaagtaccggtctgggcaccctacgaggagatcgccttcagccgcatcgccaccccgccggccgccttccccagccaattccgccatggcgtgcgctggcgaccttacagcttcgatccgcggccgttcatgggcttcgacgaaagcctcgacctgtttggcgacggccgcctggtgctggtccccctgcccggccatacgcccggctcggtcggtctgttcgtcaccctcgacagcgggcgccggctgttcttcagcggcgacaccagttggcgactcgaaggcgtcgaaggcccacggcagaaattcttcgccggccgcgccctggtcgatcgcgatcccgcgcgcaccctcgcgcaactggcgaagatccgcctgctgctccgcagcgacccgcgcctgagcgtgattccggcgcacgatgcgcgggtccaggccgccctgggctacttcccgcactggctggaatag

SEQ ID NO: 1920 - DNA, 1341 bp, Pseudomonas aeruginosa
ccgggctgtcacaggccgacgtggcgtcacgccgccgccatcggcctgccccaagcgctcgaggagacaataacaatgagcatgaccccgatcgcccgtgccgtggcttttgccgcgctgggttccagcattaccgtcccaaccctggcccatgccgagttcatcaaggacagcaaggccagcatcgaactccgcaacttctacttcaaccgtgatttccgccaggaaggcgccagccagtccaaggccgaggaatgggctcagggcttcctcctgcgctacgaatccggctacaccgagggcaccatcggtttcggcgtcgacgccatcggcctgctcggggtgaagctcgactccagccccgaccgcagcggcaccggcctgctcaagcgcgaccgcgagaccggccgcgcccaggacgactatggcgaggcagggatcaccgccaagctgcgggcgtcgaagagcaccctgaagatcggcaccctgacccccaagctgccggtgatcatgcccaacgacagccgcctgctgccacagaccttccagggcggcgcgctgaactccatggagatcgacggcctgaccctcgacgccgggcgcctgaagaaggtcaaccagcgcgactcctcggacaacgaggacatgaccatcaccggtggcggcaagcgcaacatcgtggtccgttccgggctgacttcggacaagttcgacttcgccggcggcagctacaagtggaccgacagcctcagcaccagctaccactacggcaagctcgacaacttctacaagcagcattacctcggcctggtgcacaccctgccgatcgccgacaagcagtcgctgaaatccgacatccgctgggcgcgctccaccgacgacggttccagcaacgtcgacaacaaggcgctcaacgccatgttcacctacagcctcggctaccacgccttcggcgtcggctaccagaagatgagcggcgacaccggcttcgcctacatcaacggcgccgacccctacctggtgaacttcatccagatcggcgacttcgccaacaaggacgagaaatcctggcaggcgcgctacgactacaacttcgccggcgtcggcattcccggcctgaccttcatgacccgctacgtcaagggcgacaacatcgacctgctgaccacctcgggcgaaggcaaggaatgggaacgcgacatggacatcgcctacgtgttccagagcggcccgttgaagaacctcggggtgaagtggcgcaacgcgaccatgcgcaccaactacaccaacgactacgacgaaaatcgcctgatcgtcagctacacgctgccgctctggtaa

SEQ ID NO: 1921 - DNA, 450 bp, Pseudomonas aeruginosa
tcggctcgctgttctgcggctggcgcctgtaccagtcgatcaacgacgaaagctcgccgttcagcgccaccctggaagaactggccaacgaccgcgagcgactgctgccatgacaaggaaacgcgcatgagccaactaccggtgaacgcgaccggcctgtcgcgtcgcgaattgcgcaaggcggtgatccgcctgcgcctggaaatgcagcgccagcaattgcgtcgcgaaagccaactgctggtgcaacccttccgccaggcccaggggctgggccacaacctcagccagcaactgttcggcggtggcaatgcggcgctctggggcgccggcggagccgcactgctgggcgtactgcttggcaagggcggacgctggcagcgtctgctgcgcctgggcgtcgccctggccccgctgttgctcggcctgcgcaagcagaaaggccgttga

SEQ ID NO: 1922 - DNA, 699 bp, Pseudomonas aeruginosa
cagggtctccagcagttcgcgcagccgttccgggcggtcgccgccgaggctgctgagagcggctgcatcatagagcccccggggctgcgcggcgtcgcgtccgaaagaggtcgcgaggtagttgcgcagggtctccaggccgagcggcttgaacaggcaatcatccatgcccgcgtcgcggcagcgctgtacctcgtccggctcggcgtcggcggtatagccgaggatcaggatcggcgcgcgtcgctcgcatcgttcctggatgcgtatcctgcgtgccaactgatagccgttcaggcgcggcatgttgcagtcgctgatcagcacctcgaagcgctcgtcggcccagagctccagcgccacctggccatcctccgcttccgccacccggtggccgagaaactccagttgctggcgcagcagtacccggttgggcggatagtcgtcggcgatgaggatatgcaggcggcgagacggctccatggatgctgccagcgggtcctggccggattcaggcattttcggcccgcactggcgcaagagcaggtcgagcgacacccgggtgcctttgcccggctcgctgtgcatctcgacatcgccgcccatgaggtccaccaacttccgacagatcgccagcccaaggccggtcccgccctgcaccgtgcgtcccttggccacctggatgaaaggctggaatag

SEQ ID NO: 1923 - DNA, 1089 bp, Pseudomonas aeruginosa
gcgcgcctggtccgccggagcgataccgataccggaatcctccacgtccacccggacgatcgccctcccctcgtccaggctcctttcctggagacggatcgtcacctgtccccgctcggtgaacttgatcgcattgctcaccaggttggagagcacctgcttgaagcgcaggggatcgatcagcacgtcccgtcccggggcatcgtccagctccacaacgagcctcaggcctttctgccgggccaggccttcgaacatgcggcgcaccgactccacgacatggcgcaggcgaacccgctcgggcgtgagggtcaggtgaccggactcgatcttggcgacgtcgaggatgtctccgatgagcagttgcagcgaccccgctgcctcgtaggcgacctccagcgaggcgcgttcgcgctgctccggcgccaggcgctgcaggaccagttcgaggatgccgatgaccgcattcatcggcgtacggatctcgtggctcatggtcgccaggaagacgctcttcgcccgattcgcctcgtccgcctggcgcatcgcctcgcgcaactggcgggccaggcgctcccgttcggtgatgtcgatccagccgttcatcaggccgagcacccggccctggcgatccctgtagggcgtgacccaatggtggatctccagcaattgcccgccgatgcgcaccgccatgtcggtgaagctcgccgttcctccccgagccaccgccaggcactgctggtgcatgagccgtgccttgctgccctcgacccagtcggaatcggtcaacagggtgccgcgcgcctgctcacgggtcatccgcaggctttccaggtaattgcggttgcaggccagcaggcgaccgtcgagcgtgcggatgctcaccgggtagggaatcccgtcgaccagcgcctgcttcaatgccaggcggccgctcaggtcggcttcggtacgttgccaacgcctgagcctgagctgcaggacggtattccagcccaggcatccgacgcagaccaggcaggccaccagcaggccgagcaccaggctggaaggggatggcgagcgcagcccgtcggcagcctggcgtag

SEQ ID NO: 1924 - DNA, 2475 bp, Pseudomonas aeruginosa
atgccgctcgcctcagcgaacggtgattctccaggcccgatggatcttcggattacgcgcgaaatccggatcgagggtttcgccagtgatctcttcgaccgcatagcgggcctgcacgctctcgtccagttcgaacttgcggaagttgttggagaaatacagcaccccgcccggcgccagccgcgccatggccaggtcgagcagttcgacgtggtcgcgctgcacgtcgaacacgccttccatgcgcttggagttggagaaggtcggcgggtcgatgaagatcagttcgtactggccatcgtcttcccgcaaccactccatcacgtcgccgtgcaccaggcgctgcttgtcggaaaagccgttgagcgacaggttgcggcgcgcccagtccaggtaggtcttcgacaggtcgacgctggtggtgctgcgcgcgccgcccctggccgcatgcacggtggccgtggcggtatagcagaacaggttgaggaagcgcttgccggccgcctccttctggatgcgcaggcgcatcggccggtgatcgaggaacagcccggtatccaggtaatcggtcaggttcaccagcaggcgcacatcgccctcacccacctcgaggaacttgccctcgctgctctgccgttcgtactgcttcttgccggcctggcgctcgcggcgcttgaccaccactcgctcctgggcaacgcccagggtctgcggaatcgccgccagggcgtcgaacaggcgcgcctgggcttttgccggatcgatcgacttgggcgcggcgtactcctggacgtgaacccaatcgccgtagatatccaccgccagggcatactccggcatgtcggcgtcatacaggcgatagcactcgatcttgtcgcggcgcgcccatttgcccagttgccggaggttcttctgcaggcgattggcgaacatctgccccccctcgctcagccgtgccggctcgctcggcgcccgtgccaggccttcgtcgttgcgttcgccacgctcgccggtgacgaactggcgcggctcgacctggatcatcagcagcttgcaggccagcgcgccgttccagaacgcgtattgcttatggctgcggatgcccatgcgcttgcccagttccggcgccccggtaaacaccccggcgctccagccgatgcagctctggcgcaggcgctcgccgaggttctggtagagatacagcaggctggcttcgtcgccgagacgctcgccatagggcgggttgcagatcaccaggccggtctggcccttgtccgggcgcggctcgaaagtcgccagttcgccctggtagatcttcacccagtcggccactccggcacgctcgatattgttgcgcgccggctggatcaggcgcgggtcggcctcgtagccgcgaatccacaacggcggcctggccaggccggtcgccgcgcgctgctgggcttcctcgtggagcttgcgccacagcgccggcacgtgacccagccaattgctgaagccccagcgctcacgcctgaggttcggcgcgatatcggcagccatcagcgccgcctcgaccaggaaggtgccgacgccgcacatcgggtcggccagggcaccgccctcggcggcgatcttcggccagccggcacggatcaacaccgccgccgccaggttctccttcagcggcgcggcgccctgctgcagacgatagccgcgctggtgcaggctatgcccggagaggtccagggaaagggtcgcctggccgcggtcaaggtgcaggtggacgcgcacgtccggattgaccttgtccaccgacgggcgtcggccggagcgctcgcgcaggttgtcgacgatcgcatccttgaccttcagcgccccgaaatgggtgttgtcgatgcccgagcccttgccgctgaactccaccgccagcgtgccgccggcgtccaggtggtcttcccagttcaccgcgtggaccgccatgtacatggactcggcgttctccaccgggaatcgcgccagcaccagcaagacccggttggccaggcgcgaccacaggcagaggcgataggccacctccaggctgccctgtccgcgcaccgccgacacctgggcgcgcgcctcgtccaggccgagcccctgcgcctcttcgaggagcaggctttccaggcctttcgggcaggtcagaaacaattcgtaaacatcagccatatcgccttcccgggccgtagcccttgtcagtggaagcaccctcatgggcacttctttggcaccaggtgccgtggttcgattgccggaacgctcccggcgttgctcgctgcgaccccgagtcgcagtctgggcgacccttcgtcggaatgcgaggaaatctcaattggtgggggtgcaaatcgttataaggcgcaaccccgcgaccctgcggcgttagcgccggaaaccaggcgtcatgagcctgcaacatatggccctatcgacgaaagcgttaagtctttatga

SEQ ID NO: 1925 - DNA, 567 bp, Pseudomonas aeruginosa
  unsure (60): Identity of nucleotide at the above locations are unknown.
agaccatcgaaggcgtgtgcagccgggagatcctcgtccaggcaccttgcccacgcctgngaagacctggccacggccgaggtctgccggggcgtacggatcatcagctacaaggatttcgtcaaggccctgagcctggccctgccgcgtttcaccaacggcgacagcatccgcctgcgccaggccgcctggcacggcgagcgcctgttctgggcgggcgaacgccaagcctgcgccttcgccgcggcgatcgtctacgcccgccgccgcgaactggaactgaagctgccggcacacctggaacgctacgaactggagcccggcgcgctggacgaactggaacggcgctaccacatgctgcggattccgacccaggcctggtccgagccgaccttcatgagcctgctgctggataccggcctgccctatgcgcgactcgccctgttcaccccggaaaccccggagtgcctgttgctgccccgcaacgacgaacgcgccgatgccctcggcgaaggtctgcgggcggctggcgcggcagacgtggtgaagtatctgaagcaactgtag

SEQ ID NO: 1926 - DNA, 642 bp, Pseudomonas aeruginosa
gacccgcgcctacctggagaaactggtagccgcctcctccggccgcatcgccctgcgcgagttgcccgagcgcagcgccgagggtcacccgatgctgctggtgaccgcctccaccgaggccgacaagtccgccgccggcctgaagcgctccgccaagccgaccttgctggtggaagccgagatccatcccggcgaggccaacggcaaggacgccatgttcatgctgctgcgcgacatgagcgctgccgaccgcccgctcgccgggctactggagaagatcaacctgctgttcatcccggtggtcaacgtcgacggcgacctgcgccgcagcgcctacgggcggatcaaccagaacggcccgcaggagaccggctggcgggtgaacggccgcaatctcaatctcaaccgcgacttcaccaagctcgacagcgcggagatccgcaacgtcgcctgggtattcaaccactacgagctgagcttcttcgccgacacccactccaccgacggcgccatgtatccctacgacagctcctactgccacaacggcaacggctggtcaccggcgagcagcgcctggatggaccaggtcatgcgcaagccggtgtaccaggcgctggaaagcctcgggcacatggtccatga

SEQ ID NO: 1927 - DNA, 900 bp, Pseudomonas aeruginosa
cggcggataacgctgcgcgttatccgccctaccgctgggcttcgggagccccgttgcctctcccgcttgcgggagagggctggggagagggagccggtctcaggtaccgtcggtgggtgtgggcaggttgcttctcggcttgcgcttgcgcctgggtttcggtggtttttcgggtggcggcgacaactcccgcttgcgcaccttcttgaggatttcccgatgcttctcgcgccaggccggcacgtcgagaccgtggagttcgagcagctcggggttgcgctccaccagatagaccgccgcttcctgggcggcctcggcgatcttccaggcgatcgactgcggttcgatgctgccttcataggcgatccagtcgctgaactccgggaaggtcccgcagaccttctcgaaatcctcgtcgtgcatgcgctgccggccactctcgatgttctcaaggcgtttgggatccatgccgaccacctcggaaaactgcggtcggttcaaccccgtcagcccgcgcaacccgaacaggcgctcgccggcgcgaaacaggcagcgcttcctcactacatagaccatgtacagatacttcccttcgtttctggcgcgatgcgcctcagtcgcccttgccgctcgcgggcgttttcctcttccgctggcgcctgggttccggcggctcttccaggggcgccggctccgcctccggcgcctgttccgccgccagcagcgcctcgcgtatctcgcggtggcgttcgcgccaggcctgcatgtcgatgccgtgccgctccagcagcaccgggttgcgctccaccaggtagaccgcggccgcctgcgccgagtcggcgaccttccaggcgatcgactgcggctcgatgctgccttcataggcgatccagtcgctga

SEQ ID NO: 1928 - DNA, 321 bp, Pseudomonas aeruginosa
accgagggttcccctccaacatcggaccatggtgcaggacgcctgatgaaagtggaagaactcccccaagagggtttcgccgagtgcccccgctatataaccctgatgcgtttcgccttcctgaccggcctcagcgaccggccggacctgctctacgcctggatagagagcggcgacctgccgatgcgaaccttcggtacgcaacgcctggtggatatgcagaagctgcaaaaacgcatcgaggaagcaaaaaagtgccggtgtcaagtctttcgcgcaaatcacgcagggcttgaaaccgtatatgggacagtaggttag

SEQ ID NO: 1929 - DNA, 543 bp, Pseudomonas aeruginosa
agccggctttcaggaacgcctctttctggtcttgccggttctgtacggcggtcgggtcggcaggctgcgtcgccaccgatgccggcccggccgcgagtgggtcgaaggccgcgagcgcgcttgcaccaccaggcgcacccggtgtcgcctgcgccacggtcgcggcggcttggccttggccgcccgagcggaagaacaccgacgaagccgcagcggcttccgcctctttgcgcaaggcatcgttggggtcgtggccgggggccgcgtaagcggccacggccggctgctgcgagttcacgatggcagggccgaggtcgcccggcagcggcggccccagctcgggcaccttcggcggcagcttcgagtagtcggccggcagaccgtccagcccttcggacttcgagacgcgatcgacgttgtatagctcggtctgttcgcctgcgctgcgccgctgcggttgcagcgaccagatcgtggccccgagcacggcgaccgacaggccgccgacaaggacggccagcgtgcgccggttcaggcgcgtga

SEQ ID NO: 1930 - DNA, 1065 bp, Pseudomonas aeruginosa
gcacctttatccagcggaaacccatcgatgaaaactccaaacctcctttccagaaaaacccgttgggtcgtgatcgccgtcgtcgtgctcgctcttggcggcgcactggcgttctggctgtcgcgcgaccatggacaacaagatgcattgcgcctctacggcaacgtcgacatccgcgaggttcaactggccttccgtcagcccgggcgcgtgatgcaaatggctttcgatgagggcgatgccgtcagcgccggcgcgcgcctggcggcgctcgatccgcaaccctatcgggaagcccttgcagcagcacaggcccaggtgcaggtggcgcaggcggaactggccaagctgcgccgcggcctgcgaccgcaggaaatcacccaggcgcgcgaagccctcaggcaggcccaggcgctcgccaccgagaccgagcgtaatttccagcgccagagtgggctgctggcatcgggcgccaccagccagcgcacggtcgatgcagcccgcacagcgcgcgaccaggcagccgctggcgtcgaagcggccaaggcggccctgtcgcaagcatccgaaggttttcgcaaggaagacatcgccgcggcagaagctcgccttgcggccgcacaggccgccgcagcgcaagccacgacagccttggcggacaccgaattggcggcgcccagtagtggcaccgtcatcgcacgggtgcgcgagcccggcagcatggttgtaagccagagcgcggtctacagcctgagcctggacaagccggtttacgtgcgcgcctacgtgggcgagtcggacttggggcgcatcgcgcccggtactgtggtgcgcgtcaaaagcgattcatcagagaaggtctatcgcggccagatcggcttcatctcgccgcgcgccgagttcacccccaagacggtggagacgacggatttgcgcacggatctggtctaccgcctgcgcatcgtcatcgacgaaaccgacagcgacagggccttgcgccagggcatgccggtgacgatcgaggtcgatgcgaaagccggcaccagtatcccgggggagcgttga

SEQ ID NO: 1931 - DNA, 1185 bp, Pseudomonas aeruginosa
gatggaggctaccgcatgaacgccgttgagaaacacaaggacggcgctggcccgatgcagggcgacttgcgccgctttaacctaggacgcctggtggccttggtcaccaaggaaagctaccaggcgctgcgcgacccctcgacgctgctgatcgcgttcgtgctgccggtggtgttgctgctgctgttcgcctatgcggtgtcgctggatgcgaaggaggttcgcgtcggtgtggtgctggagtcgcccggcgcatcggcacagtcgctggccgcagcgttttcgggcacccgcttcctgaatacgcacttcgcccatgaccggcgcgaagtggccgaccaactggtctcaggcgacctgcgcggctacgtggtgattccgcaggatttcgagcagcggctggcccagcgtggcagcgagccgctggtgcagatcgtcaccgatggctcctaccccaataccgccaactacgtcgagaactacgcccgcggcgtggtccagttctggcgcgccgggctggatgtcgcggcgcccgcgcaagccgtcatgctggagccgcgctactggttcaaccccgagctggaaagccgccgcgcactgattcccggcgccatcgccatcgtcatgaccatcatcggcaccatgctgactgcactggtggtggcgcgcgaatgggagcgcggcaccatggaggcagtgctgtccacgccagcctcggtggccgaaattctgatcggcaagctgctgccgtacttcgtactcggcatgctgtccacgctgggtgcggcggcgctggcggtgttcgtgttcggcgtcccgatgcgcggctccttgctgtccctgttgctcttgtcggccgtgttcatggtgccggcgctgggtcagggtctgctgatttcctcattggcgcgcaaccagttcctggccgcgcagatcgcgctgttcacgggttttctgccggctttcatgctgtcggggtttctatatgagatcgacgcgatgcccgcgccaatccgggccatcacccgggcagttccggcgcgttacttcgtcgattcgctgaaaacggtgttcctggccggcgacatctgggctgttttcctgcccaacctggcggccatggcggcgatcggagtgttgttcttcgtgatcgccaagcgcgccacgcgcaagaacctggagtga

SEQ ID NO: 1932 - DNA, 1338 bp, Pseudomonas aeruginosa
actcgggaccttcgaccagttgctggtgtcgcccacctcgacgcccgagatcatcatttccaaatcactgccggcactcgcaattggcaccgcgctgggcctgttcatgatcagcgcgggcgtcttcctgttcggcatcccgtttacgggctcgtttgcgctcctgctcgccagtctggtgctgttcatcctgtcggtggtcggcatcggtctgatgatttccgcggtcagcatgacgcagcagcaggccatcctgggggcgttcgccatcggcgtgccggcggtgctgatgtccggctttgcgacgcctgtagaaaacatgcctgtcgtcctgcaatggctggctcaagccattccactgacccacttcctcatcatcgtcgaaggcagctttctcaaggccatgccacccagcgacattctcgccagcctgtggccgctggcggtcatcgccctcgccacgctgaccatggccaccgtattcgtccgaggacgcctgcaatgaaatccaagccctgcactccctttcttcgcgcaaccatcaccggcctgccccctgggcgcgcgcgtccgctcgcgctggccctgtcctgcatgctgctgactgcctgcgcaagcgtgggccctgactaccgcgagccgccaccggtcgacgtcggcagcggctggagcttgccgttggcaagcgaatcccagtccgcagacttgagccaatggtggtctgcactggacgatcccatcctcgatcgcctgatggccacggcgctggcacagaacctggatctgcgccaggctgcggcacgcatcgatgaggcacgcgccctgcgcgatcgtgtggccggcgaggcattgcccaccgccgccgctggcgcgagcgtcaaccggcgccgtcaaagcgagaacggacccctgcccgtaggctcgatccccggccttgacgccacgcagaccatctacgacgcgggcttcgacgcggcctgggaggccgacttgttcggggccaagcggcgcgcgctggaaggcgccagcgcccgcctgcaggcgaccgaagccgaggcgcagggcgtacgcatgcgcatcgtggccgaggtcgcgcgcacctggttcaccgccgtcggcgcccgctacgagttgcacgcacaacaggccacactggatacgctgcagcagaccttggaattggtgcgcctgcggcatgcgctgggcgacgcgtcggccgccgacgtggaggcggcgtacgcccaatggacagcagtccacgcgctcatcccggatatccaggcgcgtcagcgcgccgcgatactcagcctgggcgttctgctgggcgctccgccgtga

SEQ ID NO: 1933 - DNA, 954 bp, Pseudomonas aeruginosa
cctcttgcagcagcaactcggctggcaggtcacggtgcccgagtatggccatgcgctgcgctggccggactttctggcgcacgagtgatgaagcccgcagaagatctcgatgaacgcctgcgcgccatccgcgagtcgccaacgtaccggcttgcgtacgaagacatcgagctgcttggccaggacgaactgcggccgctgcgactacagctcgaactgctcaagcccgagcgcatcctgcacgaacaaggcattcgctcgacggtagtggtcttcggcagcgcacgcgtgagcgatgccgagacggcagaagcccgtcttggcgttctggagcgtcaggcgctcgtcactccggaggatgtcgggctgcggcaagagcttgcgcgggccaatcgccgggtcgaacaggcacgtcactacgagcaagcgaggcgtttctcgggccttatttcggcgcgtttccagcagcaaaaccgccgtgatttcgtcgtcgtcaccgggggtgggcccggcatcatggaggccgccaaccgcggtgctttcgaggtcggcgcacgttcgattggcctcaacatcacgctgccccacgaacaggcacccaacccctacatgtgcccggatttggcgttccgattccactatttcgcgctgcgcaagatgcacttcttgttacacgccaagggcttggtggccttccccggtggctatggaacgctcgatgagctgttcgaggtgctcaccttgatccagaccagaaagatgcagcgtgttccggtggtgctggtcggccgtgcattctggcgtcgcgtagttgatttcgatcttctgctcgacgaaggctatgtctcttcatccgatctcgacttgttcacctgcgtagacgatgcggaggaaatcgtcagtgccctcgaacgcttttacgtcaacagggcggcaggcgatggggcaacatga

SEQ ID NO: 1934 - DNA, 672 bp, Pseudomonas aeruginosa
aaggcgcgcgcaaccgtaagcgcgcaggagcccttggacatgaacctcatcgctgctttgaccgctgagaacggctcgacgcggctcaaggccgctctcgtgatcggctccaatgctgacccgggtctggtcgacaccgttatagcgcggtgtgcgatcgagccagatttctacgtgcgcgacatgctcacgtgggcgttgacccgtttcccgaacgagatcactgtgccgagactggtcgcggagctgcattcggaaggtgcgcaggcccggagtcaggcgttgcacacactgtcgaaaatcaaagacgccggcgcatggccggcgatcacgcgatccctgctgcgcgactcggacgacgaggtcgcccggagcgcatggcgtgctgcggtcgtcatggtgcctgatggacagaagaaggacttggccgaggaactcgccgtgcagttcggtcgcggcaaccgggaagtgcagctcagtctgagtcgcgccctcatcgccctaggagaagaagtggtcgagccggttctccggaaggcgatggcgagcgacaatccaggtgttcatgcccatgcgagcgctacggagcggatcctgcgcgacccgaacgccagtttcgagttcgccgtccaagaggcgaggcggatatttgtgctcggcaaggagcggtag

SEQ ID NO: 1935 - DNA, 954 bp, Pseudomonas aeruginosa
cctcttatgaacgacatggtttaccgaagcgcggaagcagcggcagccgtcgaaacgcaatacaagcgagtcttggagcgatggccggttccgaagaccgagttgcatgtgccgactcattatggctcgacctttgtcgtggcctgcggcccggaaagcgcaccgcccgtcgtgttgctccacggctcgctggccaactcggccgcatgggtgcctgatgttgcgttgtggtcaacgaagttcaggctgttcgcgatcgatatgatcggcgaggccggcttcagtgcacgggtccggcccgatcttgccggggacgcccatgcactgtggctcgacgacgttctcgaggggctggggctggggctgggatcgggacgggcgcgcgtcgccatcgtcggcacgtcgctcggcggatggctggcactcgactatgccaacagaaggccagcggccgttcgcgcgctggcgttgatctgcccggccggcatcggccgtcagaaaaactttctcctgaaggtgctgccgcttctcctgctcggcgcatggggcaagcgtcgggtgtgggagctggtgttcggccccgctcccaaggtattgccgccagaaatgcagccgctcgcggaactgatggaaattgtaggacgagccgtcaagccgcgcgtggccagcattccgcaactgactgacgctcaactgagtgaactcggcatgccgatcctgacgatcatcggcgggcgggacgttttgttggactctcggcacacgagggaaaggttgcaacggagcgctccgcaagccgagatatgtttcattgaagatggctatcacttccttccggatcaggcgccacgcgtcatggattttctggagcgaagcgcgatattcgctcctgcttcacgggcaaccggaaaagagatcaaggccgaacaatcgtccgtagcgtcttggagatag

SEQ ID NO: 1936 - DNA, 600 bp, Pseudomonas aeruginosa
ccgaaatccatgacccgcatgctcagcaccgtccgaaaacaacttctcgccctgcgtgcacgcgacgagcaggttcgcgccgaacttactgccgatggctccttgtacgagggctaccaccctcggatggaaaaggtgcaccagggcaatgccgaagagcttcgctccatcatccaagagcacggatggccggatgaagagcttgccggacccgagggtgcggaagcagcttggctcattgcccaacattccatcggcgaaccggaattcctgcgccaatgcaggacgctccttgatgaagcaagctccctcgggcgcgttcccaggtggcagttcgcctacatcgacgatcggattcgcgtcttcgagggaaagcctcagcgcttcgggacacagatcgaccttcggccggaggggccgaagattcacgaactggaagatccatcgcaagtcgatgcttggcggaaggagatcggcctgccagcgctcgcaagcactcttgccagggcgcagtccgatccactccccacgccggacgagtacgaggccaaggaggccgccgggctctcgtggcgtcggaaggtaggttgggtgaagtga

SEQ ID NO: 1937 - DNA, 330 bp, Pseudomonas aeruginosa
caggcgctcggcgagggtcgatgtaccgcctggcccgccgccgagcaaatcaataaaggcgtcttcgaaacgcgcgggcactggagccagttgcacttgggcccgatcggccagcgcctggatttgctccgttggtgcaccctcgcgcagtaccacgcgcacccctgcgccctggatcacgccatcgctcacgctgggcagatcgagcgcctcggtcagaaccgcccggcgctcggcgccgacgttttccaggcggaagctgcggccttcaagctgcgcggtcaactcttgcggcggaccatcaaacaagagctgcccctggttcagtaa

SEQ ID NO: 1938 - DNA, 762 bp, Pseudomonas aeruginosa
cagcacgctctcgcagcgctcggcctcgtcgaggtaggcggtggaccagaccaccgccatgccctcatcggtcagcgcctgcaccatgcgccacaggtcctggcggctgacgggatcaacgcccactccaggttcgtccagcagcaggaccttgggccgcgccatgagcgcgcaggccaggcccagtttttgcttcatgccgccagagagcttgccggcgaggcgcttggtgaagggtccgagccgcgtgaagtcgagcagctcggcaaacagctcggcgttgcggtctgcgtccatgccacgcaactgcgcatacaggcgcatgttctccatcaccgacaggtcttcgtacaggccaaagcgttgcggcatgtagccgctggcgacatgaatggcgtcgttgtccttgaccacgtcatagcctgccaaggtgacgcggccggcgttcggcaccaggaggccggtcagaatccgcatcagcgtcgtcttgccagcgccgtcggggccgaccagacccgtcagccgcccatagtggatgcgcgcgctcaagccccgcagcgcctttacgtcgccgaaatgcttgtccacgtcttcgatgacgacggcagcgtcttcgcccgcgcccgcaggcacggcggcgatggcagggcttacctgcatctcaacgctcccccgggatactggtgccggctttcgcatcgacctcgatcgtcaccggcatgccctggcgcaaggccctgtcgctgtcggtttcgtcgatga

SEQ ID NO: 1939 - DNA, 300 bp, Pseudomonas aeruginosa
tcccccggaggaattgatgccatgaagaaggccatcccattcttgttggcggccatcctgaccgcctgcggtcaggccgagacgcctcagaaggccatcagttcagaaccggacatcccgacagtggaagaactggcggccaaccccgaacggctcaaagaactgcgccagcaatgcaaaaccgaccgcccgaagctcggcgacgtgctgtgcaaccgggtggccgaggccacgcgcaagcggttctacggcgatggcgaaaccccttacacgccgccgaaggaatcgcccaagttctga

SEQ ID NO: 1940 - DNA, 1188 bp, Pseudomonas aeruginosa
acagttgggccgccacctgctgcgcgggcgcagcctggtgcgcgacgtggtggaggaactgcatcccgatcctatgcgaatggaggacgcggcggcggctgcgcaagcgcgggagcgtgcgtcatgagcgccgttccgcagtccatgagcgccacgtcgctcgaccgccgaatccagatgctgcgcacagcgatggggtcgctgatcgccgccgcgctcgaagacccggacgtggtggaggtgatgctgaatcctgatcgcaccctttgggtggatcggctttccagtgggcgcgcgccgatgggcgtggaactgcccgaggcggacggcgagcgaatcatccgcctggtcgcggcccatgtcggtgcggaaatccatcgcggccagccgctgctatccgccgaactgcccgaaaccggcgaacgcttcgagggcatcttgccgccggcagcgccggggccggcctttgcgctgcgcaagcgtgctatcggcgtgatcccgttggagcggtacgtcattgacgggatgatgaccagcgtgcaggcgggctttctcgttcgcgccgtgcgcgagcggcagaacgtgctgatcgccggcgccaccagcagcggcaagaccacgctcgccaatgctttgctcgccgaaatcgccgccaccggcgaccgcgtgctggtgctcgaagacacggtggaactgcaatgcgcggcccgcgaccacgttccgctgcgcacgcgcgcaggcgtggtatccatgaccgagctggtgcgctcgtccatgcgcctgcggcctgatcgcgtattcgtcggcgaggtgcgcggcgccgaggcgctggatctcatcaaggtgtggggcacgggacaccccggcggcatcgccacgatccacgcaggttccgcgctgggcgcgctgctgcgcctggagcaactgattctcgaagtggccgtgaacccgccgcgtgcgctgatcgccgaggcggtcaacgtggtgatccacatcgccgggcgtgggcgcaaacgccgcatcgagagcattgcccgcgtcgtcggcttcgacggcgtgggctaccgattggcgaattgggaggcggacgcgctggacacgccgtttcccgagttgtcgccaaaccccgatgccgcatccgctgcggcgacttccccatcccctgacttacttggagaactgccatga

SEQ ID NO: 1941 - DNA, 1239 bp, Pseudomonas aeruginosa
cggccagacactgacctacctgcacgccaccatctcgacgcggcgctatcgcgtcggcgtgcccgaagtggcgttccatatcgacgcgctgctgaccgattccgcactggtcggtggcctggcgcccatgctgggcgaccagcacctgcgcatggtgtcggtgcggggcttcccgacctcgacttggccggggattctggacgacctcaaccgccttggctttgcctaccgctggagcacgcgcttcctgtgcctcgacaaagccgaggcggaacgggagttgggacgcctgcgccgccagtggttcgccaaacgcaagaacgtcatcgcgctgctgcgcgaaacgatcttccagcaggaaagtccgctggtcgataccgacgccagcaacaaggccgccgatgccgatgccgccttgcaggagctgggcagcgatcaagtcgccttcggctacctcaccgccacggtgatggtgctcgatgccgacgcggctgtggccgacgagaagctgcgcatggtggagcgtgtcatccagggccggggcttcatcaccatcccggaaacgctcaacgccgtggatgcctggctgtcgtccattccgggcaacgcttacgccaacgtgcgccagcccatcgtctcgacgttgaacctggcgcacatgatgccggtttcggcggtatgggccgggccggagaagaacgaccacctcgacggccctccgctgatcgtcacgcgcacggatggcgcgacgccgttccggctagtgacgcacatcggcgacgtgggccacacgttggtcgcggggccgaccggcatgggcaagtcggtcttgctcgccacgctggcgatgcaattccgccgctatcgcggctcgcgcatctttgccttcgacatggggcgttcaatgcgcgccacgatcctcgggctgggcggcgaacactacgacctgggcacggatggcgaaatcgccttccagccactcgcccgcatcgaccgcgagagctaccgcacctgggcggccgaatggatcgagggccgcttgctgcacgaaggcgtcgcagtcggccccgacgaaaaggccgctatttggtcggcgctgggaagtttggccggtgcgcccgtagaacagcgcacgatgaccggcctgtccgtgctgctgcaatcgaatgcgctgcgccaagcgctcgcgccttatgtgctgggcggcgcgcacggcaagctgctggacgccgaccatga

SEQ ID NO: 1942 - DNA, 1239 bp, Pseudomonas aeruginosa
cccggtgtttgccgcgcgcatccgccagtggctcaagacgctgcgcaagaagaacgtcagcgtcatattcgccacgcagtcgctcgcggacatcaaggattcgagcatcgcgcccgcgatcatcgagagttgcgcgagtcggattttcttgcccaacccgcaggccaccgagccgcagattcgcacgatctacgagggcttcggcctcaacaggcggcagatcgaaatcgtcgccaccgcgcaacccaagcgcgactactactaccaatcccgcctcggcaaccgcctgttcgacctcgacctgggggcggcggcgctggccttcgccggcgcttccacgccgcaagaccagcgcgacatagaccgcgtgctgctggacgtcggcatacccggcttcgcgggcgcctggctgcgccatcgcggcctcgattgggcggccgacctgctgccctcgttccccggtctcgcgccgggttccctccgtaccaccgaccacccacaggagagcctgtcatgaagaagcgacttgtcgccgccgccattgcggccgttctttgcaccgccactgcccatgcgcaatgggtcgtgatcgaccccacgaacctcgtgcagaacacgttaaccgcgatccgcacgctggagcagatcaacaaccagatccagcagctccagaacgaagcgcagatgttgatgaaccaggcgcgcaacctggccaacctgccgtccagtgtggtgaaccagttgcgcgccaacctggcgacgaccgagcggctgatcgcccaggcccgaggcttggcctacgacgtgacgaatctggatcgggagttcgcgcgcctgtatcccgagcaatacgccgccaccgtgagcggcgaccagatgtaccgcgacgcgcaggagcgttggcgaaacacgctcaacggcttgcagaccacgatgcagatgcaagctcaggtgtcgcagaacctgggcgaagacgaaagcgtgctggccgacctcgtgggcaagagccagtcggccgaaggtgcgttgcaggcaatgcaggccatgaaccagttgctggccttgcaggccaagcagtcgatccagtctcaacggctccaggtcacgcaagaccgggcggcgtcgctggagctggcgcggcaggcggcagccaccgagcgcgcccgcgaagtgcggcggcgcttcctgggcgaaggcacgccgtacacgccgcagtccgtgaacttctacggcaactga

SEQ ID NO: 1943 - DNA, 345 bp, Pseudomonas aeruginosa
cgggaggccgccatgcgatgcgtcctcgccccgtctgttgtggtgcttgtcgtgctgctggccgcttgcaacaagcagccggccgacaaccttgccgatgctctggccgccgatcctgcgcggctcaaggcattgcgcgcgcaatgcgccgccgaccggcagaccaagggcgaggacgcttgccgcgccgccgccgaagccttccggcggcgcttcttctccggcgaggccgggccggacgaataccagacgctggccgacctgccgccgattccgccgagcttcgaggaaccggccgatggcatggcgccggcctttcccgccgaaccggaggacacgccatga

SEQ ID NO: 1944 - DNA, 753 bp, Pseudomonas aeruginosa
tcgtcgggatcggctcgggcttgttcgctcagttccaaatccatcccgccgagccgtccatcgaccacgcgctggtcatcatgctggcctcgctcaccttgctggcgctcgggatcttcggccccggcattgcgacgggccttgtgtccggtgcgccgcagctcggcgcgggcgcgatggccggtgctgctgtcggcgctgccggcacggccgtcgctatcggcgccgccgcgacgggcgtgggtggcgccgtggctgctggcgcgcgtatggctccggccgccgcaaagctggccggtagcggtgcgcgcgccgccacgtcggcggccagcaatgcgaagtcggcgtttcaggccggttccgccgccgctggcggcggcgcaaagggcgcgatggcgggcctgggccacgtcgccaagaccggcgcgcagtccgccggacgcgccgcagcatcccgtgcttccgctgccgggcagcggatggccgctccgttccgtgctggctggaatcgctcgacggccgacgctggcgcgtcaaccggccaagcctccgcaggagaagcctccgcaggagaagccgctgcacagaagccggaacaacccgcctgggccaagcggctgcatcgccgccagcaactcacccacgccgcgaccaccgccgcgcacacgctgcgcggtggcgacggtggcggctcggggcaaggcccgagcctgcgcggctccgacgactaatgcgattcacaaggagaactga

SEQ ID NO: 1945 - DNA, 561 bp, Pseudomonas aeruginosa
gccggtgcaggcccagccgctgcccgaacggcccgcgccggtggaggtggtggccgtgcccgaggtgctgccgatgccggcgcagttgaagccattgcccgaagccgaggacgccaagcccacgccggagccggccgacgagacggtgcgcgtctcgcgcgccaatgccgaggcccgcgtcgcgcccacgcgcgagggctacgtcaacgcgattcaggtgtggcccttcaccgatggcgcgctgtatcaggtctatgcggccgtgggccgcgtgaccgtcgtttcgctccagccgggcgaggaactggtgacggtggccgccggcgataccgtgcgctggatcgtgggcgacacgtccagcggcagcggtgccgatctgcgcgtgaacgtgctggtcaagccgattcgctcgggcctcaagaccaatctcgtcatcaccaccagccgcaggacgtacctgctggagctggcttcgacggaaaagacgtggatggcatcggtgtcctgggagtacccgcgcgaccggatgctggccttgcagcgccaggcacaggccgctag

SEQ ID NO: 1946 - DNA, 1332 bp, Pseudomonas aeruginosa
caagggcgacgtggtgcgaatcgagcgcacggacggcgtggcgcggagggactgaccatgagccaggacgacacccccgaccttgacacgccacaggcgggcaaggtcgcgcccgagtcggtgacgctgcgcgcccagccgcgtccggtcacgcgcctgaaccggcgcacgctggccgtccttgtcggcggcctgtcggtcgccgtgctcggggccacgatctggtcgctgcaaccgcagcggcgcagcgcaggcgaacagaccgagctatacaacgtcgatcgcgtctcgaagtccgaagggctggacggtctgccggccgactactcgaagctgccgccgaaggtgcccgagctggggccgccgctgccgggcgacctcggccctgccatcgtgaactcgcagcagccggccgtggccgcttacgcggcccccggccacgaccccaacgatgccttgcgcaaagaggcggaagccgctgcggcttcgtcggtgttcttccgctcgggcggccaaggccaagccgccgcgaccgtggcgcaggcgacaccgggtgcgcctggtggtgcaagcgcgctcgcggccttcgacccactcgcggccgggccggcatcggtggcgacgcagcctgccgacccgaccgccgtacagaaccggcaagaccagaaagaggcgttcctgaaagccggctctacggaaacccgcaattccggcaatctggcgctgccggcgtcgccctatcaggtgatggccggaaccgtgatcgcgggcgcgctggtgactggcatgaagtcggacttgccgggcgacgtgatcgccactgtcacggagccggtctatgacacggccacgggcaagttcctgctgatcccgcagggctcgcgcatcctgggcaagtacaacagccaggtcagctatgggcagagccgcgtgcagatagtgtggaaccgggtcatcctgccggatacctcatcgctgacgctcgacaaccttgtgggcaccgattcagcgggctacgccggcctggaggacgacgtggactggcattggaagcgcatcgtctcgggcgcggtgctgacgacgctgctgggcgtaggcgccgagctggccgcgccggagaatcgccaggatggcaaccgcatcgtgatcgccgggcgcgatagcgcgcaagacagcatcaaccaggtcggccaggagatcacccgccgcaacatgaacatccagccgacactgacggcgcggccagggttgccggtgcggatcatcgtcaaccgggatctggtgctgcggccgtaccagcccctgttctttaaccggggagcttcgcaatga

SEQ ID NO: 1947 - DNA, 501 bp, Pseudomonas aeruginosa
ggaaccatcagacgcggactacacatggtaaagaatcgacgtttgttcactgctggcaagcgcttgcgcgccctgcgcgagctgatgggcttgagccgtccgcagttcgccgagttggtggggatgacggccaagcgcctggagaacatcgagaacgagctgcagcgcatgcacgacgaggacttcgagaaggtctgcggaaccttcccggagttcagcgactggatcgcctatgaaggcagcatcgagccgcagtcgatcgcctggaaggtcgccgactcggcgcaggcggccgcggtctacctggtggagcgcaacccggtgctgctggagcggcacggcatcgacatgcaggcctggcgcgaacgccaccgcgagatacgcgaggcgctgctggcggcggaacaggcgccggaggcggagccggcgcccctggaagagccgccggaacccaggcgccagcggaagaggaaaacgcccgcgagcggcaagggcgactga

SEQ ID NO: 1948 - DNA, 492 bp, Pseudomonas aeruginosa
  unsure (444): Identity of nucleotide at the above locations are unknown.
cccggcgagcgggcggtcggcagcgctcatgtcgcgcagcagcatgaacatggcgtccttgccgttggcctcgccgggatggatctcggcttccaccagcaaggtcggcttggcggagcgcttcaggccggcggcggacttgtcggcctcggtggaggcggtcaccagcagcatcgggtgaccctcggcgctgcgctcgggcaactcgcgcagggcgatgcggccggaggaggcggctaccagtttctccaggtaggcgcgggtctcacggtagtcgctggtgcgctgaaagtcgctgctctcggcctgggtgatcaaggggtcgccgggcttggcgaggtagcgcaggctgcccagcctctgctcgaacatcggtggcaggatgcgctggcgggccgcggccgggtaggcgctgtcatcgatgtaggcgggcgcgtggggcanctccgcgtgagcgggcatggcgctcgccagcatgacgccggcgaatag

SEQ ID NO: 1949 - DNA, 1746 bp, Pseudomonas aeruginosa
ctgacccgcaccaggcgcttgaggaccgcgtgggcttccgccttgtcttcctggaccgggccggacagcgcgccgcgcggcagatcgaccagggtgtgcaggggcggtccggcctgccaccagacgctcggctccggcagtcgcaatggctggaacggcagctcgagggcggccgcccgttcgcgcagctcccggccatcgcttcgcgcggcacccaggcgcaggcggttggcgagtgcggaaaggcgaccggtgaaggtgctgttgctacgcgagttggaactcatgatcgacggagggctcctcgggctcggcgaccgacgcggaaaggggcgggaggggacggcgacggtccgtccattgaagcacaggttcgggcgtgacattcaaccgcgtggtttgtggcaagctgtcgtggttcattcaagcggggggctccatgcccagtctcatcatggatatcgccctgtccggcgaacgcctgcaggccatctacggcggcagggccaatcgggtcctgctgcgcagccgcgacggtcgccgggtgaacctgccggcccatcacctgcgtccgttcatcggccacgatggcgtgcatggcacgttccgcctcgatttcagcgaggacggccgcctgctggcgctgcaacgcctcgcctgagcgggtgctcgacggctataatcggcacccttcattctgccgaccgatacccgaccatgtacaccctggcccgccagctgctgttcaaactgtccccggaaacctcccacgaactgtccatcgacctgatcggggccggcggtcgcctgggcctgaaccgcctgctgacgcccaagccggccagcctgccggtctctgtgctgggcctggagtttcccaatccggtggggctggccgcgggcctggacaagaacggcgacgccatcgacgggttcggccagctcggtttcggcttcatcgagatcggcaccgtcactccgcgaccgcagccgggcaatcccaagccgcgcctgttccgcctgccgcaagccaacgcgatcatcaatcgcatgggcttcaacaaccacggcgtcgaccacctgctggcacgggtgcgcgcggcgaagtatcgcggcgtactggggatcaacatcggcaagaacttcgataccccggtggagcgcgcggtcgacgactacctgatctgcctggacaaggtctacgccgacgccagctacgtcaccgtcaacgtcagctcgccgaacacgcccggcctgcgcagcctgcagttcggcgattcgctcaagcaactgctggaggcactgcgccagcgccaggaagcgctggcgctgcggcatggccggcgggtaccgctggcgatcaagatcgccccggacatgaccgacgaagagaccgcgctggtcgccgcggcgctggtcgaggcggggatggacgcggtgatcgcgaccaataccactctcggccgcgaaggcgtggaaggcctgccgcatggcgacgaggcgggtggcctgtccggcgcgccggtgcgggagaagagcacgcacacggtgaaggtgctggccggcgagctgggcggacggctgccgatcatcgccgccggcggtatcaccgagggcgcgcacgcggcggagaagatcgccgccggggcgagcctggtgcagatctattcgggtttcatctacaagggaccggcgttgatccgcgaagcggtggatgccatcgccgctttgccgcggcggaattga

SEQ ID NO: 1950 - DNA, 432 bp, Pseudomonas aeruginosa
tgtttacgaattgtttctgacctgcccgaaaggcctggaaagcctgctcctcgaagaggcgcaggggctcggcctggacgaggcgcgcgcccaggtgtcggcggtgcgcggacagggcagcctggaggtggcctatcgcctctgcctgtggtcgcgcctggccaaccgggtcttgctggtgctggcgcgattcccggtggagaacgccgagtccatgtacatggcggtccacgcggtgaactgggaagaccacctggacgccggcggcacgctggcggtggagttcagcggcaagggctcgggcatcgacaacacccatttcggggcgctgaaggtcaaggatgcgatcgtcgacaacctgcgcgagcgctccggccgacgcccgtcggtggacaaggtcaatccggacgtgcgcgtccacctgcaccttga

SEQ ID NO: 1951 - DNA, 1542 bp, Pseudomonas aeruginosa
tccgaagatccatcgggcctggagaatcaccgttcgctgaggcgagcggcattcatgcaaaaggccgccggcgggcaaccgctggcggcctttttttcgtactgcgccttatttccgcgtgtgcaggctcagcagtacctggtcgaggatcgccgaagcgccccacggccgcgggctgttgaggatcgccaccaccacccagttgtggccgctggcgtcgcggctgaagccggcgagggcgcgcacggtgttgagggtgccggtcttcacgtgcgcctcgccgaccagtgcggtgcgccgcaggcgtttgcgcatggtgccgtcgaggccggccagcggcagcgaggagatgtactccgctgcataggggctgtgccaggcggcttgcagcatcgccgccatctcacgggcgctgacccgttcctggcgcgacagtcccgagccgttctccatcaccaggcgcggcgcggtgatgcccttgcgcgccagccactgccgcaccacccgctgcgcggcctgggcgtcgtcgccgtcggcgctgttgcggaactgcgcgccgatggagaggaacaactgccgggccatggtgttgttactgtatttgttgatgtcgcggatgatctcgaccaggtctggcgagaaggccttggcgatcagcgtggcgttgcgcggtacgctgccctggcggtccttgccgaggatgctgccgcccagttcctgccagatgccgcgcaccgcgccggcggtgtagccggggtggtcgagcagcgacatgtaggtctgcgcgctacagccctggggaatctgtccggtggccagcagggtggtgccgtcgaactgggtcaccgggctgaagcgcagcttcggccaggccgggcaggtggccggcgcggtcatcttcacctggttgtcgatgcgtacgttggccagcggcgggtccatctgcacgttgaccttgttgccgtcggtgcgcaccaccatgcgcacgctcttcaggttgaccagcagcgagtccggaccgaccaggaacggcttggtgtcgtcgccgccgtcgtcgttgaataccggcaactgcgggatgttgaagtagctgcggtcgagtaccaggtcacctgtgaccttggtcacgccattggcgcgcaggtcgcgcatcagcagccagagcttctccatgttcagtttcggatcgccgccgcccttgaggtagaggttgccgttgagcactccgttcttgagctggccgtcggtgtagaactcggtcttccactggtaggtcgggccgagcatttccagggcggcataggtggtgaacagcttcatggtcgaggccgggttcaccgatacgtcggcgttgtagtaggtggggttgcccgggccgtcgagcggaatcagcaccagcgacagatcgttgccggtcagcttgttggtctgcagggctttctgcacgttggccggcagggtggcgttgacctgggcgagggtgggaagggcgaaaggcaggagcgtggcgaaggcaagagtacgcagcgacttgaacattaa

SEQ ID NO: 1952 - DNA, 747 bp, Pseudomonas aeruginosa
gtttccgtgagaatattccttaaagtatatgagttgccatcgagtatctcgacaatatggctcccgtctatatcttgctcaggagaattttttctgaatttttattggcaaggaaatcagacaatgagccgtatcctgatagtcgacgatcatcccgtgattcgcatggccatgaagatgttgctggaagccgaagggcaccagatcgtcggcgataccgataatggcgtggatgccatcagcctcgggcgggagctgaagccggacctggtcatcctcgatatcggcattcccaggctggacggcctcgaggtcatcagccgcctgatggtgctggcgttgcccctgaagatcctcgtcctgaccggccagagcgcctcgctcttcgccctgcgcagcatgcaggcgggcgcagccgggttcgtctgcaagcagggcggactggccgaactggtgacggcggtgaatgcggtcgcctcgggatacagttactttcccagctcggccatgcgtcctgtgcaacagggcgcctattccgacgatgtggaattgctcggacgcctgtccgatcgcgaagtatcggtattgcaatacctcagtcagggttattcgaacaagcagatatccgagcagatgtttatcagcaacaagaccgtcagcacttacaaggcgcgcttgttgttgaagttgaacgccggctcgctggtggatctcatcgagttcgccaaacgcaatacgcttatctaa

SEQ ID NO: 1953 - DNA, 996 bp, Pseudomonas aeruginosa
gcaggcgcgcggcaccctgttgaccgattccgactgggtcgagggcagcaaggcacggctcatgcaccagcagtgcctggcggtggctcggggaggaacggcgagcttcaccgacatggcggtgcgcatcggcgggcaattgctggagatccaccattgggtcacgccctacagggatcgccagggccgggtgctcggcctgatgaacggctggatcgacatcaccgaacgggagcgcctggcccgccagttgcgcgaggcgatgcgccaggcggacgaggcgaatcgggcgaagagcgtcttcctggcgaccatgagccacgagatccgtacgccgatgaatgcggtcatcggcatcctcgaactggtcctgcagcgcctggcgccggagcagcgcgaacgcgcctcgctggaggtcgcctacgaggcagcggggtcgctgcaactgctcatcggagacatcctcgacgtcgccaagatcgagtccggtcacctgaccctcacgcccgagcgggttcgcctgcgccatgtcgtggagtcggtgcgccgcatgttcgaaggcctggcccggcagaaaggcctgaggctcgttgtggagctggacgatgccccgggacgggacgtgctgatcgatcccctgcgcttcaagcaggtgctctccaacctggtgagcaatgcgatcaagttcaccgagcggggacaggtgacgatccgtctccaggaaaggagcctggacgaggggagggcgatcgtccgggtggacgtggaggattccggtatcggtatcgctccggcggaccaggcgcgcctattccagcctttcatccaggtggccaagggacgcacggtgcagggcgggaccggccttgggctggcgatctgtcggaagttggtggacctcatgggcggcgatgtcgagatgcacagcgagccgggcaaaggcacccgggtgtcgctcgacctgctcttgcgccagtgcgggccgaaaatgcctga

SEQ ID NO: 1954 - DNA, 1395 bp, Pseudomonas aeruginosa
acgtccaacccaatgaaaatcaaggaaagtccgggagctttccatgctgcctcaggcaccttgcgaaacgtctgccgaagaaaagcggcggttcgcacgacgactactgcttcgtcatggtgcgttgaagggcgggcgtgggcgtttctggtgctttctctctacgcgcgaaggctgcctcaatccatggataacctgaatagtgcggtgcaagtcctgatccacggctccaataccctgttcatcctgctcggagcggtgatggtgctggcgatgcacgccggcttcgccttcctcgaggtgggcaccgtgcgcctgaagaaccaggtcaacgccctgtcgaagattctgtccgacttcgccatctcggcgctggcctatttcttcgtcggctactggattgcctacggcgtgactttcttccatccggcggcggcgctgaccgtggacagtggctatgcgctggtgaagttcttcttcctgctgaccttcgccgcggcaatcccggcgatcatctccggcggcatcgccgagcgtgccaggttcggtccgcagttgtgcgccacggcgctgatcgtggccttcgtgtacccgtttttcgaaggcttggtgtggaacggcaatttcggcttgcaggaatggctgaagctggagttcggcgcgcccttccacgatttcgccggctccgtggtggtgcatgcgctgggcggctggctggcattggcggcggtgctattgctgggcagccgcaacggccgctatcgcgacggcaagctggtggcgatggcgccgtcgagcatcccgttcctggcactggggtcgtggatcctgatcatcggctggttcggcttcaacgtgatgagcgcccagaccctcgctggggtcagcgggctggtggcggtcaactccttgctggcgatggttggcggcaccatggcgtcgctgctgatcggccgcaacgacccgggtttcctgcacaacggtccgctggccgggttggtggcggtgtgcgccggttccgacctgatgcatccgatcggcgcgctggctaccggcctggtggcgggggccctgttcgtctgggcgttcaccgcgacccaggtgcgctggaagatcgacgacgtcctcggtgtctggccgttgcacggtctttgcggggtctggggcgggattgcctgcggcatctttggccagcaggcattgggtgggctcggcggggtgagcctggccagccaggcgctcggcagcctgctgggggtgacggtggctttcgccggcggcctgttggtctatgggctgatgaaggcgctgctgggcatccgcttgagccaggaggaggagtactacggcgcggacctgtcgatccacaagatcggcgcgatcagccacgaatga

SEQ ID NO: 1955 - DNA, 408 bp, Pseudomonas aeruginosa
cagggagaagaactcccggtgctggtccggcatgaaggtgcggatcgcgcggctgccgaagccggcgacctgttcgcgaacgccggcgcgttcctggatcgccagttcgccggtgtggaagggactctgttcctggctcatgctgcctcctgccgagctacaggccgggcatcgggatgtagccgggcagcgcgcggatgcgggcgatccaggcgttcagcgccaggtagtggtccagcgccaggccgccttcgggggcgagggccaggtaggggtagagggccacgtcggcgatgctcggctgttcgccctgggccagccagcgatgctcggccaggtgccggtcgaccaggcgcagcacttccaggcctcgctggtgggtttgctcgcgatccagcggcaggttaa

SEQ ID NO: 1956 - DNA, 1299 bp, Pseudomonas aeruginosa
gcaggtgcccctggagcaggctggcggccgcgtgctggcggtcgacctgctggccggcctggacctgccgccgtggccgaacagcgccatggacggctacgccttgcgcctcgccgactggaacggcgagccactgccggtcagccagaagatctttgccggacaggcgccgaagccgctgcaagcggatacctgtgcgcggatcttcaccggtgcgccgctgcccgaaggcgccgatctggtagagatgcaggaaaacgccgaagcgctcgacgatggccgcgtgcgcttcacccagccgttgcgcgtgggccagcatgtgcgcccgcgtggccaggaaatccgccagggcgacctggtcctgccggccggcacgcgcctgcgctccatcgaactggggttggcggcttcgctcggctacgcggccctggaggtgcgacgcaagccgcgggtggcgctgctgtccaccggcgacgagctggtcgaggcgggccagccgctgcaggccgggcagatctacaacagcaaccgtccgttgctcaaggattggctgcaacgcctgggctgcgacgtgctcgacgccggcatccttcccgacgacctggcacgtactcgcgagcgcctggccgggttggccggggtggacctgatcctgtccaccggcggcgtatcggtgggcgaggccgacttcctcggcatggcgctgcgcgaagccggcgagctgaccctctggaagctggcgataaaacccggcaagccgctgaccgtcggccagttccagggcatcccggtgatcggcctgccgggcaatccggcttcgaccctggtcaccttcgccctgctggcgcgtccctacctgctgcgccggcttggcgtggcgcaggtcgcgccgctgcgggtggaggtaccggccggctttgcctggaccaaggcggggcagcgtcgcgagtacctgcgtggtcgcctggagcagggccgcgcggtgctctatccgaaccagagttccggggtactgcgcagcgcttcctgggccgaggggctggtggaggtccgcgagggacgtaccctcgtggaaggcgagggtgtggcgttcattccgctgagcgaactgctcgactgagccgacggtggccggatggccgccgttctcattgcgccgccggctccttgcgccgttgccggtactcgccgggcgtctgcccggtccaacccttgaaactgcgatggaacgagcgcgactcggtaaagcccaggtactgggcgatgtcctggatcggcagctcgctatgcagcaggtag

SEQ ID NO: 1957 - DNA, 2439 bp, Pseudomonas aeruginosa
gggacgcttcgggatcatttcctcggtgaaggtgcgggtctcgccgctggccgaggacgagcgcttctacagcgtcttcctgccgaactggcagcaggccctgcaagccacccgcgagctggcacaggcgcgcgtgccgctgtcgatgctgcgactgtccaacgccgtggaaaccatgacccaactggccctggccggccatcccggacagatcgcctggctggagaaatacctggcgctgcgcggcgcgggcgagggcaagtgcatgctgaccttcggcgtgaccggcaaccgccggcagaacggattgtcgctgagccaggcgaaggccttgctgaaacgcttcggcggggtcttcaccggaaccctgctggggcgcaagtgggcgcagaaccgcttccgcttcccctacctgcgcgaggccctgtggcaggcgggctacgccgtggacaccctggagaccgccaccgactggagcaacgtcgacggcctgctgcagaagatcgaggccagcctgcgcgacggcctggcggccgagggcgagagggtccatgtgttcacccacctctcgcatgtctatggcgaggggtcgagcatctataccacctacgtgttccgtccggccgcgagctatgcggcgacgctggagcgctggaagcgtctcaagcatgcggccagccaggcgatcgtcgacaatcgcggcaccatcagccaccagcatggcgtcggcaaggaccacgcaccctacctgccccgcgagaagggcgaactgggcgtcgccgcgctgcgtgccatggccggtcacttcgacccggccgggcggctcaaccgcggcaccctgctgcaggactgagcggaatgacttcagcctggaacgaggagtggcgtcgccgccgcctgccggcgctggcggggcaggagtgggacctgatcgtggtcggcggcggcatcagcggtgccggcatcctccgcgaagccgcgcggcgcggctggcgctgcctgctgctggagcagcgggacttcgcctggggcacctcgagccgctcgtcgaagatggtccatggcggcctgcgctacatcgcgaagggccagtggcggctgacccgcgactcggtgcgcgagcgccagcgcctgctcggcgaggcgcctgggctggtggagccgttgagcttcgtgatggcccactaccgcggcggctttcccggcccgcggctattcggcggcctgctgagcgtgtacgacgcccttgccgggcggcgcaaccaccgtttctacgacgccgccgcgttgcgctacctggcgccgggcctgaaggaacaacggctgctcggcggcacgcgattcttcgatgcggtgaccgacgatgcgcgcctggtgctgcgggtgctggccgaggcgcgtcacgacggcggcgaggcattcaacggcatgcgtgtgcgcgaattgctgcgcgagggcggccaggtggtcggcctgcgcgccgaggaccgcgagagcggcgagcttttcgactttcgctgccgcgccctggcgctggccaccggggcctgggccgatgagttgcgccagcccggcggaagcgagcacatccgcccgctgcgcggcagccatctattgctgccggcctggcgcctgccggtggcccatgccttcagcttcatgcacgccacggaccggcgaccggtgttcgtgttcccctgggagggcgcgacggtggtcggcaccaccgatctcgaccatcgcgacggccttggggaggacgcgcggatcagccgcgccgaactcgactacctgctggcggcctgcgcccagcagtttcccgccgctgccatcgaggcgcgcgacgtgctgtcgacctgggccggcgtgcgaccggtggtcagcagcggcgacgacagcggcaagccttccgacgagaaacgcgagcatgtgctctggcgcgagccgggctgcgtgaccctggccggcggcaagctgaccaccttccggccgctggcggtggaggtgctacaagcctgcgcgccgctgctcgggcgcacggtcacggacgatggcgcggcggtgttcggcgcctgcgaaggcccgctcatcgacgggctcggcagcggccagcgacgccgcctggccggtcgctacggacgcgacctggtccgcctcaagcggctggtggacaccctcggaacggactgcgtgggtgccagcgaaacgctctgggccgaactggcgttcgccgccgaggcggaaatggtgctgcatctcgatgacctgctgttgcgccgcacccgcctcggcctgctgttgcccggaggcggcgcggcatacctgccgcgtatccgcgcactctgccaagcgcgcctgggctgggacgacccgcgctgggaacgtgagcaacaggcctatctggacctctggcgccggcaatacagcctgcccgtctga

SEQ ID NO: 1958 - DNA, 618 bp, Pseudomonas aeruginosa
gcaaagacaaggccacgacgaggggttcggttcgatggacaaggacaaggttctgctggtcctgcatggcaagcaggcgggcaacgaagaggttcgtgccgcggtcgcggcgcagcgcgaggccggacgggcgctggcggtgcgagtaacctgggaggacggcgacgcccggcgcatcgtcgaggaggcgctggcggccggctatgcgacgctggtcgccggcggtggcgacggcacgctgcgcgaggtggccgaagcgctggcgcgcgggcgaggcgaggcgagcctggcgatcctgccgctgggcaccgccaacgatttcgcccgcgccgccgggattcccctggaaccggccgcggcgctggcgctgctcgaccagacggcgcggccgatcgacctgggcgaggtgaacggcaagctgttcctcaacatggccactggcggcttcggttcgaaggtcacggcgaatacctcggaggacctgaagaaggttctcggcggtgccgcctacctgttgaccgggttgacccgtttttccgaagtgcatgccgcccagggccgtttcagcgccccggacttccagtgggaaggcgagttcctcgccctgggcatcggtaa

SEQ ID NO: 1959 - DNA, 1389 bp, Pseudomonas aeruginosa
cgggcgccaggccggcggcgggcacgtactgtgtccgcaagcgcgagtggacgacggcctgctggacgtgagcatcctgccgacgccgcaggacatggtcggtaccctgggcaccctgctcggcggtggcaacggagtggaaagcctgttcgtccgcgcgcgggtgccatggctggaagtggaggcggcggaaggtctcgacgtcaatctcgacggcgagccgctggaaggacgcaagctgcgtttctcggtttccccgggcgcgctgcgcgtgcacttgccggccggttcgccgttgttgcgcgagccgccgcgcgaggactgagggcggggccgactgatccgctgcctggagtggcgtctgtgtcttgtcggcctttcccgcgacaccgtataacagcatctttccaccaaggatgctggttccatgttccgtctctccgcgctgtaccgctatccgatcaagtcttccgccgccgagtccctggagcgcgtcgcgctcgatgcgctgggcgtggtcggcgaccgacgctggatggcggtggacaccgaaaccggacgtttcttcacccagcgcctgctgccgcagctggggcgtatccaggcgcgctgggcggcgccggaggtcctgcggctgaatgcgccggggatgtccgagctgagcctcgaagtaccggcagccgacgccaacctgcgtggcgtcacggtctggcgcgataccttgcaggcgccggatgccggcgacgccgcagcggactggctgacgcgcttcctcggccgcccgacgcgcctggtgcacattcccgaggcgcgcgcgcggcaggtcgataccggctacgccgaaccggggcagaaggtgcatttcgccgacggtttcccgctgctgctgatcggccaggcttcgctcgacgacctcagccagcgggtcggccggccgttggagatgctgcgcttccgtcccaacctggtggtggaaggcagcgccgcgttcgccgaggacggctggaaacgcatccgcatcggctcggtcgagttcgtcgtggccaagccctgttcccgctgcatcctcaccaccctggatccggcgaccggcgagcgcaacgaggaccgcgagccgctgacgaccctgaagacctaccgggaaaaggatggcgcggtgctgttcgggcagaacctgattgcgctgggacagggcagcctggaggtggggatgccggtggaaatcctcgactgaggaacggtcgcccgccgttgcggcgggcggccattgccggcgatcagagcttggcgtcgacgcaaccggtgctcaggcactcgcgctcgcgttcgcggaggaagtcgaggcgctggcgggtcttctcggtggcgcagtcgaggttgacgaaataa

SEQ ID NO: 1960 - DNA, 1701 bp, Pseudomonas aeruginosa
cctggcgcgcctctcgcgggtccagcaggaactcgaggcgcgcgatggctggcgcctgcagcaactggtggacagcaccctcagccgcctgcagttgccggccgacaagaccctcgccgaactctccggcggctggcgtcggcgcgtgctgctggcccaggcgctggtcgccgagccggacctgctgctgctcgacgaaccgaccaaccacctggacatcggcgccatcgcctggctcgaggaagcgctgctgggcttcaacggcgcggtgctgttcattacccacgaccgcgccttcctgcaatccctggcgacccgcatcctcgagctggatcgtggccacctgatcgactggaacggcgactacgccagtttcctggtgcacaaggaacagcaactggccgccgaagaagctgccaacgcattgttcgacaagcgcctggcccaggaagaagtgtggatccgccagggcatcaaggcccgccgcacgcgcaacgaagggcgggttcgggcactgaaggaaatgcgtcgcgaacgcgccgagcgccgcgagcgccagggcaaggccagcttccagctggaaagcgcggacaagtccggcaagcaggtgatcgtggtggagcacgtcagcttcgcccatcccggcggccagccgctggtacgcgacttctccatggtcctgcagcgcggcgaccgtatcggcctgctcggcgccaacggtaccggcaagaccaccttgctcaagctgctgcttggcgacctgcagccgacctcgggcaagatcgaggtgggcaccaagctggaagtggcctacttcgaccagttgcgccatcagctcgaacccgagcagacggtgatcgacaatatctccgaaggccgcgagttcatcaccatcgacggccagaaccggcatgtgctcagctatctcggcgacttcctgttcagtccgcagcgcgcccgcaccccggtgaaggcgttgtccggcggcgagcgcgcgcgcctgttgctggccaagctgttcagcaagccggccaacctgctggtgctcgacgaaccgaccaacgacctcgacgtggaaaccctggaactgctggaggaagtcctgctcggcttccagggcaccgtgctgatggtcagccacgatcgggccttcctcgacaacgtggtgaccagcaccctggtcttcgagggcgagggcaaggttcgcgaattcgtcggtggctaccaggactggctgcgccaagggggcacgccgcgcctgctcggcgtgagcgagtcgaagagcggcaaggccgagctgaataccgcgctggcgcccgccgccgaacccgcgccggctgctgcggcgccgagcgaggcgccggcgaagaaaaagctcagctacaagttgcagcgcgagctggaggctttgcccgggcagatcgacgcggtcgaggcggagctggcgggtgtccaggaaaccatcgcgcagcaggatttctatctgcgcccgcaggacgagcagcgcgaaaccctggcgcggctggacgcgttgcagcaggaactcgatgccttgctcgagcgctgggccgaactggaagactgatccatctcgaaaaagtgagctgcatcaatgtgatagcggctcatctcgatgatccttgcgggccttgccggcggtgggtgcagtcccccgtcggtccctctggctggcgtcattga

SEQ ID NO: 1961 - DNA, 720 bp, Pseudomonas aeruginosa
cgggccggccgtctcccgagaaaggatcagtccatggcaatcgagtaccgcatcacgctggacgaccagcatcagctcaactatcgcatcgagctggagcggcactacgacccgcaggcggctgccgcagcgccgcgctggacgcgcctggaacacaatcgctgcagcaactgcccgctcgatcgcgaacgctacagccattgtccggcggcggtcgacctgcatggggtgatcgaggatttccgcaacctgccggcgttccgcaaggccggcatctgcgtgcgcacgccggagcgcgagtacatcaagcaggcgggcctggaggaaggactgcgcgcgctgatcggcttgatcatggccagcagcgcctgtccgctgctggcgccgctgaggccgatggccatgcagcacctgccgttcgccagcaaccaggagttcgtgctgcgggtggtgccgctgtacctgatgcgccagtacttcaacttccgcgaggggcggcatgccgattgggaactgaaagggctggtgcggctgttccagcagttgcaactggtcaaccaggcgttctggcagcgaatccacgacacctgtgtcagcgattccaacctgaaggcgttcctgaccttcttctcgctgtcgtcgagcatcagctattcgctggaaacccagttgcagaagatccgcccgctggtgatgagcgccgaggaaacgctcggctga

SEQ ID NO: 1962 - DNA, 402 bp, Pseudomonas aeruginosa
cgccgtcgagtggatcgcctcgggcaaggaaaacaaggccgaggacgccctgaaggtcggcgccgtcgacgccgtggtcgctcccgagcaactgcaggccgctgccctcgacctggccaagcgcgccgtcgccggcgagctggaccacaaggcacggcgccagccgaagctggaaaagctgaagctgaatgcaatcgagcagatgatggccttcgaaaccgccaagggcttcgtcgccggccaggccggtccgaactacccggcgccggtggaagccatcaagagcatccagaaggccgccaacttcggccgcgacaaggcgctggaagtcgaagccgccggcttcgtcaagctggccaagacctcggtcgcgcagagtctgatcggcctgttcctgaatga

SEQ ID NO: 1963 - DNA, 699 bp, Pseudomonas aeruginosa
aaccgccatcgccaccaccgtcgcctacgccaagaagatgggcaagagcccgatcgtggtcaacgattgccccggcttcctggtcaaccgtgtgctgttcccgtacttcggcggcttcgccaagctgctgagcttcggcgtcgacttcgtgcgcatcgacaaggtgatggagaagttcggctggcccatgggcccggcctacctgtccgacgtggtcggcatcgacaccggccaccatggccgcgacgtcatggccgagggcttcccggaccgcatggcggtcgagggcaagaccgccgtcgacgtgatgtacgaggccaaccgcctgggccagaagaacggcaagggcttctacgcttacgagaccgacaagcgcggcaagccgaagaaggtcaccgatccgcaggcctacgaagtgctcaagccgatcgtggtcgagcagcgcgaagtgaccgacgaggacatcgtcaacttcatgatgatcccgctgtgcctggaaaccgtgcgttgcctggaagacggcatcgtcgagaccgctgccgaggccgatatgggcctgatctacggcatcggcttcccgcccttccgtggtggtgctctgcgctacatcgattcgatcggtgtcgccgagttcgtggccctggccgacaagtacgccgagctgggcgcgctgtaccacccgaccgcgaagctgcgtga

SEQ ID NO: 1964 - DNA, 420 bp, Pseudomonas aeruginosa
agtcgagcatcggccacatccgtgacctgcccaccagtggttcgtcgagttccaaggagccggcggccaagggccgcaagagcgcctccgaggcgccggcgctgtcaccgaaggagaaggccaggcgccaactggtctcgcgcatgggggtcgaccccgagcatggctggaaggccaagtacgagatcctgcccggcaaggaaaaggtcatcgacgagctgcgccgcctggccaaggacgccgacaccgtctatctcgcgaccgacttggaccgcgaaggggaggccatcgcctggcacctgcgggaagccatcggcggcgacgaaagccgctacaagcgcgtggtattcaacgaaatcaccaagaaggccatccaggaggccttctcccagcccggcgagctcgatatcaaccgggtga

SEQ ID NO: 1965 - DNA, 249 bp, Pseudomonas aeruginosa
ttcccggcgacgagatcgccgcggacgacgagggcgagtccgagtcgcgggtgttgcgtggcaagcatcgctgcccgatctgcagtaccgcgatggacgcctacctgctggacgagaaacacaagctgcatatctgcggcaataaccccgactgtccgggctacgagatcgaggaaggccagtaccggatcaagggctacgaagggccgagcctggaatgcgacaagtgtggcagcgagatgcagttga

SEQ ID NO: 1966 - DNA, 567 bp, Pseudomonas aeruginosa
cctggcctgcgctccgcattccttccagttttaatcgggagtaccggcatggcccaagagctttatacccgcaccaaccagaagctgtatttcgccgggttggctctggaggcctggaagcgagccgatgccgagcgggcgatgaatgcccaggcgatcatccagggggagcgcgagtcggcgctgttccacctttatggcgcagtgctcggtgtatgccatgagatcgccggttactaccgtctgccgcaggctgccgctcctcgcgtggatgcattgctgaatgccgaagtgctggcggccgcgcccagccccgagctggctgaactggtggagttggcgtcgcagccggaaacctggctgggccagttgctgggcgcctactccgagctgttcctgccgccgcgaccgaccaaggcagcgaagatcgaccccagcacaccgttgatcgttgccgtgagtatcgacgaagaagcccccttgctttctcgcgaaaccctcgaggaatggcggcagtcgctgaagcaattggtcctgcgttttcgcgagagcctgacggagctgtaa

SEQ ID NO: 1967 - DNA, 816 bp, Pseudomonas aeruginosa
catcgtcgagcaagggtgcgccgttgctggcccagaacgcttcctggaacagtggcaactgggcgctgggcagcgagtgggaggtctgcatggtatctcctgtcagcgccggatcacgccgacgctcaagccttcgatgatcagttcctgctccttcagatcgacttcgatcggagcgaactcagggttttccgccagcagccagaccttgctgccttcgcgcttgaagcgtttcaccgtgacctcctcgccgatccgcgcgaccaccacctggccgttgcgcgcttcgcgggtgacgtggacggccagcaggtcgccgtcgaggatgccgatgtccttcatgctcatgccgcgcacgcgcaacaggtagtcggcgcgaggattgaagaaggcgggattgatacggcaggattcctcgatgttctgttcggcgaggatcggtgcgccggcggcgacccgtccgatcaccggcaggccctcatcgtcgttggcggcatgcggttcgaagccgggaatgcggatgccgcgagaggcgcccggagtcatttcgatggcgcccttgcgtgccagcgccttgaggtgctcctcggcggcgttcggcgacttgaagccgagttcctgggcgatttccgcccgggtcggcggaaagccgtggtcttccaggcagcgcttgatgaaggagaggatctcggcttggcggggcgtcagcttctgcatgtcgtcgctctgtgtttttatccagtgactgggattatatacagtgagcggggcgtggcaatgattttccgcatgacatttcgtcctgcgtcacgatga

SEQ ID NO: 1968 - DNA, 834 bp, Pseudomonas aeruginosa
agttggccagtgtcttgcttccgtttttcgggacttctctgtaattttcctgactggtgcgtcatctgccgcttgacaagggatgtggctgaaacgtatgtttcaaacaagtgtttgtcaggcggagaaaccatggcccagtcggaaaccgtcgaacgcattctcgatgcggcggaacagctgttcgcggaaaaaggcttcgccgaaacctcgttgcgtctgatcaccagcaaggccggggtcaacctggcggcggtgaattatcacttcggttcgaagaaggcgctgatccaggcggtgttctcgcgcttcctcgggccattctgcgccagcctggaaaaggagctggatcgtcgccaggccaagcccgaggcccagcacgccaccctggaggacctcctgcacctgctggtgtcccaggcgatggcggtgaagccgcgcagcggcaacgacctgtcgatcttcatgcgcttgctcggcctggccttcagccagagccaggggcacctgcgcaagtacctggaggaggtctacggcaaggtcttccggcgctacatgctgctggtcaacgaggctgcgccgaagctgccgcccatcgagctgttctggcgcgtgcacttcatgctcggcgcggccgccttcagcatgtcggggatcaaggccctgcgggcgatggcggaaaccgatttcggcgtgaacacttccaccgagcaggtgatgcacctgatggtgccgttcttcgctgccggcatgcgcgccgagagcggcatcgacgatccgctgctggccggggcgcaactgcgcccgcggaacaagacgcccgccaaggcctga

SEQ ID NO: 1969 - DNA, 1200 bp, Pseudomonas aeruginosa
tcgcagacggcgccccagggcgccgttttcctttctcctttctctgtgctccgggcggaactccatgcgccaggccggctccattggcaggcgcgcggtaccgccccgggacttaagtctttctgccgggtgcagtacagtgtgcgctgtctgaggcccgtgacggcgggcttcgctgatttccaggccataggacttttcatgcaaggctctctgatgctcgacatcggcggcacctggctgaccgccgaggaccgccaaatcctgcgccaccccgaggtgggcgggctgatcatcttcgctcgcaacatcgagcatcctgcccaggttcgcgaactgtgtgcggccattcgcgccatccgtcccgacctgttgctggccgtcgaccaggaaggagggcgcgtgcagcgcctgcgccagggcttcgtgcgcctgccggcgatgcgcgcgatcgccgacaaccccaatgccgaagagctggccgagcattgtggctggctgatggcgaccgaggtgcaggcggtcggcctcgacctgagtttcgcgccggtgctggatctcgaccaccagcgcagcgccgtggtcggtagccgcgccttcgagggcgacccggagcgtgccgcgctgcttgccggtgctttcattcgcggcatgcatgccgccgggatggccgccaccggcaagcattttcccggtcacggctgggccgaggccgattcccatgtggcgattcccgaagacgcgcgcagtctcgaggaaatccggcgcagcgacctggttccgttcgcccgcctggccggacagctcgacgcgctgatgccggcccatgtcatctatccgcaggtcgacccgcagcccgccggcttttcccggcgctggttgcaggagatcctgcgcggcgagctgaagttcgacggggtgatattcagcgacgacctgtcgatggccggcgcccatgtggtcggcgacgccgccagccgcatcgaggccgccctggccgcgggctgcgacatgggcctggtgtgcaacgaccgggcttccgccgagctggccctggctgccctgcaatgcctgaaggtgaccccgccgtcgcgtctgcaacgcatgcgtggcaagggctacgcgaataccgactatcgccagcagccgcgctggctggaagcactgtccgcgttgcgcgccgcgcaactgattgattga

SEQ ID NO: 1970 - DNA, 966 bp, Pseudomonas aeruginosa
tccttaggtggtttgcggtgtcaggcgctcgaacagcgcctccagggtattgaagcgttcttccggtcgttccatgggcacctggaagcggaacagggttgcgccttcgaacttgtagcggttcggttggccctggatcagcttgatcaataccagcgggtcgacctgggtatcggcggcgaattctatacgaccgccctgcggtccggcatcgaccttgagtattccaagtttttccgcctgcagtttcagaagggtcaggcgcatcaggttcttcgccggatcgggcaggagcccgaagcggtcgatcatctccacctgcaactcgcgcaaaccttcctcgtcaggggcgttggcgatgcgcttgtaaaggatcagccgggcatgcacgtcgggcaggtaatcctcggggatcagcgcaggcacccgcaggttgacctccggcccgccgcccagtggctgctcgaggttcggttgctcgcccttgcggatgggcttcaccgcccgttcgagcatttccatgtagagggtgaagccgaccgcctggatctgcccgctctggccgtcgccgagcaactcgccgggcgccgcggatctccaagtcgtgggtggcgaggaaggaacccggcgcccaggtcctgggcgtttggcgatggcttccaggcgtttctcggcgtccggcgtcatctgacggcgcggcggtgtcagcaggtaggcgtaggcctggtggtggctgcgaccgacgcggccgcgcaactggtgcaactgggccaggccgaacttgtcggcgcgctcgatgaggatggtgttggcgctgggcacgtcgatgccggtctcgatgatggtcgaggccaccagcacgttgaagcgcttgtggtagaagtcgctcatcacctgttccagctcgcgctcgtgcatctgtccgtggccgatgccgatgcgcgcctccgggaccagttcggctag

SEQ ID NO: 1971 - DNA, 2124 bp, Pseudomonas aeruginosa
ccgcgcagcgttctcgacttccttggcgctcttgaagcggctcatcacctcgacgctcaccggccagtcggcgaagcggtcgcggaagctgttgtagtgctgctgggcgagcagggtggtgggcaccagcaccgccacctgcttgccgctatgcacggcgacgaacgccgcgcgcatcgccacttcggtcttgccgaagccgacgtcgccgcagaccaggcggtccatgggcctgggcgcgagcatatcggcgaccaccgcctcgatggcgctttgctggtccggcgtctcctcgaacgggaagccggccgagaaggtcgcgtagtcggcctgcggatccttgaacgcgaagccttcgcgggcggcgcggcgggcgtagatgtcgagcagctcggcggcgacgtcgcggacctgctcggcggccttgcgcttggccttctgccaggtttccgagccgagccggtgcaacggcgccagggcgtcgtcggcgccggtgtagcgggcgatcaggtgcaggttggcgaccggcacgtagagcttggcgtcctcggcgtattgcagcatgaggaattccgcctgctggttgtccacctcgagggtgatcaggcccaggtagcggccgacgccatggtcgatgtgcaccaccggcgcgccttcgcgcagctcggtgaggttcttgatcaccgcgtcgccgccgtcgcgggtcttttcccggcgccggcgctgcatgacgcgctggccgaacagcgggctttcggcgaccagggcgagggccggatggtccagcagcaggccctcgtccagcggcgcgatgctgatcgccaggcgtgcctggctggcgaggaaggccggccagccgtcgacttcctcggggcgcagcttcagtcgggccagcagctccagcaggacttcccggcgtccggccgattcggcgcagaacagtacgcggccggggaactcctcgatgaaccggcgcagcgcggccagcggctcggcggtcttggcttcgatcgccaggttcggcagcggcagggccgggaagcgctcgcgcccgacgcccggctcgacgtcctcctggctggcgaccacccgtggccagttcttcagccgggcgaagcagtcttccaccggaaggaacacttccgccggcggcagcaatggccgttccggatcgacccggcggtcctcgtagcggctgcgtacgtcattccagaactgctccgcggcctgttcgatgccgggcagggagaacacctgggtgtcttgcggcaggtagtcgaagagggtcgcggtttcctcgaagaacagcggcaggtagtactcgattcccgagggtgtcaaaccgctggcgaggtcctggtagatcgggcagcgccggtagtcgacgtcgaagcgctcgcggaagcggccgcggaagccggtgaccgcttccttgttcagggggaattcgcgtgccggcagcaggcggatcgactcgaccttgtcgatggagcgctgggtctccgggtcgaaggtgcgcagggtctcgatctcgtcgtcgaacaggtcgatacggaagggcaactcgctgcccatcgggaacaggtcgatcagcgcgccgcggacggcgaactcgccgtgctcgtagaccgtgtcgacgcagcggtagccggcgccttccaggcgcaggcgcatccgctcgacgtcgagtttctggccgacgtcgaggaccaggctgctgccgagcaggaagcgggtcggcgccaggcggtgcaaggcggtggagatcggcaccaccagcacgccgtgcttgagctgcggcaactggtagagggcggcgatgcgctgggaaatgatgtcctggtgcggcgaaaagacgtcgtagggcagggtttcccaatcggggaaatgcaataccggcaggtcgggggcgaagaaccgcagttcctgttccaggcgttcggcattctggctgtcggcggtcagcagcagggtgaagcgcttggcggaactggcggcctcggcgacagccaggctcagcgcggcaccggggaggttgccccagtgttgcttgccggcgctggccggcaggctgggaagacgcagtacggacacgggcaagctgggctccggtcgggaatttga

SEQ ID NO: 1972 - DNA, 1149 bp, Pseudomonas aeruginosa
cggccgcagcatcgaggacttcgtcaaggccgagctggccgaggtggtcggcaagcagaacggcgatgcccgcgaaggcaccgacgtcgtgctctacggcttcggccgcatcggccgcctgctggcgcgcatcctgatcgagaagaccggcggcggcgacggcctgcgcctgcgcgcgatcgtcgtgcgcaagggtgccgagaacgacctggtcaagcgggccagcctgctgcgtcgggactcggtgcacggtccgttcgacggcaccatcaccatcgacgaagaaaacaacacgctgaccgccaacggcaacctgatccaggtgatctactccaacgatccagcgtcgatcgactacacccagtacggcatcaagaacgccctgctggtcgacaacaccggcaagtggcgcgacgccgaaggcctcggccagcacctgaagtgcccggggatcgatcgcgtggtccttaccgctccgggcaagggtgcgctgaagaacatcgtgcacggtatcaaccacaccgacatcggcgccgacgacaagatcatctcggccgcctcctgcaccaccaacgccatcgtgccggtgctgaaggccgtcaacgaccagtacggcatcgtcaacggtcacgtcgagaccgttcactcgtacaccaacgaccagaacctgatcgacaacttccacaagggcagtcgtcgtggccgcagcgcgccgctgaacatggtgatcaccgagaccggtgccgccaccgccgcggccaaggccctgccggtgctgaaaggcaagctgaccggcaatgcgatccgcgtgccgacgccgaacgtgtccatggcgatcctcaacctgaacctggaaaaggccaccacccgcgaagagatcaacgagtacctgcgccagatggccatgcactcggacctgcagaagcagatcgacttcgtcagctcccaggaagtggtttccaccgacttcgtcggttcgcgccatgccggcgtggtggacgccgaggcgaccatctgcaacgacaaccgtgtcgtcctgtacgtgtggtacgacaacgagttcggctacagctgccaggtagtgcgcgtgatggaagacatggctggggtcaacccgccggccttcccgcgttgatgcgcaaggcgtag

SEQ ID NO: 1973 - DNA, 1419 bp, Pseudomonas aeruginosa
ggtttttcaatggatggtcaacatctgcaccagggcgagctgaagcgtggcctgaagaatcgccacatccagttgatcgcgctgggcggggcgatcggcaccgggctgttcctcggctcggcgggcgtcatcaagacggccggcccgtcgatgatcctcggttacgccattggcggcttcatcgccttcctgatcatgcgccagctcggcgagatgatcgtcgaggagccggtggccggctccttcagtcacttcgcacacaagtactggggcggattcgccggtttcctttccggctggaactactgggtgctgtacatcctggtgggcatgtcggagctgaccgcggtgggcaagtacatccagtattggtggccggacgtgccgacctgggcgacggcggcggcgttcttcgtgctgatcaacgcgatcaacctggccaacgtgaaagccttcggcgagaccgagttctggttcgcgatcatcaaggtagcggcgatcatcggcatgatcctgctcggtatctacctgctggtcggcggcggtggcggaccgcaagcctcggtgagcaacctgtgggaccgcggcggcttcttccccaacggtctcagcggcctggtgatgaccctggcgatcatcatgttctccttcggggggctggagctggtgggtatcaccgccgccgaggcgtccgagccgcggaaggtgatcccgaaggcgatcaaccaggtgatctaccggatcctgatcttctatatcggcgccctggcggtgctgctctcgctgtatccatgggaccagttggtggagaccatcaacgcttccggcgacgactacagcggcagcccgttcgtgcagatcttctcgttgatcggcagcggcaccgcggccaacatcctcaacttcgtagtactcaccgcggcattgtcggtctacaacagcggcgtctactgcaacagccggatgctctacggcctggccgcccagggtgacgcgccgaaggtgctgatgtcggtggaccgccggggcgtgccggtgctgtcgatcctggtctcggcgctgatcaccttcctctgcgtgatcgtcaactacgtattgccgcacaaggcgctggagctgctgatgtcgctggtggtggcggcgctggtgatcaactgggcgatgatcagcctgtcgcacctgaagttccgcgcggcgatgaagcgccagggcgtggacaccttcttcaaggcgctctggtcgccgttcagcaactacctgtgcctggccttcgtggtgttcatccttggcatcatgctgatgatccccgggatcaacatctcggtgtacgccattccattctggctgctgctgatgtggttgtgctaccgggtcaagctgtcgctggcggaaaggcgcgggctcggccagcaggcctga

SEQ ID NO: 1974 - DNA, 1347 bp, Pseudomonas aeruginosa
gcactagacatgatcaagataaaacgtggcctggacctgcccatcagcggcgcccccgaacagcgcattgaggcagcacgcccggtacgcagcgtggcgttgatcggtttcgactaccacggcatgaagccgaccatggcggtgcaggtaggcgaccgggtgaagctggggcaggtgctgttcaccgacaagaagaatccctccgtcagctataccgcacccggcgccggtgtggtcagtgccatccatcgtggcgagaagcgcgtcctgcaatcggtggtcatcgatctcgacggcgacgagcaactggagttcgcccgttatcccgctgacaaactcgccacgctgagcgccgagcaggtccgcgacaacctgttgcagtcgggcctgtggaccgcgctgcggacccggccgttcagcaaggtgcccgatcccgagtccagccccagttcgattttcgtcactgccatcgatacccagccgctggccgccgatccgcaggtggttatcgcggagcagggcgaggccttccaggccgggctgacggtgctcgggcgcctggcccgggtgttcctgtgcaaggcggaaggcgtttcgctacccggcgaggcgctctccggcgtgaccgcgcaagcattctccggtccgcatccggcgggcctgcccggcacccatatccacttcctcgacccggtgggtgccggcaagagcgtgtggaacctgaactaccaggacgtgattgccatcggcaagctgttcacgaccgggcaattgtggaccgagcgggtgatcgccctggccggtccggtggtggaaaagccgcgtctggtgcgcacccgcttgggcgccaacctcgacgaactggccgccggccagttgcagccgggcaacaaccgactgatctccggctccgtgctgggcggtcgcaccgcccatggcgcctacgcctacctggggcgctaccacctgcagttgtcctgtctcaaggagggcgaccagcgcgagttcctccactacctgcgcgccggggtggaaaagcattcgctgctcaacgtgttcgtctccaggctgctcggcggcaagcgctttgccttcaccaccagcaccaacggcagcccacgggcgatggtgccggtaggtaactacgaggcggtgatgccgctggatatcctgccgactcaactgctgcgctacctgatcgtcggcgacacggaaatggcccagaagctcggcgccctggaactcgacgaagaggacctggcgctgtgcagctacgtctgcgccggcaagtacgaatacggcccgattctgcgggacaatctggcacgcatcgagcaggagggctga

SEQ ID NO: 1975 - DNA, 1215 bp, Pseudomonas aeruginosa
gccatgggtttgcgtaacctgctcgacaaggtcgagcatcatttcgagaagggcgggcgctacgagaagtggtacccgctgtacgaagccgtggacaccttcctctatcgtcccggcagcgtcacccgcaccactgcacacgtgcgcgacggcatcgacctgaagcgcatgatgatcatcgtctggctatgcaccttcccggcgatgttcttcggcatgtacaacgtcggccaccaggccaacctgatcttcgcccagagccccgacctgttgagcgcccaggatggctggcgcttcgccctgatcggcgcgctggccgggttcgacccgaacagcttgtgggattgcctggtccagggcgccgcgtacttcctgccggtgtacctgaccaccttcatcgtcggcggtttctgggaggtgctgttcgccagcatccgccgccacgaggtcaacgaaggcttcttcgtcacctcggtgctgttcgccctgaccctgccgccgtccgtcccgttgtggcaggtagccctggggatcagcttcggcgtggtgctgggcaaggaagtgttcggcggcaccgggaagaacttcctcaatccggcactggtcggccgggccttcctgttcttcgcctacccggcgcagatgtccggcgacgcggtatggacctcggtggacggcttcgccggcgccacctcgctgagcctggccgccgccggcggcgtggacaacatcctcggccacggcttgacctggatggatgccttcctcggccacatgcagggttcgatgggcgagaccagcaccctggcgatcttcatcggcggcgccgtgctgctgctgacccgcatcgcctcctggcgcatcgtcgccggggtgatgctggggatggtcgccatgagctacctgttcaacgccatcggctcggccagcaacccgatgttcgccatgccctggtattggcacctggtcaccggcggcttcgccttcggcatgatcttcatggccaccgacccggtctcggcgtccatgaccgataccggcaagtggctgttcggcgccctgatcggagtgatggtcatgctgatccgggtggtcaacccggcgttcccggaaggcatgatgctggcgatcctgttcgccaacctgttcgcaccgctgatcgaccatttcgtcgttcaggccaacatcaagcggaggctggcgcgcaatggctaa

SEQ ID NO: 1976 - DNA, 1449 bp, Pseudomonas aeruginosa
tcaagaatccaccacccgcacactgctggtagccctggtggtgtgcctggtcagctcggtgttcgtcactggcgcggcggtggcgctgaagccgacccaggcggaaaaccgcctgctcgacaagcagcgcagcatcctcgccatcgctggtctcggcgagccgggcatgtccggcaaagaggtcaaggcgctgttcgacagtcgcatcaccgccaaggtggtcgacctccagagcggcaccttcagcgatgcccaggacccgctcggctaggacccgctgaaagcggccaaggacccggcgctgtcggatgcgctgcccgccgccgaggacatcgcctcgatcaagcgccgcgagcgctataccacggtctacctggtggagaccgacggcaagctcgacaccctgatcctgccggtgcgcggctacggtctgtggtcgaccctctacggcttcctggcgctcaagggcgacctcaatacggtcgccggcttcggcttctaccagcatggcgagacccccggtctcggcggcgaggtcgacaatccgaaatggaaggcgctgtgggtcggcaagaccctctacgacgcccagggcgatcttgccgtacagatcatcaagggctcggtggacccgcaatcggcgaaggcgacccaccaggtcgacggcctggccggcgccaccctgaccagcaagggtgtcgacaacctgctgcatttctggctcggcaaggacggtttcgacgccttcctcgccaatctgcgcaaaggggaggcgtgatggctgctcaacccacgatccgcgaagtcctgttcaatccggtcttccagaacaatccgatcggcctgcagatcctcgggatctgctcggcgctggcggtaacctcgaacctgaagaccgctaccgtcatggccatcgccctgaccctggtgaccggcttctccaacctgttcatctcgatgatccgccggcagattcccagctcgatccggatgatcgtgcagatggtgatcatcgcctcgctggtgatcgtcgtcgaccaggtgctcaaggcctatgcctatagcctgagcaagcagctctcggtgttcgtcgggctgatcatcaccaactgcatcgtgatgggccgcgccgaagccttcgccatggccaacccgccgctcgtgtcgttcttcgacggcatcggcaacggtctcggctacagcgccatgctgctggtgctgggcttcgtccgcgagctgttcggcgccggcaagctctacggcatcagcgtgttgccgacggtcaacgatggcggctggtaccagccgaacggcctgctcctgctgccgccttcggcgttcttcctgatcggcctgatcatctgggccctgcggacctggaagaaagaccaggtcgaggccccgacctacaagatggccccgcaggtatccagcaaggaggcttactga

SEQ ID NO: 1977 - DNA, 1275 bp, Pseudomonas aeruginosa
tgtcgttgggcttcatgtcgttctccggcgtgcagttgtaaggagaggcccgtgatcggattcgagattttcctggccatcggcatgttcaccgccatcgtcctgggcctggtggcgatcatcctggtcgcccgcgccaagctggtgtcgagtggcgacgtgaccatccagatcaacggcgagcacagcctgaccgtgccggccggcggcaagctgctgcaaaccctggcggcgaacaacgtgttcctgtcttccgcctgcggcggcggcggcacctgcgcgcagtgcaaatgcgtggtggtcgagggcggcggcgagatgctgcccaccgaggagtcgcacttcacccggcgccaggcgaaggaaggctggcgcctgtcgtgccagacgccggtcaagcaggatatgcagatccgcgtgcctgaagaggtcttcggggtgaagaaatgggagtgcacggtggagtccaaccccaacgtcgccaccttcatcaaggaactcaccctgcgcctgccggacggcgagagcgtggactttcgtgccggcggctacgtgcagctggaatgcccgccgcacgtggtcgagtacaaggacttcgatatccagccggaatatcgcggcgactgggacaagttcaacatgtggcgctacgtgtcgaaggtcgacgagacggtgatccgcgcctactcgatggccaactacccggaagagaagggcgtggtcaagttcaacatccgcatcgcctcgccgccgccgggcagcgacctgccgccggggcagatgtcgtcctgggtgttcaacctcaagccgggcgacaaggtcaccgtgtacgggccgttcggcgagttcttcgccaaggacaccgaggccgagatggtcttcatcggcggcggcgccggcatggcgccgatgcgttcgcacatcttcgaccagttgcgccggctcaagtcgaaccgcaagatcagcttctggtacggcgcgcgctcgctgcgcgaggccttctataccgaggagtacgaccagctgcaggcggagaatcccaacttccagtggcacctggcgctgtccgacccgcagccggaggacaactggaccggcctgaccggtttcatccacaacgtgctgttcgagaactacctgaaggaccacccggcgcccgaggactgcgagttctacatgtgcggcccgccgatgatgaatgccgcggtgatcaagatgctcaccgacctgggcgtggagcgcgagaatatcctgctggacgatttcggtggctga

SEQ ID NO: 1978 - DNA, 807 bp, Pseudomonas aeruginosa
cgtcggccatcgacacctgcgcatcgacggccagcgcctgtgcaaggacgccgccgtacagctggacttcgacagcatcgccgctggctatacggtggacgcggtaggcgaacgcctgaaggagctcggcgtgcgcagctacctggcggaaatcaccggcgagttgaaagccgaagggcgcaagccggacggcacgccctggcgcatcgctatcgaagcgccgcgcgagggccagcgggtcgcccagcaggtactggcgctggacggctacggcgtctcgacctcgggcgattaccgcaactatttcgaagagaacggccagcgctattcgcacaccttcgacccgcgcaccggcgcgccgatcgaccatcacctggcttcggtcacggtgatcgatccgtcgacgcgcaacgccgacggcctgtcgaccctgctgatggtgctcggtccggaggagggctaccgtttcgccgagaagcaccgactggcggcgctgttcgtcagtcgccagggcaacggtttcgacagccgcaccacgccacgctacgagcaactgttcggcaaccaaggagaacgtccatgacctggctactggtcttcgtcatcatgctgctggtggtcttcggcatgtccatcggcgtcatcatgggccgcaagccgatcgccggttcctgcggcggcatcgccaacctggggatcgagaaggaatgctcgatctgcggcggcgaccggcagaaatgcgaggaagccaaccgcgacgaatctgtagtgcccggaaaactcgcctacgacgcgaccaaacgctaa

SEQ ID NO: 1979 - DNA, 1254 bp, Pseudomonas aeruginosa
tgctcgacgatgtcgtgctggtctgcggcgcggccctggtcctcagcttcttcgccactttgtatccagcctggcgtgcggcgcgcacccagcctgcggaggctttgcgttatgaatgacaagtcggtgctgagttgccgcaacctgagcaagagctacgacgaggggccgcaatcggtgcaggtgctgtccggcgtcgagttgaacctgctgcctggggagcgggtggctatcgtcggcagctccggttcgggcaagagcaccttgctgaacatgctcggcggcctggacacgccctccgccggcagcgtctggctcgccggcgaggaactctcggcgctgaacgagacggcccgcgggctgccgcgcaaccgcgcgctgggcttcgtctaccagttccaccacctgttgccggagttcaccgctctggagaacgtctgcatgccgctgttgatcggccgcacgccgatcgcggaagcccgccagcgggcggccgagctgctggagcgggtcgggctggggcatcgcctgttcgcacaagccggccgagctgtccggcggcgagcgccagcgggtggcgatcgcccgcgcgatggtcaaccgtccgcagctggtactgctcgacgagcccaccggcaacctcgaccagcataccgcccagggtatccaggagctgatgctggaactgagccgttcgttgcagacctcgttcctggtggtaacccacgatctccagctggccgggcacatggatcgcatcctgcgcctggaagaaggccgactgatcgccgcgtagcggggcgacggcgtgcccgccgtccgctcccgtccggcgaatcccccatcgactcggtgcatccgcgacatgttcagaccgttaccgttcttcataggcctgcgctacacccgcgccaaacgccgcaaccactacatctcgttcatctcgctgacctcgatgatcggcctggcgctgggcgtgctggcgatgatcatcgtgctctcggtgatgaacggcttccagaaggaaatgcgcacgcggatcctcggcatggtgccgcatgccaccatcagcgcggcgcagccgctggacgactggcagaccgtcgccaacgcggcgcttcggcaccgcgaggtggtcggcgcggcgccgttcgccgaactgcagggcatgctgtcgtacaagggcaatatgctgccggtgctggtcaacggcatcgacccgcaggaggagcgcaaggtttccatcgtcggtga

SEQ ID NO: 1980 - DNA, 1056 bp, Pseudomonas aeruginosa
gcacatcgtccagggcagcctggacgacctcaagcctggcgagttcggcatcgtcctcggcgagatcaccgcgcggcgcttccatgtcaatgtcggcgacaagctgaccctgatcgtcccggaagccaccagcgcgccgggcggcatcactccgcgcatgcagcgcttcaccatcgtcgccctgttcaaggtcggtgccgaactggacaactcgctggcgctgatcgacatcgccgatgccggccagttgctgcgcctgcaaccgggccaggtgccgagcgtgcgcctggagctgaaggatctctaccagtcgccgcaggtcgccgccaaggtggtcaaggagttggggcagggcttcaggtccagcgactggaccaggacccagggcagcctgttcaacgcgatgaagatggaaaagaccatgatcggcctgctcctgctgctgatcatcgcggtcgccgccttcaacatcatcgccaccctgatcatggtggtcgccgacaagcgcaccgacatcgcgattcttcgtaccctcggcgccacgccgcggcagatcatggcgatcttcatggtccagggcaccgtcatcggcgtgatcgggacggtcatcggcggggtactcggggtgttcgcggcgttgaacatcaccgggatgatcgaccgcatcgaacggttggtcggacacaaggtcttcagctcggatgtgtacttcatcaactacctgccttccgatctgcaggtgctggacgtggtgctgatctgcagcgctgcattgctgatgagcttcctcgccaccctgtacccatcctggcgcgcggcgcggacacaaccggccgagtcgctgcgctacgagtgagcgagaaggcctgcgccagtcccagcacggggcggacaaggcccacgaaaaagccgccttcgaggcggctttttcatgtccggcggatcacttcgcggcgacccgttcgcgacgttgccggcagcgtcggctccaactgcgctgcacccaccagcgccagtagagcatcgtcagcgcgtagccgaggatggcggcgatga

SEQ ID NO: 1981 - DNA, 1149 bp, Pseudomonas aeruginosa
atcggcgggcgacaacaacctgccggtggtgatcagcgccgatgccaagtccacccaccagtcggtggtcacggcgatggacgcagcgggcaagctgggcttcgtccacctgcgcatcaccacggtcgagaacacggcggccaagccctgatgtcgttctccgagcgactgctcgccgcctggtaccaggggcatccggcgctggcgctgctgcgtccgctggaggctctctatcgtcgggtggcgaacggccgccgggcggacttcctgtccgggcgcaagcccgcttaccgggcaccgctgccggtgctggtggtaggcaatatcaccgtcggcggaaccggcaagacgccgatgatcctctggatgatcgagcactgcagggctcgcggcttgcgggttggcgtgatcagccgcggctatggtgcccggccgcccaccacgccgtggcgggtgcgggccgagcaggacgccgcggaggctggcgacgaaccgctgatgatcgtccggcgcagcggcgtgccgctgatgatcgacccggatcgtccgcgcgccctgcaggcgctgctcgccgaagagcagttggacctggtcctctgcgacgatggcttgcagcactatcgcctggcgcgcgatctggaactggtgctgatcgatgccgcgcgcggtctcggcaatggtcgttgcctgccggccggtccgttgcgcgaaccggcggagcgtctggaaagcgtcgacgcgctgctttacaacggcgccgacgaggatcctgacggcggttacgcattccgcttgcagcctactgcgctgatcaacctgcagagcggcgagcgccgaccgctggagcattttcccgcgggccaggaggtccatgccctggccgggatcggcaatccgcagcgtttcttcaggacgctcgaggcgctacactggcgggcgattccgcatgccttcccggatcacgcgacctacacggcggccgaactggcgttcagcccgccgctgccgctgctgatgaccgagaaggatgccgttaaatgccgggctttcgcagcggccgactggtggtacctggcggtcgatgcggtgccttccccagcattcgtcgcctggttcgacgcccgactcgagcatctcctggcgcgctga

SEQ ID NO: 1982 - DNA, 987 bp, Pseudomonas aeruginosa
ccggcggccgtgccgccattgtatgaaggactccgccatggacccgaaactcctcgatatccttgcctgcccgttgaccaagggcccgctggtgctcagcgaagacaagaccgaactgatcagcaagcaggccggcctggcctatccgatccgcgacggcatcccggtgatgctggagagcgaggctcgctccctgaacgtggacgagcggctggacaagtaatgacccaggcgttcactgtcgtcattcccgcccgctacgcctccactcgcctgcccggcaagccattgcaggatatcgccggccagccaatgatccagcgcgtctggaaccaggcccgcaagagcgccgccagccgcgtggtcgtcgccaccgacgacgaacgcatcctggcggcgtgccaggggttcggcgccgaggcgctgctgacgcgtgccgagcacaactccggcaccgatcgcctggaggaagtcgcttcccggctcggcctggccagcgatgccatcgtggtcaacgtccagggcgacgaaccgctgatccccccggcgctcatcgaccaggtggcggccaacctggcggcgcacccggaagctgccatcgctaccctggccgagccgatccatgaggtctccgcgctgttcaatccgaacgtggtcaaggtcgccaccgacatcgacggcctggccctgactttcagtcgtgcgcccttgccctgggctcgcgacgccttcgcccgcgatcgcgacagcctgccggagggcgtgccctatcgtcgccacatcggcatctacgcctatcgcgtgggtttccttgccgatttcgtcgcctggggaccgtgctggctggagaacgccgaaagcctcgagcaattgcgcgcgctctggcacggggtgcgaatccatgtggccgatgcccgcgaaaccatgcttccgggcgtggatacgccggaagacctcgaacgcgttcgccgcgtgctggggggctga

SEQ ID NO: 1983 - DNA, 501 bp, Pseudomonas aeruginosa
cctgttcaagcaggagccggatcgctggctgatcctccgcgtgcgcctgcgcctgacgcggcgggagaggctgcacctggactacgggccggtacgccagcgcctggaggaggagggcatcgccagtccgacggccagggacgtaagccgggtaatctgcgccattcgccgggagaagctgcccgaccccgccgtattgggcaatgccggcagcttcttcaagaacccgctggtggatgcggcgcaggccgaacgcttgcgtcaggccttcccggatctggtcggctatccgcaggcggacggtcggctgaagctggctgcaggctggctcatcgacaagggcggctggaagggtttccgcgatggcccggtgggggtacacgcgcagcaggcgctggtcctggtcaaccatggcggcgccactggtgcccaggtccgggcattggccgagcgtatccaggaggacgtccgtcggcgtttcggcgtcgaattggagcctga

SEQ ID NO: 1984 - DNA, 1071 bp, Pseudomonas aeruginosa
gctgccgcttcggctgctgctgcggcttcgcgtgccagacgctcggcttcgcgttgcaggcgacgtttttcccgtgggtcgttgagggcacggccagtcgcgttggccggcaccgccgcgatggccggggtcggctcctcggtggctgcgggctcgctaggggctgctacttcgacgggcaccggagcggcaacttcttcggccgcttccgttgccggttgcacggcgctctcggcgtcttcgcggctttccacgctttcgctggcgaagggagcttcttcagtggcttgcgcgaccagcagggtgctctggtcggcttcgtcccggaccacgctgacggtcaccggcgcttcgatgtcggcggtttcgccggtattggcctcgctgtccgcgtcctgggtttcgacggcttcgctggtcgacgcgtcggtctcatcgcttgccgtggtttcgctggcagcctcgctggtagtggccggggcttgctccacgtttgcttctacggcttcgctggcgacagcgataccggcagcggcggcggctgcgacggtgttcagcggcgcggcggcattatcggtcgcctcgctgccttccacctcgccgctgacctcgcgctggcgttcgcggcggttgctgcgacgacgctggccgcgggagcggcggcgcgggcgctcgccatcggtatcgtcctgctcgtcctgctccaggctctcgtcgttcggcaatgcctcggcttccagggccgcggcgtcgcgagcctggcgatcctcgcgcggctggcgctcttcgcgggccgggcgttcgacgcgttcttcacggccttcgcggggttggcgctcttcgcgggccgggcgttcggcgcgctcttcgcggcggcgttcgctgcgttcctcgcgaccttcgcggccttcgcgcggttggcgctcttcgcggggtgtccgctcggcgcgctcttcacggccttcgcgcggctggcgctcctcgcgagccggacgctcggcgcgctcttcgcggcggcgttcgctgcgctcttcgcggttcgggcgttcggcgcgctcttcgcgcggttga

SEQ ID NO: 1985 - DNA, 693 bp, Pseudomonas aeruginosa
atgactgactacgcgttgctggtattcgattgggacggcaccctggtcgactcgatcgcgcgcatcgtcgattcgatgaaggcggcggcgcgggaaaccgctctgccggagcgggacgatacccggatcaagggcatcatcggcctcggcttgcccgaggcgatcgcttcgctctatccggaggttggcgatcctgctctggtcgagcgtttccggtgtgcctacagcgagcattacctggcgcaggaagcgcagccgtcgcggttgttccccggcgtggccgaagccatggtgcattttcgcgaggccgggttccgcctggcggtcgccaccggcaagagtcggcgcggcctggaccgggtgctggcggggcatggctggagcgatttcttcgatatcacccgctgcgccgacgaaacggccagcaagccggacccgttgatgctccacgagatcctggcgcactgccgggtcgagccggggcgggcgctgatgatcggtgattcgccgttcgacctggaaatggcgcgacgggcggggatggattcggttgcggtggcctatggcgcccaatcgctggagcagttgcggccttatgcgccgcggctggaagttgagcatttcaccgagttgcgcgcctggttgggcggtgctcgacgtgaggcggtttcaggagtggttgagcatgtctga

SEQ ID NO: 1986 - DNA, 189 bp, Pseudomonas aeruginosa
tcaatcatggctgttcagcagaacaaaaagtctcgttccgctcgtgacatgcgtcgttcccacgatgcgctcgagtccaatgctctgtccgtggaaaagagcaccggtgaagtccacctgcgccaccacgtatccccggacggcttctatcgcggccgtaaggtagtagacaagggctccgacgagtaa

SEQ ID NO: 1987 - DNA, 1014 bp, Pseudomonas aeruginosa
tccttgtccgcaccaatcatcgcgattgatgcaatgggtggggacttcggtccccactgcgttgttccggcctctattgccttcctggccgagaattcctcttcgcaactgatcctcgtcggtcagcctgccctcctcgaagaactcctttcccgctatccgtcgctcgaccggcagcgcctgcgtgtgcatgcggccagcgaagtgataggttcagacgaacgtccctcccaggccttgcgtggcaagccggacgcttccatgcgcgtggcgctggagctggtccgcgacggccgggcgcacgcgtgcgtcagcgccggcaataccggggcgttgatggcgctgtcgcggcacctgctgaagaccctgcccggtatcgaccgccctgcgatggtgacggcggttccgaccgagaaggggcattgtcatctgctcgacctcggcgccaacgtggattgcagtgccgagcatctctatcagttcgcggtgatgggcgcggtggcggcagaggccttgggctgcgtctcgccccgggtcgccctgctcaacgtggggaccgaggagatcaagggcaaccagcaggtcaagctggcggcgagtctgttgcagaaggcgcaggggttgaatttcagcggatatatagagggcgatggcctgtatcgcggcgaggccgacgtggtggtctgcgacggtttcgtcggcaacatcctgctgaaagccagcgaaggcctggctgccatggtgtcggcgcggatcgaacagcgcttccgcgatggactggcggcgaagctggtcggtgcgctggcgttgccgctgctgcgccggctgcgcggcgatatcgctccggcacgctataacggcgccagtttcctcggattgcaggggatagtggtgaaaagccatgggtctgccgccgaggagggtttccagagcgccttgcgtcgcgcggcactggaagtccgggaaaacctgccgcaacgattgcatggccgtctcgagcatctgctgctctaa

SEQ ID NO: 1988 - DNA, 1044 bp, Pseudomonas aeruginosa
tgtgtgaccgggcggtccaggcagccatccaacactcagtttcctgcgccagtcgcggctggcgcgttatctccgacgagcaaaagaccacaagggacctattcaatgtctgcatccctcgcattcgtcttccccggccagggttcgcaatccctcggcatgctggccgagctgggcgcccagcaggcgctggtgcgcgataccttcgccgaggcctccgaggcgctcggttacgacctttgggcgctggtccagaatggtcctgaagagcacctgaaccagaccgacaagacccagccggccatcctcacggtttcgatcgcgctctggcgcctctggctggccgagggcggcgcgcgcccggcgttcgtcgccgggcacagcttgggcgaatattccgcgctggtcgcggccgaaagcctggcgttcgccgatgcggtcaagctggtcgagcgtaggggccaactgatgcagcaggcggttccggcggggcagggcggcatggccgcgatccttggcctggaagacgccgatgtattggcggcctgtgccgaggcggcccagggcgaggtggtcagcgcggtcaacttcaacgcgccggggcaggtagtgatcgccggtgccgcggctgccgttgagcgtgccatcgaggcatgcaaggcacgcggcgccaagcgcgcggtggcgctgccagtcagcgtgccgtcgcattgcgaactgatgcgtccggccgccgagcagttcgccgcctcggtcgaaagcctgcagtggcaggcgccgaagattgcgctggtgcagaacgtcagcgccgccgtgccggctgatctcgatacgctgcgccgcgacctgctggcacagctgtacagcccggttcgctgggtggagagcatccagctgctggcggaaaagggcgtcaccgagctggtcgagtgcgggccgggcaaggtcctggcaggcctcaacaggcgctgcgcgaagggcatcaatacccatggcctggatggcgtcgaggcgttcgccgccacgcgcgccgccctggcctga

SEQ ID NO: 1989 - DNA, 1266 bp, Pseudomonas aeruginosa
aatgagaaagaggaagtcgtagtgtcgcgtagacgcgtcgtcattactggcatgggcatgctgtcgccgctgggcctggatgtcccgagcagttgggaaggtattctcgccggtcgcagcgggatcgccccgatcgagcatatggacctgtccgcctattccacccgcttcggtggttcggtcaagggtttcaatgtcgaggaatacctgtccgccaaggaagcccgcaagctcgacctgttcatccagtacggtctcgccgccagcttccaggccgttcgcgattccggcctggaggtcaccgacgccaatcgtgagcgtatcggcgtatccatgggttccggtatcggcggcctgaccaatatcgagaacaactgccgatccctgttcgagcaggggccgcggcgcatctcgccgttcttcgtgcccggttcgatcatcaacatggtttccggcttcctgtcgatccacctgggtctgcaggggcccaactacgccctcaccaccgcctgcaccaccggtacccacagcatcggcatggctgctcgcaacatcgcctatggcgaggccgacgtgatggtcgccggcggttccgaaatggctgcctgcggtctcggcctgggtggtttcggcgcggctcgcgcgctctccactcgcaacgacgagccgacccgtgccagccgtccgtgggaccgggatcgcgacggcttcgtcctgtccgacggttccggcgccctggtgctcgaagaactggagcacgcccgtgcccgcggcgcgcggatctatgccgagctggttggcttcggcatgagcggcgacgccttccacatgaccgcgccgccggaagacggcgccggtgccgcccgctgcatgaagaacgcgctgcgcgatgccggcctggatcctcgccaggtcgattacatcaacgcccatggcacctccaccccggccggcgacatcgccgagatcgccgcggtgaagagcgtgttcggcgagcatgcccatgcgctgtcgatgagttcgaccaagtcgatgaccggccacctgttgggtgccgccggcgcggtggaggcgatcttcagcgtgctggccctgcgcgaccaggtcgccccgccgaccatcaacctggacaacccggacgaaggttgcgatctcgacctggtggcccatgaagccaagccgcgcaagatcgacgtggccctgtcgaactcgttcggtttcggcgggaccaacggcaccctggtgttccgcaggttcgccgactga

SEQ ID NO: 1990 - DNA, 987 bp, Pseudomonas aeruginosa
atggctgatatctatccctggcagcaggcgctctggagccaactgggcggccgcgcccagcacgcccacgcctatctgctctacggtcccgccgggatcggcaagcgtgccctggccgagcattgggccgcccaactgctctgccagcggcctgccgccgctggcgcatgcggcgagtgcaaggcctgccagttgctggccgccggtacccatccggactacttcgtgctggagccggaggaggcggagaaaccgatccgggtcgatcaggtccgcgacctggttggcttcgtggtgcagaccgcgcaactgggcgggcgcaaggtcgtgttgctcgaacccgccgaggcgatgaacgtgaacgccgccaacgccctgttgaaaagccttgaagagccgtcgggcgatactgtgctgctgctgatcagccaccagcccagccgcctgttgccgaccatcaagagccgctgcgtgcagcaggcctgccctttgccgggcgcggcggcgagtctggaatggctggcgcgggccctgcccgacgagccggccgaggccctggaggaactgttggcgctttccggcggctcgccgctcaccgcccagcgcctgcacggccagggcgtgcgcgagcagcgcgcgcaggtggtcgagggggtgaagaagctgctcaagcagcagatcgccgccagcccactggccgaaagctggaacagcgtgccgttgccattgctcttcgactggttctgcgactggacgctgggcatcctgcgctaccagttgacccacgacgaggaggggctggggttggccgacatgcgcaaggtgatccagtacctgggcgacaaatccgggcaggccaaggtgctggccatgcaggactggctgctgcaacagcggcagaaagtgttgaacaaggccaacctcaaccgtgtcctgcttctcgaagccctgctggtgcagtgggcaagcctgcccgggccgggctag

SEQ ID NO: 1991 - DNA, 390 bp, Pseudomonas aeruginosa
aatcccgctgatattcgactggcaggaacctgcatgagtttgccacccaatctggggccgcgtaacggcatcctgtccttgaccatcaaggacaagtccgtgctgtacgccgcctacatgccgttcatcaggaacggcgggctgttcattcccaccaacaagaactacaagctcggcgacgaagtcttcatgctgctcaacctgatggaagagccggagaagatcccggtggccggcaaggtcgtctggatcaccccgaagggcgcccagggcaaccgtgcggctggcatcggcgtgcagttcaacgacggtgacaacaccgcccgcaacaagatcgaaacctacctggccggggcgctgaagtcggaccggccgacccacacgatgtaa

SEQ ID NO: 1992 - DNA, 441 bp, Pseudomonas aeruginosa
gcctgtacgtcgaagggcagggcgccgagctgctggatcgcgtcgatgcagaacagcaccccgcggcggcgacatcccgcgccgatgcgctccaggtcaaggcgcaggccgctggcgtactgcaccgcgctgatcgacagcaggcgggtgcgcgggccgcaggcggcgagcagggcgctctcgggatcgtcgccggcgagaccgacctcgaccacttcgacgccgcgcgggcgcaaggcttcccagaccactctattggaggggaactcctcgttgccgatgacgacctggtcgccctctcgccaatccaggccgaaggctacgaaggaaagcgcctcggaggtgttcttgaccagggcgaggtcgctgccggcgcgcgcattgagcagtcgggcaaggcgctcgcgcaggcgatgttctatcttcagccattccggatag

SEQ ID NO: 1993 - DNA, 654 bp, Pseudomonas aeruginosa
cctgacagtctttttatgcagaaagagcctcgcaaagttcgtgaatttcgtcgccgtgaacaggagattctcgataccgccctcaagctgttcctcgaacagggggaagacagcgtaacggtcgagatgatcgcggatgccgtcggcatcggcaaaggcacgatctacaagcacttcaagtccaaggcggagatctacctgcgcctgatgctggactacgagcgcgatctcgccgccctgttccattccgaagacgtagcccgcgacaaggaagccctgtcgcgcgcctacttcgagttccgcatgcgcgatccgcagcgctaccgcctgttcgaccgcctggaagagaaggtggtgaagaccagccaggtgccggagatggtcgaggagctgcacaagatccgcgcctccaacttcgaacgcctgacccaactgatcaaggagcgtatcgccgacggcaagctggagaacgttccgccgtacttccattattgcgctgcctgggcgttggtgcatggcgccgtggcgctgtaccactcgccgttctggcgcgaggtgctggaagaccaggaaggtttcttccacttcctgatggatatcggcgtgcgcatgggcaacaagcgcaagcgcgaaggcgacgctcccagcgcctga

SEQ ID NO: 1994 - DNA, 405 bp, Pseudomonas aeruginosa
agcccagcgacctggccgacggcgccgactactacctgcgcgacgccggggtgctcgatcacagcgccagccagcgcagcaacaaccggcggatccaggccgactccttcatctacatcggccagggcccgttcgtgccgccgggctaccggtacgcgcggccgaacgtggtggccgagcaggccttcgaaggtttcgtcgagtatttcccgctggtgcgccgcgccaaggcgccgctcggcctggacgacgcgatgcgcgaggcgcgtgccgccggcgctcactacctgctgtactgccgtttcgcccggggcgacaacaggatcggcaactgggaggagtgggaagacgaagaggaactcggccgggtcgggcgcgatcgcagtgtcatccaggtcatgctga

SEQ ID NO: 1995 - DNA, 588 bp, Pseudomonas aeruginosa
acagtcgaggaacaggctatgagtgataccggcaaggccaacgacctgctggcgcagatccccaggggcgaaaagaagggcctgccgcccgtgcacctgtggaatccgccgttctgcggcgacatcgacatgcgcatcgcccgcgacggcacctggttctacctgggcacgccgatcggacgcaagccgatggtgaagctgttctccagcatcattcgccgcgacggcgacgactatttcctggtgactccggtggaaaaggtcggtatccgcgtcgacgatgcgcccttcgtcgcggtgaccctgcaggtgcagggcgagggcggggcgcaggtactgcgcttcgccaccaacgtcgaggacgaggtcgaggcggacgccgggcatccgctgcgcgtcgagatcgacccccgcagccaggaacccacgccctacctgcgggtgcgcgacaacctcgaggcgctggtgcatcgcaacgtgttctaccagctggtcgagctggcggtgccgcgccggatcgacggcatcgaatggctcggcgtctggagccacggcgagttctttcccctcggcccgcagccggactga

SEQ ID NO: 1996 - DNA, 1365 bp, Pseudomonas aeruginosa
caggcgcagcatgaaaaaaggctcccgagggagcctttttcgtttgccttacatgttggggtagttcggcccgccggtaccttccggcgccacccaggtgatgttctgcgccgggtccttgatgtcgcaggtcttgcagtgcacgcagttctgcgcgttgatctggaagcgcttgctgccgtcgtcgttggccaccacttcgtacacgcctgccgggcagtagcgctgggccggctcgtcgtagagcggcaggttcttctcgatcggaatgctcgcatcggccagcttgaggtggatcggctggtcttcctcgtggttggtattggagaggaacaccgaggacagcttgtcgaagctgagcttgccgtccggcttcgggtagtcgatcttcggcgcttcgctggcctttttcaggcaggcgtagtccggcttgtcgtcatgcagggtgacggggatcttgccgccgaagatgttctggtcgatgaagttgaacgcgccgccgccgatagcgccgaacttgtggatggccgcgccgaagttgcggctgcggaacagttcgtcgtacaaccagctggccttgaacgcatcgacgtagctggacagctcgtcgccgccttcgcggccggcggccagggcctcggcgatcgcgtcggcggcgagcatgccggacttcatcgcggtgtggctgcccttgatcttggcgaagttcagggtgccgaggtcacaaccgatcagcgcgccgccggggaagaccatcttcggcagcgaattcaggccgcccttgcagatggcccgggcgccgtaggccacgcgcttgccgccttccaggtactgcttgaccaccgggtggtgcttgtagcgctggaactcgtcgaacggcgacaggtgcgggttgctgtaggacaggtcgatgatcaggccgacgaacacctggttgttctccaggtggtagaggaacgagccgccggtattttcgtcgttcagcggccagccggcggtatggaccaccaggccgggcttgtgcttggacgggtcgatgtcccagatttccttgatgccgataccgtagtgctgggcatcggcctcgctgtccaggttgtatttcttgatcagttgcttgccgatgtgcccgcggcagccttcggcgaacagggtgtacttggcccgcagctccatgccgggggtgtagtagccttctttcgggttgccttcgcggtcgacgccgaggtcgccggtgacgatgccgcggaccacgccgttctcgtcgatcagcgcttcctgggcggcgaagcccggatagatctccacgcccagtccttcggcctggtggggccagccagcggcagaggttgcccagggagatga

SEQ ID NO: 1997 - DNA, 930 bp, Pseudomonas aeruginosa
aatcggcattcgagggggggaaaccacccttttgccgtattgaccgaaaagggtgatccggtcaaaatacgggcggttttgcggtcgctgtctatcagagtgtcggtttccggccggcgagcatcaccggccaggcctgtctggcgacatccttattcaccggagaataacgaggaatccatgaaggttcttgtagcagtcaaacgagtggtcgactacaacgtcaaggtccgcgtcaaggcggacaactccggcgtcgacctcgccaacgtcaagatgtccatgaaccccttctgcgaaatcgccgtggaagaagccgtgcgcctgaaagagaagggcgtggctaccgagatcgtcgctgtctccgtcggcccgaccgccgcccaggagcaactgcgcaccgcgctggcgctgggcgctgaccgtgcgatcctggtggagagcaacgacgagctgaactccctggccgtggccaagctgctcaaggccgtggtcgacaaggagcagccgcagctggtgatcctcggcaagcaggccatcgacagcgacaacaaccagaccggccagatgctcgccgcgctgaccggctacgcccagggcaccttcgcctccaaggtcgaggtcgctggcgacaaggtcaacgtgacccgcgagatcgatggcggtctgcagaccgtcgcgctgaacctgccggccatcgtcaccaccgacctgcgcctgaacgagccgcgctacgcgtcgctgccgaacatcatgaaagccaagaagaagccgctggacgtggtgaccccggacgccctgggcgtttccaccgcttccaccgtgaagaccctgaaggtcgaggcgccggctgcacgctccgctggcatcaaggtcaagtccgtggctgaactggtagagaaactgaagaacgaggcgaaggtaatctaa

SEQ ID NO: 1998 - DNA, 1239 bp, Pseudomonas aeruginosa
ctcctgaatgtgcttttccggcatctagcaaccgaggttttcatgatcatcaaaccgcgcgtgcgtggcttcatctgcgtcactacccatccggcaggctgcgaggccaacgtcaagcaacagatcgactacgtcgaggccaagggccccgtcgtcaacggaccgaagaaggtcctggtcatcggttcctccaccggctatggcctggctgcccgcatcaccgccgcgttcggttccggcgccgataccctcggggtgttcttcgagcgtccgggcagcgagagcaagccgggcaccgccggctggtacaactcggcggccttcgagaagttcgcccacgagaaaggcctgtatgcccgcagcatcaatggcgacgctttctccgacgaggtgaagcggctgaccatcgagaccatcaagcgcgatctcggcaaggtcgacctggtggtctacagcctggccgcgccgcgccgtacccatccgaagagcggcgaagtgttctcctcgaccctcaagccgatcggcaagtcggtcagcttccgtggcctggacaccgacaaggaagtgatcaaggacgtggtcctggaggcggccagcgaccaggaggtcgccgataccgttgcggtgatgggcggcgaggactggcagatgtggatcgacgcgctgctggaggccgacgtgctggccgacggcgcgaagaccaccgcgttcacctacctgggcgagaagatcacccacgacatctactggaacggttccatcggcgcggccaagaaggatctcgaccagaaggtcctcggtatccgcgacaagctcgccccgctgggcggcgacgcgcgcgtgtcggtgctcaaggcggtggtgacccaggccagctcggcgatcccgatgatgccgctgtacctgtcgctgctgttcaaggtgatgaaggagcagggcacccacgaaggttgcatcgagcaggtcgacggcctgtaccgggagagcctgtacggcgccgagccgcgcctcgacgaggaaggccgcctgcgtgccgactacaaggaactgcagccggaagtgcagtcccgtgtcgaggagctgtgggacaaggtaaccaacgagaacctttacgaattgaccgacttcgctggctacaagagcgagttcctcaacctgttcggtttcgaggtcgctggggtcgactacgagcaggacgtcaacccggacgtgcagatcgccaacctgatccaggcctga

SEQ ID NO: 1999 - DNA, 621 bp, Pseudomonas aeruginosa
atcgccgctgcacgaactgttcgaggaccagttggccagtgccgacctggtgatcctgaacaaggccgaccagctcgacgccgaggccctggcgcgggtccgcgcggagatcgccggggagctgccggcggcagtgaagatcgtcgaggcgagccggggcgagctgccgctgccggtcttgctgggactcaacgccgaggccgagctgcacatcgacggccggccgacccaccacgaccacgaaggccacgaggaccacgaccacgacgagttcgactccttccacgtcgatctccccgaggtggaggaagctgcgctgctcgaggccctcggcgagctggtggagcgtcacgacatacttcgcatcaagggtttcgccgccattccgggcaagcccatgcgcctgttggtacagggcgtcggcaagcgcttcgacaggcatttcgaccgcaagtggctggccgacgaagtccgcagcacccggctggtggtgatcggccaggagctggaccaggccgccattgccaaccagctgcgcacagcgcttgcctgatccgtgatccccggccggggccggcgatggcgattcgccggccccagcttcttgcgtcctaccggtag

SEQ ID NO: 2000 - DNA, 462 bp, Pseudomonas aeruginosa
ccagctcgcggtggatctgcgattcgctggtgcgcgcgccgatcgccgcccagctcagcaggtcgtcgaagtagccggcggccagcggttgcaggagttcggtggccagcggcaggccgaggcgcagcatgtccagcatcagttgccgggatagcgccaggccggcggccatgtcgtcgctgccatccaggtgcgggtcgtaggcgaggcccttccagcccaccgtggtgcgtggcttttccacgtaggcgcgcatcaccaggagcaactggccgtcgagttcgtcgctcagcgcggcgaggcgttcggcgtattcgagggcggagcggggatcgtggatcgaacagggaccgactaccaccagcaggcgcgggtcgtcgccgtcgaggatggcgcggatggcgtcgcggctggcggcgacctggctggccagctccagcggcaacggctggcgggccttga

SEQ ID NO: 2001 - DNA, 258 bp, Pseudomonas aeruginosa
gcgtcccgtataccgtgggcgccgttggggtatcaggcgccggagtggctaaaccaatacccgaagaaatacgcggcacggggtgcctgcggcgcacgcgcgcgcaacgacaagccagggcgcgaggcactggaatgcaggtgcggatggcgggtgtgcggcatgggtttctcccgtgaacgagtcccgagcttactgcaagcgaggcggccggttcaacgactgtttcacggttcgataccggcgccgccggcctga

SEQ ID NO: 2002 - DNA, 993 bp, Pseudomonas aeruginosa
acttggcggtccgtatttccgtccgtccgccgcaggaatccccatgagcgctaccgtgcattaccccctgtccgccgtggtcgccgccgacgaactgaagctggcgctgtgcctggccgcggtcgatccggcgatcggcggggtactgatcgaggggccgcgcggaatggccaagtcgaccctggcgcggggcgtcgccgaactgctgccggcgggcgagttcgttaccctgccgctgggcgccagcgaggagcgcatcgtcggcagcctcgacctggacgccgccctcggcgaaggtcgcgcgcggttttccccaggcgtgctggccaaggccgacggcggcgtgctctacgtcgacgaagtgaacctgctgccggaccacctggtggacttgttgctcgacgtcgccgccagcggcgtcaacctggtcgagcgcgatggcatttcccaccggcatccggcgcgtttcgtgctgatcggcacgatgaacccggaagagggcgaactgcgcccgcaactgctcgaccgtttcggcctcaacgtgcgtctcgacacccagccgccgccggccgagcgggcagagatcatccgtcgccggctggccttcgatgccgacccgcaggccttcgccgaacgctgggaaggccagcaggacaccctgcgccgccgttgcgccgaggcgcgccggcggctggcgcggattcccctggacgatgcggcgctggacagcatcgctcgacgctgcttcgaggcggctgtcgatggcctgcgcgccgacctggtctggctgcgcgcggcgcgcgcccatgcggcctggcgcggcggcgagcggatcgaggcggaggacatcgatgcggtggaacatttcgccctgctgcatcgccgtcgccagtcgaacccgccaccatcggcggccaatccaccgccaccgcccgcggcggcccctgtcgcgctcccggagcgcaccggcaacggcgaagggcagtggggtga

SEQ ID NO: 2003 - DNA, 732 bp, Pseudomonas aeruginosa
attgccggctcggccggtggccatggggaccgcccgcgagctgccgcgctggccaaaaaagccctgagcatccgcccgcgctcggtcatgggtgcggatgccaggagcagacccggagccctgcgcggcggtcttggcggcgccctgagccagggtgcggagggcgccatccaatggttgccgaccctgctgcgtggacgtccccgacagcgccgcgacctgcttcgccagccgcgcagccggcgcccgggcgaactctggctggtgatcgtcgatgcctccgccagcacccgccggtacggcgccctggcccaggccaagggggtgttggcgacgctgttcgaggaggcctatcggcagcgtatccgcctggccgtgctgcacgccaccgggcagcaggcgcaatggctctggcaggggcagaaggcctcgcgggagttgcaggactggctgcgccagctgggcgccggcggcggtacgccgctgctcgacgccctgcaccaggccgctggctggctggcgcgccgacagcggcagaaacccgccgagcatcagcgtctgctggtgcttaccgacggccgtctgcgcgactggccggcgctgccggaggctgcctgcccgagcctgctggtcgacctcgaaagcggcccgttgcgcctgggcaaggccgagcgcctggcccgggaactgggggccgagtatcggcatatcagtgaattgaacgaagtctga

SEQ ID NO: 2004 - DNA, 417 bp, Pseudomonas aeruginosa
cgaggacttcgcgcgccgccacgggctggcgatcctggcgcggatcaaggcggtggcggtggccggttgtgcgccggagatcatgggcatggggccggtgcaggcgacgcgcaaggttctgcaacgggccgggctgggcatcgccgacatcgacctggtggagatcaacgaggccttcgccagccaatccatcgcctgcatccgcgaactggggctggacatggacaggatcaacctggatggcggcgccctggccatcggtcatccgctgggcgccaccggcgcgcggatcaccggcaaggccgctgcgttgctgcggcgcaccggcgggcgctatgccatcgccacccagtgcatcgccggcggccagggcgtggcgaccctgctggaagcggtggagtgatcgcgcgccgatga

SEQ ID NO: 2005 - DNA, 1644 bp, Pseudomonas aeruginosa
tcgcggttacttgatgaagtcgtgaccccagcgttcgatctggctggcgctcttctgcatctgcagcgaccgcgattgtactttctggccggcggcggcgatctcgtcgtcgaccaccttggtcgacagcgacagccaactggtcacgaaggccatggcgtcgctgtggatctccagggcgtcctggttgatgttggcgatgccgtcgcacttgctgtggtagcactcgtcgtaggccttgccggcggtgccgccgtacttctgcgcctgctcttcggtcttcaggccctcggcgccggtgaacaggccgccgaaggcgatgccgctgttgaagaactcggcgtagtcggagcggaagtcgatctcggtgccttccgattgctggccgcgcaggcggaagtaggcttcgaacaggcgctcgatggcggccgagccgggcggaccctggaggccgaagtcggaaccgtcgccgtcatagatgaagttgccgaagttcggcgagccgatcatgtcgaagttcaggtaggccttgatcttcttcttctcttccggggcgaggttctgcacgtagtgggtcgagcccaccaggccggcttcctcggcgccccaccaggcgaagcgcaccttgttgaccggcagcgccttggccagcagcacggccatctccagttgggcggcgctgcccgaaccgttgtcgttgataccggggccttcgaacaccgagtcgaggtgcgcgccgaccatcaccacgttgttcgggttgccgcgacgggtctcggcgaccacgttgtaggtctcggtcttcttgcgtaccacgtcgaccaccaggtgcaactgcaggtccggggtctgcgaccaggccacgccgttgtcgtaggtggcgaagatcaccgggatgccgccctcgtaggactcgcccacggtgacgttctccaggcccttgcggtcgtcggtgttgccctggttgaagatgatcaccccggcggcgccggcggccgcggcgttctcggccttctgctcgaagttgcaggtgccgcgctggatcagcgcgatcgagccggccgggaagttggcgaagtcttccgcctcgcaaccgctggtggaggtgttgccggcgccgagggacaggtccaccgggaccaccttggcggtgacgtcgcctgcctcggtctgcgacaggtaggtgaagtccttctcccattcgtaggtgaccggctgcggcacggtggcgctcaggctacccgggcctttcgggtagtaggcggtgaacgggaagggctgcacgctgaccttgtagccggctttctgcagggtctgcttcacgtagtcgacggaggcctggtagcccggcgtggcggcggcgcggttgccgtcgttgagactggcgatgtcctccagcttctgcaggcgcttgaccacgttgctggcttgcaggcagcgcggcaggccaagcggggtgctgaccagcaacggcgatttgcagatcgacgggttgggtttgccgggcgtccagaactcggtgaactgttgcgcttccgaaggtgccgccagggatgcggcggaaaccgagagggcgagggcgccgagtgcgtatctgagattgttcttgttgctcatgagactccgttccttgtgaggcgatga

SEQ ID NO: 2006 - DNA, 1470 bp, Pseudomonas aeruginosa
agacgagaacctcggtgtcggcgccaacatggcctacggcctgcaacatgtgctgaccatgtatggcggtatcgtcgcggtccccctgatcctcggccaggccgccggcctcgcgcccggcgacatcggcctgctgattgccgcttcgctgttcgccggcggcctggcgaccctgttgcaaaccctcggcgctccgttcttcggctgtcagttgccgttggtccagggggtgtccttcgctggcgtggcgaccatggtggcgatcatcggcagcggtggcagcggcggcattcccgcagtgctcggcgcggtgatggcggcctcgctgatcgggttgctgatcacgccgatcttctcgcgcatcaccaaattcttcccgccgctggtgaccggcatcgtcatcaccaccatcggcctgaccctgatgccggtcgccgcgcgctgggcgatgggcggcaacagccacgcgccggacttcggcagcatggccaacatcggcctggcggcgatcaccctggtcatcgtgctgctgctgagcaagctcggcagcgcctcgatctcgcgcctgtcgatcctcctggcgatggtcatcggcaccgtcatcgcggtgttcctcggcatggccgacttctccaaggtcaccgaaggcccgctggtggcgtttcccacgccgttccacttcggcatgccgaccttccaggtcgccgcgatcatctcgatgtgcatcgtgatcatggtgaccctggtggaaacctcggcggacatcctcgcggtaggcgagatcatcgacaccaaggtcgactcgcggcgcctgggcaacggcctgcgcgcggacatgttctccagcatgctggcgccgatcttcggctccttcacccagagcgccttcgcccagaacgtcggtctggtggcggtgaccgggatcaagagccgctacgtggtcgccaccggtgggttgttcctggtgatcctcggcctgctgccggtgatgggccgggtgatcgccgcggtgcccaccgccgtgctcggcggcgccggcatcgtgttgttcggcacggtcgccgccagcggcatccgcaccctgtcgaaggtggactaccgcaacaacatgaacctgatcatcgtcgccacttcgatcggcttcggtatgatcccgatcgccgcgccgaccttctacgatcacttccccagttggttcgccaccatcttccattccggcatcagttcctcggcgatcatggcgatcctgctcaacctggcgttcaaccacttcaccgccggcaactccgaccagcagtcggtgttcgtcgccgccagcgagcggaccctgcgctaccaggacatcgccgccctgcacgaaggcgactatttcctcgacggcaagctgtacgacgcccagggcaacgaagtgccgctggccggcgacgacagccatggcgcgccgccgcgacggcgcagcgaaaccgctga

SEQ ID NO: 2007 - DNA, 1767 bp, Pseudomonas aeruginosa
ggtttccgccaggcggtcgtcggcggcgaagaaactgaagtgccagaccagcgactcgccctgggcggtgaaggccgggaagcggtagatccgcgcgtccgggatcggcgcttccatgtacaccaggcgggcgatgtcggcctggttcttcaccaccatcgggtaggtgttccagataccgatgtcgtgggccaccaggtcgaacgggcgatccgggctgaattgccgggccagcttgtgcaggtagacggcgacctgttcgccgctatagccggtcttcggcggctcggactggccgaggccgggcaggtccggcgcgatcacggtgaagcgcttggccagttccggcatcagttggtgccattcgtaccaggtctggccgaaaccgtgcaccagcatcaccagcggcccctggccgcctttcacgtagtgcagcttcacgccgtcgacttcccggtaggcgctttcgaagccattcgggacggggaattcctcggcggcgaagccgcccagggagaaggtcagggcgatgccggccaggaggccgcggcagagtctatcgaggatcatggttgtgcttccttggtgggctcagtgagggatttggccgccgagggacggctcggtggcagcttggcgtggcgccagcatcagcagcagggccacggccatcgccgccaggcagaccagcgcgccgacctcgccgagcggcgccaggccgctgccgtcgatcacccagctgccggcgagggcgccgatgccgatcccggcgttgcaggcggagatgttcagcgaggcggcgaacgccggggcccgcggcgcggacttcatcacccgcacctggccgacgatgaacagtgctgcctgggccacgccccagatcgccagggtggcggcgagcagccaggcgttgccgagggtcggcaccagggcgagcatgcccagcgccatcagcaggacgaacagcagggttgcgcccagcgggctgcgatccaccaggcgcccgccgagccagttgccgagcaggcctaccgcgccgaagcccatcagcgtccagccgaccagcgaaccgctgaagccggccaggcgctggaggatgtcggccaggtaggtgtagggggtgaacatgccggtgaagaccagcagcgacagcaacaggtggccgagcaccagcggttggcgcaacacgctcgcctggctgcgcagcgagatacccggccgtccgggaatgcgcggcagccaggcggccagcagcagcgccttggccagggccagcgcggcgagtgcggcgaatgccaggcgccaaccccaggcgtcggcgatcagcgtgccgatgggaatgccaagcacggtggcggcgacgatgccgaagaacaccagcgccacggcgcgcccttcgcgcgaggggccggccaggtgcgcggcggtttcgctggccatggcccaaaacaccgggagcgccagggccgggacgaagcgcgccacggccatcgtccagatatcgccggccacggcggccagcgcattggccgcggcgaacagcagcaggcaggcgacgaacagccgcttgcgttcgacgcccgccagcgcggcggtgaggaacggaccgaaggcggcgacgctgaaggcgaacaggctgaccagcaggccggcctgggcgacgctgacctggaggtctgcggcaagtgccgggagcaggccgacgatgacgaactcggtggtcaggatggtgaagccggcggcggccagcaggaggatcggcaatag

SEQ ID NO: 2008 - DNA, 513 bp, Pseudomonas aeruginosa
tggtggaacagccagtgggcatggctgccgggcggccaggggaagtcgttgcggcggatcgccaggtcgatgccgcggccgaaggcgaacggcccgccgccggcgaccagctggatcgacagtcgtggctgttcctgcatgaatccggcgatccgcgggatcagccagcgcatcagcaaggtcggttcgcaggacagcaccagcgcggtggggccggcctccgcgcgcagggtctcgccggtgcgctcgatcaggtcgagggccgggccggtgccggcgagcaggcgcctgccggcctcgctgaggaaaacccgctggctgcggcgttcgaagagcgcacaaccgagttcctcctccagggtccgcacggcgcggctgatggcaccgtgggtcaggcacagggcctcggcggcacgggaaaagttctccaggcgggcggcggcctcgaagcagcgcagggcgttcagcgagggcaggcgacggcgcctgaatggtgagttttcctcaccatga

SEQ ID NO: 2009 - DNA, 1575 bp, Pseudomonas aeruginosa
aatgcgccgttcatgccgtcgccagttgagggatggtcccaggatcgcgggacgcatgggagttgcatgaagaagggagcgacgcttttcgccgtcctctgggcggtactcggcctgggcctgctggtcggtttgccggtggccattcatttcattctcggccagtacgacgaggccggcttcagcgggccgcaactggtcttcgaggaacagggccattcctacctggcgttcaccctcgacgactatcgcgccaacgaagtggacaacggcgtggtacacggcagcagccgcagctatgcccaggtggtcgacctggaggacggcagcctgcgctggagcatgcgcctggatgccgacaacgagcgcggcgacgactggggttccggcgaactgctgggccagtcgtcgcgctacctgttcttcctgcgcaacgaactctacgtactcgaccggcgcgacgccgcccctgcgctggcgtttgacgagctggagcggcgcactggcgggctgccgttgaagtgggcgccctgggggaaggacgcctatcgctacgacgaaggccggggcggattgctgatgctcgcgctggacggccgcgtctggttcctcgacggcgacagcctggccctgcgcgaagctccggaagtcgatgccgcgcggtatttccacggcgacccgccgccgccggcgaatgccgggatcgactggcaggcgccgggcctgacgcgcctgcccgacggacgcctgctgatcctcgccagcgatcacgaggcccgagcgctggagcgtggcgaggcgctgccggcagcgaaccaacgggcgcgacgccagcgcctgtcactgggcaccctggattggcggtcgccggcggagaatcgactgcgtccgctgctcgacgcggccttcctgcaggatggcctgctgcccgatccagccgctgccgaagagccgcagcggctgctcgatcgaccgtccgagcggcagcgccagcatccgtcgctgccgcccgagccgcagccgccggaagagttcgacgagcgcgtggagcgttttcccagtacccgtgcgttccttgcggcgcgtgacgcctaccgccaggaacggcgacgctggattgccgcgcacgatgcctggcgggaacgggtcgccgacctggaggcggcggcggatgccgagtaccgtcgccggcgcgacgagcagacgcgggaggaggcgttgtaccgtcgctatgcctcggcgctgccgggcggcgattccaggttggcgcgccgtccctggcgagtcgacggcaactggctggtgctgcaccggcgcagcctggccgagcgtagcgagctgctgctcagctcggtgtctggcgacggcagcttgctctggaccctggagctgcccatcgagcgtcccgagcggctgttccgcctggatgcccacaacctgcttctcagcggccgtggagaggaaggcgggcggttggtgcgggtcgatctgcgccggggcagcggcatcgtccatcgcctcgggcgcggcggcgcgccattgcagcgggtcgagtggcccgaaggccaaccgtga

SEQ ID NO: 2010 - DNA, 1464 bp, Pseudomonas aeruginosa
tcgcctgcgcccggcctgggtggctgcccagcgggggggccgggcgccgattcaggggttcctgaagacgaatacgccgctgtccaccaggcgcgtcaggcggatgcgcagcagcagggtgcggtgggctgcgaggaagcgcggcacctgcgccagcggaattgccaggccttcgctgtcgccggggcccaccgcggtatagccgaccggctggcgcggcggatcgaacggcggctgggccgacacgctgagcgacagggtgtccacggcgaaaccggcgagcaggtcgtcgagggactcgatcgacaggtacagcgagcggtaggcggggttgtcctcgtagggatggacgtcggcgatgacctgctcgtagaagcgctgttcgaaacgccggtcgctgttcagcttgcggaagaactggatgaagtagtcgcgcacctcctggtcgaggtcgtcgcagacgtggctgaccaggttcaggtagcgcggcgagcggcgctcgatgccggggtcgagctgatcgatgcggcgctgccaggggaagcttgcgccgctgctccggtaatcggcgtcctcgacctccagcgcggcgcggatcagctccagggtatgcgggttcttcggtccgcggtccttcagcgccacgctggcgtggttctcgccgtcgacgatggcgaaggcgatctcgccgcgcgattcttccaggcgccagccgggcctggcgcgctggcggacatccagttcgaggctcaggcggcaggcgttgaggttcgccgtggcgatccgcaccgtgccgtcgccgccggcttcgttggcgatggcttcgacgccgctgtagccggcattgcccaccagcaccgtggcgagcaggcggccggcgccgtaccaggcctcggcgccgaacaggtcgcgctcggcgagttgccaggagtacggcgagcccagctccagtcccttcagcacctgggtgccggtctgcccgacgaagcggttccagcctttcagtacgcgaccgatgaaggagcgtcccttgtgcgccagcggcgagccgaagttggccggggcgagcatcaggaagcgcttgaccggcgcgctggcggggtcgaagtggcgggtcagccagtcgcgcagcaccagggcgccggtgctgtgcaccaccacgtcaaccgtgcgcggtgcccgcgacagtccctgggcggtccaggcgcgatccagggcggcggcgaggtcggcgtaggtgacgtcgtcctgcagggagatccagtcggcgaggcgaatctgcgtcggcgcgctgccgaaccaggcttccatctgctcggcgaggcggcggaacgacttcgaatcgtcgctccagccgtggacgatgacgatcgaacggggcatgtccggcatcctctggggctgatccgggcgactatagatcatgcgccgcggcgacgtgccctgacctgtgaaaacgtctag

SEQ ID NO: 2011 - DNA, 231 bp, Pseudomonas aeruginosa
gatgcggcggtcgcccccgactgccgccggcgcggcatcgccagcgcgttgctgcggcaggcgcgggacgactgtcgcggcgaccgcctgttcacttcctgcaaccgctccaacctgccgatgcggcgcctgctggagcgcaagggattccagccgagcggggtgatcgacaacctcgacgaaggtgatccggagctggtcttcgtgcgtttcctcgcgccgtcgcgctga

SEQ ID NO: 2012 - DNA, 822 bp, Pseudomonas aeruginosa
gccccaggctcatttcaggttgccggcgaggaactggcgcaggcgttcgctgcgcggcgcgccgaacacctggtccggcgtcccttgctcttcgatcacgccctggtggaggaagatcacatggctggaaacctggcgggcgaaggccatctcgtgggtgaccaggaccatggtgcgaccttcctcggccaactgctgcatgactttcagcacttcgccgaccagttccggatcgagcgccgaggtcggttcgtcgaacagcatcacctgcggctccatggccagggcgcgggcgatcgccacgcgctgttgctggccgccggagagttcgcagggatactgccgttcgaccttctccgccaggccgaccttggccaggtagtggcgcgcgtgggccacggcgtcgtcgcggttcattctcaggacgttgaccgggcactcgaccacgttctccagcaccgtcaggtggctccacaggttgaaatgctggaagaccatcgccagccggctgcggatcctctgcaactgccggggatcggcggcgcgcagctcgcccagggtgccgggacgggtgcgcagttcctcgtcgccgacgcggatgcgcccggcacagggcttttccaggaagttgacgcagcgcaggaaggtgctcttgcccgagccggaggagccgatgatgctgatcacgtctcccttcccggccctgagcgaaacgcccctgagcacctcatggctgccgtagcgcttgtggatgtcttcgacctgcaggctgtacatgcgcgtgtctccgggagaggtcagtgggtttgcggtctgaggtag

SEQ ID NO: 2013 - DNA, 843 bp, Pseudomonas aeruginosa
cgcacgatggggagccgagactggatcgacctggcccgcgacgccgagaccgggatcgagaccctgcgcgcccatttcgagggccacgcctacgatccgcactggcacgacagctacctgatcggctacaccgagatcggcgtgcagcaattcaactgccgccgacgccgacacgacagcaccgccggccaggtattcctggtcgaaccgggggagatccacgacggtcgcgcgccgatcgccggcggcttcacctactcgatgctgtacctgcagccggactggctgcggcgcgaactgcgggcgaccttcgacgatgcgcccagcgaccgcgaccccggcttccacgccaacctcaccgaagacccgcgcctgaccctggccatcgcccaggccttccgcgtcctgcatggccgcgagctgcgactgctgcggcagaccgccctggagctggtgctggagcggctgcgcgtgcacctcggctggcgcgaggcgaagccattcgatccgcgcctgccgctggtggcgcagaaagcccgcgactacctgcatgcgcacttctaccaggacatcggcctggacgagctggccagcgcctgcggcaccgaccgcttccgcctgaaccgtgcattcaaggccgcctacggcttgccaccctacgcctacctggtccagttgcgcctggccaaggcgcggcagatgctcgctgtcggcgggcaaccggcggacctcgccagcgctctcggtttcgccgaccagagccatctcggccgctggttccggcgcgcctacgggatgaccccggcggcctaccgccggcagtgcacccagcttccagactga

SEQ ID NO: 2014 - DNA, 1002 bp, Pseudomonas aeruginosa
cttcctgacaaacctgtgggttggtacgccgggcccgggttggctatggtgggacgatccgtagccatggcgcggtcgccgtcagcacgccgcgcaaggaacctccatgttgatacccgacatcactgccttcttcgacccggccacctccacctacagctacgtggtgcgcgacccgtccagccgcgcctgcgccatcgtcgacccggtgctcgactacgacccggccgccgggcgcaccagccatgccagcgccgaacgcctgatcgcccatgttcgccagcacgacctgcaggtggaatggctgctggagacccacgtgcacgccgaccacctgtcggcggccatcttcctgcagcgcgaactgggcgggtgcctggccatcggcgcgcgaatcacccaggcgcaggcgaaattctccggcctgttcaacctcggcgaggcgttcccggtggacggccgccagttcgagcacctgttcgaggacggcgagtcgttccgcatcggcgccctggaatgccgcgcgctgcataccccggggcataccccggcgtgcatgacctacctggtcggcgacagcgccttcgtcggcgataccctgttcatgcccgactacggcaccgcccgctgcgatttccccggcggcgacgcgcgccaactgtatcgctcgatccagcgcctgttcgcgctacccgacgcgacccgcctgttcatgtgccacgactacacggctcccggccgcgacgagcaccgctgcgaaaccagcgtcggcgagcagcgccggcacaacgtgcacgtccgcgaaggcgtcgacgaggaggcgttcgtcgccatgcgccagcagcgcgatgccaccctcggcatgccaaccctgatgctgccggcgatccaggtcaacatgcgcggcggcaacctgccgccggtggaaggcaacggggtgcgttacctgaagatcccgctggatctgttctgatcagctgcggcgacgcagcaggagaatga

SEQ ID NO: 2015 - DNA, 543 bp, Pseudomonas aeruginosa
gaccgacgaagccgatggcgccgctcaccgagaccagcacgccggtcagcagcgagcagcagacgaagacccacaggcgtacgcgacgggcgtccaggccgagggtcacggcggtctgttcgccggccatcagcgcgttcagcgcacggcccagcccgagcagtaccagcaggccgccggccacgcacagcgccggcagccagatcaacgaccagcgcgccaggccgaggccgccgagcatccagaacagcacagaggaggcggcgcggtggtcgccgaggaacagcagcaggttggccagcgccaggagcacgaacgacaccgcgacccccgccagcaacagccggtcgctgcccaggcggccgccgcgactggccacgccgagcaccagcagcatgctgccgagggcgccgaggaaggccgccagcggcagggtcagcaggccgatcacctcgccgatgtagagcaccaccaacaccgcgccgagggtcgcgccggaggtggcgccgagcaggtgcggatcggccagcggattgcgcgtga

SEQ ID NO: 2016 - DNA, 2241 bp, Pseudomonas aeruginosa
agggacgacatggctactcgcaggtccggtggttcagcagagacgattgccgcggcgccggcttcagaaactgaagtcggcggtgacgttgaacgagcgtggctggcccatgatccattgctggccgttgttgttgtcagccagggcgtactggcggtcgaacaggttgtacagctcaaggccgagggtcaggtccggccgtacccgccagcccaggttggagtcgaccaccgtgtagccgggcaggctggcctggttggcggcgtcggcgtagcgccggtcgacgtagcgcagcccggcgccgacgcgcagggtctcggcgaaggacttgtccagccagaggttggcggtgcgccgtggcacgttcctggggcgattgccgttgcgcgagtaggtctgcccgtcgatcgtttcgtcgaagtcgtcgtattcggcacgcaccagcgcggcgttcgccgacagccgccagtcctgggccaggttcagttccaggctggcctccaggccgtccgaactctgctggccgacctgctgcgcgtcgtgcggcggcagcgggttggcgctgagcagcttcttcttgacgatatggtaggcggccagggtccattcgccgcgaccgtccgggaacagctgcttgaggccgacctcggtctgcttcgagtgggtcaggtccatctgctgctgggccgcgttgagggtgatcaggttgctcacaccgtcctcgctggtggagtactggccgtacagcgacagttccggggtcagcgcgaagaccatcccggcgcgccagttgccgccctgcaggctgcggtcgctgcgggtgccggtgagcaggtcgtcgcggtcgatatggttctggtcgcggcgcaccccggtcaccagcgacaggcgctcgttgagctgcaggcggttctcggcgaacagggcgaaggtgcgggtctggctgcgcgagtgcggccggtagggcgagcggctttcgaagtagccgggcgcgggatgccaggggtcgatgtagtcgccgccgacatcggtatagggcgatatgttgttggtcaggcggaagcggatgcggttgtactcggcgccgaccagggtgcggctgtcgaggccgaacagggcgtgctggaaggcgaaggtctggcggtcgccgatctgctcctgctcgtggctgatgcgcaggtagtccctgcgcaacagctcttcgcgcgggacgtcccattcgtaggtttcggcgttgcgccagtggcggcgggccttgatgtagtacaactggttgctcgcggtgacgctgtcggaaaggctccagtcgctggtcaggcgggtccactggtcgttgtagcgctgcacgtcgttgcgcacgttgtagttcttctcgcgcaggcgcttgtggtacttgccgccgaccagcggggtgccgaagtcgttcatcggctcctggtcgccatagtcgtgggcgagggtgaaggccagatcgtcgctggcctgccagcgcagcgccgcgctgatgcccaggttgcgcgagtcgccacggtcgatccagccgtggctctgctgctggttcaggttgagccggtagctgaggctgtcggtcagcgagccgccgctgtccagggccaactggcggttgtcgtaggagccgtagccgaggcgcaggtggttgcggatctcgccggcgaaaggcttcttcggcaccacgttgatcaccgcgccggtggcgccttcgccgtacagcaccgaggccgggccgcggatcacgtcgatgcgctcgaccatccacggatcgctggggaagttcaccgtgcccatgccggtgtacaggcgcgtgccgtcgaacagttgcatcaccgatgcgtggccgctgaagccgcgcgccgagaggccggtaccgccatctcctggggtgccgatgaagctgatgccggggctgcgggtgacggcggcctggacgctggggttgttgcgtcggcgaacttcctcgccgctgatgctgctggtgctcgccggggtgtccagggcgctgaggcccaggcgcgaaccggcactgaccggagtggcgaggtcgatgtggtcgagttcggcgggatcctggcgaacgctgaccaactggctgggcagggcgagggcggcttcctcggtttcggcgagggcgggcggtaccagcagcaggctggtggagaggccgagggcgaaaggctcggtgcgcaaacggctgaagcggggcatgggcgttccatctcatga

SEQ ID NO: 2017 - DNA, 594 bp, Pseudomonas aeruginosa
ctcatgcccggctggagtatccgcgtgaatcccgtttccctgatcttcctcgccttcgccatgtccaccgatgccttcgccgcggccatcggcaagggctccagcctggatcggccgcgcctgtcggaggcgctgcgcaccgggataatcttcggcgtgatcgaggccatcacccctctggtcggctggctgcttggccaggccgccagccagttcgtcgccgactgggatcactggatcgccttcgtcctgctggtgctgctcggcctgcacatgatccacaacggcctgcgcgcggatcatgcgacggaacaggaaaagcccggccagcattcgttctggattctcgcggtgacggcgctggccaccagcatcgacgcgctggcggtgggcgtcggcctggccttcgtcgacgtcaacatcttcctcgccgccggtgccatcggcctggccaccatgaccatggtcaccctcggcaccatgctcggccgggcgctcggcgcggtgaccggcaagcgcgcggagatggtcggcggggtggtgctgatcctggtcggcgcgaccattctctacgagcatctcagcgcggcgtga

SEQ ID NO: 2018 - DNA, 1203 bp, Pseudomonas aeruginosa
gcggcgccggagatggaggcgggacaggtcgcggcgagtgggtgggcgttcgcttcaggcgctttcccaatcgcggatcgccgtcagcagcgcctcgccgtcggcgaactcgcggtccgccggcggcagcgccggacgcgccaggaccagcaccggcaggcccatttcccgcgccacctggagcttcggctcggtggcctggctaccgctgttcttgctcaccagcacgtcgcaggcgaggcgctcgaacaacgcccgttcgccatccaggctgaacggcccgcgcgcgccgatcacctcggcgcgcggcgcggccggctggccttgcaggcagcgcacggtccagtgctggtgcggcgggacctggccgagatgctccagcggttcgcggccgagggtgaacagcggacggcggaagggtgcgagggcggcgatcagctcgcgccagtcggctacctcgcgccagtcgtcgccgggcccggcctgccagccgggccggcgcagcgcccagcagggcactccggccagtcgcgcggcgcgcacggcgttccggctgatccgtgcggcgtaggggtgggtggcgtccaccagcaggtcgaagccctgctcgtcgatgaacgccgccagcccttcggcgccgccgtagccgccgacccggacccggcaggccaggtcgccgggcaccttgcccagcccggcgaggctgtagagatgcgccggaccgagccggcgggcgagggccagggcctcaccgatcccgccgagcagcaacaggcgcttcatcggcgctcctcgcaggcctggccgaccaggttgccctggcggtcgatggcgaagacttccagcgccacctcggtgggcacgatgccgcgggcgaagcgcagggcgtgggcgcagaccgcatcgcccagggccacgccttcggcgtgtgcctgggccagcgcctgctggctggtgttggcggcgcgcatgctgtcctgtagcgcggtgctggcaccgagcgcggcggcccagccggccaattgcggcaggtcgatgctggaatggcggctgtgcaggtcgaggtggccgccggcgagcttgctgatcttgccgaagccgccgcacaggctgagcttttccaccggcgccctgcgcaggtgcttgagcaccgcgccggcgaagtcgcccatctcgatcagggcgatctccggcagcgcatag

SEQ ID NO: 2019 - DNA, 1059 bp, Pseudomonas aeruginosa
tcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgagtgcgtcttcccgttttccgcctgaggtcactgcgtggatggagcgctggcgcctgctgcgcgacggcgagctgctcaccacccactcgagctggatacttcccgtccgccagggggacatgccggcgatgctgaaggtcgcgcgcattcccgatgaagaggccggttaccgcctgttgacctggtgggacgggcagggcgccgcccgagtcttcgcctcggcggcgggcgctctgctcatggagcgcgcgtccggggccggggaccttgcacagatagcgtggtccggccaggacgacgaggcttgcaggatcctctgcgacaccgccgctcgtctgcacgcgccgcggtccggaccgccgcccgatctccatccgctacaggaatggttccagccgcttttccggttggccgctgagcacgcggcacttgcgcccgccgcccgcgtggcccgcccactcctggcggcgccgcgcgaggtgtgcccgctccacggcgacctgcaccatgagaacgtgctcgacttcggcgaccgcggctggctggccatcgacccgcacggactgctcggcgagcgcaccttcgactatgccaacatcttcacgaatcccgatctcagcgaccccggtcgcccgcttgcgatcctgccgggcaggctggaggctcgactcagcattgtggtcgcgacgaccgggtttgagcccgaacggcttctgcgctggatcattgcatggacgggcttgtcggcagcctggttcatcggcgacggcgacggcgacggcgagggcgctgcgattgatctcgccatcaacgccatggcatgccggttactcgattag

SEQ ID NO: 2020 - DNA, 450 bp, Pseudomonas aeruginosa
ttcaaggacaataggggctatatgggaatgtctgtcagccttgtcaccgtcgagcaggcggctgagcatctacacctgcaccccaagaccgtgctgcgctacatccgtgacggacgactgtcggcaacgcgggttggaaagtcctaccgcatcgcacgcaccggactggacgcctttagcggcgtcgcgagcgctcaatcagaatcggcagcaggcatacgggcaacatgcatcgttgacatccccgatgtctccgtgggcacggcggaacgactggcaacgttcctccagtccgctgctatggccagcccggctaacacgccaccgctgcatcttcaaacggcgttcgacccgctcgccaagagcatgaaagtggtggtgatcgccagtccgtccaacgcggccgagctgttggaaatgttacaggtgaagatgagtagcctcttatga

SEQ ID NO: 2021 - DNA, 540 bp, Pseudomonas aeruginosa
cattcgggtcggcatcgacaagccccgcggcgtcttcctcggcctgcatcgccgccagtatctgcggcacgaaggcccggaacacgtcctgatctttgcacgaaggcgctccgacaagggcgtcggcctggtggtgccgacgctgttgagctggccggcgtccgccgtcatcagcagcgtgccgacttcctggccgaacaggggctggccgagcggcgcggccagcgcgccatccccgcccgcaacctgctgggcacgctgcgcaaccgggaactgacgcaggccgccaaagacattgcctccgaaaccggcctgcagcatcgcccggtggccgacggccagcgtgtagcaggcatctaccgtcgcagcgtcatgctcgccagcggtcgctatgcgatgctcgatgacggcatggggttcagcctggtgccgtggaagccggtgatcgagcagcggttgggacaacaactcgctgcgaccattcataaaggatcggcttcctgggaactcggaattcgtcgaggtatatcgattggatag

SEQ ID NO: 2022 - DNA, 1338 bp, Pseudomonas aeruginosa
gccagcgcggcctgccgctcggccgcctcgcgtgcccgaatttcggctcgcacacggccaccgtcgaacaggcgccaggaaatcagcggcaggatggaaaaacgcgagctggatgcatcgaaccaatcgcccgtgctgagcgcttggaacccgccgccgacaccgatggagagtttggggaacagttcggccgtggccacgccgatgtcggcggaactcgctgccaggagacgttccgcggccagcacgtccgggcgccggcgcagcatctctgcgcgctcgcccaccggcagcgcccgcagcgtgctcggcgtcaaggggccatccagcagtgccagctcccgctcacggcggagcgcccagcagaacgcccaggctgagtatcgcggcgcgctgacgcgcctggatatccgggatgagcgcgtggactgctgtccattgggcgtacgccgcctccacgtcggcggccgacgcgtcgcccagcgcatgccgcaggcgcaccaattccaaggtctgctgcagcgtatccagtgtggcctgttgtgcgtgcaactcgtagcgggcgccgacggcggtgaaccaggtgcgcgcgacctcggccacgatgcgcatgcgtacgccctgcgcctcggcttcggtcgcctgcaggcgggcgctggcgccttccagcgcgcgccgcttggccccgaacaagtcggcctcccaggccgcgtcgaagcccgcgtcgtagatggtctgcgtggcgtcaaggccggggatcgagcctacgggcaggggtccgttctcgctttgacggcgccggttgacgctcgcgccagcggcggcggtgggcaatgcctcgccggccacacgatcgcgcagggcgcgtgcctcatcgatgcgtgccgcagcctggcgcagatccaggttctgtgccagcgccgtggccatcaggcgatcgaggatgggatcgtccagtgcagaccaccattggctcaagtctgcggactgggattcgcttgccaacggcaagctccagccgctgccgacgtcgaccggtggcggctcgcggtagtcagggcccacgcttgcgcaggcagtcagcagcatgcaggacagggccagcgcgagcggacgcgcgcgcccagggggcaggccggtgatggttgcgcgaagaaagggagtgcagggcttggatttcattgcaggcgtcctcggacgaatacggtggccatggtcagcgtggcgagggcgatgaccgccagcggccacaggctggcgagaatgtcgctgggtggcatggccttgagaaagctgccttcgacgatgatgaggaagtgggtcagtggaatggcttga

SEQ ID NO: 2023 - DNA, 438 bp, Pseudomonas aeruginosa
gccagccattgcaggacgacaggcatgttttctacaggcgtcgcaaagccggacatcagcaccgccggcacgccgatggcgaacgcccccaggatggcctgctgctgcgtcatgctgaccgcggaaatcatcagaccgatgccgaccaccgacaggatgaacagcaccagactggcgagcaggagcgcaaacgagcccgtaaacgggatgccgaacaggaagacgcccgcgctgatcatgaacaggcccagcgcggtgccaattgcgagtgccggcagtgatttggaaatgatgatctcgggcgtcgaggtgggcgacaccagcaactggtcgaaggtcccgagttcacgttcgcgcgcgatcgacagcgaggtgatgagcagcgcgctgaatagcgccaggatgcccgtcaggccgggcacgatgaaccagcggtag

SEQ ID NO: 2024 - DNA, 552 bp, Pseudomonas aeruginosa
ggaaatcagcagaccctgacccagcgccggcaccatgaacacggccgacaagagcaacagggacagcaaggagccgcgcatcgggacgccgaacacgaacaccgccagcgccgccgcacccagcgtggacagcatgccgagtacgaagtacggcagcagcttgccgatcagaatttcggccaccgaggctggcgtggacagcactgcctccatggtgccgcgctcccattcgcgcgccaccaccagtgcagtcagcatggtgccgatgatggtcatgacgatggcgatggcgccgggaatcagtgcgcggcggctttccagctcggggttgaaccagtagcgcggctccagcatgacggcttgcgcgggcgccgcgacatccagcccggcgcgccagaactggaccacgccgcgggcgtagttctcgacgtagttggcggtattggggtaggagccatcggtgacgatctgcaccagcggctcgctgccacgctgggccagccgctgctcgaaatcctgcggaatcaccacgtagccgcgcaggtcgcctga

SEQ ID NO: 2025 - DNA, 408 bp, Pseudomonas aeruginosa
atgaaggcgtcctccatggtcgggtcggggcgctcggaattggccgcaatccgcttgagcgcgtcgggcgtgtccagtgcaatcaggcgcgcacgcgagagcatggcgacccggtcgcagtattcggcttcgtccatgaagtgcgtggtgaccatgatggtcacgcccttgcgtgccaagccattgatgtgggtccagaattcgcgccgggtgatcggatccacgcccgaagtaggttcatccaggaacagcacgggtggccgatgcatgagcgagcaggccagcgctaggcgctgtttgtgccccagcggcagggagtcgggcgtcgcggacaaccagtcgccgagatcgaaggtggcgatcatttcctcgatacgctcgcgccggacgttgccttccagcccgtaa

SEQ ID NO: 2026 - DNA, 579 bp, Pseudomonas aeruginosa
cccaccacatgcgcttcaccagccgtaggtttcagtaggccgcacagcatcttgaaggtggtggacttgccggcgccgttggggccgagcaggccgaagatttcacctttctgcacctcaaaactgacctggtcggtggcggtgaattcgccgaagcgcttcgtgaggttgcggcaggacacagcgacgtcggaacccagttcgaccggtgacaggcgctcggcgagggtcgatgtaccgcctggcccgccgccgagcaaatcaataaaggcgtcttcgaaacgcgcgggcactggagccagttgcacttgggcccgatcggccagcgcctggatttgctccgttggtgcaccctcgcgcagtaccacgcgcacccctgcgccctggatcacgccatcgctcacgctgggcagatcgagcgcctcggtcagaaccgcccggcgctcggcgccgacgttttccaggcggaagctgcggccttcaagctgcgcggtcaactcttgcggcggaccatcaaacaagagctgcccctggttcagtaacagcacgctctcgcagcgctcggcctcgtcgaggtag

SEQ ID NO: 2027 - DNA, 840 bp, Pseudomonas aeruginosa
atcgcttttgacgcgcaccacagtaccgggcgcgatgcgccccaagtccgactcgcccacgtaggcgcgcacgtaaaccggcttgtccaggctcaggctgtagaccgcgctctggcttacaaccatgctgccgggctcgcgcacccgtgcgatgacggtgccactactgggcgccgccaattcggtgtccgccaaggctgtcgtggcttgcgctgcggcggcctgtgcggccgcaaggcgagcttctgccgcggcgatgtcttccttgcgaaaaccttcggatgcttgcgacagggccgccttggccgcttcgacgccagcggctgcctggtcgcgcgctgtgcgggctgcatcgaccgtgcgctggctggtggcgcccgatgccagcagcccactctggcgctggaaattacgctcggtctcggtggcgagcgcctgggcctgcctgagggcttcgcgcgcctgggtgatttcctgcggtcgcaggccgcggcgcagcttggccagttccgcctgcgccacctgcacctgggcctgtgctgctgcaagggcttcccgatagggttgcggatcgagcgccgccaggcgcgcgccggcgctgacggcatcgccctcatcgaaagccatttgcatcacgcgcccgggctgacggaaggccagttgaacctcgcggatgtcgacgttgccgtagaggcgcaatgcatcttgttgtccatggtcgcgcgacagccagaacgccagtgcgccgccaagagcgagcacgacgacggcgatcacgacccaacgggtttttctggaaaggaggtttggagttttcatcgatgggtttccgctggataa

SEQ ID NO: 2028 - DNA, 945 bp, Pseudomonas aeruginosa
gtggaactgcgccatcttcggtgcttcgtcgccgtcgctgaagaactccacttcgctcgcgccgccgagcggctgcacatcgagcagtcgccgctgtcgcgggccatcaaggaactggaagaagaactcggcgtgatgctgtttgcccgcaccacgcgcagtacgcggctgacccatgccggaacattgttcttggagcatgtgcgtcgtgtgtttgctgccttggagcaagcgcgagagagcgtgaaagcagcggcaaacggttttcacgggcagttgcgcgtggccttgtcggatggcatcacgccgtcgcgcctgcccgccttactggcgttgtgtcgccaggaagaacccgaggtcgagatccgctttttcgaagtgtcactatcgcagcagatcaaagggctgcatgatgatctgtacgacgtggggtttgcccaatccgacgaagtgggcgacggcatcgtcactttgcccgcttggagcgatgcactcatggtggcagtgccggcccggcatccgctgctggcctacaagcgtattcccttggacgagttgctgcgctacccgctggtcttgtgcgatccgcaagtgtgtgagggccacgccaagcacgttgaacgagtgctgcgtcgtgctgacatggaaccactgatcgcagaacgggttgccacctgcgatctgatgatggcactggtatcggccggcttcgcgcttggactagcgggcgctgcacacatcgccgccagccgtgagccgggtgtcgtagctcgaccgctggcgtcgcgagtgccaccacttacgacctacttgctccgtctcgacggcaatccgtctgatgaactggcacgtttcgttgagcgcgtgcagaccatcgagttgccggaaactcctagggccatacgaggccgaaaccctgatcccccggaggaattgatgccatga

SEQ ID NO: 2029 - DNA, 525 bp, Pseudomonas aeruginosa
tccagccatgcagcgcacggcccggctggcttccctcgaccccaacgacggaatcgagctatgagccactaccgcctgaacctctttatccagcccgagcacgccaagcgcctggacgagctggccgccaagaagggcgtttccaagtcgtccatcgtcgcggcggcgctcgcatcgtggctgtcgcccgatgccgccgaccagcgcgaggcggccatcgccaagcgcctggatcggctgtcgcgccaatccgaacggctggagcgcgaccagaacatccagatcgagacgctggcgctgttcattcgctactacctcacggtcagcacgcccgttcccgaggcgcaccaagaggccgcccgcgctcagggcaaagcgcgcttcgagcagttcgttgaacagttgggccgccacctgctgcgcgggcgcagcctggtgcgcgacgtggtggaggaactgcatcccgatcctatgcgaatggaggacgcggcggcggctgcgcaagcgcgggagcgtgcgtcatga

SEQ ID NO: 2030 - DNA, 2475 bp, Pseudomonas aeruginosa
ggggaggacgccgcgatgctgaacctagccgaataccgccagcgcccggccttgctcgccgactggctgccctgggccgggctggtcgcgccgggtgtcatcttgaacaaggacggcagtttccagcgcacggcccggtttcgtgggcctgacctcgacagcgcgacgcaaggcgaactgatagccacgtcggcgcgcttgaacaacgcgctacgccgcatgggttcgggctgggcgctgttcatcgaggccgagcgccgacccgctgccgactatccgcaatcggagtttcccgagccgctgtcgtggctggtggacgaggagcgccgggccaccttcgaggaatcgggcaacgacttcgagagcggctatcacctgacgctggtgtacctgccgcccgaggaatcgcgcgcccgcgcggcggggatgctgtacgagaaccggcccaccgatggcgtggactggcgcgagcggctgcaagccttcgtcgcggagacggatcgcgtctttgacctgctcgatggcgtgatgccggaaatcgcttggctcgatgacggccagacactgacctacctgcacgccaccatctcgacgcggcgctatcgcgtcggcgtgcccgaagtggcgttccatatcgacgcgctgctgaccgattccgcactggtcggtggcctggcgcccatgctgggcgaccagcacctgcgcatggtgtcggtgcggggcttcccgacctcgacttggccggggattctggacgacctcaaccgccttggctttgcctaccgctggagcacgcgcttcctgtgcctcgacaaagccgaggcggaacgggagttgggacgcctgcgccgccagtggttcgccaaacgcaagaacgtcatcgcgctgctgcgcgaaacgatcttccagcaggaaagtccgctggtcgataccgacgccagcaacaaggccgccgatgccgatgccgccttgcaggagctgggcagcgatcaagtcgccttcggctacctcaccgccacggtgatggtgctcgatgccgacgcggctgtggccgacgagaagctgcgcatggtggagcgtgtcatccagggccggggcttcatcaccatcccggaaacgctcaacgccgtggatgcctggctgtcgtccattccgggcaacgcttacgccaacgtgcgccagcccatcgtctcgacgttgaacctggcgcacatgatgccggtttcggcggtatgggccgggccggagaagaacgaccacctcgacggccctccgctgatcgtcacgcgcacggatggcgcgacgccgttccggctagtgacgcacatcggcgacgtgggccacacgttggtcgcggggccgaccggcatgggcaagtcggtcttgctcgccacgctggcgatgcaattccgccgctatcgcggctcgcgcatctttgccttcgacatggggcgttcaatgcgcgccacgatcctcgggctgggcggcgaacactacgacctgggcacggatggcgaaatcgccttccagccactcgcccgcatcgaccgcgagagctaccgcacctgggcggccgaatggatcgagggccgcttgctgcacgaaggcgtcgcagtcggccccgacgaaaaggccgctatttggtcggcgctgggaagtttggccggtgcgcccgtagaacagcgcacgatgaccggcctgtccgtgctgctgcaatcgaatgcgctgcgccaagcgctcgcgccttatgtgctgggcggcgcgcacggcaagctgctggacgccgaccatgaccgactgggcatggccgacgtgcagtgcttcgagatggaggagctgatgcacagcaaggccgccgtcatggccgtgctgcattacctctttgcgcgcttcgacgaacgctttgatggcgctcccacgctgctgatcctcgatgaagcgtggctgttcctcgatgacccggtgtttgccgcgcgcatccgccagtggctcaagacgctgcgcaagaagaacgtcagcgtcatattcgccacgcagtcgctcgcggacatcaaggattcgagcatcgcgcccgcgatcatcgagagttgcgcgagtcggattttcttgcccaacccgcaggccaccgagccgcagattcgcacgatctacgagggcttcggcctcaacaggcggcagatcgaaatcgtcgccaccgcgcaacccaagcgcgactactactaccaatcccgcctcggcaaccgcctgttcgacctcgacctgggggcggcggcgctggccttcgccggcgcttccacgccgcaagaccagcgcgacatagaccgcgtgctgctggacgtcggcatacccggcttcgcgggcgcctggctgcgccatcgcggcctcgattgggcggccgacctgctgccctcgttccccggtctcgcgccgggttccctccgtaccaccgaccacccacaggagagcctgtcatga

SEQ ID NO: 2031 - DNA, 1236 bp, Pseudomonas aeruginosa
agagtcggtgactgtgcagatcaccagcgtcgtgcgcgccagcgacacgtctttcaacgtgcgctggacggaacgccgctacgtcaacggcgccgcggcgggcttggagcggtggacggccgtggtgtccatcgtgctccagccgccgcgcaccgaagaacgcctgcgcaagaaccccctgggcatctacgtcaacggcctgtcgtggagccgcgaactggattcttccgaaggagccaagccatgaatgatcttttccgtaaatccgccttgccggtgatcttgcttgccctggcgggctgcgccacgcagggcaagccaccgccgaccatctcgctcgatgagccggtgcaggcccagccgctgcccgaacggcccgcgccggtggaggtggtggccgtgcccgaggtgctgccgatgccggcgcagttgaagccattgcccgaagccgaggacgccaagcccacgccggagccggccgacgagacggtgcgcgtctcgcgcgccaatgccgaggcccgcgtcgcgcccacgcgcgagggctacgtcaacgcgattcaggtgtggcccttcaccgatggcgcgctgtatcaggtctatgcggccgtgggccgcgtgaccgtcgtttcgctccagccgggcgaggaactggtgacggtggccgccggcgataccgtgcgctggatcgtgggcgacacgtccagcggcagcggtgccgatctgcgcgtgaacgtgctggtcaagccgattcgctcgggcctcaagaccaatctcgtcatcaccaccagccgcaggacgtacctgctggagctggcttcgacggaaaagacgtggatggcatcggtgtcctgggagtacccgcgcgaccggatgctggccttgcagcgccaggcacaggccgctagcgccgctgcgccggtggactccggcttgtcgctggagaacctgcgcttccgctacgcgatcagcggcagcaatccgccgtggaagccgttgcgcgccttcgacgacgggcagaaggtctatatccagttccccgccggcatcgcgcaaggcgagctgccgccgctttttgtcatcggtgcgcagggcgatgggcaactggtgaactaccgcttccgctcgccgtactacatcgtggatcggctgttcggcgcggccgaactgcgcttgggcggtgacaagggcgacgtggtgcgaatcgagcgcacggacggcgtggcgcggagggactga

SEQ ID NO: 2032 - DNA, 888 bp, Pseudomonas aeruginosa
cggccaagcgcctggagaacatcgagaacgagctgcagcgcatgcacgacgaggacttcgagaaggtctgcggaaccttcccggagttcagcgactggatcgcctatgaaggcagcatcgagccgcagtcgatcgcctggaaggtcgccgactcggcgcaggcggccgcggtctacctggtggagcgcaacccggtgctgctggagcggcacggcatcgacatgcaggcctggcgcgaacgccaccgcgagatacgcgaggcgctgctggcggcggaacaggcgccggaggcggagccggcgcccctggaagagccgccggaacccaggcgccagcggaagaggaaaacgcccgcgagcggcaagggcgactgaggcgcatcgcgccagaaacgaagggaagtatctgtacatggtctatgtagtgaggaagcgctgcctgtttcgcgccggcgagcgcctgttcgggttgcgcgggctgacggggttgaaccgaccgcagttttccgaggtggtcggcatggatcccaaacgccttgagaacatcgagagtggccggcagcgcatgcacgacgaggatttcgagaaggtctgcgggaccttcccggagttcagcgactggatcgcctatgaaggcagcatcgaaccgcagtcgatcgcctggaagatcgccgaggccgcccaggaagcggcggtctatctggtggagcgcaaccccgagctgctcgaactccacggtctcgacgtgccggcctggcgcgagaagcatcgggaaatcctcaagaaggtgcgcaagcgggagttgtcgccgccacccgaaaaaccaccgaaacccaggcgcaagcgcaagccgagaagcaacctgcccacacccaccgacggtacctga

SEQ ID NO: 2033 - DNA, 297 bp, Pseudomonas aeruginosa
agcacaggttcgggcgtgacattcaaccgcgtggtttgtggcaagctgtcgtggttcattcaagcggggggctccatgcccagtctcatcatggatatcgccctgtccggcgaacgcctgcaggccatctacggcggcagggccaatcgggtcctgctgcgcagccgcgacggtcgccgggtgaacctgccggcccatcacctgcgtccgttcatcggccacgatggcgtgcatggcacgttccgcctcgatttcagcgaggacggccgcctgctggcgctgcaacgcctcgcctga

SEQ ID NO: 2034 - DNA, 2337 bp, Pseudomonas aeruginosa
gatttcctcgcattccgacgaagggtcgcccagactgcgactcggggtcgcagcgagcaacgccgggagcgttccggcaatcgaaccacggcacctggtgccaaagaagtgcccatgagggtgcttccactgacaagggctacggcccgggaaggcgatatggctgatgtttacgaattgtttctgacctgcccgaaaggcctggaaagcctgctcctcgaagaggcgcaggggctcggcctggacgaggcgcgcgcccaggtgtcggcggtgcgcggacagggcagcctggaggtggcctatcgcctctgcctgtggtcgcgcctggccaaccgggtcttgctggtgctggcgcgattcccggtggagaacgccgagtccatgtacatggcggtccacgcggtgaactgggaagaccacctggacgccggcggcacgctggcggtggagttcagcggcaagggctcgggcatcgacaacacccatttcggggcgctgaaggtcaaggatgcgatcgtcgacaacctgcgcgagcgctccggccgacgcccgtcggtggacaaggtcaatccggacgtgcgcgtccacctgcaccttgaccgcggccaggcgaccctttccctggacctctccgggcatagcctgcaccagcgcggctatcgtctgcagcagggcgccgcgccgctgaaggagaacctggcggcggcggtgttgatccgtgccggctggccgaagatcgccgccgagggcggtgccctggccgacccgatgtgcggcgtcggcaccttcctggtcgaggcggcgctgatggctgccgatatcgcgccgaacctcaggcgtgagcgctggggcttcagcaattggctgggtcacgtgccggcgctgtggcgcaagctccacgaggaagcccagcagcgcgcggcgaccggcctggccaggccgccgttgtggattcgcggctacgaggccgacccgcgcctgatccagccggcgcgcaacaatatcgagcgtgccggagtggccgactgggtgaagatctaccagggcgaactggcgactttcgagccgcgcccggacaagggccagaccggcctggtgatctgcaacccgccctatggcgagcgtctcggcgacgaagccagcctgctgtatctctaccagaacctcggcgagcgcctgcgccagagctgcatcggctggagcgccggggtgtttaccggggcgccggaactgggcaagcgcatgggcatccgcagccataagcaatacgcgttctggaacggcgcgctggcctgcaagctgctgatgatccaggtcgagccgcgccagttcgtcaccggcgagcgtggcgaacgcaacgacgaaggcctggcacgggcgccgagcgagccggcacggctgagcgagggggggcagatgttcgccaatcgcctgcagaagaacctccggcaactgggcaaatgggcgcgccgcgacaagatcgagtgctatcgcctgtatgacgccgacatgccggagtatgccctggcggtggatatctacggcgattgggttcacgtccaggagtacgccgcgcccaagtcgatcgatccggcaaaagcccaggcgcgcctgttcgacgccctggcggcgattccgcagaccctgggcgttgcccaggagcgagtggtggtcaagcgccgcgagcgccaggccggcaagaagcagtacgaacggcagagcagcgagggcaagttcctcgaggtgggtgagggcgatgtgcgcctgctggtgaacctgaccgattacctggataccgggctgttcctcgatcaccggccgatgcgcctgcgcatccagaaggaggcggccggcaagcgcttcctcaacctgttctgctataccgccacggccaccgtgcatgcggccaggggcggcgcgcgcagcaccaccagcgtcgacctgtcgaagacctacctggactgggcgcgccgcaacctgtcgctcaacggcttttccgacaagcagcgcctggtgcacggcgacgtgatggagtggttgcgggaagacgatggccagtacgaactgatcttcatcgacccgccgaccttctccaactccaagcgcatggaaggcgtgttcgacgtgcagcgcgaccacgtcgaactgctcgacctggccatggcgcggctggcgccgggcggggtgctgtatttctccaacaacttccgcaagttcgaactggacgagagcgtgcaggcccgctatgcggtcgaagagatcactggcgaaaccctcgatccggatttcgcgcgtaatccgaagatccatcgggcctggagaatcaccgttcgctga

SEQ ID NO: 2035 - DNA, 618 bp, Pseudomonas aeruginosa
aatgaagatgaaaaacgaagcgaacctgaaaaaagagacggacatcacgcgaagaggccgtcttgctcattatgccgcaaggcggataacgatgcgctggagtttcgcggagttcgccgtcatatcgccgaatggtcggaactggtagagtgcgccggcaatccggccgcgccgcgcggagcttgccggggttcgtccgcggctccagcggcgtcggctactgtctgtaatgcgaggctccgccaatggagcgtcaatccaggagatgccgccatggctactaatcgttcccgccgcctgcgcaagaaattgtgcgtcgatgaattccaggagctgggtttcgaattgaacttccactacaaggaaggcgtggatgccgatgcggtgaacgctttcatgttgcgcttcatcgatcaggcgatcgaagccaacgaactgacctatggcggctgcgacgaattcggtttcgtctgcctggcgcgccgtggctcggtcaatgaagagcagcgggccctgatcgaggcctggttgaagcagcaaccggaactggccagcgtcgaggtcggcgcgttggtcgacgcctggtacccggaacagcctgtcctgccgaagctctaa

SEQ ID NO: 2036 - DNA, 2295 bp, Pseudomonas aeruginosa
acgccggctcgctggtggatctcatcgagttcgccaaacgcaatacgcttatctaagggccggaaccgaatgaagttccagaaacgcagtgcgtgcatgctcggcctgcttctcatattcgcctgcatggcgggatatgccgttccggcgagggcgacggctggcgaatattcttccatgctccggattcccgctccggatcgtccgggggacgccgatgtggtcgacgaagcgccgctacgccaggctgccgacgggctgcgctcgccatccccttccagcctggtgctcggcctgctggtggcctgcctggtctgcgtcggatgcctgggctggaataccgtcctgcagctcaggctcaggcgttggcaacgtaccgaagccgacctgagcggccgcctggcattgaagcaggcgctggtcgacgggattccctacccggtgagcatccgcacgctcgacggtcgcctgctggcctgcaaccgcaattacctggaaagcctgcggatgacccgtgagcaggcgcgcggcaccctgttgaccgattccgactgggtcgagggcagcaaggcacggctcatgcaccagcagtgcctggcggtggctcggggaggaacggcgagcttcaccgacatggcggtgcgcatcggcgggcaattgctggagatccaccattgggtcacgccctacagggatcgccagggccgggtgctcggcctgatgaacggctggatcgacatcaccgaacgggagcgcctggcccgccagttgcgcgaggcgatgcgccaggcggacgaggcgaatcgggcgaagagcgtcttcctggcgaccatgagccacgagatccgtacgccgatgaatgcggtcatcggcatcctcgaactggtcctgcagcgcctggcgccggagcagcgcgaacgcgcctcgctggaggtcgcctacgaggcagcggggtcgctgcaactgctcatcggagacatcctcgacgtcgccaagatcgagtccggtcacctgaccctcacgcccgagcgggttcgcctgcgccatgtcgtggagtcggtgcgccgcatgttcgaaggcctggcccggcagaaaggcctgaggctcgttgtggagctggacgatgccccgggacgggacgtgctgatcgatcccctgcgcttcaagcaggtgctctccaacctggtgagcaatgcgatcaagttcaccgagcggggacaggtgacgatccgtctccaggaaaggagcctggacgaggggagggcgatcgtccgggtggacgtggaggattccggtatcggtatcgctccggcggaccaggcgcgcctattccagcctttcatccaggtggccaagggacgcacggtgcagggcgggaccggccttgggctggcgatctgtcggaagttggtggacctcatgggcggcgatgtcgagatgcacagcgagccgggcaaaggcacccgggtgtcgctcgacctgctcttgcgccagtgcgggccgaaaatgcctgaatccggccaggacccgctggcagcatccatggagccgtctcgccgcctgcatatcctcatcgccgacgactatccgcccaaccgggtactgctgcgccagcaactggagtttctcggccaccgggtggcggaagcggaggatggccaggtggcgctggagctctgggccgacgagcgcttcgaggtgctgatcagcgactgcaacatgccgcgcctgaacggctatcagttggcacgcaggatacgcatccaggaacgatgcgagcgacgcgcgccgatcctgatcctcggctataccgccgacgccgagccggacgaggtacagcgctgccgcgacgcgggcatggatgattgcctgttcaagccgctcggcctggagaccctgcgcaactacctcgcgacctctttcggacgcgacgccgcgcagccccgggggctctatgatgcagccgctctcagcagcctcggcggcgaccgcccggaacggctgcgcgaactgctggagaccctgctaggcagcaaccgtcaggacctccagcgccttgccatcctcctgcgcgagggcgacaggacccggctcgccgagcatgcccaccgcatcaagggcgccgcacggatgatcggggcgcgtaccctgctggaggcctgcgaggccctggaggacgcctgccggcgaagtggtgacggggagtgcctgcagacgcctggcgaaagactccggctggccctggaggcgttgcaggaggaactccaggagcagttggcgggcgctgcggtatga

SEQ ID NO: 2037 - DNA, 1407 bp, Pseudomonas aeruginosa
cgcggctatccgcggggcctgccgttaccagagcggcagcgtgtagctgacgatcaggcgattttcgtcgtagtcgttggtgtagttggtgcgcatggtcgcgttgcgccacttcaccccgaggttcttcaacgggccgctctggaacacgtaggcgatgtccatgtcgcgttcccattccttgccttcgcccgaggtggtcagcaggtcgatgttgtcgcccttgacgtagcgggtcatgaaggtcaggccgggaatgccgacgccggcgaagttgtagtcgtagcgcgcctgccaggatttctcgtccttgttggcgaagtcgccgatctggatgaagttcaccaggtaggggtcggcgccgttgatgtaggcgaagccggtgtcgccgctcatcttctggtagccgacgccgaaggcgtggtagccgaggctgtaggtgaacatggcgttgagcgccttgttgtcgacgttgctggaaccgtcgtcggtggagcgcgcccagcggatgtcggatttcagcgactgcttgtcggcgatcggcagggtgtgcaccaggccgaggtaatgctgcttgtagaagttgtcgagcttgccgtagtggtagctggtgctgaggctgtcggtccacttgtagctgccgccggcgaagtcgaacttgtccgaagtcagcccggaacggaccacgatgttgcgcttgccgccaccggtgatggtcatgtcctcgttgtccgaggagtcgcgctggttgaccttcttcaggcgcccggcgtcgagggtcaggccgtcgatctccatggagttcagcgcgccgccctggaaggtctgtggcagcaggcggctgtcgttgggcatgatcaccggcagcttgggggtcagggtgccgatcttcagggtgctcttcgacgcccgcagcttggcggtgatccctgcctcgccatagtcgtcctgggcgcggccggtctcgcggtcgcgcttgagcaggccggtgccgctgcggtcggggctggagtcgagcttcaccccgagcaggccgatggcgtcgacgccgaaaccgatggtgccctcggtgtagccggattcgtagcgcaggaggaagccctgagcccattcctcggccttggactggctggcgccttcctggcggaaatcacggttgaagtagaagttgcggagttcgatgctggccttgctgtccttgatgaactcggcatgggccagggttgggacggtaatgctggaacccagcgcggcaaaagccacggcacgggcgatcggggtcatgctcattgttattgtctcctcgagcgcttggggcaggccgatggcggcggcgtgacgccacgtcggcctgtgacagcccggttacttaagcactacaggaagacggccactgttagacattag

SEQ ID NO: 2038 - DNA, 1515 bp, Pseudomonas aeruginosa
ccgtcggcgtcgaggctgcccaccagcaacagcgatagcagggagaagaactcccggtgctggtccggcatgaaggtgcggatcgcgcggctgccgaagccggcgacctgttcgcgaacgccggcgcgttcctggatcgccagttcgccggtgtggaagggactctgttcctggctcatgctgcctcctgccgagctacaggccgggcatcgggatgtagccgggcagcgcgcggatgcgggcgatccaggcgttcagcgccaggtagtggtccagcgccaggccgccttcgggggcgagggccaggtaggggtagagggccacgtcggcgatgctcggctgttcgccctgggccagccagcgatgctcggccaggtgccggtcgaccaggcgcagcacttccaggcctcgctggtgggtttgctcgcgatccagcggcaggttaaagcgagtgatcagccgggcgctggccgggccgttctgcacctcgttggccgaatagctgagccagtaggcgatgcggccctggctgacggggtcgagcggataccactcgggaccggcatggcgtcgtgccagatagacgagaatggcgtgggagtcgcccagttgcagctcgccgtcttccagcaccgggatctgtccgcggggattcatgcggaggaaggcctgggtcttgtgctcgcggttgaggaaatcgaccggccgcagcgtcgcctcgcggccgatgagggagaggaacaggcggaccttgtaggcgttgccggagagatccaggtcatgcagtttcatctgagggttccaggcgggtattggtgcctggatattagacagacaggtctgtatatttcaaggcgcgcgttcgcctttttccgtcggtattcgtccggggagcgacgcagagcggttcaagggggcgccagggtcgcgcataatgggccgctcaggaggctttccatgacatcccgcaaacgcgagcaactgctcagcaccgccgtcgacctgttctatcgcgagggttaccacgccaccggcatcgaccgcatcctggccgagtccggggtggcgaagatgacgctgtacaagcactttcgctcgaaggacgaactgatcatggccgccctggaggtgcgtcggcagcgcaccgccgaacgcatgctcgaagccgaggcacggttgcagccgcgagcggcgatcctggcggtgttcgatggtctgcaggagttcctccaggacgaggcgttccgtggctgtgccttcatccatgccgccgccgagttccatgagcgctcgcatccgatccatcgccaggcggccgagcaaaaggccttcgttgaagcctatttccagcgccagctggagcgcctgggcgcgcgttcggcggcactgcttgcgcggcagttgcaatacctgatggagggcgccctggtgatggcgcacatccatgggccggcggatcaggctcgcgaggcctggcaggcggccgaaagtctgttgcaggtcgctggcatctga

SEQ ID NO: 2039 - DNA, 285 bp, Pseudomonas aeruginosa
gcgcgggtgctaccatcgccgcgaaacactgcacaggtcctttcgatgcccccggaatgccaactcttcggaaccctcggttgccacctctgcgaagtcgcggaggcggtgctgatgcccttcgtcgaacatggcctgctggtcgaactggtggacatcgccgacgacgaagcctgggtcgagcactatggcctgcggatcccggtgctgcgccgctgcgacaatggcgccgagctgaactggccgttcgaggccgagcaggtcgcagccttcctcagctgctga

SEQ ID NO: 2040 - DNA, 1545 bp, Pseudomonas aeruginosa
cgtgcaggtcgtgctgatcaccggcggcaccggtttcaccggccgcgacagcaccccggaagcggtggcctgcctgctggacaagcaggtggacggcttcggcgagctgttccggcagatttcgctggccgacatcggtacctccaccatccagtcgcgggccctggccgggctttccaacggcaccctggtctgctgcctgccgggctccaccaacgcctgccgcactgcctgggaaggcatcctcgtcgagcaactggacgcccgtcatcgcccgtgcaacttcgtcccgcacctgaaacaggcggcgccctgcgagagccgcgggtgagcggctgctgcgaacagccggggctgatgccggtcgagacggcgctggaacggctcctcgaactggccgcgcaaacgcctatcgatacgtgtgagcaggtgcccctggagcaggctggcggccgcgtgctggcggtcgacctgctggccggcctggacctgccgccgtggccgaacagcgccatggacggctacgccttgcgcctcgccgactggaacggcgagccactgccggtcagccagaagatctttgccggacaggcgccgaagccgctgcaagcggatacctgtgcgcggatcttcaccggtgcgccgctgcccgaaggcgccgatctggtagagatgcaggaaaacgccgaagcgctcgacgatggccgcgtgcgcttcacccagccgttgcgcgtgggccagcatgtgcgcccgcgtggccaggaaatccgccagggcgacctggtcctgccggccggcacgcgcctgcgctccatcgaactggggttggcggcttcgctcggctacgcggccctggaggtgcgacgcaagccgcgggtggcgctgctgtccaccggcgacgagctggtcgaggcgggccagccgctgcaggccgggcagatctacaacagcaaccgtccgttgctcaaggattggctgcaacgcctgggctgcgacgtgctcgacgccggcatccttcccgacgacctggcacgtactcgcgagcgcctggccgggttggccggggtggacctgatcctgtccaccggcggcgtatcggtgggcgaggccgacttcctcggcatggcgctgcgcgaagccggcgagctgaccctctggaagctggcgataaaacccggcaagccgctgaccgtcggccagttccagggcatcccggtgatcggcctgccgggcaatccggcttcgaccctggtcaccttcgccctgctggcgcgtccctacctgctgcgccggcttggcgtggcgcaggtcgcgccgctgcgggtggaggtaccggccggctttgcctggaccaaggcggggcagcgtcgcgagtacctgcgtggtcgcctggagcagggccgcgcggtgctctatccgaaccagagttccggggtactgcgcagcgcttcctgggccgaggggctggtggaggtccgcgagggacgtaccctcgtggaaggcgagggtgtggcgttcattccgctgagcgaactgctcgactga

SEQ ID NO: 2041 - DNA, 441 bp, Pseudomonas aeruginosa
gtagctggcgcagggcgttcttcacccgcagcggcagcggttcgtcatcgtctagctcggccatcagcgccagggcatgttcctccagggtgcgcagcagcgtcgcgtcggcctggcgcagcggcagcgccaggtagtccagcggtaccagcagcgccgaacagggttgggcgaagcgcaccggacagccgaagaaggtctcgtagtcttccacgcgggttccgtccggcaggtcgtgttccagccagacctcgtccggcgaaccttccaggtcggcgatccagcgcgcgtagaggacccaggaagccaggacgtgctcgaccatgtggcgccgtaccaggggtgtctggtggcggcagttccagatcagccggacctgcccgccggccgcctcgatgcggctggtgcccatgtcgccgaccagcttctcgtagggcgtga

SEQ ID NO: 2042 - DNA, 1629 bp, Pseudomonas aeruginosa
acaggttgccgcgacaagcgaggggagaggttcatgcgccgttggaatggctggggcgaagaaagcaccgtggtcgaattgccggacagcgcccgtgggttcctggcggaactggtcgggcagggcgcacgcttgccggacgccagcctggaggcggcgctggcgaaggtcccggcgtcgcgcctggaggccgatccgcgctacagcatcgacccccgtgagcgtctgctgcatgcccgcgggcagagcctgccggactggctggcgatgcgcgagggcgacttcggcgtctacccggacgccgtggcctatccggaaaccgccgaacagatccgcgagttgctggccctggccgactcccgcgacctgcaactgattccctatggcggcggtacttccgtggccggccatatcaatccgcaagcctcgcggcggccggtactgacggtctcgctggagcgcatgaaccgcctgatcgatctggaccgcgagagcctggtcgcgaccttcggccccggcgccgccggcccgcaggtggagagccagttgcgtgcgctgggctacacgctcgggcatttcccgcagtcctgggagttgtcgaccctcggtggctgggtcgccagccgctccagtggccagcagtcgctgcgctacgggcggatcgaacaacttttcgccggcgggaccctggagaccttcgccgggccgcttgaaatcgctaccttcccggcatccgcggcgggaccggacctgcgcgaactggtgctgggctctgagggacgcttcgggatcatttcctcggtgaaggtgcgggtctcgccgctggccgaggacgagcgcttctacagcgtcttcctgccgaactggcagcaggccctgcaagccacccgcgagctggcacaggcgcgcgtgccgctgtcgatgctgcgactgtccaacgccgtggaaaccatgacccaactggccctggccggccatcccggacagatcgcctggctggagaaatacctggcgctgcgcggcgcgggcgagggcaagtgcatgctgaccttcggcgtgaccggcaaccgccggcagaacggattgtcgctgagccaggcgaaggccttgctgaaacgcttcggcggggtcttcaccggaaccctgctggggcgcaagtgggcgcagaaccgcttccgcttcccctacctgcgcgaggccctgtggcaggcgggctacgccgtggacaccctggagaccgccaccgactggagcaacgtcgacggcctgctgcagaagatcgaggccagcctgcgcgacggcctggcggccgagggcgagagggtccatgtgttcacccacctctcgcatgtctatggcgaggggtcgagcatctataccacctacgtgttccgtccggccgcgagctatgcggcgacgctggagcgctggaagcgtctcaagcatgcggccagccaggcgatcgtcgacaatcgcggcaccatcagccaccagcatggcgtcggcaaggaccacgcaccctacctgccccgcgagaagggcgaactgggcgtcgccgcgctgcgtgccatggccggtcacttcgacccggccgggcggctcaaccgcggcaccctgctgcaggactga

SEQ ID NO: 2043 - DNA, 3024 bp, Pseudomonas aeruginosa
ccaccttccggccgctggcggtggaggtgctacaagcctgcgcgccgctgctcgggcgcacggtcacggacgatggcgcggcggtgttcggcgcctgcgaaggcccgctcatcgacgggctcggcagcggccagcgacgccgcctggccggtcgctacggacgcgacctggtccgcctcaagcggctggtggacaccctcggaacggactgcgtgggtgccagcgaaacgctctgggccgaactggcgttcgccgccgaggcggaaatggtgctgcatctcgatgacctgctgttgcgccgcacccgcctcggcctgctgttgcccggaggcggcgcggcatacctgccgcgtatccgcgcactctgccaagcgcgcctgggctgggacgacccgcgctgggaacgtgagcaacaggcctatctggacctctggcgccggcaatacagcctgcccgtctgaccagccgagacgagaacgagatgaacgacaagaactatctgctggcgatcgacaatggcacccagagcgtgcgcgccctgctgttcgacctgcagggcaacctgctgggcaagggcaaggtggagctggaggcctactactcgaagcatccgggctgggccgaacaggaccccgagtactactgggcgatgctcggcgaggcctgtcggcggctctgggaccaggtggacatcgatcgcgggctcatccgcggggtgtcgctgaccacccagcgtggcacggtgatccatgtcgatgccgagggcaggccgttgcggccggcgatcctctggctcgaccagcgccgggcggaggtccgcgagcgcatcagggggccttggggctggctgttcaagctggtcggcgccgagggcgcggtggagcatttccgcgcccaggccgaggtcaactgggtggcccaggagcagccggagatcgccgcgaagaccgacaaggtgttgctgctttccggctttctcagccaccgcctgaccggccgtttcgtcgactcggtggggtgctgcgtggcctacctgccgttcgactacaagcgcctgcgctgggccgcgccgcgcgactggaaatggcaggcactggcggtacgccgcgagcagttgccggagctgttcaagccgggcgagcggctcggcgagatcagcgccgaggccagccggcacaccggcattccgcaaggcctgccgttgatcgctgcgggggccgacaaggcctgcgaggtgctcggcgcaggtgcgctggagcccaccatcgcctgcctctcctatggcaccacggcgaccatcaacaccactcgcgcccgctacctggaaaccgtgccgctgattccaccctatccggcggcgattcccgatcatttcaataccgaggtgatgatctatcgcggctactggatggtcagctggttcaagcgcgagttcggcttgcgcgagatgcagcaggcgcgcgagcagggggtcgagccggagcaactgttcgacgaactggtcaacggcgtgccgcccggctcgatgggcctgaccctgcaaccctactggtcgccgggaatccgcgaaccgggactggaggccaagggggcgatgatcggtttcggcgacgtgcatacccgggcgcacatctaccgggccatcctcgagggcctggcctatgccctgcgccagggcaaggagcgcatcgagaagcgttcgggcacgccgatcgtgcgcctgcgcgtggccggcggcggctcgcagagcgacgcggcgatgcagctcaccgccgacatcttcggcctgccggccgagcgcccgcatgtctacgaggcgtccggcctgggtgcggcgatcgactgcgcggtggggctcggcctctatccggacgtcgccagcgcggtggccgggatgacccgcgtcggccgggttttcctgccccaggcggaggcccggcagatctaccagcggctctatggcgaggtctacctgcgcatgtatcgccagttgcgcccgctctaccgcagcattcgcgagattaccggctaccctgcctgaaccgggcgccgcacttccgtcccggatacgcggtcaataggcaaagacaaggccacgacgaggggttcggttcgatggacaaggacaaggttctgctggtcctgcatggcaagcaggcgggcaacgaagaggttcgtgccgcggtcgcggcgcagcgcgaggccggacgggcgctggcggtgcgagtaacctgggaggacggcgacgcccggcgcatcgtcgaggaggcgctggcggccggctatgcgacgctggtcgccggcggtggcgacggcacgctgcgcgaggtggccgaagcgctggcgcgcgggcgaggcgaggcgagcctggcgatcctgccgctgggcaccgccaacgatttcgcccgcgccgccgggattcccctggaaccggccgcggcgctggcgctgctcgaccagacggcgcggccgatcgacctgggcgaggtgaacggcaagctgttcctcaacatggccactggcggcttcggttcgaaggtcacggcgaatacctcggaggacctgaagaaggttctcggcggtgccgcctacctgttgaccgggttgacccgtttttccgaagtgcatgccgcccagggccgtttcagcgccccggacttccagtgggaaggcgagttcctcgccctgggcatcggtaacgggcgccaggccggcggcgggcacgtactgtgtccgcaagcgcgagtggacgacggcctgctggacgtgagcatcctgccgacgccgcaggacatggtcggtaccctgggcaccctgctcggcggtggcaacggagtggaaagcctgttcgtccgcgcgcgggtgccatggctggaagtggaggcggcggaaggtctcgacgtcaatctcgacggcgagccgctggaaggacgcaagctgcgtttctcggtttccccgggcgcgctgcgcgtgcacttgccggccggttcgccgttgttgcgcgagccgccgcgcgaggactga

SEQ ID NO: 2044 - DNA, 837 bp, Pseudomonas aeruginosa
cagcatctttccaccaaggatgctggttccatgttccgtctctccgcgctgtaccgctatccgatcaagtcttccgccgccgagtccctggagcgcgtcgcgctcgatgcgctgggcgtggtcggcgaccgacgctggatggcggtggacaccgaaaccggacgtttcttcacccagcgcctgctgccgcagctggggcgtatccaggcgcgctgggcggcgccggaggtcctgcggctgaatgcgccggggatgtccgagctgagcctcgaagtaccggcagccgacgccaacctgcgtggcgtcacggtctggcgcgataccttgcaggcgccggatgccggcgacgccgcagcggactggctgacgcgcttcctcggccgcccgacgcgcctggtgcacattcccgaggcgcgcgcgcggcaggtcgataccggctacgccgaaccggggcagaaggtgcatttcgccgacggtttcccgctgctgctgatcggccaggcttcgctcgacgacctcagccagcgggtcggccggccgttggagatgctgcgcttccgtcccaacctggtggtggaaggcagcgccgcgttcgccgaggacggctggaaacgcatccgcatcggctcggtcgagttcgtcgtggccaagccctgttcccgctgcatcctcaccaccctggatccggcgaccggcgagcgcaacgaggaccgcgagccgctgacgaccctgaagacctaccgggaaaaggatggcgcggtgctgttcgggcagaacctgattgcgctgggacagggcagcctggaggtggggatgccggtggaaatcctcgactga

SEQ ID NO: 2045 - DNA, 2946 bp, Pseudomonas aeruginosa
cgccgagctgtagtagtcgagcaggctcagggccttttccgggtcctgccgcgccaggcggcgcaggccgagaccgaccacgtcggcggtggcatggtcgcgctggctgaagcggccggtctggctcagctgggcggggttctgcgccacgctgaccatcagcgcgccctggttgccgagggtcggcaggcgctgcgcgaggtgcgaggcgaggctgtagttgcgcgcttcggcggccagcttgaggcgtttccagaccttttcctcggtgagctggccttcgccctgccagaggccgaacagggtgtcgcaggcagccggctgcgacttgccgaccagccacaggcgttcgctggtggcgtagccttcggccttctggccgtggcccagctggtactggccatacaggcagtcgagttcggtgaagttcagcttcggatcgtagtagttgacgaaggtcttccagtcgccgcggtcggccagcaggcgcagccagcgcagtttcagccagccgatctgcggcaggtcgccgtgttcggtgaggaagcgctcgacctcctcgttgctggcggacttcagccggtgggtcagttcgtcgtaggccaggtagggttccagcgggtaatcgcgcagggcgctgcgcgaggccatgtagggcgcgctgttgcccttggccagggcggccttggcctggtcgtagagacggcgttgttcggtcagggaagcggcgtggaccgcgtcgacggaggaaatactgagcaaaaggcaggaaacgagagtgaacaggcgaccgcgcatgacttatccgggcaggtgatgtcgggtaacgtcggcaggtccgcaacggctgcctacgggcgtttcgaccgctcgcgggactggcgcgcgaccgctgtcgcggggcgcgcccgaagccgggcggatggcttgcctaagcttagccgttgcggcatggcggtgaaagcgccgtgccatccgatgcctatccggcgtaaaatgcgcgccctgtttccggaggcgcccatgaccctgctcaagttcaccgatgtatcccttgcctttggcaccactcccttgctggacaaggtgtcgtggcagatcggccgtggcgagcgggtctgcgtgatcgggcgcaacggtaccggcaagtccagcctgttcaaggtggtcaagggcgaacagcaggccgacgacggcgaagtctggcgcgcaccggcgctgaagatcggcgaattgccccaggaactgccgcgtgccgacgaacggacagtgttcgacgtggtggccgagggtctggcggaagtcggcaagctgctcgccgagtaccaccacctgagcctgaacatccataccgacgatgacctggcgcgcctctcgcgggtccagcaggaactcgaggcgcgcgatggctggcgcctgcagcaactggtggacagcaccctcagccgcctgcagttgccggccgacaagaccctcgccgaactctccggcggctggcgtcggcgcgtgctgctggcccaggcgctggtcgccgagccggacctgctgctgctcgacgaaccgaccaaccacctggacatcggcgccatcgcctggctcgaggaagcgctgctgggcttcaacggcgcggtgctgttcattacccacgaccgcgccttcctgcaatccctggcgacccgcatcctcgagctggatcgtggccacctgatcgactggaacggcgactacgccagtttcctggtgcacaaggaacagcaactggccgccgaagaagctgccaacgcattgttcgacaagcgcctggcccaggaagaagtgtggatccgccagggcatcaaggcccgccgcacgcgcaacgaagggcgggttcgggcactgaaggaaatgcgtcgcgaacgcgccgagcgccgcgagcgccagggcaaggccagcttccagctggaaagcgcggacaagtccggcaagcaggtgatcgtggtggagcacgtcagcttcgcccatcccggcggccagccgctggtacgcgacttctccatggtcctgcagcgcggcgaccgtatcggcctgctcggcgccaacggtaccggcaagaccaccttgctcaagctgctgcttggcgacctgcagccgacctcgggcaagatcgaggtgggcaccaagctggaagtggcctacttcgaccagttgcgccatcagctcgaacccgagcagacggtgatcgacaatatctccgaaggccgcgagttcatcaccatcgacggccagaaccggcatgtgctcagctatctcggcgacttcctgttcagtccgcagcgcgcccgcaccccggtgaaggcgttgtccggcggcgagcgcgcgcgcctgttgctggccaagctgttcagcaagccggccaacctgctggtgctcgacgaaccgaccaacgacctcgacgtggaaaccctggaactgctggaggaagtcctgctcggcttccagggcaccgtgctgatggtcagccacgatcgggccttcctcgacaacgtggtgaccagcaccctggtcttcgagggcgagggcaaggttcgcgaattcgtcggtggctaccaggactggctgcgccaagggggcacgccgcgcctgctcggcgtgagcgagtcgaagagcggcaaggccgagctgaataccgcgctggcgcccgccgccgaacccgcgccggctgctgcggcgccgagcgaggcgccggcgaagaaaaagctcagctacaagttgcagcgcgagctggaggctttgcccgggcagatcgacgcggtcgaggcggagctggcgggtgtccaggaaaccatcgcgcagcaggatttctatctgcgcccgcaggacgagcagcgcgaaaccctggcgcggctggacgcgttgcagcaggaactcgatgccttgctcgagcgctgggccgaactggaagactga

SEQ ID NO: 2046 - DNA, 492 bp, Pseudomonas aeruginosa
gcgccgaggaaacgctcggctgaggcgcaggccccggccgagcggggagagatcaggctttcttcaggtgcaccgcgagcacgtcgcagggcgcgccgtgcagcacgtcgttggcagtggaaccgagcagcagcgccaggccgtggcgaccgtggctgccgaccacgatcaggtcgcaagcctgttccgcggcgaggcggtggatttcctggcgcggttgcccgtagaccaggtggcgctgctcgctgccgaggtccggatagcgtacggcgaaggcatccaggcgttcacgggcctggtcgaactgctgctgctgcaacatcgacaggtccatcggcacgtccccaccgaaggccatggccatgggctcgaccacatgcaccaccgagagccgggcctggttgctggtggccagggccgccgcacgcttcatcaccgggtcgcattcgtcggtcaggtcgacggcgaccagaatgtgttgatagggcatga

SEQ ID NO: 2047 - DNA, 2163 bp, Pseudomonas aeruginosa
cgtggagatcagttgatgatttaccaaggtaaagccatcacggttaagcctcttgagggcggcatcgtcgagttgaatttcgatctcaagggcgagtccgtcaacaagttcaaccgtctcaccctcagtgagttgcgtgcggcagtcgatgcgatcaaggccgatgcatcggtcaagggcgtgatcgtgaccagcggcaaggacgtgttcatcgttggtgccgacatcaccgagttcgttgacaacttccagctgcccgacgaggaactgatggcgggcaacctcgaagccaacaagatcttcagcgacttcgaagacctggacgtacccaccgttgccgcgatcaacggcatcgccctcggcggcggcctggagatgtgcctggccgcagacttccgcgtgatgagcgcgaccgccaaggtcggcctgccggaagtcaagctgggcatctacccgggcttcggcggcaccgtccgcctgccgcgcctgatcggctgcgataacgccgtcgagtggatcgcctcgggcaaggaaaacaaggccgaggacgccctgaaggtcggcgccgtcgacgccgtggtcgctcccgagcaactgcaggccgctgccctcgacctggccaagcgcgccgtcgccggcgagctggaccacaaggcacggcgccagccgaagctggaaaagctgaagctgaatgcaatcgagcagatgatggccttcgaaaccgccaagggcttcgtcgccggccaggccggtccgaactacccggcgccggtggaagccatcaagagcatccagaaggccgccaacttcggccgcgacaaggcgctggaagtcgaagccgccggcttcgtcaagctggccaagacctcggtcgcgcagagtctgatcggcctgttcctgaatgaccaggaactgaagaagaaagccaagaaatacgacgaagtcgccaaggacgtgaaactggccgccgtgctcggcgccggcatcatgggcggcggcatcgcctatcagtcggcgctcaagggcaccccgatcctgatgaaggatatccgcgaagagggtatccagatgggcctgaacgaggccgccaagctgctcggcaagcgcgtcgagaagggtcgcctgaccccggcgaagatggccgaggcgctcaatggcatccgtccgaccatgtcctatggcgacttcggcaacgtcgacatcgtcgtcgaagccgtcgtcgagaaccccaaggtcaagcaagccgtgctcgccgaagtggaaggcgcggtgaaggaagacgcgatcatcgcctccaacacctcgaccatctccatcagcctgctggcccaggcgctgaagcgtccggaaaacttctgcggcatgcatttcttcaacccggtgcacatgatgccgctggtggaagtgatccgtggcgagaagaccggtgaaaccgccatcgccaccaccgtcgcctacgccaagaagatgggcaagagcccgatcgtggtcaacgattgccccggcttcctggtcaaccgtgtgctgttcccgtacttcggcggcttcgccaagctgctgagcttcggcgtcgacttcgtgcgcatcgacaaggtgatggagaagttcggctggcccatgggcccggcctacctgtccgacgtggtcggcatcgacaccggccaccatggccgcgacgtcatggccgagggcttcccggaccgcatggcggtcgagggcaagaccgccgtcgacgtgatgtacgaggccaaccgcctgggccagaagaacggcaagggcttctacgcttacgagaccgacaagcgcggcaagccgaagaaggtcaccgatccgcaggcctacgaagtgctcaagccgatcgtggtcgagcagcgcgaagtgaccgacgaggacatcgtcaacttcatgatgatcccgctgtgcctggaaaccgtgcgttgcctggaagacggcatcgtcgagaccgctgccgaggccgatatgggcctgatctacggcatcggcttcccgcccttccgtggtggtgctctgcgctacatcgattcgatcggtgtcgccgagttcgtggccctggccgacaagtacgccgagctgggcgcgctgtaccacccgaccgcgaagctgcgtgaaatggccaagaacggtcagaaattcttcggttaa

SEQ ID NO: 2048 - DNA, 1191 bp, Pseudomonas aeruginosa
agcgagagtgaatttatgagcctgaatccgagagacgtcgtcattgtcgacttcggccgcaccccgatgggtcgttccaagggtggcatgcaccgcaacacccgcgccgagaccatgtcggcgcacctgatcagcaagctgctggagcgtaacccgaaggtcgacccggccgaagtggaagacgtgatctggggctgcgtcaaccagaccctggagcagggctggaacatcgcgcgcatggcgtcgctgatgacccagatcccgcacaccagcgccgcgcagaccgtcagccgcctgtgcggttcgtcgatgagcgcgctgcacaccgccgcccaggcgatccagaccggcaatggcgatgtattcgtcatcggcggcgtggagcacatgggccacgtcggcatgatgcatggcgtcgacccgaacccgcacctgtccctgtacgccgccaaggcctcgggcatgatgggcctgactgcggaaatgctcggcaagatgcacggtatcagccgtgaggcgcaggacaagttcggcgcgcgttcgcaccaactggcctggaaggccacccaggaaggcaagttcaaggacgagatcatcccgatggaagggtatgacgagaacggtttcctgaaagtcttcgacttcgacgagaccattcgtccggaaaccaccgtcgagaccctggccgagttgaagccggcgttcaatccgaaaggcggcaccgtgaccgcggggacctcctcgcagatcaccgacggtgcctcctgcatgatcgtgatgtcggcccagcgcgcccaggacctgggcatccagccgatggcggtgatccgctccatggccgtggcgggtgtcgacccggcgatcatgggctacggcccggtgccgtcgaccaacaaggcgctcaagcgtgccggcctgaccatcgccgacatcgatttcgtcgaactcaacgaagccttcgccgcccaggccctgcctgtgctgaaggacctcaagctgctcgacaagatggacgagaaggtcaacctccacggcggcgccatcgccctgggtcacccgttcggttgctccggtgcgcgcatttccggcaccctgttgaacgtgatgaagcagaacggcggtacccttggcgtgtccaccatgtgcgtgggcctgggacagggtatcaccaccgtcttcgagcgcatctaa

SEQ ID NO: 2049 - DNA, 891 bp, Pseudomonas aeruginosa
cgccgagcgcctgtacgacctgatctggcgccagttcgtggcgtgccagatgaccccggccgaatacctctcgaccagcgtgagcgtcaccgccggcgatttcgagctgcgcgccaagggccgcatcctcaagttcgacggttatacccgggtactgccgcagcagagcaagccgggcgaggacgacgtcctgccggaaatgaaggaaggcgagaacctcaagctgatcaagctcgatccgagccagcacttcaccaagccgccggcgcgctactccgaagcgagcctggtcaaggaactggagaagcgcggtatcggccgcccctcgacctacgcggcgatcatctccaccatccaggagcgcggttacgtaaccacccacaaccgccgcttctatgcggagaagatgggcgacatcgtcaccgatcggctcaacgagagcttcgccaacctgatggactacggtttcaccgccgggatggaggagcatctcgacgacgtggcccagggcgagcgcgactggaagcacctgctcgacgagttctacggcgatttcaagaagaagctcgaggtggccgaagtcagcgagaaggggatgcgcgccaaccagccgaccctgaccaacattccctgccgcgagtgcggccggccgatgatgattcgtaccgcctccaccggcgtgttcctcggctgctcgggctacagcctgccgccgaaggaacgttgcaaggcgaccgtcaacctgattcccggcgacgagatcgccgcggacgacgagggcgagtccgagtcgcgggtgttgcgtggcaagcatcgctgcccgatctgcagtaccgcgatggacgcctacctgctggacgagaaacacaagctgcatatctgcggcaataa

SEQ ID NO: 2050 - DNA, 246 bp, Pseudomonas aeruginosa
agagcgtctgtcatgccaacatccttccttgaaatcgtagaaatgcccgacgggcgcatcgtgctgcgtcgcgccgatgacgaggaggcgttggtgaccctggagttctccggggacgcgaagaatttcctgcaaggccagcatgtcgaagtggccaaggccatgttcaatgtcggcgtgcaaatggccggtcgtcttgccgagggcgagatggaacacgacgaaggcccccgcgtcctgcactga

SEQ ID NO: 2051 - DNA, 588 bp, Pseudomonas aeruginosa
caggatgcgctcgcggttcaggccggcgcggcgcagccattcatgggtcaggctcgccggcggagcgatcagggtcagccagcgggcatcctgttcctcgctgagctcgcggagaatcggtgcgagcagggtcaggcagtgccccggcaggccgctgagcgaaagttcgctaaaggcagcgggttcctcgatggaggcgctggaagggctgtcgatgacatcgtcgagcaagggtgcgccgttgctggcccagaacgcttcctggaacagtggcaactgggcgctgggcagcgagtgggaggtctgcatggtatctcctgtcagcgccggatcacgccgacgctcaagccttcgatgatcagttcctgctccttcagatcgacttcgatcggagcgaactcagggttttccgccagcagccagaccttgctgccttcgcgcttgaagcgtttcaccgtgacctcctcgccgatccgcgcgaccaccacctggccgttgcgcgcttcgcgggtgacgtggacggccagcaggtcgccgtcgaggatgccgatgtccttcatgctcatgccgcgcacgcgcaacaggtag

SEQ ID NO: 2052 - DNA, 507 bp, Pseudomonas aeruginosa
cgagccgttgcgccagcgcctgatcgaggcgttgcgtgcgttggggctggcgcacagcagccatggggtttacgcctgcacccaagggccgcgcctggaaacggtggcggaaatcgcccggttggagcgggacggcaacgatatcgtcggcatgaccggcatgcccgaggcggcactggcccgcgagctggacctgccctacgcctgcctggcgctggtggtcaatcccgcggcgggcaagtcggcggggatcatcaccatggccgaaatcgaacaggcgttgcacgatggcatcggcaaggtgcgcgaggtgctggcgcgggtcctggccggctaggcggccatcgcaacgaaaaaaaggccgctattgcggcctttttcgctattgcgcaggaggtgcggcgtcgaagccgccttcgacggggggcgcgtccgccggtgcctgctgttcttccatttccatgggattgggggcggcgggacgggcgccgaccggcaccaccttga

SEQ ID NO: 2053 - DNA, 444 bp, Pseudomonas aeruginosa
tacacctggccgccgcgcagcagttcgcggagcagcgcttccttgatcaccgcgttctgctgctccatgacgaaggtgcgcaccgacaggcggcgcgccggcggcgtggcgatgatggacaggtcgcgcatgccggagacggccatgttcagggtccgcgggatcggcgtggcggtgagggtgaggatgtccacttcgctgcgcagggccttgagctgctccttctggcgcaccccgaagcggtgttcctcgtcgatcacgaccaaccccaggttggcgaacttcacgtcttcctggagcagcttgtgggtcccgatgaggatgtcgatcttgccttcggccagtagccgcgcagcgttctcgacttccttggcgctcttgaagcggctcatcacctcgacgctcaccggccagtcggcgaagcggtcgcggaagctgttgtag

SEQ ID NO: 2054 - DNA, 228 bp, Pseudomonas aeruginosa
tgctgctgggcgagcagggtggtgggcaccagcaccgccacctgcttgccgctatgcacggcgacgaacgccgcgcgcatcgccacttcggtcttgccgaagccgacgtcgccgcagaccaggcggtccatgggcctgggcgcgagcatatcggcgaccaccgcctcgatggcgctttgctggtccggcgtctcctcgaacgggaagccggccgagaaggtcgcgtag

SEQ ID NO: 2055 - DNA, 576 bp, Pseudomonas aeruginosa
cggccgacgccatggtcgatgtgcaccaccggcgcgccttcgcgcagctcggtgaggttcttgatcaccgcgtcgccgccgtcgcgggtcttttcccggcgccggcgctgcatgacgcgctggccgaacagcgggctttcggcgaccagggcgagggccggatggtccagcagcaggccctcgtccagcggcgcgatgctgatcgccaggcgtgcctggctggcgaggaaggccggccagccgtcgacttcctcggggcgcagcttcagtcgggccagcagctccagcaggacttcccggcgtccggccgattcggcgcagaacagtacgcggccggggaactcctcgatgaaccggcgcagcgcggccagcggctcggcggtcttggcttcgatcgccaggttcggcagcggcagggccgggaagcgctcgcgcccgacgcccggctcgacgtcctcctggctggcgaccacccgtggccagttcttcagccgggcgaagcagtcttccaccggaaggaacacttccgccggcggcagcaatggccgttccggatcgacccggcggtcctcgtag

SEQ ID NO: 2056 - DNA, 1836 bp, Pseudomonas aeruginosa
ggcagggtttcccaatcggggaaatgcaataccggcaggtcgggggcgaagaaccgcagttcctgttccaggcgttcggcattctggctgtcggcggtcagcagcagggtgaagcgcttggcggaactggcggcctcggcgacagccaggctcagcgcggcaccggggaggttgccccagtgttgcttgccggcgctggccggcaggctgggaagacgcagtacggacacgggcaagctgggctccggtcgggaatttgacccgccggattgtaactttcccgactgctggatgtcagtcttccgactgctgcagattgccgagcctggccggcgcggtcataatgtagccccttttttcatcccctacatgtggaaggtattgcccgtgactcagaagcccgaccagtgtctcggtgaatggatcgatcgtgaagccatcgcggaagccatgatcccgctgattggccagctctaccgcaataacaatgtggtgacctcgatccatggccgtggtctgatcaaccgctcggtgatcgcgatcatgaaggcgcatcgtttcgcccgtcatcgcatggctgatgacgccgagctgtcggttcacgagacgttcccgatcctcaaggcgatgagcgagctcaagctgggcgccgcttccgtcgatctgggcaagatggtcgccaagttcaaggcagaaggtaacggccgcagcatcgaggacttcgtcaaggccgagctggccgaggtggtcggcaagcagaacggcgatgcccgcgaaggcaccgacgtcgtgctctacggcttcggccgcatcggccgcctgctggcgcgcatcctgatcgagaagaccggcggcggcgacggcctgcgcctgcgcgcgatcgtcgtgcgcaagggtgccgagaacgacctggtcaagcgggccagcctgctgcgtcgggactcggtgcacggtccgttcgacggcaccatcaccatcgacgaagaaaacaacacgctgaccgccaacggcaacctgatccaggtgatctactccaacgatccagcgtcgatcgactacacccagtacggcatcaagaacgccctgctggtcgacaacaccggcaagtggcgcgacgccgaaggcctcggccagcacctgaagtgcccggggatcgatcgcgtggtccttaccgctccgggcaagggtgcgctgaagaacatcgtgcacggtatcaaccacaccgacatcggcgccgacgacaagatcatctcggccgcctcctgcaccaccaacgccatcgtgccggtgctgaaggccgtcaacgaccagtacggcatcgtcaacggtcacgtcgagaccgttcactcgtacaccaacgaccagaacctgatcgacaacttccacaagggcagtcgtcgtggccgcagcgcgccgctgaacatggtgatcaccgagaccggtgccgccaccgccgcggccaaggccctgccggtgctgaaaggcaagctgaccggcaatgcgatccgcgtgccgacgccgaacgtgtccatggcgatcctcaacctgaacctggaaaaggccaccacccgcgaagagatcaacgagtacctgcgccagatggccatgcactcggacctgcagaagcagatcgacttcgtcagctcccaggaagtggtttccaccgacttcgtcggttcgcgccatgccggcgtggtggacgccgaggcgaccatctgcaacgacaaccgtgtcgtcctgtacgtgtggtacgacaacgagttcggctacagctgccaggtagtgcgcgtgatggaagacatggctggggtcaacccgccggccttcccgcgttga

SEQ ID NO: 2057 - DNA, 327 bp, Pseudomonas aeruginosa
tcgaccatttcgtcgttcaggccaacatcaagcggaggctggcgcgcaatggctaatcaagaatccaccacccgcacactgctggtagccctggtggtgtgcctggtcagctcggtgttcgtcactggcgcggcggtggcgctgaagccgacccaggcggaaaaccgcctgctcgacaagcagcgcagcatcctcgccatcgctggtctcggcgagccgggcatgtccggcaaagaggtcaaggcgctgttcgacagtcgcatcaccgccaaggtggtcgacctccagagcggcaccttcagcgatgcccaggacccgctcggctag

SEQ ID NO: 2058 - DNA, 507 bp, Pseudomonas aeruginosa
gacccgctgaaagcggccaaggacccggcgctgtcggatgcgctgcccgccgccgaggacatcgcctcgatcaagcgccgcgagcgctataccacggtctacctggtggagaccgacggcaagctcgacaccctgatcctgccggtgcgcggctacggtctgtggtcgaccctctacggcttcctggcgctcaagggcgacctcaatacggtcgccggcttcggcttctaccagcatggcgagacccccggtctcggcggcgaggtcgacaatccgaaatggaaggcgctgtgggtcggcaagaccctctacgacgcccagggcgatcttgccgtacagatcatcaagggctcggtggacccgcaatcggcgaaggcgacccaccaggtcgacggcctggccggcgccaccctgaccagcaagggtgtcgacaacctgctgcatttctggctcggcaaggacggtttcgacgccttcctcgccaatctgcgcaaaggggaggcgtga

SEQ ID NO: 2059 - DNA, 714 bp, Pseudomonas aeruginosa
tcatctgggccctgcggacctggaagaaagaccaggtcgaggccccgacctacaagatggccccgcaggtatccagcaaggaggcttactgatggagcactacatcagcctgttcgtgaaggccgtgttcgtcgagaacatggcgctggcgttcttcctcggcatgtgtaccttcatcgccatctcgaagaaggtggagaccgccatcggcctgggtatcgcggtgatcgtggtgcagaccatcaccgtgccggccaacaacctgatctacacctacctgctcaaggacggcgcgctggcctgggccgggctgcccgaggtggacctgagtttcctcggcctgctcagctacatcggggtgatcgccgccatcgtgcagatcctcgagatgctcctcgacaagtacgtacccagcctctacaacgcgctgggcgtgttcctgccgctgatcacggtgaactgcgcgatcatggccggctcgctgttcatggtcgagcgcgactacaaccttgccgagagcacggtgtacggcgtcggctcgggcttttcctgggcgctggcgatcgccgcgctggcgggtatccgcgagaagctcaagtacagcgacgtccccgagggcctgcagggcctggggatcaccttcatcaccatcggcctgatgtcgttgggcttcatgtcgttctccggcgtgcagttgtaaggagaggcccgtga

SEQ ID NO: 2060 - DNA, 426 bp, Pseudomonas aeruginosa
tccgcgcctactcgatggccaactacccggaagagaagggcgtggtcaagttcaacatccgcatcgcctcgccgccgccgggcagcgacctgccgccggggcagatgtcgtcctgggtgttcaacctcaagccgggcgacaaggtcaccgtgtacgggccgttcggcgagttcttcgccaaggacaccgaggccgagatggtcttcatcggcggcggcgccggcatggcgccgatgcgttcgcacatcttcgaccagttgcgccggctcaagtcgaaccgcaagatcagcttctggtacggcgcgcgctcgctgcgcgaggccttctataccgaggagtacgaccagctgcaggcggagaatcccaacttccagtggcacctggcgctgtccgacccgcagccggaggacaactggaccggcctga

SEQ ID NO: 2061 - DNA, 1086 bp, Pseudomonas aeruginosa
tcaagatgctcaccgacctgggcgtggagcgcgagaatatcctgctggacgatttcggtggctgagcgtttccgtccgcttgccatggccggactggcagcgctggcgctggtcctggccggttgcggcgacaccctggaaagcttcggcggcccgaccatgggcagcacctattcgatcaagtacgtgcgcggcgcctcggcgcccgacgtccagacggcgaaagccgcggtggaggcgatcctcgccgaggtcgaccggcagatgtccacctaccgcgacgattccctggtctcgcgtttcaatgcgctgccggcgcagtcctgcatggagctgccgccaccgatgctggagttgctgcgctacggcggcgagttgtcggaacagagccagggcgccttcgacatgaccgtcgagccgctgatgaacctctggggcttcggtccgcaggcgcgggtggagaaggttcccagcgccgagcagatcgccgcggtgcgccgtgacgtcggccatcgacacctgcgcatcgacggccagcgcctgtgcaaggacgccgccgtacagctggacttcgacagcatcgccgctggctatacggtggacgcggtaggcgaacgcctgaaggagctcggcgtgcgcagctacctggcggaaatcaccggcgagttgaaagccgaagggcgcaagccggacggcacgccctggcgcatcgctatcgaagcgccgcgcgagggccagcgggtcgcccagcaggtactggcgctggacggctacggcgtctcgacctcgggcgattaccgcaactatttcgaagagaacggccagcgctattcgcacaccttcgacccgcgcaccggcgcgccgatcgaccatcacctggcttcggtcacggtgatcgatccgtcgacgcgcaacgccgacggcctgtcgaccctgctgatggtgctcggtccggaggagggctaccgtttcgccgagaagcaccgactggcggcgctgttcgtcagtcgccagggcaacggtttcgacagccgcaccacgccacgctacgagcaactgttcggcaaccaaggagaacgtccatga

SEQ ID NO: 2062 - DNA, 1404 bp, Pseudomonas aeruginosa
ggagtacgcatggctgtctacaactacgacgtggtgattttgggcacgggtccggcgggcgaaggggcggcgatgaacgcctccaagtacggacgcaagctggcggtagtcgacagccgtcgcgtggtcggaggcaactgcacgcacctcggcaccattccttccaaggccctgcgccactcggtgaagcagatcatcgagttcaacaccaacccgatgttccgccagatcggcgagccgcgctggttctccttccccgacgtgctgaagagcgccgaccgggtgatctccaagcaggtcgcttcgcgtaccggctactacgcgcgcaatcgcatcgacatgttcaccggcaccgccagcttcgtcgacgaacgcaccgtcgaagtggtgacgccgagcggcgcggtggagcgcctggtcgccgaccagttcgtgatcgccaccggctcgcgcccgtatcgtccttcggacatcaatttcaaccacccgcgggtctacgacagcgacaccatcctgtccctgagccacaccccgcgccggctgatcatctacggagccggggtgatcggctgcgaatacgcgtcgatcttcagcggcctgggcgtgctggtggacctgatcgatacgcgcgaccagttgctcagcttcctcgatgacgagatttccgatgcgctgagctaccacctgcgcaacaacaacgtgctgatccgccacaacgaggagtacgagcgcgtcgaggggctggacaacggtgtcatcctgcacctgaagtcgggcaagaagatcaaggcggacgcgctgctctggtgcaacggccggaccggcaacaccgacaagctcggcctggagaacgtcggcatcaaggtcaacagccgtggccagatcgaggtggacgagaactaccgcacttcggtgagcaacatcttcgccgccggcgacgtgatcggctggccgagcctggccagcgctgcctacgaccagggccgctcggccgccggcaacatcgtcgagagcgacagctggcgcttcgtcaacgatgtgccgaccggcatctacaccattccggagatcagctcgatcggcaagaacgaaagcgaactgaccgcggcgaagattccctacgaagtgggcaaggcgttcttcaagggcatggcccgggcgcagatttccaacgagccggtgggcatgctgaagatcctgttccatcgcgagaccctggagattctcggcgtgcactgcttcggcgaccaggcttcggaaatcgtccacatcggtcaggcgatcatgaaccagccgggcgagctgaataccctgaagtacttcgtcaacaccaccttcaactacccgaccatggcggaagcctatcgggtagcggcgttcgacggcctcaaccggcttttttga

SEQ ID NO: 2063 - DNA, 498 bp, Pseudomonas aeruginosa
cttctacgcccgcgactggacgcgcagccacggcaacctgtaccaggccatccgcatggaaaagaccatgatcggcctgttgctgctgctgatcgtcgcggtcgccgcgttcaacatcatttccaccctggtgatggtggtcaccgacaagaagtcggacatcgccatccttcgtaccctcggcgccacgccggggcagatcatggctaccttcatggtccagggtacggtgatcggggtgatcggcacgctggtcggcggggtcctcggggtggtcgcggcactcaacgtcagcgcctggatttccgccctggaaaagctgctgggccaccagttcctcgcgtccgacgtgtacttcatcgattacctgccgtcgcaactgatgctcgacgatgtcgtgctggtctgcggcgcggccctggtcctcagcttcttcgccactttgtatccagcctggcgtgcggcgcgcacccagcctgcggaggctttgcgttatga

SEQ ID NO: 2064 - DNA, 342 bp, Pseudomonas aeruginosa
tcggccgcacgccgatcgcggaagcccgccagcgggcggccgagctgctggagcgggtcgggctggggcatcgcctgttcgcacaagccggccgagctgtccggcggcgagcgccagcgggtggcgatcgcccgcgcgatggtcaaccgtccgcagctggtactgctcgacgagcccaccggcaacctcgaccagcataccgcccagggtatccaggagctgatgctggaactgagccgttcgttgcagacctcgttcctggtggtaacccacgatctccagctggccgggcacatggatcgcatcctgcgcctggaagaaggccgactgatcgccgcgtag

SEQ ID NO: 2065 - DNA, 1314 bp, Pseudomonas aeruginosa
cggggcgacggcgtgcccgccgtccgctcccgtccggcgaatcccccatcgactcggtgcatccgcgacatgttcagaccgttaccgttcttcataggcctgcgctacacccgcgccaaacgccgcaaccactacatctcgttcatctcgctgacctcgatgatcggcctggcgctgggcgtgctggcgatgatcatcgtgctctcggtgatgaacggcttccagaaggaaatgcgcacgcggatcctcggcatggtgccgcatgccaccatcagcgcggcgcagccgctggacgactggcagaccgtcgccaacgcggcgcttcggcaccgcgaggtggtcggcgcggcgccgttcgccgaactgcagggcatgctgtcgtacaagggcaatatgctgccggtgctggtcaacggcatcgacccgcaggaggagcgcaaggtttccatcgtcggtgagcacatcgtccagggcagcctggacgacctcaagcctggcgagttcggcatcgtcctcggcgagatcaccgcgcggcgcttccatgtcaatgtcggcgacaagctgaccctgatcgtcccggaagccaccagcgcgccgggcggcatcactccgcgcatgcagcgcttcaccatcgtcgccctgttcaaggtcggtgccgaactggacaactcgctggcgctgatcgacatcgccgatgccggccagttgctgcgcctgcaaccgggccaggtgccgagcgtgcgcctggagctgaaggatctctaccagtcgccgcaggtcgccgccaaggtggtcaaggagttggggcagggcttcaggtccagcgactggaccaggacccagggcagcctgttcaacgcgatgaagatggaaaagaccatgatcggcctgctcctgctgctgatcatcgcggtcgccgccttcaacatcatcgccaccctgatcatggtggtcgccgacaagcgcaccgacatcgcgattcttcgtaccctcggcgccacgccgcggcagatcatggcgatcttcatggtccagggcaccgtcatcggcgtgatcgggacggtcatcggcggggtactcggggtgttcgcggcgttgaacatcaccgggatgatcgaccgcatcgaacggttggtcggacacaaggtcttcagctcggatgtgtacttcatcaactacctgccttccgatctgcaggtgctggacgtggtgctgatctgcagcgctgcattgctgatgagcttcctcgccaccctgtacccatcctggcgcgcggcgcggacacaaccggccgagtcgctgcgctacgagtga

SEQ ID NO: 2066 - DNA, 1641 bp, Pseudomonas aeruginosa
caggatttcgttgcccattgtatgaccccatgtgacatgtcggggagcggagggcacgccacggggatgggaggaaccgttcatgcgcctgggattgccagccctcgccgcggggctgctggccctgcgcttcctggcggaattgccgtcggtcggctggctgctgggcatggccgccgccggactgttgctgctgttcggccggctgtactggctggggttgttcctgctcgggttcgcctgggcctgcggctcggcgcaagtcgccctggacggacgcctggccgccgagctggatggtcgcaccctttggctggaggggcgtgtggtcgatctgccggcgagcggcgagggcgtcacgcgcttccggctggaggaggtccgcgctgcgcggggcgtgcttcttcccgagcgtttgcgcctgagctggcgcggcgcgccgccgctgatgggcggcgaacgctggcgcctggcggtgaccctgaaacgcccccgcggcctggtgaacgcggcgggtttcgactacgaggcctggttgttggcgcagcgggtcggtgctgtgggcacggtgaaggcgggccagcgcctgcagccggccagcggcctggatgcctggcgcgatgcctggcgccagcgcctgctggcggtcgacgcacaggggcgcggcgccgccctggcggcgctggtgctgggggatggctcggggttgagcgcggccgagtggcgcatgttccaggacaccggcaccgtgcatctgatggtcatctccggttcgcatatctcgttgctggcggggatgctctatggcctggtggcggccttgcatcgcctgggctgctggccgcggcgcctgccctggctgccctgtgcctgcgccctgggtttgcttggtgcctggagctacgggttgatggcgggtttcgaggtcccggtgcggcgcgcctgcctgatggtcagcctggcgctggtctggcgcctgcgtttccgccacctgggcttgctgaccccgctgctggcaacgctggtgctggtcttgctggtcgagccgctggccagcctgcaggcggggttctggctgtcgttcctggcggttgccctgctgctctggctgttcgccgggcgccttgggcgctggcgctggtgggcggcctgggggcgggcgcagtgggggatggcgctggggctggcgatgccgctgctggcgctgggcctgccgttgagcctgagcggagcgccggccaacctgctggcggtgccttggatcgaactgctggtagtgcccccggccctggcggggagcctgctgctgtgggtgcccgggctgggcgaggggctgcttcgcgccgctggcgtttcgctggacctgctgtttcgtgcgcttggcctgctggcgggcctggccgaggcctggcagccacccgccgcagcggcctggagcgtagcgctgggcatgctcggcgcgctctgctggctggcgccggctggcttgccgttgcgtgccctcggtgccgcgttgctactgccggcattgttgccgtcatcgccgcctgtcgaatgggggcgggcggaagtgcgggtgctggacgtcggccaggggctggccgtgctggtgcgtacccgaaagcatgtcttgctctatga

SEQ ID NO: 2067 - DNA, 468 bp, Pseudomonas aeruginosa
agtcgactacgtcgaggaaggcaaagcgtgaaattccgccgcagacgggcgggtgccgcccgtgaagacgtcttcatcaacctggcgtcgctgatcgacgtgatcttcgtcctgctgctgttcttcgtggtcagtaccaccttcacccgccccgagcagctcaacatcgagctgccatcggcggagagcggcgaaaccgccggcaccgagcagaagcaactggaactctcggtggatgccgaggggcactacgccttgaacgggcaggcgctggccaagagcgacctggccaccctgatggcggcgatgcagcgtgaatcggcgggcgacaacaacctgccggtggtgatcagcgccgatgccaagtccacccaccagtcggtggtcacggcgatggacgcagcgggcaagctgggcttcgtccacctgcgcatcaccacggtcgagaacacggcggccaagccctga

SEQ ID NO: 2068 - DNA, 354 bp, Pseudomonas aeruginosa
ccgagaaggatgccgttaaatgccgggctttcgcagcggccgactggtggtacctggcggtcgatgcggtgccttccccagcattcgtcgcctggttcgacgcccgactcgagcatctcctggcgcgctgaccggcggccgtgccgccattgtatgaaggactccgccatggacccgaaactcctcgatatccttgcctgcccgttgaccaagggcccgctggtgctcagcgaagacaagaccgaactgatcagcaagcaggccggcctggcctatccgatccgcgacggcatcccggtgatgctggagagcgaggctcgctccctgaacgtggacgagcggctggacaagtaa

SEQ ID NO: 2069 - DNA, 447 bp, Pseudomonas aeruginosa
ctttcagtcgtgcgcccttgccctgggctcgcgacgccttcgcccgcgatcgcgacagcctgccggagggcgtgccctatcgtcgccacatcggcatctacgcctatcgcgtgggtttccttgccgatttcgtcgcctggggaccgtgctggctggagaacgccgaaagcctcgagcaattgcgcgcgctctggcacggggtgcgaatccatgtggccgatgcccgcgaaaccatgcttccgggcgtggatacgccggaagacctcgaacgcgttcgccgcgtgctggggggctgatgcgcgtcctgttcgtctgcctgggcaacatctgccggtcgcccaccgccgaaggcgtgttccggcgcaaggtcgaggaggccgggctggcctcccgtatccatgtcgattccgccggcaccgccggctggcatgtcggcaaggcacctga

SEQ ID NO: 2070 - DNA, 1236 bp, Pseudomonas aeruginosa
cctgatcctggccatggacctgtccaacctggccgacctcgagaccctgcgtgccgggcgcggtgccgccgaactggatctgttcctgcgtcgctacgggtccgagcgggacgaagtacccgatccctactatggcggcgaagaaggcttcgagcaggtcctcgacctgatcgaacatgcctgcgaccgtctgttgatcgaagccaaggggcgactgtgagcctggaactgcaagagcattgctcgctgaagccctataacaccttcggcatcgacgtgcgcgcccgcctgctggcccacgcccgggacgaggctgatgtgcgcgaggccctggccctggctcgggagcgtggattgccgctgctggtgatcggtggtggcagcaacctgctgctgacccgtgacgtcgaggcgctggtattgcgcatggccagccaggggcggcgaattgtttccgatgccgcggattcggtgctggtcgaggcggaggcgggcgaggcctgggacccattcgtgcaatggagcctggaacggggcctggccggtctggaaaatctcagcctgattcccggcaccgtgggtgcggcgccgatgcagaacatcggcgcctatggcgtggagctgaaggacgtcttcgacagtctgacggcgctggatcgccaggatggaaccctacgtgagttcgatcgccaggcctgccgtttcggctaccgcgatagcctgttcaagcaggagccggatcgctggctgatcctccgcgtgcgcctgcgcctgacgcggcgggagaggctgcacctggactacgggccggtacgccagcgcctggaggaggagggcatcgccagtccgacggccagggacgtaagccgggtaatctgcgccattcgccgggagaagctgcccgaccccgccgtattgggcaatgccggcagcttcttcaagaacccgctggtggatgcggcgcaggccgaacgcttgcgtcaggccttcccggatctggtcggctatccgcaggcggacggtcggctgaagctggctgcaggctggctcatcgacaagggcggctggaagggtttccgcgatggcccggtgggggtacacgcgcagcaggcgctggtcctggtcaaccatggcggcgccactggtgcccaggtccgggcattggccgagcgtatccaggaggacgtccgtcggcgtttcggcgtcgaattggagcctgaacccaatctctactga

SEQ ID NO: 2071 - DNA, 759 bp, Pseudomonas aeruginosa
cctcgcgctggcgttcgcggcggttgctgcgacgacgctggccgcgggagcggcggcgcgggcgctcgccatcggtatcgtcctgctcgtcctgctccaggctctcgtcgttcggcaatgcctcggcttccagggccgcggcgtcgcgagcctggcgatcctcgcgcggctggcgctcttcgcgggccgggcgttcgacgcgttcttcacggccttcgcggggttggcgctcttcgcgggccgggcgttcggcgcgctcttcgcggcggcgttcgctgcgttcctcgcgaccttcgcggccttcgcgcggttggcgctcttcgcggggtgtccgctcggcgcgctcttcacggccttcgcgcggctggcgctcctcgcgagccggacgctcggcgcgctcttcgcggcggcgttcgctgcgctcttcgcggttcgggcgttcggcgcgctcttcgcgcggttgacgctctgcacgctcctcgcgcggtttgcgctcttcgtcgcggcgattgccatcgcggccatcgcggcggcggttctgctggcggccgttgcgacgctcgtcctggcgggtttggcgctcggcagccggcttgctggtttcagcaggcttggcggcaggttgatccttgcctgcgaacaggccgaccagggacttcaccaggccctggaacaggctcggctcgggcatcggcttggccggctcgaccggtgcttcggtgtgttgcggtgcgggctgctggggagcgacggtcttga

SEQ ID NO: 2072 - DNA, 237 bp, Pseudomonas aeruginosa
gtcaggaggaggaatcggctgtcggaggcggacgaaaaatgcgtctggatcaagctagaagctacgcagtccaacagccgtacatctccaccctacacatgttccttaagaatcgggcgccgctcgcagtatccggagcgggttggcatctcgcgctcaccgaagtggtcgcggctcatgtttcaaggctttggtttcgagtcgttagcgggttggaaattttcgtatttccgctga

SEQ ID NO: 2073 - DNA, 1170 bp, Pseudomonas aeruginosa
tcggtgattcgccgttcgacctggaaatggcgcgacgggcggggatggattcggttgcggtggcctatggcgcccaatcgctggagcagttgcggccttatgcgccgcggctggaagttgagcatttcaccgagttgcgcgcctggttgggcggtgctcgacgtgaggcggtttcaggagtggttgagcatgtctgacgagtggaagtcggaaacgccgaaggcgaatgacgacaagagctggaagctgctggagaaggcggtcctcgccggggtccaggagcagcggcgggcgcggcgctgggggatattcttcaagtcgctgaccttcatctatctctttgtcgtgctgctggccttcagtccgttcggcagcctggagaaatcggcctcgcgcagcggtagccacacggcactgatcgaggtgaagggcatgatcgccgacgatgagccggccagtgccgacaatatcgtcacggccctgcgcgcggcgttcaaggatgagggtaccaaggggatcgtcctgcggatcaacagtccgggcggcagtccggtgcagtcgggctatatctatgacgagattcgtcgcctgcgcggcgagcacccgaacgtcaaggtctatgcggtgatcagcgacctgggtgcctccggcgcctactacatcgccagcgccgccgaccagatctacgccgacaaggccagcctggtcggttccatcggcgtgacggcggccagcttcggtttcgtcggcaccatggagaagctcggtgtcgagcggcgcgtctatacctccggcgagcacaagtcgttcctcgatcctttccagccgcaaaagcccgaggagacccagttctggcagcaggtgctggataccacccacaagcagttcatcgacagcgtgaaaaaagggcgcggcgaccggctcaaggtcgaggggcatccggagctgttctcgggtctggtctggtccggcgaacaggcattgcagctgggtttgatcgacggcctgggcaatgccagctatgtggcgcgcgaagtggtgaaggagaagaagatcgaggactacaccgtgcaggagtcgcctttcgatcgcttcgccaagaagttcggtgccagtgtggcggagcgcctcgcgctgtggatgggctggcaggggccggtactgcgctga

SEQ ID NO: 2074 - DNA, 1089 bp, Pseudomonas aeruginosa
tgcgtccggccgccgagcagttcgccgcctcggtcgaaagcctgcagtggcaggcgccgaagattgcgctggtgcagaacgtcagcgccgccgtgccggctgatctcgatacgctgcgccgcgacctgctggcacagctgtacagcccggttcgctgggtggagagcatccagctgctggcggaaaagggcgtcaccgagctggtcgagtgcgggccgggcaaggtcctggcaggcctcaacaggcgctgcgcgaagggcatcaatacccatggcctggatggcgtcgaggcgttcgccgccacgcgcgccgccctggcctgagagagagaaaggagagaatcccatgagtctgcaaggtaaggtcgcattggtaaccggcgccagccgtggcatcggccaggcgattgcgctggaactggggcgcctgggtgccgtggtcatcggcaccgcgaccagcgcgtccggcgccgagaagatcgccgaaaccctcaaggccaatggcgtcgagggtgcgggcctggtcctggacgtttccagcgacgaatccgtagccgcgaccctggagcacatccagcagcatctcggccaaccgctgatcgtggtcaataacgccggcatcacccgcgataatctgctggtgcgcatgaaagacgacgagtggttcgatgtggtcaacaccaacctgaacagtctctaccgtctgtcgaaagccgttctgcgcggtatgaccaaggcccgctgggggcgcatcatcaacatcggttccgtggtcggcgccatgggcaatgccgggcaaaccaactatgccgcggcgaaggccggcctggagggcttcacccgtgcgctggcccgggaagtcggttcgcgtgccattaccgtgaatgcggtggcgccgggcttcatcgacaccgacatgacccgcgagctgccggaagcccagcgcgaagcgctgctgggccagattccgctgggtcgcctggggcaggcggaagagatcgccaaggtggtcggcttcctcgcttcggacggcgcagcctatgtgaccggggccaccgtgccggtcaatggtgggatgtacatgagctga

SEQ ID NO: 2075 - DNA, 246 bp, Pseudomonas aeruginosa
aaacaaggtatgagcaccatcgaagaacgcgttaagaagatcgtcgctgaacaactcggcgtgaaggaagaagaagtcaccaacagcgcttccttcgtcgaagacctgggcgccgactcccttgacaccgtcgagctggtgatggctctggaagaggaattcgagaccgaaatccctgacgagaaagctgaaaagatcaccaccgttcaggaagccatcgactacatcgttgctcaccagcaataa

SEQ ID NO: 2076 - DNA, 801 bp, Pseudomonas aeruginosa
ccggccacctgttgggtgccgccggcgcggtggaggcgatcttcagcgtgctggccctgcgcgaccaggtcgccccgccgaccatcaacctggacaacccggacgaaggttgcgatctcgacctggtggcccatgaagccaagccgcgcaagatcgacgtggccctgtcgaactcgttcggtttcggcgggaccaacggcaccctggtgttccgcaggttcgccgactgatgctggactgggtcgacggccggcccgccgccgagctgtccgtgcgcgatcgcggactggcctatggcgacgggctgttcgagaccctggcggtgcgcgccggcacgccgcgtctcctggagcgccacctggcgcgcctggaagaggggtgtcggcgcctggcgatccctctcgacgccgcggcgttgcgccaggagttgctggcgttctgcgcggcgctgggcgacggtgtcgccaagctgatcgtcacccgcggcgagggtttgcgtggctacgcgccgcctgccgaggcctcgccgcggcgaatcctctccggatcgccgcgtccggcctatcccgagcgccactggcagcaaggcgtgcgcctgttcgcttgccgcacgcgcctggccgagcagcccctgctagccggcctcaagcacctcaatcgcctggagcaggtcctcgcccgtgccgagtggagcgacgccgggcatgccgaagggctcatgctggacgtgcacgagcgggtagtggagggcgtgttcagcaacctgctgctggttctcgacggcaccctcgtggcgcctga

SEQ ID NO: 2077 - DNA, 1092 bp, Pseudomonas aeruginosa
actgcaagaccaacttcgcgacgacctggatttctgactttgatgcgcaaactgctggtgctgctggagagtggcctgttgttcgttggcctctgcgtcggcctggctgcatggcagcagcagcgggcgctggagcagcccctgcaattgaccgaggagcgcctgctggacgtttcctcgggctccacgccgggcggcatgctcgcgcgtctggagcaggaaaaggtgctccatggcgcgttctggctgcgcctctactggcgtttcaacctgccgggccaggccatgcacagcggcgaataccgcctcttgccggggatgaagggcgccgacctgctggaactctggcgtgaaggcgaggtggtgcagtacagcctgaccctggtcgagggctggagtttccgccaggtgcgcgaagcgctcgccaggcagggcaagctggagcagaccctggccggcctgagcgacggcgagatcatgcaacgcctcggcaagcccgacgaagtggccgaagggcgcttcttccccgatacctaccgctacacccgtggcatgcgcgacatcgacatactgcgcaaggcctaccagcgcatgcagaccatcctcgccaaggaatgggatggccgcagccaggacctgccttatcgcgacgcctaccaggcgctgatcatggcctcgctggtggaaaaggaaaccggcgtgccggaagagcgttcgcagatcgccggcgtcttcgtccgccgcctgcagcgcggcatgctgttgcagactgatccgacggtgatctatggcatgggcgagcgctacaacggcaagatcacccgcgccgacctgcgcgaaccgaccccttacaatacctatgtggtgccgggcatgccgccgaccccgatcgccctggccgggcgcgaggcgattcgcgccgcgctgcatccggccgagggtgagaccctgtatttcgtggcgcgcggcgatggcagccatgtgttctccagcagcctggacgaacacaacaaggcggtccgcgagtaccagttgaagcgtcgctcggactatcgctccagccccgcgcccatcaccccgccgccacaatga

SEQ ID NO: 2078 - DNA, 828 bp, Pseudomonas aeruginosa
actgctgctggcgcccagcgacgagccgatggccgccgataccgagctgttgctgatgttcgccgcgcgggcccagcatctcgccggggtcatccgcccggcgctggcgcgcggggccgtggtgctctgcgatcgcttcaccgatgccacctatgcctaccagggcggcgggcgcggtttgccggaggcgcgcatcgccgcgctggaaagcttcgtccagggcgacctgcggcccgacctcacgctggtcttcgacctgccggtggaaatcggcctggcgcgggcggcggcgcgtggccggctcgaccgtttcgagcaggaggaccgacgcttcttcgaggccgtgcgtcagacctacctgcagcgcgccgcgcaggccccggagcgttaccaggtgctcgatgccgggttgccgctggccgaggtgcaggctggcctggatcggctgctgccgaatctgctggagcgtctgaatggctgatatctatccctggcagcaggcgctctggagccaactgggcggccgcgcccagcacgcccacgcctatctgctctacggtcccgccgggatcggcaagcgtgccctggccgagcattgggccgcccaactgctctgccagcggcctgccgccgctggcgcatgcggcgagtgcaaggcctgccagttgctggccgccggtacccatccggactacttcgtgctggagccggaggaggcggagaaaccgatccgggtcgatcaggtccgcgacctggttggcttcgtggtgcagaccgcgcaactgggcgggcgcaaggtcgtgttgctcgaacccgccgaggcgatga

SEQ ID NO: 2079 - DNA, 861 bp, Pseudomonas aeruginosa
agtcggaccggccgacccacacgatgtaacgctagacaggatcatgctggtcgattcccactgccacctcgatcgcctcgacctggccgcccatggcggctcgctcgatgcggcgctggatgccgcgcgagcgcgtggcgtcggtcaattcctctgcatcggcgtcagcgccgacaatgcccaggcggtgaaggccctggccgagcgctatgccgacgtgcactgttcggtgggcgtgcacccgctggacctggagcccggaagcgcgccagcgctggactggctgctgggcgaactggcgcatccgcgggtggtggcgatcggcgagaccggcctcgactaccactacgaaccggaagccgccgagttgcaacaggaggcgtttcgcctgcacctggaagccgcgcggatcaccgccaagccagtgatcgtgcacacccgcgaggcgcgcgccgacacgctggcgctgctgcgcgaggcggcgttgccgcaggccggcgtgctgcattgcttcaccgaggactgggaaatggcgcgatcggcgctggacctgggcttctacatttccctgtccggcatcgtcaccttccgcaatgccgatgccctgcgcgaggtggctcgccaggtaccggccgaccggctgttggtggagaccgactcgccctacctggcgccgattccccatcgcggcaagccgaacctgccggaatacgtgcgcgatgtcgccgaattcctcgcgacgttgcgtggcgtcagcctggaaaccctggcggagcagactaccgccaatttccatcggctgtttccgttggcccgctaggccggcgcacggataaaaaaaacccgggttctgggggatga

SEQ ID NO: 2080 - DNA, 1125 bp, Pseudomonas aeruginosa
tggatatcggcgtgcgcatgggcaacaagcgcaagcgcgaaggcgacgctcccagcgcctgatacctgtggtgccgagacgcagtcactgcgccccgcgcactctttgccggcagggatatactcgtcgcccatcgatccgccggcgggacgtcggctgcccatttccggcgaatccgccggtggcaccgtcccggtggcggctccacgttcgttcaggagttctccgatgagtgtccgtgaattccccatccactacatcgaaccggtgttccggcccccgagcgaggcgcattcgctgatcctcccggtgaccaatggctgttcctggaacaaatgcggcttttgcgagatgtatacccagccgcaaaagaaatttcgcgcccgcgacgagaacgaggtactggaggagatccgccgctgcggcgagcgcctgatcgtcaagcgggtgtttctcgccgatggcgacgccctggtattgccgacccgccggctgctcgcggtgctgcaggcgattcgccagcacttgccggaggtggagcgggtatccagctactgcctgccgcgcaacctgcgcaggaagtcggtcgacgagttgcgcgaactggccgacgccgggctgcgaatggcctatgtcggcgccgagtccggcgacgacgaagtgctggcgcgggtcaacaagggcgagacctattcctctaccctggatgcgctggaaaagcttggcgaggcggggatcagtcgttcggtgatgatcctcaacggtctgggcggaatgaccctgagcgcgcagcacgcggacaactccgcgcgcctgatgaacgccgcccagccggagtacctgtcgaccctggtggtgagtttccctaccggcgagcagcgtttccgtgctggcttcgccgatttcgaggcgctggaccggcgtgccctgttcgtcgaggtcgaacgcctgttgcagggtttggagctcgaagacacggtatttcgcagcgaccacgcttccaactatctggtgctcaagggcgaactgggtgccgacaaggcgcgcctgctggccgaggtccgccaggctatcgagcagccgcagcacgctgccctgcgccaggagtggcagcgtggcctgtga

SEQ ID NO: 2081 - DNA, 447 bp, Pseudomonas aeruginosa
cgccatcgctaccgtgcagtcctcggctgcggtcaaggtgatcaccgtgcgtaccaccggcttcgacgccgtcgccgccgaaggcggttcggctgccgtcgagcaggtttccggcccggccgatgccggcaagtccgccttcgtcggcgaagagctggccaagtccgaccgtccggaactgaccgctgccaagatcgtggtctccggcggccgcggcatgcagaacggcgacaacttcaagatcctctacgccctggccgacaagctgggtgccgcagtcggcgcttcccgcgccgcggtcgacgccggtttcgtgccgaacgacatgcaggtcggccagaccggcaagatcgtcgccccgcagctgtacatcgcggtgggcatctccggtgccatccagcacctggcgggcatgaaggactcgaaggtgatcgtcgcgatcaataa

SEQ ID NO: 2082 - DNA, 438 bp, Pseudomonas aeruginosa
ggacggcggttcattcgccgggtcgatagagatgtcgatgctcggcgcggtacagcgaagagtcggcgaagccttcggcggccagcacctcgccgaccaggatcagcgcggtgcggcggaaattcctggcggcgaccttgggcaggatgtcgccgagggtgccgcgaacctgttcctggtcgggccaactggcccggtggatcaccgcgaccgggcagtcggcgccgtagtgcggcagcagttcctcgacgatcttcgccaggtgggcgacgcccaggtggatcgccagggtcgcccggtgccgcgccaggtcacccaggctctcgccttccggcatcttcgtgcgtgcggcgtagcgggtcaggatcagcgtctgggacacttcgggcagggtcagctcgcacccgaacagggcggcgcaggcggcggtggcggtga

SEQ ID NO: 2083 - DNA, 897 bp, Pseudomonas aeruginosa
aatagacggtcatgggagttctcgttcggtgagaagacgtgccagggcgatgctcgcccgatcgttgctgcgtttcgccccgagcagatcggcgcgaccgccacccaggcgttcggccagggccagggcggcggcctcggcgacgctggagcagccggtttcgcgcagcgcgacggcggaggggctgagcaggcgcggctcgtagtcgtgcaggacggcgggtgcgaggaaatgcacggggcgttcgagcagcgtggccagttgccgcaggccgggttcgtcgcgtttgccgtcgatgctggcgagggcgtccagctcggccaggctgcgcccgtgttcgcccagcgttcgctccagcagcgcgcgcagatgctcggcgctacagcctcggcggcagccgatgccggcgatcagcaggctggggatgggcaggggcatgcgcgcaccggaggaaatggaaggagaggcactatggacccgcgaccggcaagggtcgcgggtggcaggcggtcaggcgtcgacgccgccccggttgcgccggaacagccaggcagcggccaggccgagggcggcccagaacagcgcattgctgaccagcgaggcgaccacgaaacgctgggccagggcttccggcgccaggctggcatggacctcgggctgcggcgcgccgaacaggtgcggcagcgccagcaggacggcgccgaccagcttcagcggccagttgccgccgaacaccagcagggccaggcccaccgcggtggcggcggcggtggcgatccaccagtactggcgttgcaccaggtcggccgcggcggtacccggcagctccggcggcaggcccagcgacggcgccaggcagaacaccgagtagccggccaggccccagagcaggcctag

SEQ ID NO: 2084 - DNA, 1206 bp, Pseudomonas aeruginosa
gccaggagacctgcctcgtcgatcccgtggcgcgatgcccggggacaagacttccatacaaccgggcggggtgatccggtggcgaatccgttgcgcggcccctgcgtccgcgccactcgtccgcatgcccgccgagctgaacaagggctgcccatgaaaaccctggcgaaactccccgtcaccatcgtcaccggcttcctcggcgccggcaagaccaccttgctccggcacatgctggacaacgccgaaggccggcgcatcgcggtgatcgtcaacgagttcggcgaactcggcatcgacggcgagatcctcaagcaatgttccatcggctgcagcgaagaagaggcgcagggccgcgttttcgagctggccaacggttgcctgtgctgcaccgtgcaggaagagttcttcccggtgatgcgcgagctggtggcgcgccgcggcgaccttgaccagatcctcatcgagaccagcggcctggccctgcccaagccgctggtgcaggctttccagtggccggaaatccgcaacgcctgcacggtcgacgcggtgatcaccgtggtcgacagtccggcggtggcggccggtaccttcgccgcccatcccgagcaggtggaccagcaacgccgccaggaccccaacctcgaccatgaatcgccgctgcacgaactgttcgaggaccagttggccagtgccgacctggtgatcctgaacaaggccgaccagctcgacgccgaggccctggcgcgggtccgcgcggagatcgccggggagctgccggcggcagtgaagatcgtcgaggcgagccggggcgagctgccgctgccggtcttgctgggactcaacgccgaggccgagctgcacatcgacggccggccgacccaccacgaccacgaaggccacgaggaccacgaccacgacgagttcgactccttccacgtcgatctccccgaggtggaggaagctgcgctgctcgaggccctcggcgagctggtggagcgtcacgacatacttcgcatcaagggtttcgccgccattccgggcaagcccatgcgcctgttggtacagggcgtcggcaagcgcttcgacaggcatttcgaccgcaagtggctggccgacgaagtccgcagcacccggctggtggtgatcggccaggagctggaccaggccgccattgccaaccagctgcgcacagcgcttgcctga

SEQ ID NO: 2085 - DNA, 1737 bp, Pseudomonas aeruginosa
tccgtgatccccggccggggccggcgatggcgattcgccggccccagcttcttgcgtcctaccggtagaacgtccatgcacctgttgcgcacccaacccggcggcttcgttcccgacgacggcatcgcccacctggcccagactcccgccgagctggtgatcctctgcagcggcgattcgcacctcgcattgctggccgaggccgcccgtgcgctgccggacgactacccgagcctgcgcctggccaaccccatgcagttgcagaaccacgcctcggtggacctctacgtcgaccaattgctgcggcacgcgcgggtgatcctgctttcgctgcacggcggcatcggctactggcgctacggcgtggagcaactggtggcgctggccgagcgcggcgcgctgctgatcccggtgcccggcgacgaccgccccgacccggagctgagcgcccttggcaacctgccggcggagcaggccgagcgcttctggcaatacttgcgccagggcgggctggagaacgccgggcagttctaccgctgcctggccagccagtgcctcggccgcgactacgcctggcgcgaaccgcaggcgctgccgcgggtggcgctgttccatccacggcatgccgaggcgaccctgggaacactggcgtgccgactggcaggccgggcgtccggtggtcgcgttgctgttctatcgcacccacctgcaggcagccaacaccgccttcatcgcgcgcttctgcgaacgcctcgcggcgcaggggctcaacccgttgccgatcgcgctggccagcctcaaggaaagcgcctgcctggcgcaggtggaagactggctggagcgcagcgacgccgcgctgatcgtcaataccaccggtttcgcccagtccaatccggaggcgcccgagttgcgtccgttccgtcgcgacgtgccggtattgcaggcgatctgctcgctggacaaccgcccgctctggctggacaacccgcaaggcctggggccgcgcgacctggccatgcacgtggcgctgccggagctggacgggcgcatcgtcacccggccgatcagtttcaagggcctggcctggcgcagcgaacgcagcgagagcgacgtggtctgctatctcgccgacgacgagcgcatggatttcgtcgccgaactggcgcggcgctgggccgagctggcgcgcaagccaaacgcggaaaaacgggtggcgctggtgctggccaactacccgacccgcgatggccggatcggcaatggcgtcggcctggacaccccggcggcggcgctgaacatccttcgtgccctgcgccagcagggctatccggtcgacggactgcccgccagcggaaccgagctgatccgccagttgctcggcggcgtcagcaacgacctggagcatctcgacctacggccctgcgcccagagcctggcgctggacgactacctggcctgcttcgcacgcctgccggagcgcaatcgccaggcggtgctggcgcgctggggcgagccgcaacaggacccgatgttccgcgacggacggatgatggtcgccggcctgcgctatggcctgaccttcgtcggcatccagccggcgcgcggctatcagctcgatccggcggcggtctaccacgatcccgacctggtgccgccgcacggctacctggcgttctacttctggctgcgccacgcctaccgcgccgatgccctgctgcacgtcggcaagcacggtaa

SEQ ID NO: 2086 - DNA, 2208 bp, Pseudomonas aeruginosa
cctggaatggctgccgggcaagggagtcggcctgtccgccgaatgctggccggacgcgttgctcggtccgctgccgaacatctatccgttcatcgtcaacgatccgggggagggcgcccaggccaagcgccgcacccaggcggtgatcatcgaccacctgatgccgccgctgacccgcgccgagagctacggcccgctgcgcgacctggagcgcctggccgacgagttctacgatgcctcgctgctcgacccgcgccgcgccgaacagttgcgcggcgagattctcgtcctcctgcgcgacaaccgtctcgaccgcgagatcggcttgcagctcagcgacgatccggacagctggctgccgcagctggacgcctatctctgcgacctgaaggagtcgcagatccgcgacggcctgcatgtgttcggcgagtcgccgagcgggcgattgcgcctggataccctgctggcgctgctgcgggttccgcgcggcgatggcaagggcgccaacgccgggttgctgaagagcctggcggacgaccttggcctgggcttcgatccgctggcctgcgacatgggcgaggcctggcagggcgcgcggccggcctgcctggaagagcggggcggggagccctggcgtactctcggggatacccgcgaacgcctggaattgctggcgttgcactggatagaacgctgcctgggcggcgaatcgccgcctgccacctggcgtgccagcggcgaggtgttgcgcggcttgtgcgaacaggtggcaccgaccctggacgcctgtggcggggccgagatcgacgggctgctggcagccctcgaagggcgcttcgtaccggccggtccgagcggcgcgccgagtcgcgggcgactcgacgtgctgcccaccggacgcaacttcttctcggtggacgtgcgcaacctgccgaccccgaccgcctggcgcatcggcttccagtcggccaacctgctgctcgagcgtcacctgcaggaacatggcgatcacctgcgccagctcggtctctcggtgtggggcacggcgaccatgcgcaccggcggcgacgacatcgcccaggccctggccctgctcggcgtgcgaccggtctggcaggccggcagccagcgcgtcgccgatttcgagatcctcccggtctccctgctggaccgcccgcgggtcgacgtgacgctgcgggtctccgggttcttccgcgacgccttcgccaacctgatccgcctgttcgatgcggcggtgcaggcggtcgccgagctggacgaggcggaggagctgaacccgctggccgctcgcgtacgcttggagcgccagcgcctcgaggcgcagggcacggcgccggcggaggcgcgccggcaggccggctggcggatcttcggcgccaagccgggtgcctacggcgccggcgtgcagggcgcaatcgaagagcggctgtgggagacccgcgccgaccttgccgaggtctacctgaactggggcggctacgcctacggtgccgccgacgacggcacgccggcgcgggaacgcttcgcccagcgcctggaacgcctgcaggcggtgctgcacaaccaggacaaccgcgagcacgacctgctcgattccaacgactactaccagttccagggcggcatgctggcggcggtggaaaccctgcgcggcgcgccggtggccagttaccacggcgaccacagccagccggacaacccgcgcatccgcacgctcaaggaagagctcaaccgggtggtgcgggcgcgggcggtgaatccgaagtggatcgccgggatgaagcgccacggctacaagggcgccttcgaactggcggcgacggtggactacctgtgcgccttcgatgccaccagcgagctgatcgacgaccaccagtacgcgctgctggccgacgcctacctgctcgacgcggagacccgcgagttcgtccgccagcacaatccgcaagccttgcgcgacatggccgagcgcctggtggaggcgcagcggcgcgggctctggcaggagccgggggcctatcgcgaggccctggagaacctgctgctggacgtcgaagaggaatagcggagcggcatggccgctcccaccgctttcagcgccgctcggcgagccgccgggcggcgtcgcggagaatccgctcggtgccttcccagccgaggcagccgtcggtgatcgagacgccgtag

SEQ ID NO: 2087 - DNA, 432 bp, Pseudomonas aeruginosa
ctgcaatcgaccatcatccggcgtggcgatgcctggctttcccagggcctggcgcacggcctgcacctgctcgggcccgtagttcgaaccgtggcggccgccgcgcagcaccacatgggtgtccggattgccgcgggtctcgatcagcgccgggtgaccgtgcgggtcgaggccgaaatggcggtggccgtgggccgccgaacggatcgcgtcgcaggcgatgccgacgccgccgtcggtgccgttcttgaagcccaccggcaggccgaggccgctgaccagctcgcggtggatctgcgattcgctggtgcgcgcgccgatcgccgcccagctcagcaggtcgtcgaagtagccggcggccagcggttgcaggagttcggtggccagcggcaggccgaggcgcagcatgtccagcatcagttgccgggatag

SEQ ID NO: 2088 - DNA, 414 bp, Pseudomonas aeruginosa
cgccaggccggcggccatgtcgtcgctgccatccaggtgcgggtcgtaggcgaggcccttccagcccaccgtggtgcgtggcttttccacgtaggcgcgcatcaccaggagcaactggccgtcgagttcgtcgctcagcgcggcgaggcgttcggcgtattcgagggcggagcggggatcgtggatcgaacagggaccgactaccaccagcaggcgcgggtcgtcgccgtcgaggatggcgcggatggcgtcgcggctggcggcgacctggctggccagctccagcggcaacggctggcgggccttgagttcgagcgggctgggcaggcgttccagggcggtacgggcggtggcgctgggcagggcgacggcctggacgttcggcgaaagggtggtcagtgcggatacggatga

SEQ ID NO: 2089 - DNA, 1269 bp, Pseudomonas aeruginosa
accaatacccgaagaaatacgcggcacggggtgcctgcggcgcacgcgcgcgcaacgacaagccagggcgcgaggcactggaatgcaggtgcggatggcgggtgtgcggcatgggtttctcccgtgaacgagtcccgagcttactgcaagcgaggcggccggttcaacgactgtttcacggttcgataccggcgccgccggcctgatagacttggcggtccgtatttccgtccgtccgccgcaggaatccccatgagcgctaccgtgcattaccccctgtccgccgtggtcgccgccgacgaactgaagctggcgctgtgcctggccgcggtcgatccggcgatcggcggggtactgatcgaggggccgcgcggaatggccaagtcgaccctggcgcggggcgtcgccgaactgctgccggcgggcgagttcgttaccctgccgctgggcgccagcgaggagcgcatcgtcggcagcctcgacctggacgccgccctcggcgaaggtcgcgcgcggttttccccaggcgtgctggccaaggccgacggcggcgtgctctacgtcgacgaagtgaacctgctgccggaccacctggtggacttgttgctcgacgtcgccgccagcggcgtcaacctggtcgagcgcgatggcatttcccaccggcatccggcgcgtttcgtgctgatcggcacgatgaacccggaagagggcgaactgcgcccgcaactgctcgaccgtttcggcctcaacgtgcgtctcgacacccagccgccgccggccgagcgggcagagatcatccgtcgccggctggccttcgatgccgacccgcaggccttcgccgaacgctgggaaggccagcaggacaccctgcgccgccgttgcgccgaggcgcgccggcggctggcgcggattcccctggacgatgcggcgctggacagcatcgctcgacgctgcttcgaggcggctgtcgatggcctgcgcgccgacctggtctggctgcgcgcggcgcgcgcccatgcggcctggcgcggcggcgagcggatcgaggcggaggacatcgatgcggtggaacatttcgccctgctgcatcgccgtcgccagtcgaacccgccaccatcggcggccaatccaccgccaccgcccgcggcggcccctgtcgcgctcccggagcgcaccggcaacggcgaagggcagtggggtgaattgccggctcggccggtggccatggggaccgcccgcgagctgccgcgctggccaaaaaagccctga

SEQ ID NO: 2090 - DNA, 1272 bp, Pseudomonas aeruginosa
acgaagtctgagggcgtttcggcgagtcctgcggctttttcggtcaaattgtatttcgactgtaattcaataaatattatgcgcgtaatatcttcctgcgatccagccaatccatctcacggagatatcctcatgtcgccgatttcagtcgttatcgccggttacgcccgttcgccgttccacttcgccaggaaaggcgcgctggtcgatatccgcccggatgacctggccgccgcggtgctcaaggggctggtggagaaactcgatctcgaccctgcgctgctggaggacgtggtcatgggctgcgcctatccggaggcggaacagggcatgaacatcgcgcgcatcgccagtttccgtgccggcttcccgcagagcctcggcggtgcgaccctcaaccgtttctgcggttcgtccatgagcgccgtccactacgccgccgggcaagtcctgctgggcgccggagaagccttcatcgccgccggggtagagtcgatgacgcgggtgccgatgggcggcttcaacctgtcgcccaatcccgcgttgctgcaggactatccggcggtatacatgagcatggggcagaccgccgagaatgtcgccgagcgctacgccgtcagccgcgtcgagcaggaagagatggccgtacgctcccacgccaaggcagtcgccgcgcgcgaggccggcttgctgcgccaggagatcgtcgccatcgacacccccgccggccgggtcgccgaggatggctgcatccgcccgggtaccaacctggagagcctggcccagttgaagccggcgttcggcggcagcgtcaccgccgccacctcgtcgccgctcaccgatggcagcgccgcgctgctggtctgtagcgaggacttcgcgcgccgccacgggctggcgatcctggcgcggatcaaggcggtggcggtggccggttgtgcgccggagatcatgggcatggggccggtgcaggcgacgcgcaaggttctgcaacgggccgggctgggcatcgccgacatcgacctggtggagatcaacgaggccttcgccagccaatccatcgcctgcatccgcgaactggggctggacatggacaggatcaacctggatggcggcgccctggccatcggtcatccgctgggcgccaccggcgcgcggatcaccggcaaggccgctgcgttgctgcggcgcaccggcgggcgctatgccatcgccacccagtgcatcgccggcggccagggcgtggcgaccctgctggaagcggtggagtga

SEQ ID NO: 2091 - DNA, 1548 bp, Pseudomonas aeruginosa
aagcgagaacagcgcaccatgaaaacgacgtcctccggaaccccacccgttccacggcctgaagacgagaacctcggtgtcggcgccaacatggcctacggcctgcaacatgtgctgaccatgtatggcggtatcgtcgcggtccccctgatcctcggccaggccgccggcctcgcgcccggcgacatcggcctgctgattgccgcttcgctgttcgccggcggcctggcgaccctgttgcaaaccctcggcgctccgttcttcggctgtcagttgccgttggtccagggggtgtccttcgctggcgtggcgaccatggtggcgatcatcggcagcggtggcagcggcggcattcccgcagtgctcggcgcggtgatggcggcctcgctgatcgggttgctgatcacgccgatcttctcgcgcatcaccaaattcttcccgccgctggtgaccggcatcgtcatcaccaccatcggcctgaccctgatgccggtcgccgcgcgctgggcgatgggcggcaacagccacgcgccggacttcggcagcatggccaacatcggcctggcggcgatcaccctggtcatcgtgctgctgctgagcaagctcggcagcgcctcgatctcgcgcctgtcgatcctcctggcgatggtcatcggcaccgtcatcgcggtgttcctcggcatggccgacttctccaaggtcaccgaaggcccgctggtggcgtttcccacgccgttccacttcggcatgccgaccttccaggtcgccgcgatcatctcgatgtgcatcgtgatcatggtgaccctggtggaaacctcggcggacatcctcgcggtaggcgagatcatcgacaccaaggtcgactcgcggcgcctgggcaacggcctgcgcgcggacatgttctccagcatgctggcgccgatcttcggctccttcacccagagcgccttcgcccagaacgtcggtctggtggcggtgaccgggatcaagagccgctacgtggtcgccaccggtgggttgttcctggtgatcctcggcctgctgccggtgatgggccgggtgatcgccgcggtgcccaccgccgtgctcggcggcgccggcatcgtgttgttcggcacggtcgccgccagcggcatccgcaccctgtcgaaggtggactaccgcaacaacatgaacctgatcatcgtcgccacttcgatcggcttcggtatgatcccgatcgccgcgccgaccttctacgatcacttccccagttggttcgccaccatcttccattccggcatcagttcctcggcgatcatggcgatcctgctcaacctggcgttcaaccacttcaccgccggcaactccgaccagcagtcggtgttcgtcgccgccagcgagcggaccctgcgctaccaggacatcgccgccctgcacgaaggcgactatttcctcgacggcaagctgtacgacgcccagggcaacgaagtgccgctggccggcgacgacagccatggcgcgccgccgcgacggcgcagcgaaaccgctgaagccggcagcgcctga

SEQ ID NO: 2092 - DNA, 513 bp, Pseudomonas aeruginosa
gggatttggccgccgagggacggctcggtggcagcttggcgtggcgccagcatcagcagcagggccacggccatcgccgccaggcagaccagcgcgccgacctcgccgagcggcgccaggccgctgccgtcgatcacccagctgccggcgagggcgccgatgccgatcccggcgttgcaggcggagatgttcagcgaggcggcgaacgccggggcccgcggcgcggacttcatcacccgcacctggccgacgatgaacagtgctgcctgggccacgccccagatcgccagggtggcggcgagcagccaggcgttgccgagggtcggcaccagggcgagcatgcccagcgccatcagcaggacgaacagcagggttgcgcccagcgggctgcgatccaccaggcgcccgccgagccagttgccgagcaggcctaccgcgccgaagcccatcagcgtccagccgaccagcgaaccgctgaagccggccaggcgctggaggatgtcggccaggtag

SEQ ID NO: 2093 - DNA, 729 bp, Pseudomonas aeruginosa
ggggtgaacatgccggtgaagaccagcagcgacagcaacaggtggccgagcaccagcggttggcgcaacacgctcgcctggctgcgcagcgagatacccggccgtccgggaatgcgcggcagccaggcggccagcagcagcgccttggccagggccagcgcggcgagtgcggcgaatgccaggcgccaaccccaggcgtcggcgatcagcgtgccgatgggaatgccaagcacggtggcggcgacgatgccgaagaacaccagcgccacggcgcgcccttcgcgcgaggggccggccaggtgcgcggcggtttcgctggccatggcccaaaacaccgggagcgccagggccgggacgaagcgcgccacggccatcgtccagatatcgccggccacggcggccagcgcattggccgcggcgaacagcagcaggcaggcgacgaacagccgcttgcgttcgacgcccgccagcgcggcggtgaggaacggaccgaaggcggcgacgctgaaggcgaacaggctgaccagcaggccggcctgggcgacgctgacctggaggtctgcggcaagtgccgggagcaggccgacgatgacgaactcggtggtcaggatggtgaagccggcggcggccagcaggaggatcggcaatagcacggcaagactcctccgcgagcgcagccgtggccgcgcccgggaacgatgcatgggagggaagggaatcaggccgtag

SEQ ID NO: 2094 - DNA, 615 bp, Pseudomonas aeruginosa
tcgatacaaataatggaggtcaggatggcaacgcgaggcaggccacgggcattcgacagggacaccgccctgcagcgagccatggacgtgttctgggtgcgtggctacgaaggcgcttcgctggcggccctgaccgaggcgatggaaatcaggccgcccagcctgtacgccgccttcggcagcaaggaagggctgttccgcgaagccctggcccactatctcggccagcacggccgctatcgccgggatgtcctcgatggcgcgccgagcgcccgcgagggcgtggccgagctgctccgcgagaccgtcgcgcgcttctgttccgacgagttcccgcgcggttgcctggtggtgctcgcggcgctgaccggaaccccggaaagcgaggcggtgcgggacgcgttgagcgccgagcgcggcgagtcgatccgcctgttccgtgagcgcatgcggcgcggcatcgctgacggcgacctggcggcggacaccgacgtggaggagttggcgaccttctatgccaccgtgctgttcggcctcagcgtgcaggccaaggaccgggtgccttgcgagcgcctgctggcggtggtcgaacgggcgctgcgcgcctggccctga

SEQ ID NO: 2095 - DNA, 651 bp, Pseudomonas aeruginosa
attgtgtcgtccattctaccttggagccttccaggcatgacagagttgctagctttcctgaccatcactgtgcttgcggtgatcagccccggcgccgatttcgccatggtctcgcgcaacagcctgctgtattcccgccgcgccggcctgctcaccgcgctgggcatcggcgcgggggtaacggtacatgtcggctacagcatcctcggcgtcggcgtgctggtgcgcgagtcgctggcgctgttcaccgcgctgaagctggcgggcgccgcctacctggtgttcctcggcctgcgcatgctgctggcgcgagaggactcggtggcggaggaggcggcgggcggcgccggggtttcgtcctgggcgatgttgcgcagcggcttcctgaccaatgcgctcaatccgaagacctgcctgttcgtggtcagcctgttcatgcaggtgatcgatccgcataccgcgttgccggcgcaactgggctacggggccttcatcgcgctcgcccacgtggcctggttcggcctggtcgcctgctttctctcgagcccggcggtgcgcggccggctcctgcgtttccgccggcgcatcgaccagttcttcggcgccctgctggtcggtttcggcgtcctgctgggggcgaaaagcccatga

SEQ ID NO: 2096 - DNA, 1023 bp, Pseudomonas aeruginosa
tcctcgccagcgatcacgaggcccgagcgctggagcgtggcgaggcgctgccggcagcgaaccaacgggcgcgacgccagcgcctgtcactgggcaccctggattggcggtcgccggcggagaatcgactgcgtccgctgctcgacgcggccttcctgcaggatggcctgctgcccgatccagccgctgccgaagagccgcagcggctgctcgatcgaccgtccgagcggcagcgccagcatccgtcgctgccgcccgagccgcagccgccggaagagttcgacgagcgcgtggagcgttttcccagtacccgtgcgttccttgcggcgcgtgacgcctaccgccaggaacggcgacgctggattgccgcgcacgatgcctggcgggaacgggtcgccgacctggaggcggcggcggatgccgagtaccgtcgccggcgcgacgagcagacgcgggaggaggcgttgtaccgtcgctatgcctcggcgctgccgggcggcgattccaggttggcgcgccgtccctggcgagtcgacggcaactggctggtgctgcaccggcgcagcctggccgagcgtagcgagctgctgctcagctcggtgtctggcgacggcagcttgctctggaccctggagctgcccatcgagcgtcccgagcggctgttccgcctggatgcccacaacctgcttctcagcggccgtggagaggaaggcgggcggttggtgcgggtcgatctgcgccggggcagcggcatcgtccatcgcctcgggcgcggcggcgcgccattgcagcgggtcgagtggcccgaaggccaaccgtgatcgcctgcgcccggcctgggtggctgcccagcgggggggccgggcgccgattcaggggttcctgaagacgaatacgccgctgtccaccaggcgcgtcaggcggatgcgcagcagcagggtgcggtgggctgcgaggaagcgcggcacctgcgccagcggaattgccaggccttcgctgtcgccggggcccaccgcggtatag

SEQ ID NO: 2097 - DNA, 447 bp, Pseudomonas aeruginosa
tcgacaacctcgacgaaggtgatccggagctggtcttcgtgcgtttcctcgcgccgtcgcgctgagccccaggctcatttcaggttgccggcgaggaactggcgcaggcgttcgctgcgcggcgcgccgaacacctggtccggcgtcccttgctcttcgatcacgccctggtggaggaagatcacatggctggaaacctggcgggcgaaggccatctcgtgggtgaccaggaccatggtgcgaccttcctcggccaactgctgcatgactttcagcacttcgccgaccagttccggatcgagcgccgaggtcggttcgtcgaacagcatcacctgcggctccatggccagggcgcgggcgatcgccacgcgctgttgctggccgccggagagttcgcagggatactgccgttcgaccttctccgccaggccgaccttggccaggtag

SEQ ID NO: 2098 - DNA, 1065 bp, Pseudomonas aeruginosa
gaaagtcctgggcgcgtatggcattcaggctgtagacgccggtgtagaagaacagcaactggatgtacagcggggtgccgcggaacacgtaggtgtagagccagaccgggtagcgcagcagcgggttgccgcaggtccgcgccaccgccagcgggatggccagcaggaagccaagcgccacggcgaggatcagcagccacagggtcatcgccagtccggtcagttgcaggccgtcggtccacaggtaggcctgccagtattcgtcgagtaccgcgttcatggcagcggcctcctgacgcccagcgagctgcgccgctccagccacagcagcgcggcgttggagattgcggtgatggccaggtagatcagcccgcagaccagggtgaagtggaagaactgcagggtgcctttgccggcgtcctgggtggccttgaccaggtcgccgagaccgatgatcgagaccagcgcggtggacttgaccagcacctgccagttgttgccgatgcccggcagggcgtagcgcagcatctgcggcaggagtacccggcggaacactcgccagcgccccatgccgtaggcttgcgcggcttcgacctggccggccgggaccgcctggaaggcgccgcggaaggtttccgtgaagtaggcgccatagatgaacgccagggtgacgcagccggcggcgaacgggtcgatgtcgacctggccgatgccgagggcgtcggtgacgcggttgaggaggatctgcaggctgaagaacagcaacagcatgatgaccaggtcggggacgctgcggatcagcgtcgtatagccgctggccagggcgcgcagcgggcggttggcggcgagcttggcgctggcgccgaggaggccgatgagcacggcgccgagcagggagcccagcgccagtttcagggtcaccagggtgccggcgagtatctgcgggccgaagccgtcgaggaacatttcactctccattgcttgttgttgtcggtcgaggtgaaaagcggccggacgccgttcagggcgtgccgtagaggtcgaagtcgaagtagcgggcgttga

SEQ ID NO: 2099 - DNA, 1215 bp, Pseudomonas aeruginosa
tgccgtcccagttgctttcgacccattcgcagcgggctcgcagctccgcgcagagggcttcgccgatctcgatgccgaagcctgccaggcggccgtccggctgcttgtattcgagcggcgggtaggtcgggtcgacgcccaggcgcaggaccttgcctgtccagtcggcggcgccggccggtgcggcgaggaggagggagagggcgatgctgccgagggttcttgtcattgtggttgtcctctgtcgatccgcgcgcgccaggccgcgcgcccgttgaaaaccctggctcaggccaggaagcgctcggccagtcgcacccagtagctggcgccgacggccaggcagtcgtcgttgaagtcgtagccggggttgtgcaactggcagccgctctcgccctggccattgccgatcaccaggtagctgccgggacagcgttcgaggatgaaggcgaaatcctcgctggcggtgaacggccgcagtccgtcgatcaggcattcctcgcccagccagtcgcgggccacctcgcgggcgaacgcggtctgcccgggatggttgaccagcaccggatggcaatgccggtagtcgacctccgcccgcgcgccgaagctggcggcctggccgcgggccagttcgccgatgcggcgctccagcagggcacgggtttccgcggtcagggcccggacgctgaggatcatttcggcgctggccgggatcacgttggagaccgtcccggcatggatcgcgccgacgctgacgatcgcggtgtcctgcgggtcgacgttgcgcgagacgatgctctgcaaggccagcacgatggcggagcagaccaccaccgggtcgacggtgcgctgcggcaccgcgccgtggccgccactgccgatcacgcggatgaccacggtatcggccgaggccatgaaggggccgggatggaagccgaggtggccgacggggtatcccgggacgttgtgcatggcgaagatggcgtcgcaggggaagcgctccagcagcccgtcgtcgagcatcgcgcgggcaccgccgaggccctcttcggcaggctggaagatcagttgcagggtgccgcgccagtgcggcgactcgaccaggtgcctggccgcggcgaggagcatcgcggtgtggccgtcgtggccgcaggcgtgcatcacgccgtccacctggctggcgtagggcaggccggtggcttcctggatcggtag

SEQ ID NO: 2100 - DNA, 921 bp, Pseudomonas aeruginosa
gcccgtgaaactccaccagttgcaagccctggtcgccagtgccgacgccggcggcatccgcgccgccgcccgcgtcctggggatttcccaggcggccgtgacccgcgcgctgcgcgaactggaaaccgaacagcatctgccgctgttcgtccgcacgcccagcggcctgaccttcaccgaatacggcaaggcgctgctgatccacgcccggctggtgctcaagcaactggagcacgcgcaggtcgaactcgaccacctgcgtggccaggccagcggccggctgtgcatcggggtgacgccttgggtggcgctgaccttcctctcggaggcggtgcaggcgttccgcgagcgcatgccggaggtgcgcctggagcttttcgaaagcctgatggcggtggcccagccattgcttcgcgacggcagcatggatttcgccatcggcccgctgcacggcgcccaggcggcccaggagttcgcctgcgagaagctgctcgactacgacaccgcggtgctggtccgccaggggcatccgctggcgggttgcggctcgatccacgagctgctggaacaggactgggcgttgaactacaccggcgacggccacgacgccctgatgcgcgagttgttctggcgccacggcgccttgatcgacgagcggcgcatcgtccgcgcgcactccgtggcgatcctgcagaccctggtggagcaggccgacatgtgcacctgggtgccggcgatcataggcgccgccccgccgttgctcggccgggtggtgccgctggcgctgcgggaaaccttcgagccacgacggctgggcatcatcacccggcgcggcggagccctcagcaatccggcgcaatgcttcgtcgagtgcctgctgcaggtgatccgccgccacgcccgctcggcgaagaaggatga

SEQ ID NO: 2101 - DNA, 537 bp, Pseudomonas aeruginosa
cagcgatcgccagttcggggcgatgcgcgaggtgatcaaccagctcgacgagatggaagaggcggccgcggccgccgacggcgaggcgtcctccgcgctgggcgagcgccaccgctggcagcaggtggcgctggtggcgttcggcctgctggtgtgcctgtcgctggtgctggtgttccccggcctggtgacccgtccgttgcagcgtctgctgcaacgcctggaagagatcgccaacggcgatggcgacctgcgcgtgcgcctggaggtcacttcgcgcgacgaacccggccgcctcggcagcgccttcaacgccttcctcgacaagttgcagccgctgatccgcgaggtcggccgggtcaccggcgaggtcgccgattcagccggttcgctggccggcatgaccgccgccaacgatcgtctgatcaacagcgagcacgcatcggtggaccaggtcagcaccgccgcgacgcagatgagcagcgccgtccacgaggtggcgcgcaatgcccagagcgccgcgcaggtggccgatga

SEQ ID NO: 2102 - DNA, 1116 bp, Pseudomonas aeruginosa
cgcccgccggcaggcgcgcgagggcgccaacgtggtggaagcgaccatcgaggtgatccgccagttggcgcaggaagtggagagcagttccgagagcatccagcaactggcccaggaaaccgccagcatcgacgcggtgctgacggtgatcaagggcatcgccgaacagaccaacctgctcgccctcaacgccgccatcgaagccgcgcgggccggcgagcagggtcgcggtttcgccgtggtggccgacgaggtgcgggcgctggcggcgcgcacccaggattcgaccaaggacatccaggcgcgcatcgagcgcctccaggccggggtgcagaacgccgtgcgggccatgcagtcgggcagcctcaaggcgcgcgacagcgtcgagcgcgccgccggggtcgacggcgtgctggccgccaccggcgacgcggtggggcggatcaacgacctcgccgcgcagatcgcctcggcctgcgaggagcagagccgggtaatcgacgaaatcgcccgcaacatcagcgaggtgcgcgagctttccgcccaggcggcggaacattcggagcagggtaccggggccagccgccggctgtccgagctgtcctcggaactggcgcggctggtcggccgtttccgcgtctgaagcgccgccgcctagcgcggcgccagccagatcgccacgccggccagtgccgccgggaccaggaagaccagcagcaggatcggcagttcttcgcgcaagccgtagccggcgtgctggacgccgacccacaggttgaccagcgcgacggccagccaggtcggcaggaacaggccggcagcgagcgccggcccggcatcccagagtttgccgaagagcaggaacagaccgagcaggacgatgccgccggcgattaccagggtcacgtgcatgaagggtttccgcaggcaggcagcgaccgccgtggcggccgctgcgtggctcacttggtggagaagccgccgttgatgaggatggtctggccggtgatccaccaaccttcgctgaccaggtggcggatgaacggcaccacgtcgtcgatgtcggtcaggccggttttggagaacggcgacaaggccgcggcgttcttcaggtag

SEQ ID NO: 2103 - DNA, 909 bp, Pseudomonas aeruginosa
ccatggcgcggtcgccgtcagcacgccgcgcaaggaacctccatgttgatacccgacatcactgccttcttcgacccggccacctccacctacagctacgtggtgcgcgacccgtccagccgcgcctgcgccatcgtcgacccggtgctcgactacgacccggccgccgggcgcaccagccatgccagcgccgaacgcctgatcgcccatgttcgccagcacgacctgcaggtggaatggctgctggagacccacgtgcacgccgaccacctgtcggcggccatcttcctgcagcgcgaactgggcgggtgcctggccatcggcgcgcgaatcacccaggcgcaggcgaaattctccggcctgttcaacctcggcgaggcgttcccggtggacggccgccagttcgagcacctgttcgaggacggcgagtcgttccgcatcggcgccctggaatgccgcgcgctgcataccccggggcataccccggcgtgcatgacctacctggtcggcgacagcgccttcgtcggcgataccctgttcatgcccgactacggcaccgcccgctgcgatttccccggcggcgacgcgcgccaactgtatcgctcgatccagcgcctgttcgcgctacccgacgcgacccgcctgttcatgtgccacgactacacggctcccggccgcgacgagcaccgctgcgaaaccagcgtcggcgagcagcgccggcacaacgtgcacgtccgcgaaggcgtcgacgaggaggcgttcgtcgccatgcgccagcagcgcgatgccaccctcggcatgccaaccctgatgctgccggcgatccaggtcaacatgcgcggcggcaacctgccgccggtggaaggcaacggggtgcgttacctgaagatcccgctggatctgttctga

SEQ ID NO: 2104 - DNA, 1116 bp, Pseudomonas aeruginosa
tcagctgcggcgacgcagcaggagaatgaagaacagcccgccgatggccgcggtggcgatgccgatgggcaggtcctggggggcgatcagggtgcgcgcggcgacatccatccagaccaggaacagcgcgccgagcagggcgcacaccggcagcagtcggcggtgctcggcacccaccagcaggcgcgcggcgtgcggcagcatgagaccgacgaagccgatggcgccgctcaccgagaccagcacgccggtcagcagcgagcagcagacgaagacccacaggcgtacgcgacgggcgtccaggccgagggtcacggcggtctgttcgccggccatcagcgcgttcagcgcacggcccagcccgagcagtaccagcaggccgccggccacgcacagcgccggcagccagatcaacgaccagcgcgccaggccgaggccgccgagcatccagaacagcacagaggaggcggcgcggtggtcgccgaggaacagcagcaggttggccagcgccaggagcacgaacgacaccgcgacccccgccagcaacagccggtcgctgcccaggcggccgccgcgactggccacgccgagcaccagcagcatgctgccgagggcgccgaggaaggccgccagcggcagggtcagcaggccgatcacctcgccgatgtagagcaccaccaacaccgcgccgagggtcgcgccggaggtggcgccgagcaggtgcggatcggccagcggattgcgcgtgaccgcctgcagggccgctcccaccagcgccaggccggcgccgacgcaggcgccgagcagtacccgtggggcgcggatcagccagacgatgtgctcctggccggcgctccaggcaccgggctccgccgccacgccgaacaggcgctggaggacgatgcggccgaccaggccgctgtccagtcgcgccggaccgaagccgagggcgaccacgcaggacaggccgagcaacatgaccaggctgcccagcaacaggcaataggcgcgagggctgcggaacagggtcatggacgtggcgcccgagggtggaggccggcgaccagggtttctatcgccgcggcgttgccgatgcccggcgtggcctggttatag

SEQ ID NO: 2105 - DNA, 816 bp, Pseudomonas aeruginosa
ggtcgtggaagctcgccagggtgctcaggccgaggccgcgcagcaggcgcagaagctccagctggtagcgcgggtcgaggtggttggtcggttcgtcgaggatcagcaggcgcggttcctggaccagcgcgcgagccagcagggcgcgctgcttctcgccaccggagaggctggcgaaggggctcgcggcacgcccttcgagaccgacctggagtagcgcctggcggacccgctggcggtcgtccgcgccgtggccgtcgaacaggcccttgtgcggcgtgcggcccatggcgaccacgtcctcgacggcaaggccgaagtcctcggggaactcctgcaacaccaccgcgatacgccgggcggcccagcgcggcggctggcgccagaggtcgtcgccgtcgagcaccacccggccgcgctgcggtcgcgcatagcggaaggcgcagcgcagcaggctggtcttgccgctgccgttggggccgatcaggccgacgaaactgctggccgggacttccagatgcacgccgcgcagcaactcggtggaggcgtcgggcgaccagtgcagggcatcgaggtgaagggacgacatggctactcgcaggtccggtggttcagcagagacgattgccgcggcgccggcttcagaaactgaagtcggcggtgacgttgaacgagcgtggctggcccatgatccattgctggccgttgttgttgtcagccagggcgtactggcggtcgaacaggttgtacagctcaaggccgagggtcaggtccggccgtacccgccagcccaggttggagtcgaccaccgtgtag

SEQ ID NO: 2106 - DNA, 399 bp, Pseudomonas aeruginosa
gggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgggcttgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatga

SEQ ID NO: 2107 - DNA, 237 bp, Pseudomonas aeruginosa
cggctgcggcacgtccctgtgccgcatgccgcacaggagaaatcggaggccgcagtgcaaggtcaaggcgtgctgttggggcaggtgggtgtcgccttcggtatcgtgcttgccggcgtatggttcgccacccaatggacagccgccgccctgggctatcagctacgcctcggctcagcctggttcgatcttcttggcacgccggtctatcaccgctggcgcctcttcgagtggtga

SEQ ID NO: 2108 - DNA, 444 bp, Pseudomonas aeruginosa
ttctccttcgacgcctacgcgtcgcgcatcttcgacaccggctgcgcgatcgccggcggcagcggcctggtggccgtggtggtcgccatcgtcatgtcggtatggcgctcgcggcaatcgaatttggttacaacctacggctcggcgcgatgggccaacgccgctgacattcgggtcggcatcgacaagccccgcggcgtcttcctcggcctgcatcgccgccagtatctgcggcacgaaggcccggaacacgtcctgatctttgcacgaaggcgctccgacaagggcgtcggcctggtggtgccgacgctgttgagctggccggcgtccgccgtcatcagcagcgtgccgacttcctggccgaacaggggctggccgagcggcgcggccagcgcgccatccccgcccgcaacctgctgggcacgctgcgcaaccgggaactga

SEQ ID NO: 2109 - DNA, 201 bp, Pseudomonas aeruginosa
gcagctttgctgggttttggagaaagccgcgatgactgcttggccgtcattccgctgtgcagcctcgcccatggcggtcgcggcgtcatggacctgtccatcaagaccccgaaactttccagcgtctgcaccaagccaggcaaggatgcgcatcttttccgacatgggcggctcggcatggttggcgattcgtggtgctag

SEQ ID NO: 2110 - DNA, 2040 bp, Pseudomonas aeruginosa
ggaaaaagcgcaggagaaatcggaggccaggtcatgcaagggacgaacgtgctgttcggtcagatcgccgtggtattcggcatcgtgatcgccggagtgtggggcgccacacaatggacagcagcggcccttggctaccaagtacgccttggctcgccctggttcgactttcttggcacgtcgatctaccacccgtggaagctgtttgagtggtggtttttcttcggcgcttatgcgccggaagtcttcgataccggcggcgccattgccggtgccagcggcatggtcgccgtgggcgtcgccatcgccatgtctgtatggcgctcgcgccaagcgcgcctagtcacgacttacggctctgcgcgctgggccaacgcgcaggaaattcgcaaggctggcctcacacagccggccggcgtgttcctgggccagcacgatcgccagtatctgcggcatgaaggcccggaacacgtcctgaccttcgcgcccacgcgctcgggtaagggcgtgggcctggtagtgcccaccttgttgagctggcccgcgtcggccgtcattcacgacatcaagggcgagaactggcagatcaccgcaggctggcgctcgcgcttctcgcattgcctgctgttcaacccgaccgatgcgaaatcggcggcctacaacccgctgctggaggttcggcgcggcgcgcatgaagtgcgcgacgtgcagaacatcgcggacattctggtcgatcccgaaggcgcgctggagaagcgcaaccattgggaaaagacctcgcacgcgctgctggtcggcgccattctgcatgtgctctacgcgggcgaggacaagacgctgcgcggcgtcgccaacttcctctccgacccggccagcccgttcgagctgaccttgcatcggatgatgaccacgccccacctgggcgatgggccgcaccctgtcgtcgcttcggcggcgcgagaagtgctcaacaagtcggacaacgagcgttccggcgtgttgagcacggccatgtcgttcctcggcctgtaccgcgatcccacggtggccgaagtcacttcgcgctgcgactggcgcatagccgacctgatcgctgcggaacatccggtgtcgctgtatctggtggtgccgccctcggacatttcgcggacgaagccgctcattcgcctgatcctcaaccagatcggccggcgcctcaccgaatcgcttgatggctccgacggcatcgagcggcgccacaagctgctgctgatgctcgacgaattcccggcgctgggccgcctggacttcttcgagacggccttggccttcatggcgggctacggcattcgcagcttcctcatcgctcagagcctgaaccagatcgacaaagcctacggccagaaccattcgattctggacaactgccatgtgcgcgtgacgttcgccaccaacgacgaacgcacggccaaacgaatttccgaaacgctcggcaccgccaccgagctgcgtgcgcagcgcaactatgcgggccacaggctcgcgccgtggctcgggcatttgatggtgtcgcgccaagaaacagcgcgcccgctgctaacgccgggcgaggtgatgcagcttccgcctgacgaggcggtggtgatggtgtccagcgtcgcaccgatcaaggccaagaagctgcgctactacgcggacgccaatttcaagcgccgcgtgctgccgccgcccgcgcttgcaggcgggcagtacgctgacgcgccgccgctacgcccggacgactggagcgggctggcgattccgcggacgcctgccataccggccacggtatccgccgatggcctggggagcttgaccgccgacgacggcggcccgcgccgtcaacacgagctttccgaagccgtcgcctacgcacccgagctggtcgttcccgcagccgacctcgcgctgctcgatgacgacgacgacctgccgcttccccttcctcgccagcttgatccagccatgcagcgcacggcccggctggcttccctcgaccccaacgacggaatcgagctatga

SEQ ID NO: 2111 - DNA, 402 bp, Pseudomonas aeruginosa
cttacttggagaactgccatgacgcagatgacttttcctgctttccgtttttctgcaaatccggcattgcgtcttgcgcggctgcgctgcctggcccgccctgcggggcaagggctgctgctggccgcgctgctgttgttcctgaccggaaccgcgcaggccgccggttcctcgatgccgtgggaaggcccgctgcaatccatcctcgaatccatccaggggccggtggcgcgcatcgtcgcggtcatcatcatcatcgccacgggcctcgcgctcgccttcggcgacacttcgggcggattccgcaagctgatccagatcgtgttcggtctgtccatcgcgtttgcggcttcgagcttcttcctgtcgtttttcagcttctccggcggggccgtcgtatga

SEQ ID NO: 2112 - DNA, 2598 bp, Pseudomonas aeruginosa
accgcgtgctgctggacgtcggcatacccggcttcgcgggcgcctggctgcgccatcgcggcctcgattgggcggccgacctgctgccctcgttccccggtctcgcgccgggttccctccgtaccaccgaccacccacaggagagcctgtcatgaagaagcgacttgtcgccgccgccattgcggccgttctttgcaccgccactgcccatgcgcaatgggtcgtgatcgaccccacgaacctcgtgcagaacacgttaaccgcgatccgcacgctggagcagatcaacaaccagatccagcagctccagaacgaagcgcagatgttgatgaaccaggcgcgcaacctggccaacctgccgtccagtgtggtgaaccagttgcgcgccaacctggcgacgaccgagcggctgatcgcccaggcccgaggcttggcctacgacgtgacgaatctggatcgggagttcgcgcgcctgtatcccgagcaatacgccgccaccgtgagcggcgaccagatgtaccgcgacgcgcaggagcgttggcgaaacacgctcaacggcttgcagaccacgatgcagatgcaagctcaggtgtcgcagaacctgggcgaagacgaaagcgtgctggccgacctcgtgggcaagagccagtcggccgaaggtgcgttgcaggcaatgcaggccatgaaccagttgctggccttgcaggccaagcagtcgatccagtctcaacggctccaggtcacgcaagaccgggcggcgtcgctggagctggcgcggcaggcggcagccaccgagcgcgcccgcgaagtgcggcggcgcttcctgggcgaaggcacgccgtacacgccgcagtccgtgaacttctacggcaactgacgggaggccgccatgcgatgcgtcctcgccccgtctgttgtggtgcttgtcgtgctgctggccgcttgcaacaagcagccggccgacaaccttgccgatgctctggccgccgatcctgcgcggctcaaggcattgcgcgcgcaatgcgccgccgaccggcagaccaagggcgaggacgcttgccgcgccgccgccgaagccttccggcggcgcttcttctccggcgaggccgggccggacgaataccagacgctggccgacctgccgccgattccgccgagcttcgaggaaccggccgatggcatggcgccggcctttcccgccgaaccggaggacacgccatgaatgatgtgaccatcatcgaccaattcctcaacacctttgccgcttatatcgactcgggtttcgggctgctgcgtggcgaggtggcgttcctcacggccacgctgatcgtcatcgacatgacgatcgccggcctgtactgggccatgagccatgccaccggccagggcgaggacgtgatcgccaagctgctgcgcaaggtgctctacgtcggtgccttcgcctacatcatcaataacttcaactggctggccagcatcgtgttccgctcgtttgcgggattgggcatcaccgccaccggctcggccatcacgatggagaacttcttgcagccgggccggctggcgaaaaccggcatcgatgccggggcgccgattctggagcagatcggcgagatggcgggctttccggaagtgttcgtgaacctcgaccccatcgtggtgatgttcctcgcgtggctggtcgcggtcttgcgcttcttggtgctggcgatccaactgttcatcacgctgatcgagttcaagctgaccacgctcgccggattcgtgttggtgccgttcgcactctggaacaagaccgcgttcctcgccgaaaaggtcttgggcaacgtggtggcctccggcgtcaaggttctggtgctggccgtgatcgtcgggatcggctcgggcttgttcgctcagttccaaatccatcccgccgagccgtccatcgaccacgcgctggtcatcatgctggcctcgctcaccttgctggcgctcgggatcttcggccccggcattgcgacgggccttgtgtccggtgcgccgcagctcggcgcgggcgcgatggccggtgctgctgtcggcgctgccggcacggccgtcgctatcggcgccgccgcgacgggcgtgggtggcgccgtggctgctggcgcgcgtatggctccggccgccgcaaagctggccggtagcggtgcgcgcgccgccacgtcggcggccagcaatgcgaagtcggcgtttcaggccggttccgccgccgctggcggcggcgcaaagggcgcgatggcgggcctgggccacgtcgccaagaccggcgcgcagtccgccggacgcgccgcagcatcccgtgcttccgctgccgggcagcggatggccgctccgttccgtgctggctggaatcgctcgacggccgacgctggcgcgtcaaccggccaagcctccgcaggagaagcctccgcaggagaagccgctgcacagaagccggaacaacccgcctgggccaagcggctgcatcgccgccagcaactcacccacgccgcgaccaccgccgcgcacacgctgcgcggtggcgacggtggcggctcggggcaaggcccgagcctgcgcggctccgacgactaa

SEQ ID NO: 2113 - DNA, 729 bp, Pseudomonas aeruginosa
tgcgattcacaaggagaactgaccatgcgattcagaaaaccgcaggtgcgctatgccgacacgccgcagcctgccacgccgtaccaagctgccggccaggtgtgggacgaccgtatcggctcgccgcgcgtgcaggcgaagaactggcggctgatggccttcgggtgcctgacgctcgcgctgctgatggctggcggcctggtgtggcgctcggcgcagtccatcgtgacgccctacgtggtggaagtggacagcgcgggccaggtgcgcgccgtgggcgaagccgccacgccctaccggcccaacgatgcacagacggcgcaccacatcgcgcgcttcgtgacgctggtgcgctcgctgtccatcgaccccatcgtcgtccgccagaactggctggacgcctacgactacacgaccgacaagggcgcggccgtgctcaacgactacgcgcgggtcaacgacccgttcgcacgcatcggtaaagagtcggtgactgtgcagatcaccagcgtcgtgcgcgccagcgacacgtctttcaacgtgcgctggacggaacgccgctacgtcaacggcgccgcggcgggcttggagcggtggacggccgtggtgtccatcgtgctccagccgccgcgcaccgaagaacgcctgcgcaagaaccccctgggcatctacgtcaacggcctgtcgtggagccgcgaactggattcttccgaaggagccaagccatga

SEQ ID NO: 2114 - DNA, 756 bp, Pseudomonas aeruginosa
cacgccacaggcgggcaaggtcgcgcccgagtcggtgacgctgcgcgcccagccgcgtccggtcacgcgcctgaaccggcgcacgctggccgtccttgtcggcggcctgtcggtcgccgtgctcggggccacgatctggtcgctgcaaccgcagcggcgcagcgcaggcgaacagaccgagctatacaacgtcgatcgcgtctcgaagtccgaagggctggacggtctgccggccgactactcgaagctgccgccgaaggtgcccgagctggggccgccgctgccgggcgacctcggccctgccatcgtgaactcgcagcagccggccgtggccgcttacgcggcccccggccacgaccccaacgatgccttgcgcaaagaggcggaagccgctgcggcttcgtcggtgttcttccgctcgggcggccaaggccaagccgccgcgaccgtggcgcaggcgacaccgggtgcgcctggtggtgcaagcgcgctcgcggccttcgacccactcgcggccgggccggcatcggtggcgacgcagcctgccgacccgaccgccgtacagaaccggcaagaccagaaagaggcgttcctgaaagccggctctacggaaacccgcaattccggcaatctggcgctgccggcgtcgccctatcaggtgatggccggaaccgtgatcgcgggcgcgctggtgactggcatgaagtcggacttgccgggcgacgtgatcgccactgtcacggagccggtctatga

SEQ ID NO: 2115 - DNA, 261 bp, Pseudomonas aeruginosa
ccggggagcttcgcaatgaccacgaccaagaagctgcggctcgggcctctgcccaagaccgagagtgtcaagctgaccttcgcctgcccggcaagcctgaaagccgacctcgaccgctacgcctcgctgcacgcgcaggcgtatggcgaggcggtcgatgcagagaaattgatcccgcacatgctggaggcgttcatggcgggggatcggggattcaggaagggcacggcgacccggagcgcgccatcgaagccgacatga

SEQ ID NO: 2116 - DNA, 741 bp, Pseudomonas aeruginosa
accgaccgcagttttccgaggtggtcggcatggatcccaaacgccttgagaacatcgagagtggccggcagcgcatgcacgacgaggatttcgagaaggtctgcgggaccttcccggagttcagcgactggatcgcctatgaaggcagcatcgaaccgcagtcgatcgcctggaagatcgccgaggccgcccaggaagcggcggtctatctggtggagcgcaaccccgagctgctcgaactccacggtctcgacgtgccggcctggcgcgagaagcatcgggaaatcctcaagaaggtgcgcaagcgggagttgtcgccgccacccgaaaaaccaccgaaacccaggcgcaagcgcaagccgagaagcaacctgcccacacccaccgacggtacctgagaccggctccctctccccagccctctcccgcaagcgggagaggcaacggggctcccgaagcccagcggtagggcggataacgcgcagcgttatccgccgtcagccccaggtgggcctcagaacaccactcctaccggatagacgaaggcgttcacgtcgtagaacggcgtgcgctggtagaaccattgcaggcgcgcctgcggatcggcggcgaaggccttgtcctcgcgcaggcgtttgtcgaaggcggccttcagcgccgggtcttccgccagcatcttgcgcgccatcggctccatcacgtattcctccggctcctcggcggccaccagggtggaattga

SEQ ID NO: 2117 - DNA, 1158 bp, Pseudomonas aeruginosa
acctccatgtggatgggaacggccgcggcgtgggcgggcctgcgcgacgcgagccacgcgtcgtcgcgcagccagtgcagtgaaacgccggcggcaggcatcggggatgacgccgggcaaggcgcggcgaagccgatggcgagagcgccgccggtggatggttcagggctgggtttgcagaccctccagcagtgcctggtggaagcgttccggagcctgtatctgcggggtatggccaaggtcggggaattccaccagggtcgcctggggaatccgtctggcggcgtccttgcccagttgcgcgtagttgcccagcctggctttcagttccgccggcgcggcgtccttgccgatggcggtgttgtctttctcgccgatcagcagcagggtcggcatctgcaaccggtccagttcgtagaccaccggctgggtgaagatcatgtcgtaggtcagcgccgagttccaggccaccgactcgcgccccttgccgcgatacatgccggcctgcatctgtacccagcgatcgaactcggggcgccattcgccggcgtagtaggtggcttgctggtattggcgaatgccttcggcgctggtctgcaagtcgcgcctgtaccagtcgtcgacgctgcgccagggcacgcccagggccttccagtcctccagaccgatggggttgaccagcaccagtcgttcgacctgccgcggatagagcagggcgtagcgggtagcgagcatgccgcccatggagtggccgatcacgctggcccgggcgacgccgagctgttccagcagggcgtgggtgttggctgccagttgctggaagctgtactggtaatgggccggcttgctcgacttgcagaaaccgacctggtcgacggcgatcacccggtagccggcgtcggcgagcacgtcgatggtgcgctcccaggtcccggcgcagaaattcttgccgtgcatgagcaggatggtgcggccgttggctttcttcggcgcgacgtcgaggtaggccatgctcagcggctggccctgggaggtgaagtccagataatgcaccggataggcgtagtcgaagccttccaggcgttcgccgtagaccggcgcctggctggccagcgccggcccgcaggcgagggcgaaacatatactgaggcggggtag

SEQ ID NO: 2118 - DNA, 1308 bp, Pseudomonas aeruginosa
acctgccggcccatcacctgcgtccgttcatcggccacgatggcgtgcatggcacgttccgcctcgatttcagcgaggacggccgcctgctggcgctgcaacgcctcgcctgagcgggtgctcgacggctataatcggcacccttcattctgccgaccgatacccgaccatgtacaccctggcccgccagctgctgttcaaactgtccccggaaacctcccacgaactgtccatcgacctgatcggggccggcggtcgcctgggcctgaaccgcctgctgacgcccaagccggccagcctgccggtctctgtgctgggcctggagtttcccaatccggtggggctggccgcgggcctggacaagaacggcgacgccatcgacgggttcggccagctcggtttcggcttcatcgagatcggcaccgtcactccgcgaccgcagccgggcaatcccaagccgcgcctgttccgcctgccgcaagccaacgcgatcatcaatcgcatgggcttcaacaaccacggcgtcgaccacctgctggcacgggtgcgcgcggcgaagtatcgcggcgtactggggatcaacatcggcaagaacttcgataccccggtggagcgcgcggtcgacgactacctgatctgcctggacaaggtctacgccgacgccagctacgtcaccgtcaacgtcagctcgccgaacacgcccggcctgcgcagcctgcagttcggcgattcgctcaagcaactgctggaggcactgcgccagcgccaggaagcgctggcgctgcggcatggccggcgggtaccgctggcgatcaagatcgccccggacatgaccgacgaagagaccgcgctggtcgccgcggcgctggtcgaggcggggatggacgcggtgatcgcgaccaataccactctcggccgcgaaggcgtggaaggcctgccgcatggcgacgaggcgggtggcctgtccggcgcgccggtgcgggagaagagcacgcacacggtgaaggtgctggccggcgagctgggcggacggctgccgatcatcgccgccggcggtatcaccgagggcgcgcacgcggcggagaagatcgccgccggggcgagcctggtgcagatctattcgggtttcatctacaagggaccggcgttgatccgcgaagcggtggatgccatcgccgctttgccgcggcggaattgaaaagggctccttgcggagcccttgggcttgcgcccgccgcccggatggggcgtgccttggggaaatcggtgctatccgtgttgtcgcttacacgtgctggagttgattga

SEQ ID NO: 2119 - DNA, 1245 bp, Pseudomonas aeruginosa
tcggggcgcgtaccctgctggaggcctgcgaggccctggaggacgcctgccggcgaagtggtgacggggagtgcctgcagacgcctggcgaaagactccggctggccctggaggcgttgcaggaggaactccaggagcagttggcgggcgctgcggtatgagcccttcctttcaggaggggctcgagcgtccggtcatttcccgggccatttccgtggcgtagctgtcggtcatgccggcgatgaaatcgatcacctggaggaaggcgcggtacagcggccactgcgggtcgggcgcgttgcgtccgagcaggtcgaggatgcgccggttcttgaacgacggcgtatgcccgccatattgctccagcgcggcgccacagaaggcgttgaggaggatctccagagtggtgtaggcgccgatctcgtggagggtcttgcgcttgtcctggaagatcttttcccgcgcgatggccttggcccgctgcacgcagagcttggccgggccatgcatgtgttccaccaggtcgccggcaagctgcccggcgagcagggcctgctgctggtcgacgaaggcacgggcggcggcattggtcaggtgctcgatggccttgccgcggaggatcgccagtttacgccggcgggagtccctggggccgagttggcgataggtgtcgggcaggtcgtcgccgaccaggccgagcagcagcgcctcgacctcgctgtattcgagcagttccatttccaggccgtcttcgaggtcgatcaggccatagcagatgtcgtccgccgcttccatcaggtagaccagcggatggcgagcccagcgctcgtcgtcgagttgcggcatgccgagcttatgggtgatctgctcgagcagcggcagttcgctctggtagcagccgaacttgtgcttcttgtagcccagcgcttcggcgtggcgcgaggtccaggggtacttcaggtaggtacccagggtggcgtaggtcaaccgcgtgccgccgtcgaactggtggtattccagttgggtgaggacccggaagccctgggcgttgccttcgaagtggagaaagtcggaacgctcggcgtcgctcatctcgtccagccagccacgtccggcggcttgctggaaccagttgcggatcgcgtcttcgccggagtgcccgaatggtgggttgccgatgtcgtgggccaggcaggccgactggacgatgaccccgaggtcgctggggtcgcaccactcgggtag

SEQ ID NO: 2120 - DNA, 1536 bp, Pseudomonas aeruginosa
cggtttgccttggcaagctcaatcgtcgcgttggggaaacggagggcgccgaccgttgccggtcggcgcatccttcaacggcctttctgcttgcgcaggccgagcaacagcggggccagggcgacgcccaggcgcagcagacgctgccagcgtccgcccttgccaagcagtacgcccagcagtgcggctccgccggcgccccagagcgccgcattgccaccgccgaacagttgctggctgaggttgtggcccagcccctgggcctggcggaagggttgcaccagcagttggctttcgcgacgcaattgctggcgctgcatttccaggcgcaggcggatcaccgccttgcgcaattcgcgacgcgacaggccggtcgcgttcaccggtagttggctcatgcgcgtttccttgtcatggcagcagtcgctcgcggtcgttggccagttcttccagggtggcgctgaacggcgagctttcgtcgttgatcgactggtacaggcgccagccgcagaacagcgagccgatcacgtagaacaggcacaacccgagcgccgctgcgagccggttggtgtcccagaacacgatcagcaccagcagcgacaggccgaccagcaggagcagggcgaataccagggccagcccggcgaacagcagcaggcgcagggtattggccttctgttcctgcagctcgatgccgaacagctcgacgtgaccgtgcaacaggccgaggaaggcggcgccgaagcgccgcagggaggggcggccgtccgccgggtcctttccttcgctcatggctcagcgccggctgaccaacaggccaagcaggaagccgacgccggcggcgatgccgatgctctgccaggggtgttcgccgacgtacacctcggtggcgtccaccgcggcctggctgcgttcgcggacgttgtccttcagcgagtccttggtgtcgcgcaaggtatcgcgagcgcgcttgaggctgtcgtggatcttgccgcggatttcttccgcctggtcgcccgccacgtcggcggtgctttgcaggagtttctcggtatcggcgaccagtgcctggaattcagccaacagttcatcctttgcagcgtttgcagtggtcttgcggggcatgacgagctcctctggtcatggggtgtgtttttttcgagccgagcgcggggcggaaggttcaaccggtgggtaatttccgcgcgttgccggtcgctcccggcgttcctttcattaaagactgccacagcgtgcctgtcggcgcggctgcggcgagatgacgcccatccggctgcctcgcaacggggcgcgaactggtatggcgcttgcaattccctggtgcgcacgtcggccggaatgccccttgcgagggcgccaggcgctcccggagggtacttcgggatgaacgtccaacccaatgaaaatcaaggaaagtccgggagctttccatgctgcctcaggcaccttgcgaaacgtctgccgaagaaaagcggcggttcgcacgacgactactgcttcgtcatggtgcgttga

SEQ ID NO: 2121 - DNA, 1233 bp, Pseudomonas aeruginosa
tgcggtgcaagtcctgatccacggctccaataccctgttcatcctgctcggagcggtgatggtgctggcgatgcacgccggcttcgccttcctcgaggtgggcaccgtgcgcctgaagaaccaggtcaacgccctgtcgaagattctgtccgacttcgccatctcggcgctggcctatttcttcgtcggctactggattgcctacggcgtgactttcttccatccggcggcggcgctgaccgtggacagtggctatgcgctggtgaagttcttcttcctgctgaccttcgccgcggcaatcccggcgatcatctccggcggcatcgccgagcgtgccaggttcggtccgcagttgtgcgccacggcgctgatcgtggccttcgtgtacccgtttttcgaaggcttggtgtggaacggcaatttcggcttgcaggaatggctgaagctggagttcggcgcgcccttccacgatttcgccggctccgtggtggtgcatgcgctgggcggctggctggcattggcggcggtgctattgctgggcagccgcaacggccgctatcgcgacggcaagctggtggcgatggcgccgtcgagcatcccgttcctggcactggggtcgtggatcctgatcatcggctggttcggcttcaacgtgatgagcgcccagaccctcgctggggtcagcgggctggtggcggtcaactccttgctggcgatggttggcggcaccatggcgtcgctgctgatcggccgcaacgacccgggtttcctgcacaacggtccgctggccgggttggtggcggtgtgcgccggttccgacctgatgcatccgatcggcgcgctggctaccggcctggtggcgggggccctgttcgtctgggcgttcaccgcgacccaggtgcgctggaagatcgacgacgtcctcggtgtctggccgttgcacggtctttgcggggtctggggcgggattgcctgcggcatctttggccagcaggcattgggtgggctcggcggggtgagcctggccagccaggcgctcggcagcctgctgggggtgacggtggctttcgccggcggcctgttggtctatgggctgatgaaggcgctgctgggcatccgcttgagccaggaggaggagtactacggcgcggacctgtcgatccacaagatcggcgcgatcagccacgaatgagggggcggacttccttggtccggtggggtatcggcggataa

SEQ ID NO: 2122 - DNA, 1572 bp, Pseudomonas aeruginosa
gggcgatggataaaccctgagttcccttcaggactgactggaaacagccgggaacccgcgtggcgcaggacgcgtcgcaggtcgttcggtccgctgtcgcggaccgccggggtgtgggggtcgggacgacgaggctcggcgtttcctcttaacgaaagaggacgcctgatgaaaacgcccgcctggacgcgccatgccctctgggtcatgccgctcgccctggggctgcaatccgccgtggtcgcgggggatgagcagccaagcaagacttccagctattcgccggtggtgatcaatgaggacttcgccaccatcatgaagcgcatgacggcgaacaaaccgtcgatcgaacaggcccacaagacgcttctcgagcagcgttacgatctcagcgacaggccggccaagggcgccagcatgacgcgcggcaagccgctgcaggaggggatccgggtgaagctgccggccggcaccagctgggaggaactggccaggctgagccccgaggaaatccgcaagcaggggctgttccccggtggcttcctgccgctgccgcaccccaaccatgccgaaggcgggatggtctttcccaagttcctcatcgacgagatcaagcgccaggaaagccgcgacctgacccgtttcgacctcgactacgacctgccggaccacttcctgccggaattcccggcaccgatgttccttaccacccggcctgacctgggcgatgtgtccaagggcaagctggtgaccatcgacaactatttcgagttgttcaacgggattctcaatcccaagcagctggaagggctgcgcctgctgctaacggcctttccgcagcagcagttcaacctcaccgacgatcgccgtagcgagcatccgagccgcggcgtagcctgcttcgactgccatgcgaacggccacaccaatgccgctacccacctggccggcgatgtgcgcccgcagccgttccgccaccgcatcgacacgccgacgctgcgcggggtgaacatccagcggttgttcggctcgcagagggcgctgaagaccgtcgaggacttcaccgagttcgagcagcgcgccgcctacttcgacggtgatccggtaatcgccaccaagaagggggtgaacgtgctcgagcgtggcagtcaagtgcatttcatgggtgagttccaggcgctgctggacttccccccggcaccgaagctggatgtggaggggcggctcgatccgggcaaggccagcgagcaggaattgcgtggcgaaaagctgttctacggcaaggcggcctgcgccgggtgccatgcgccgccttacttcaccgacaacctgatgcacaacctgaaggtggagcgcttctacgatccgaaactggtcaatggcgtgatggcgtccgccgacgggccgatcaagaccttcccgttgcgcgggatcaaggattcgccgccgtacctgcacgacgaccgcctgctgaccctggaggacaccgtggagttcttcaacctggtgctggagcgcaagctgtccgcggaagagaagggcgacctggtggcctacctgcgtaccctgtga

SEQ ID NO: 2123 - DNA, 1272 bp, Pseudomonas aeruginosa
gaagagttccccctaaaaacgagtgttccccccaccttcgagaaaattcgactcgacgtcccttccgttttacttcagttcgcggtgattagccaacagctcgggggtgttcaggttggccagccgcggatcgcccgcggccagctcgatggcctccgcgccaagcggcaacaggacgtggcgtgggctacggtcgccctggcgccaggcgtgttctatctcttcggccaggtgcgtcgggatcaggctgaacagcggttcccactggccgccgcagcgcagcatccaggggcgcgccggtgtgcggccggcggcctgcagcagggtttccagcaaggcgcggtcgatgcgcggcgcgtcgcagggcagcaccagcagccagggatgccgggccaccgccaggccggcgcggatgccggcgagcgggccggggaagtctcggctgtcgtcgctcaccaggcggtcggcataggccgcatagcgttcctggttgcggttgcaggagacgatcaggtcatcggtgagcgggcgcaccaggcgatgcaggtgggcgatcaggggcaggccctgccactcgatcaggcccttgtcgcgaccgcccatgcgctggccgcggcctcccgccaggagaaggatggagcaggggggcagggcgctatcgggcatctggggtctccgtgtcgggcctgtgatataacaccgcgatcacgtccacaagcaagggccaaccccatgagccacaaggccgaaacggcattcgtgccgttgaacatcgccgtcctgaccgtcagcgatacccgtaccctggaaaccgatacttcaggccagttgttcgtcgaccgcctgaccgaggccgggcacaacctggccgctcgcgtgctgctgaaggatgacctataccggatccgcgcacaggtcgcgacctggatcgccgaggatagcgtgcaggtcgtgctgatcaccggcggcaccggtttcaccggccgcgacagcaccccggaagcggtggcctgcctgctggacaagcaggtggacggcttcggcgagctgttccggcagatttcgctggccgacatcggtacctccaccatccagtcgcgggccctggccgggctttccaacggcaccctggtctgctgcctgccgggctccaccaacgcctgccgcactgcctgggaaggcatcctcgtcgagcaactggacgcccgtcatcgcccgtgcaacttcgtcccgcacctgaaacaggcggcgccctgcgagagccgcgggtga

SEQ ID NO: 2124 - DNA, 1206 bp, Pseudomonas aeruginosa
ctcggccatcagcgccagggcatgttcctccagggtgcgcagcagcgtcgcgtcggcctggcgcagcggcagcgccaggtagtccagcggtaccagcagcgccgaacagggttgggcgaagcgcaccggacagccgaagaaggtctcgtagtcttccacgcgggttccgtccggcaggtcgtgttccagccagacctcgtccggcgaaccttccaggtcggcgatccagcgcgcgtagaggacccaggaagccaggacgtgctcgaccatgtggcgccgtaccaggggtgtctggtggcggcagttccagatcagccggacctgcccgccggccgcctcgatgcggctggtgcccatgtcgccgaccagcttctcgtagggcgtgatgcggctcatggcctcgcccagggtggcgcagttcatcgcgatgtagccgagcacgctccaggagccgggctggacgaaacgcgccgaatgcaggccgaacaggggatcgccggaatgctcgcagaaatagccgagcaggcgctcgtgggcttcgcccggcaggcgctggcgattgtcgttgagctggtcggcctggaggccggcggcggccagggcaggggcgatgtccaggccgagccgttcggcatggcgcaggtatttcagcagggccggaaccgaggtggagccaagggtctgcatggtcgttgttcttgtcgtggcgggtggaacaggccgtccggcgtgcgtgccggctgtcttgatcggtcacagggagtgtctcgatccgacagtgacaggcgagggcggctggctagtataggcagccagaaaggttccgataaacaggttgccgcgacaagcgaggggagaggttcatgcgccgttggaatggctggggcgaagaaagcaccgtggtcgaattgccggacagcgcccgtgggttcctggcggaactggtcgggcagggcgcacgcttgccggacgccagcctggaggcggcgctggcgaaggtcccggcgtcgcgcctggaggccgatccgcgctacagcatcgacccccgtgagcgtctgctgcatgcccgcgggcagagcctgccggactggctggcgatgcgcgagggcgacttcggcgtctacccggacgccgtggcctatccggaaaccgccgaacagatccgcgagttgctggccctggccgactcccgcgacctgcaactga

SEQ ID NO: 2125 - DNA, 1221 bp, Pseudomonas aeruginosa
aacgcttcggcggggtcttcaccggaaccctgctggggcgcaagtgggcgcagaaccgcttccgcttcccctacctgcgcgaggccctgtggcaggcgggctacgccgtggacaccctggagaccgccaccgactggagcaacgtcgacggcctgctgcagaagatcgaggccagcctgcgcgacggcctggcggccgagggcgagagggtccatgtgttcacccacctctcgcatgtctatggcgaggggtcgagcatctataccacctacgtgttccgtccggccgcgagctatgcggcgacgctggagcgctggaagcgtctcaagcatgcggccagccaggcgatcgtcgacaatcgcggcaccatcagccaccagcatggcgtcggcaaggaccacgcaccctacctgccccgcgagaagggcgaactgggcgtcgccgcgctgcgtgccatggccggtcacttcgacccggccgggcggctcaaccgcggcaccctgctgcaggactgagcggaatgacttcagcctggaacgaggagtggcgtcgccgccgcctgccggcgctggcggggcaggagtgggacctgatcgtggtcggcggcggcatcagcggtgccggcatcctccgcgaagccgcgcggcgcggctggcgctgcctgctgctggagcagcgggacttcgcctggggcacctcgagccgctcgtcgaagatggtccatggcggcctgcgctacatcgcgaagggccagtggcggctgacccgcgactcggtgcgcgagcgccagcgcctgctcggcgaggcgcctgggctggtggagccgttgagcttcgtgatggcccactaccgcggcggctttcccggcccgcggctattcggcggcctgctgagcgtgtacgacgcccttgccgggcggcgcaaccaccgtttctacgacgccgccgcgttgcgctacctggcgccgggcctgaaggaacaacggctgctcggcggcacgcgattcttcgatgcggtgaccgacgatgcgcgcctggtgctgcgggtgctggccgaggcgcgtcacgacggcggcgaggcattcaacggcatgcgtgtgcgcgaattgctgcgcgagggcggccaggtggtcggcctgcgcgccgaggaccgcgagagcggcgagcttttcgactttcgctgccgcgccctggcgctggccaccggggcctgggccgatga

SEQ ID NO: 2126 - DNA, 1632 bp, Pseudomonas aeruginosa
gcaacaggcctatctggacctctggcgccggcaatacagcctgcccgtctgaccagccgagacgagaacgagatgaacgacaagaactatctgctggcgatcgacaatggcacccagagcgtgcgcgccctgctgttcgacctgcagggcaacctgctgggcaagggcaaggtggagctggaggcctactactcgaagcatccgggctgggccgaacaggaccccgagtactactgggcgatgctcggcgaggcctgtcggcggctctgggaccaggtggacatcgatcgcgggctcatccgcggggtgtcgctgaccacccagcgtggcacggtgatccatgtcgatgccgagggcaggccgttgcggccggcgatcctctggctcgaccagcgccgggcggaggtccgcgagcgcatcagggggccttggggctggctgttcaagctggtcggcgccgagggcgcggtggagcatttccgcgcccaggccgaggtcaactgggtggcccaggagcagccggagatcgccgcgaagaccgacaaggtgttgctgctttccggctttctcagccaccgcctgaccggccgtttcgtcgactcggtggggtgctgcgtggcctacctgccgttcgactacaagcgcctgcgctgggccgcgccgcgcgactggaaatggcaggcactggcggtacgccgcgagcagttgccggagctgttcaagccgggcgagcggctcggcgagatcagcgccgaggccagccggcacaccggcattccgcaaggcctgccgttgatcgctgcgggggccgacaaggcctgcgaggtgctcggcgcaggtgcgctggagcccaccatcgcctgcctctcctatggcaccacggcgaccatcaacaccactcgcgcccgctacctggaaaccgtgccgctgattccaccctatccggcggcgattcccgatcatttcaataccgaggtgatgatctatcgcggctactggatggtcagctggttcaagcgcgagttcggcttgcgcgagatgcagcaggcgcgcgagcagggggtcgagccggagcaactgttcgacgaactggtcaacggcgtgccgcccggctcgatgggcctgaccctgcaaccctactggtcgccgggaatccgcgaaccgggactggaggccaagggggcgatgatcggtttcggcgacgtgcatacccgggcgcacatctaccgggccatcctcgagggcctggcctatgccctgcgccagggcaaggagcgcatcgagaagcgttcgggcacgccgatcgtgcgcctgcgcgtggccggcggcggctcgcagagcgacgcggcgatgcagctcaccgccgacatcttcggcctgccggccgagcgcccgcatgtctacgaggcgtccggcctgggtgcggcgatcgactgcgcggtggggctcggcctctatccggacgtcgccagcgcggtggccgggatgacccgcgtcggccgggttttcctgccccaggcggaggcccggcagatctaccagcggctctatggcgaggtctacctgcgcatgtatcgccagttgcgcccgctctaccgcagcattcgcgagattaccggctaccctgcctga

SEQ ID NO: 2127 - DNA, 366 bp, Pseudomonas aeruginosa
acatccataccgacgatgacctggcgcgcctctcgcgggtccagcaggaactcgaggcgcgcgatggctggcgcctgcagcaactggtggacagcaccctcagccgcctgcagttgccggccgacaagaccctcgccgaactctccggcggctggcgtcggcgcgtgctgctggcccaggcgctggtcgccgagccggacctgctgctgctcgacgaaccgaccaaccacctggacatcggcgccatcgcctggctcgaggaagcgctgctgggcttcaacggcgcggtgctgttcattacccacgaccgcgccttcctgcaatccctggcgacccgcatcctcgagctggatcgtggccacctga

SEQ ID NO: 2128 - DNA, 1368 bp, Pseudomonas aeruginosa
tccttgcgggccttgccggcggtgggtgcagtcccccgtcggtccctctggctggcgtcattgacgggccggccgtctcccgagaaaggatcagtccatggcaatcgagtaccgcatcacgctggacgaccagcatcagctcaactatcgcatcgagctggagcggcactacgacccgcaggcggctgccgcagcgccgcgctggacgcgcctggaacacaatcgctgcagcaactgcccgctcgatcgcgaacgctacagccattgtccggcggcggtcgacctgcatggggtgatcgaggatttccgcaacctgccggcgttccgcaaggccggcatctgcgtgcgcacgccggagcgcgagtacatcaagcaggcgggcctggaggaaggactgcgcgcgctgatcggcttgatcatggccagcagcgcctgtccgctgctggcgccgctgaggccgatggccatgcagcacctgccgttcgccagcaaccaggagttcgtgctgcgggtggtgccgctgtacctgatgcgccagtacttcaacttccgcgaggggcggcatgccgattgggaactgaaagggctggtgcggctgttccagcagttgcaactggtcaaccaggcgttctggcagcgaatccacgacacctgtgtcagcgattccaacctgaaggcgttcctgaccttcttctcgctgtcgtcgagcatcagctattcgctggaaacccagttgcagaagatccgcccgctggtgatgagcgccgaggaaacgctcggctgaggcgcaggccccggccgagcggggagagatcaggctttcttcaggtgcaccgcgagcacgtcgcagggcgcgccgtgcagcacgtcgttggcagtggaaccgagcagcagcgccaggccgtggcgaccgtggctgccgaccacgatcaggtcgcaagcctgttccgcggcgaggcggtggatttcctggcgcggttgcccgtagaccaggtggcgctgctcgctgccgaggtccggatagcgtacggcgaaggcatccaggcgttcacgggcctggtcgaactgctgctgctgcaacatcgacaggtccatcggcacgtccccaccgaaggccatggccatgggctcgaccacatgcaccaccgagagccgggcctggttgctggtggccagggccgccgcacgcttcatcaccgggtcgcattcgtcggtcaggtcgacggcgaccagaatgtgttgatagggcatgaacgtctcctcccagaaggggatagtgttttcattatggactttcgcgccgcgcgtggaacctgttccgttgcgctgggcaaaaagctgctccgccgtggtcgcattcgcctgtaa

SEQ ID NO: 2129 - DNA, 459 bp, Pseudomonas aeruginosa
ccgtttttcgagtgtccgttccttatgaccacttggctggtgatcctgctgctggctgtcatgctcagtcccctggcctggctgatgccgtccaacaggcagcgcggcaggatggccctgcgcctcgaggcgcgccgtctcggcctggccatgcagctcgcgcgccaggattggccgcattggctggagagcgctccgccgacgtcctgcgcgcagttccactgcccgcgccgacgcggccgggaggcctggtgctattggcagaataccccgggccagtggctgaaccagtggcgcgagccgtgcgcggacgatgagttgctggacgccctgcgcagcctccccggggatgtctacaaggtggaggcgaccgcccagttccttgccctgtattggggcgagcgcggcgatagcgccgacctcgggcgcatcgccgagtttctccgccagcgcgcctga

SEQ ID NO: 2130 - DNA, 540 bp, Pseudomonas aeruginosa
agcagaacggcggtacccttggcgtgtccaccatgtgcgtgggcctgggacagggtatcaccaccgtcttcgagcgcatctaagcgttcgtcgaaggggaaagccggggcctcgtgccccggctttcgtttttcagtgtcagtcgtttccggctgtatcgagcgaatgacgccccgggagcgcgggtttgcctattgtgcgatccgtgcctataccgggctgttgtatgtcggcattgtgccgttgttttccgattttcgagacaaggtaaggaacatggacctgcaggctgggctctatcgtcattacaagggacagaactaccgggtcctgggtgtcgcgcggcattcggagacggaagaggcgctggtgatctaccaggcgctgtacggcgaattcggtctctgggtgcgtccgctggagatgttcaccgaggccgtggaggtcgatggcgagtgggtgccgcgcttcgtcctggtgagtcccgaggccgatcccctgggcttgcagaaagctcccggcggggaagaccgcgcttga

SEQ ID NO: 2131 - DNA, 2670 bp, Pseudomonas aeruginosa
cggtgccgcgctagtcgctccctcctttatattcatcttttcgacgcaggaaccttccgatccatgggtaaatcgctggtcatcgtggaatccccggccaaggccaagaccatcaacaagtacctgggcagccagtacgtggtgaagtcgagcatcggccacatccgtgacctgcccaccagtggttcgtcgagttccaaggagccggcggccaagggccgcaagagcgcctccgaggcgccggcgctgtcaccgaaggagaaggccaggcgccaactggtctcgcgcatgggggtcgaccccgagcatggctggaaggccaagtacgagatcctgcccggcaaggaaaaggtcatcgacgagctgcgccgcctggccaaggacgccgacaccgtctatctcgcgaccgacttggaccgcgaaggggaggccatcgcctggcacctgcgggaagccatcggcggcgacgaaagccgctacaagcgcgtggtattcaacgaaatcaccaagaaggccatccaggaggccttctcccagcccggcgagctcgatatcaaccgggtgaacgcccagcaggcgcggcgtttcctcgaccgcgtggtcggctacatggtctcgccgctgctctggcagaagattgcccgtgggttgtccgccggccgcgtgcagtcggtggcggtgaagctggtggtggagcgcgaacgcgagattcgcgccttcgtcccggaagagtactgggaagtgcatgccgacctcggtaccgccaagggcgccaacgtgcgcttcgaggttacccgtgagaagggcgaggccttcaagccgctcaacgaagcccaggccatggcggccctggaaaagctcaaggcctcggcctatagcgtcgccaagcgcgaggaccggccgacctccagccgaccctcggcgccgttcatcacttccaccctgcagcaggcggcgagcaaccgcctgggcttcggggtgaagaagaccatgatgatggcccagcgtctctacgaggccggctacatcacctacatgcgtaccgactcgaccaacctgtcggccgatgccattggcatggtccgcggtttcatcgaggacgagttcggccagaagtacctgccgggcaaggccaacgtctactcgagcaaggagggcgcccaggaagcgcacgaggcgatccgtccttccgacgtcaacctcaagccgacccagctgtccggcatggagcgtgacgccgagcgcctgtacgacctgatctggcgccagttcgtggcgtgccagatgaccccggccgaatacctctcgaccagcgtgagcgtcaccgccggcgatttcgagctgcgcgccaagggccgcatcctcaagttcgacggttatacccgggtactgccgcagcagagcaagccgggcgaggacgacgtcctgccggaaatgaaggaaggcgagaacctcaagctgatcaagctcgatccgagccagcacttcaccaagccgccggcgcgctactccgaagcgagcctggtcaaggaactggagaagcgcggtatcggccgcccctcgacctacgcggcgatcatctccaccatccaggagcgcggttacgtaaccacccacaaccgccgcttctatgcggagaagatgggcgacatcgtcaccgatcggctcaacgagagcttcgccaacctgatggactacggtttcaccgccgggatggaggagcatctcgacgacgtggcccagggcgagcgcgactggaagcacctgctcgacgagttctacggcgatttcaagaagaagctcgaggtggccgaagtcagcgagaaggggatgcgcgccaaccagccgaccctgaccaacattccctgccgcgagtgcggccggccgatgatgattcgtaccgcctccaccggcgtgttcctcggctgctcgggctacagcctgccgccgaaggaacgttgcaaggcgaccgtcaacctgattcccggcgacgagatcgccgcggacgacgagggcgagtccgagtcgcgggtgttgcgtggcaagcatcgctgcccgatctgcagtaccgcgatggacgcctacctgctggacgagaaacacaagctgcatatctgcggcaataaccccgactgtccgggctacgagatcgaggaaggccagtaccggatcaagggctacgaagggccgagcctggaatgcgacaagtgtggcagcgagatgcagttgaaaaccggccgtttcggcaagttcttcggttgcaccaatccgacctgcaagaacacccgcaagctgctgaagaatggcgaggcggcgccgccgaagatggacgccatccgcatgcctgaattgaagtgcgagaaggtggacgatatctacgtgctgcgcgacggcgcttcgggcatgttcctggccgccagccagttcccgaagaaccgcgagacccgcgcgccgttggtgagcgagatcatcccgcacaaggccgagctggatcccaagtaccattacctctgcgacgccccgcagaaagacccggacggccgtcccgcggtgatccgtttcagccgcaagaccaaggagcaatacgtgcagtccgaggtcgatggcaagcccaccggctggcgcgccttctacgatggcggcaagtggaaggtcgaagacaagcgctga

SEQ ID NO: 2132 - DNA, 858 bp, Pseudomonas aeruginosa
aacgtatgtttcaaacaagtgtttgtcaggcggagaaaccatggcccagtcggaaaccgtcgaacgcattctcgatgcggcggaacagctgttcgcggaaaaaggcttcgccgaaacctcgttgcgtctgatcaccagcaaggccggggtcaacctggcggcggtgaattatcacttcggttcgaagaaggcgctgatccaggcggtgttctcgcgcttcctcgggccattctgcgccagcctggaaaaggagctggatcgtcgccaggccaagcccgaggcccagcacgccaccctggaggacctcctgcacctgctggtgtcccaggcgatggcggtgaagccgcgcagcggcaacgacctgtcgatcttcatgcgcttgctcggcctggccttcagccagagccaggggcacctgcgcaagtacctggaggaggtctacggcaaggtcttccggcgctacatgctgctggtcaacgaggctgcgccgaagctgccgcccatcgagctgttctggcgcgtgcacttcatgctcggcgcggccgccttcagcatgtcggggatcaaggccctgcgggcgatggcggaaaccgatttcggcgtgaacacttccaccgagcaggtgatgcacctgatggtgccgttcttcgctgccggcatgcgcgccgagagcggcatcgacgatccgctgctggccggggcgcaactgcgcccgcggaacaagacgcccgccaaggcctgatcgcagacggcgccccagggcgccgttttcctttctcctttctctgtgctccgggcggaactccatgcgccaggccggctccattggcaggcgcgcggtaccgccccgggacttaa

SEQ ID NO: 2133 - DNA, 411 bp, Pseudomonas aeruginosa
tttccaggccataggacttttcatgcaaggctctctgatgctcgacatcggcggcacctggctgaccgccgaggaccgccaaatcctgcgccaccccgaggtgggcgggctgatcatcttcgctcgcaacatcgagcatcctgcccaggttcgcgaactgtgtgcggccattcgcgccatccgtcccgacctgttgctggccgtcgaccaggaaggagggcgcgtgcagcgcctgcgccagggcttcgtgcgcctgccggcgatgcgcgcgatcgccgacaaccccaatgccgaagagctggccgagcattgtggctggctgatggcgaccgaggtgcaggcggtcggcctcgacctgagtttcgcgccggtgctggatctcgaccaccagcgcagcgccgtggtcggtag

SEQ ID NO: 2134 - DNA, 753 bp, Pseudomonas aeruginosa
  unsure (138),(189),(336): Identity of nucleotide at the above locations are unknown.
ttgagggagctgtcgatgagtgtctacgcgattatcggaggaaccggcctgacccagctggaagggctgacgctgagcgagtccctgccgatcgaaacgccgtatggcgcgccgtccgcgccgttccagcgtggccgntacgccgggcgcgaggtgctgttcctggcacgtcacggtcatccgcaccgnttcccgccgcaccaagtgaactaccgggccaatctctgggcgctgaagcaggcgggtgccgaggcggtgatcgcggtcaacgcggtgggtggcatccatgcggcgatgggaacggggcacctgtgcgtgccgcaccagttgatcgantacacctcgggacgcgagcacacctatttcgccggcgatatcgagcatgtcacccatatcgacttcagccacccctatgacgagccgttgcgccagcgcctgatcgaggcgttgcgtgcgttggggctggcgcacagcagccatggggtttacgcctgcacccaagggccgcgcctggaaacggtggcggaaatcgcccggttggagcgggacggcaacgatatcgtcggcatgaccggcatgcccgaggcggcactggcccgcgagctggacctgccctacgcctgcctggcgctggtggtcaatcccgcggcgggcaagtcggcggggatcatcaccatggccgaaatcgaacaggcgttgcacgatggcatcggcaaggtgcgcgaggtgctggcgcgggtcctggccggctag

SEQ ID NO: 2135 - DNA, 1023 bp, Pseudomonas aeruginosa
ccagaacaagaaactactcacttcgatttagggtttttcaatggatggtcaacatctgcaccagggcgagctgaagcgtggcctgaagaatcgccacatccagttgatcgcgctgggcggggcgatcggcaccgggctgttcctcggctcggcgggcgtcatcaagacggccggcccgtcgatgatcctcggttacgccattggcggcttcatcgccttcctgatcatgcgccagctcggcgagatgatcgtcgaggagccggtggccggctccttcagtcacttcgcacacaagtactggggcggattcgccggtttcctttccggctggaactactgggtgctgtacatcctggtgggcatgtcggagctgaccgcggtgggcaagtacatccagtattggtggccggacgtgccgacctgggcgacggcggcggcgttcttcgtgctgatcaacgcgatcaacctggccaacgtgaaagccttcggcgagaccgagttctggttcgcgatcatcaaggtagcggcgatcatcggcatgatcctgctcggtatctacctgctggtcggcggcggtggcggaccgcaagcctcggtgagcaacctgtgggaccgcggcggcttcttccccaacggtctcagcggcctggtgatgaccctggcgatcatcatgttctccttcggggggctggagctggtgggtatcaccgccgccgaggcgtccgagccgcggaaggtgatcccgaaggcgatcaaccaggtgatctaccggatcctgatcttctatatcggcgccctggcggtgctgctctcgctgtatccatgggaccagttggtggagaccatcaacgcttccggcgacgactacagcggcagcccgttcgtgcagatcttctcgttgatcggcagcggcaccgcggccaacatcctcaacttcgtagtactcaccgcggcattgtcggtctacaacagcggcgtctactgcaacagccggatgctctacggcctggccgcccagggtga

SEQ ID NO: 2136 - DNA, 1230 bp, Pseudomonas aeruginosa
cctgctcgacaaggtcgagcatcatttcgagaagggcgggcgctacgagaagtggtacccgctgtacgaagccgtggacaccttcctctatcgtcccggcagcgtcacccgcaccactgcacacgtgcgcgacggcatcgacctgaagcgcatgatgatcatcgtctggctatgcaccttcccggcgatgttcttcggcatgtacaacgtcggccaccaggccaacctgatcttcgcccagagccccgacctgttgagcgcccaggatggctggcgcttcgccctgatcggcgcgctggccgggttcgacccgaacagcttgtgggattgcctggtccagggcgccgcgtacttcctgccggtgtacctgaccaccttcatcgtcggcggtttctgggaggtgctgttcgccagcatccgccgccacgaggtcaacgaaggcttcttcgtcacctcggtgctgttcgccctgaccctgccgccgtccgtcccgttgtggcaggtagccctggggatcagcttcggcgtggtgctgggcaaggaagtgttcggcggcaccgggaagaacttcctcaatccggcactggtcggccgggccttcctgttcttcgcctacccggcgcagatgtccggcgacgcggtatggacctcggtggacggcttcgccggcgccacctcgctgagcctggccgccgccggcggcgtggacaacatcctcggccacggcttgacctggatggatgccttcctcggccacatgcagggttcgatgggcgagaccagcaccctggcgatcttcatcggcggcgccgtgctgctgctgacccgcatcgcctcctggcgcatcgtcgccggggtgatgctggggatggtcgccatgagctacctgttcaacgccatcggctcggccagcaacccgatgttcgccatgccctggtattggcacctggtcaccggcggcttcgccttcggcatgatcttcatggccaccgacccggtctcggcgtccatgaccgataccggcaagtggctgttcggcgccctgatcggagtgatggtcatgctgatccgggtggtcaacccggcgttcccggaaggcatgatgctggcgatcctgttcgccaacctgttcgcaccgctgatcgaccatttcgtcgttcaggccaacatcaagcggaggctggcgcgcaatggctaatcaagaatccaccacccgcacactgctggtag

SEQ ID NO: 2137 - DNA, 993 bp, Pseudomonas aeruginosa
cctgagcaagcagctctcggtgttcgtcgggctgatcatcaccaactgcatcgtgatgggccgcgccgaagccttcgccatggccaacccgccgctcgtgtcgttcttcgacggcatcggcaacggtctcggctacagcgccatgctgctggtgctgggcttcgtccgcgagctgttcggcgccggcaagctctacggcatcagcgtgttgccgacggtcaacgatggcggctggtaccagccgaacggcctgctcctgctgccgccttcggcgttcttcctgatcggcctgatcatctgggccctgcggacctggaagaaagaccaggtcgaggccccgacctacaagatggccccgcaggtatccagcaaggaggcttactgatggagcactacatcagcctgttcgtgaaggccgtgttcgtcgagaacatggcgctggcgttcttcctcggcatgtgtaccttcatcgccatctcgaagaaggtggagaccgccatcggcctgggtatcgcggtgatcgtggtgcagaccatcaccgtgccggccaacaacctgatctacacctacctgctcaaggacggcgcgctggcctgggccgggctgcccgaggtggacctgagtttcctcggcctgctcagctacatcggggtgatcgccgccatcgtgcagatcctcgagatgctcctcgacaagtacgtacccagcctctacaacgcgctgggcgtgttcctgccgctgatcacggtgaactgcgcgatcatggccggctcgctgttcatggtcgagcgcgactacaaccttgccgagagcacggtgtacggcgtcggctcgggcttttcctgggcgctggcgatcgccgcgctggcgggtatccgcgagaagctcaagtacagcgacgtccccgagggcctgcagggcctggggatcaccttcatcaccatcggcctgatgtcgttgggcttcatgtcgttctccggcgtgcagttgtaa

SEQ ID NO: 2138 - DNA, 1194 bp, Pseudomonas aeruginosa
agaggtcttcggggtgaagaaatgggagtgcacggtggagtccaaccccaacgtcgccaccttcatcaaggaactcaccctgcgcctgccggacggcgagagcgtggactttcgtgccggcggctacgtgcagctggaatgcccgccgcacgtggtcgagtacaaggacttcgatatccagccggaatatcgcggcgactgggacaagttcaacatgtggcgctacgtgtcgaaggtcgacgagacggtgatccgcgcctactcgatggccaactacccggaagagaagggcgtggtcaagttcaacatccgcatcgcctcgccgccgccgggcagcgacctgccgccggggcagatgtcgtcctgggtgttcaacctcaagccgggcgacaaggtcaccgtgtacgggccgttcggcgagttcttcgccaaggacaccgaggccgagatggtcttcatcggcggcggcgccggcatggcgccgatgcgttcgcacatcttcgaccagttgcgccggctcaagtcgaaccgcaagatcagcttctggtacggcgcgcgctcgctgcgcgaggccttctataccgaggagtacgaccagctgcaggcggagaatcccaacttccagtggcacctggcgctgtccgacccgcagccggaggacaactggaccggcctgaccggtttcatccacaacgtgctgttcgagaactacctgaaggaccacccggcgcccgaggactgcgagttctacatgtgcggcccgccgatgatgaatgccgcggtgatcaagatgctcaccgacctgggcgtggagcgcgagaatatcctgctggacgatttcggtggctgagcgtttccgtccgcttgccatggccggactggcagcgctggcgctggtcctggccggttgcggcgacaccctggaaagcttcggcggcccgaccatgggcagcacctattcgatcaagtacgtgcgcggcgcctcggcgcccgacgtccagacggcgaaagccgcggtggaggcgatcctcgccgaggtcgaccggcagatgtccacctaccgcgacgattccctggtctcgcgtttcaatgcgctgccggcgcagtcctgcatggagctgccgccaccgatgctggagttgctgcgctacggcggcgagttgtcggaacagagccagggcgccttcgacatga

SEQ ID NO: 2139 - DNA, 1317 bp, Pseudomonas aeruginosa
ggccgccggcgatgcctcgccacttcgccatcccgacgcatccattttctgccagctaagggcgacatgttcagacccctgtccgttttcatcggcacgcgctatacgcgggccaaacgtcgcagccatttcgtctccttcatttcgctgacctcgatgatcggcctggcactgggcgtgctggtgatgatcgtggtgctctcggtgatgaacggcttcgatcgcgaaatgcgtacccgcatcctcggcatggtgccgcaggccaccgtcgagtcgtaccagcccatcgatgactggcgcgccctggccgagaaggtcaaggcccacgagcatgtcaccgcggtagcgccgttcacccagatgcagggcatgctcagcgccaatggcgcggtacagacggtgatggtcgatgcggtcgatccgctggaagaggccaaggtctcgatcattcccgatttcttcaagcagggctcgctggcggaactcaaggccggcggcttcggcatcgtcatcggccaactggcggcgcagaagctcggcgtcggcatcggcgataaggtcaccctgatcctccccgaggtggcggtcaccccggccggggtattcccgcggatgaagcgtttcaccgtggtcggcaccttccgcgtcggcgccggcgaactggatggcggcctgtcgctgatccacctggaagacgccgcgcgcctgcagcgctggaagaccaaccaggtacaggggctgcgcctgaagctcgacgacctgttccaggcgccgcgggtggcctgggagatcgcccggaccctgaccgacaatgacttctacgcccgcgactggacgcgcagccacggcaacctgtaccaggccatccgcatggaaaagaccatgatcggcctgttgctgctgctgatcgtcgcggtcgccgcgttcaacatcatttccaccctggtgatggtggtcaccgacaagaagtcggacatcgccatccttcgtaccctcggcgccacgccggggcagatcatggctaccttcatggtccagggtacggtgatcggggtgatcggcacgctggtcggcggggtcctcggggtggtcgcggcactcaacgtcagcgcctggatttccgccctggaaaagctgctgggccaccagttcctcgcgtccgacgtgtacttcatcgattacctgccgtcgcaactgatgctcgacgatgtcgtgctggtctgcggcgcggccctggtcctcagcttcttcgccactttgtatccagcctggcgtgcggcgcgcacccagcctgcggaggctttgcgttatgaatga

SEQ ID NO: 2140 - DNA, 2283 bp, Pseudomonas aeruginosa
ccccatgtgacatgtcggggagcggagggcacgccacggggatgggaggaaccgttcatgcgcctgggattgccagccctcgccgcggggctgctggccctgcgcttcctggcggaattgccgtcggtcggctggctgctgggcatggccgccgccggactgttgctgctgttcggccggctgtactggctggggttgttcctgctcgggttcgcctgggcctgcggctcggcgcaagtcgccctggacggacgcctggccgccgagctggatggtcgcaccctttggctggaggggcgtgtggtcgatctgccggcgagcggcgagggcgtcacgcgcttccggctggaggaggtccgcgctgcgcggggcgtgcttcttcccgagcgtttgcgcctgagctggcgcggcgcgccgccgctgatgggcggcgaacgctggcgcctggcggtgaccctgaaacgcccccgcggcctggtgaacgcggcgggtttcgactacgaggcctggttgttggcgcagcgggtcggtgctgtgggcacggtgaaggcgggccagcgcctgcagccggccagcggcctggatgcctggcgcgatgcctggcgccagcgcctgctggcggtcgacgcacaggggcgcggcgccgccctggcggcgctggtgctgggggatggctcggggttgagcgcggccgagtggcgcatgttccaggacaccggcaccgtgcatctgatggtcatctccggttcgcatatctcgttgctggcggggatgctctatggcctggtggcggccttgcatcgcctgggctgctggccgcggcgcctgccctggctgccctgtgcctgcgccctgggtttgcttggtgcctggagctacgggttgatggcgggtttcgaggtcccggtgcggcgcgcctgcctgatggtcagcctggcgctggtctggcgcctgcgtttccgccacctgggcttgctgaccccgctgctggcaacgctggtgctggtcttgctggtcgagccgctggccagcctgcaggcggggttctggctgtcgttcctggcggttgccctgctgctctggctgttcgccgggcgccttgggcgctggcgctggtgggcggcctgggggcgggcgcagtgggggatggcgctggggctggcgatgccgctgctggcgctgggcctgccgttgagcctgagcggagcgccggccaacctgctggcggtgccttggatcgaactgctggtagtgcccccggccctggcggggagcctgctgctgtgggtgcccgggctgggcgaggggctgcttcgcgccgctggcgtttcgctggacctgctgtttcgtgcgcttggcctgctggcgggcctggccgaggcctggcagccacccgccgcagcggcctggagcgtagcgctgggcatgctcggcgcgctctgctggctggcgccggctggcttgccgttgcgtgccctcggtgccgcgttgctactgccggcattgttgccgtcatcgccgcctgtcgaatgggggcgggcggaagtgcgggtgctggacgtcggccaggggctggccgtgctggtgcgtacccgaaagcatgtcttgctctatgacagcggtgcgcggcagggggcgttcgacatgggcgaacgggtggtggtgccggtgctgcgcagcctggacctgcggcgcctggacggcctgttgctgagccatgccgacaacgaccatgcaggcggtgctcctacggtcgcttcccgattcccgccggtttggctggtcagcggcgaacccgcgcgcctgccttcgccgttgttcgcggacagctgcgacgagcggagctggtcctgggatggcgtggttttcgaacagtgggcatgggcacaggccggcgacagcaacgaccgctcctgtgtgctgagggtcgaggccgatggcgaagtcctgctgctgaccggggacatctcgcgtgcggccgagcatgcctggctggcgcgacaggccgatccccgggtcgactggttgctggcgccgcatcatggcagccgcagttcctccggagtcgccttcgtgttgcgtacgcggcctcgccatgtgctggtctcgcgaggttggcgcaacgccttcggccatccccatggcgaagtgatggagcgttacgcgagggtcgccgcgcaggtccacgacacggcacgcgacggtgccctgacgtttctcctcggaagccgtggcggcgcacgccgggagcgtgattcggcgcacttctggcgggaaaaatga

SEQ ID NO: 2141 - DNA, 708 bp, Pseudomonas aeruginosa
gaaccgtggcggtcggcggaaaagggtcgctgtgctagagtggcgccacttttttttcggggatatgccactgtgtgggaactggttcaagccggcggctggatgatgctgccgatcattctgagttcgatcgccgccaccgccatcgtcgcggagcgcctgtggacgctgcgcaagagccgcgtcgcgccgcccgagctgctcggccaggtgtggaagcagatcaagggcaagcaactgagcgcccagaagctcaaggacctgcgcgccaactcgccgctgggagagatcctcgccgccggtctggccaactccaagcacggtcgcgagatcatgaaggagtgcatcgaggaggctgcttccggtgtcatccacgagctggagcgctacctcaacgccctcggcaccatcgccgcgatggcgccgctgctgggcctgctgggtacggtgttcggcatgatccagatcttcggcgccttcatggacaacggcatggccaactcgccgatgctcgccgcgggcatctccaaggcattgatcaccaccgccgccggcctgctggtggcgattccggcggtgttcttccatcgctacctgctgcggcgggtcgacgaactggtgatcgccatggagcaggaggccatcaagctggtggaagtggtgcagggcgatcgtgaagtcgactacgtcgaggaaggcaaagcgtga

SEQ ID NO: 2142 - DNA, 825 bp, Pseudomonas aeruginosa
ggtctccgcgctgttcaatccgaacgtggtcaaggtcgccaccgacatcgacggcctggccctgactttcagtcgtgcgcccttgccctgggctcgcgacgccttcgcccgcgatcgcgacagcctgccggagggcgtgccctatcgtcgccacatcggcatctacgcctatcgcgtgggtttccttgccgatttcgtcgcctggggaccgtgctggctggagaacgccgaaagcctcgagcaattgcgcgcgctctggcacggggtgcgaatccatgtggccgatgcccgcgaaaccatgcttccgggcgtggatacgccggaagacctcgaacgcgttcgccgcgtgctggggggctgatgcgcgtcctgttcgtctgcctgggcaacatctgccggtcgcccaccgccgaaggcgtgttccggcgcaaggtcgaggaggccgggctggcctcccgtatccatgtcgattccgccggcaccgccggctggcatgtcggcaaggcacctgaccagcgcacccgcctggccgcgcaaaggcgcggctacgatctgtcggcactgcgtggacgccaggtcggcatcgaggatttctcctgccatgacctgatcctggccatggacctgtccaacctggccgacctcgagaccctgcgtgccgggcgcggtgccgccgaactggatctgttcctgcgtcgctacgggtccgagcgggacgaagtacccgatccctactatggcggcgaagaaggcttcgagcaggtcctcgacctgatcgaacatgcctgcgaccgtctgttgatcgaagccaaggggcgactgtga

SEQ ID NO: 2143 - DNA, 3546 bp, Pseudomonas aeruginosa
aaaagggatgccggcggcatccctttttcattgtgcgtgttcggcggctctggtcatgacgggcggtatgccggagtgccgcggaatggcgcgcaaaaaaaggggatgccatggcatccccttttttcagcctgtcactcaggcatgcgggcgcgaggtttcgctttcctcggtctttttcgcgtgctccgtgtcggcggcgtcttcgccggaagcttcaggctcggcctgtaccgcttcctgggcttcgtccgcctgggacggaacgtcggcctgggtgatttcttcagcctggggtgcagcaggttcctcctgggccgacgcttcctcgctcgctacagccgggatctcctcgacggcgggagcggcctgagctgccgcttcggctgctgctgcggcttcgcgtgccagacgctcggcttcgcgttgcaggcgacgtttttcccgtgggtcgttgagggcacggccagtcgcgttggccggcaccgccgcgatggccggggtcggctcctcggtggctgcgggctcgctaggggctgctacttcgacgggcaccggagcggcaacttcttcggccgcttccgttgccggttgcacggcgctctcggcgtcttcgcggctttccacgctttcgctggcgaagggagcttcttcagtggcttgcgcgaccagcagggtgctctggtcggcttcgtcccggaccacgctgacggtcaccggcgcttcgatgtcggcggtttcgccggtattggcctcgctgtccgcgtcctgggtttcgacggcttcgctggtcgacgcgtcggtctcatcgcttgccgtggtttcgctggcagcctcgctggtagtggccggggcttgctccacgtttgcttctacggcttcgctggcgacagcgataccggcagcggcggcggctgcgacggtgttcagcggcgcggcggcattatcggtcgcctcgctgccttccacctcgccgctgacctcgcgctggcgttcgcggcggttgctgcgacgacgctggccgcgggagcggcggcgcgggcgctcgccatcggtatcgtcctgctcgtcctgctccaggctctcgtcgttcggcaatgcctcggcttccagggccgcggcgtcgcgagcctggcgatcctcgcgcggctggcgctcttcgcgggccgggcgttcgacgcgttcttcacggccttcgcggggttggcgctcttcgcgggccgggcgttcggcgcgctcttcgcggcggcgttcgctgcgttcctcgcgaccttcgcggccttcgcgcggttggcgctcttcgcggggtgtccgctcggcgcgctcttcacggccttcgcgcggctggcgctcctcgcgagccggacgctcggcgcgctcttcgcggcggcgttcgctgcgctcttcgcggttcgggcgttcggcgcgctcttcgcgcggttgacgctctgcacgctcctcgcgcggtttgcgctcttcgtcgcggcgattgccatcgcggccatcgcggcggcggttctgctggcggccgttgcgacgctcgtcctggcgggtttggcgctcggcagccggcttgctggtttcagcaggcttggcggcaggttgatccttgcctgcgaacaggccgaccagggacttcaccaggccctggaacaggctcggctcgggcatcggcttggccggctcgaccggtgcttcggtgtgttgcggtgcgggctgctggggagcgacggtcttgactgctgcttcctggcggaccagggtgcgggtcgagctgaccggctgggcttcttcgtgctcgacggtggccatttcgtagctggtctggccggcaaccagttcggggctgtcatcgcgcagacgctgcacttcgaaatgcggggtttccagatgatcgtccggcaggatgaagatgcgcgcgcgggtacgcagttcgatcttggtgatggcgttgcgcttctcgttgagcaggaaggcggcgacctggaagggcacgcgggcgcggacttccgcggtgcggtccttcagggcttcttcctcgatcaggcgcaggatggccagcgacagcgactcgacgtcgcggatgatgccctggccgttgcagcgcgggcagacgatgccgctggtctcgccgagggacggacgcaggcgctggcgggacatttccagcaggccgaagcgcgagatgcgaccgacctggacgcgcgcgcggtcggcctcgagggcttcgcggacacgctcttccacggcgcgctggttcttcgccggggtcatgtcgatgaagtcgatgacgatcaggccgccgatgtcacgcaggcgcagctggcgggcgatttcctcggccgcttccaggttggtctgcagggcggtttcctcgatgtcgccgcccttggtggcgcgcgccgagttgatgtcgatggaaaccagggcctcggtcgggtcgatgacgatggagccgccggacggcagcttcacttcgcgctggaaagcggtctcgatctggctctcgatctggaagcgattgaacagcggaacgctgtcctggtacagcttcaccttgctggcgtactgcggcatcacctggcggatgaagttcagggcttcttcctgggcgtcgatgctgtcgatcagcacttcgccgatgtcctggcgcaggtagtcgcggatggcgcggatgatgacgttgctttcctggtagatcaggaagggcgcgccacgttcgccggacgcttccttgatcgcgctccacagttgcagcaggtagtcgaggtcccactgcagttcctcggtgctgcggccgaggccggcggtgcgcacgatcaggcccatgtcggccggtgcgttgaggccgttcagggcctcgcgcagctcgttgcgctcttcgccttcgatacggcgggagatgccgccggcgcgcgggttgttcggcatcagcaccaggtaacggccggccaggctgatgaaggtggtcagggcggcgcccttgttgccgcgctcttccttctcgacctggacgatgacttcctggccttcgctcaggacttccttgatgttgatccggccttcgggggatttcttgaagtattcgcgggagatttctttgagggggaggaagccgtggcgttcggcgccgaagtcgacgaaggcggcttcgaggctgggttcgacgcgagtgatgcggcctttgtagatgttggccttcttctgctcgcgggcgcccgactcgatgtcgaggtcgaacaggcgttggccgtcgaccagtgcaacacgcaactcctcgggttgagtcgcgttgatcagcattcttttcatgtagtaccaatggtttccggggctaccggaaacggcgatcggcacacacgactctcacggtcggtgctcgggcgcgtattcaggaatggcgggccattcccgtgtccagcggcgctcggcactgggtgccggtccgcgactacgtctcctgcttcctgtgtttcagaagcacttgagtcaggaggaggaatcggctgtcggaggcggacgaaaaatgcgtctggatcaagctag

SEQ ID NO: 2144 - DNA, 981 bp, Pseudomonas aeruginosa
atgaaaaattgttatgatgtacggatgactactcccgcctctccgaccaccggtgtccagctgctcgatgtgccgccggaactggctggtcaacgtatcgacaatttccttatcgcccgtctcaagggtgcgcccaagaccctgatctatcgcatcctgcgtaagggcgaagtgcgcgtgaacaaggggcggatcaagcccgactatcggctccaggccggagaccaggtgcgcgtgccgccgctgcgcctggccgagcgtgatgagccggcgccgctggcgcaggggctgctggagcggatggaggcggcgatcgtctacgaggacaaggcgctgatcgtggtcaacaagcccgccgggatcgccgtgcatggcggcagcggcgtgagcgccggggtcatcgaggtgtttcgccagttgcgccccgatgccaaggatatcgaattggtgcatcgtctcgatcgcgatacctccggcctgctgatgatcgccaagaagcgcagcatgttgcgtcacctgcatgaggccctgcggggcgagaagattgtcgacaagcgctatcacgccctggtccgaggccactggccggctggcaagaagaacgtgcgcgcgccgctgctgaagaacaacctgcgttcgggtgagcgaatggtagaggtgaacgtcgagggcaaggacgcgctgaccgagttccgggtgctgcgtcgcttcggcgatttcgccaccctggtggaagcacgcccgatcaccgggcggacccaccagatccgcgtgcatgccaagcacgccgggcatgccatcgccggcgacccgaagtatggcgacgaggatttctcccgcgagatccgcgagctgggcggcaagcgcctgttcctgcatgccgcgcagttgcgcgtgccgctgcccgacgggcaggtgctggagctggaggcgccggtggacgagatgtggcagcgttcgctggagcgtttgaatgactga

SEQ ID NO: 2145 - DNA, 570 bp, Pseudomonas aeruginosa
caggcgcgggggcgtccctataatggcgcgcttatgttgaatgggccgattccacctcatatcgatccgcgcaagttggtcgaccgcggcgccaccctcgagggtgtgtacgcgctcgccgatatgccgcgtgtatgcgagcaactgaccagcgatgccggtgaggtgcgcgtgaaggtttccttcgagcgcgaccaccagaagctggcggtcatgcatatgcaactcgataccgaggtgagcatggtatgccaacgctgcctggatgcggcggccattcccgtgcatggcgaatatacctacgccattcttcgggaaggtcagtccgccgacggtctgccgaaggggtacgatgcgctggaagtgggggaggaacccctggacctgctggcgctggtcgaggacgagctgttgctcgccttacccatcgttccggcccatgaccccgaagtatgtcagcacccggctggattcgtcgtcgaagacgagccggagtcgagcgaagtcgaggacaagcgtcctaatccgttcagcgtactggcacagttgaagcgtgacccaaacgtttag

SEQ ID NO: 2146 - DNA, 828 bp, Pseudomonas aeruginosa
tgcaatgggtggggacttcggtccccactgcgttgttccggcctctattgccttcctggccgagaattcctcttcgcaactgatcctcgtcggtcagcctgccctcctcgaagaactcctttcccgctatccgtcgctcgaccggcagcgcctgcgtgtgcatgcggccagcgaagtgataggttcagacgaacgtccctcccaggccttgcgtggcaagccggacgcttccatgcgcgtggcgctggagctggtccgcgacggccgggcgcacgcgtgcgtcagcgccggcaataccggggcgttgatggcgctgtcgcggcacctgctgaagaccctgcccggtatcgaccgccctgcgatggtgacggcggttccgaccgagaaggggcattgtcatctgctcgacctcggcgccaacgtggattgcagtgccgagcatctctatcagttcgcggtgatgggcgcggtggcggcagaggccttgggctgcgtctcgccccgggtcgccctgctcaacgtggggaccgaggagatcaagggcaaccagcaggtcaagctggcggcgagtctgttgcagaaggcgcaggggttgaatttcagcggatatatagagggcgatggcctgtatcgcggcgaggccgacgtggtggtctgcgacggtttcgtcggcaacatcctgctgaaagccagcgaaggcctggctgccatggtgtcggcgcggatcgaacagcgcttccgcgatggactggcggcgaagctggtcggtgcgctggcgttgccgctgctgcgccggctgcgcggcgatatcgctccggcacgctataa

SEQ ID NO: 2147 - DNA, 909 bp, Pseudomonas aeruginosa
agccaagccgcgcaagatcgacgtggccctgtcgaactcgttcggtttcggcgggaccaacggcaccctggtgttccgcaggttcgccgactgatgctggactgggtcgacggccggcccgccgccgagctgtccgtgcgcgatcgcggactggcctatggcgacgggctgttcgagaccctggcggtgcgcgccggcacgccgcgtctcctggagcgccacctggcgcgcctggaagaggggtgtcggcgcctggcgatccctctcgacgccgcggcgttgcgccaggagttgctggcgttctgcgcggcgctgggcgacggtgtcgccaagctgatcgtcacccgcggcgagggtttgcgtggctacgcgccgcctgccgaggcctcgccgcggcgaatcctctccggatcgccgcgtccggcctatcccgagcgccactggcagcaaggcgtgcgcctgttcgcttgccgcacgcgcctggccgagcagcccctgctagccggcctcaagcacctcaatcgcctggagcaggtcctcgcccgtgccgagtggagcgacgccgggcatgccgaagggctcatgctggacgtgcacgagcgggtagtggagggcgtgttcagcaacctgctgctggttctcgacggcaccctcgtggcgcctgacctgcggcgctgcggcgtcgctggagtgatgcgcgcggaattgctcgagcgcgccgaaggaatcggcgtcccgctggcgatacgggatgtttccatggctgaactggcgacggccgacgaggtctttctgtgcaacagccagttcggcatctggccggtccgggcattggacgagcacgtctggccggtcggcgagctgacccgtaaactgcaagaccaacttcgcgacgacctggatttctga

SEQ ID NO: 2148 - DNA, 717 bp, Pseudomonas aeruginosa
agcgtcgctcggactatcgctccagccccgcgcccatcaccccgccgccacaatgagcggcgcagccaagataaggagtgccgtgtgaccggcctgttcgtcaccctggagggcccggaaggggccggcaagagcaccaaccgcgactacctggccgagcgcctgcgcgagcgcggcatcgaggtgcagttgacccgcgagcctggcggcacgcctctcgccgagcgcatccgtgaactgctgctggcgcccagcgacgagccgatggccgccgataccgagctgttgctgatgttcgccgcgcgggcccagcatctcgccggggtcatccgcccggcgctggcgcgcggggccgtggtgctctgcgatcgcttcaccgatgccacctatgcctaccagggcggcgggcgcggtttgccggaggcgcgcatcgccgcgctggaaagcttcgtccagggcgacctgcggcccgacctcacgctggtcttcgacctgccggtggaaatcggcctggcgcgggcggcggcgcgtggccggctcgaccgtttcgagcaggaggaccgacgcttcttcgaggccgtgcgtcagacctacctgcagcgcgccgcgcaggccccggagcgttaccaggtgctcgatgccgggttgccgctggccgaggtgcaggctggcctggatcggctgctgccgaatctgctggagcgtctgaatggctga

SEQ ID NO: 2149 - DNA, 606 bp, Pseudomonas aeruginosa
agagccgtcgggcgatactgtgctgctgctgatcagccaccagcccagccgcctgttgccgaccatcaagagccgctgcgtgcagcaggcctgccctttgccgggcgcggcggcgagtctggaatggctggcgcgggccctgcccgacgagccggccgaggccctggaggaactgttggcgctttccggcggctcgccgctcaccgcccagcgcctgcacggccagggcgtgcgcgagcagcgcgcgcaggtggtcgagggggtgaagaagctgctcaagcagcagatcgccgccagcccactggccgaaagctggaacagcgtgccgttgccattgctcttcgactggttctgcgactggacgctgggcatcctgcgctaccagttgacccacgacgaggaggggctggggttggccgacatgcgcaaggtgatccagtacctgggcgacaaatccgggcaggccaaggtgctggccatgcaggactggctgctgcaacagcggcagaaagtgttgaacaaggccaacctcaaccgtgtcctgcttctcgaagccctgctggtgcagtgggcaagcctgcccgggccgggctagaatcccgctga

SEQ ID NO: 2150 - DNA, 867 bp, Pseudomonas aeruginosa
caacaccgcccgcaacaagatcgaaacctacctggccggggcgctgaagtcggaccggccgacccacacgatgtaacgctagacaggatcatgctggtcgattcccactgccacctcgatcgcctcgacctggccgcccatggcggctcgctcgatgcggcgctggatgccgcgcgagcgcgtggcgtcggtcaattcctctgcatcggcgtcagcgccgacaatgcccaggcggtgaaggccctggccgagcgctatgccgacgtgcactgttcggtgggcgtgcacccgctggacctggagcccggaagcgcgccagcgctggactggctgctgggcgaactggcgcatccgcgggtggtggcgatcggcgagaccggcctcgactaccactacgaaccggaagccgccgagttgcaacaggaggcgtttcgcctgcacctggaagccgcgcggatcaccgccaagccagtgatcgtgcacacccgcgaggcgcgcgccgacacgctggcgctgctgcgcgaggcggcgttgccgcaggccggcgtgctgcattgcttcaccgaggactgggaaatggcgcgatcggcgctggacctgggcttctacatttccctgtccggcatcgtcaccttccgcaatgccgatgccctgcgcgaggtggctcgccaggtaccggccgaccggctgttggtggagaccgactcgccctacctggcgccgattccccatcgcggcaagccgaacctgccggaatacgtgcgcgatgtcgccgaattcctcgcgacgttgcgtggcgtcagcctggaaaccctggcggagcagactaccgccaatttccatcggctgtttccgttggcccgctag

SEQ ID NO: 2151 - DNA, 636 bp, Pseudomonas aeruginosa
ccgatgttgcacctgttccgtatcgccctggcgatgctcctcctgggcagcctgtccgcctgcatgaagcccagcgacctggccgacggcgccgactactacctgcgcgacgccggggtgctcgatcacagcgccagccagcgcagcaacaaccggcggatccaggccgactccttcatctacatcggccagggcccgttcgtgccgccgggctaccggtacgcgcggccgaacgtggtggccgagcaggccttcgaaggtttcgtcgagtatttcccgctggtgcgccgcgccaaggcgccgctcggcctggacgacgcgatgcgcgaggcgcgtgccgccggcgctcactacctgctgtactgccgtttcgcccggggcgacaacaggatcggcaactgggaggagtgggaagacgaagaggaactcggccgggtcgggcgcgatcgcagtgtcatccaggtcatgctgatcgagaccagcacccgtttcctggtggacagcgcgaccatccgcagccgcggcggtttcctgacgttctacgacgccaccccggaagacctgctgcgtcccccgctggagcaatacgcccaggaattgctgggcctgaacagtcgaggaacaggctatgagtga

SEQ ID NO: 2152 - DNA, 468 bp, Pseudomonas aeruginosa
ccgtgcgatcctggtggagagcaacgacgagctgaactccctggccgtggccaagctgctcaaggccgtggtcgacaaggagcagccgcagctggtgatcctcggcaagcaggccatcgacagcgacaacaaccagaccggccagatgctcgccgcgctgaccggctacgcccagggcaccttcgcctccaaggtcgaggtcgctggcgacaaggtcaacgtgacccgcgagatcgatggcggtctgcagaccgtcgcgctgaacctgccggccatcgtcaccaccgacctgcgcctgaacgagccgcgctacgcgtcgctgccgaacatcatgaaagccaagaagaagccgctggacgtggtgaccccggacgccctgggcgtttccaccgcttccaccgtgaagaccctgaaggtcgaggcgccggctgcacgctccgctggcatcaaggtcaagtccgtggctga

SEQ ID NO: 2153 - DNA, 969 bp, Pseudomonas aeruginosa
actggtagagaaactgaagaacgaggcgaaggtaatctaatggctatcctggttatcgctgagcacaacaacgcggccctggcggctgccaccctgaacaccgttgccgctgccaaggccattggcggcgacatccacgtgctggtcgccggacagaacgttgccgccgtggccgaagccgccgccaaggtcgagggcgtctccaaggtgctggtcgccgacaacgccgcctacgcccaccaactgccggaaaacgtcgcaccgctgatcgccgagctgggcaagaactacagccacgtgctggccccggctaccaccaacggcaagaacttcctgccgcgcgtcgccgcgctgctggacgtcgaccagatctccgagatcgtcgaagtggtcagccccgacaccttcaagcgtccgatctacgccggtaacgccatcgctaccgtgcagtcctcggctgcggtcaaggtgatcaccgtgcgtaccaccggcttcgacgccgtcgccgccgaaggcggttcggctgccgtcgagcaggtttccggcccggccgatgccggcaagtccgccttcgtcggcgaagagctggccaagtccgaccgtccggaactgaccgctgccaagatcgtggtctccggcggccgcggcatgcagaacggcgacaacttcaagatcctctacgccctggccgacaagctgggtgccgcagtcggcgcttcccgcgccgcggtcgacgccggtttcgtgccgaacgacatgcaggtcggccagaccggcaagatcgtcgccccgcagctgtacatcgcggtgggcatctccggtgccatccagcacctggcgggcatgaaggactcgaaggtgatcgtcgcgatcaataaggacgaagaggctccgatcttccaggtcgccgactacggcctggtcgccgacctgttcgacgccgtaccggagctggaaaaggccgtctga

SEQ ID NO: 2154 - DNA, 1494 bp, Pseudomonas aeruginosa
ccctttggtcacgattcctgccttcggtccgcccaagcggaggtgtctcatttacaatgcgcgacgtctctagctcctgaatgtgcttttccggcatctagcaaccgaggttttcatgatcatcaaaccgcgcgtgcgtggcttcatctgcgtcactacccatccggcaggctgcgaggccaacgtcaagcaacagatcgactacgtcgaggccaagggccccgtcgtcaacggaccgaagaaggtcctggtcatcggttcctccaccggctatggcctggctgcccgcatcaccgccgcgttcggttccggcgccgataccctcggggtgttcttcgagcgtccgggcagcgagagcaagccgggcaccgccggctggtacaactcggcggccttcgagaagttcgcccacgagaaaggcctgtatgcccgcagcatcaatggcgacgctttctccgacgaggtgaagcggctgaccatcgagaccatcaagcgcgatctcggcaaggtcgacctggtggtctacagcctggccgcgccgcgccgtacccatccgaagagcggcgaagtgttctcctcgaccctcaagccgatcggcaagtcggtcagcttccgtggcctggacaccgacaaggaagtgatcaaggacgtggtcctggaggcggccagcgaccaggaggtcgccgataccgttgcggtgatgggcggcgaggactggcagatgtggatcgacgcgctgctggaggccgacgtgctggccgacggcgcgaagaccaccgcgttcacctacctgggcgagaagatcacccacgacatctactggaacggttccatcggcgcggccaagaaggatctcgaccagaaggtcctcggtatccgcgacaagctcgccccgctgggcggcgacgcgcgcgtgtcggtgctcaaggcggtggtgacccaggccagctcggcgatcccgatgatgccgctgtacctgtcgctgctgttcaaggtgatgaaggagcagggcacccacgaaggttgcatcgagcaggtcgacggcctgtaccgggagagcctgtacggcgccgagccgcgcctcgacgaggaaggccgcctgcgtgccgactacaaggaactgcagccggaagtgcagtcccgtgtcgaggagctgtgggacaaggtaaccaacgagaacctttacgaattgaccgacttcgctggctacaagagcgagttcctcaacctgttcggtttcgaggtcgctggggtcgactacgagcaggacgtcaacccggacgtgcagatcgccaacctgatccaggcctgaggcctggatccgagccgtcctcgcgacggctcccgctcccccgaaccggcgcccaggcgccggttcgcgttttcagcgaccggccacctgggcgttccgtacgccgtcgaggaaggcctggtagtgctgcgcggtttcctccgggcgttcgaccatcggcacgtgtccgcagttttccatga

SEQ ID NO: 2155 - DNA, 645 bp, Pseudomonas aeruginosa
ccgtgccggcccgctgtcgcaagccttgtgacgagtctaggcgtgctgccggtggtcggcgccgaacctaaggacggcggttcattcgccgggtcgatagagatgtcgatgctcggcgcggtacagcgaagagtcggcgaagccttcggcggccagcacctcgccgaccaggatcagcgcggtgcggcggaaattcctggcggcgaccttgggcaggatgtcgccgagggtgccgcgaacctgttcctggtcgggccaactggcccggtggatcaccgcgaccgggcagtcggcgccgtagtgcggcagcagttcctcgacgatcttcgccaggtgggcgacgcccaggtggatcgccagggtcgcccggtgccgcgccaggtcacccaggctctcgccttccggcatcttcgtgcgtgcggcgtagcgggtcaggatcagcgtctgggacacttcgggcagggtcagctcgcacccgaacagggcggcgcaggcggcggtggcggtgaccccggggacgatctcataggggatgccgagttcgcgcaggtggcggatctgctcgccgatggcgccgtacagggagggatcgccggaatgcacgcgggctacgtcgaagccgcggcgatgggcttgcgcgagtag

SEQ ID NO: 2156 - DNA, 666 bp, Pseudomonas aeruginosa
tcgtgcaggacggcgggtgcgaggaaatgcacggggcgttcgagcagcgtggccagttgccgcaggccgggttcgtcgcgtttgccgtcgatgctggcgagggcgtccagctcggccaggctgcgcccgtgttcgcccagcgttcgctccagcagcgcgcgcagatgctcggcgctacagcctcggcggcagccgatgccggcgatcagcaggctggggatgggcaggggcatgcgcgcaccggaggaaatggaaggagaggcactatggacccgcgaccggcaagggtcgcgggtggcaggcggtcaggcgtcgacgccgccccggttgcgccggaacagccaggcagcggccaggccgagggcggcccagaacagcgcattgctgaccagcgaggcgaccacgaaacgctgggccagggcttccggcgccaggctggcatggacctcgggctgcggcgcgccgaacaggtgcggcagcgccagcaggacggcgccgaccagcttcagcggccagttgccgccgaacaccagcagggccaggcccaccgcggtggcggcggcggtggcgatccaccagtactggcgttgcaccaggtcggccgcggcggtacccggcagctccggcggcaggcccagcgacggcgccaggcagaacaccgagtag

SEQ ID NO: 2157 - DNA, 357 bp, Pseudomonas aeruginosa
agatcgtcgaggcgagccggggcgagctgccgctgccggtcttgctgggactcaacgccgaggccgagctgcacatcgacggccggccgacccaccacgaccacgaaggccacgaggaccacgaccacgacgagttcgactccttccacgtcgatctccccgaggtggaggaagctgcgctgctcgaggccctcggcgagctggtggagcgtcacgacatacttcgcatcaagggtttcgccgccattccgggcaagcccatgcgcctgttggtacagggcgtcggcaagcgcttcgacaggcatttcgaccgcaagtggctggccgacgaagtccgcagcacccggctggtggtga

SEQ ID NO: 2158 - DNA, 3378 bp, Pseudomonas aeruginosa
gcgcccttggcaacctgccggcggagcaggccgagcgcttctggcaatacttgcgccagggcgggctggagaacgccgggcagttctaccgctgcctggccagccagtgcctcggccgcgactacgcctggcgcgaaccgcaggcgctgccgcgggtggcgctgttccatccacggcatgccgaggcgaccctgggaacactggcgtgccgactggcaggccgggcgtccggtggtcgcgttgctgttctatcgcacccacctgcaggcagccaacaccgccttcatcgcgcgcttctgcgaacgcctcgcggcgcaggggctcaacccgttgccgatcgcgctggccagcctcaaggaaagcgcctgcctggcgcaggtggaagactggctggagcgcagcgacgccgcgctgatcgtcaataccaccggtttcgcccagtccaatccggaggcgcccgagttgcgtccgttccgtcgcgacgtgccggtattgcaggcgatctgctcgctggacaaccgcccgctctggctggacaacccgcaaggcctggggccgcgcgacctggccatgcacgtggcgctgccggagctggacgggcgcatcgtcacccggccgatcagtttcaagggcctggcctggcgcagcgaacgcagcgagagcgacgtggtctgctatctcgccgacgacgagcgcatggatttcgtcgccgaactggcgcggcgctgggccgagctggcgcgcaagccaaacgcggaaaaacgggtggcgctggtgctggccaactacccgacccgcgatggccggatcggcaatggcgtcggcctggacaccccggcggcggcgctgaacatccttcgtgccctgcgccagcagggctatccggtcgacggactgcccgccagcggaaccgagctgatccgccagttgctcggcggcgtcagcaacgacctggagcatctcgacctacggccctgcgcccagagcctggcgctggacgactacctggcctgcttcgcacgcctgccggagcgcaatcgccaggcggtgctggcgcgctggggcgagccgcaacaggacccgatgttccgcgacggacggatgatggtcgccggcctgcgctatggcctgaccttcgtcggcatccagccggcgcgcggctatcagctcgatccggcggcggtctaccacgatcccgacctggtgccgccgcacggctacctggcgttctacttctggctgcgccacgcctaccgcgccgatgccctgctgcacgtcggcaagcacggtaacctggaatggctgccgggcaagggagtcggcctgtccgccgaatgctggccggacgcgttgctcggtccgctgccgaacatctatccgttcatcgtcaacgatccgggggagggcgcccaggccaagcgccgcacccaggcggtgatcatcgaccacctgatgccgccgctgacccgcgccgagagctacggcccgctgcgcgacctggagcgcctggccgacgagttctacgatgcctcgctgctcgacccgcgccgcgccgaacagttgcgcggcgagattctcgtcctcctgcgcgacaaccgtctcgaccgcgagatcggcttgcagctcagcgacgatccggacagctggctgccgcagctggacgcctatctctgcgacctgaaggagtcgcagatccgcgacggcctgcatgtgttcggcgagtcgccgagcgggcgattgcgcctggataccctgctggcgctgctgcgggttccgcgcggcgatggcaagggcgccaacgccgggttgctgaagagcctggcggacgaccttggcctgggcttcgatccgctggcctgcgacatgggcgaggcctggcagggcgcgcggccggcctgcctggaagagcggggcggggagccctggcgtactctcggggatacccgcgaacgcctggaattgctggcgttgcactggatagaacgctgcctgggcggcgaatcgccgcctgccacctggcgtgccagcggcgaggtgttgcgcggcttgtgcgaacaggtggcaccgaccctggacgcctgtggcggggccgagatcgacgggctgctggcagccctcgaagggcgcttcgtaccggccggtccgagcggcgcgccgagtcgcgggcgactcgacgtgctgcccaccggacgcaacttcttctcggtggacgtgcgcaacctgccgaccccgaccgcctggcgcatcggcttccagtcggccaacctgctgctcgagcgtcacctgcaggaacatggcgatcacctgcgccagctcggtctctcggtgtggggcacggcgaccatgcgcaccggcggcgacgacatcgcccaggccctggccctgctcggcgtgcgaccggtctggcaggccggcagccagcgcgtcgccgatttcgagatcctcccggtctccctgctggaccgcccgcgggtcgacgtgacgctgcgggtctccgggttcttccgcgacgccttcgccaacctgatccgcctgttcgatgcggcggtgcaggcggtcgccgagctggacgaggcggaggagctgaacccgctggccgctcgcgtacgcttggagcgccagcgcctcgaggcgcagggcacggcgccggcggaggcgcgccggcaggccggctggcggatcttcggcgccaagccgggtgcctacggcgccggcgtgcagggcgcaatcgaagagcggctgtgggagacccgcgccgaccttgccgaggtctacctgaactggggcggctacgcctacggtgccgccgacgacggcacgccggcgcgggaacgcttcgcccagcgcctggaacgcctgcaggcggtgctgcacaaccaggacaaccgcgagcacgacctgctcgattccaacgactactaccagttccagggcggcatgctggcggcggtggaaaccctgcgcggcgcgccggtggccagttaccacggcgaccacagccagccggacaacccgcgcatccgcacgctcaaggaagagctcaaccgggtggtgcgggcgcgggcggtgaatccgaagtggatcgccgggatgaagcgccacggctacaagggcgccttcgaactggcggcgacggtggactacctgtgcgccttcgatgccaccagcgagctgatcgacgaccaccagtacgcgctgctggccgacgcctacctgctcgacgcggagacccgcgagttcgtccgccagcacaatccgcaagccttgcgcgacatggccgagcgcctggtggaggcgcagcggcgcgggctctggcaggagccgggggcctatcgcgaggccctggagaacctgctgctggacgtcgaagaggaatag

SEQ ID NO: 2159 - DNA, 429 bp, Pseudomonas aeruginosa
gcgcgcatcaccaggagcaactggccgtcgagttcgtcgctcagcgcggcgaggcgttcggcgtattcgagggcggagcggggatcgtggatcgaacagggaccgactaccaccagcaggcgcgggtcgtcgccgtcgaggatggcgcggatggcgtcgcggctggcggcgacctggctggccagctccagcggcaacggctggcgggccttgagttcgagcgggctgggcaggcgttccagggcggtacgggcggtggcgctgggcagggcgacggcctggacgttcggcgaaagggtggtcagtgcggatacggatgagttcatggtctggcttcctgggctggcggcgggcgtcccgcgcgcgtcgtgccctatcgaggtgttcggcaatgtcgtgggttggcgagcggctggcggccgtcgctaa

SEQ ID NO: 2160 - DNA, 1221 bp, Pseudomonas aeruginosa
acccggaagagggcgaactgcgcccgcaactgctcgaccgtttcggcctcaacgtgcgtctcgacacccagccgccgccggccgagcgggcagagatcatccgtcgccggctggccttcgatgccgacccgcaggccttcgccgaacgctgggaaggccagcaggacaccctgcgccgccgttgcgccgaggcgcgccggcggctggcgcggattcccctggacgatgcggcgctggacagcatcgctcgacgctgcttcgaggcggctgtcgatggcctgcgcgccgacctggtctggctgcgcgcggcgcgcgcccatgcggcctggcgcggcggcgagcggatcgaggcggaggacatcgatgcggtggaacatttcgccctgctgcatcgccgtcgccagtcgaacccgccaccatcggcggccaatccaccgccaccgcccgcggcggcccctgtcgcgctcccggagcgcaccggcaacggcgaagggcagtggggtgaattgccggctcggccggtggccatggggaccgcccgcgagctgccgcgctggccaaaaaagccctgagcatccgcccgcgctcggtcatgggtgcggatgccaggagcagacccggagccctgcgcggcggtcttggcggcgccctgagccagggtgcggagggcgccatccaatggttgccgaccctgctgcgtggacgtccccgacagcgccgcgacctgcttcgccagccgcgcagccggcgcccgggcgaactctggctggtgatcgtcgatgcctccgccagcacccgccggtacggcgccctggcccaggccaagggggtgttggcgacgctgttcgaggaggcctatcggcagcgtatccgcctggccgtgctgcacgccaccgggcagcaggcgcaatggctctggcaggggcagaaggcctcgcgggagttgcaggactggctgcgccagctgggcgccggcggcggtacgccgctgctcgacgccctgcaccaggccgctggctggctggcgcgccgacagcggcagaaacccgccgagcatcagcgtctgctggtgcttaccgacggccgtctgcgcgactggccggcgctgccggaggctgcctgcccgagcctgctggtcgacctcgaaagcggcccgttgcgcctgggcaaggccgagcgcctggcccgggaactgggggccgagtatcggcatatcagtga

SEQ ID NO: 2161 - DNA, 576 bp, Pseudomonas aeruginosa
agccggcgttcggcggcagcgtcaccgccgccacctcgtcgccgctcaccgatggcagcgccgcgctgctggtctgtagcgaggacttcgcgcgccgccacgggctggcgatcctggcgcggatcaaggcggtggcggtggccggttgtgcgccggagatcatgggcatggggccggtgcaggcgacgcgcaaggttctgcaacgggccgggctgggcatcgccgacatcgacctggtggagatcaacgaggccttcgccagccaatccatcgcctgcatccgcgaactggggctggacatggacaggatcaacctggatggcggcgccctggccatcggtcatccgctgggcgccaccggcgcgcggatcaccggcaaggccgctgcgttgctgcggcgcaccggcgggcgctatgccatcgccacccagtgcatcgccggcggccagggcgtggcgaccctgctggaagcggtggagtgatcgcgcgccgatgaaaaaaggcccggtggatgagccgggcctggatggggaacctgcgccggcggcccggcgcagggtagtcgcggttacttga

SEQ ID NO: 2162 - DNA, 750 bp, Pseudomonas aeruginosa
tcccgatcgccgcgccgaccttctacgatcacttccccagttggttcgccaccatcttccattccggcatcagttcctcggcgatcatggcgatcctgctcaacctggcgttcaaccacttcaccgccggcaactccgaccagcagtcggtgttcgtcgccgccagcgagcggaccctgcgctaccaggacatcgccgccctgcacgaaggcgactatttcctcgacggcaagctgtacgacgcccagggcaacgaagtgccgctggccggcgacgacagccatggcgcgccgccgcgacggcgcagcgaaaccgctgaagccggcagcgcctgagccgcgccgcgatgaacgacggccctccttgcgagggccgttttcgttgtgcgcttcagaacagcgccttgccgcggtccaggcgctggtccaccagccatttgccgtgggcgatggaggcgcgctgggcgttttccaggtcggcgaggaaggcgaagcgcacgggcagggcgatgcgcttgctggtgtggccttcgggatcggtgatgtggcagccgccggcccagggcgtgggaatgcccggatgctcgacgacgtcggcggtgatggtgtagctgcggtgctggcagtgcaggctggccatggcatgctcctctctgtcggaggccgacccggctacctgcgcgacgcctgtggttgccacggaggagcctcggggcggcgaggttttccctgcgtgtccctacctctatag

SEQ ID NO: 2163 - DNA, 495 bp, Pseudomonas aeruginosa
tcgaaactttcaaatgtgacgttattgcaccgaaacagtgctgcgagtcgcttttttccgaagcggaagctacttggcggaataattccgggtcgggatcattgtaagttggtttttccttcgccccggcactcgcgccacgccggcagagcctggggcggggcgcggctgaccctcaagcattatcgggaaatatattccgttgtctttccgctgacgttttgccgacagcaagctgacacagatgtaattgaactcgatcgcttcgtttctatagtcttcgaacacttcgccgtgcactttcaaggacggcaagtgcatatcctgcgtcttttccgccatgacgattctcgaggtgagagcatgagtagtgagcacgatggcaaggaccaggacgacctgttctccccgttgccttacctgctggtttccggcgctgtcgtgctcatgaccctgctgctgcgctgcctgttttgcccgggcgagcagttctga

SEQ ID NO: 2164 - DNA, 525 bp, Pseudomonas aeruginosa
agcgcttggccagttccggcatcagttggtgccattcgtaccaggtctggccgaaaccgtgcaccagcatcaccagcggcccctggccgcctttcacgtagtgcagcttcacgccgtcgacttcccggtaggcgctttcgaagccattcgggacggggaattcctcggcggcgaagccgcccagggagaaggtcagggcgatgccggccaggaggccgcggcagagtctatcgaggatcatggttgtgcttccttggtgggctcagtgagggatttggccgccgagggacggctcggtggcagcttggcgtggcgccagcatcagcagcagggccacggccatcgccgccaggcagaccagcgcgccgacctcgccgagcggcgccaggccgctgccgtcgatcacccagctgccggcgagggcgccgatgccgatcccggcgttgcaggcggagatgttcagcgaggcggcgaacgccggggcccgcggcgcggacttcatcacccgcacctggccgacgatga

SEQ ID NO: 2165 - DNA, 462 bp, Pseudomonas aeruginosa
agaccagcagcgacagcaacaggtggccgagcaccagcggttggcgcaacacgctcgcctggctgcgcagcgagatacccggccgtccgggaatgcgcggcagccaggcggccagcagcagcgccttggccagggccagcgcggcgagtgcggcgaatgccaggcgccaaccccaggcgtcggcgatcagcgtgccgatgggaatgccaagcacggtggcggcgacgatgccgaagaacaccagcgccacggcgcgcccttcgcgcgaggggccggccaggtgcgcggcggtttcgctggccatggcccaaaacaccgggagcgccagggccgggacgaagcgcgccacggccatcgtccagatatcgccggccacggcggccagcgcattggccgcggcgaacagcagcaggcaggcgacgaacagccgcttgcgttcgacgcccgccagcgcggcggtga

SEQ ID NO: 2166 - DNA, 1302 bp, Pseudomonas aeruginosa
agccggcggcggccagcaggaggatcggcaatagcacggcaagactcctccgcgagcgcagccgtggccgcgcccgggaacgatgcatgggagggaagggaatcaggccgtagcggactggccgagagtcgggtaatcggtgtagccggcagcgtcgccaccgtagaaccgcgcctggttggcctcggccagcggcgcgccgagacggatccgctcgaccaggtcggggttggcgatgaacggccggccgatcgccaccgcgtcggccagtccggcctggagtatcgcttcggcgcgctcggcgtcgtagttgccgcagacgatcagcggcgcgcggaagcgttcgcgcaggcgctcgcggaagccttgcgggtaggccgggccgccgctccattcccactcggccaggtgcaggtaggcgatgccgcgtcgcagcagggcttcggcaaggtaaagggtcatcgcttccggctcgtcgtcgtgcatgtcgttgatcgtgccccagggcgacaggcgcaggccgacgcgctcggcaccgaccgcggcgaccagcgcgtcgacgatctccagcaggaaccgcgcgcggttctccaggctaccgccataggcatcgctgcgccggttgctggcgctggcgaggaactggtcgatcaggtagccattggcgccatgcagctcgaccaggtcgaagccggcgtcgagcgcgttgcgtgcggcgcggacgaattcgtcgcggacccggcggatgtcttccagggtcatttcccgcggcgcgtcggcgggcgccatggacccgccgccctggccatcggcgatgaacacctgggccttggcctggatcggcgagggcgcgatcggcgcctcgccgccggcctgcagcgagcgatgcgacatgcgcccgacatgccagagctgcgcggcgatcagtccgccggcggcgtgcaccgcctcggtgacctggcgccagccggccagttgcgcctcgctgtagataccgggggtgtaggcgtagccctggccgaggcgggaaatctgcgtgccctcgctgacgatcagcccggcgccggcgcgctgcgcatagtagagagcgttcagggcggtcggcacgtcgcccggctgttgcgcccgggagcgggtcatcggcgccatgacgatgcggttgcgcaaggccaggttgcctacggcgagcggggagaggagcaggttggacatggtcttttcctttcgaaggcggcagggagatggcttgaatatctgtatcggtcgctaaataatatggcgatggcaacgctcgtcaagtaa

SEQ ID NO: 2167 - DNA, 456 bp, Pseudomonas aeruginosa
gggatggtcccaggatcgcgggacgcatgggagttgcatgaagaagggagcgacgcttttcgccgtcctctgggcggtactcggcctgggcctgctggtcggtttgccggtggccattcatttcattctcggccagtacgacgaggccggcttcagcgggccgcaactggtcttcgaggaacagggccattcctacctggcgttcaccctcgacgactatcgcgccaacgaagtggacaacggcgtggtacacggcagcagccgcagctatgcccaggtggtcgacctggaggacggcagcctgcgctggagcatgcgcctggatgccgacaacgagcgcggcgacgactggggttccggcgaactgctgggccagtcgtcgcgctacctgttcttcctgcgcaacgaactctacgtactcgaccggcgcgacgccgcccctgcgctggcgtttga

SEQ ID NO: 2168 - DNA, 603 bp, Pseudomonas aeruginosa
cgagctggagcggcgcactggcgggctgccgttgaagtgggcgccctgggggaaggacgcctatcgctacgacgaaggccggggcggattgctgatgctcgcgctggacggccgcgtctggttcctcgacggcgacagcctggccctgcgcgaagctccggaagtcgatgccgcgcggtatttccacggcgacccgccgccgccggcgaatgccgggatcgactggcaggcgccgggcctgacgcgcctgcccgacggacgcctgctgatcctcgccagcgatcacgaggcccgagcgctggagcgtggcgaggcgctgccggcagcgaaccaacgggcgcgacgccagcgcctgtcactgggcaccctggattggcggtcgccggcggagaatcgactgcgtccgctgctcgacgcggccttcctgcaggatggcctgctgcccgatccagccgctgccgaagagccgcagcggctgctcgatcgaccgtccgagcggcagcgccagcatccgtcgctgccgcccgagccgcagccgccggaagagttcgacgagcgcgtggagcgttttcccagtacccgtgcgttccttgcggcgcgtga

SEQ ID NO: 2169 - DNA, 873 bp, Pseudomonas aeruginosa
gcacctcatggctgccgtagcgcttgtggatgtcttcgacctgcaggctgtacatgcgcgtgtctccgggagaggtcagtgggtttgcggtctgaggtaggccagccagcgcagctcgccgcggcggaacagccagatcagcaggaaggcggtgccggcgtagagcgcgccggcgatgccgaaggacaggaacggcgcataggtggcggaattgacgtcgcgggccaccttgagcaggtccggcactgtggcggtgaacgccaccgaggtggaatgcagcatcaggatcacttcgttgctgaagtacggcagtgcccggcgcagcgccgagggcaggacgatgcgccggtagagggtgaagccgcccatgccgtaggcgcgcgccgcttccacttcgccgtggggcgtgttcctgatcgcgccggcgaagatttccgtcatgtaggcgcaggtgttgaggacgaaggccagcaccgtgcagttgaagccgtcgcggaagaacgcgttgagaaagtcctgggcgcgtatggcattcaggctgtagacgccggtgtagaagaacagcaactggatgtacagcggggtgccgcggaacacgtaggtgtagagccagaccgggtagcgcagcagcgggttgccgcaggtccgcgccaccgccagcgggatggccagcaggaagccaagcgccacggcgaggatcagcagccacagggtcatcgccagtccggtcagttgcaggccgtcggtccacaggtaggcctgccagtattcgtcgagtaccgcgttcatggcagcggcctcctgacgcccagcgagctgcgccgctccagccacagcagcgcggcgttggagattgcggtgatggccaggtag

SEQ ID NO: 2170 - DNA, 900 bp, Pseudomonas aeruginosa
aaagcggccggacgccgttcagggcgtgccgtagaggtcgaagtcgaagtagcgggcgttgattcgcgcgtaggttccgttggcgcggatcgtcgccagcgccttgttcaggtcctcgcgcagcgccacgtcctccttgcgcaggccgatgccgtcgccgaccccgaagtagcgagggtcgtccagcaccgctccggccagttcgaaatccttgccgaccggcttgtcgaggaagccgtagctggcctgcaccgcgccttgcagcgaggcgtcgaggcggcccatgacgaggtcggcgtagacctggtcctggttctggtaggagacgacccgcacccccttggcggcccattcggccttggcgtaggcctcctggttggagccctggccgacccccacgcgcttgccgcgcaggctctcggcgtcgggcaggagcgccgagccacggcgtaccaccaggcggctcggcgcgttggagacgcggtcggtgaaggcgatgtgctgtgcgcgtttcggcgtgatggtcatcgacgagacgatggcgtcgatcttgcgcgacagcagcgccgggatgatgccgtcccagttgctttcgacccattcgcagcgggctcgcagctccgcgcagagggcttcgccgatctcgatgccgaagcctgccaggcggccgtccggctgcttgtattcgagcggcgggtaggtcgggtcgacgcccaggcgcaggaccttgcctgtccagtcggcggcgccggccggtgcggcgaggaggagggagagggcgatgctgccgagggttcttgtcattgtggttgtcctctgtcgatccgcgcgcgccaggccgcgcgcccgttgaaaaccctggctcaggccaggaagcgctcggccagtcgcacccagtag

SEQ ID NO: 2171 - DNA, 603 bp, Pseudomonas aeruginosa
tcgacctccgcccgcgcgccgaagctggcggcctggccgcgggccagttcgccgatgcggcgctccagcagggcacgggtttccgcggtcagggcccggacgctgaggatcatttcggcgctggccgggatcacgttggagaccgtcccggcatggatcgcgccgacgctgacgatcgcggtgtcctgcgggtcgacgttgcgcgagacgatgctctgcaaggccagcacgatggcggagcagaccaccaccgggtcgacggtgcgctgcggcaccgcgccgtggccgccactgccgatcacgcggatgaccacggtatcggccgaggccatgaaggggccgggatggaagccgaggtggccgacggggtatcccgggacgttgtgcatggcgaagatggcgtcgcaggggaagcgctccagcagcccgtcgtcgagcatcgcgcgggcaccgccgaggccctcttcggcaggctggaagatcagttgcagggtgccgcgccagtgcggcgactcgaccaggtgcctggccgcggcgaggagcatcgcggtgtggccgtcgtggccgcaggcgtgcatcacgccgtccacctggctggcgtag

SEQ ID NO: 2172 - DNA, 1026 bp, Pseudomonas aeruginosa
gcaagcgggggactggcggggaggctcgctttggctatgatgacaacctttcgttgtcacctcggtaagcccgtgaaactccaccagttgcaagccctggtcgccagtgccgacgccggcggcatccgcgccgccgcccgcgtcctggggatttcccaggcggccgtgacccgcgcgctgcgcgaactggaaaccgaacagcatctgccgctgttcgtccgcacgcccagcggcctgaccttcaccgaatacggcaaggcgctgctgatccacgcccggctggtgctcaagcaactggagcacgcgcaggtcgaactcgaccacctgcgtggccaggccagcggccggctgtgcatcggggtgacgccttgggtggcgctgaccttcctctcggaggcggtgcaggcgttccgcgagcgcatgccggaggtgcgcctggagcttttcgaaagcctgatggcggtggcccagccattgcttcgcgacggcagcatggatttcgccatcggcccgctgcacggcgcccaggcggcccaggagttcgcctgcgagaagctgctcgactacgacaccgcggtgctggtccgccaggggcatccgctggcgggttgcggctcgatccacgagctgctggaacaggactgggcgttgaactacaccggcgacggccacgacgccctgatgcgcgagttgttctggcgccacggcgccttgatcgacgagcggcgcatcgtccgcgcgcactccgtggcgatcctgcagaccctggtggagcaggccgacatgtgcacctgggtgccggcgatcataggcgccgccccgccgttgctcggccgggtggtgccgctggcgctgcgggaaaccttcgagccacgacggctgggcatcatcacccggcgcggcggagccctcagcaatccggcgcaatgcttcgtcgagtgcctgctgcaggtgatccgccgccacgcccgctcggcgaagaaggatgaccggcgcctgttcgaaaccctgcgcctgctagtctga

SEQ ID NO: 2173 - DNA, 1722 bp, Pseudomonas aeruginosa
ttcctactggcacggacgtacggtcgctcaagatcggtcgtgctgcgaccgatagcctggaaagccacgagcgaggatgccggcatgctgcaatggttcgctaacctgtcgttccgcaggaaaatcgccctgccgatcctcctgctggcggtgcttctgctgctggtgggcgcgctcggcgtgcatggcatcgcccagctgaacgaatccaaccagcgcctgggcaagcgttttctccccggcatcgccctgctactcaacgccgaccgcgatctctaccaggccttcgtcgccgagcgcagcctgctcgagggccacctgagcgccgagcagatcgccggcctgaggaacgatcacgcggaaaacctgcagcaggccctggatcgggtgcgccagtacgcggcgatgcagccgggcgaggcggaactggccaaggtcgccgagttcgagcgcggctatgccctctggagcgcgacctcggcgcgggtgctgagcctggcggccagcgatccgagcgccgcggcgcagctcagctacggtgacagcgatcgccagttcggggcgatgcgcgaggtgatcaaccagctcgacgagatggaagaggcggccgcggccgccgacggcgaggcgtcctccgcgctgggcgagcgccaccgctggcagcaggtggcgctggtggcgttcggcctgctggtgtgcctgtcgctggtgctggtgttccccggcctggtgacccgtccgttgcagcgtctgctgcaacgcctggaagagatcgccaacggcgatggcgacctgcgcgtgcgcctggaggtcacttcgcgcgacgaacccggccgcctcggcagcgccttcaacgccttcctcgacaagttgcagccgctgatccgcgaggtcggccgggtcaccggcgaggtcgccgattcagccggttcgctggccggcatgaccgccgccaacgatcgtctgatcaacagcgagcacgcatcggtggaccaggtcagcaccgccgcgacgcagatgagcagcgccgtccacgaggtggcgcgcaatgcccagagcgccgcgcaggtggccgatgacgcccgccggcaggcgcgcgagggcgccaacgtggtggaagcgaccatcgaggtgatccgccagttggcgcaggaagtggagagcagttccgagagcatccagcaactggcccaggaaaccgccagcatcgacgcggtgctgacggtgatcaagggcatcgccgaacagaccaacctgctcgccctcaacgccgccatcgaagccgcgcgggccggcgagcagggtcgcggtttcgccgtggtggccgacgaggtgcgggcgctggcggcgcgcacccaggattcgaccaaggacatccaggcgcgcatcgagcgcctccaggccggggtgcagaacgccgtgcgggccatgcagtcgggcagcctcaaggcgcgcgacagcgtcgagcgcgccgccggggtcgacggcgtgctggccgccaccggcgacgcggtggggcggatcaacgacctcgccgcgcagatcgcctcggcctgcgaggagcagagccgggtaatcgacgaaatcgcccgcaacatcagcgaggtgcgcgagctttccgcccaggcggcggaacattcggagcagggtaccggggccagccgccggctgtccgagctgtcctcggaactggcgcggctggtcggccgtttccgcgtctga

SEQ ID NO: 2174 - DNA, 1086 bp, Pseudomonas aeruginosa
tggagtggtcgaccatggggtgtttctcctgcggtgagtggagaacccagtctagggagggcggccttgcggagtaatcgcggcggcctggatagattgtccagaaacgccgatcaattcccgcctccggaggagcgcagccgcctgcacgaatcttctagaaccccgggacgggcgcgttatagtcgcggcgacgaaaccaacgagtgggaagacctgacgcacgatggggagccgagactggatcgacctggcccgcgacgccgagaccgggatcgagaccctgcgcgcccatttcgagggccacgcctacgatccgcactggcacgacagctacctgatcggctacaccgagatcggcgtgcagcaattcaactgccgccgacgccgacacgacagcaccgccggccaggtattcctggtcgaaccgggggagatccacgacggtcgcgcgccgatcgccggcggcttcacctactcgatgctgtacctgcagccggactggctgcggcgcgaactgcgggcgaccttcgacgatgcgcccagcgaccgcgaccccggcttccacgccaacctcaccgaagacccgcgcctgaccctggccatcgcccaggccttccgcgtcctgcatggccgcgagctgcgactgctgcggcagaccgccctggagctggtgctggagcggctgcgcgtgcacctcggctggcgcgaggcgaagccattcgatccgcgcctgccgctggtggcgcagaaagcccgcgactacctgcatgcgcacttctaccaggacatcggcctggacgagctggccagcgcctgcggcaccgaccgcttccgcctgaaccgtgcattcaaggccgcctacggcttgccaccctacgcctacctggtccagttgcgcctggccaaggcgcggcagatgctcgctgtcggcgggcaaccggcggacctcgccagcgctctcggtttcgccgaccagagccatctcggccgctggttccggcgcgcctacgggatgaccccggcggcctaccgccggcagtgcacccagcttccagactgaggcccggcgcgtcgccaggatga

SEQ ID NO: 2175 - DNA, 621 bp, Pseudomonas aeruginosa
aggctcccccgccacaggagcccgtccatgcaatccctcgtgcccttcctgctgttcgccgtcgtcgcctcgatcacccccggaccgaccaacatcctggtcctgagcaacagccagcgccacggcctggccgccgcctggccgatcgtgctcggcgcctgcgcggcggtggcggcgctgatcctgctgctcgggctcggcctgggcgagttgctgcgacgccatccgctgctccagcaggggctcgcctggctcggcgtcggctggctcagctacctggcctggagcctgttccgcagcgcgggcggcatcgacggcgcggagccgccgcggcgcctcggcgtgctcggcggcgcggcgttgcaactggtcaatcccaaggcctggatgatggccctcgccgcgctggcactgttcgccggggaaggcgccggacaggccgggcggatcggcctgctggcattgctgttcttcctggtttcgctgccgtgcctggccagttgggccttgctcggcgtcggcagcgcgcggctgctgcgctcgccgtcgctgatgaaacgcttcaaccagggcatggcgctgttgttgctggcatcggcctgggccgccctgctgctctga

SEQ ID NO: 2176 - DNA, 693 bp, Pseudomonas aeruginosa
agatcccgctggatctgttctgatcagctgcggcgacgcagcaggagaatgaagaacagcccgccgatggccgcggtggcgatgccgatgggcaggtcctggggggcgatcagggtgcgcgcggcgacatccatccagaccaggaacagcgcgccgagcagggcgcacaccggcagcagtcggcggtgctcggcacccaccagcaggcgcgcggcgtgcggcagcatgagaccgacgaagccgatggcgccgctcaccgagaccagcacgccggtcagcagcgagcagcagacgaagacccacaggcgtacgcgacgggcgtccaggccgagggtcacggcggtctgttcgccggccatcagcgcgttcagcgcacggcccagcccgagcagtaccagcaggccgccggccacgcacagcgccggcagccagatcaacgaccagcgcgccaggccgaggccgccgagcatccagaacagcacagaggaggcggcgcggtggtcgccgaggaacagcagcaggttggccagcgccaggagcacgaacgacaccgcgacccccgccagcaacagccggtcgctgcccaggcggccgccgcgactggccacgccgagcaccagcagcatgctgccgagggcgccgaggaaggccgccagcggcagggtcagcaggccgatcacctcgccgatgtag

SEQ ID NO: 2177 - DNA, 336 bp, Pseudomonas aeruginosa
agcaccaccaacaccgcgccgagggtcgcgccggaggtggcgccgagcaggtgcggatcggccagcggattgcgcgtgaccgcctgcagggccgctcccaccagcgccaggccggcgccgacgcaggcgccgagcagtacccgtggggcgcggatcagccagacgatgtgctcctggccggcgctccaggcaccgggctccgccgccacgccgaacaggcgctggaggacgatgcggccgaccaggccgctgtccagtcgcgccggaccgaagccgagggcgaccacgcaggacaggccgagcaacatgaccaggctgcccagcaacaggcaatag

SEQ ID NO: 2178 - DNA, 480 bp, Pseudomonas aeruginosa
gcgggtagcgctcggccagcgcggcatcggcgcaggcgagcagggcgccgagcagcaggtggtgcaggatcgggtgcttcatgcttgggtaatccaggtcaggcgcgggtggtcggcgagggggtggcggtcgaccagggcgcggacgccgaacacccgccacagcaggtcggcatcgagcacctcggtcggcgtgccctgggcgacgatgcgcccgccgtcgagcacgtagaggcggtcgcagaaggccgccgccaggttgaggtcgtggaagctcgccagggtgctcaggccgaggccgcgcagcaggcgcagaagctccagctggtagcgcgggtcgaggtggttggtcggttcgtcgaggatcagcaggcgcggttcctggaccagcgcgcgagccagcagggcgcgctgcttctcgccaccggagaggctggcgaaggggctcgcggcacgcccttcgagaccgacctggagtag

SEQ ID NO: 2179 - DNA, 453 bp, Pseudomonas aeruginosa
tccattgctggccgttgttgttgtcagccagggcgtactggcggtcgaacaggttgtacagctcaaggccgagggtcaggtccggccgtacccgccagcccaggttggagtcgaccaccgtgtagccgggcaggctggcctggttggcggcgtcggcgtagcgccggtcgacgtagcgcagcccggcgccgacgcgcagggtctcggcgaaggacttgtccagccagaggttggcggtgcgccgtggcacgttcctggggcgattgccgttgcgcgagtaggtctgcccgtcgatcgtttcgtcgaagtcgtcgtattcggcacgcaccagcgcggcgttcgccgacagccgccagtcctgggccaggttcagttccaggctggcctccaggccgtccgaactctgctggccgacctgctgcgcgtcgtgcggcggcagcgggttggcgctga

SEQ ID NO: 2180 - DNA, 981 bp, Pseudomonas aeruginosa
cggcgcgctggtcaacattcttggcaacctgccatggccagcgcatccaaccggattggtgagaccaacgacattcctgcgccgaagccgggccgcggggtcatgtcgttgactcatgcccggctggagtatccgcgtgaatcccgtttccctgatcttcctcgccttcgccatgtccaccgatgccttcgccgcggccatcggcaagggctccagcctggatcggccgcgcctgtcggaggcgctgcgcaccgggataatcttcggcgtgatcgaggccatcacccctctggtcggctggctgcttggccaggccgccagccagttcgtcgccgactgggatcactggatcgccttcgtcctgctggtgctgctcggcctgcacatgatccacaacggcctgcgcgcggatcatgcgacggaacaggaaaagcccggccagcattcgttctggattctcgcggtgacggcgctggccaccagcatcgacgcgctggcggtgggcgtcggcctggccttcgtcgacgtcaacatcttcctcgccgccggtgccatcggcctggccaccatgaccatggtcaccctcggcaccatgctcggccgggcgctcggcgcggtgaccggcaagcgcgcggagatggtcggcggggtggtgctgatcctggtcggcgcgaccattctctacgagcatctcagcgcggcgtgagcggcgccggagatggaggcgggacaggtcgcggcgagtgggtgggcgttcgcttcaggcgctttcccaatcgcggatcgccgtcagcagcgcctcgccgtcggcgaactcgcggtccgccggcggcagcgccggacgcgccaggaccagcaccggcaggcccatttcccgcgccacctggagcttcggctcggtggcctggctaccgctgttcttgctcaccagcacgtcgcaggcgaggcgctcgaacaacgcccgttcgccatccaggctga

SEQ ID NO: 2181 - DNA, 945 bp, Pseudomonas aeruginosa
cgcggtgctggcaccgagcgcggcggcccagccggccaattgcggcaggtcgatgctggaatggcggctgtgcaggtcgaggtggccgccggcgagcttgctgatcttgccgaagccgccgcacaggctgagcttttccaccggcgccctgcgcaggtgcttgagcaccgcgccggcgaagtcgcccatctcgatcagggcgatctccggcagcgcatagcgccggcgcatggcgtcctcgctggcgttgccggtacaggcggcgatgtgacggacgccgttggcgcgagcgacatcgatgccctgatggatcgaggcgatataggccgagcaggagaacggccggacgatgccgctggtgccgaggatcgacagcccgccgaggatgcccaggcgcgggttcatggtcttcagcgccagctcggcgccgccctccacgccgatggcgacctcgaagccgccggcgtagccccgttcggcggcgagctgggcgaggtggcgttcgatcatctgtcgcggcaccggattgatcgccggctcgccgaccgccagggtcagccccgggcgggtcaccgtaccgaccccggggccggcatggaagcgcacgccaggctcggcgctcaggcgcacccgggcgaacaccagggcgccatgggtgacgtcgggatcgtcgccggcatccttgagggtgccggcttccgcgccgttttcccaggcgcggcagaattccaggcgcatcagcacctgctggcccttgggcaggacgatctgcaccgcgtcgctgatcgtgccgcccagcagcaggcgcgccgccgccaggctggtggcggtggcgcaactgccggtggtgtatccgctgcgcaacggcgcgggctgctcgggggtttcctcacgcatcgcggggaggcttcctggcggcgggcttgcgcaattccagcagggtga

SEQ ID NO: 2182 - DNA, 1557 bp, Pseudomonas aeruginosa
acaagaacgctgtgccgaacgatccgcagagcccgttcgtcacctccggcatccgcatcggcaccccggccatcaccacccgcgggctgcaggaagcgcagagccgcgaactggccggctggatctgcgacatcctcgaccacctcggcgatgccgacgtggaagccaaggtcgccacccaggtcgccggtctctgcgcggacttcccggtctatcgctgagccccccgaagacggtcggggagcccgacgcgccccggcccaaccctctccgcgggagagggagcaacagttcaggagcatccacatgcaacgctactccggcttcggcctgttaaagcattcactgagccatcacgagaactggcaacgcatgtggcgcacgcccacgccgaagccggtctacgacgtggtcatcgtcggcggcggcgggcacggcctggccaccgcctactacctggccaaggaacacggcatcagcaacgtggcggtagtcgagaaaggttggctgggcggcggcaacaccgcgcgcaacaccaccatcgtgcgctccaactacctgtgggacgagtccgcgctgctctacgaacacgcgatgaagctgtgggagggcctgtcccaggacctcaactacaacgtgatgttctcccagcgcggggtctacaacctctgccacaccctccaggacatgcgcgacggcgagcgccgggtcagcgccaaccgcctcaacggcgtcgacggcgaattgttgaacgcgcagcaggtggcggaggagattccctacctggactgcagcaagaacacccgctacccgatcatgggcgcgaccatccagcgtcgcggcggcgtcgcccgccatgacgcggtggcctggggcttcgcccgcgccgccgatgccctcggcgtggacctgatccagcagaccgaagtcaccggcttccgcaagcaggacggcgcggtgatcggcgtcgagaccaaccgcggcttcatcggcgcgcgtcgtgtcggggtggtcaccgccggcaactccgggcacatggccaggctcgccggcttccgcctgccgctggagtcgcacccgttgcaggcgctggtctccgagccgctgaagccgatcatcgacagcgtgatcatgtccaacgccgtgcatggctacatcagccagtcggacaagggcgacctggtcatcggcgccggcatcgacggctacaacggctacggccagcgcggctcgtacccggtgatcgagcacaccctgcaagccatcgtcgagatgttcccggtgctctcgcgggtacgcatgaaccgccagtggggcggcatcgtcgacaccaccccggacgcctgcccgatcatcggcaagactccggtgcagaacctgttcttcaactgcggctggggcaccggcggcttcaaggccactcccggctccggaaacgtcttcgccgccaccctggccaagggcgaaccgcatccgctggccgcgcccttctccatcgaacgcttccacagcggtgcgctgatcgacgagcacggcgcggcggcagtggcgcactga

SEQ ID NO: 2183 - DNA, 414 bp, Pseudomonas aeruginosa
caaaagccgcccgaagggcgaaatccgctgcccctcgcccttcagggagagggtgccggtcaaccggcaagaacagtttccggaggctacaaaatgctgaatatcttctgcccccactgcggcgaactgcgttccgaagaggaattccacgccaagggtcaggcccacatcccgcgcccgctcgacccgaacgcctgcagcgacgaggaatggggcgactacatgttcttccgcgacaacccgcgcggcctccatcacgagctgtgggtgcacgccgccggctgccgcaagtacttcaacgtcacccgccatacggtgacctacgagatcctcgagacctacctgatcggcgagcagcccagcgtcgtcgccgacggtgagaagaaacccgccgtacaaggggaaccggcatga

SEQ ID NO: 2184 - DNA, 540 bp, Pseudomonas aeruginosa
ttctcgccgacgagcaggaagagttcggcggcagcctgctggacacccgcgagaccctcgacggcaagcccgccgccgagtgggtcgcggacgccgtggccgagctgcaaggcctgccggaagtcatcctgctaccgcgctccacggtcaacggctaccacgaccacaacttcctcaccatccacgagcggcgcaccgaccacctcggcgaggtcgccccgctcggccaggtccgccagcgcgtgcaccgcgtgcgcgccaagcgcgtggtactggccgccggcgcccatgagcggccgctggtctacggcaacaacgacctgcccggcaacatgctcgccggcgcggtttccacctatgtacggcgctacggcgtggcaccgggcaagaaactggtgctggccaccaacaacgactacgcctaccgcgtcgccctcgactggcaggaagccggcctgcaagtggtggccatcgccgacgcccgggccaatccgcgcggcgagtggatcgaggaagcacgccaacgcggtatgcgggtga

SEQ ID NO: 2185 - DNA, 408 bp, Pseudomonas aeruginosa
acggcgtgttcgggctcgccgaggtgctcgccgacggctaccaggccgggagtcgcgccgccctcgacgccggctacaagaccaccgccggcagcctgccgaaggtccagccgcgccgcgaggaagcgtccgtcgcgctgttccaggtgccccacgagaagcccacggcacgcgcaccgaagcagttcgtcgatccgcagaacgacgtcaccgccgccgccatcgaactggcctgccgcgagggcttcgagtccatcgagcacgtcaagcgctacaccgcgctgggcttcggcaccgaccagggcaagctgggcaacatcaacggcctggcgatcgccgcgcgggcccagggcaagagcatcgccgacaccggcaccaccatgttccgtccgaactacaccccggtga

SEQ ID NO: 2186 - DNA, 915 bp, Pseudomonas aeruginosa
cggcatgagcagccttcccctctccccgagaggggataccggacccggagcctcgcgatgagccgtacccccgacacctggatcctcaccgccgacagtcccagcctgctgggcaccgtcgacgtggtgacgcgctacctcttcgagcagcgctgctacgtcaccgagcaccactcgttcgacgaccgcctggcgcaacgcttcttcatccgcgtggagttccgcgccggcgacggcttcgacgaagcctccttccgcgccggactggccgaacgggtggcaccgttcggcatgcgtaccgagctgaccgcgccgggctaccgcagccaggtggcgatcatggtttccaaggccgaccactgcctgaacgacctgctctaccgccagcgcatcggccagttgccgatggacgtggtggcggtgatttccaatcacccggacctggagccgctggcgcgctggcacggcattccctaccaccacttcccgctcgacccgaacgacaagccggcccaggaagccagggtctggcaggtgctcgaagagagtggcgccgagctggtgatcctcgctcgctacatgcaggtgctgtcgccggaactgtgccggcgcctggacggctgggcgatcaacatccatcactccctgctgcccggcttcaagggcgccaagccgtaccaccaggcctaccagaagggcgtgaagctggtcggcgccaccgcccactacatcaacaacgacctcgacgaagggccgatcatcgcccagggcgtcgagacggtcgaccacgcccactaccccgaggacctaatcgccaagggccgcgacatcgagtgcctgaccctggcgcgggcggtgggctaccacatcgagcggagggtattcctcaacgccaatcggaccgtggtgctgtaa

SEQ ID NO: 2187 - DNA, 804 bp, Pseudomonas aeruginosa
cggtcaatccggcgcgtgccggcggcgccctacggctacgtcgacatgggtggctgggtcggcggccaggccgaatacgtggctggtgccatacgccgacttcaacctgctgaaactgcccaaccgcgaagcggcgatggagaagatccgcgacctgacctgcctttcggacatcctccccaccggctaccacggcgcggtcaccgccggcgtcggcccgggcagcacggtctacatcgccggcgccggtccggtcggcctggccgcggcggcctcggcacgcctgctcggcgcggcggtggtgatcgtcggcgacgtcaacccgacccgcctggcccacgccaagaaacagggcttcgagatcgccgacctgtccaaggacaccccgctgcacgaacagatcgccgctctactgggcgagccggaggtcgactgcgcggtcgatgcggtcggtttcgaggcgcgcggccacggccattcgggctcgcagcaggaagccccggccaccgtgctcaactcgctgatgggcatcacccgggtcgccggcaagatcggcatccccggcctgtacgtcaccgaagacccgggcgcggtggacgcggccgccaagcacggcgccctgagcatccgcttcggcctgggctgggccaagtcgcacagcttccataccggccagaccccggtgatgaagtacaaccgccagctgatgcaggcgatcatgtgggaccggatcaagatcgccgacatcgtcggggtggaagtcatcaccctcgacgatgcgccgaaaggctacggcgagtttga

SEQ ID NO: 2188 - DNA, 966 bp, Pseudomonas aeruginosa
aatggatcggtgatactgctgccatccattcgcctcccggagaccgccatgaacaccgatagcccgatcaaccgcgtcgaacaggtacaggtcgacgacctggcctgctggcgcatccacaccgcccatggcgaggcgctgatcgcccagcagggcgcgcaactgctcagctaccagccccacgaacagccgccgctggtctggctcagcgacgaggccggctaccggcgcgggcagtcggtacgcggcggggtgccggtgtgctggccgtggttcggtccgctggagcgcaacccgcaggaagtccgcggccaggtggaagatggcctgaaggcgcccgcccacgggctggtccgggcggtcgactgggaaatcgacgacatcgccgaggaggacggcgacctctgcgtcagcttccgtctcgacgcccccgatggcctccccggctggccgcacccggcggcgctgcgcatgctgttccgcttcggcgagcgcctgaccctgcgactcaccagcgagaacctcggcagcaagccgctggtgctcagccaggcactgcacacctacttcgcggtcagcgacagccgcgagatcgccatcgagggcctggaaggcgcgcgctacatcgagaccctggagaactgggaagaacgcactcagcacggcgcggtacgggtcaagggcgaactggatcgcatctacctcggtctcgaacgcgacctgctgatcaaggacccgcgctgggaacgcagcatccacctgcacgccctcgactcgcgctcggcggtggtctggaacccctgggtggacaagtcccggcgtctctcgcagttcgccgacgacgcctggcagcagatgctctgcatcgagaccgggcgggtctgggacgacctcatggtggtcgcccccgggcgcagcgaaagctttggcgtgcagatctggagcgagccgctgaaacgaccctga

SEQ ID NO: 2189 - DNA, 2070 bp, Pseudomonas aeruginosa
tcccatgacagtccctccttacgggtgtatgcgcatgtattgcgcctgccatgggacagtgtagaaaagccttgggttcagtgccgcccgccaacccaaggatgggcgggcggcaatcgctcacgcctcgatcagcgcctcgacctcggcgatgcgcgcctgcagcgtcgcccggtcggcacaacgcagggtggcgtggccgaccttgcggccgttcttgaaggccttgccgtagtgatgcaggtggcagtcggcgacggcgaccacctgagccaccggggggaccgcgccgatgaaattgagcatcgcgctctcgccgaccttggcggtcgagcccagcggcaggccggcgacggcgcgcaagtggttctcgaactggctgcactcggcgccttcgatggtccagtgcccggagttgtgcacgcgcggggcgatctcgttggccttcaggccgccgtccacctcgaagaactcgaaggccagcacgccgacgtagtcgagccgggccagcacgcggccgacgtagtcctcggccagcgcctgcaacggatgcccgctgctggccacggagagcttgaggatgccgctgtcgtgggtgttgtgcaccagcgggtagaaacgcgtctcgccatcgcgagcgcgcaccgccaccagcgagacttccccggtgaacggcacgaagccctcgaggatgcacggcacgctgcccagttcggcgaacgcgccctgcacgtcggccggctggcgcaggaccttctggcccttgccgtcgtagcccagggtgcgggtcttgagcaccgccggcaggccgatggcggctgcggcggcatcgaggtcggcctgggactggacgtcggcgaagtccggagtgggaatgccgaggtccttgaacatcgacttctcgaaccagcggtcgcgggcgatgcgcagcgactcggcgttcgggtagaccggcacgaactgggagaggaaggccacggtttccgccggcacgctctcgaactcgaaggtcaccaggtcgacctcgtcggccagttgccgcaggtgctcctggtcgccgtagtcggcgcggatgtgctcgcccagggaggccgcgcaggcgtccggcgccgggtcgaggaaagcgaagttcatgcccagcggggttcccgccagggccagcatgcggcccagctggccgccaccgatgacaccgattttcatggttcgagccttaccttctcagagcctgtctcacgcatcgcgcgggtcgggattgtccagcacggtttcggtctggttggcgcggaactgcttcagcgcctcgtggtactgcgggtgcttggcgccgaggatgctcgccgagagcagcgccgcgttgaccgcgccggccttgccgatggccagggtggcgaccggtacgccggcgggcatctgcacgatggagagcagcgagtcgacacccgacagcatcgacgactgtaccggcacgccgagtaccggcaggtgggtcttggccgcgcacatgcccggcaggtgggcggcgccgccagcgccggcgatgatcacttcgaggccgcggccttcggcttcctcggcgtactggaagagcaggtccggggtgcggtgggcggaaaccaccttcacttcgtaggggatgcccagcttgtccagcatgtccgcggtgtgactgagggtgctccagtccgatttggaacccatgatcacgccaaccagtgcgctcatcgtcgtgcctctctcaaatgcgccgtccggcgcgtcagaaaccaacaagccacgcttcgtcgaggggcgtggcttgtactgggccgagccggcgggcagtgccggttcgaaggcggcgcagtataccgcaaaggcaggccgggcgcgcgccgggggctaccgtccgtcccgttttttcgcgccatggcgggaaacttgccgcaactcaatgcgcgcctgccacgagcggccagactggttgtcgcggcgcgctccgagggagcggcggccgcgccggttccgcagcctgtcgcggtgcccgtcaaaggcaccgcgacaggcgctcagccccgtccaaggagatga

SEQ ID NO: 2190 - DNA, 651 bp, Pseudomonas aeruginosa
cggtcaacgcccggcaggaagacccggtggaggcgatccagcgcgacatcggcggcgcccacggggtgctggtcaccgcggtatccaacagcgccttcggccaggccatcggcatggcccgccgcggcggcaccattgccctggtcggcctgccgccgggtgacttcccgacgccgatcttcgacgtggtgctcaagggcctgcacatcgccggctccatcgtcggcacccgcgcggacctgcaggaagccctcgactttgccggcgaaggcctggtcaaggcgaccatccatccgggcaagctggacgacatcaaccagatcctcgaccagatgcgcgccgggcagatcgaggggcgcatcgtcctcgagatgtgacctgcggggcggcgtcccggcgccgcccttgcctgtctactcgacgctgcccagcccgccttccagcttgcgccagagcaggcggatcgccgccttgcgcaccagcgcgcagcggtacaggcggatttcctgcggcacgaaccattgcggcccgccacagatcgccagttcgccgcgctccagttcgttgaccacgctcagccgtggcacccaggccacgcccatgccttgcagcgccatgctcttcaggctgtcggccatcgccgtctcgtag

SEQ ID NO: 2191 - DNA, 918 bp, Pseudomonas aeruginosa
gtacaagtacctgcacccgaacaacgatgtgaacatggcgcagtcgaccaacgacgcctacccgaccgccatccgcctgggcctgctgctcggccacgacaccctgctggccagcctcgacagcctgatccaggccttcgccgccaagggcgtcgaattcgccggcgtactgaagatgggccgcacccaattgcaggacgccgtgccgatgaccctcggccaggaattccacgctttcgccaccaccctcggcgaagacctcgatcgcctgcgtcgcctggcgccggagctgctcaccgaagtgaacctcggcggcaccgccatcggcaccggcatcaacgccgaccccggctaccagaagctcgccgtcgagcgcctggccgccatcagcgggcagccgctgaaaccggccgccgacctgatcgaagccacctccgacatgggcgccttcgtgctgttctccggcatgctcaagcgcaccgcggtcaagctgtcgaagatctgcaacgacctgcgcctgctctccagcggcccgcgcaccggcatcaacgagatcaacctgccgccgcgccagccgggcagttcgatcatgccgggcaaggtcaacccggtgatcccggaagcggtcaaccaggtcgccttcgaagtgatcggcaacgacctcgccctgaccctggcggccgaaggcggccagttgcaactgaacgtgatggagccgctgatcgcctacaagatcttcgactcgatccgcctgctgcaacgcgccatggacatgctccgcgaacactgcatcaccggcatcaccgccaacgtcgagcgctgccacgaactggtcgagcacagcatcggcctggtcaccgcgctgaacccgtacatcggctacgagaactccacgcggatcgccaagaccgcccttga

SEQ ID NO: 2192 - DNA, 486 bp, Pseudomonas aeruginosa
tctggaggcacctttacccggacatggaaccgagccatgagcacgtccctgcagattcgtcccgtcggcgccggcgaccacgccgcctggctgccgctgtgggagggctaccagcgcttctacaagaccgagatcgccgccgctaccagcgacgccacctggcagcgcttcctcgacgccgacgaaccgatgaacgccgccctcgcctggctcgacgagcgcgccgtgggcctggtgcactggatctaccaccgctcctgctggaccgtcggcgactactgctacctgcaggacctgttcgtcgccgagggcctgcgcggcgaaggcatagggcgccggctgatcgagcatgtctacgccgaggccggcgccgctggctgttcgcgggtgcactggctgacccacgagagcaacagcgacgcgatgaagctgtacgagcgcatcgccgacaagtccggtttccttcagtaccgcaggattctctga

SEQ ID NO: 2193 - DNA, 894 bp, Pseudomonas aeruginosa
actggcgccccgtcgccactccaccccacgccccgctcgacggccgcttcgtcaagctcgaaccgctcgatccgcaacgccacggcgacgacctgtgggacgccctgcaagggcctggcgccgacccgttgctgtgggaatacctggcctacggcccgttcgccgagcgcccggcgttcgacgcctggctggccggccaggcggccagccgcgacccgctgttcttcgccgtgcgcgagcggcgcacgcagcgcgccgtcggcctgctcagctacctgcggatcacgccgaaggatggcgtcatcgaaatcggccatatcgccttcggcgcgcctatgcagcgcacaccggggtctaccgaggcggtctacctgctcgccgaactcgccctcggccgcctcggctaccgccgcctggagtggaagtgcaatgccggcaacgcccgttcgatgcgcgccgccgagcgcctgggcttcacctacgaaggcaccttccgccagcacatggtggtcaagcagcgcaaccgcgacaccgcctggttctccctgctcgacagcgaatggccggcgcgacaggcggcgttcgagcgctggctcgatccttccaacttcgacgccgaaggccgccagcggcagacgctggaggcgctgcgcgactagcccctggcagggactgccggtcgctcaacggtactccggcagccagtgcaggctggccaggatgtgcgcgaccgcgttggccacgccgaacagcagcaccagcacgatcgccggcgtgccgccccaggcgcggaacagcgggctgccgaagcgcttgcgcgaggcccgcgccatcagcgccggaacgatcaccgcccagaacgccgcggccagcccggcgaaaccgatggcgtag

SEQ ID NO: 2194 - DNA, 477 bp, Pseudomonas aeruginosa
tcagcgcctgcggcgcgacgcgccgttgggcagaggcggcattctaggcggcgcgcgcgccgggcgcaccctggcagggcgaacagccggccgacgcggcaaccgatgccgataaaaaaaggggagcatcatgctcccccagggactttaaccgtctgtcgcggtcagcccgcaatctcgatcaggatctcgcccgggttgacccggtcgcccttggccacgtggatcgccttgaccgtaccggcgatgccggcctggacctcggtttccatcttcatcgcctcggtgatcaacaccgcctggccggccttgacgctatcgccttccttcaccagcacgtcgacgatgttgcccggcatggtggtgctgacgtggcccggctcgctggcatgcttgcggccgctggcggagccggcgacatattcgttgagcggctcgaacaccacttcttccggcatgccgtcgatggacaggtag

SEQ ID NO: 2195 - DNA, 1005 bp, Pseudomonas aeruginosa
ccattagaaaagctttatagtcgcccgaccgatctcggtcagagtgtgactggaatgcgtaagtcgttgatgcgtatgacattacggcagcttcaggtttttcgtgccgtatgcgagagccgctcctacagccgggcggcggaggaaatggccctgacccagccggcggtcagcctgcagatccgccaactggaagagctggtcggccagccgctgttcgagtacgtcggcaagaagctctacctgaccgatgccgccgaagccctgctgaagaccagcaccgacctgttccagcgcctggaaagcctggacatgcagctctcggacctgaagggctcgctgcagggccagttgcgcctggcggtggagtccagcgccaagtacatcaccccgcacctgttcaaggcgttccagaacctgcatccggaagtcagcctgagcctgacggtggtcaaccgcacccaggtgatcaagcgcctggccgacaaccgcgacgacctggtgatcatgtccctggtaccgcaggacatggccctggagttcctgcccttcctgaacaacccgatcatcgccgtggcgccgccggaccatccgctgtgcaacgccgcgaagctggccctgaaggacctggagcccttcccgctactggtccgcgaaccgggctccggcacccgcaaggcttgcgaggagttcttccagcaacgccgcgcgcacttctcgcagatccaggagatcgcctcgctggagtccctgcgcgaaggggtgatcgccggcctcggcctggccctgctgccgcgccatgcggcgcaccaggaactggccaacggcctgctgcgcgaactaccggtggaggaattgccgctctatcgcagctggtgcctggtgcacgccaagggcaagcgcctgagcccggtggcccaggcgttcgtcgccttcgtccgcgaggagcgggcgctgatcagccagctcgctgggcgcttcgccggccctggcggttcgagctga

SEQ ID NO: 2196 - DNA, 1518 bp, Pseudomonas aeruginosa
ttatactacaaacagtcagccacgcccagccaacgccgtcgggagcttgccttgagtacaccagccactccaacgtcctgcgacatcctggtcttcggcggtaccggcgacctggccctgcacaagctgctgccggcgctctatcgcctgcaccgggaggaccgcctgccggccgatacgcggatcttcgccctcgcccgcagcgcgctggacaacgccgccttcctcgccctcgccgagcgcaacgtccgcgcggtggtggcgcgcagcgagttcgccgccgaacaatggaaaggcttcgccgcgcgcctcgactacctggccatggacgcctcgcagagcgccgacttcggccgtctcgcgcggcacctgaagagcagcgagggccgggtgctggtgcactacctggcgacctcgccgagcctgttcgcgccgatcgcgcagaacctctccatcgccggcctcgccgggccgcaagcgcgcatcgtgctggaaaaaccgctgggccattcgctggactcggcgagggcgatcaaccagtccatcggccgggtgttcgacgagtcgcgggtgttccgcatcgaccactacctgggcaaggaaaccgtgcagaacctgatggccctgcgcttcgccaatgcgttgttcgagccggtctggcgcgcggcgcacatcgaccatgtgcagatcagcgtcaacgagacccttggcgtggagaaccgtggcggctactacgaccacgccggggcgatgcgcgacatggtgcagaaccatctgctccagttgctctgcctggtggcgatggaggcgccggtgcgtttcgacgccgaggctgtgcgcaacgagaagctcaaggtgctgcaggcgctgaagccgatctccgggctcgacgtgcaggacaagacggtacgcggccagtacgccgccggcaggatcggcggccaggaggtgccggcgtactacttcgagaagaacgtcgacaacgacagcgataccgagaccttcgtcgcgctccaggccgaggtcgagaactggcgctgggccggggtgccgttctacctgcgcaccggcaagcgcatggcgcgcaagtgctcggaaatcgtcatccagttcaagccggtgccgcacagcctgatcgacggcggcggcgggccggccaaccgcctgtggataaggttgcagccggaggagcggatcagcgtgcaactgatggccaagaccccgggcaagggcatgcaactggaaccggtggagctggacctcaacctggccgaggccctcagccgcaacaagcggcgctgggacgcctacgagcgcctgctgctggacgtgatcgagggcgactcgacgctgttcatgcgccgcgacgaggtagaggccgcctggggctgggtcgacccgatcctcgccggctggcgcgagcactaccagagcccgcggccctacccggccggcagcaacggcccggaacaggcgcaactgctgctggaactgcagggtcgacgctggctggaatga

SEQ ID NO: 2197 - DNA, 1971 bp, Pseudomonas aeruginosa
tctgtccctgcaggatgtacagcgtctcggcccgcgccagcaccggctgcggcgcgacgccgctccacagccagaaggcgccgtagtcctcggcgcgcaccgcggcctcgacggacggcaacagcggcaggcccagcaacaggcccgccagccaggctcgccagcgcctcaccagtagtacttcagttccttggcccaggagctgtcggcgtaggtcgacttgagcgtacggaaccattgcttgcgctcggcctgcgggatgtcctgctggccgcaggtgttgtagccggccggggcgaagcagttgatcgcgcggaacagcgcgtaggccttgtcttcgcgcggagccttggggttgtccatgaccaggcgatagccatccagccgggagtacacctcgcccttgaagccgctcggggtgccgcccagctcgttggcctcgggctggctgtccagcggcatgccgtcgagaccgttgcgcaggatgaattcgcccaggcagttcaggcccttcgggtccttgtcatcggcggccagcgccgcggccgactcggcgatggccgggcaaacgtagccggactcggccttgtcgctcttccagcggaacagctccaggctgttaccggcgccgtagacatagccgaggctggtgcccagcttggtctgcgagggggtttcgccgagcagcgcgaagtccttgccgaagtcggcgaagcggctgcggcgcaggtccttgtaaaggagagtgaacagcgcggtatcgcgctcttccgccgtcgcgccctgcttggcctggcggcgcaacagcgcggcgtcggcgacgttgcgcaggaggatgctgcgcagcagcggctcctggaccggcgaaccttcggcgaagaccttttccaactggccgctgcgctcgtagttgagcgccagggccagctgcaactggcccttctggtacggctgcgcggcctgcggcaacagttccagccagagcgcctcggcggctttccagtccttctgctgctccagcgccagcccgcgcagggtctgctggctgaagccgacgtagtcgaggctgccgaccttttgcggcagcgcttcgagggtcttcgccgggtcctggtcgacatagaagcgataggccgcctgcaggtaggcgaacagttcgggatgcgcggcgaagctggcctgttgggcctgcagcgtttcccaggtgaagctgcgcggggtcgacggatcgtgggcgcgcatctgcaccaggtcggccaccgccagcagcagcggagtctggatgtcgccgagctggataccggtcaggagcttgttgtcgacctcctggaccaggtcttccagggccatgttgcgctgcccttgctcggcttcggcgaattgcgcggcatagtcctgggccagcagcttctggtcgccggccagccaatgcacgcgccgttgcaagcccttggccgaggcggcgtagagccccttcggatacgcctgcaggtaggcctcgagggcgctgcgggtctgttccaggcgagccttgtcgacattctgcagctcggggaagcccatgtcgtcgaaggcgttctgctgggcggcgttgagcagggtgcgcgcctgcaggtacagggcggtttccttcagccagggctgcgacacgtcctgcaacgccttgaagccctgttcggcttcgtcgaagcgaccgctgtagaagttggccgcagcctccaggtacgtggcgaaggccttgcctgcggccgactcgacgccttgcgcgagcacaccgcccagttcctcttgttcccagccgcaggcaccgagcaggtccaggcggctgttggccagggccttggtctccgcctcgcccagcccggcgtcacgcacctggcgaagaaacgccagcgcgctgtcctggtcgttgctgcggcagcggctgccctcgccctcgaagaattcggcgccggcgatcttttccggtag

SEQ ID NO: 2198 - DNA, 2196 bp, Pseudomonas aeruginosa
aatgccgcgatgaacgacgacctctccctcctgctgaactccctcaacgacccgcagcgccaggccgtggccgcgccgctgggccgccaactggtcctcgccggcgccggctcgggcaagacccgcgtgctggtgcaccggatcgcctggctgatccaggtcgagcacgcctcgccctacagcatcctgtcggtgaccttcaccaacaaggcggcggcggagatgcgccaccgcatcgagcagttgctcgggatcaatccggcgggcatgtgggtcggcaccttccacggcctcgcccatcgcctgctgcgcgcgcactggcgcgaggccgggctgagcgagaacttccagatcctcgacagcgacgaccagcaacgcctggtcaagcgggtgatccgcgaactcggcctcgacgagcagcgctggccggcgcgccaggcccagtggttcatcaacgggcagaaggacgagggcctgcggccgcaacacatccagcccggcggcgacctgttcctcgccaccatgctgaagatctacgaagcctacgaggcggcctgcgcccgcgccggggtgatcgacttctccgagctgctgctgcgcgccctggacctctggcgcgaccatcccggcgtgctcgagcactaccagcggcgcttccgccatatcctggtggacgagttccaggacaccaacgccgtgcagtacgcctggctacggattctcgccaagggcggcgacagcctgatggtggtcggcgacgacgaccagtcgatctacggctggcgtggcgcacggatcgagaacatccagcagttcagcgacgacttcgccgacgccgaggtgatccgcctggagcagaactaccgttccaccgcgtcgatcctcaaggccgccaacgccctgatcgccaacaaccagggacgcctgggcaaggagttgtggaccgacggcgaggacggcgagtcgctgagcctgtacgccgcgttcaacgagcacgacgaggcgcgctacgtggtcgagtcgatcgagagcgcgctcaagggcggcctggcgcgcagcgagatcgccatcctctaccgctccaacgcccagtcgcgggtgctggaggaagccctgctgcgggagaagattccctaccgcatctacggcggccagcgcttcttcgagcgtgccgagatcaagaacgccatggcctacctgcgcctgctcgacggccgcggcaacgacgcggcgctggaacgggtggtcaacgtgccggcacgcggcatcggcgagaagaccgtggagagcatccgcgaattcgcccgcggcaacgatgtgtcgatgtgggaggcgatccgcctgatgatcgccaacaaggtcctgcccggccgcgccgccagcgccctgaccggcttcgtcgagctgatcgagaatctttcggcgaaggtcatggacatgccgctgcacctgatgacccagacggtgatcgagcagtccggactgatcagctaccacaaggaagaaaaaggcgagaaaggccaggcccgggtggagaacctcgaggaactggtcagcgccgcccgcgccttcgagaacagcgaggaagaggaagacctcaccccgctgcaggccttcctcagccacgcctccctggaggccggggaaacccaggccgacgcccacgaggacagtgtccagctgatgaccctgcacagcgccaagggcctggagttcccgctggtgttcctggtcggcatggaggaagggctgttcccgcacaagatgagcctggaggaatccggccgcctggaagaggaacgccgcctggcctacgtcggcgtcacccgcgccatgcagcgactggtcctgacctacgcggagacccgccggctctacggtagcgagacctacaacaaggtttcgcgcttcatccgcgagatcccgccggcgctgatccaggaagtgcgcctgtccaataccgtcagccgcccctacggcggcacttcgcgcaacgccggcggcagcctgttcagcggcgccggggtgccggagacgcccttctccctcggccagcgggttcgccacgcgctgttcggcgaagggactatcctcaacttcgaaggcgccggcgcccaggcccgggtgcaggtgaacttcgagagcgaaggcagcaagtggctgatgctcggctacgccaagctggaagccctgtag

SEQ ID NO: 2199 - DNA, 1560 bp, Pseudomonas aeruginosa
aggcgaaaaatcgcggaaaccctagactggcgggcccctaataattcgtcgtctgaggttcgttccatgtaccgtgatcgcgtgcgcctgccccccctgctcgacaaggtgatgagtgcggccgaagccgccgacctgatccaggacggcatgaccgtcggcatgagcggtttcacccgcgccggcgaggccaaggccgtaccccaggcgctggccatgcgcgccaaggaacgtccgctgcgtatcagcctgatgaccggcgccagcctcggcaacgacctcgacaagcagctcaccgaggccggcgtgctcgcccggcgcatgccgttccaggtcgacagcaccctgcgcaaggcgatcaacgccggcgaagtgatgttcatcgaccagcacctctcggaaaccgtcgagcagttgcgcaaccaccagctgaagctgccggacatcgccgtcatcgaagccgccgcgatcaccgagcagggccacatcgtgccgaccacctcggtgggcaactcggcgagcttcgcgatcttcgccaagcaggtcatcgtcgagatcaacctggcccacagcaccaacctggaaggcctgcacgacatctatatcccgacctaccggccgacccgcacgccgatcccgctgacccgcgtcgacgaccgcatcggcagcacggcgatcccgatcccgccggagaagatcgtcgccatcgtcatcaacgaccagccggactcgccatccaccgtgctgccgccggacggcgagacccaggccatcgccaaccacctgatcgatttcttcaagcgcgaggtcgacgccgggcgcatgagcaacagcctcggcccgctgcaggccggtatcggcagcatcgccaacgcggtgatgtgcggcctgatcgagtcgccgttcgagaacctgaccatgtactccgaagtgctgcaggactcgaccttcgacctgatcgacgccggcaagctgcgcttcgcctcgggcagctcgatcaccctgtcgccgcggcgcaacgccgacgtgttcggtaacctggagcgctacaaggacaagctggtgctgcgcccgcaggaaatctccaaccaccccgaggtggtccgtcgcctgggcatcatcggcatcaatacggcgctggagttcgacatctacggcaacgtcaactcgacccacgtcggcggcaccaagatgatgaacggcatcggcggctccggcgacttcgcccgcaacgcgcacctggcgatcttcgtcaccaagtcgatcgccaagggcggcaacatttccagcgtggtgccgatggtcagccacgtcgaccacaccgagcacgacgtcgacatcctcgtcaccgagcagggcctcgccgacctgcgcggcctggcgcctcgcgaacgggcccgggtgatcatcgagaactgtgtccacccgtcctaccaggcaccgctgctggactacttcgaggcggcttgcgcgaaaggcggccacacgccgcatctgttgcgcgaggcgctggcctggcacctgaacctggaagaacgcggacacatgctggccggctga

SEQ ID NO: 2200 - DNA, 1449 bp, Pseudomonas aeruginosa
ccttgggatgctcgaacacataggtgcattcgaccaacagacgcgtcatggagtgctctccgcggaagtggggtccagagccgcctcgccggagcggctgatatgggtttcggcgcccagccaggagcaaccgacgaagtcttcctggcggttgttgatgacatggaagaccaggccgtagtcgcgccattcgaagttgcggtccaggtgcgagtccagccgcgacaggctcagcgccaccgagtagtgccccttgcccaggcgcatgtcgaaggcgaagcggtaggtgatgcgctcgccggccttcaggtcggtgagcgccttgtccaggcggtgggtattgatcccgtacatcggctggccgaggcggtccttgatcatgaagccgaggatcagccgctcgatgtcctggcgaacctcgacctcgacttccagcgtcaccgcctggcctacctcgaccacctccagcgcgcgctgccgctggtcgaccatccgtacgtcgaggatcgctgcctcgccggtgccggaaatcgtccgtacctggccgtcggcgagcatttcctggcgcacggtctgcccctcgcgctcggcgagcagggcgttgtagtagtccatcacttcttccggccgcccgcgcatggccatccgtccctgctccaggaggatcgcggagtcgcagatggactggatcgccgagcggtcgtgggaaacgatcagcagggtggtgccggccttgcggaaactgcggatgcgctcgaagctcttgtgctggaaataggcatcgccaaccgacagggcctcgtcgacgatcaggatgtccggccgccgggcagtcgccacgctgaacgccaggcgcatctgcatgccgctggagtaggtgcgcaccggttgctcgatggcctcggcgatttcggcgaaggcctcgatctccggcatcagcgcctggatttcctcgacctgcatgcccagcagttgcccggccatgaagacgttctgccggccggtgaagtccgggtggaagcccatgcccagctcgagcagcgcggcgacccggccggccacgcggatctcgccgcaggtcggctgggtggtgccggcgatcatcttcagcagggtgctcttgccggcgccgttgaccccgacgatgccgaccgcttcgcccggctcgatggtgaactcgacctcgcgcaggatccagtgcaggtggtggcgcggagggctgaaaggcaccagccattcgaacaaccggctccagcgattgggatactgcttgtaggccttgccgaggccggatacgcgtatctgtcccatcagagttcatccaccatttcgccgacccgctggcggaacagacgcaggccgagcgcgcacagcagcagcgccagcagggtgatcggcagcaatgaaggccagtccggccattgcccgtggaggaacagctgctggtag

SEQ ID NO: 2201 - DNA, 996 bp, Pseudomonas aeruginosa
atttcatcctttactcggatatcaacgagcgctcgatcggccacaacctcggtcgccccgaatacagctactacttcgtcctcaaggcctaccggccaatcctcgaatcgctgggacaggtccacctggtacagagcacggacgaagtcgacccgctctaccggcaactgcatgaacagggcgaagactgcctgttcctctccttcaccccgccgcacaaggcggcgcggggcctgcaatgcccgatgctgtgcgtggtcgcctgggagttcgagtcgattcccgacgtggcgtgggacggcgatccggcgcaggactggagccaggtcctggccggccatggcgcagccatcaccctctccgagcagactgcccgcgcggttcgccgggtgctgggcgaagattttccggtactggcgctgccgacgccgatctgggaggacttcgccgcgatccgccagcaaggcgaacggaatccggtcaagtccggcgagaccctgcaactcaagggctgcgtcatcgacagccgcctgctgggcctttccgccgacggcctcatcgcaccgatcagggaagagaccgaggacgagatcctcgaggtcctccccgagacgcccgccgagcccgagcccgaaccggtccctgagccagaaccagagccagagccggttcctctcgactggaggcgccgactggtcatcagcaagcactacctgctgctgtggtaccgggaagccgtcagcgacctggtacccataccggtacgccgctggctgttccgtcacctgcgccggccgctgccgcccccgccaacggcgctggaaacgctgccggagccattgccccaggccatcgagccgatgccgcccgccgagcccgagcatccgccggcgctgttgccggccgtcgaccagcaccagcaggtcgtcgtggacggggtggtctacgtctcggtgttcaatccgctggacgggcgcaagaactggcatcagctga

SEQ ID NO: 2202 - DNA, 597 bp, Pseudomonas aeruginosa
cccgggaacagccggagcgctatcggcaactgtccgccgcggccaaccaacgcatgcgcggctactgcgccggcgacgtggtccgccagcgcctggaacccttcctttccgcccgcaaggcaacccctgcgcccggcgtcgaactggcggccaccgccacaggcaacgttccatgctgatcatcatccactccgaggaccaacaagaccaccatccggcagaacctcgggcgcccggagtacagctattacttcgtcctcaaggaattccgtccgctgctggaagagatcggccaggtggtcgaagtcagcgatcccgacgaactggtggaccgcctctaccacgactgccgcaagcgcggcgaaccctgcgtcttcctctccttctcgccgccccatcgcacgccgatccaccatgcctgcccgaccatcccggtgttcgcctgggagttcagcaccctgcccagcgaaacctggcacggcgaaccgcgccacgactggcgacatgtgctgcgccacagcggacgggccatcacccactccagcttcacggtcgacgtggtgcgcgccgccatgggtcgcgactacccggtactga

SEQ ID NO: 2203 - DNA, 858 bp, Pseudomonas aeruginosa
tcgactacatcgacgccgacaacgccttcatcgtcgactcctcggaagaagccaccgcctggccccacgacccgcgcgcggcctaccgcacgctgcgctacatcaccgactgggagtcgctgtgccgggcctaccgggccagtttcgaggtcgctcgccaggagccggagcgctacgcacgcatgtccgcgcatgccagcgccagcctcgaacgcttctgcagccgcaagctggccgtggagcgcctgcgtcgcttcctcgacgaagcggcacaaggcgaccccgccgccttgcaaagcatcccggcatgatccgcgccctgctccaacgctggcgttcccgtcccgctgcggcgagcgagccggtgtcgccacgcatgtgcggtctgcgcgatgcggtgctggatggctggttccgcagcgaaaccggcgaactgctcgccggcttcgccatcggcgcccaggacaccctgctcgatctcggctgcggcgaaggcgtcgccaccctcttcgccgcccgccagggcgcttcggtgatcttcaccgacagcgaggaggacaaggtgcggagcctggcgcagcaggtcgaggcggtggcccggcggcccttcaccggcctggtcagcgacagcgacccgctgccgctgcgcgacgcctgcgccgacaagctggtgtgcatggaagtgctcgaacacgtggccaacccagcgcgggtgatggccgaactcgtgcgtctcgggcgccctggcgcgcagtacctgctgagcgtgccggacccggtcggcgaacacctgcagcagggcatcgccccggccgactacttccgggcgcccaaccacatccacatcttttcccgtga

SEQ ID NO: 2204 - DNA, 1332 bp, Pseudomonas aeruginosa
gctcggcggcgccgtccgcgaccgtatccagccgccctacccggcgctgatggaagactgggcacggctctgggaaaacctcctggcccgtcccgacggtctggagatcaagcacctgctcgaccatttcatgcccaagagccaggtgatcatcgcgcgcaagccgctcgaccccggatcgtcgcggacatgagcggcaaacgcatcctcgacatcgaactgttgcgcgggctggccgtgctcggcgtggtattccaccatctgcacggcaacctgttcagcggctccccggcactgctggacggcatcaaccagcgcgtccagttctggtggggcgtggacctgttcttcgccatctccggcttcgtcatcgcccgcaccctcatcccgcaactgcgcgaggcgcccacacgccaggcattctgggaacaggcgcggtacttctggatccgccgcgccttccgcctgctgccctcggcctggctgtggctggcgctgatcctggcctgttgcctgctgctgaaccgctccggagccttcggcagcctgtcggccaacctcgcggcgagcctcgccggtttcctccaggtcgccaacttccgcttcgccgacagtttctaccgctacgaatacggtgccagcttcgtctactggagcctttccctggaggaacagttctacctcctgctgccgctgctgatcctctgcctgcgtcgctacctgggctgggccctcctggcgctggtgctggtccagttcttcagcctgcgcacgccgctgctgatggtattgcgcaccgacgccctggccatcggcgtactactcgccctcgcctccctgcagcctggctatgcccgctggaaccccaccctgctgggccgcgcctggagcgggccgttgctgctggccgccgtggccgcggccctgggcgtgctggccagcgaagcgtacagcctggtcgccgtgcggatcggcgccatcgcgctattgtgcggactgctggtgtggatagcctcctacgaccgcgactacctgctctccaacgggccgctgaagcgcttgctggtctgggtcggcgcgcgctcctatgcgatctacctgatccacatcccggcgttctatctcagtcgcgaactctgcttccgcctgggctgggacgccggcgagcggcccctgtcgctgctcgccatcagcctggtcctgatcgtcgtactcagcgagctcaactaccgcttcgtcgagagcccctgccgcgacctgggctcccgcctggtcaagcgcctgagcgccgcccgccgcgtcgccaccacttccggagccacctcatgctga

SEQ ID NO: 2205 - DNA, 801 bp, Pseudomonas aeruginosa
acttcctcaagaagatcgtctcgccgcccagccccgccaccgagcccgtcgccgcgccacccgcacccgcgccggtcgacccgtacatgctcgggttgcgcgacgcggtgctcagcggctggttcaaccaggagaccgacgagctgttcagcggctttccgatttccgccgaggacaccgtgctcgacgtggggtgcggcgacggcggcaacgttcatttctgcgccatgcgcggcgctcgcatcatcatcgccgacatcgacgcggaaaagatcgccaggacccgcgagcgcctggccgataccccggcccgcgaactggaatgcctggtcagcgactgcgacccgttgcccctggctgacgccacggccacccgggtggtctccaccgaggtcatcgagcacgtcgacgatccgcggcagttcctcgccgagctggtgcgggtcggccagcccggcgcactctatctgctcagcgtgccgcatcccacgtcggaagacctgcagaaagacttcgccgccgacgaatacttccgcaaacccaaccacatccgcgtgctcggcgaggagcagttcgccgcactggtgcgcgaagccgggctggaaatcctcagccacagccgctacggcttctactggtcgctgtggatgctgctgttctgggaggccaaggtcgatttcggcaatcccgaccatcccctcctcgaacactgggccaggacctggcaggcgctgctcgactcgccgcgcggcccggccatcaagcaggccctggacgccgtggtcgccaagagccaggtga

SEQ ID NO: 2206 - DNA, 546 bp, Pseudomonas aeruginosa
ccagcacgccgttcgagaacaaattgttacgcgatgcccggggcgatgcggccagcttcgtcgccagcgatggcagcatccgtggtgcgcgcctggaagcggcgctgcgctggttgcgtgtcgcgcaccccgagctggcggccagcgatcaggaactggccgaagcaattcttgcccaataggcgatcaccaccgttccggagaacctccatgcgccgtagctccatgcgtcatagccccctgttcgccgccctgctgctggcgctctgcgccacggccgcggaagcacgctcggtggtcgcgaccagcaatatcatcgtccgcgccctcgaccgcagcatcgacttcacttccgacaccaccacttccgtgcgcgacatgaaagtggtcaccgaggcgcgcgacgacgccgccagtttcgtcgccagcgacggcgccattcgcggcgcccagctggaagccgcgatgcggaccctgcgcagccgtctgccggaagcccgggaagcctccgaccaggtacttgccgaagccattctcgccctgtga

SEQ ID NO: 2207 - DNA, 474 bp, Pseudomonas aeruginosa
agctggaccgcgaggaggtcgccagcctggtcgagcgcgccgcgcagagtcactggagctacgacggccagtactacttcatctccaacaattgcgcggtggaaaccctcaagctgctgcgcagcggcatcccccggcgaccgctgcaaagcctggacagcatcaccccctacggcgtgctcgagatgctggagaaccgcaagctggccgatcccagtgtgctcgacgaccccaaggaagccctgcgcctgggctaccgcttcgactccttccgcgaccgctaccaggcgatgttcgacgtgctcaagcagcgcctgcacattccccaggacaaggtcgaggactggctggcgctgccggccagggagcgccagccctggttcgccaaggccgacctgcgcgccagcgcggcgctgctgctgctcgagcaggcctcgctgcggcgccagctgctgctcgcccaggacgagttga

SEQ ID NO: 2208 - DNA, 789 bp, Pseudomonas aeruginosa
ctgaccgagacgagtgaccgcttcatggaatggctgaccagcccggaaatctggattgcgttcttcaccctgaccgccctggagatcgtcctcggcatcgacaacatcatcatgatctcgatcctggtcgggcgcatgccgaagcacctgcagccacgcacccgcttcttcggcctggccctggcgatggtgacgcggatcctgctgttgctgtcgatcacctgggtcatgcgcctgaccgccgacctcttccacctgttcggccagggcatctccggacgcgacctgatcctgttcttcggcggcctgttcctgctctggaaaagcagctcggatatctaccagggcctggaaggcgaggaagaaagcggcgatgaaccgaaggggtcggcgggcggcttcatcggcaccatcatccagatcgcgatcatcgacatcgtcttttccctggactcggtgatcaccgccgtcggcatggtctcccacgtgccggtgatggtcgcggcgatcatcgtcgcggtactggtgatgatgctctgcgccggcgccatcagcgacttcatcgacaagcacccgtcgctgaagatgctcgccctgtcgttcctcatcgtggtcggcacggtgctgatcgccgaagccttcgaagtccatgtgccgaagggctacgtctacttcgccatgggcttctccctggccgtggaggcgctgaacatccgcatgcgcggcgctgccgcgcgcaagcggggcgaagagccagtgaagctgcgcaaggaagtgctcggcgactga

SEQ ID NO: 2209 - DNA, 1887 bp, Pseudomonas aeruginosa
acgctgcctttccatcgtggccgttggcgccgttgtccgggctccgcggcgcaacgcacgcggaacctggcgcgaggttggccattcgtcgtagtgccaggggggccacgccatgctgaaactgctcgacctgctctctgccgtcgccctgctggtgtggggcacgcatatcgtccgcaccggaatcctccgggtctacggcgccgacctgcggcgcatcctcagtcgcagcgtggaaaaacgcccgctggcgttcgccgccggcatcggcgtcaccgccctggtgcaaagcagcaacgccaccgccctgctggccacctccttcgtcgcccagggcctgatggcactggcgccggccctggcgatcatgctcggcgccgatgtcggcaccgcgctgatggcgcgggtgctgaccctcgacctgtcgtggctttcgccattgctgatcttcttcggcgtgattttcttcctcagccgcaaacagacccgcctcggccagctcggccgggtattcatcggcctcggcctgatcatcctggcgctccagctgatcgtcgccgccgccgagccgatgacccaagccaagggcgtcaaggtactgttctccagcctgaccggcgacatcatgctcgacgcgctgaccggcgcgttgttcgccatgatttcctattccagcctggccgccgtgctgcttaccgcgaccctcgccgcgtccaaggtgatctcgctgaaagtcgcgctgtgcctggtggtcggcgccaacctcggcagcggcatcctggccatgctcagcgccaccgcgcaaaacgccgccggtcgccgggtggccctcggcagcctgttgttcaaggtcgccggctgcctgctggtgctgcccctggtggggccgctggcggactggatggatcactggcagttcagcacagccgaactggtgatcgccttccacgtgctctacaacgccgcgcgctgcctcgcctgcctgccgctgaccaacgccatggccagcttctgcacccgtgtgatgcccgaccgtgcccttcccgacgacgtcgcccggccgcgccatctcgaccccgccgccctcgacacgccgagcctggcgctggccaacgcggtgcgcgagaccctgcgcatgggcgacaccgtcgagcagatgctgaacaatctgatgcagatcatccgcggcggcgatccgctgctcggcaaggacatccgcaagctcgacgacgacgtcgacgccctctacaccgcgatcaagctgtatctggcaaggatgccgcgcgaggacctgtccgaacgcgacagccggcgctgggcggagatcatcgagctggcgatcaacctggagcaggccggcgacatcatcgagcacatgctcgccgccgtgcaggacaagaagacctcgcgcagccgctcgttctccgacaccggcctggaagagatcggcaccctgtaccagcagttggtctccaacctgcgcctgggtctctcggtgttcctcaacggcgacctcgacagcgccaagcgcctgcgccgggccaagcagcgcttccgtctgcaggaacggcgctacgcccatgcccatgtcgaccgcctgcaccagcaggtggtacagagcatcgagaccagctcgctgcacctggacctgatcagcgacatgaagcgtctcaactcgctgttctgcgccatcgcctacgccgtgctggacaatccagacgcgccgagcagcgcggccgacgagggcactcggcgggacgaggacgactgggccgacgaagtcgacgacatgacctcggcgccgctggccgagccagcgctcgccgaggagcgagcggaaacgcgccgttcgcgacattagccgttctgcgggtaggttcgtcatga

SEQ ID NO: 2210 - DNA, 690 bp, Pseudomonas aeruginosa
agcatccgctattctcggtattttcagttccaggctcggcccatgcgttcgttgtccaccctgctgctgttctgcctgctctgcccctggtcgtacgccgaccagcgcagcgaggtcgaagccttccagctggaaaacggcatgggcgtgctgctcaagcccaccgagcagcaccggcacgtctcgatccggctggtggtgggggtcggtttcgccgacttctcgtgccgtgaaaagcagctgccgcacctgctcgagcaccttttcttcagcggcctggacggcggcgacgaggccgacctggaagcccgcatgcaggccctcggcggacaatggaacgcctacaccagcgaaggcgacaccaccttcgtcatcgaggcacctgccgccacccagcggcaggtcctagacctgctgctggacaccatcacccgcaccgaactggacgagccgcgcatcgccgccgccaagcgagtgatcgagcgcgaaggcggcggccattactcgcacctgcagcgctggctcgaccgcgagaacctgggccgtggcgccatggaccaactggcggggaaattggccttggcctgttcccagcgggcgccgctggcccaggcttggcgcggagcagctggagcggctgcgcagcgactgttacgtaccgggcaacatgaccctgatcctggtcggtga

SEQ ID NO: 2211 - DNA, 534 bp, Pseudomonas aeruginosa
acgacgcgctgtacgccgacctgcgtgtgcgtcgcggactcacctacgggccatcgaccgatcgccaggtgttcgccaaccagggcttcttcagcctcgacgcggatgtcgagcgcagcgacctacccgccaccgaggccgccctgcgcgagttgctcggcggcatccgccagcatggcctggacccgggtcgtttcaagcgggtgcaattcgccgagcgcgccaggctggcctggagcacccagggcaacgcggcgctggcggactattactggggctcgctggccgactacgaggacggccatttccccaatgaggagcgccgcctggcgaaggtcagcctgcaacaggcgaacgcgctggcgaagcggctgttcgacggcgaaggctacctgcgcatcgaaaagccgctattcgacgacgacatgctctacccattgctgctcgccgccggtctcctggccagcggcctgctctggttcggcctgcgccgccggcgcgcctgaccgggctacagggccaggcggtggatga

SEQ ID NO: 2212 - DNA, 1311 bp, Pseudomonas aeruginosa
aaactcctgtcgaacaatctaaaattgcccgaaaggtgcgaattgaaggggtttgaaaggctgtcgaaagcttcgcgaccatcggtcgggaaagcgacgcctttttccctggtcgacctccagaaaggagagcggagcctctgtcgggcgaaggaaacattcgccacgcggcagctgtccttcgttcatacccaggaaacccggccggggttatgctgcgcgccccggccggctggccgagcagctccgatcgagaacccgctggtccccatgcccaaccaacaacgccccgtcctcaaggcccgcctggagcaactgatcgccctggtcggcggcctgatggcccgctatccacgcaccatcgccctgttcggcttctgttcgggcgtgttcagtttcatcatggtcgaccggcagaagggcttcgcccaggtgctggcgatcatcatgctggtcagctgggtctggttgatcctcgagaacctcctgcgggagaccttcgcccgccgcttcggctgggagatcccggcgccgctgctgcgctacgcgacccaactgatccaccaggaaagcctgttcttcgtcctcccgttctttctcatcaccaccacctggaacagcgggcaggcgctgttcacagggacgctggccgccgcggcgctgatctccatcaccgatccgctctactatcgctggctgtccaggcgtcgttgggtgttcctcgcctaccacaccctgaccctgttcgcggtgttgctgacctcgctgccgatcctgctgcacctgaccaccccggaaagctaccggttgtcgctgggcatcgccgtcgtgctgtccttccccagcctgctcgtgaccttcccgctacagcactggtggcgcggcttcctgcttctcggcctgaccctggcggtgggcctggccggatggttcggccgcacctgggtaccgccggccaccctgtggctgaccgaagtggcggtgagcagccagttcgacgaccagagccgcacgcccggcgacagcctggagcaggtcggcgccgcccagttgcgcagccagggcctgttcgcctataccgcgatcaacgcgccgcgcggcctcgacgagcgcatctatcacgtgtggatgttcaacgggaaggagttcgaccgcatcgccctggatatccacggcggccgcaaggagggctaccgggcctggacccacaagcagaacttccccggtgacccggtcggccactggcaggtgaaggtactcaccgaggccggacagatgatcggcaccctgcgcttcgacgtcacccagtga

SEQ ID NO: 2213 - DNA, 1275 bp, Pseudomonas aeruginosa
cgtcgaagcctggcgacctcaggcgaagaaccagtagcacacggcgatggaggcgatgaccccggccaggtccgcggtcagcgcgcagcccaccgcgtggcgcgcgcgctgcaggccgaccgagccgaaatagacggcgagcacgtagaaggtggtctcggtactgccctgcacggtggcggcgaccagcgccgggaaactgtcgacgccgtgggtctgcatggtctccagcagcatcgcccgcgccgcgctgccggagaacggcttgaccagcgcggtgggcagcgcttcgacgaagcggctgtcccaacccagcccctcgaccgcccagcgtatcccgccgagtaccacttccagcgccccggaggcgcgcaacacgccaaccgcgcaaagcattgcgaccaggtacggcaacaggttcctggcgacgtcgaaaccttccttcgccccctccacgaagctctcgtagaccggcaccttcttcagcgcgccgacgatcaggaacagcacgatcaggctgaacagcgtcaggttgcccagcagcgaggacagctgcgccagcgcggtggccgagagcgtgccgagcaccgccatgaagccggccagcagcaacgcgccggggatcaggtaggccagcaccaccgggtcccacaagcgcaggcgctgcatcagcgccaccgacaacaggccggccagggtcgaggcgctggtggccagggggatcggcaggaataccagggtcggatcggccgcgccctgctgcgcgcggtacatgaagatagtcaccggcagcagggtcagggacgaggcgttgagcaccaggaagaggatctgcgcattgctcgcggtggtgctgctgggattgagctcctgcaacgccttcatcgccttcaggccgatcggcgtggcggcgttgtccagacccaggccattggcggcgaagttcagggtgatcaggccgatcgccggatgccccggcggcacttccggcatcagccggcggaacaacggaccgagcagcaccgccaggcgctccaccagcccggccttctcggcgatgcgcagaaagccgagccagagcgtcagggtgccgaacagcaggaccatcacctcgaccgccagcttggccatggcgaacaggctctccaccatcgccgcgaacaccgtcgcatcgccgccgatcaaccagcgcgccagcgcactcgccgccgccaccaggaaaaaacccaaccacaagccgttcagcattcagaatcccccgcgttgcgcggatga

SEQ ID NO: 2214 - DNA, 693 bp, Pseudomonas aeruginosa
accaggatcaccagcttggccagcggcagcagcgaggcgaagccgaagttggcgacggtcaccgcgatcagggcgaagacaccgataggggcgtacttcatgatcatgtgggtgaccttgaacatggtctcggaaacgccctggcaacaccttcaccagcggctcgcgcaggtcgttgggcaggctcgacaggccgaggccgaacatcaccgagaagaagatgatcggcagcatctcgccacgggcgatggcggcgaagacgttggagggaatcaggttgaggatggtcgcgatgaacgcatggtcatgctgcacttcctgggtggtcttctggtactgggaaatgtccacggtacccagggtgctcatgtcgatgccggtgccgggctggaacaggttggccagcagcaggccgacgacgatggcgacggtggtgacgatctcgaagtagatgatggtcttcaggccgatgcggccaagcttcttcgcgtcgccgacgccggcgatgccgaccaccagcgaggaaatcacgatcggcaccacgatcatcttgatcagacggatgaagatgtcgccggccggttgcagcacgttggcgatccaccaggccttttcggcgctgaaatggttgagcactgcgccgacggcgataccgagtgccagaccgatcacgatctgccaggcgaggcttag

SEQ ID NO: 2215 - DNA, 1155 bp, Pseudomonas aeruginosa
tggcctccagcgcgaccctcgaccaggccgccaagaccctcggtatcgatgcctcgaccctgtaccggaagcgcaagcagtatggcctatgagcatgccgctgccgatgaagctccggacccggttgttcctcagcatttccgcgctgatcaccgtctcgctgttcggcctgctgctcgggctgttcagcgtgatgcagctcggccgcgcccaggaacaacggatgtcgcaccactacgcgaccatcgaggtgagccagcaactgcgccagttgctcggcgaccagctggtcatactgctccgcgaaacccccgacgggcaggccctggagcgctcgcaaaacgacttccgacgagtcctggaacagggccgggcgaataccgtcgacagcgccgagcaggccgccctggatggcgttcgcgacgcctacctgcaactgcaggcgcacaccccggcgctgctcaaggcgcccatggccgacaacgacggcttcagcgaagccttcaataccctgcgcctacgcctgcaggacctgcagcaactggcgctggccggcatcagcgacgccgagaccagcgcccgccaccgtgcctacctggtcgccggcctgcttggcctggtgggcgtcgccatcctgctgatcggtttcgtcaccgcccacagcatcgcccggcgcttcggcgcgccgatcgaaaccctggcgcgggcggcggacaggatcggcgaaggcgatttcgacgtgaccctgccgatgaccaacgtcgccgaggtcggccagttgacccggcgtttcggcctgatggccgaggccctgcggcagtatcgcaagaccagcgtcgaagaggtgctttccggcgagcggcgcctgcaggcggtactcgacagcatcgacgacggcctggtgatcttcgacaaccagggacgcatcgaacacgccaacccggtcgcgatccgccagctgttcgtctccaacgacccccatggcaagcggatcgacgaaatactcagcgatgtcgatgtccaggaggcggtggaaaaggccctgctcggcgaagtccaggacgaggcgatgcccgacctggtggtggacgtcgccggcgagtcgcgcctgctggcctggtcgctgtatccggtcacccatcccggcgggcatag

SEQ ID NO: 2216 - DNA, 1296 bp, Pseudomonas aeruginosa
agctcccacagcggaccgtcgaaggtggtgcgcagggtgatcagcatcgccagcgccgagggcccggccaccgccggggtggccaggggtaccagcagcggctcgccgtcgggcacttcgccgagcagcccttggggcgacgggaagatcaggcgcatggcgatcacgaacaggatgatgccacccgcgatcccggtcgcctcgcgggacaggccgaggccgctgaggatgtgctcgccgagggtgaggaagagcagcagcaggcccagggcgaaagccagctcgcgaaacgccacgcgcaggcggcgcccaggtgcgacgcctttcagcgcggcgaggaacacggcgatgttgccgaaggggtcggtgaccagaaagatcaggacggcgacgccgaacatatccatgggagtttccagagcgggacagccggtcattctaccgggcgggaccattctagcgagccgcggcaacacctgcaggcgagcccgtcccgagtcgtcggaatgtgcgctggtcgcccttcaggccacttccaggcggtcccggccggcgcgcttggctcgatacagcgcctggtcggcacgctcgaaaaccgcttcgccggcctcgttgccttcgaacgcggtgatgccggcggaacaggtgatgctcaggggctcgcccttgaaatggaacggacaggcggcgatcgccgcgcgcagccgttcgagcagttgccggccggcttccagggacgtggccgggagcaggacgacgaactcctcgccgccgaaacgggcgatgaaatcggcctgccgcaaccgtttgcgcaattcgccggcaatgatcttcagcaccttgtccccggccaggtggccgaagtcgtcgttgatccgcttgaagtggtcgatgtccagcaccgccagcagcagatcgccgccgtcccggtgccggcgcgccacttcctgttccaggcgctcgctgagcgccgcgcggttgggcaggccggtcagcggatcggtcagggctttctgtcgctggtcctccaggtggctgtggaacgccttggcatcctgctccatgctgttgacccgctccatcagcgcctgcaggcggccggacacctcctgttcgtgctcggcctgttcgcgctggtgttcgtccatggaggcaagcaggccgttcagccggctgtccaccgccagcttgaggctgttcaggtcggtcgcctgctgcacgctggcctgcaggccactgacctgctcacgcagcgattggtcaaagccgcgcgcgttgtccagcacgtcggtatag

SEQ ID NO: 2217 - DNA, 1080 bp, Pseudomonas aeruginosa
gcctcgtctaccgcctgcccgtcgaggttatccacaggagtggccggagcttcgggcgcgctttcaacgtccgccggcattgcgggcgacggctccgcacccgcttcttccagcgtctcgctaaagctcaggccggccggtagcggcaggctgtcgagccagatttcccgaggctcatccagcaggatctggttcggctcgccacgctcggcgaccccgacccaacccgctggcgcgctttcgatggcggcgaccgtgcaggcgggcaacggctgcggcggaccgcctggcgcctcgtcgtgctcggcgaccggcagggacggcgcggccgccgccggttggatcggtgtattgcttgccgccacaacggacggcaccgatgcgctcggctccgcggtggtttccgactccttgccgccgaacaggcgttgcaacaggctcgggcgaccgtcttcggcatcgccgcccttgcgctcggccagcgcctggcgttgcagcctgctcagctcgctgagcaggatcggaatctcgcgcgactgccgggcgcgctcctcgatatcgcgggcgaactgcttcagcggcttgcgcagttcccgcggcaggtccagggccagcaactgctgggccagttcgccgagagcatcgatgttctgctgggtgcgttgctggcggcgctgttcggagtcgagcacggccttttccaggcgcggaatcaggcccgacaggccggcgtccatgtcgtcgcgacggaggatctcgcgcagctccttcatgcactggtcgaccgccttgtcgctgccttcggccgccagactgctacgcaccaggccgcgacgcagcaggtcgatccgggcatcccagcgccgttgcaggcgctcctgctgctcgatgttctccaggtacttgtctttccagcgctggacgtcgtcgcgactcatggcggactcccggcatccccgcgcacgaccaaggccttgtcgcgcaggttgtccggcaggcgaatctccaccgataccggcagatggtcggagatcggctggtcgagcacgtcgacccgctcgagagcgagatcggaactga

SEQ ID NO: 2218 - DNA, 1215 bp, Pseudomonas aeruginosa
gaatcaggttacgcatcgttcactcctaggcgaggtcagtgccgctctccggccgggttcggcccggtcagttcgaccggggggagcggtcacgggttccagcattgtagcgatggcggacgcaaaaaagggcagccgaggccaccctttttcatacatcttttttgccgtgctacgcagcgatcagtgcagaccctggatgtagctggaaatcgcggcgatgtccttgttcgacagcttggcggcgatggactgcatgatcttggtgtcgccgtcgttggtgcgggtaccttcgcggaagtcggtcagctgcttggccacgtaggtcgcgtgctggccgcccaggtgcgggaaaccggcggttgcgatgccgacgccgctcggggaatggcaaccggtgcaggccggcatgccttcggcgatcttgccgccgcggaacagcgcttcgccctgggccaccaggttcggatcggccatgccgacgctcatcttctggctggcgaagtaggcggcgatgtcggccaggtcctggtcgctgaggttggtcagcagcccggtcatttccagcacggtacgcttgccgtccttgatgtcatgcatctgcttgagcaggtaacgctcgccctggccggccagtttcgggaagttcggcgccgggctgttgccatccgcaccgtgacaggcgccgcacaccgcggctttcgcctggcccgcggcggcatcgccagcggcatgggcaaggccggtcagacccagggtcaacagcagactcacgagaagtttgttcatcagctaatccaattacggctaagggtgaaagatagtgggcttcggctacttcttcaccatccactggatggttgcctggtagtcttcggcactgcagtcggtgcacaggccgcggggcggcatggcgttgaatccgttggtcacatgctggaccagggtcggcatgcccttggccagccgcggctcccaggcggcatggtcgccctttttcggcgccatcggcagctggccgtcgtgacacgcgccacaggtccggttgaacactgcttccgggtcctgcgccgcatgcgccgtaacggccaccgcaacgactgtcgctgcgagcagcagtttcttcatgatcgtcctcatcagggggaacgcccgcgttctaccgcgcggaaaatgctctgtccgttcccgcgcgcgctcgaccctgggggataa

SEQ ID NO: 2219 - DNA, 651 bp, Pseudomonas aeruginosa
cccatgtcagagaagaaccccatcgtcggcctgtgccagaaggccagctttctcatcagtgccgcccaggtcgaccagtgcccccccgacgaaggcctggaagtcgctttcgccgggcgctccaatgccggcaagtcgagcgcgctgaacaccctcactcacgccaacctggcgcgcacctcgaaaaccccgggacgtacccaactgctcaatttcttcgccctggacgactcgcggcgcctggtggacctgcccggctacggctacgcgaaggtgccgatccccctgaagcagcactggcagcgccacctggaagcctacctgagcagccgcgcaagcctggccggggtgttcctgatgatggacatccgccacccgctcaccgacttcgaccgactgatgctggattgggcccaggccagccagctaccgatccatgtactgatgaccaaggccgacaagctggccttcggcgcggccaagaacgccctgctcaaggtacgccgggaagtccagcaaggctggggcgacgtcgccaccctgcaactgttctccgcgcccaagcgccagggcgtcgacgaggcgcaaatggtcctggcgcaatggctgggcctgctggacgaggaacaagaggcgttcgaggaagcctga

SEQ ID NO: 2220 - DNA, 519 bp, Pseudomonas aeruginosa
ctgtcggcaaaacgggaaagttcagcgcaccgcgaaaaacttttccacggcaccctcaccgggcactccggacctgctcgcaaggcccgccacacgggcctcgcaaccgttcatcagtgggcttcgtcccagttcgaaccgacacccgcctcgaccaccagcggtacgtccagggtcgccgctccgctcatcagcgggcggattccctcgcacacctgctcgaccagctcctcgcgcacttccagcaccagttcgtcgtgcacctggaggatcacccgggcatcgaggccgctttcctgcagccagttatccacagcgaccatggcgcgcttcatgatgtccgccgccgtgccctgcatcggcgcgttgatcgcggtgcgctcggcggccttgcgcatggcgccgttcttcgaatggatctccggcaggtacaggcgacggccgaacagggtttcgacgaagccctgctccgcggcctgggcgcgggtccgttccatgtacgccaggacgccggggtag

SEQ ID NO: 2221 - DNA, 678 bp, Pseudomonas aeruginosa
agcacctccaggccgccaccgacaccggtcagcaggcccagcgcggttttctcgccgacacccggaacgccggggatgttgtcgaccttgtcgcccatcagggcgaggaaatcgatgatcagctcaggaccgacgccgaatttctctttcacgccatccacgtcgaggcggctaccggtcatggtgttgaccagcgtaatgtgcccgtcgaccagttgcgccatgtccttgtcgccggtggaaatcaccaccgggcggtcagccgcggcgctgctgcgcgccagggtgccgatcacgtcgtcggcctcgaccccctccacgcacagcagcggcaggccaagggcgcggacgctggcatgcagcggctcgacctggacccgcaggtcgtcgggcatcgacggccggttggccttgtactcggcgaacagctcgtcgcggaaggtcgggcccttggcgtcgaagaccaccgcgaacgggctgtccgggtactgcttgcgcaggctcaggagcatgttcagcacgcccttcaccgcaccggtgggcttgccggtcgaggtggtcagcggcggcagggcatggaaggcgcggtacaggtacgaggaaccgtccaccaggacgaggggcgcttggctcatgaggggaatcaaccttttccggagaccagggcgtgtagaatga

SEQ ID NO: 2222 - DNA, 882 bp, Pseudomonas aeruginosa
catgtcggtgttcaccccactcgaacgctcgaccctggaagccttcctcgccccctacgacctgggccgcctgcgggatttccgtggcatcgccgaaggctccgagaacagcaacttcttcgtcagcctggaacacggcgagttcgtcctgaccctggtcgagcgcggcccggtgcaggacctgccgttcttcatcgaactgctcgacgtgctccacgaggacggcctgccggtgccctacgccctgcgcacccgcgacggcgaggccctgcgccgtctcgaaggcaagccggcgctgctgcaaccgcgcctggccggccgccacgagcggcagccgaacgcccaccactgccaggaagtgggcgatctgctcggccaccttcacgccgccacccgcgggcgcatcctcgaacgcccgagcgaccgtggcctgccctggatgctggaacaaggtgccaacctcgccccgcgactaccggaacaggcccgcgccctgctcgccccggccctggcggagatcgccgcgctggatgccgagcgtccagcgctgccgcgcgccaacctgcatgccgacctgttccgcgacaacgtgctgttcgacggcccgcacctggccggcctgatcgacttctacaacgcctgctccggctggatgctctacgacctggcgatcaccctgaacgactggtgctccaataccgacggcagcctggacccgggccgcgcccgcgccctgctcgccgcctacgccaaccgccggccgttcaccgcgctggaagccgagcactggccgagcatgctgcgggtcgcctgcgtgcgcttctggctgtcgcgactgatcgccgccgaggcgttcgccggacaggacgtgctgatccatga

SEQ ID NO: 2223 - DNA, 531 bp, Pseudomonas aeruginosa
cgtctctaccctcgagcgtcgcagcccatgtacaagattgcgcccaagaccccgctggcctgccagccccatgaccacagccagtgcgtcagcaccgcgctggccgaggccgatgcgctgtgcgcgcgccagggcgtacgcctgaccgaattgcggcggcgcgtgctggagctggtctggcagagccacaagccgctgggggcctacgatatcctcgcggtgctcagcgaaaccgacggccgccgcgccgcgccgccgaccgtctaccgcgcgctggacttcctccaggagaacggcctggtgcaccgcatcgcctcgctcaacgcgttcgtcggctgcaacaacccggagcacagccaccagggccagttcctcatctgccgcacctgccacaccgcgatcgagctggaacagccggatatcagccgggccatcgtcgccggagcgaacagcgtcggcttcgccgttgaaagccagaccgtcgaggtggtcggcctctgcggcacctgccgggaccagaaggacgcctga

SEQ ID NO: 2224 - DNA, 1005 bp, Pseudomonas aeruginosa
accgccatgtctgctgctcagggcaccccgagcaggtcagcggcgacccggccttcgtcgagctgttcggccaggacgctcgcagcctggcgatctaccaccaccatcacgaccacgcccacgacctccacggcgaggtggtcaaggccggtcccggcgccttgcctccaggcacccgcttcactcctgtccacaagcacggccccgactgcaaccatggctgacttcctgctcaacgccctcctcgccggcctcgccctggccctggtggctggccccctgggctccttcgtggtctggcggcggatggcctatttcggcgataccctgtcccacgccgcactgctcggggtagccctgggtttcctcctcgatgtcagcccgaccctggctgtgaccgtcggctgcgtgctgctcgcagtgctgctggtgaccctgcagcagcgccagccgctggccgccgacaccctgctgggcatcctcgcccacagcaccctgtcgctgggcctggtcaccctgagcttcatgaaggaagtgcgggtcgacctgatggcttacctgttcggcgatctgctggcggtaagcgccagcgacctgctgtggataatcgccggcagcgcgctggtcctggcactgatctgcttcctctggcggccgctgctggcgatcaccgtgcacgaggaactggcgaaggtggaaggcctgccggtcggagcgatccgcctggcgctgatgttgctgatcgccatcgtcatcgccgtggcgatgaagatcgtcggcgtactgctgatcacctcgctgctgatcattcccgccgccgccgcccagcgccatgcccgcagtcccgagcagatggcggtcggcgccagcctgctgggactggtcgcggtgtgcgccggcctggccctgtcctggttcaaggatacccccgccggcccctcgatcgtggtcagcgccgccggcctgttcctgctgagttttgtcctgccccgccgcacggtgtag

SEQ ID NO: 2225 - DNA, 333 bp, Pseudomonas aeruginosa
tgtcgtccttctttcgcctgctgtccgtcctggcggcggcgctgctggtcagcgcctgccagggcaatgcgtcgtcgcaaccgacgccggtggtcgcgccccaggcgcagcccgccgatccctatgccgaactgcagcaaaccctggccgccggcaagctcgaacaggccgagcaacaatggctggccctgcgcagcgcagccgccggcgacgagcgcgtcgaagcgttccgccgccagttggccgaggcctacatgcagcgcggggaaaccgcgctgcgtcaaggagacctcaacaccgccaccagcgccctcggccatgcccgcggactga

SEQ ID NO: 2226 - DNA, 1020 bp, Pseudomonas aeruginosa
ctgaccgcccatgcttcccgccaagcccgtgctccagccgtaacagcatcgccgcacccacaaggttcgcccagtgatcgaattccacgacgtccacaagacctatcgagttgccggtcgggaaatccccgccttgcaaccgacccgcctgaacatccaggccgggcagattttcggcctgatcggccattccggtgccggcaagagcaccctgctgcgcctgatcaaccgcctcgaggagcccagcggcggccgcatcctggtcgagggcgaagacgtcaccgccctcgacgccgaaggcctgcgccgtttccgccagcgcgtcgggatgatcttccagcacttcaacctgctgtcctcgaagaccgtcgccgacaacatcgccatgcccctgcgcctggccggcggcttcagccgtgccgaagtcgatgcgcgggtctccgagctgctcgcgcgggtcggcctgtccgaccacgcgcgcaagtatccggcccagctctccggcggacagaaacagcgcgtcggcatcgctcgcgccctggcctgccggccgagcatcctgctctgcgacgaggccaccagcgccctcgatccgcagaccaccgcctcggtcctgcaactgctggcggaaatcaatcgcgagctgaagctgaccatcgtcctcatcacccacgagatggacgtgatccgtcgtgtctgcgaccaggtcgcggtcatggacggcggcgccatcgtcgagcagggcgatgtcgccgatgtcttcctccatccgcagcacccgaccacacgccgcttcgtgttcgaggccgaacgggtcgacgaagacgagcgtcacgacgatttcgcccacgtgccgggtctcatcctgcgcctgaccttccgcggcgaagccacctatgcgccactgctgggcaccgtggctcggcagaccggggtcgactacagcatcctttccggacgcatcgaccgcatcaaggacacgccctacggccagttgaccctggccctggtcggcggtga

SEQ ID NO: 2227 - DNA, 702 bp, Pseudomonas aeruginosa
cgtacatgtggaggtactgcgctgatggacttcttcgaaaccatgagcttcgccaacatcgactggtacgaaatctggctggccagcgtcgacaccttctggatgctcggcggttcgctgctgttcacggtggtcctcggcctgcccctcggcgtcctgctgttccttaccgggccacggcagatgttcgagcagaaggcggtctacaccctgctctcgctagtggtgaacatcctccgttcgttgccgttcatcatcctgctgatcgtgatgatcccgctgaccgtactgatcaccggtacctcgctgggcgtcgccggggccatcccgccgctggtggtgggcgccacgccgttcttcgcgcgcctggtggaaaccgcgctgcgcgaggtcgacaagggcatcatcgaggcaacccaggcgatgggcgccagcacccggcagatcatctggaacgccctgctgccggaagcccggccgggcatcatcgccgccatcaccgtcaccgccatcaccctggtctcgtacaccgcgatggccggagtggtcggcgccggcgggctgggcgacctggcgatccgcttcggctatcagcgcttccagaccgacgtgatggtggtcacggtggtgatgctgctgatcctcgtccagattctgcaaaccgtgggcgacaagctggtggtgcacttctcgcgcaagtaa

SEQ ID NO: 2228 - DNA, 543 bp, Pseudomonas aeruginosa
gttcaacaaggccaagggcaccgacctggtcgccgtgaccggcgtacacatcgagccgctgggcgcctactcgagcaagtacaagaagctcgacgaactgccttccggcgctaccgtggtgatccccaacgacgccaccaacggcggccgcgccctgctcctgctggacaaggccggggtgatcaagctcaaggacaacaagagcatcaccgccacgccgaaggacatcgtcgacaatccgaagaacatcaagatccgcgaactggaagccgcgaccctgccgcgcgtgctgacccaggtcgacatggcgctgatcaataccaactacgccctggaagccaagctgaacccgaccaaggatgcgctggccatcgaaggcagcgactcgccctacgtgaacatcctcgtcgcgcggccggacaacaaggacagcgacgccatgcagaagctggccaaggccctgcacagcgccgaggtcaagcagttcatccaggagaaatacaaaggcgcggtggtaccggcgttctgagccaagccgcgtaa

SEQ ID NO: 2229 - DNA, 333 bp, Pseudomonas aeruginosa
cccgccccgatgacatccagcgcctcgccgactggctgctcgacagccgcctgcgcgtgcactgccacggcggacgcttcagccgtttcctcgccggctacctggtcacccatctgcgcctgctgcgcccgcagtgccgattgctcgacgacggcgccctgctccccgaccagctctacgacctcggccgccaggacctgctggtcctgttcgactatcgccgctaccagagccaggcccagcacgtggcccaggccgccaaggcacgcggcacacggctggtgctgttcaccgacatctacgcctcgccgctgcgcgaacacgccgacctga

SEQ ID NO: 2230 - DNA, 756 bp, Pseudomonas aeruginosa
cgaccctggtggcgcgcatgggcgcgccgctcgacgaacgcctggagggcatcgaccagctccgcaacgcgttcagcagtcatattctggaggaatgacccgatgttcagcctgccccaccactcgccgcgcgacctgccattcggccgccggcagaccgccatcctgttcgtcgacatgcagcgtgcctgggtcgagccggggcgcgacccgcacgtcgatccgcaggcagccggttacttctacgagcgcgtgcagaaccaggtgatccccaaccagcagcgcctgctcagggccatgcgcgcagtggacgagaacgtcctgcacaccgtcatcgagagcctcaccgccgatggtcgcgaccgctcgctggatcacaagctgtcggagatgcacctgcccaagggcagcccggacgccagggtgatcgacgccctggagccgaccgccaacgagatcgtgctgccgaagacttcttccggcgttttcaactccaccgccatcgactacgtactgcgcaacctcggcacccgccacctgatcgtctgcggggtggtcaccgaccagtgcgtggacatggccgtgcgcgatgccgccgaccgcggttacctggtcaccctggtcgaggatgcctgcgccacccataccccggaacgccaccaggcctgcctggaagcgatcaagggctactgctggatcagcgacaccgagaccgtcctgcaacgcatcgccgccctcggccggagcaacctgtga

SEQ ID NO: 2231 - DNA, 450 bp, Pseudomonas aeruginosa
tcgacgagagcagcccctggggcagccacggcgacctgcgcttgctgcccgacccgaacagccgggtgcgcgtcgagcagggtcccgacgccgctgcgccggcgctcgactacctgcacggcaacctggtggaaaccgacggcacgccgtggccggcctgcccgcgcagcctgctgcgggccgaggtggaacgctatcgcgacagcggcctgcaggtcatcgcggcgttcgaacacgaattcagcctgctcggcctgcccggcgagcgtccggccgcggcgttttcgctgcaggcccagcgtgccgccgggcagttccccggctggctggtcagcgccctggcccaggctggcaccgagccggagatgttcctccccgaatacggccagcgccagtacgaggtcacctgccgcccggcgcagggcgtggccgccgccgaccgcgcggtga

SEQ ID NO: 2232 - DNA, 789 bp, Pseudomonas aeruginosa
cggcgggcctttccgacgacgacctgtgccgccactatgccgagctttactgacaaccccgaactcggcatctaccagctgccaccctaccgcctgctcaaccccgaaggggcgcacccggtggtcctggtctgcgagcacgccagccggcacatcccgctggagttgcagcgcctcggcctggaccaggccgcggcggaagaacacatcgcctgggatatcggcgccctggcgctggccgaagagctttcccggcggctcgacgcgccattgctggcggccggctactcgcgcctgctgatcgacctgaaccgaccgctggaggcacccgacagcattccgccgcacagcgagatctacccggttcccggcaaccgcgagctgtccgagacggtgcgccgctatcgccaggattgcctgttccatccgttccaccagcgcctgacgcaactgctcgacgagcgccaggccgccggcgtgccgacccgcgtggtcggcgtgcacagttttaccccggtgtaccacggcagaccccgcccgctggttgccggggtgctttatcgcaacgccggcgcctacgccaggcgcatcctcgacggtttgcgccggcacggcctggaagtcgccggcaaccagccctatgcgatcgacccggcggaagacactaccgttccggtgcatggcgacgcacgcggtctggaagcggtgctgctggagatccgcaacgatggattgcgcacgccggatgcggtgtacgcctgggccgagcgtctgtatccctggctctga

SEQ ID NO: 2233 - DNA, 465 bp, Pseudomonas aeruginosa
cgctcggcggcgttggccagctcgcgtacattgcccggccagccgtgggccatcagccgcgccagttccgccggcgcggcgggctgcggctcgcggccgaggcgctggctggcaacgctggcgaaatgttcgaagagcagcgggatgtcctcgcgacgctcgcggatcggcggcaggcgcagctcggcgacgttcaggcgatacaccaggtcctcgcggaagcgtccggcacgtgcttcggccagcaggtcgggcttggtcgcggcaatcacccgcaggtcgacgtggatactctggttcgagccgagccgctccagttgctgctcctgcaggacgcgcagcagcttgacctgctgcgccaacggcatgctttcgatctcgtcgaggaacagggtgccgccatgggcatgctcgagcttgccgatgcgcttgccctgcgcgccggtgaacgcaccgctctcatga

SEQ ID NO: 2234 - DNA, 582 bp, Pseudomonas aeruginosa
tctcatgggccagggctgccgacatctgccccagggcggccagcttggccgcctgcaccaggccgtcctgcgcggtacgcaggtcggcggtgcgctgctcgaccaggcgctccagctcctcccggctacgttgccgcaggcgggcgatacgccagcgctggtgcaggaacaagccgaggaagaccagcgccagccaagtgccggcggcggccaggcgcgcggtggcgacgtcgtcctggatgctcgcggtgtcgcgcagcaagtggagggtccagccgtcgttgggcaggtccagcgattgccagaggtagtccttctcgccgtcggcgctttccacccgcgccagacggctgtcttcgccgtagctgcgcaaggtctggtggcgcaggggtgtcaggggctggcgatcgtattgccgggtctccgccagttcgaagcggtccacggtatccagcggttccagttcgcggtagcgccaaccggcgtggttggcgaggaacacgatgcccttggcgtcgctggccaggaccaggtcgggggtctggttccactgccgttccagatcgggaaactccagcttga

SEQ ID NO: 2235 - DNA, 1038 bp, Pseudomonas aeruginosa
ccacggtggtcacgggccaggcgcaggcgccggcgcgcgacattctcgtcgagcagttccacgccctgcttggcgcaatgctgcttggccagcagcaacgcccgctcgcgcacgccatgggcgcgccaccaccaggctgcggcggcgcccaacaggagcatgacgaaaaggttacccagggtcacgagcggaatccggtgtagggggacggccagcttacccgttctcccggcaggcagcgagtggggggtgttttcgccatgtgaattagcccccatactgcgccgactcagctgtaggaagtcgtctcatgccacgtacgccccacctgctcgccatccagtcccatgtggtcttcggccacgccggcaatgccgcggcggtgttcccgatgcagcgcatcggaatcaacgtctggccgttgaacacggtgcaattctccaaccacacccagtacggtcaatggaccgggcaggtgctgccgccggagcagattccggcgctggtggacggtattgccggcatcggcgaactgggcaactgcgacgcggtgctgtccggctatctcggcagcgccgcccagggccgcgccattctcgatgtggtggcacggatcaaacaggccaaccctcgggcgttgtacctctgcgacccggtcatgggccacccggaaaaaggctgcatcgtggccccggaagtcagcgacttcctgctggaagaagccgccgcggtcgccgactacctgtgccccaaccagttggagctggacagcttctgcgaccgccagccgaactccctcgccgactgcgtggaaatggcacggagcctgctggcacgcggtcccagggcaatcctggtaaagcacctgaactatccgggcaaggccggcgacaccttcgagatgctgctggtggccgccgatcaggcctggcacctgcaacgcccgctgctggccttcccgcggcaaccggtcggggtcggcgacctggcctcggggctgttcctctctcgcctgctgctcggcgacgacctgcgtaa

SEQ ID NO: 2236 - DNA, 966 bp, Pseudomonas aeruginosa
agacggcgcaacatgtcaggccgactgcggcagcggtgcgtcggcgccgcgctcgtcacggtcgagtcccaggcgatggaccatgccgcaggcgatctcgcgctcgcccatgatcaccaggttggcgccgttctgctccaggtagtccacctcggcgtcgaaatgcgcccgggcgacgatgtccagcggcgggttcaccgcgcgggcgtggctggcgatctgcccggcctcgaagccgttgggaatggcgatcagcaaccagcgcgcctcggcgatgttggccagttccagcacgccgggactggcggcattgccgaggaccacgctgtagccctgttcgcgcagttcgtcggccttgtcgcgcttgtccaccactaccacgaagggcgtcccggcggtgcgcaggcgagcgctgaccaacccgccaacccggccatgaccgatcagcaccgcatgctcgcgctccaggatcggcggcggcaggtcctgcgccggcatctcgcggaccccgccagcggcctccgccaggcgctgctccttgcgttgctgcaggcgatcgatggcgatgaacagcagcggattgaccaggatcgacaggatcgccccggccagcaccaggtcgcggctctgctccggcaccagttcgaggccaatgcccaggccgatgagaatgaaggaaaactcgccgatctgcgccaggctggcggcgatcaccagtgcggtgctgttcggatggccgaaagcacggacgatcaggtaggcggccaccgacttgccgaagacgatgaccaggaaggtggccaggaccgtcagcggctcctgcaacaggatcatcggattgaacagcatccccaccgagacgaagaacagcaccgcgaaagcgtcgcgcagcggcaacgagttctccgccgcctcgtggctgagttcggactcgttgaggatcatcccggcgaagaaggcgcctag

SEQ ID NO: 2237 - DNA, 738 bp, Pseudomonas aeruginosa
cgcgaaggacaccccgaacagcaccgccgagccataggcgatgcccagggcaatggccagcacggccagggtgaagagctcccgcgaaccgctggcggcgatcctctccagcacccagggcaccacccggcgaccgccgaagatcatcagggcgacgaaggcggcgaccttgcccagggtaatcagcagcggccagagcagaccggcgtcgccgccgtcggtcttgccgccgagggtgccggcgagcgccggcaggagcaccagggtcaggaccatcgccaggtcctcgacgatcagccagccgatggcgatcctgccacgcttggtgtccagcaactggcgctgctccagggcgcgcaacagcaccacggtactggccaccgacaggctcaggccgaataccaggccgccgccgaagctccagccgagcagcttggccaggccgatgccaagcagcgtggcgacgccgatctgcaccagcgccccgggaatggcaatggccttcaccgagagcaggtccttgagcgagaagtgcaggccgacgccgaacatcagcaggatcacgccgagttcggcgatttcctgcgacagcgcctggtcggcgacataaccgggagtgaacggcccggccaggacgcccgcgagcaagtagccgaccagcggcgaaatgcgcaggcgattggccagggccccgaagaggaaggcgaggacgaaccccgcggcgagtgtagtgagtaa

SEQ ID NO: 2238 - DNA, 774 bp, Pseudomonas aeruginosa
actggcccttttccaccgggaatcgctccaatgcctgccgccatacgcatccttctcctggccctggccgtgcttgccggcatcggtgccgctgccatccaggccgaggatacgccctgcgccaccgccgcggaatgcaacacgcgcggcacccaggcttatcgacaggggagttatccacaggcgctggacgccttcgcctggcaattgcgcctggccgagcgccaggagcagggcggagccgactcggaacaggcgctgaacaatctcgcgctgaccagcctcaaggccgggcaaccgggacgcgcccgcgcctggatgaacctggcgctggatcgcggctacagcggcaaagccacgcgctacaacctggaacaggttgccctgaaagtcgactatccgtccctccagggcctcgccgggcactacctgcgctacgccgggcaggccgaatgggaaagcctgcagatcgaaccggtgaagggcggctaccaggcgagcttcgccctgatgcgcatcggcaatccggagaaactgatggaatatgggcccgcggcggtcggcgagctgtccggtcggctggaggggcaaggcgcgctctaccggctgcgcagcgaaggcctgggcgccggctgcagcctgctggtatggcaggaaggcatcgacctgcgagtggtggagagccttggcgggaactgccagggttacggcggcatgggcatcgccgccgccggtaactgggtgaagatatccagtcaggccagggacgactga

SEQ ID NO: 2239 - DNA, 906 bp, Pseudomonas aeruginosa
ccggcaacgccggcagccgttcattcaggcctggttgagataccagcgccagtcctgctcgccgacctcgcccatgaaggcacggtattcggcctgcttgatcgccaggtagatcttcaggaaatcctcgccgagcgcctcgcgcgcccaggccgagccctccagcgcgcgcagcgcggtcagccagtcgctcggcaacgcctgggtggcttgagcgtagccgttgccagtgatcggcgcaccggggtcgagtcgctcgcgaatacccaggcgcaccgccgcgagcaacgccgccgccgccaggtagggattggcgtcggcgccgcagatgcggtgctcgatgtgccggctggacgccgggccgccgggaacccgcagcgacacggtgcggttgttgattccccaggtcggcgccagcggcgcgtagctgttcgcctggaagcggcggaacgagttggcgttcggacagaacagcgccaaagactccagcaggcacgccttcattccaccgatggcctggcgcagcagcggggtcccggccgggtcctcgctggcgaacagattgttgccagcggcgtcggccaggctgacgtgcaggtgcaggccgctgccggaaagatcggcgaacggcttggccatgaagcaggcctgcaacccatggcgattcgccacgcccttgaccaggcgcttgtagcgcacgccttcgtcgatcgcctggagcgtgtcgaagcgatgctgcagggtaatttccacctgccccggcgcgtactccgaaatcgccgtgcgcgccggcaggccctgggcctcgcaggcggcatacaagtcatcgaggaatggctgcaactgctccagctcgtagacgccatagacctgggtcgcccgcggccgctggccattcatctgtaa

SEQ ID NO: 2240 - DNA, 765 bp, Pseudomonas aeruginosa
tcgaaaacaaacggagctgaacatgcgcaactgcagcctgacgctttcccagcttccggcgccaccggcgacccggagctgaccatggccgagaatctccaggaacgactctaccaacgactgcgggaagacttgctggccggacgtttccagcccggcgagcgactgaagatccgcgacctggcgaaccagtggggcaccagcccgatgccggttcgcgccgccctgcaacggctggtggcggaaggggcgctggagggcgaggcacaacgctcgctcagggtgccgctgatgacccgcgagcgtttcctgcagatcctccaggtgcgcctgtccctcgaagggctggcggccgaaagcgccagcggccggctggacgagcaggcactggaaggactcgaaggttgtctgcggcgaatggaggacgccttgcgccaacgcgaggtacaggcctacctggaagccaacagcgaattccacctgacgctctaccgcgcctgcggcaacccggtgctgctgcgtctcatcgagacgctctggctacaggtcgggccgttcttcaaccggctgttcaccgaggccgacctctccctacgtctgaacgatttccacgaggacgccctggacgcgctacgccgcggcgacggcccggccgcgcgcgcggcgatcgaacaggacctggcctacttcggccagtacctgctgaacctcctggagctggaggcccggccacgaaagcgacaccgttccggcgagcacgcctga

SEQ ID NO: 2241 - DNA, 2184 bp, Pseudomonas aeruginosa
ccgcaccgagcgcaagacaagtgtcgcggctggccttcggccatggcgccggacgaatggtcggtcaacccgccaacggagatgaaaaaacccccgttccctggcggaagcgggggtttcggcggcccccgaagggaccgcaaccactcgggatcagttctgccggataccggccaccagccatggctggttctcgccctgggcgcgctccatccgccagctttcgctgaaggcttcgccctggtcgaagcgcgaggtcttcgacacaccgctgaaggtcagggtggcgattgtcttgtcggcctggtcgtcgacgccgtccagttgcacgaccaggttgtcgatgtaggtggactggtaggcgtcgccgatctcggcgcgctcctgcttcagccattgcaacatctgcggggtgacgaactcggcgatcttgtccatctcgttggcatcccaatgctgctgcagggacatgaagtgttcgcgagcggcaccgacgaagcgctcctcgttgaaccagctcggcgcgttgatcaccgggctcggcgcagcggcagcagcggcggcgccaccgaagatcggcgcctgggccggcatttcgcgctgcatcggcgcgtgcccggccatcgcaggctggccctggttctgctggcgccggcgagcggcgatgaagcggaaggcgatgaaggccaccagggcgatcaacaggatgtcgagcatctggatgccctcgaagccgtcgcccatgaacatggaagcgagcaggccgcccgcggcgataccggccagcgggccgagccagcgcgaagcaccgctggcggcagcggcgggacgagcggcgttgggggcggcagcagtggcgttcggcgcagtggccggctgcgcctggcgggtctggtggctgggtgccgagccgaggctcttgccgccgccgaagcgcttggcattggcatccaggctgacggtcagcgccaggcagaaggcgagggcgatgctgagaacacgctgcattgtagtctttctctcttgggggaatcgacgcgcgccatgttgcggcggtacgggcgacaggaccagccggattttgtttcgggctattgctccccggccgccgttttttcgcccgccgcgtctggctcgcgggtcggcgccagggtacaccttcgttgccggggacgacaggcatgcacgcggatcggcgcgcgaagatccgcccggcgacccgggaagcacaacgcagagcctcgccgaaacgtctgttacagtttttttcagcccaccgatcaagcacttgcggatgctagtctgcgggtctgcgaggccgcccggtcgccgcgtctgccgacccattccccgagcgaggaccgccgccatgcatgccgtcgatttcatccaggacctcgccgtgatcatgctggtggcgggtgtggtcactatcctcttccaccgcctgcgccaaccggtggtcctcggctacatcgtcgccggcttcatcatcggcccgcacaccccgcccttcggactgatccacgacgaagacacgatcaagaccctggccgaactcggggtgatcttcctgatgttctgcctcggcctggagttcagcctgcgcaagctcttccaggtcggcgccacggcgttcatcgcggcgttcctggaaatcgtcctgatgatctggatcggcttcgagatcggtcgcttcttcgagtggagcaccatggactcgctgttcctcggcgcgatcctggcgatctcctccaccaccatcatcgtcaaggcgctcggcgacctgaagatgaagaacgagcgcttcgcccaactgatcttcggcgtgctgatcgtcgaggacatcctcggcatcggcatcatcgccctgctgtcgggaatcgccgtgagcggttcggtggaaaccggcgaggtgttctccacggtcggcaagctcagcctgttcatgatcgtcgcgctggtcgtcggcatcctcctggtgccacgcctgctggcctacgtggcgaagttcgagagcaacgagatgctgctggtcaccgtgctcggcctgtgcttcggcttctgcctgctggtggtgaagctggaatacagcatggtgctcggcgccttcctgatcggcgcgatcatggccgagtcgcgccagttggtgcagatcgaacgattgatcgagccggtccgtga

SEQ ID NO: 2242 - DNA, 237 bp, Pseudomonas aeruginosa
ccacgctgcggttattcgccctcgcctgcacctggtgtcgctatcggaccctttgccctgaaggatcggcggatttccgcttatccactctcccggtcggcggactcccgctcggccaagaccaccccgctcctcttccaacccagtccccacgcggctttcccgcgttggcacggcacctgctatcgagccatccaatacgtcgccctcgcgatgtgccggtgtgctgcgccctga

SEQ ID NO: 2243 - DNA, 588 bp, Pseudomonas aeruginosa
accggaggatccatgcgcaacggcttgatgtcactgtcgttgaggctgccgctgggcaggccggccggaccttgcgagccgctgggcgcggtctgcgcgccgggcgtgctctgcccgacggtaggtgcgggcggcggcggggcggcgctggacgggctgggctggctggatgcctctgtgctcggctcgggttccggcttgggtttgggttccggcttcggcttggccttgggaatggcgttttccaccggtttgggcttgggtttcggcttgggcttgggtttttccaccggcttcggcttcggcggctccggcttgggttcctcgatcttcggcggcgtcggctccggcgcggcagccggcggctgcggggtcggctcggccttcttctcgagctggacgaaattcacctgcatggtcttcggcagttcgccgtggccaaggttgagttcggccggggtcggcatcacccacaccagcgcaccgatgatcgccacatgcatcgccaccgccgcgccggaggacaaccaccagcgcgacttgggcggctcgccggggacgtcttcgggatcgctgccatgggcgtag

SEQ ID NO: 2244 - DNA, 984 bp, Pseudomonas aeruginosa
gggatcagcacttcctcgaccgccacttcctcgtcgcggcgcgcgccggagcagtccaccacgcgcaggttgggttctccgcgctgggcattcacgcatggcagggactcgctttcgtctccctgggcgggagcagtggggtggtcttcggcgagcgcggccagcgaaaaacggtcaggcgaccgtgaaggctgtggcgacatgagggcgacctgcggagaagtgaaaggtaaggaagtagagtcttctgataattattatcattcagtcgcgtcctcagggcaaccttggcggatcattccgcgaccatccgacacgccaggaacgcctcttcgagcgccttttcatccgcgcctgcggcgaggatcagttccagccgattatcccgccgccacgaggacttgccccagttatccacaaacggcgcggcattcgctgcataccaaccgtccgcgcaatgcagcaccgccttggctcgccgcagtccggacagacggttcagccaggcgtccactgcggcccgatcgaaacgcaccgacggcgccagccgccagccgatggcgaactggccgtcctgctcgcgcacggcgcgcagcggtcgctcggcaggcagcaccgttcccaactgagcaggcgcctccggcagggccgcccaggtcgtcgcgctaccttccccggcaacgctggtcggcagatcgcgcaatgccaggtgaccgcgcacgctccagcgcaacggcaggaccggcaggcgcgcgcgcacggcgcagcgctgcgtcgcgtcgagcgtttcggatttgttcagcagcaacatgccagccgcttccagcgcctgttcctgtgcctccggcagcggttggccggaggccagcgcggcggcatccagcaccactaccaggggttgcagggccaggacgccggaccagggaggagcctgcagctgtttccacagcgccagcggatgtcccaacccggagggttcgatga

SEQ ID NO: 2245 - DNA, 744 bp, Pseudomonas aeruginosa
tcgaagcggccttcccgggcgagacggccgacctcttccagcaggtcttcgcgcagggtgcagcagatacagccgttgctcatctccaccagccgttcttcagcgcggttcaggctgacatcgcgctggacctcgctgccatcgatattgatttcgctcatatcgttgacgatcaccgcaacccgtcggttctcgcggttcttcagcacatggttgagcagcgtgctcttgccggcgccgagaaagccggacagcacggtgacaggtaggcgttggttcacggttggtaacctcttcagttgtgccgcacgtggcgttcgcgcttctcctggcgctctttcgcctcgatgcagagggtggcggtgggacgcaacagcaggcggcgcaggccgatcggctcgccggtttcctggcaccagccgtagtcgccgcgggccaggcgctccagcgcttcgtcgatcttgtcgagcagcttcttctcccgctccagcaggcgaagttgccattgccgctgttcctcgcgggaagccaggtcggcctcgtcgctggggcgttcgagatcgcgcagctcgccgaattcgccttcgatgcgcgcctgaagttcctggcgctgacgcagcagcaggtcgcggaagaagtcctgctgggcttcgtccatgtaggcagcgtcgggctgggcaagcagttcctgttcggtcatgggctgaacctgggaaatttaaaacgttatactataacaattaa

SEQ ID NO: 2246 - DNA, 390 bp, Pseudomonas aeruginosa
cctgcgggcgggtcagcggctgcagcgaaggccctagccgggaggctgcgcgctgagcgccgccaggtagctgccggcgggagggcgttgccggaagtagccctgcacgccagcgaagatcgcctcggccaggcgctggcgatggcgttcgtccatcaaccggcgacaatcgccgcgattcgagatgaagccggtctccaccaggatcgaagggatgtccggcgacttgagcacggcgaagccggcctgctcgacacgcttctggtgcagcgcggtgacgtccgacaactggccgagaacgctgtggccgaggtccaggctgctggcgatggtcgaactcagggccatgtcgaggatcaccccggcgagtaccttgtcgcggccctgtag

SEQ ID NO: 2247 - DNA, 1380 bp, Pseudomonas aeruginosa
gtccaggaccaggcgatggccctttcccgcctgcggttccagggcgaagctgcgcggcctgaccgcctggcgcaggtcgaggacgatgcgcgtcccgccgccacccagttggccgctgcggatggcgcgcacggggccgtccagcggcagctcggagagcgttgcgagcaattgcgcgtcgggcaggtcgaggatcaaccgctcgggggcctgcagggaaaaggttcgataacgcggcgggccgtccagttccagcaccaggcgccagctttccgaggaattccaggcccgggcctggcggattcgtacattggcgctggcggccaggaacggctggagggccaggccggcgagcaggctttgcaggaggcgacggcgcttcatcgacgaaatacccgattgcaagggtcggcattagctaatacgttatattataacattcaagccatttccaggccttgcctgcccttcttcgagttctccatgaatgccttgacgcttcccgatattgcccgccagaccaccaccgccgatcttcccctggactgggtcggcatgcagggcatcgccctccccgtgcagatcggcgggcagagggtcgccgccgaagccgatgccggtgtcagcctggacgacccgcaggcccgcggcatccatatgtcgcgcctctacctggcgctggccgaactggaacagggcgagctagacctttcccgcctgcgcgccgtcctgcaacgcttcctcgacagccacgccggcctgtcgcgtcgcgcctacctgcgcctgcgcctcgcgccgctgctgcggcgtccggcgctggtcagcccgctgagcggctggaaacgttatccactggtgctggacacgcgcctggaaggcgatgacttccaggccgaagtccatctcgagctgacctactcctcgacctgcccctgttcggcggcactggcccggcaattgatccaggagcgcttcgaccaggacttcgccggacagccgctcgatcatgccagcgtgctcgcctggctcggcagcagcgccggcatcgtcgccaccccgcacagccagcgcagcagcgcgcacctgcgcatcggcctggcggaagactgcgtcggactgcccctggaagagctggcggatctcggcgaaagcgccctcggcaccgcggtgcagactgcggtgaaacgcgccgacgagcaggccttcgccctcgccaacgggcagaacctgatgttctgcgaagacgcggtgcgccggctgcaccgcgccctgcagggttatccacaggcgagccggttctccatacgggtcgtccatgcggaaagcctgcatgcccacgacgccgtcgccgaaagccactggcagcgaggtgccgcatga

SEQ ID NO: 2248 - DNA, 672 bp, Pseudomonas aeruginosa
ccatcggcgagcacagctccatcgcccaccgctccatcgtccacggtccttgcgaagtcggcgaccgggtcttcatcggcttcaacagcgtgctgttcaactgccgggtcggcgatggctgcgtggtccgccacaacgcggtggtcgacggctgcgacctgccagcgggtttctacgtaccgtccaccgagcgcatcggtccgcgcaccgacctggcgagcatgccgcgggtcagcgtttccgccagcgagttctcggaagacgtggcgcgcaccaacgtcgacctggtacgcggctacaagtcgctgcagaacgagttctgaacatgcaaagcctgctgatccgcaatgcccggatggtcaacgagggacaggtacgcgaaggcgatctgctggtccgccacggtcgcatcgaacgcatcgccggctgcctggaaaactgcggcgccagccgggagatcgatgccgccggacgctacctgctgccgggaatgatcgacgaccaggtgcacttccgcgagccgggttatccacagaagggctcgatcgccagcgaatcccgcgccgccgtggcgggcggcatcaccagtttcatggacatgcccaatacccgcccggcgacgctgagcctcgaagcgctggcggaaaagaagcgcctcgccgccgcccatag

SEQ ID NO: 2249 - DNA, 954 bp, Pseudomonas aeruginosa
cgtgaccaactacggtttccacttcggcgtcagccgcgacaacctcgacaccgtggccgccctcgatccacgcgaggtcgccgcggtgaaggtgttcatgggcgcctccaccggcgacatgctggtggacgacctgccgactctggagcgcctgttcgccagcgttccgaccctgctgctgagccattgcgaagacacgccgcggatcgaagccaacctggcgcgctggcgacaacgcttcggcgaacgtattccggcagccgcccacccgcgcattcgcgacgccgaggcttgctaccgttccaccgccctggcggtggaactggcgcaacgacatggcacgctgctgcatgtcctgcacttatccacagcgcgcgaactggccctgttcgaggacaagccgctgtgccagaaacgcataaccgcggaagtctgcgtccaccacctgctgttcgacgacagcgactacgcccgcctcggccatctgctcaagtgcaacccggcgatcaagagccgcgaggaccgcgacgccctgcgcagggcgctggccggcaaccgcctggacgtgatcggcaccgaccacgcgccgcacgcctgggccgagaagcagcaggcttatccacaggcgccggccggcctgccactggtccagcatgcgttgccggcactcctggagctggtccgcgaaggctggctgtcgctggccaccctggtggcgaagaccagccaccgggtcgccgaactgttcgccatcgccgatcgcggtttcctccgcgaaggctactgggccgacctggtgctggtcagcgaactggagcacccggcgctggccagcgccatgccgctgctgtcgcgctgcaactggacgccgttccgccaccgggcattccaccatcggatcgataccaccatcgtctccgggcagctcgcctggcacgcgggacgcctgtctga

SEQ ID NO: 2250 - DNA, 1311 bp, Pseudomonas aeruginosa
cgattgccagggactgcccctgcggttttcccgctgaagtcttgcccacagcctgctgtggatatccgctcgcccacggccctagcgcagggctttcaccgccgcgccaaggaaggcataggtctcctcctcgcgatcgtccatctccggcttcggccaggcgctccagaccaccgccacgatcttctccttgcggttgatgtagaggtactggccgaagatgccctgggcttcgaaggccccaccgtcatgctcgggcagggccttggcgcccaccgggaaggtccaccactggtagccgtagccgagcgcgtattcgccatcgtagagcttgcccggggccaggtgggaagaagcctcgacgcgactggcacgatcgacccaaccttcggggaggatacgttcgccatcgatcaccccgttctcgaggacgaactggccgaagcggccatagtcgcgcagggtcgcgctcaagccgctgctgccgatctcttgcccggccggcgattccagttgccagaagccgtcgctctccatgcccattcgcgcccagatccgctcggacaggtagtcgctcaccggaatgcgggtcgccgcgtgcagcagctcactctgcaggtgcgactcgccggtgctgtaggtgaagtgggtaccgctcgggtactgccgcggcaggctcgccagcagccgcaggatgccaccgggacgttcggcgagctgggcgtcgaacatctgcctgcggtcggacttcggatcgcgataggtctcgttccagcggaccccggaactcatctgcaggacctgctccaccgtcaccccctggtaggcggagccggccaggctcggcaggtacttgtccacaggctggtcgagagccagcaggccctgctgcacggcggcgcccaccagggtcgaggagatcgacttgaccaccgagaacgaggtccagcgcgtgcgttcgtcgttgcccaggccgtagcgctccagggcgaccttgccatccttgaggaccaacaccccgccaacgcggttgcgccgcatgaaatcgtcgacgccgtattcctcgccgccgatccggtagcgcggcgcgatggccacacccgccggcagcggacggaccttggtccccttgtggataacccgggtcggatagaccttgtccatgttccggtaggtgtccggctggtattccgggatcagttcatagagatcggcggcacggccgatccgcgggttttccacagccgcgtcggcgccggccgagccgcttgccgagacgaacagtgccagcagggccggccggaagactga

SEQ ID NO: 2251 - DNA, 1377 bp, Pseudomonas aeruginosa
cgacctggaacacggaaaaggccagggccacggcgaacaacgcgcgcggccagttttccgcctcaagatgcagcccgttctgatgatcgctcatgcatcgactccctacagccggaaacgcggggaacccggtccgccgcacggaccggggctacggagaaacgggcctcactcgggcagtacgcccttctccttgtagaagcgctcggcgccgggatgcagcggaatcggcaggttcttcgccgccttgtccagggcgatgtccttggcggcagcatgggcggtgaccaggcgcggcaggttgtcgaacatcagcttggtcatctggtaggccagctcgtcgctgaccccggagtggctgaccaggatattgtcgatcgccaccgtcggcacgtcctgctcctggccgtcgtaggtgccggcgggaatgctcgcggcgtggtaggccgggctgtcgatcttcgccaccacgtccgccgggatcgcgacgaaggtgatcggcatggtcgaggccaggtcgcggatggccgccatgcccaggccggaggattgcagcgtagcgtcgagctggcggttcttgatcagctccaccgactcggcgtagggcaggtactccaccttgcccatgtcctcgtagctcaggccggcggccttgaagatcgctcgggcgttcagctcggtaccgctcttgggcgcgcccaccgaaatgcgcttgcctttcaggtcggccagggtcttgatgcccgaggcttggctggccactacctggatatagttcggataggtattgccgatagcccgcagcttcttcaacggcgccttgaagccggcgtcggcgaccccgttccaggcgtcggcgaccgagtcgcccagcgccagcgccagttctccacgcccggcctgcaacaggttgaggttctcgaccgaagccttggtggcctgcaccgaggttttcgcgccctggatatcgtgcccgtagatctgcgagaggccgacccctatggggtaatagaccccgctggtgccgccggtgaggatattgatgaaggtcggcgcggcaaagaccgaggtactgaaggtcaccgttgcggcaagcgtgaaaagaccgaagcgtctgctcagcgacatgggaagtctcctgttcttatcgttgttgtcgcgctgtcgcggaagcgtcccggcttccttcgaccgcgcaggacttcgtgcagactagaccgccccgccacgcaggacaatcagcaaggaccgattgcgcgaccggctccgcaagggagccggtcgccggcgttcaggcgtacaggtcgcgccgcgaccagggcagctcgtgggagccatcctcgtgggggcgaatggcgaggatctggtgcaggttga

SEQ ID NO: 2252 - DNA, 1527 bp, Pseudomonas aeruginosa
tttctccagcactcccgagccccgagcggattccggggagagccgcttgaggcgatacgccgaagccttcttcgaaatcgtgcactggcccccagaatctccctccgttctcttcttttctccccgccgttcctgcatcaaccaaacagccatgccctccatagcccgagcggttcatccctgaccctggcgccggctccacgagccggcgcccccttggcgttcgtccgctcattcagccaaagagaacatcatgaaccagaaaatttccccgccttcacagaagctcgacggcctgttcctgctggccctgtcgatggccgtattcttcgtcggcgtgaccgagttcatgctgtcctccatgctcgggccgctggcgcaggcgttccacaccactaccagcggcgccgcttggctgatctccagctacgcgttctcctatgcgatcgccgcgccgttgctgggctacttctccgaccgcatgcaacgcaggaagctgctgctgctcgccctggtcctcttcgcggtcgatactctggccatcgtcatcgccccgaccctggaaattgccgtcgtcctgcgggtgatcgggggcatcgcctcggcaatcatcatcccgaccaccttcgccctggtcgcggaggtggtcgccccgcaaagacaggccggtgccatgggccaggtgatgctcggcatgaccctcggcattgccgccggcccggcactggccggcctcctctcggacttcttcggctgggcggcgcccttcctgttggtctcgtgcggttgcgtgctggtcttcctgatggcacgccagcgccttcccgtgcaagccgtggtaccgcgcgccgagggccatgcgctgggctggtgcaggcaatggagcatcctcaggccactgatcgccaagggtgcctggaacggcaccggggtcgccggcctgcttctctcgggagaggtgctgcgccagcgctacggcttcagcaccgcgcagataggcgtcagcatcgccgccttcggcgtgggcctggccgtgggcaacctcgccgcgggttacctgcgacgttatctgaagcgcgacgaagacatgctcctgctggtgctggcgctcctggtgttatcgatgtcgaccttcatgctcctgccgctaccgttacccgtggcgctctgctgcctgggcgcctggggcgccgcgctgggcctgggcgcgccggcgggcacggtggtactcgcctcgcgctccgggccggacaagggcatggtgctgtcgttcgccgagacgttcaacaacatcgccattctcgccagcgtgcccctggctgtgcgactgctggagctgaaggggccgcccgccaccctgtgggtattgggcatcggcctggggatcggcgcctggctcaccgtgctggactggttcgccagccgcaggagcgacgaggcgctgccgttgcgcgattgacggcgagcgccggggccgcatgcctgccccggcttctcgggcacgcggccggcgttactcgacggtga

SEQ ID NO: 2253 - DNA, 1323 bp, Pseudomonas aeruginosa
ctggcggagcgtacgggggtgccgctgcgggcgaagatgtcgatgcccttgtgcactccggagcgcccccagggctcgaaccagaaggttcgcggattccagtcgcgggcactggcgccttcgacgggtatccgcggccattcgggcagcaccgcccaggctatgagcagccccagcacgatccgtttcgcaggcttcggcatccgtgccgctccgttacttcttgattttttccgggcgcttccagttttccaggttcttctgccgggcgcggccgaaggccaggttcttcgccggaacctcatgggtgatggtggagccggccgcggtcgtcgcgccatcgccgatcttcagcggcgccaccagcgagttgttcgagccgatgaacacatcgtcgcccagctcggtgcggaacttgttcgcgccatcgtagttgcaggtgatggtgccggcgccgatgttgcagttggcgcccaactcggcatcgcccaggtagctcaggtggccggccttgctgccctcgcccaggcgggcattcttcagttcgacgaagttgccgacatgggcccgagcgccgagcacgctgcccggacgcaggcgggcgaacggaccggcatcgctaccctcgcccagctccgcgccttccaggtggctgttggccttgatcaccgcgccacgccgcaggacgctgtcgcgaatcacgcagttcggtccgatgcgcacgtcgtcctcgatcaccacgcggccttccagcaccacattgacgtcgatcagcacgtcgcggccgaccgagatttcgccacggacatccaggcgctgcggatcgagcagggtcacgccctggcgcatcagctcctctgcgcgcaggcgctggtagtgacgctccagctgggcctgttgcatgcggtcattgacgccctgcacttccatcgcgtccagcggttgggcgctggccaccaccaggccgtcgccgaccgccatggcgatcacgtcggtcaggtagtactcgccctgggcgttgtcgttggacaggcggccgagccagtcggcaaggcgcttgcccggcaccgcgaggatgccggtgttgatctcgccgatctggcgctgcgccggggtcgcgtccttgtgctcgacgatggcctgcaccgcgccctggtcgtcacggacgatgcggccgtagccggtggggtcgagcatgtcgacggtgagcaacgacaactggtccggggtgacttgcgccagcaggcgctgcaaggtgtccagctggatcagcggcacgtcgccgtagaggatcagcacctggtctgcactgaggaacggtag

SEQ ID NO: 2254 - DNA, 897 bp, Pseudomonas aeruginosa
ggcctgggccaccgcatggcccgtaccgagctgttcggcctggagcacgaaattcaggtcgtcggcggccatccgctcacgcaccagatccgcgccgtggccgatcaccacgtggatccgttccggctgcaactggcgcgcgcagtcgatgacgtggccgagcatcggcttgccggcaatgggatggaggaccttgggcagggccgaacgcatgcgggtgccctggccggcggcgagaatcacgatttcaagggacatggactggactaccgttcctggtggtcacaggcaaaacctgtgagtgaagatgcaaaacgaaaaaagggtagcccacaggctacccttttccctgacaccgctagaagtaccggctggaaatcagccgccgaacttcttgcgcagttgctggacggtgcgcagctgggctgcggcttcggccagacgcgcggcagcggcgctgtagtcgaactcggcgcccttgccctgcagcgccttttcggcagccttcagggcttcctgggcggccgcttcgtcgaggtcgccggcacgaaccacggtgtcggcgaggaccttgaccatgttcggctggacttcgaggaaaccgccggagatgtagtacacctcctgctcgccgccctgcttgaccaggcggatggggcccggtttcaggtcggtgatcagcggcgcgtggcccggggcgatacccaggtcacccagagcgccgtgcgcgataaccatctcgaccaggccggagaagatctccgcctcggcgctgacgatgtcgcaatggactgttatggccatacgcttgcctcacatgagcgcccgtcgccgggcgcacaggattacagttttttggctttctcgaccgcttcttcgataccgccgaccatgtag

SEQ ID NO: 2255 - DNA, 528 bp, Pseudomonas aeruginosa
cgccctcgcttagatctcggctgccagtttggaaaccagctgctcgtgcgcgtttgcgtcgatcgaagcacccaggatcttctctgcgccggtgacggccagggcacccacttgggcacgcagggcgtccttgacgctgttcagttcctgttcgatttccgcttgggcctgggccttcaggcgttcgccttcggtacgggcctggtcgcgggcttcatcgacgatctggttagcgcgtttcttcgcctgttcgacgatttcggctgcctgagccttggcttcgcgcagttgctggcccgctttctcatgagccagctccagatcacgagccgcgcggttggcagcgtccaggccgtcagcgatcttcttctgacgctcttgcagagccgcgatgaccggaggccacacgaacttcatgcagaacagcacaaagatgaagaacgcaacggactggccaatcagggttgcattaatgttcacgccaacacctcgctcgttcgttgtccgtcaaacactcaaatcgaatga

SEQ ID NO: 2256 - DNA, 1497 bp, Pseudomonas aeruginosa
tcagcagggccaggtaggccagcagctggcgttgcttgtcggcgtcgagggcgacgcctagctcgtcagcaccgcgcgcgagttcgtcggcgtggtgttgggttaccgcagacatcaagcgctctgctccagttggcggccagaggcacgcttcttcaggtggatcaacaacagcgaaatcgcagccggcgtgacgccggggatccgcgaagcctgtccgagggtttccggacgggcctggttcagcttgttctggatttccttcgacaggccggaaatccccaggtaatcgatatccacaggcaggcgggtatcttcgctggcgcgcagacgggagatttcctcctgctggcggtcgatgtagccggcgtacttggtgcgaatctccacctgctcggccacctgggggttatccacagcgttgccggtgatctccaccaggccggcgtaatcgatctcggggcggctcagcaggttgagcagattgtattcatgggtcagcggcgtaccgaagcgctcggcgatggcgtcgccctgcggggtattcggccgcacccaggtgctcttcagccgctgttcctcgcgttcgataccttcgcgcttggcttcgaaggcagcccagcgccgatcgtcgacaaggcccagctcgcgtcccttctcggtgagacgcaggtcggcgttgtcctcgcggaggatcaggcggtattccgcccgcgaggtgaacatgcggtacggctcctgggtgccgagcgtgatcaggtcgtccaccagcacgccgatgtaggcctcgtcgcggcgcgggcaccagctgtccttgccttgcgaacgcaacgcagcattggcgccggccagcaggccctgggcgccagcttcctcgtagccggtggtgccgttgatctggccggcgaagaacaggccgccgatgaccttggtctccaggctgtacctgagatcgcggggatcgaagaagtcgtactcgatcgcatagcccggccgcacgatgtgggcgttttccatgccacggatggaacgcacgatctgcagttgcacgtcgaacggcagggacgtggaaatgccgttgggatacagctcgtgggtcgtcaggccttccggctcgaggaagacctggtggctttccttatcggcgaagcgatggatcttgtcttcgatcgaagggcagtagcgcgggccgatgccttcgatcacaccggaatacatcggcgaacgatcgagattggcggcgatgatctcgtgggtccgggcgttggtatgggtgatccagcaactgacctgctcgggatgctgttccttcgaaccgaggaaggacatcaccgggatcggcgtgtcgcccggctgctcggtcatcaccgagaagtccacgctgcgcccgtcgatccgcggcggcgtaccggtcttcagccggccgacccgcagcggcaattcacgcagacgacgcgccagtgcgatggacggcgggtcgccggcgcgtccgcctga

SEQ ID NO: 2257 - DNA, 750 bp, Pseudomonas aeruginosa
gtagttctccaggccgatgtggataagtccgccgaggaaggtgccggtagtcaggaccacgttgtcggcatggaagcgcagtcccatctgggtcactacgccgcggacctgatcctgctcgacgatcaggtcgtcgcaggcctgctggaatatccacaggttcggctggttttccagtgtatggcggatagcggccttatagagcacgcgatcggcttgtgcacgagtggcgcgcactgccggccccttgcggctgttaaggatgcggaactggataccgcccttgtcggtggcttcggccatggcgccgccaagggcgtcgatttccttgaccagatggctcttgccgatgccgccgatggcggggttgcagctcatctgccccagggtttccacattgtgggtcaacagcagggttttcacacccatgcgcgcagccgcgagtgcggcttcggtgcctgcatggccaccgccgatcacgattacgtcaaaacgggtagggaaatccaccacgcacctcggcctgttcagaagcaggaattcaggaaagccggacagtataaggatttagcgaacctgaatgaagactcctggacaaaaaatagccaatccagatcgagggagcaaaacggctcggcgggcttacaaaaaataaaaggaaaggaatgtttatatctttttagaacttgtgtttattacttagcagcggcttttctgttgataagtacctcgagcccagtaaagacatag

SEQ ID NO: 2258 - DNA, 951 bp, Pseudomonas aeruginosa
gtgccggcggcaaggggcacagtgaaaggaaagtacgcagcgaaccttgccctggttatccacaactcggcgtgggccgagccccattacttgccgatgcagaaactcgagaagatgcgacccagcaggtcgtcgggggtgaatgcgccggtgatttcgcccaggtgctgctgggcctggcgcagatcctcggccagcagttcgccggcgccattgtggataagttggctgtggccatgctccagcgcctgccctgccaggcgtagcgcttccaagtggcgccggcgggcgctgaaaccgctttccgcggtctgttcgaagcccatgcaggccttcaggtgttcgcgcagcagctccaggccggcgccggtgcgcgccgagagggtgatggtgacgtggccgtccgcgctttcctcgaggccaatggactctgtggacaaatccgccttgttgcggatcagggtgaccttgcccggttccggtcgctggtcgagaaactccggccatagggaaaacgggtccgctgcttccggggcggtggcgtccaccaccagcagcacgcgatcggcttcgccgatggctttcagcgcacgttccacgccgatcttttccacatggtcctcggtatcccgcaggcctgcggtgtccaccacatgcaggggcatgccatcgatgtggatatgttcgcgcagtacatcgcgggtggtgccggctatgtccgtgacgatggccgcctcgcgaccggccagggcattcagcaggctggacttgccggcattcggtcgtccggcgatgaccacggtcatgccgtcgcgcagcagggcgccttgggaagcttcgcgctgcactgtggataattctgtgcgtactttttccagaagccccagtacatggccatcggcgaggaagtcgatttcttcctcggggaagtcgatggcggcttcgacatag

SEQ ID NO: 2259 - DNA, 1590 bp, Pseudomonas aeruginosa
gcgcttatttcgttgtgccgcctttccaatctttgggggatatccgtgtccgtggaactttggcagcagtgcgtggatcttctccgcgatgagctgccgtcccaacaattcaacacctggatccgtcccttgcaggtcgaagccgaaggcgacgaattgcgtgtgtatgcacccaaccgtttcgtcctcgattgggtgaacgagaaatacctcggtcggcttctggaactgctcggtgaacgcggcgagggtcagttgcccgccctttccttattaataggcagcaagcgtagccgtacgccgcgcgccgccatcgtcccatcgcagacccacgtggctcccccgcctccggttgctccgccgccggcgccagtgcagccggtatcggccgcgcccgtggtggtgccacgtgaagagctgccgccagtgacgacggctaccagcgtgtcgagcgacccctacgagccggaagagcccagcatcgatccgctggccgccgctatgccggccggagccgcacctgcggtacgcaccgagcgcaacgtccaggtcgaaggcgcgctgaagcacaccagctatctcaaccgtaccttcaccttcgagaacttcgtcgagggcaagtccaaccagttggcccgcgccgccgcctggcaggtggcggacaacctcaagcacggctacaacccgctgttcctctacggtggcgtcggtctgggcaagacccacctgatgcatgcggtgggcaaccacctgctgaagaagaacccgaacgccaaggtggtctacctgcattcggaacgtttcgtcgcggacatggtgaaggccttgcagctcaacgccatcaacgaattcaagcgcttctaccgctcggtggacgcactgttgatcgacgacatccagttcttcgcccgtaaggagcgctcccaggaggagttcttccacaccttcaatgcccttctcgaaggcggccagcaggtgatcctcaccagcgaccgctatccgaaggaaatcgaaggcctggaagagcggctgaaatcccgcttcggctggggcctgacggtggccgtcgagccgccggaactggaaacccgggtggcgatcctgatgaagaaggccgagcaggcgaagatcgagctgccgcacgatgcggccttcttcatcgcccagcgcatccgttccaacgtgcgcgaactggaaggtgcgctgaagcgggtgatcgcccactcgcacttcatgggccggccgatcaccatcgagctgattcgcgagtcgctgaaggacctgttggcccttcaggacaagctggtcagcatcgacaacatccagcgcaccgtcgccgagtactacaagatcaagatatccgatctgttgtccaagcggcgttcgcgctcggtggcgcgcccgcgccaggtggccatggcgctctccaaggagctgaccaaccacagcctgccggagatcggcgtggccttcggcggtcgggatcacaccacggtgttgcacgcctgtcgtaagatcgctcaacttagggaatccgacgcggatatccgcgaggactacaagaacctgctgcgtaccctgacaacctga

SEQ ID NO: 2260 - DNA, 2424 bp, Pseudomonas aeruginosa
agcatgagcgagaacaacacgtacgactcttccagcatcaaggtgctgaaggggctggatgccgtacgcaagcgccccggcatgtacatcggcgacaccgacgatggcaccggtctgcaccacatggtgttcgaggtggtggataactccatcgacgaagcgctggccggttactgcagcgaaatcagcatcaccatccatacggatgagtcgatcactgtccgcgacaatggacgcggtattccggtggatatccacaaggaagaaggggtttctgcggcggaagtgatcatgaccgtcctccacgccggcggcaagttcgacgacaacacctacaaggtgtccggcggcttgcacggtgtgggcgtctcggtggtgaacgcgctgtcccatgaactacgcctgaccatccgtcgccacaacaaggtctgggaacaggtctaccaccacggcgttccgcagttcccactgcgcgaagtgggcgagaccgatggctccggcaccgaagttcacttcaagccgtccccggagaccttcagcaacatccacttcagttgggacatcctggccaagcgcatccgcgagctgtccttcctcaactccggcgtcggcatcctgctgcgcgacgagcgtaccggcaaggaggagctgttcaagtacgaaggcggtctgaaggccttcgtcgagtacctgaacaccaacaagaccgcggtgaacgaggtattccacttcaacgtccagcgtgaagaggacggcgtgggtgtggaagtcgccttgcagtggaacgacagcttcaacgagaacctgctctgcttcaccaacaacatcccgcagcgtgacggcggcacccacctggccggtttccgttcggcgctgacgcgtaacctgaacaactacatcgaggccgaaggcctggcgaagaagttcaagatcgccaccaccggcgacgatgcccgcgaaggcctcaccgcgatcatctcggtgaaggtaccggacccgaagttcagctcgcagaccaaggacaagctggtctcctccgaggtgaagactgcggtggaacaggagatgggcaagtacttcgccgacttcctgctggagaatcccaacgaagccaaggccgtggtcggcaagatgatcgacgccgcccgtgcccgcgaggccgcgcgcaaggcgcgcgagatgacccgccgcaagggcgcgctggacatcgccggcctgcccggcaagctggccgattgccaggaaaaggacccggcgctctccgaactgtacatcgtggagggtgactccgcgggcggttccgccaagcagggccgtaatcgccggacccaggcgatcctgccgctcaagggcaagatcctcaacgtcgagaaggcacgcttcgacaagatgctctcctcccaggaggtcggtacgctgatcaccgccctgggctgtggcatcggccgcgaggagtacaacatcgacaagctgcgctaccacaacatcatcatcatgaccgatgctgacgtcgacggttcgcacatccgcaccctgctgttgaccttcttcttccgccagatgcccgagctgatcgagcgtggctacatctacatcgcccagcccccgttgtacaaggtcaagcgcggcaagcaggagcagtacatcaaggacgaccaggccatggaagagtacatgacccagtcggccctggaagacgccagcctgcacgtcaacgagcacgctccgggcctgtccggggcagcgctggagaaactggtcaacgagtatcgcggggtgatcgccaccctcaagcgcctgtcgcgcctgtacccccaggagctgaccgagcacttcatctacctgcctaccgtgtcggtggacgacctggctaacgagtcggccatgcagggctggttggagaagttccaggcgcgcctgaccgccgccgagaagtctggcctgacctacaaggccagcctgcgcgaagaccgcgagcgccacctctggctgcccgaggtggaactggtggcccacggcctgtccagctacgtcaccttcaaccgtgacttcttcgccagcaatgactaccgctcggtgtcgctgctcggcgaccagctgaacagcctgctggaagacggcgcctacgtgcagaagggtgagcgcaagcgcccgatcagcgccttcaaggacggcctggactggctgatggccgaaggtaccaagcgccacagcatccagcgatacaaggggttgggcgagatgaaccctgagcagctgtgggaaaccaccatggatccgaacgtccggcgcatgctcaaggtgaccatcgaggacgccatcgccgccgaccagatcttcaacaccctgatgggcgatgccgtggagccgcgccgcgacttcatcgaaagcaacgcgctggcggtgtcgaacctggacgtgtga

SEQ ID NO: 2261 - DNA, 273 bp, Pseudomonas aeruginosa
ccgcgaaaccgcgccatctcgtccagcgcccgtgtgacgcgaaagccgctgataccgtgctccaccaggatgccgaccgactccttggtgaagtcatcgaccaccgtcaggcatttgatccgccgcccggtgctcagtgcatcgaagacgaagtccatcgaccagacctggtttggtgcgctcggcaaactcagacgttcgcgctccaccgcgacgccatggcggcggcgccgccgtttcaccatcaagccggcagcgcggtacaggcgatag

SEQ ID NO: 2262 - DNA, 1023 bp, Pseudomonas aeruginosa
gggcttttggcggcagctcttcggtgcccagttcgaccaggaaatccttggcgctcatcattcggcctccttcagcttggccagtacttcgtcacgcaattcgggggtggccatggggaagccgaggcgcgcgcgggcctgcaagtagctctgcgccacggcgcgggccagggtacgcacgcgaaggatgtagcgctggcgctcggtgaccgagatggcgcgccgcgcatccagcaggttgaaggtatgcgaagccttgaggaccatctcgtaggtcggcaacggcagctccagcgcgatcaggcggttggcttcgctttcgtagaagtcgaacagttcgaacagcttcggcacgttggcgtgctcgaagttgaaagtggattgctccacctcgttctggtggaacacgtcgccataggtgaccttgccgaacgggccgtcggtccagaccaggtcgtagaccgagtccacgccctgcaggtacatggccaggcgctccaggccgtaggtgatctcgccggtgaccggatagcactcgatgccgccgacctgctggaagtaggtgaactgggtgacttccatgccgttcagccagatttcccaacccaggccccaggcgccgagggtcggcgactcccagttgtcctcgacgaagcggatgtcgtggaccagcgggtcgatgccgatggctttcagcgagccgaggtacagctcctggaagttctccgggttcggcttcaggaccacctgaaactggtagtagtgctgcaggcggttggggttctcgccgtagcgaccgtcggtggggcggcggctcggctggacgtaggcggcgttccaggtctccgggccgatggcgcggaggaaggtggcggtgtggaaggtgccggcgcccacttccatgtcgtagggctgcagcaccacgcagccctgctctgcccagtagttctgcagggcgagaatcaggtcttggaaggtgcgcacggcgggcgtagtctggctcacgaaattcacctgtgctga

SEQ ID NO: 2263 - DNA, 525 bp, Pseudomonas aeruginosa
tcacagagtgggcgaaaccgctgccggttatcggctagaatgcgcgccgctcggcatggtgccgggcatgggttccctcaccccatcgcgcaaaaaggacagcacatgtcagcctcttctccggcggcctggcgcggcaccctggccggcctgatcgccttccacatcttcatcatcatcgccagcaactacctggtgcagttgccgatcaccctgtttggctggcacaccacctggggcgccttcagctttccgttcatcttcctggctaccgacctcaccgtgcgcttgctgggcaagggccctgcccggctggtcatcgcccgggtcatgatcccggcgttgatcgcctcctacgtggtctcggtgttgttccaggaagcggcgttccgtggtttctccgcgctgctggagttcaacaccttcgtcgcacggatatccctggcaagcttccctcgccctattgtgctcgggcagaacccccgaacgtccaggttattccgaccgccctccggttcgtttccc

SEQ ID NO: 2264 - DNA, 1251 bp, Pseudomonas aeruginosa
aggcggccgagagcggactcaggcgcccatcaccaggcggatgtcccgcgccagttcgcggacccgctcgatatcggtatcccaggaacacatgaaacgcgcgccaccttcaccgatgaaggtgtagaagcgccagccgcgcgcgcgcaaggcttcgatcgccggctcggaaagctgcaggaacacgccgttggcttctaccgggaacatcaggctgacgccgggaacgtcggccaccagctcggccagcaggcgcgcgcagcggttggcgtgatcggcgtagcgcagccaggcatcgtcctgcagtacgccgacccagggcgcggcgaggaagcgcatcttcgaggccagttggccggcctgcttgcagcggtagtcgaagtcctcggccaggtcgcggttgaagaacaggatcgcctcgcccaccgccatgccgttcttggtgccgccgaagcagagcacgtcgaccccggccttccagctgagctccgccggcgagcagccgaggaaggcgcaggcgttggagaagcgcgcgccgtccatgtgcaggtgcaggccgagctccttgcaggtggcgctgatcgccttcagctcgtccgggcggtacaccgtgccgacctcggtggcctgggtgagagtcaccacgcgcggcttcggatagtggatatcctggcgcttgagagcgatgtcgcggatcgacgccggggtcagcttgccgacctcggtctgcgccagcagcagcttggagccattggagaagaactccggcgcgccgcactcgtcggtctcgacgtgggcggtctccgagcagatcacgctgtggtagctctggcacagcgcagccagggccagggagttggcggcggtgccgttgaaggcgaagaacacttcgcaatcggtctcgaacaactggcggaagtagtccgaagcacgcgcggtccactggtcgtcgccataggcgcgttcgtggccgcggttggcttcggccatcgccgcccaggcttcggggcagatgccggaatagttgtcgctggcgaactgttgggtgtgatcggtcatgtgggcctctggaacggttgccgagcccttgtggggctccatgcggtcgtgccggcacgggtacgtgccggcacagtctgtcagggtagcttggtcagcttcatctgctcgacgaacggcaccagcacctggcgcatcgccgtggcgctgccgccattgggcgtgtcgcgggtgctgagggtcagtacgtag

SEQ ID NO: 2265 - DNA, 945 bp, Pseudomonas aeruginosa
tcggcgagcagcccagcgtcgtcgccgacggtgagaagaaacccgccgtacaaggggaaccggcatgagccagatcaatcgcctgtccagcggcggccgcatcgaccgcaaccgcccgctgaccttcagcttcaacggccagcactaccagggctatgccggcgacaccctggccgccgcgctgctggccaacggcgtcgacatcgtcggccgcagcttcaagtactcgcgggcgcgcggcatcgtcgccgccggcgccgaggagcccaacgcgatcctgcagatcggctcccgcgaagccacccagatccccaacgtacgcgccacccagcaggcgctctacggcggcctggtggccaccagcaccaacggctggccgaacgtgcagaacgacctgatgggaatcttcggcaaggtcggcggcaagctgatgccgcccggtttctactacaagaccttcatgtacccgcagtcgatgtggatgacctacgagaagtacatccgcaaggccgccggcctgggccgcgcgccgaccgaggtcgatccggacagctacgactggatgaaccaccactgcgacgtgctggtggtcggcgccggcccggccggcctggccgccgccctcgccgccgctcgcagcggcgcgcgggtgattctcgccgacgagcaggaagagttcggcggcagcctgctggacacccgcgagaccctcgacggcaagcccgccgccgagtgggtcgcggacgccgtggccgagctgcaaggcctgccggaagtcatcctgctaccgcgctccacggtcaacggctaccacgaccacaacttcctcaccatccacgagcggcgcaccgaccacctcggcgaggtcgccccgctcggccaggtccgccagcgcgtgcaccgcgtgcgcgccaagcgcgtggtactggccgccggcgcccatga

SEQ ID NO: 2266 - DNA, 1818 bp, Pseudomonas aeruginosa
gcggccgctggtctacggcaacaacgacctgcccggcaacatgctcgccggcgcggtttccacctatgtacggcgctacggcgtggcaccgggcaagaaactggtgctggccaccaacaacgactacgcctaccgcgtcgccctcgactggcaggaagccggcctgcaagtggtggccatcgccgacgcccgggccaatccgcgcggcgagtggatcgaggaagcacgccaacgcggtatgcgggtgatcactggcagttcggtgatcgaggctcgcggcggcaagcgggtcagcggcgccaaggtcgcccggatcgacctgcaggccatgcgcgccagcggcggcgaatggctggactgcgacctgatcgccagctccggcggctacagcccggtcgtgcacctggcctcgcacctgggcggcaagccggaatggcgcgaggaaatcctcgccttcgtccccggcgaaggcctgcagaagcgcatctgcgccggcgccgtgaacggcgtgttcgggctcgccgaggtgctcgccgacggctaccaggccgggagtcgcgccgccctcgacgccggctacaagaccaccgccggcagcctgccgaaggtccagccgcgccgcgaggaagcgtccgtcgcgctgttccaggtgccccacgagaagcccacggcacgcgcaccgaagcagttcgtcgatccgcagaacgacgtcaccgccgccgccatcgaactggcctgccgcgagggcttcgagtccatcgagcacgtcaagcgctacaccgcgctgggcttcggcaccgaccagggcaagctgggcaacatcaacggcctggcgatcgccgcgcgggcccagggcaagagcatcgccgacaccggcaccaccatgttccgtccgaactacaccccggtgaccttcggcgccgtcgccggccgccactgcgggcacctgttcgaaccggtgcgtttcaccgccctgcacgcctggcacgtgaagaacggcgccgagttcgaggacgtcggccagtggaagcggccgtggtacttcccgcgccgcggcgaggacatgcacgccgccgtggcccgcgaatgccgcgcggtgcgcgaggcggtcggcctgctcgacgcctcgaccctgggcaagatcgacatccagggcccggacgcgcgggagttcctcaaccgggtctacaccaacgcctggaccaagctcgacgtcggcaaggcgcgctacggcctgatgtgcaaggaagacgggatggtcttcgacgacggcgtgaccgcctgcctggccgacaaccacttcgtcatgaccaccaccaccggcggcgccgcccgcgtactggagtggctggagctgtaccaccagaccgaatggccggagctgaaggtgtacttcacctcggtcaccgaccactacgcgaccctcaccctgtccggcccgaacagccgcaagctgctcgccgaagtcaccgacatcgacctggacaaggatgccttccccttcatgacctggaaggaaggcaaggtcgccggggtgccggcgcgggtgttccgcatctccttcaccggcgagctgagctacgaggtgaacgtccaggccgactacgccatgggcgtgctcgaagcgctcgccgagcacggcgcgaagtacggcctgacgccctacggcaccgagaccatgcacgtcctgcgcgccgagaagggcttcatcatcgtcccccaggacaccgatgcctcggtcaccccggacgatctcaacatgggctgggcggtgggccgcaccaagccgttctcctggatcggctgggcgcggcatga

SEQ ID NO: 2267 - DNA, 1482 bp, Pseudomonas aeruginosa
ccctggcgcgggcggtgggctaccacatcgagcggagggtattcctcaacgccaatcggaccgtggtgctgtaagcgcgccctctcttcccaaccctcgctgaaggaagagggccagggagaggggcgcttcccacggcctcgcgtcccgagcaacaccgacagcccgccggctgccagcattctccggccctgtcgcgcaacagacgactttccagtgcaaagccgcgcggccgtggacgccgcgcatttgtacccacaacgacaaagaggaaacgcgtatgtctggcaatcgtggtgtggtctatctcggcccgggcaaggtcgaggtgcagaacattccctatccgaagatgcaggacccgcagggccggcagatcgaccacggggtgatcctgcgggtggtctccaccaacatctgcggctccgaccagcacatggtgcgcggccgtaccaccgcgccggaaggcctggtgctgggccacgagatcaccggcgaggtggtggagatcgggcgtggcgtggaaaccatgaagatcggcgacctggtctcggtaccgttcaacgtcgcctgcggccactgccgtacttgcaaggaacagcacaccggcgtctgcctgacggtcaatccggcgcgtgccggcggcgccctacggctacgtcgacatgggtggctgggtcggcggccaggccgaatacgtggctggtgccatacgccgacttcaacctgctgaaactgcccaaccgcgaagcggcgatggagaagatccgcgacctgacctgcctttcggacatcctccccaccggctaccacggcgcggtcaccgccggcgtcggcccgggcagcacggtctacatcgccggcgccggtccggtcggcctggccgcggcggcctcggcacgcctgctcggcgcggcggtggtgatcgtcggcgacgtcaacccgacccgcctggcccacgccaagaaacagggcttcgagatcgccgacctgtccaaggacaccccgctgcacgaacagatcgccgctctactgggcgagccggaggtcgactgcgcggtcgatgcggtcggtttcgaggcgcgcggccacggccattcgggctcgcagcaggaagccccggccaccgtgctcaactcgctgatgggcatcacccgggtcgccggcaagatcggcatccccggcctgtacgtcaccgaagacccgggcgcggtggacgcggccgccaagcacggcgccctgagcatccgcttcggcctgggctgggccaagtcgcacagcttccataccggccagaccccggtgatgaagtacaaccgccagctgatgcaggcgatcatgtgggaccggatcaagatcgccgacatcgtcggggtggaagtcatcaccctcgacgatgcgccgaaaggctacggcgagtttgacgccggggtgccgaagaaattcgtcatcgacccgcacaacctgttccgcgcggcctga

SEQ ID NO: 2268 - DNA, 570 bp, Pseudomonas aeruginosa
tcggcgcggatgtgctcgcccagggaggccgcgcaggcgtccggcgccgggtcgaggaaagcgaagttcatgcccagcggggttcccgccagggccagcatgcggcccagctggccgccaccgatgacaccgattttcatggttcgagccttaccttctcagagcctgtctcacgcatcgcgcgggtcgggattgtccagcacggtttcggtctggttggcgcggaactgcttcagcgcctcgtggtactgcgggtgcttggcgccgaggatgctcgccgagagcagcgccgcgttgaccgcgccggccttgccgatggccagggtggcgaccggtacgccggcgggcatctgcacgatggagagcagcgagtcgacacccgacagcatcgacgactgtaccggcacgccgagtaccggcaggtgggtcttggccgcgcacatgcccggcaggtgggcggcgccgccagcgccggcgatgatcacttcgaggccgcggccttcggcttcctcggcgtactggaagagcaggtccggggtgcggtgggcggaaaccaccttcacttcgtag

SEQ ID NO: 2269 - DNA, 846 bp, Pseudomonas aeruginosa
ctgagggtgctccagtccgatttggaacccatgatcacgccaaccagtgcgctcatcgtcgtgcctctctcaaatgcgccgtccggcgcgtcagaaaccaacaagccacgcttcgtcgaggggcgtggcttgtactgggccgagccggcgggcagtgccggttcgaaggcggcgcagtataccgcaaaggcaggccgggcgcgcgccgggggctaccgtccgtcccgttttttcgcgccatggcgggaaacttgccgcaactcaatgcgcgcctgccacgagcggccagactggttgtcgcggcgcgctccgagggagcggcggccgcgccggttccgcagcctgtcgcggtgcccgtcaaaggcaccgcgacaggcgctcagccccgtccaaggagatgaccatgaccctgccacagaccatgaaagccgcggtcgtgcacgcctacggcgcgccgctgcggatcgaggaagtcaaggttccgctgcccggccccgggcaggtactggtgaagatcgaagcctccggcgtctgccacaccgacctgcacgccgccgagggcgactggccggtgaagccgccgttgccgttcattcccggtcacgaaggcgtcggctacgtcgccgcggtgggcagcggagtgacccgggtgaaggaaggcgaccgggtcggcatcccctggctgtacaccgcctgcggctgctgcgagcactgcctgaccggctgggagaccctctgcgaaagccagcagaacaccggctactcggtgaacggcggctatgccgaatacgtattggccgacccgaactacgtcggaattctgccgaaaaacgtcgaattcgctga

SEQ ID NO: 2270 - DNA, 426 bp, Pseudomonas aeruginosa
ccccgcgaccgaggaaggcgctggcgctgtaggcgagcagcggcacgctctggccgttctccaggtcgaacagcggctggccctcggcgttcaccgcgcagaccggcagcatctcggtgcgccccaggtgcagcgaggggaagatctccgggtccatctgcaacgcggcgtcagggtcgtagaacgccagcatcaggtcgcagctaccctcgcgcagggaatgcaccgcctcgccgacgttggtggcgatcagccggctggcgatgttcagcccctcgttgcgcagccgcgcgatccactgcgggaagaagcccagcgccagcgagtgggcggcggcgaactgcagcacctcgccctgcccgccttccaggtggtgcaggtggcgcaccacctggccgagctgctcgaccacgctgcgcgcggtga

SEQ ID NO: 2271 - DNA, 1470 bp, Pseudomonas aeruginosa
tgggcatcgcggcactggccgtgtccctctgagacaaatcccgtcatgtcccccgttgcatcttcccgtatcgagaaagacctgctcggcaccctcgaagtgcccgctgacgcctactacggcatccagaccctgcgcgccgtgaacaacttccgcctctccggggtgccgctgtcgcactacccgaagctggtcgttgccctggccatggtcaagcaggccgccgccgacgccaaccgtcagctcggccatctcccggaagacaagcacgccgccatcagcgaggcctgcgcccgcctgatccgcggcgatttccacgagcagttcgtggtggacatgatccagggcggcgccggtacctccaccaacatgaacgcgaacgaagtgatcgcgaacatcgcgctggaagccatgggccataccaagggtgagtacaagtacctgcacccgaacaacgatgtgaacatggcgcagtcgaccaacgacgcctacccgaccgccatccgcctgggcctgctgctcggccacgacaccctgctggccagcctcgacagcctgatccaggccttcgccgccaagggcgtcgaattcgccggcgtactgaagatgggccgcacccaattgcaggacgccgtgccgatgaccctcggccaggaattccacgctttcgccaccaccctcggcgaagacctcgatcgcctgcgtcgcctggcgccggagctgctcaccgaagtgaacctcggcggcaccgccatcggcaccggcatcaacgccgaccccggctaccagaagctcgccgtcgagcgcctggccgccatcagcgggcagccgctgaaaccggccgccgacctgatcgaagccacctccgacatgggcgccttcgtgctgttctccggcatgctcaagcgcaccgcggtcaagctgtcgaagatctgcaacgacctgcgcctgctctccagcggcccgcgcaccggcatcaacgagatcaacctgccgccgcgccagccgggcagttcgatcatgccgggcaaggtcaacccggtgatcccggaagcggtcaaccaggtcgccttcgaagtgatcggcaacgacctcgccctgaccctggcggccgaaggcggccagttgcaactgaacgtgatggagccgctgatcgcctacaagatcttcgactcgatccgcctgctgcaacgcgccatggacatgctccgcgaacactgcatcaccggcatcaccgccaacgtcgagcgctgccacgaactggtcgagcacagcatcggcctggtcaccgcgctgaacccgtacatcggctacgagaactccacgcggatcgccaagaccgcccttgagagcggccgcggcgtactggaactggtacgcgaggaaaagctgctggacgaagccaccctggccgacatcctgctgccggaaaacatgatcgcgccgcgcctgattccactgcgcgcctga

SEQ ID NO: 2272 - DNA, 624 bp, Pseudomonas aeruginosa
cgatcacctgttccgcctcgcagcgcaggccgcgcgcgctgcgcaggtaggcggcgatcagctcgcgcaggcgcgcctcgccggccgggtcgccgtagcccaggcagtccgccggtgggttgcgccagaagcgcgcctgtagccgcgcccaggtgtcgaaggggaacaggtcgaaggccggcacgccgacgcggaacgctcgcggcgcgccttccggtggcggcgccagggccgccgggccgcgcggcgcgggagcgctcggggcgacggcgggggccctgcctgggatttcctgcaactcggcaacgtaggtgccgtcgcctgtgcgcccgtcgatatagccctcggcgtgcaactgttcataggcccgcaccacggtgttgcgcgagaccttcagggcctgggccagctcgcggctggcgggcatccgcgtgcggctgccgaggcggccgtcgaggatccgttcgcgcagcgcggcgtagagctggcgggccaggccctgggcggggtcgaggtggatgccggcggcgtcgaagggcagtacggtggccatggcggtctcggagggaagaaagcgccagtgtggattggacctgtggaattgaccagcaatggatcttctag

SEQ ID NO: 2273 - DNA, 981 bp, Pseudomonas aeruginosa
agctgtacgagcgcatcgccgacaagtccggtttccttcagtaccgcaggattctctgaggcccaccatgcgcgaacccttgaactggcgccccgtcgccactccaccccacgccccgctcgacggccgcttcgtcaagctcgaaccgctcgatccgcaacgccacggcgacgacctgtgggacgccctgcaagggcctggcgccgacccgttgctgtgggaatacctggcctacggcccgttcgccgagcgcccggcgttcgacgcctggctggccggccaggcggccagccgcgacccgctgttcttcgccgtgcgcgagcggcgcacgcagcgcgccgtcggcctgctcagctacctgcggatcacgccgaaggatggcgtcatcgaaatcggccatatcgccttcggcgcgcctatgcagcgcacaccggggtctaccgaggcggtctacctgctcgccgaactcgccctcggccgcctcggctaccgccgcctggagtggaagtgcaatgccggcaacgcccgttcgatgcgcgccgccgagcgcctgggcttcacctacgaaggcaccttccgccagcacatggtggtcaagcagcgcaaccgcgacaccgcctggttctccctgctcgacagcgaatggccggcgcgacaggcggcgttcgagcgctggctcgatccttccaacttcgacgccgaaggccgccagcggcagacgctggaggcgctgcgcgactagcccctggcagggactgccggtcgctcaacggtactccggcagccagtgcaggctggccaggatgtgcgcgaccgcgttggccacgccgaacagcagcaccagcacgatcgccggcgtgccgccccaggcgcggaacagcgggctgccgaagcgcttgcgcgaggcccgcgccatcagcgccggaacgatcaccgcccagaacgccgcggccagcccggcgaaaccgatggcgtagatga

SEQ ID NO: 2274 - DNA, 252 bp, Pseudomonas aeruginosa
tggccctgcgcttcgccaatgcgttgttcgagccggtctggcgcgcggcgcacatcgaccatgtgcagatcagcgtcaacgagacccttggcgtggagaaccgtggcggctactacgaccacgccggggcgatgcgcgacatggtgcagaaccatctgctccagttgctctgcctggtggcgatggaggcgccggtgcgtttcgacgccgaggctgtgcgcaacgagaagctcaaggtgctgcaggcgctga

SEQ ID NO: 2275 - DNA, 2343 bp, Pseudomonas aeruginosa
aggccgcctggggctgggtcgacccgatcctcgccggctggcgcgagcactaccagagcccgcggccctacccggccggcagcaacggcccggaacaggcgcaactgctgctggaactgcagggtcgacgctggctggaatgacgcggacattgatccggctcaggatcgcccggcgcgcgctcggctagagtcgcgcgcccacgtcgttgcgagcccgaaccatgaccgccaccaccctccgccccgaactgctgtgccccgccggcaccctgaaaagcatgcgctatgccttcgcctacggcgccgatgccgtctacgccgggcagccgcgctacagcctgcgggtgcgcaacaacgatttcgaccacgcccaactggccgaaggcatcgccgaggcccacgcacttggcaagcgcttctacgtggtggtcaacatcgccccgcacaacgccaagctgaaaaccttcctgcgcgacctggagccggtggtcgccatgggtccggatgcgctgatcatgtccgatcccggcctgatcatgctggttcgccagcatttcccgcagatgcccatccacctgtcggtgcaggccaacgcggtgaactgggccgcggtgcaattctggcggcagcagggcctgacccgggtgatcctttcccgcgagctgtcgctggaggagatcgaggaaatccgccagcaggtgccggacatggagctggaagtgttcgtccacggcgccttgtgcatggcctattccgggcgctgcctgctgtccggctacatcaaccgccgcgaccccaaccagggcacctgcaccaatgcctgccgctgggaatacaaggcggtggagggccgcgaggacgagctgggcaacgtggtggcgcgggagccgaccctgggacgcggcgcgccgaccgagcaggtgttcctcctcgaggaaggcaaccgtcccggcgaaccgatggccgccttcgaggacgaacacggcacctacatcatgaattccaaggacctccgcgccgtgcagcacgtcgagcggctggcgcggatcggcgtgcactcgctgaagatcgagggccgcaccaaatcccactactacgtggcgcgcaccgcccaggtctaccgccaggcgatcgacgacgcggcggccggcaagccgttcgaccgcggcctgatggacaccgtggagtccctcgcccaccgcggctacaccgagggcttcctgcgccgccacgtgcacgacgagtaccagaactaccagcacggccattcgttgtccgagcgccagcagttcgtcggcgaactcaccggcgaacgccgcgacggactggccgaggtggaggtgaagaaccgcttccagcgcggcgacagcgtcgaactgatgactccgcgaggcaacctgagcctgcgcgtggaggacctgcgcaacgccgccggcgaggccatcgaggtggcgccgggcaatggccacgtggtctacctggcgctgccggaaggcctggacctgtgctacgcgctactgatgcgcgatctccagcccggccaggatacccgccagccgcaggccgaacgcagcggcgggtgtgccggcaagggcgcttgcggctgcgctcactgagggttgagcaggaacaccacgtagcccctgaaccaggggctcttttccaggtagtcgggggcttgccagtcgccgccctggaccaggccgatccggtacggcagttgcaggcggctgacccgcgggaggtaggcggcgtggttgggaatgctgtggcgcccctggtaggtctgcaccaccacttcgtcgaccacgcccttgagccggttgatcgccgccggctcggcgttgctgccccagtcgagcaacccggtgatgctcaagcggtattcgcggggcaggcgccggcgcaggtcgcggaggaaatcgacgtactcgtcgaggtagcgggtacgcgcatcgaagtcgatctggatgccgaccaccgggttgccggcacgcttccagcgctgcacctggttcagcacggcctggtagatctgcggcgtccagcgcagggtatgggcgcggtacaccacccagacctcaccccgcgccaggcgcggcaccgagatgccctgggcgatcagccgcacgccctcgccggggcgccggcgcgactggctgatctgtccctgcaggatgtacagcgtctcggcccgcgccagcaccggctgcggcgcgacgccgctccacagccagaaggcgccgtagtcctcggcgcgcaccgcggcctcgacggacggcaacagcggcaggcccagcaacaggcccgccagccaggctcgccagcgcctcaccagtag

SEQ ID NO: 2276 - DNA, 423 bp, Pseudomonas aeruginosa
aagttggccgcagcctccaggtacgtggcgaaggccttgcctgcggccgactcgacgccttgcgcgagcacaccgcccagttcctcttgttcccagccgcaggcaccgagcaggtccaggcggctgttggccagggccttggtctccgcctcgcccagcccggcgtcacgcacctggcgaagaaacgccagcgcgctgtcctggtcgttgctgcggcagcggctgccctcgccctcgaagaattcggcgccggcgatcttttccggtagcgcttcggcgcccatctgccgggccagttcggcgagcggcgagggcgctggcgcaggcggcggtgtctcggcctcgctcgccgccgacggcgcgggcggctggctgccgtcgccgggcagcaggcggaacaggccgaacggcaccaggccgtag

SEQ ID NO: 2277 - DNA, 2565 bp, Pseudomonas aeruginosa
cttcacccccatctcgcgcaactggcggaaggtcgccaggacactatcgagggcgtccagccactggctttcggtcaactccagctccagttgcgccgccggcaggccgctgtcggcaagcgccgagcgcactacgtcgagcaggtcgccctggcgcaactggtggaccgagaggttcaccgagacccgcaggttcaggccccgctggctccactcggcggcctgcaggcaggcccggcgcaggacgaattcaccgatctcgccgatcaacccgcactcctcggcgaggccgatgaaggtcgacggcgggatcatgccctcctccggatggtgccagcgcaccagcgcctcgaccgagtccgggcgggcgctggccaggcacagcttgggctggtaatgcacgtccagctggccctcctcgaccgccttgcgcaaccgggtttccaggcgcaggcgttcgagggtgctgtcctgcaggttgtcgcggaagaactggaaggtattgccgccgagttgcttggcatgttgcatcgccaggttcgcctggctcatcagcacggagatttcccgtgcctgctcggaaaacaggctgatccccagcgaggcgccgaggatcaactcgtggccgagcacgctcaccggctggcgcaactggaccagcaggcgttcggccaggcgcgacagggccgcggtgccggtgccgccatcgaggagaatggcgaactcgtcgccggccagacgcgccagggtgttggcttccggcgcggtgcgccgcaggcgctgggccatctccctgagcaactggtcggcgacctcgtggccgaggctgtcgttgagcagcttgaagcggtccaggtcgatcagcagcagggccagcccgccctcctcctggcgcgcccgctgggccgcctcgtgcagccgctcgcggaacaaccggcggttggccaggccggtcagttcgtcgtagtgcagcaggtgacgcaggcgctcctcgacgtcgcggcgggcactgagatcggtgaagaaaccgacgatgtgggtcgcctcgccattgccgtcgcgcagcaggttgagctgcagccattggggatagggatcgccattcttccgcgtatccaccagttcgccctgccactgcccgtgctggcgcagctcggcgcggatctgccggtagtggcgctgggcctcgggggtattcaccagcaggctggcgttgcgcccgaccacgtcctcgcggcgatagccggtgatgcgactgaaggcctggttgaccgccagcaggttgtaggccggatcgaggatcacgatgctctcgctggccgcctcgaacactgtcgcggccagttgctgctgctcttccaggcgcttgcgcgcgctgatgtcgctgcgcgtgccgagcatccgcgtcacccgtccccgcgggtcgcgagccatggcccggccacgatcctccagccagcgccagccgccctcccggtcgcgcacgcggtactccacccggtacagctcgctgcgccccttgagatgttcggcgagggcgcgacggatgcgcggcaggtcgccggggtggatgctttcgatcagcctgcgatagtcctcgggaccgcccccggcgtcgctgaagaccgcctcgagataggaatgctggacccggccgctctccaggtcccagtcccacaaccccagttcgctggcctccagggccatggccaggcgcgcctcgctctggctgagcgcctggctggtcgcgccaagctcctcggtgcgcgcctccacccggcgctgcaaggcgtcgcgggcggcgcgcagctcgcgttcgaccaggcgccgctggccgacctcctgggcgagcttgcgattgagcgcttcggcctcggcgttgacgcgttccaggtgcaggttcagcgcctgggtctggaagcgtcgcagcagcgcgccctgcaccagccggtggatctgcccggcgaccaccagcagcgccaccagcaggatcaggccgagcacgccccagccctgcaacaggctatgcggctgcaacagcaggaaaacgatggatggcagcaggcccggcaaggcgaaagtgaggaaggccggcaggctcaccgcataggcgacgctggcggagaggatcgccgccgccaccaggccgaacaccagcacctgctggaggaaggcatcggccgggaccagcatgatcaccgcgaacgccagggtcaggcccgaggcgccggcgccgcacaggaaggtccgccgccagtggcggctggcctggcgacggctgtcggcctgctggaaggcggcgacctgcagcaggcgcaggacggcgagcaacaccagccagaccagccagccgccgagcagccaactgctgaccttgccccacaccaggcaggcgctggtcacgccgccgagcagcatgagcagggtcggcgtgcgcgagccgagataaaggagccgggtacgctcgatggcgatttcgcgggcgtagagccgcagtacatcggtgctgccgcccggcagcgccaagggctcgacatggacggtcataggcgcttgttcttgtag

SEQ ID NO: 2278 - DNA, 456 bp, Pseudomonas aeruginosa
tgctcggctacgccaagctggaagccctgtagcggcgcagcccgtggagaaggcccggaggaggacgacatgctggcatcctgggccttctgggcactgctttcggcgctgttcgccgcgctgaccgcgatcttcgccaagatcggcctcgaccgggtcgattcggacttcgccaccttcatccgcaccctggtgatcctcgtcaccctcggcggcatcctcgcggtcctgggcaagttccaggccccgggaagcatcctgccgcgcagctggctgttcctggtgctctccgggctggccaccggtgcctcctggatctgctatttccgcgccctcaagctcggcccggcgtccctagtggcgccggtggaacaaattcagcgtggtgctggtggcactgctcggcggggccttcctcggcgaacgcccgggacttgcgccaaaggctgggcgtag

SEQ ID NO: 2279 - DNA, 1554 bp, Pseudomonas aeruginosa
tgcccgatgccggtccgcggcgcctggagaatccgcgcgttaaccgcaatccgcatgtactgcctcgccatgcgccggggccttgccgagggcgagcaggatccgcgcgatcagttgccgactcgcctcgtgccagccgatccagcgccattcgccgaccggtcgctcggccgggaactcgcccgtggcttcgaagcgggtgaccaggttcgccagggtctgcggatcggcgaggtcgaagtaggccatgaattcgccgccgatctcgcggaacaccgggatgtcgctgcccatcgccggcaggccgcgctgcatggcctccaccagcggcaggccgaaaccttccacataggacgggaagaccagcgatgcggcatgggagtatgcgtactccaggctcttgtcggagaggtcgttgaacatgaacaggcgcttgttcagctccggatgctgccgcacccgttccaccagcgcctcgcacttccagccgatgcgtccggcgatgcacaaccgcgcctgcgaaccctgggcccaggcacgctcgaaggcatccagcaggtaaccgtggttcttccgcggctcgatggtgctgaccatcaggaataccggcgccttggccttgaacatgcgcagcagatcgggctcgacggaggcgccgtcctccaccaggtccagctccgaacccaggtggaaataatcgaaccagcgttgcgcgaccttctccgggccgatgcgccgcagcatctccgcgcgcacttcgtcgcggatggtctcggaaatcgcgacgtagccgtcggcggtggccgcgatccagtcgaaccagtggttgaacaccttgaccaggccggcatcgcagaattgcggatgggtcaggggaatcaggtcgtagatcaccgagacgatgcccacaccctcgctcttgaggcgttccgccagcgggaagaaatcggcgtgccaggaggagtccagcaagaccagttggtcgccggcccgatgttcgagcggggtcgcgcgcacgggtgcaggctgctgcttgccgaggatgcggtcgagcaggcgcagcggaatgctgaggaaggcgaaagcgaacaggcggcaggctacatagagaaggcgccgggcccacggcgaggaacggaacgggcggcgcttttccagggtgcgctggcccagccagaagtagttggcggctcgctccaccaggatgcgcaggcgtaccagcggcgaatgcggccgcgggtccagcggcgccaggctgtggacctgatacagggtgccgtcgagcattgccaccgggatgcactccaccgtctcgtcggcttccggcaactcgcggatgacgttgcgcaccacccgctgaataccggaattgaccttgggatgctcgaacacataggtgcattcgaccaacagacgcgtcatggagtgctctccgcggaagtggggtccagagccgcctcgccggagcggctgatatgggtttcggcgcccagccaggagcaaccgacgaagtcttcctggcggttgttgatgacatggaagaccaggccgtag

SEQ ID NO: 2280 - DNA, 1359 bp, Pseudomonas aeruginosa
cgctgccgagaacgaagccacgatagccccacaaggaacgagacaagccaagaagcatcagaccaccctgccgtactggtcctcgaagcggacgatgtcgtcctctcccaggtattcgccgctctgcacctcgatcatcaccaggtcgatgacccccgggttttccaggcgatgccggtggcccgcgggaatgtaggtcgactcgttgctgttgaccagccgcgcgccatcgccattggtgaccctggccatgccttgcaccacgatccagtgctcgctgcggtgatggtgcatctgcagcgacaagcgctctcccggcctgaccacgattcgcttgatcttgaagcgcggcccctcctcgaggacggtatagctgccccagggacggttgacggtccgatgcagccgataggcctcgtgccgctcgtccttcagccgctgcaccaccctgcgcacctcctggacccggtcggcgcgggcgatcagcagcgcatcggaagtatccaccacgaccaggtcgtcgaccccgaccgtggcgaccaggcgcccgtcgctctgcacgaaggtgttacgggtgtcgacgaacagggtgtcgccgctgccgcgattgccctctgcgtccgcgtcgagcagcgcgctcatcgcgccccaggaaccgatatcgctccagtcgaaggccgccggcaccacggcgacccgcgcggagcgctccatcagcgcatagtcgatggaaatgtccggcagcgcggcgaaggcttcgcctgccagctcatgctggatgccatcggccatcttcaccgccgcactggcggccaggcaggccctggcctgctccagcagggccggggcatgctgcgccagctcgtcgaccagggtcgaggccgtgaaacagaacatcccggaattccacaggaaaccgccactttccacgtagcgacgggcggtttcctcatcgggtttctcgacgaagcggcgcaccttggccgccccctgctcgtccagccggtcgcccagctcgatatagccgaaaccggtttccgctgcgtccggcaccacgccgaaggtaaccaggtgcccggcgacggcgagacgcgcggcatgccccaccgcctcgcggaaggcctcctcgttgcggatcaggtgatccgccggcatcaccaccagtaccgccgcgtcgccatgttcggcttgcagcgccagggcggcgacggcaatcgccggagcggtgttgcgcccggtcggttcgaggatgaaatgtcctcggtgccgccccaggcgggccgcctggaactggtccttgctctggaagtaatgctcgcggttggtcaccgtgacgatttcgccatgcccggccagtag

SEQ ID NO: 2281 - DNA, 1107 bp, Pseudomonas aeruginosa
cccggcggcacgtcggtaggtcttgcccagcagggtctggccatcgggcaggcgcatgaacggcttcggctgtccttcacgcgacaccggccacaggcgggtaccggcgccgccggaaagcaccacgggaatcagcatggcttactcccgggaaacgcgtcgcaggtccgcctcgaccatcatccggatcagctcgtccaggctggtcctgggcttccagccgagcacacgctgggccttggccggattacccagcagcacgtcgacctcggcgggccggaagaacgccgggtcgatcttgaggaagtcgcggtagtccaggcccacatgctcgaaagcgatctggcacatgtcgcgcacggtggtagtgacaccggtggccaccacgtagtcgtcggccttgtcctgctgcaacatcagccacatggcttcgacgtagtccccggcaaagccccagtcgcgcttggcgtcgacgttgcccaggcgcaattcctgctgcttgccgagcttgatgcgggccaccgcgtcggtaaccttgcgcgtgacgaactcgatgccgcgcagcggcgactcgtggttgaacaggatgccgctggaggcatgcaggccgaagctctcgcgatagttgacggtgatccagtggccatagagcttggccacgccgtaggggctgcgcgggtagaacggcgtgttctcgtcctggcgctcggcctggatcaggccgaacatctcgctggtggaagcctggtagaagcgcgtttccgggctgaactggcggatcgcctcgagcaggtgggtcacgcccaggccgtcgacgacggcggtggtcaccggctggttccaggaagccccgacgaagctctgtgccgccaggttgtagacctcctgcggctgcgccttgatcaccgcgcgctgcaccgaacaggcatcggccatgtcgccgtcctcgtactggatatcgccttcgatccccagttcgcgcaggcgccagcgcgtgtcgctgctgcgccgcgccaccaggccgtggacccggtagcccttctccagcagcagcttggccaggtacgctccgtcctgaccggtgatcccagttaccagtgcacttaa

SEQ ID NO: 2282 - DNA, 3135 bp, Pseudomonas aeruginosa
gccagaaccagagccagagccggttcctctcgactggaggcgccgactggtcatcagcaagcactacctgctgctgtggtaccgggaagccgtcagcgacctggtacccataccggtacgccgctggctgttccgtcacctgcgccggccgctgccgcccccgccaacggcgctggaaacgctgccggagccattgccccaggccatcgagccgatgccgcccgccgagcccgagcatccgccggcgctgttgccggccgtcgaccagcaccagcaggtcgtcgtggacggggtggtctacgtctcggtgttcaatccgctggacgggcgcaagaactggcatcagctgatcaccgccttctgctgggcattccgcgacaccagcgatgccacgctggtgctgaagatgacccagagcgacctgacgacctaccacgtcgaactgctcaccctgctttcccaactgtcgccattcgcctgccgggtcatcgccctgcacggctatctcgatgccgcggagtacgcccgcttgtacggagccgccagctactacgtgaacgcctcgcgctgcgagggcctgtgcctgccgctgatggaattcatgtcctgcggcaccccggcgatcgctccggaccattcggcgatggccgactacatggacgcccaggtgggcttcgtggtccgctccagccaggagcccgcggcctggccgcaggattcgcgccggttgtacagcacccggcgctaccggccgagctgggagtccctgaaggaggcctacctggagagctaccgggtagcccgggaacagccggagcgctatcggcaactgtccgccgcggccaaccaacgcatgcgcggctactgcgccggcgacgtggtccgccagcgcctggaacccttcctttccgcccgcaaggcaacccctgcgcccggcgtcgaactggcggccaccgccacaggcaacgttccatgctgatcatcatccactccgaggaccaacaagaccaccatccggcagaacctcgggcgcccggagtacagctattacttcgtcctcaaggaattccgtccgctgctggaagagatcggccaggtggtcgaagtcagcgatcccgacgaactggtggaccgcctctaccacgactgccgcaagcgcggcgaaccctgcgtcttcctctccttctcgccgccccatcgcacgccgatccaccatgcctgcccgaccatcccggtgttcgcctgggagttcagcaccctgcccagcgaaacctggcacggcgaaccgcgccacgactggcgacatgtgctgcgccacagcggacgggccatcacccactccagcttcacggtcgacgtggtgcgcgccgccatgggtcgcgactacccggtactgagcgtgccggcgccggtctgggatcgcttcgccaaccgcgcctcgcagcaggcaggccgtcccgaagcccgggatgtgcgcctgcgcctggacggcctgctggtggacagccgccagctggacctggccgtccatgccgaccccgagccgtcggcggaggtcctggccctgccggaccgcgcggcgaaacaggtcgagctgagcctcgacggggtcatctacacctcggtgttcaacccctacgacgggcgcaagaactggcaggacatgatcagcgcgttctgcgccaccttccgcgacgagcccgacgccaccctggtgctgaaactgacccaccacaacgtcggcgaagcgctggccgacatgcttcaccacctgtacaagaaccagtcctaccgctgccgcatcgtgctgatccacggctacctcgccgacccggactacgagcggctggtcgaggccaccagctacgtggtgaacacctcctacggcgaaggccaatgcctgccgctgatggaattcatgtccagcggcaagccggccgtggctccgcgcaataccgcgatgatcgactacatcgacgccgacaacgccttcatcgtcgactcctcggaagaagccaccgcctggccccacgacccgcgcgcggcctaccgcacgctgcgctacatcaccgactgggagtcgctgtgccgggcctaccgggccagtttcgaggtcgctcgccaggagccggagcgctacgcacgcatgtccgcgcatgccagcgccagcctcgaacgcttctgcagccgcaagctggccgtggagcgcctgcgtcgcttcctcgacgaagcggcacaaggcgaccccgccgccttgcaaagcatcccggcatgatccgcgccctgctccaacgctggcgttcccgtcccgctgcggcgagcgagccggtgtcgccacgcatgtgcggtctgcgcgatgcggtgctggatggctggttccgcagcgaaaccggcgaactgctcgccggcttcgccatcggcgcccaggacaccctgctcgatctcggctgcggcgaaggcgtcgccaccctcttcgccgcccgccagggcgcttcggtgatcttcaccgacagcgaggaggacaaggtgcggagcctggcgcagcaggtcgaggcggtggcccggcggcccttcaccggcctggtcagcgacagcgacccgctgccgctgcgcgacgcctgcgccgacaagctggtgtgcatggaagtgctcgaacacgtggccaacccagcgcgggtgatggccgaactcgtgcgtctcgggcgccctggcgcgcagtacctgctgagcgtgccggacccggtcggcgaacacctgcagcagggcatcgccccggccgactacttccgggcgcccaaccacatccacatcttttcccgtgacgacttcgcgcgcctggtgcaggacgccgggctggtcatcgagcaccgccaggccagcggcttcttctgggtgatgggcatgatcttcttctgggccagcgaacgggccgccggccgtgagctcggcggcgccgtccgcgaccgtatccagccgccctacccggcgctgatggaagactgggcacggctctgggaaaacctcctggcccgtcccgacggtctggagatcaagcacctgctcgaccatttcatgcccaagagccaggtgatcatcgcgcgcaagccgctcgaccccggatcgtcgcggacatga

SEQ ID NO: 2283 - DNA, 306 bp, Pseudomonas aeruginosa
gcggcaaacgcatcctcgacatcgaactgttgcgcgggctggccgtgctcggcgtggtattccaccatctgcacggcaacctgttcagcggctccccggcactgctggacggcatcaaccagcgcgtccagttctggtggggcgtggacctgttcttcgccatctccggcttcgtcatcgcccgcaccctcatcccgcaactgcgcgaggcgcccacacgccaggcattctgggaacaggcgcggtacttctggatccgccgcgccttccgcctgctgccctcggcctggctgtggctggcgctga

SEQ ID NO: 2284 - DNA, 408 bp, Pseudomonas aeruginosa
gcgccgcccgccgcgtcgccaccacttccggagccacctcatgctgaacttcctcaagaagatcgtctcgccgcccagccccgccaccgagcccgtcgccgcgccacccgcacccgcgccggtcgacccgtacatgctcgggttgcgcgacgcggtgctcagcggctggttcaaccaggagaccgacgagctgttcagcggctttccgatttccgccgaggacaccgtgctcgacgtggggtgcggcgacggcggcaacgttcatttctgcgccatgcgcggcgctcgcatcatcatcgccgacatcgacgcggaaaagatcgccaggacccgcgagcgcctggccgataccccggcccgcgaactggaatgcctggtcagcgactgcgacccgttgcccctggctga

SEQ ID NO: 2285 - DNA, 402 bp, Pseudomonas aeruginosa
cgtggcgcacagttggttagtctcagcgttgacacggccgcgcggatgcggccgtctacgctgacttcgttcggagcaactcacatgaaacgtctgcgcctgatcggtgccgctgccctgctcgcctgcgcctccagcgcgttcgccagcagcttcgtggtcaccacggataccctggtccgcgccaccggcatgacctccaatgccacttcggacatcaccaattccttccgcgacgacaagatcgtcctcgaagcgcgcgacgacgccgccagcttcgtcgccagccagggcgacatccgcggttcgcacctggaagccgcactgcgccacatccgtggcaagctgccgagcctggccgccaacgacatgcaactggcccaggcgatcctgaccatctga

SEQ ID NO: 2286 - DNA, 2040 bp, Pseudomonas aeruginosa
actggaccctgcgcagcgcgaggccagccagcaactcttggacgaagccgcggacaagttgccgccggccttccgcgaacgcctggaccgcgagatcgaggtcgagtggcgcgacgacctgcccgccaacggcatgggccaggcccgtggcccgcagcgcatcgcgctgaaccgcaagtacctggccgatctcaccgacggcagcgccgccagccgccagaccgggcgcgtgcacggcaccgagcggcgcgagctgctggcgaccctgctgcacgagctgacccacgtctacgatcgcgcgcgcctgtggtcggcggaggaaaaacgcgagatccgccgctgcacgcgccaggaagaaaccctcggccggatcgcccagcccaccgattgccgcgggcagagcggtcgccgcttcacgctctccgacgacccgcgcctgctcgatctcgccggctggccgcagcgcgccggccagcgcgggcggcgcgaggcgcacaatggcttcgtactgcgcagcccggacgtctacgagctgagcaatccgcgcgagttcgtcgcggtgaacatggagtacttcctcctcgatcccagctacgcctgccgccgcccggcgctctaccgctactaccagcaacgcttcggctgggcgccggaacacagtgcctgtgcgcagagcttcgcctacctcaacgccggccgcgacttcggccagcagccgctgggccagctcgaccccgagcgggtctacgaggtcgactacctgctggccgaggccaacgacaacctggtcagccgctggggccacaccatgctccgcctggtgatctgcgcccccggccggccgcgtggtccggactgccggctggacctcgaccagcatctggtgctgtcctaccgcgccttcgtcggcgacctgcaattgtccagctgggacggcctgaccggcgcctatccgtcgcgcctgttcgtcctgccgctgtcgcaggtgatcgaggaatacaccaaggtcgagctgcgcagcctcgcctcggtgccgctgaagctggaccgcgaggaggtcgccagcctggtcgagcgcgccgcgcagagtcactggagctacgacggccagtactacttcatctccaacaattgcgcggtggaaaccctcaagctgctgcgcagcggcatcccccggcgaccgctgcaaagcctggacagcatcaccccctacggcgtgctcgagatgctggagaaccgcaagctggccgatcccagtgtgctcgacgaccccaaggaagccctgcgcctgggctaccgcttcgactccttccgcgaccgctaccaggcgatgttcgacgtgctcaagcagcgcctgcacattccccaggacaaggtcgaggactggctggcgctgccggccagggagcgccagccctggttcgccaaggccgacctgcgcgccagcgcggcgctgctgctgctcgagcaggcctcgctgcggcgccagctgctgctcgcccaggacgagttgaagcgcctgtacctcggccatctggacaagccggccggcgaccagcgcctggaagtggccggcaagaccttccagcagatcctcgacgacagcggcttcctcagtcgtccggcggaactcctggagggcggctacggcctgccgcaggccgccgagtggaagcacctggaagagcagacccgcgaacgccaggcgcgcctgcgccggctcagcgacgacctcgaccgcgaggtccgcgccctgctcgatcccgagcgccgcgccgagctggaagccaacgaggccaacatcaaggaggtcggcgcgcacctgcgcgagctgcacaaggcggccggcgggctgatgctgccctgagggaggcgcctgcaggacgcatggtcccgagcgctctttcagcgcctcgcagacggcggataacgctctgcgttattcgccctacaggtgccacctccggtcttcgctcacgggtcgtccgctccggcgatgaactcctcgtcctcttcgggcaactgcgggtcgaggtgtag

SEQ ID NO: 2287 - DNA, 1725 bp, Pseudomonas aeruginosa
ccatggcaggcggctgccgacccagatgtgccggttggcgggggcgcgctcgggatggtcgaggctggccacggtgaagtccagggtatcggcgctgagccgggtgaacaacgccaggttggccccgcaacgcgggcagaagtagcgcgtgcagctggccgacgaggcatattccgccggttcgcccgccagccagcggaacgccgcgcgcggcaccgtggcccaggtggtgacgatgccgcctgtggtgcgccggcagatcgagcagtggcagtgagcgacatcgtccagcggcgcggcgacggcgtagcgcagatagccgcaatggcaaccgccggtatgggtctcgggcatggcgaatcctcctcgcgggagtgccagcataagccggacttgccctgtgccgcagccacctcgcaagatgagcggattccactatccgggggtgcccgtgaccgctctgctctactccctctggccgctgttcgccctcatcgtcggcggttacgccctgcgccgctgggactttcccggcgaagccttctggcctgccgcagaacgcctgaactacttcatcctgtttcccgcgctgctgttcagcaacctggcgaccgcgccgctggacgaccccggcctggcccgccaggccctggccgtactgctcgggctcggcgtcgcctggctcgccctgctgctctgcaagcgctggcgcggctgggacgccgggcgcttcggcgccatcgcccagggcgtattgcgcttcaacacctatctcggcctggccgcggtcggcagcctgtacggcaagccgggcctgaccctggccgcgctgatgctggcgctgatggtgccgacggtgaacgtgatgtcggtctgggcgctgaccgccgagcgcggcatcagcctgcgcgcgctgctgctgccgatcctgaagaacccgctgatcctcgcctgcctcgccggcgcactggtcaacctggccggcgtcggcctgcccggcggcagcgatcgcctgctcaacctgctggcggtggccagcctgccgctgggcctgctgtgcgtcggcgcggcgctgaaaccccaggaactcggcggcgaagtcgcggcccttggctggaactgcgcggcgcggctgctggcgatgccccttctggccttcgccatcgctcgcgggctgggcctgccgagcatggaaagcgccgtgctggtactgttcttcgccctgccgacggcgcccaccgcctatgtgctgacccgccaactgggcggcgacggccacctgatggcgggcatcattaccttgcaaacgctgctttccggcgccactctggtcggcgtactcctcgtgctgcaaggaagcccatgacgacaggacgcgtcgccgccgccctcacggcgctctgcctgctctgccaaccggccttcggtttcatcaaggtgtttcccgaattcgacgacgaacccggcgccgccaccttcttctgggcggccgtcaccaccgtcggcccgttcatcggcagcaccgtcagcgcacaggagtccagcgctgacgagggcgacaagctcgtccaggcgcgggacgacgccgccagcttcgtcgccagcgacggtgcgatccgtggcgcgtacctccaggcagccttgcaggtcctgcgccaggccccggaatacgccgggtacagcgacctgcaactggccgcggcgctcctcgcgcggcagccctga

SEQ ID NO: 2288 - DNA, 1584 bp, Pseudomonas aeruginosa
tcgaccacatatccgaaattacccgcacgtttcccgccgttatccagcgaaagctgcctgaaagcttcccgccgtagcatccgcccaccaccggcagaagaccggacacgacggcgcgcccacgagacgcccgcttacccgtacaaaaacaacaatggtgattgccatgccccgttccgcacacgcctacagccgcactccgtccgcgcgacgccacccgcccgccgcctgctgaccgcacgccgcacgcccgtccgccgtcttccccggagtgaacccatgctgaccctgctcgccttcgccatggtggcgaccttcatgttcctgatcatgaccaagcgcctgtccgcgctgatcgcgctgatcctggtcccgatcgccttcgccctgatcggcggtttcgccgccggcctcggcccgatgatgctcgacggcatccgcaccctggcgccgaccggcgtgatgctgatgttcgcgatcctctacttcgccatcatgatcgactccgggctgttcgacccggcggtgcgcaagatcctccggctggtcaagggcgacccgctgaaggtctcgctgggcaccgcggcgctggcgatgatcgtctccctcgacggcgacggctcgaccacctacatgatctgcgtggccgccgtactgccgttgtacagccgcctgggcatgagcccgctggtgatggcctgcctgatcatgctctccagcggcgtgctcaacatgaccccctggggtggccccaccgcccgcgcggcgagtgccctgcacgtcgacccggcggatatcttcgtgccgatgatcccggcgatgatcgccgggctgctggcgatcttcgccatcgcctggatgtacggcaagcgcgagcgcgcccgtctcggcgagctgcacctgcccaccgaccatgaggacctggcggagatcagcgagtcgcagtatccggaggcgcgccggcccaagctgctgtggttcaacgctattctcaccgtggtcctgatggcgaccctgatcgccggcctgctgccgatgccggtgctgttcatgatcgccttcggcatcgccatgatcgtcaactacccgtgcatccaggagcagaagaagcgcatcggcgcacacgccgagaacattctcgcagtggtctcgctgatcttcgccgccggggtgttcaccggcatcctctccggcaccgggatggtcgacgccatgtccaagagcctgctggcggtgatcccgccggcgctgggcccatacctggcgaccatcaccgcgctggtgagcatgccgttcaccttcttcatgtccaacgacgccttctactacggcgtcctgccgatcctcacccaggccgccgccgaatacggcatcaccccggtggaaatggcccgcgcctcgatcgtcggccagccggtgcacctgctcagcccgctggtgccctccacctacctgctggtggggctggccaagatcgacttcggcgaccaccagcgcttcaccctgaaatgggccgtgctggtgtgcctggcaatcctcgccatggccctgctgctgggcctgttccccctgttcagtaactga

SEQ ID NO: 2289 - DNA, 990 bp, Pseudomonas aeruginosa
accagttcttgcgcgcatgccttgcccggtaggggctggggcagatccactggataccgccgcaccagcgctcggcgagcgcttcggcggcagtgccgcgcagccccagaagcagcgaacgccaggtgcgcggacgctcgccggccacctcctcgattacctcgacctcgacgccggcttgcgccgcctcgaggcacagccgctcgaacgccttcgccaccgccaggcagcattccgccggcccctgggccgcggagagttgcagcaggatcatcggcagcactccccacgggtcttgtaggtcagcaccggcttcaggcgggcgaccaggcgcagcaggccggcttcgagcagcgcgccgaccaccgagtcgatacccttgtaggcttccggcgcttcctcgtagatcagttggcggtcgccacagatcaccctgctgccaaggcgcgtacggcccaactggtcgacgctgaagcgcgccgccagacgctcccgacactcgccgcgctgccatttgcgaccggcgccgtgggccagggagaacaggctctgcgcgctcggcacaggctccaccaggtagctgtagtcgccgcgcgagccggggatcaccagcacgccctggtcggccggggtggcgcccttgcggtgcagccagccgtcgacgccatcgacctgtgccggcgccaccaggttgtggttgatgtcgagcagttccaagccgtcgcagcgcaagcgttcgagaatgcgccgggcgatgagctggcggttaccctcggcgaagcgcagcgcatcggcgtggcgcgccaggtaggcggaagcttccaggctgccgtcgagcaggccggcgtggccatgcaggctgacctgttcttgcaggatcgcctggccgagaccgcgcgagccactgtgcaccagcagttgcaggcggccggcatcgaggccgagggcgtgcagggcggcctggtcgaacacggtctcgacctgctgtag

SEQ ID NO: 2290 - DNA, 1767 bp, Pseudomonas aeruginosa
tgccaggggggccacgccatgctgaaactgctcgacctgctctctgccgtcgccctgctggtgtggggcacgcatatcgtccgcaccggaatcctccgggtctacggcgccgacctgcggcgcatcctcagtcgcagcgtggaaaaacgcccgctggcgttcgccgccggcatcggcgtcaccgccctggtgcaaagcagcaacgccaccgccctgctggccacctccttcgtcgcccagggcctgatggcactggcgccggccctggcgatcatgctcggcgccgatgtcggcaccgcgctgatggcgcgggtgctgaccctcgacctgtcgtggctttcgccattgctgatcttcttcggcgtgattttcttcctcagccgcaaacagacccgcctcggccagctcggccgggtattcatcggcctcggcctgatcatcctggcgctccagctgatcgtcgccgccgccgagccgatgacccaagccaagggcgtcaaggtactgttctccagcctgaccggcgacatcatgctcgacgcgctgaccggcgcgttgttcgccatgatttcctattccagcctggccgccgtgctgcttaccgcgaccctcgccgcgtccaaggtgatctcgctgaaagtcgcgctgtgcctggtggtcggcgccaacctcggcagcggcatcctggccatgctcagcgccaccgcgcaaaacgccgccggtcgccgggtggccctcggcagcctgttgttcaaggtcgccggctgcctgctggtgctgcccctggtggggccgctggcggactggatggatcactggcagttcagcacagccgaactggtgatcgccttccacgtgctctacaacgccgcgcgctgcctcgcctgcctgccgctgaccaacgccatggccagcttctgcacccgtgtgatgcccgaccgtgcccttcccgacgacgtcgcccggccgcgccatctcgaccccgccgccctcgacacgccgagcctggcgctggccaacgcggtgcgcgagaccctgcgcatgggcgacaccgtcgagcagatgctgaacaatctgatgcagatcatccgcggcggcgatccgctgctcggcaaggacatccgcaagctcgacgacgacgtcgacgccctctacaccgcgatcaagctgtatctggcaaggatgccgcgcgaggacctgtccgaacgcgacagccggcgctgggcggagatcatcgagctggcgatcaacctggagcaggccggcgacatcatcgagcacatgctcgccgccgtgcaggacaagaagacctcgcgcagccgctcgttctccgacaccggcctggaagagatcggcaccctgtaccagcagttggtctccaacctgcgcctgggtctctcggtgttcctcaacggcgacctcgacagcgccaagcgcctgcgccgggccaagcagcgcttccgtctgcaggaacggcgctacgcccatgcccatgtcgaccgcctgcaccagcaggtggtacagagcatcgagaccagctcgctgcacctggacctgatcagcgacatgaagcgtctcaactcgctgttctgcgccatcgcctacgccgtgctggacaatccagacgcgccgagcagcgcggccgacgagggcactcggcgggacgaggacgactgggccgacgaagtcgacgacatgacctcggcgccgctggccgagccagcgctcgccgaggagcgagcggaaacgcgccgttcgcgacattag

SEQ ID NO: 2291 - DNA, 420 bp, Pseudomonas aeruginosa
gttcgtcatgaagcatccgctattctcggtattttcagttccaggctcggcccatgcgttcgttgtccaccctgctgctgttctgcctgctctgcccctggtcgtacgccgaccagcgcagcgaggtcgaagccttccagctggaaaacggcatgggcgtgctgctcaagcccaccgagcagcaccggcacgtctcgatccggctggtggtgggggtcggtttcgccgacttctcgtgccgtgaaaagcagctgccgcacctgctcgagcaccttttcttcagcggcctggacggcggcgacgaggccgacctggaagcccgcatgcaggccctcggcggacaatggaacgcctacaccagcgaaggcgacaccaccttcgtcatcgaggcacctgccgccacccagcggcaggtcctag

SEQ ID NO: 2292 - DNA, 840 bp, Pseudomonas aeruginosa
gccagcaccaccgggtcccacaagcgcaggcgctgcatcagcgccaccgacaacaggccggccagggtcgaggcgctggtggccagggggatcggcaggaataccagggtcggatcggccgcgccctgctgcgcgcggtacatgaagatagtcaccggcagcagggtcagggacgaggcgttgagcaccaggaagaggatctgcgcattgctcgcggtggtgctgctgggattgagctcctgcaacgccttcatcgccttcaggccgatcggcgtggcggcgttgtccagacccaggccattggcggcgaagttcagggtgatcaggccgatcgccggatgccccggcggcacttccggcatcagccggcggaacaacggaccgagcagcaccgccaggcgctccaccagcccggccttctcggcgatgcgcagaaagccgagccagagcgtcagggtgccgaacagcaggaccatcacctcgaccgccagcttggccatggcgaacaggctctccaccatcgccgcgaacaccgtcgcatcgccgccgatcaaccagcgcgccagcgcactcgccgccgccaccaggaaaaaacccaaccacaagccgttcagcattcagaatcccccgcgttgcgcggatgatagcggcgcaggcggtgccggcgccagaaacgccgaggccccggacgatgccggggcctcctgggcgggaagccgccttattcgagggtggcctgcttgcccttggcttcgccgaccgcctgccgcaggtgcggcagcgaatcccagtagcgctggcccttggccgcgtcgtacatgccttcccacttggagatga

SEQ ID NO: 2293 - DNA, 669 bp, Pseudomonas aeruginosa
cgagtcggcgatcctgcgcactttccgttattgcctcgaagacgaaggctacagcgtggccaccgccagcagcgcgccgcaggcggaggccctgttgcagcgccaggtattcgacctgtgcttcctcgacctgcgcctgggcgaagacaacgggctcgacgttctcgcccagatgcgcgtccaggcgccatggatgcgcgtggtgatcgtcaccgcgcattcggcggtggataccgcggtcgatgccatgcaggccggcgcggtggattacctggtcaagccctgcagcccggaccaactgcgcctggccgccgccaagcaactggaggtgcgccaactgaccgcgcgcctggaggccctggaggacgaagtgcgccgccagggcgacggcctggaatcgcacagcccggccatggccgcggtactggagaccgcgcgccaggtagcggcgaccgacgccaacatcctcatcctcggcgaatccggctccggcaagggcgaactggcacgcgccatccacacctggagcaaacgcgcgaagaagccccaggtcaccatcaactgcccgtcgctgaccgccgaactgatggaaagcgaactgttcgggcacagtcgcggcgccttcaccggtgccaccgaaagcaccctgggcagggtcagccaggctga

SEQ ID NO: 2294 - DNA, 2418 bp, Pseudomonas aeruginosa
cggcggcaccctgttcctcgacgagatcggcgacttcccgctgaccttgcaacccaagctgctgcgcttcatccaggacaaggaatacgaacgcgtcggcgatccggtgacccgccgcgccgacgtacgcatccttgccgcgaccaaccgcgacctgggcgcgatggtcgcccagggccagttccgcgaggacctgctctatcgcctcaacgtgatcgtgctcaacctgcctcccctgcgcgaacgcgccgaggatatcctcggcctggccgaacgtttcctcgcccgcttcgtcaaggactacggccgccccgcccgcggcttcagcgaagccgcccgcgaggccatgcggcaatacccctggccgggcaacgtacgcgagctacgcaacgtgatcgaacgcgccagcatcatctgcaaccaggaactggtggatgtcgaccacctcggtttcagcgctgcgcaatctgccagcagcgcgccgcggatcggcgaatcgctgagcctggaagacctggagaaagcccatatcacggcggtgatggcctccagcgcgaccctcgaccaggccgccaagaccctcggtatcgatgcctcgaccctgtaccggaagcgcaagcagtatggcctatgagcatgccgctgccgatgaagctccggacccggttgttcctcagcatttccgcgctgatcaccgtctcgctgttcggcctgctgctcgggctgttcagcgtgatgcagctcggccgcgcccaggaacaacggatgtcgcaccactacgcgaccatcgaggtgagccagcaactgcgccagttgctcggcgaccagctggtcatactgctccgcgaaacccccgacgggcaggccctggagcgctcgcaaaacgacttccgacgagtcctggaacagggccgggcgaataccgtcgacagcgccgagcaggccgccctggatggcgttcgcgacgcctacctgcaactgcaggcgcacaccccggcgctgctcaaggcgcccatggccgacaacgacggcttcagcgaagccttcaataccctgcgcctacgcctgcaggacctgcagcaactggcgctggccggcatcagcgacgccgagaccagcgcccgccaccgtgcctacctggtcgccggcctgcttggcctggtgggcgtcgccatcctgctgatcggtttcgtcaccgcccacagcatcgcccggcgcttcggcgcgccgatcgaaaccctggcgcgggcggcggacaggatcggcgaaggcgatttcgacgtgaccctgccgatgaccaacgtcgccgaggtcggccagttgacccggcgtttcggcctgatggccgaggccctgcggcagtatcgcaagaccagcgtcgaagaggtgctttccggcgagcggcgcctgcaggcggtactcgacagcatcgacgacggcctggtgatcttcgacaaccagggacgcatcgaacacgccaacccggtcgcgatccgccagctgttcgtctccaacgacccccatggcaagcggatcgacgaaatactcagcgatgtcgatgtccaggaggcggtggaaaaggccctgctcggcgaagtccaggacgaggcgatgcccgacctggtggtggacgtcgccggcgagtcgcgcctgctggcctggtcgctgtatccggtcacccatcccggcgggcatagcgtcggcgcggtgctggtggtccgcgacgtgaccgagcagcgcgccttcgaacgggtccgcagcgaattcgtcctgcgtgcctcccacgaactgcgtacgccggtgaccggcatgcagatggccttcagcctgctccgcgaacgcctggacttccccgcggagtcacgggaagcggacctgatccagacggtggacgaagagatgtcgcggctggtcctgctgatcaacgacctgttgaacttctcgcgctaccagaccggcatgcagaagctcgaactggcttcctgcgacctcgtcgacctgctcacccaggcgcagcagcgtttcattcccaagggcgaggcccgccgggtctcgctgcaactggagctgggcgatgagctgccgcgcctgcagctcgatcgcctgcagatcgagcgggtgatcgacaacctgctggaaaacgccctgcgccatagcagcgaaggcgggcagatccacctgcaggcccggcgccagggcgaccgggtgctgatcgcggtggaagacaatggcgaaggcattcccttcagccagcaaggacggatcttcgagcctttcgtccaggtcggacgcaagaagggcggcgccggcctcggcctggcgctgtgcaaggaaatcatccagctgcatggcgggcgcatcgcggtgcgctcgcaaccgggccagggcgcgcgcttctacatgctgctgccggtgtga

SEQ ID NO: 2295 - DNA, 2139 bp, Pseudomonas aeruginosa
gcaggatcggaatctcgcgcgactgccgggcgcgctcctcgatatcgcgggcgaactgcttcagcggcttgcgcagttcccgcggcaggtccagggccagcaactgctgggccagttcgccgagagcatcgatgttctgctgggtgcgttgctggcggcgctgttcggagtcgagcacggccttttccaggcgcggaatcaggcccgacaggccggcgtccatgtcgtcgcgacggaggatctcgcgcagctccttcatgcactggtcgaccgccttgtcgctgccttcggccgccagactgctacgcaccaggccgcgacgcagcaggtcgatccgggcatcccagcgccgttgcaggcgctcctgctgctcgatgttctccaggtacttgtctttccagcgctggacgtcgtcgcgactcatggcggactcccggcatccccgcgcacgaccaaggccttgtcgcgcaggttgtccggcaggcgaatctccaccgataccggcagatggtcggagatcggctggtcgagcacgtcgacccgctcgagagcgagatcggaactgagcaggatgtgatcgagattgcgctgcggccgccagctgggaaacgtcgcctcgacctgcggcgccatcaggccgaggtcgcgcaggggcgagttttccagaagatcgacggcgtgggtgttcatgtcgcccatcagcacctgatggcggtagtcgccgatcagctcgcggatataggcgagctggcgggtgcgggtgcgagcgccgagagcgagatgcatcatcactaccaccagcgcgtcggcgccttcgccaaagcgcacgaagatcgcgccgcgtcccggcggaccgggcaacggatgatcttccagcagggtcggccgccagcggctgagcaggccgttgctgtgctgggcgatacgcccgaggttgcggttgagctgctggtaccagtaggggaacgcccccaactgggccaagtgctcgacctgattgacgtagccggaacgcaggctgccgccgtcggcttcctggagggcgacgaggtcgtagtcggcgagcagttcgccgatccgcttcaggttggtcgcccgccccgcgtggggcagcaggtgctgccaaccgcgggtcaggtagtggcggtagcgctcggtgctgataccgacctggatgttgaagctgagaaggcgcaggcggccgtcgtcgggcagctcccgcgaatcgtcacaggaggggttcactcgcgggtcgcagctgcctgcgacccgaggttcacgctgccagcggcgcaacatgccgaatcaccttgcctacttcttggccgctgcgcgctctttctcgatcaggtagtcggccagcttgagggtttcctccggaccaccggcggagccgatgtcgaagcggtatttgccattgaccaccatggtcggtacgccggtgacctggtaggccatcgccagcttcttggccttttccatctggcccttgatggcaaaggaattataggtgctcaggaatttttccttgtccacgcccttgccggcgaggaaatcggccatttcttccggagtggcgagcttcttgtgctccttgtggatcgcctcgaacacggcgttgtgtacgtcatgctcgacgcccatgctttccagggtcaggaacatctgcccatggacgttccagataccgccgaacagggcaggcaggcgcacgaaatggacatctgccggcagcttctcgctccacggcacgatggtcggctcgaacgcgtagcaatgcgggcagccataccagaacagttccaccacttcgatcttgcccggctgggacaccggcaccgggctgctcagctcgacgtattccttgccggcggtatagtcgtcggcctgggcggccatgccgaacaggctggccatggccagcatggcggtgagaatcaggttacgcatcgttcactcctaggcgaggtcagtgccgctctccggccgggttcggcccggtcagttcgaccggggggagcggtcacgggttccagcattgtagcgatggcggacgcaaaaaagggcagccgaggccaccctttttcatacatcttttttgccgtgctacgcagcgatcagtgcagaccctggatgtag

SEQ ID NO: 2296 - DNA, 465 bp, Pseudomonas aeruginosa
attcctgcccagccaggtcgtatgcctggcgctccagggcgaccatcttctcgcccagttcgcggctctggatgcccagcaggttggcgtcgaccagcgcgccgttgcgctcgatccgcgccagcaccggtaccagcggcatctcgatgtcggtcaggaccctggccagggacgggatcgcctccagcttctgccacagggcctggtgcaggcgcagggtcacgtcggcgtcctccgccgcatagggcccggcctgttcgatggcgatctggtcgaaggtcagttgcttggcgcccttgccggcgatgtcctcgaaacggatggtgctgtggccgaggtacttcagggccaggctgtccatgtcgtggcgagtggcggtggagtccagcacataggactcgagcatggtgtcgtaggctacgccccgcagcgcgatgggggtgctggcattggccaggacattga

SEQ ID NO: 2297 - DNA, 306 bp, Pseudomonas aeruginosa
aggagcaaggttaccatgcgtacgctgaaccgcttgatgctcgccggactgctggcgttcgccccgctcgtcgcgatggcggcggacgacgacgcgccctccggcgagcccgacgtaaccatccgccaggagggcgacaagaccatccaggaataccgcgtgaatggcttcctctacgccatcaaggtggttcccaagcatggcaaaccctatttcctggtccgcgccgacggcagcgatggcaacttcattcgctccgaccagccggacaagctgattccacaatgggagatcttcagctggtga

SEQ ID NO: 2298 - DNA, 984 bp, Pseudomonas aeruginosa
tgtgcatttccaaccgggcgaggccgcgctgacatgtcggtgttcaccccactcgaacgctcgaccctggaagccttcctcgccccctacgacctgggccgcctgcgggatttccgtggcatcgccgaaggctccgagaacagcaacttcttcgtcagcctggaacacggcgagttcgtcctgaccctggtcgagcgcggcccggtgcaggacctgccgttcttcatcgaactgctcgacgtgctccacgaggacggcctgccggtgccctacgccctgcgcacccgcgacggcgaggccctgcgccgtctcgaaggcaagccggcgctgctgcaaccgcgcctggccggccgccacgagcggcagccgaacgcccaccactgccaggaagtgggcgatctgctcggccaccttcacgccgccacccgcgggcgcatcctcgaacgcccgagcgaccgtggcctgccctggatgctggaacaaggtgccaacctcgccccgcgactaccggaacaggcccgcgccctgctcgccccggccctggcggagatcgccgcgctggatgccgagcgtccagcgctgccgcgcgccaacctgcatgccgacctgttccgcgacaacgtgctgttcgacggcccgcacctggccggcctgatcgacttctacaacgcctgctccggctggatgctctacgacctggcgatcaccctgaacgactggtgctccaataccgacggcagcctggacccgggccgcgcccgcgccctgctcgccgcctacgccaaccgccggccgttcaccgcgctggaagccgagcactggccgagcatgctgcgggtcgcctgcgtgcgcttctggctgtcgcgactgatcgccgccgaggcgttcgccggacaggacgtgctgatccatgatccggcggagttcgagatgcgcctggcgcaacggcagaacgtggagattcatttgccgtttgcgttgtag

SEQ ID NO: 2299 - DNA, 1326 bp, Pseudomonas aeruginosa
ccgaattgcggcggcgcgtgctggagctggtctggcagagccacaagccgctgggggcctacgatatcctcgcggtgctcagcgaaaccgacggccgccgcgccgcgccgccgaccgtctaccgcgcgctggacttcctccaggagaacggcctggtgcaccgcatcgcctcgctcaacgcgttcgtcggctgcaacaacccggagcacagccaccagggccagttcctcatctgccgcacctgccacaccgcgatcgagctggaacagccggatatcagccgggccatcgtcgccggagcgaacagcgtcggcttcgccgttgaaagccagaccgtcgaggtggtcggcctctgcggcacctgccgggaccagaaggacgcctgatggacaacgcgctggtgcggctgacccaggtcggcgtgtccttcaacggccaggcggtgctgagcgatgtcgacctggccatcgagcccggccagatcgtcaccctgatcggccccaacggcgccggcaagaccaccctggtacgcagcgtgctcggcctgctcaagccgcacgtcggcgaggtctggcgacggccgcggctgaccatcggctacatgccgcagaaactccacgtcgacgccaccctgccgctcagcgtactgcgcttcctccgcctggtacccggggtcaggcgcgagcaggcgctggcggcgttgcgcgaggtcggcgcggcgcacgtgctggagcgcccgctgcaaagcatttccggtggcgaactgcaacgcgtgctgctggcccgcgctctgctgcgcaagcccgagctactggtgctcgacgagccggtgcagggcgtcgacgtcgccggccaggccgaactctaccgcctcatcggcaaactgcgcgaccgctacggctgcggtgtgctgatggtctcccacgacctgcacctggtgatgagcgccaccgaccaggtggtctgcctgaaccgccatgtctgctgctcagggcaccccgagcaggtcagcggcgacccggccttcgtcgagctgttcggccaggacgctcgcagcctggcgatctaccaccaccatcacgaccacgcccacgacctccacggcgaggtggtcaaggccggtcccggcgccttgcctccaggcacccgcttcactcctgtccacaagcacggccccgactgcaaccatggctgacttcctgctcaacgccctcctcgccggcctcgccctggccctggtggctggccccctgggctccttcgtggtctggcggcggatggcctatttcggcgataccctgtcccacgccgcactgctcggggtag

SEQ ID NO: 2300 - DNA, 948 bp, Pseudomonas aeruginosa
gttttgtcctgccccgccgcacggtgtagaatctggcgattttttgaccaaacgagaacccgcaggaatgatgtcgtccttctttcgcctgctgtccgtcctggcggcggcgctgctggtcagcgcctgccagggcaatgcgtcgtcgcaaccgacgccggtggtcgcgccccaggcgcagcccgccgatccctatgccgaactgcagcaaaccctggccgccggcaagctcgaacaggccgagcaacaatggctggccctgcgcagcgcagccgccggcgacgagcgcgtcgaagcgttccgccgccagttggccgaggcctacatgcagcgcggggaaaccgcgctgcgtcaaggagacctcaacaccgccaccagcgccctcggccatgcccgcggactgatgcccaaagcgccggcgctgaccgccgggctggacggtgcgatcaaccgcgccaaggtcgatcccgcccgcgccgagcaggcccgacgcatgcagcaggcggcccagcagcagatgcagcagatcatccagacgccgcccggcggcgagctgaagccgctgcccggcgctccccacctgatcgatccgcaagcggccagcagcgccgtgcccctgccgatgctcgacggcaccggccagggcggcctcggtgcggtgctcgacgcggtggccgcggatgtcgtcgcctaccgttgcagggtgcatatcgaagtgcgccgggacagcgactatccgctggtttccgaccagctcttggcgcgggtgaagaagctctcacccgatttcgacctgcatctcagccatgtcgtacaggccgacaagccaacccgattgatacttaccccccggaattgagaccggtcctgccccggccgcagcagaaagcgcttgtcgggagcgcaccagacgcttattccatttcaatgatttttcatcaccaataa

SEQ ID NO: 2301 - DNA, 1038 bp, Pseudomonas aeruginosa
cagcatcgccgcacccacaaggttcgcccagtgatcgaattccacgacgtccacaagacctatcgagttgccggtcgggaaatccccgccttgcaaccgacccgcctgaacatccaggccgggcagattttcggcctgatcggccattccggtgccggcaagagcaccctgctgcgcctgatcaaccgcctcgaggagcccagcggcggccgcatcctggtcgagggcgaagacgtcaccgccctcgacgccgaaggcctgcgccgtttccgccagcgcgtcgggatgatcttccagcacttcaacctgctgtcctcgaagaccgtcgccgacaacatcgccatgcccctgcgcctggccggcggcttcagccgtgccgaagtcgatgcgcgggtctccgagctgctcgcgcgggtcggcctgtccgaccacgcgcgcaagtatccggcccagctctccggcggacagaaacagcgcgtcggcatcgctcgcgccctggcctgccggccgagcatcctgctctgcgacgaggccaccagcgccctcgatccgcagaccaccgcctcggtcctgcaactgctggcggaaatcaatcgcgagctgaagctgaccatcgtcctcatcacccacgagatggacgtgatccgtcgtgtctgcgaccaggtcgcggtcatggacggcggcgccatcgtcgagcagggcgatgtcgccgatgtcttcctccatccgcagcacccgaccacacgccgcttcgtgttcgaggccgaacgggtcgacgaagacgagcgtcacgacgatttcgcccacgtgccgggtctcatcctgcgcctgaccttccgcggcgaagccacctatgcgccactgctgggcaccgtggctcggcagaccggggtcgactacagcatcctttccggacgcatcgaccgcatcaaggacacgccctacggccagttgaccctggccctggtcggcggtgacctggaagccgccatgagccagttgaacgccgctgacgtacatgtggaggtactgcgctga

SEQ ID NO: 2302 - DNA, 921 bp, Pseudomonas aeruginosa
tcctcgtccagattctgcaaaccgtgggcgacaagctggtggtgcacttctcgcgcaagtaagcttgccggccaagcccaaaaccctgagcgccgcggttatccacagccgccaggaacacctcgaaaggagttgaagatgaaaaaactgcttgctgctttctccgctgtcgcggcgctcggcctcaccgccgcccaggccgccgagtccctcaccgtcgcggccaccccggtgccgcacgcggagatcctcaacgtggtcaagccgctgctggccaaggaaggcgtggacctgaagatcaaggagttcaccgactacgtgcagccgaacgtgcaggtctcggaaaagcgcctggacgccaacttcttccagcaccagccgtacctcgatgagttcaacaaggccaagggcaccgacctggtcgccgtgaccggcgtacacatcgagccgctgggcgcctactcgagcaagtacaagaagctcgacgaactgccttccggcgctaccgtggtgatccccaacgacgccaccaacggcggccgcgccctgctcctgctggacaaggccggggtgatcaagctcaaggacaacaagagcatcaccgccacgccgaaggacatcgtcgacaatccgaagaacatcaagatccgcgaactggaagccgcgaccctgccgcgcgtgctgacccaggtcgacatggcgctgatcaataccaactacgccctggaagccaagctgaacccgaccaaggatgcgctggccatcgaaggcagcgactcgccctacgtgaacatcctcgtcgcgcggccggacaacaaggacagcgacgccatgcagaagctggccaaggccctgcacagcgccgaggtcaagcagttcatccaggagaaatacaaaggcgcggtggtaccggcgttctga

SEQ ID NO: 2303 - DNA, 666 bp, Pseudomonas aeruginosa
catccagcgcctcgccgactggctgctcgacagccgcctgcgcgtgcactgccacggcggacgcttcagccgtttcctcgccggctacctggtcacccatctgcgcctgctgcgcccgcagtgccgattgctcgacgacggcgccctgctccccgaccagctctacgacctcggccgccaggacctgctggtcctgttcgactatcgccgctaccagagccaggcccagcacgtggcccaggccgccaaggcacgcggcacacggctggtgctgttcaccgacatctacgcctcgccgctgcgcgaacacgccgacctgatcgtcagttcgccagtggaatccgcctcgcccttcgactcgctggtgccggccatggcccaggtcgaggcactggtagcgaccctggtggcgcgcatgggcgcgccgctcgacgaacgcctggagggcatcgaccagctccgcaacgcgttcagcagtcatattctggaggaatgacccgatgttcagcctgccccaccactcgccgcgcgacctgccattcggccgccggcagaccgccatcctgttcgtcgacatgcagcgtgcctgggtcgagccggggcgcgacccgcacgtcgatccgcaggcagccggttacttctacgagcgcgtgcagaaccaggtga

SEQ ID NO: 2304 - DNA, 1791 bp, Pseudomonas aeruginosa
tcgtctgcggggtggtcaccgaccagtgcgtggacatggccgtgcgcgatgccgccgaccgcggttacctggtcaccctggtcgaggatgcctgcgccacccataccccggaacgccaccaggcctgcctggaagcgatcaagggctactgctggatcagcgacaccgagaccgtcctgcaacgcatcgccgccctcggccggagcaacctgtgaaccgcctgcagccggtacgcctggtcagcttcgtcaccaccgacctggccggcatcacccgcgggcgttcgctgcccctggcgaccctggaggagcaattggccagcggttgcggctgggtaccggcgaacagctcgctgaccccgcaggacctgatcgacgagagcagcccctggggcagccacggcgacctgcgcttgctgcccgacccgaacagccgggtgcgcgtcgagcagggtcccgacgccgctgcgccggcgctcgactacctgcacggcaacctggtggaaaccgacggcacgccgtggccggcctgcccgcgcagcctgctgcgggccgaggtggaacgctatcgcgacagcggcctgcaggtcatcgcggcgttcgaacacgaattcagcctgctcggcctgcccggcgagcgtccggccgcggcgttttcgctgcaggcccagcgtgccgccgggcagttccccggctggctggtcagcgccctggcccaggctggcaccgagccggagatgttcctccccgaatacggccagcgccagtacgaggtcacctgccgcccggcgcagggcgtggccgccgccgaccgcgcggtgaacgtccgcgaggtcactcgcgaagtggcgcggcagatgggcctgcgtacctgcttcgcaccgctgccggcacccggcgcggtgaccaacggggtgcacctgcacctgagcctgcaacatgccgacggcagcccgctgctgtacgagcccggtcgacccaacgatctctccgaactcggcgagcactgggccgccggcgtgctcgcgcacctgccagcgctgtgcgcgctgaccgcgcctaccgccgcctcctacctgcgcctgaaaccccaccactggagcgccgcctacgcctgcctgggactgcgcaaccgcgaagcggcgctgcgcatctgcccggtggtgagcgtcggcggcaagccgctgggcaagcagtacaacctggaattccggccgatggacgccaccgcctgtccgcacctggcgatggccgcggtgctgatcgccggccgcctgggcatcgaacgacgcctgccgctgcgcgccctggccgatatcgatccgcacggcctcagcgacgaagagcgccaggcccgcggcatccaggccctgccggcgaccctcggcgatgcgctcgactgcctgcagcgcgacgagacgctctgcgccgagctgccaaagccgctgctggacacttacctcgccatgaagcgccacgaactggcactgacggcgggcctttccgacgacgacctgtgccgccactatgccgagctttactgacaaccccgaactcggcatctaccagctgccaccctaccgcctgctcaaccccgaaggggcgcacccggtggtcctggtctgcgagcacgccagccggcacatcccgctggagttgcagcgcctcggcctggaccaggccgcggcggaagaacacatcgcctgggatatcggcgccctggcgctggccgaagagctttcccggcggctcgacgcgccattgctggcggccggctactcgcgcctgctga

SEQ ID NO: 2305 - DNA, 1440 bp, Pseudomonas aeruginosa
cgacaatacgctgccttttcccgaggagcccgtcatggccatcgaacagttcggataccggcaacagctgcgccgcagcctgtccctgagcgacctgatcatctacgggatgatcttcatgatccccatcgccccgttcggggtctacggctgggtccatgccgacgcccacggcatggtgccgatggcctacctggtgggcatgctggcgatgctcttcaccgccctcagctacggagccatggccaaggcctttccgattgccggctcggtgtattcctacgcccagcgcggcatccacccccatgtcggcttcatcgccggctgggtgctgctgctcgactacctgctgatcccgccgctgctctacgtgttcagcgcgctggcgctgaaccacttgttcccggcgatccccaagctggcctggatgctgctgttcctggtctcggcgaccctggtcaacctgcgcggcatcaccttcgccgcccgcgccaacctgttgttcctgatcggagagctggtggtgctggcgatcttcctggtggtcggctaccaggcgctggaaggcggcctgggcaacggccggctgaccctcgaaccgctgtatcgcccggaagccttcgatctcggcctggtgatgaaggccgcctcgatcgccgtactgtcgttcctcggcttcgacgccatctccaccctcgccgaggaggtcaagggcgatcccgcccggcagatcggccgcgccgcgctgatcgcgctgttcatcatgggcggcatcttcatcgcgcagacctggctggccaccgacctcgccgccgggatgaacttcaagtcggcggacaccgccttctacgagatcgccgaagcggccggtggccagtggctgtcgatgctgaccgcggtagccaccgcgctggcctggggtgtcaccgtgtcgatcacctcgcaggcagcggtctcgcgcctgctctactcgatggcccgggacggcaggctgccgcgcgcgctggccagggtccatccgcgctaccagacgccgcacgtcagcctgtacctggtggcggtgctgtcgctgggaatcggctgggccttcctcgacgcaccggacgtgctcacctcactggtgaacttcggtgccctcaccggcttctgcctgctgcacctgagcgtgatcaaccactactaccgccgccagcgctccggccagtggttgcggcatctactgttcccgctggtgggcctggcgatcatcgcctacgtgctgtacagcatgagcctcgacgcacagttgctcggactggcctggatcgcggtggggctggtctacctggcgttgctgcaacgcggcgggcgccaggcaccaacggagttggcgaaggatctctgacgcctcgcgagggctggttcaggccggctcttcgccgacgaaatcgctgcggctga

SEQ ID NO: 2306 - DNA, 1806 bp, Pseudomonas aeruginosa
ccaccccggcgaaggacttgtccaacgctcccaggcattcctcggcgcgcaggcacaggcgcacctcgaagccggacagctccagccattgctgcaccgcttcgcggatcgtcgcttcgtcgtcgacgaagatcacctggtcgctcatgtcgttacgctcgtgtcatcgggggccgccggcaggatcaggctgaacaccgctcccgcctcggcattggcgacctgcaggcggccgccgagttcgtggacgatcccataggataccgccaggccgaggccgagtccctctcccaccggcttggtggtgaagaacggatcgaagacgctgcccaggtgctcggcgggaatcccgccgccgttgtcggcgacgctcagcacccagtcgccgccaagccgttgcagggccaggcggatccatggccgctcctggccggcaacggcatccagggcgttgcgcagcaggttgaccagcacctgttccaggcggatcgcgtcacccatcacccaggccggccagagcagcgcctgctcgatctccacccgttcggcgcggattcgcggcagcaacaactgctgcgcctgttcgaccacgtgacccaactcgatacgctcgcgcaggccgccggcgctcttgcgcgcgaaggtcttcaggtggccggtgagcgcggccatgcgttcgagcatctggtcgatgcgcggcaacgcctggcgcgcctcgtcgtggcgtccggcgtcgagcagcaggcgcaggctggccagttgcatgcgctgggcggtgagcggctggttgatctcatgggccagggctgccgacatctgccccagggcggccagcttggccgcctgcaccaggccgtcctgcgcggtacgcaggtcggcggtgcgctgctcgaccaggcgctccagctcctcccggctacgttgccgcaggcgggcgatacgccagcgctggtgcaggaacaagccgaggaagaccagcgccagccaagtgccggcggcggccaggcgcgcggtggcgacgtcgtcctggatgctcgcggtgtcgcgcagcaagtggagggtccagccgtcgttgggcaggtccagcgattgccagaggtagtccttctcgccgtcggcgctttccacccgcgccagacggctgtcttcgccgtagctgcgcaaggtctggtggcgcaggggtgtcaggggctggcgatcgtattgccgggtctccgccagttcgaagcggtccacggtatccagcggttccagttcgcggtagcgccaaccggcgtggttggcgaggaacacgatgcccttggcgtcgctggccaggaccaggtcgggggtctggttccactgccgttccagatcgggaaactccagcttgaccacgattgcgcccaggaagctgccgtcctcggcgcgcaccgcgtgggacaggaaataaccgggaatcccgctgatcaccccgaccgcatagaaacgtccggagccttgggcgatggtctggcggaaatagggacggaaaccgtagttgtggcccacgtagctggtcggcaggttccagttgctcgccgccacggccagcccggtacggtcgagcagctccagggtggaggagcgggcggccaggttgatgctttccagcttgaggttgaggcgctgctgcaactcgccgtcgatcggcccggccagcgccgcgcgcaggtccggatccagcgccagtaccgccggcaggctgcggaagcgttcgatcagggtctgcagcgagccggcgtagaggtccagctgcttgcgcacctgttcgccctcggcgcgtag

SEQ ID NO: 2307 - DNA, 1065 bp, Pseudomonas aeruginosa
cgcctgctgccgcgcctggcgacccgcccagtccatggacagcagcaggccgccgagcagcggcagcaacagcaggaacaggcgcagtggacgggacaaggacatcggcggatcgaaacggcggcgggaagcggcgacgatagcacggcgcccggttacactgcgcgccgtacgaggagtccgcccatgtcgctatccccctggtcccattcctgctcggccggtttcaccctgcgcggctggcgcagcgaaccgagcggcaagccgttgctgcatttcctccatggcaacggcttctgcggccgcacctacgaaccgatgctgcgtctgttgacggaggatttcgacctctggctgtgcgacatccagggccacggcgaaagcgaccacggcggccgcttccacggctggaaccgcaacgccgagatggcggtggaggccttcgaggccgggcgcggtccctatggagatgtccagcgactggcctgcgggcacagcttcggcggcgtcctcagcagcctcgtcctggcccgccatcccaccctgttcgcccgcgccgtgctgctcgacccggtactgttcaccccggcgatgatcggcgtgatggcactttccgagaccctcggcctgcaattgcgcggcagcctggcgaagaaggcgcgcctgcgccgcagccagtggcccgatcgcgcagccgcctacgccggcttgcgcggccgcggtatcttcaagggctggaccgacgaggcgctgtgggcctacgtggaatatgcgctgaaggagagcgacggcggagtcgagctgaagtgccggccaagccgcgaagcggagatcttcagctccttccccaggcggctgtggccgtcgctgggcaagatcatcacgccgacccgcgtgctctacggtgaccgcacctaccctttcgtcgccaagtcggtggcgcgctggtgctcgctcaacccccaggtcagcgcccacgtggtggtcggcggccactgcttcatgcaggaagacccggccgatgccgccgaacgcgtacgcgactttctcctgcccaatccatga

SEQ ID NO: 2308 - DNA, 906 bp, Pseudomonas aeruginosa
cccccatactgcgccgactcagctgtaggaagtcgtctcatgccacgtacgccccacctgctcgccatccagtcccatgtggtcttcggccacgccggcaatgccgcggcggtgttcccgatgcagcgcatcggaatcaacgtctggccgttgaacacggtgcaattctccaaccacacccagtacggtcaatggaccgggcaggtgctgccgccggagcagattccggcgctggtggacggtattgccggcatcggcgaactgggcaactgcgacgcggtgctgtccggctatctcggcagcgccgcccagggccgcgccattctcgatgtggtggcacggatcaaacaggccaaccctcgggcgttgtacctctgcgacccggtcatgggccacccggaaaaaggctgcatcgtggccccggaagtcagcgacttcctgctggaagaagccgccgcggtcgccgactacctgtgccccaaccagttggagctggacagcttctgcgaccgccagccgaactccctcgccgactgcgtggaaatggcacggagcctgctggcacgcggtcccagggcaatcctggtaaagcacctgaactatccgggcaaggccggcgacaccttcgagatgctgctggtggccgccgatcaggcctggcacctgcaacgcccgctgctggccttcccgcggcaaccggtcggggtcggcgacctggcctcggggctgttcctctctcgcctgctgctcggcgacgacctgcgtaacgccttcgaattcaccggcgccgcggtccatgaagtgctgctggaaacccaggcctgcggcagctacgagctggaactggtgcgggcgcaggatcggatcgcacacccaagggttcgtttcgacgcagtgcgcctttag

SEQ ID NO: 2309 - DNA, 573 bp, Pseudomonas aeruginosa
gcgatgcccagggcaatggccagcacggccagggtgaagagctcccgcgaaccgctggcggcgatcctctccagcacccagggcaccacccggcgaccgccgaagatcatcagggcgacgaaggcggcgaccttgcccagggtaatcagcagcggccagagcagaccggcgtcgccgccgtcggtcttgccgccgagggtgccggcgagcgccggcaggagcaccagggtcaggaccatcgccaggtcctcgacgatcagccagccgatggcgatcctgccacgcttggtgtccagcaactggcgctgctccagggcgcgcaacagcaccacggtactggccaccgacaggctcaggccgaataccaggccgccgccgaagctccagccgagcagcttggccaggccgatgccaagcagcgtggcgacgccgatctgcaccagcgccccgggaatggcaatggccttcaccgagagcaggtccttgagcgagaagtgcaggccgacgccgaacatcagcaggatcacgccgagttcggcgatttcctgcgacagcgcctggtcggcgacataa

SEQ ID NO: 2310 - DNA, 1377 bp, Pseudomonas aeruginosa
accgccagcagctcgtcgcgatgcagcagcttgccgcgcggcacgccgttggcgtcgatcaggaacagctcgatgctgcgcacctcggggtgtgcggcgaggaactcgcgggcttcccgcggatcggcgaaatgcatctcaggcctcccgcgcgccgggtatggcgagcagctcgccgagcgcctcgtcgaggctggagagcaggcggtcgacatcttcttcgcgagtgtccgggcaacacagggtcatgttgtggaacggcgtgatgaggatgccgcggttgatcagatacaggtgcaaggccatctgcaggctgtcgtggaacgccgcctcggcggccgcgccgtcgcgtgggggttgcgggcagaactggaactcgctgcgcgcgccgagctcggtcaccgaccaggccaggccgtacttgtggataatcctgcggaagccctcggccagacgcgccgccagggacagcatgtgggcgtaggcggtatcggtcatcacctcttccaggttggcgcgcatacagcgcatcgccagggcgttggccgacagcgtggtacccatgccgctgtggccgtggccttcgctctgctcgctggcacgtgccctggccagttgcatggcgctggccatcgccgcgctgcaaccatacaccgagcacggtacgccgccggcgatcggcttgccgagggtgatgaagtccggctcgagcttccaggcgcgggtacagccgccaggacctgtggagatggtgtgggtctcgtcgatgatcagcagcgtgccgtgacgacgggtcagctcgcgcagcttctggtggaagccgggttgcggcaggaccatgccgatgttggtcatcgccggctcgcagagcacggcggccacgtcttcgctggccagcgcccgctccagggcctggaggtcgttgaacggcaccgcgcggctgaactgggtgaggtcgtgggcctggccgagcaggccggagcgatgcacggtgcggccgtcgcggcagcgaaccagggtgtcgtcgaccgtgccgtggtagcaaccgtcgaaaaccagcaccaccttgcgaccggtgatcgcacgcgcccagcgcaggacgaagcggttggcgtcggtagcggtggtcgctacctgccagaacggcaggccgaagcgctgcgccagcagctcgcctgcgacgatggcatcctcccccggaagcatggtggtcaggccgttcgcgccctgctcggcgagcgcccgggcgatcggcgccggagaatggccgaacatgctgccggtatcgcccaggcagaagtccacgtaggcgtggccgtccacatcatggaaacgcgcgccgtgggcacgttccacgaacagcggacagggtgttga

SEQ ID NO: 2311 - DNA, 2868 bp, Pseudomonas aeruginosa
gcgtcgccgatctcggcgcgctcctgcttcagccattgcaacatctgcggggtgacgaactcggcgatcttgtccatctcgttggcatcccaatgctgctgcagggacatgaagtgttcgcgagcggcaccgacgaagcgctcctcgttgaaccagctcggcgcgttgatcaccgggctcggcgcagcggcagcagcggcggcgccaccgaagatcggcgcctgggccggcatttcgcgctgcatcggcgcgtgcccggccatcgcaggctggccctggttctgctggcgccggcgagcggcgatgaagcggaaggcgatgaaggccaccagggcgatcaacaggatgtcgagcatctggatgccctcgaagccgtcgcccatgaacatggaagcgagcaggccgcccgcggcgataccggccagcgggccgagccagcgcgaagcaccgctggcggcagcggcgggacgagcggcgttgggggcggcagcagtggcgttcggcgcagtggccggctgcgcctggcgggtctggtggctgggtgccgagccgaggctcttgccgccgccgaagcgcttggcattggcatccaggctgacggtcagcgccaggcagaaggcgagggcgatgctgagaacacgctgcattgtagtctttctctcttgggggaatcgacgcgcgccatgttgcggcggtacgggcgacaggaccagccggattttgtttcgggctattgctccccggccgccgttttttcgcccgccgcgtctggctcgcgggtcggcgccagggtacaccttcgttgccggggacgacaggcatgcacgcggatcggcgcgcgaagatccgcccggcgacccgggaagcacaacgcagagcctcgccgaaacgtctgttacagtttttttcagcccaccgatcaagcacttgcggatgctagtctgcgggtctgcgaggccgcccggtcgccgcgtctgccgacccattccccgagcgaggaccgccgccatgcatgccgtcgatttcatccaggacctcgccgtgatcatgctggtggcgggtgtggtcactatcctcttccaccgcctgcgccaaccggtggtcctcggctacatcgtcgccggcttcatcatcggcccgcacaccccgcccttcggactgatccacgacgaagacacgatcaagaccctggccgaactcggggtgatcttcctgatgttctgcctcggcctggagttcagcctgcgcaagctcttccaggtcggcgccacggcgttcatcgcggcgttcctggaaatcgtcctgatgatctggatcggcttcgagatcggtcgcttcttcgagtggagcaccatggactcgctgttcctcggcgcgatcctggcgatctcctccaccaccatcatcgtcaaggcgctcggcgacctgaagatgaagaacgagcgcttcgcccaactgatcttcggcgtgctgatcgtcgaggacatcctcggcatcggcatcatcgccctgctgtcgggaatcgccgtgagcggttcggtggaaaccggcgaggtgttctccacggtcggcaagctcagcctgttcatgatcgtcgcgctggtcgtcggcatcctcctggtgccacgcctgctggcctacgtggcgaagttcgagagcaacgagatgctgctggtcaccgtgctcggcctgtgcttcggcttctgcctgctggtggtgaagctggaatacagcatggtgctcggcgccttcctgatcggcgcgatcatggccgagtcgcgccagttggtgcagatcgaacgattgatcgagccggtccgtgacatgttcagtgcgatcttcttcgtcgccatcggcctgctgatagacccgaagatcctcgtcgagtacgcctggccgatcgccctgatcaccgtcgcggtagtgctcggcaagatgttctcctgcggcatgggtgcgttcatcgccggcaacgacggacgcacttcgctgcgggtcggcatgggcctgtcgcagatcggcgagttctccttcatcatcgccgccctgggcatgactcctgaaagtcaccagcgacttcctctacccggtggcggtagcggtctcggccatcaccaccctgctcaccccgtacctgatccgcgccgccgacccgctctcgcagcacctggccaacgccatgccgcagcgcatggcgaggatcttcggccactacggcgactggctgcgcagcatccagccgcagggcgaccgtgcggtgctggcggcgatgatccggcgcatcttgctgcaggtcggggtgaacctggcgctggtgatcgcgatcttcctcgccggcggttatttcgccgatacgctttccgcctggatgagccagtgggtcgcctacgacgggctacacaaggcattgatctggggcggcgcgctgctggtctcgctggccttcctgatcgccgcgtaccgcaagctcaaggccctgtcgatgctgctggccgaactcggggtcaagccggagaaagccggacgccatacggcgcgggtacgtcgggtgatctccgagataatcccgctgctgtcgctggccggcatgatggtgctgctggcggcgctcagctcgagcatcctgccgccgggcgagttgctggtcgtagtggtgctggtcgccggcctggtgatcgcagtgctctggcgctggctgatccgcgtgcattcgcggatgcagatcgcgctgatggaaaccctcgaccaggaaaagggcagccactgagagccaagcgatcccggcctgccgtcgaatcggcggataaccacgctgcggttattcgccctcgcctgcacctggtgtcgctatcggaccctttgccctga

SEQ ID NO: 2312 - DNA, 1095 bp, Pseudomonas aeruginosa
agtcttctgataattattatcattcagtcgcgtcctcagggcaaccttggcggatcattccgcgaccatccgacacgccaggaacgcctcttcgagcgccttttcatccgcgcctgcggcgaggatcagttccagccgattatcccgccgccacgaggacttgccccagttatccacaaacggcgcggcattcgctgcataccaaccgtccgcgcaatgcagcaccgccttggctcgccgcagtccggacagacggttcagccaggcgtccactgcggcccgatcgaaacgcaccgacggcgccagccgccagccgatggcgaactggccgtcctgctcgcgcacggcgcgcagcggtcgctcggcaggcagcaccgttcccaactgagcaggcgcctccggcagggccgcccaggtcgtcgcgctaccttccccggcaacgctggtcggcagatcgcgcaatgccaggtgaccgcgcacgctccagcgcaacggcaggaccggcaggcgcgcgcgcacggcgcagcgctgcgtcgcgtcgagcgtttcggatttgttcagcagcaacatgccagccgcttccagcgcctgttcctgtgcctccggcagcggttggccggaggccagcgcggcggcatccagcaccactaccaggggttgcagggccaggacgccggaccagggaggagcctgcagctgtttccacagcgccagcggatgtcccaacccggagggttcgatgaacagccggtccggccgtgcccgacgcaacaagcgaccgagccccacctggaacggcacgccattgacgcagcagaggcacccgcccgccacctcgccgatggccacgccgtcgacgtccgtggccagcagcgcggcatccaggccgatctcgccgaactcgttgaccagcaccgcccagcgctcgcccgccggcttctgcgccagcagcgagcggatcaggctggtcttgccggcccccagagggccgccgatcaggtgtgtgggtatctctcgaagcatctgcgcaaccggaatgtgaaagcctgtggatcaatgcggtccttgcctgcggggagccaggccccgtgctag

SEQ ID NO: 2313 - DNA, 399 bp, Pseudomonas aeruginosa
agtcgcgcccgtctgcaatggagtcctcgcatgcgtccgttcctgttcttcctgtcctgcctgccgggcctggccctggccgaagcctgcatcgtccatagccaggcgaagaatctcgacgtgaaggtctgccagcagaaccgcagcatcccggccaagctgttccacgaaggcttctgccagccacaactgcagggccagaaggtcgaggtgacgttcgccgaggagtgtccgacgggcgccttcggcgtctgccgcgacgccagggtacccaacgcgccctatcggcaggacatcttctactacggcatcgcgaccgacgcacgctacctggagccgttctgcgccagccagagccaaggtcgctgggaagagcctagcgccgcgaaaaagccctga

SEQ ID NO: 2314 - DNA, 540 bp, Pseudomonas aeruginosa
gtggtgaccagccgcagcggcacgtggtcgacgtggaaacgcgggcacatcggtttatccagaacgcgcaggcgcaggccgatacgccgcgccccggtcaggcaggagaaggcctcgaccagccagcccaggtcgtcgaggaaatcggtttgtcccggcagttgctgcgcgtcgagcaggccgtccaagacgggtagccgttcctcttccatctccagcgtctggctcagcgccagtcccggccggttgcgcaccagggcggcggcgaagtcgcgcagcgccgggctcaaccggcgtgtccagaccgccaggttgacgccctcgcgaagcacctcggccagcacctggggatcgtcatcgaacgcctggcgcggcaacggtttttcctgcggcagtgcgctcatgcggcgtgcccccagtcctcgaaggggtcgtccaggccctgccagccggggatgcccaggttcatctcggcgtcatccagcaggcaggcgtccagggctgcgcgcagggccgcgaagtccaggttctgaccgatga

SEQ ID NO: 2315 - DNA, 405 bp, Pseudomonas aeruginosa
tcgcccgcaggccctcttcgtcctgtggccactgtccggtcggcacgaagcgccaccagcggcccgccaggccgtagcgcatcaggccgccggcctgcgaccagctgccggcctcgcggggccggctggcgagccagaagaagcccttggagcgcagcagccgcccctgcttcagcggattgtgcaggaaggcgtggaagcgcgcggggtggaacggccggcgcgcccggtaggccatggaggcgatgccatattcctcggtttccggcaggtgctcgccgcgcagttccttcagccagcccggcgcggacgccgcgcgatcgaaatcgaagcgaccggtatcgaggatcttcgccagcggcacctgacccatcaccatcggcaggatctccgcctcggcattga

SEQ ID NO: 2316 - DNA, 462 bp, Pseudomonas aeruginosa
ccctgcacgccagcgaagatcgcctcggccaggcgctggcgatggcgttcgtccatcaaccggcgacaatcgccgcgattcgagatgaagccggtctccaccaggatcgaagggatgtccggcgacttgagcacggcgaagccggcctgctcgacacgcttctggtgcagcgcggtgacgtccgacaactggccgagaacgctgtggccgaggtccaggctgctggcgatggtcgaactcagggccatgtcgaggatcaccccggcgagtaccttgtcgcggccctgtagcggcaggttgccgctgttgccgatcaggtcggcgccgttctcgcgctcggccatccagcgcgccatggtcgagctggcgccatgctcggagagggcatataccgacgcgccggaggcggtcagtcgcggcgccgcgtcggcgtgcaccgaaacgaacatgtcggcgttgtag

SEQ ID NO: 2317 - DNA, 513 bp, Pseudomonas aeruginosa
cgccgggccacttccggccgcttgcgcagcgggacgaacacgtcgccgttgcgcaccaggcgcgccttgaagcctttctcgcggtcgatccgccgcgccagcaggcgggcgatagccagcgccacgtccttttcgcgctcgcccttgctaccgaccgcgccggggtccttgccgccatggccggcatcgaccaccacgaggatgtcgcggcccgtcgagggtagcgggcgggccagcgccagcattggctcggggggcgccgccagcgcctgtggatataggtccaggaccaggcgatggccctttcccgcctgcggttccagggcgaagctgcgcggcctgaccgcctggcgcaggtcgaggacgatgcgcgtcccgccgccacccagttggccgctgcggatggcgcgcacggggccgtccagcggcagctcggagagcgttgcgagcaattgcgcgtcgggcaggtcgaggatcaaccgctcgggggcctgcagggaaaaggttcgataa

SEQ ID NO: 2318 - DNA, 2046 bp, Pseudomonas aeruginosa
tgttctgcgaagacgcggtgcgccggctgcaccgcgccctgcagggttatccacaggcgagccggttctccatacgggtcgtccatgcggaaagcctgcatgcccacgacgccgtcgccgaaagccactggcagcgaggtgccgcatgatccgcaagaatccctccggcgacctgccggtgatcgacgaatcggcctatgtggacaagaccgcgatcatctgcggcaaggtgatcatccaggccaacgtcttcgtcggtccctacgcggtgatccgtgccgacgaagtcgacgccgacggcggcatgcaaccgatcgtgatcggcgccaactcgaacatccaggacggcgtggtgatccattccaagtcgggtgccgcggtgaccatcggcgagcacagctccatcgcccaccgctccatcgtccacggtccttgcgaagtcggcgaccgggtcttcatcggcttcaacagcgtgctgttcaactgccgggtcggcgatggctgcgtggtccgccacaacgcggtggtcgacggctgcgacctgccagcgggtttctacgtaccgtccaccgagcgcatcggtccgcgcaccgacctggcgagcatgccgcgggtcagcgtttccgccagcgagttctcggaagacgtggcgcgcaccaacgtcgacctggtacgcggctacaagtcgctgcagaacgagttctgaacatgcaaagcctgctgatccgcaatgcccggatggtcaacgagggacaggtacgcgaaggcgatctgctggtccgccacggtcgcatcgaacgcatcgccggctgcctggaaaactgcggcgccagccgggagatcgatgccgccggacgctacctgctgccgggaatgatcgacgaccaggtgcacttccgcgagccgggttatccacagaagggctcgatcgccagcgaatcccgcgccgccgtggcgggcggcatcaccagtttcatggacatgcccaatacccgcccggcgacgctgagcctcgaagcgctggcggaaaagaagcgcctcgccgccgcccatagcgtgaccaactacggtttccacttcggcgtcagccgcgacaacctcgacaccgtggccgccctcgatccacgcgaggtcgccgcggtgaaggtgttcatgggcgcctccaccggcgacatgctggtggacgacctgccgactctggagcgcctgttcgccagcgttccgaccctgctgctgagccattgcgaagacacgccgcggatcgaagccaacctggcgcgctggcgacaacgcttcggcgaacgtattccggcagccgcccacccgcgcattcgcgacgccgaggcttgctaccgttccaccgccctggcggtggaactggcgcaacgacatggcacgctgctgcatgtcctgcacttatccacagcgcgcgaactggccctgttcgaggacaagccgctgtgccagaaacgcataaccgcggaagtctgcgtccaccacctgctgttcgacgacagcgactacgcccgcctcggccatctgctcaagtgcaacccggcgatcaagagccgcgaggaccgcgacgccctgcgcagggcgctggccggcaaccgcctggacgtgatcggcaccgaccacgcgccgcacgcctgggccgagaagcagcaggcttatccacaggcgccggccggcctgccactggtccagcatgcgttgccggcactcctggagctggtccgcgaaggctggctgtcgctggccaccctggtggcgaagaccagccaccgggtcgccgaactgttcgccatcgccgatcgcggtttcctccgcgaaggctactgggccgacctggtgctggtcagcgaactggagcacccggcgctggccagcgccatgccgctgctgtcgcgctgcaactggacgccgttccgccaccgggcattccaccatcggatcgataccaccatcgtctccgggcagctcgcctggcacgcgggacgcctgtctgacgattgccagggactgcccctgcggttttcccgctga

SEQ ID NO: 2319 - DNA, 543 bp, Pseudomonas aeruginosa
agatcggcggcacggccgatccgcgggttttccacagccgcgtcggcgccggccgagccgcttgccgagacgaacagtgccagcagggccggccggaagactgatatacagctacgcatggacgttttccttatgaccggaagcagctccggcttcgtcgtttttatggatgtggactggcgtctcagggttatccacaggacgttcagtcgctcgggtcccgtatcggacacgcccagagttcgaccgccgggcgctcagggtccggcggaccgatccagcgcgccagcgcatcgcagcgcccctgacggcagatccggtagtcgccggcctccggtgtgcgccccagccgcaacggttgcagcggcggcaccccacggtggtaatgccaggcgccgtcacgcagcacggcgccctcgggaatctccatccccgccccgctgccccgcacccgggcctcttccagcagcaggccgcgctcactcaggcgatagtcttcttcccagagcaccttctcgaccgtgtgttgccaggccagggtga

SEQ ID NO: 2320 - DNA, 1116 bp, Pseudomonas aeruginosa
acgactgcagcggcagcgtcgcccagacgctgccggccatgcccagacacagcgcgatcacgccaccgcctcgcgcgcacgctggcgccagaggtgccagccgatcaccagcgcgccgaggacgaagcccagctcgtcgctgatcggcaaggccaggaccaggctggcccccgcggcgaacgccaccaggcgctcccaccaggccagcggcccctgcaggtagccgatggaagccatgccccacaggccgatggccagcaccgccttgcaggtgacatagagcgtcgccccccaaccgccttcctgcagcatcagcgccggggaatacaccgccatgaacggcaccacgaaacccgccagggcgatgcgcaccgcccagaagctgatcttcaatcccctttccttggcgatcggcgcggccgcgaaacaggccagcgccaccggaggggtgaggtcggcgaggatgccgaagtagaagacgaacatgtgcgagacgatcagcggcacccccagttccagcagcgccggcgcggcgatggagctggtgatgatgtagttggggatggtcgggatgcccattcccaggaccaggcaggtgaccatggtcaggaccagcgacagcagcaggttctcccgtcccaggtcgagcacgtagctggcgaaggtggtggcgatgccggtcagcgaaatcaccccgatgatgactcccaccagggtgcaggcgatgcccaccggaatcgcatgtcgcgcaccttcggcgagggcgcggacgcagatgcgcagggtttcccggccgccacggacgaaccagcaggccagggccagggccgcgatcacgacgaagatcaccccgatgccgaggcggaagaaccccgcgcagagcagccccagcgccacccagaaggcgatgcgcaggccgagcgaggacacccgcaggatgatcgccgaaccgaggatgacgatggcggtcagcgccaggccgatggttccggagaacagcggcgtgcgcccggagaacagcagcgcgatcagcaccagcaacggaatcagcaggaaccagcgctcgcggacggcaccccaggcgctcggacactgatcgcgcggcaggccctttag

SEQ ID NO: 2321 - DNA, 204 bp, Pseudomonas aeruginosa
accccgctggtgccgccggtgaggatattgatgaaggtcggcgcggcaaagaccgaggtactgaaggtcaccgttgcggcaagcgtgaaaagaccgaagcgtctgctcagcgacatgggaagtctcctgttcttatcgttgttgtcgcgctgtcgcggaagcgtcccggcttccttcgaccgcgcaggacttcgtgcagactag

SEQ ID NO: 2322 - DNA, 1131 bp, Pseudomonas aeruginosa
accgccccgccacgcaggacaatcagcaaggaccgattgcgcgaccggctccgcaagggagccggtcgccggcgttcaggcgtacaggtcgcgccgcgaccagggcagctcgtgggagccatcctcgtgggggcgaatggcgaggatctggtgcaggttgatccagccgcgcttgaagccgtaggcgcatccggccaggtacagccgccagatccgcaaggtttcctcgggcaccaggcgagccgcctccttcagcctggcttccaggttggcgctccagaagtccagggtccgggcgtagtgcagacgcaggctttccacgtcgactacttccagcccggcttcgctcatccgcgccaccgccagcgacaggtgcggcagctcgccgtggggaaacacgtagcgatcgatgaagtcgccggcccccttgccaaccgggcggccgtcggtgtagcgcgaggtgatgccgtggttcatcaccaggccgccgggacgcaccgcctcgtacagttgctggaagtacagccccaggttggcgtgcccgacgtgctcgaacatgccgacgctgaccaccttgtcgaagcggccatcgcgcggcaggtcgcggtaatccagcagcttgagggtgactcggtcctccaggccttcggccttgactcgctcccggccgagcgccagctgctccttgctcaatgtgatgccggtgacctcgacgccgaactcgcgagcggccaggcgcgccagccctccccaaccgcaaccgacatcgagcagcttctcgcccggctgcaaacgcagcttgcggcacaggtgacggagcttggccagttgcgcggtggcgaggtcttccttgccggtctcgaaataagcgcaggaatagaccatttccggatccagccagagctggtagaagtcgttggacaggtcgtagtggtaatggatggcttcggcgtctgtgtccttgtcgtggctttcgcgaaccggcggcgcgccgccatcgggttcgccgagcgcttcgctgagggcatcgccgataccgatgacctggctgatcggtccttcgatgtcgagacgcttctcgacgtaggccttgcccagcgcatcgaggctgggatgggtgatctcggttag

SEQ ID NO: 2323 - DNA, 633 bp, Pseudomonas aeruginosa
ggaatgccgatgaacgagaccgtatccctcgaaacacgcgaagtacgctttctctccgtgttcgacttcgacggtaccctgacataccgagacagcttcgtgcccttcctgcgtttcgccttcggcaaccgggtgttcgtccgccgcatgctgcgcatggcaggacccagcctggcctatctctgccggcgtatcgaccgcgacgacctgaaggcgcgcctgatcgccaccttcctcaccgatgtgcccgtacatgtgctggaagagcgggcgctggcctaccagaaccgcttctgggaaacactgatgcgtccccacgcattgaccgcggtggccgaccaggtcagcagcggcagcaccgtgaccatctgttccgcctccccttcgctgctactcaggccgttcgccgagaagctcggcgtgcacctgatcgccaccgagctggaagtggtagacggcgtactgaccggcaggatcgtcggccgcaactgccggcgcgacgagaaagtctgccgcctggagcggcactacggtccgctgacccaatactccctgcgcgcctggggcgactcgcgcggcgatacggaactgctggcggcggcgctggagcgcttctggaaaccgttccgctga

SEQ ID NO: 2324 - DNA, 1275 bp, Pseudomonas aeruginosa
ccctggcgccggctccacgagccggcgcccccttggcgttcgtccgctcattcagccaaagagaacatcatgaaccagaaaatttccccgccttcacagaagctcgacggcctgttcctgctggccctgtcgatggccgtattcttcgtcggcgtgaccgagttcatgctgtcctccatgctcgggccgctggcgcaggcgttccacaccactaccagcggcgccgcttggctgatctccagctacgcgttctcctatgcgatcgccgcgccgttgctgggctacttctccgaccgcatgcaacgcaggaagctgctgctgctcgccctggtcctcttcgcggtcgatactctggccatcgtcatcgccccgaccctggaaattgccgtcgtcctgcgggtgatcgggggcatcgcctcggcaatcatcatcccgaccaccttcgccctggtcgcggaggtggtcgccccgcaaagacaggccggtgccatgggccaggtgatgctcggcatgaccctcggcattgccgccggcccggcactggccggcctcctctcggacttcttcggctgggcggcgcccttcctgttggtctcgtgcggttgcgtgctggtcttcctgatggcacgccagcgccttcccgtgcaagccgtggtaccgcgcgccgagggccatgcgctgggctggtgcaggcaatggagcatcctcaggccactgatcgccaagggtgcctggaacggcaccggggtcgccggcctgcttctctcgggagaggtgctgcgccagcgctacggcttcagcaccgcgcagataggcgtcagcatcgccgccttcggcgtgggcctggccgtgggcaacctcgccgcgggttacctgcgacgttatctgaagcgcgacgaagacatgctcctgctggtgctggcgctcctggtgttatcgatgtcgaccttcatgctcctgccgctaccgttacccgtggcgctctgctgcctgggcgcctggggcgccgcgctgggcctgggcgcgccggcgggcacggtggtactcgcctcgcgctccgggccggacaagggcatggtgctgtcgttcgccgagacgttcaacaacatcgccattctcgccagcgtgcccctggctgtgcgactgctggagctgaaggggccgcccgccaccctgtgggtattgggcatcggcctggggatcggcgcctggctcaccgtgctggactggttcgccagccgcaggagcgacgaggcgctgccgttgcgcgattga

SEQ ID NO: 2325 - DNA, 2172 bp, Pseudomonas aeruginosa
cggcgagcgccggggccgcatgcctgccccggcttctcgggcacgcggccggcgttactcgacggtgaccgacttggccaggttgcgcggctggtcgacgtcggtgcccttgagcacggcgacatggtacgagagcaattgcaacgggatggtgtagaggatcggcgagagcacgtcgccgatgtgcggcatgcccaccacatgggtgccctcgccagcctcgatgcccgcgccttcgtcggcgaacaccaccagttcgccgccgcgggcgcggacttcctgcaggttcgacttgagcttctccaccagctcgttgttcggcgccacggtaaccaccggcatgtcgctgtccaccagcgccagcgggccatgcttgagttcgccggccgggtaggcttcggcatggatataggaaatttccttgagcttcagcgcgccttccagggccaccgggaactgcgcgccacggccgaggaacagggtgtggtgcttctcggcgaacagctcggaaaccttctccaccgtccggttcatcgccagcgcctcgcccagccgggtcggcaggcgacgcagttcgtccaccagctcggcttcgacgccatcggccaggcgcttctgcacctggccgatgcccagggtcagcagcagcagggcgaccaactgggtggtgaaggccttggtcgaggccacgccgatttccgggccggcctgggtcagcagggtcaggtcggattcgcgcaccagcgaactggtggcaacgttgcagatcgccacgctggagaggaagcccagctccttggcgttgcgcagggcagccagggtgtcggcggtctcaccggactgggagatggtgacgaacaggcaatccggctgcaccgcgaccttgcggtagcggaactcgctggcgacctccacctggcagggaatcccggtcaggctttccagccagtaacgggcgaccatgccggcgtggtaactggtgccgcaggcgacgatctgcacgttgcggaccttggcgaacagctccgccgcctgcggaccgaagctttcaaccattacctggttctgcccgaggcggccttccagggtacgctgcacgacgctgggctgctcgtggatttccttgagcatgaaatgccggtactcgcccttgtcggcggcttcggcgccttcgtggtactgcacggtctcgcgctgcacgtcgttgccctggacatcccacaggcgcacgctgtcgcgacggatctcggcgatatcgccttcttccaggtagatgaagcggtcggtcacctggcgcagcgccagttggtcggaagcgaggaagttctcgccaagcccgaggccgatcaccagcgggctgccgctgcgagcggcgacgatgcggtccggctgcgccgcgctgatcactgccaggccataggccccgtgcaattccttgaccgcgtccttcagcgccagggtcaggtcgccgatggactgcagcttgtggtgcagcaggtggacgatgacctcggtgtcggtctgcgaggtgaacacgtagcccagccccttgagccgctcacggagaggttcgtggttctcgatgatgccgttgtgcaccaccgccagttcgtcgctggagaaatgcgggtgggcgttgccttcggttggcgcgccgtgggtcgcccagcgggtatgggcgatgcccaggcggccgagcagcggcgtaccggccaggccttcctccaggctggcgaccttgccgacccggcggcagcgctgcagcctgccttcgttatcgaagaccgccacgccggcgctgtcgtagccgcgatactcgaggcgcttgaggccttcgataaggatgggggttatgttgcgctcggcgatcgcgcctacgattccacacatggggtctttctcctttcaggcctcgaccggggtgcagatcagcgtgacgccccgggcggttatctgttcgcgcgcggaagattccaggcgctcgtcggtaatcagggtatggatgctgctccagggcaattcctggttgggaatgcgccgaccgaccttgtcggcctcggccatgacgatcacctcgcgggcgacctcggccatcacccggctcaggcccagcaattcgttgaacgtggtcgtcccgcgttcgagatcgatgccgtcggcaccgatgaatag

SEQ ID NO: 2326 - DNA, 249 bp, Pseudomonas aeruginosa
acaacagaacgtcacggccttcgtcacggaacttctcggccatggtcaggccggtcagtgcgacgcgcagacggttgcccggcggctcgttcatctggccgtataccagggctaccttgtccagtacgttggagtccttcatctcgtggtagaagtcgttaccctcacgagtacgctcgcccacacccgcgaacacggaataaccgctgtgctcgatggcgatgttacggatcagttccatcatgttga

SEQ ID NO: 2327 - DNA, 1773 bp, Pseudomonas aeruginosa
tgctcgcaatcttgctgcgaatctcttttgcgcctgccatttgacacctatcgggttagcaggcgggagcctcgcggctcccgctgcggcttaccaggtttgggtggccttgaacttctcgatgccggccttgatgcccgcgtcgatttcgtcgttgaagtcacctttctcgttgatcttcgccagcagagcggcatgctcgcgctggaagtaggagatcaacgcctgctcgaagctaccgaccttggcgatttcgacgtcctgcaggaagccacgctcggcggcatacagggacagcgacatctcggcgatcgacatcggcgcgtactgcttctgcttcatcagctcggtaacgcgctgaccatgctccagctgcttgcgggtcgcttcgtccaggtccgaggcgaactgggcgaaggccgccagttcacggtactgggccagagcggtacggatgccgccggacagcttcttgatgatcttggtctgggccgcgccacctacgcgggataccgagataccggcgttgacggccggacggatacccgagttgaacatggcggattccaggaagatctggccgtcggtgatcgagatcacgttggtcggaacgaacgcggaaacgtcgccggcctgggtctcgatgatcggcagcgcggtcagcgagccggtcttgccggtcacggcgccgttggtgaacttctcgacatactcttcggaaacgcgggaagcgcgctccagcagacggctgtggagatagaacacgtcgcccgggtaggcttcgcgacccggcggacggcgcagcagcagggagatctggcgataagccacggcctgcttggacaggtcgtcgtagacgatcagggcgtcttcaccgcgatcgcggaagtattcgcccatggtgcaaccggagtacggcgccaggtattgcagggcggcggactcggaagcgctggcggcgaccacgatggtgttggccagggcaccgttctcttccagcttgcgtacgacgttggcgatagtggactgcttctggccgatggccacgtagacgcacttaatgccgctgtctttctggttgatgatggcgtcgaccgcgagggcggtcttgccgatctggcggtcgccgatgatcagctcgcgctggccacggcctaccgggatcatggcgtcgaccgacttgtagccggtctgtaccggctggtctaccgacttacgccagatcacgcccggagcgaccttctcgaccgcgtcggtggccttggcgtcgatcggacccttgccgtcgatcggattgcccagtgcgtcgactacgcgacccagcagttccggaccgaccggaacctccaggatgcgcccggtgcacttggcgttcatgccttcggcgaggccctggtattcacccaggaccacggcacccacggaatcctgctccaggttcagcgccataccgtagacgccgcccgggaactcgatcatctcgccgtacatgacgtcggccagaccgtagatgcgcacgataccgtcggacacgctgacgatggtgccttcgtttcgtgcttgggaggcgacgtcgagtttctcgatgcgccccttgatgatttcactaatttcggaaggattgagttgctgcatgccgctgccccttcaaactcaagatttcaacgcttcggccagtttcgcgagcttgccgcgcaccgagccatcgattaccaagtcaccggcgcgaatgatcacgccgccgatcaggctcgcgtcttccgacgcatgtag

SEQ ID NO: 2328 - DNA, 258 bp, Pseudomonas aeruginosa
atctcggctgccagtttggaaaccagctgctcgtgcgcgtttgcgtcgatcgaagcacccaggatcttctctgcgccggtgacggccagggcacccacttgggcacgcagggcgtccttgacgctgttcagttcctgttcgatttccgcttgggcctgggccttcaggcgttcgccttcggtacgggcctggtcgcgggcttcatcgacgatctggttagcgcgtttcttcgcctgttcgacgatttcggctgcctga

SEQ ID NO: 2329 - DNA, 1068 bp, Pseudomonas aeruginosa
cgagctgcgccttccaggaacttgccacccagcagaccgaaaccgatggcggtacccagggcacccaggccaatcagcagagcaacggcgatagcagtcagtccaactacagtttccatttttcctcccgactttttgtcgtgttggttaaaggttgaagcgaatcgattaatggttgtcttcgtgcgccatcgacaggtagacgatggtcagcatcatgaagatgaaggcctgcagggtgatgatcaggatgtggaacacagcccacgcccagttcagggctacgcccagggcactcagcaggaacattccgctaccgaacatgacggcgatcagaatgaagatcagttcgccggcatacatgttgccgaacagacgcagcgccagcgaaaccggcttggcgatcagggtcacgaactcgagcaggaagttcaccggaatcagcaggatctgaacgacgatgttcttgctgctgaaggggtgcagggtcagttcaccgaggaagccgccgatgcccttgaccttgatgctgtaaaagacgatcagcgcgaacaccgagatcgacaggccgagggtggcgttcgggtcggtggtggccaccgcgcggaagaacaggtgctcgtcgccggtgatcttcgcggccagcatcggcaggtagtccaccggtaccaggtcgatcaggttgagcaggaagatccagacgaacacggtcagggccaggggcgcgatcaacgggttgcgcccgtggaaggtgtccttgacgctggtgtcgacgaactcgaccatcacctcgacgaagttctgcagtccacccggctggccgctggtggccttcttggctgccaggcggaagatgaacaggaacaccacgccgagcagtaccgaccagcccagggtgtctacgtggaatgcccagaagcccatttccttggcttgctcggcggtgtgggcgaacccccaatcaccattaggcagacgcccgaaggtcaggttctgcaagtggtgctggatgtaacccgaagcggtttctgctgccatgtttgcctcaatcgctctaaggtcttgtaa

SEQ ID NO: 2330 - DNA, 1233 bp, Pseudomonas aeruginosa
gagggtgtcgccgaaatgctcctgcaactgcgcggagacatcgttggtcaggctgatgcgcggatcgtacatggtccgcaacagaccctcgatcttcagcgtcgggttgagcaactggccgatgcgctggatgctgttcatcaggtcggtcagcccctccagcgcgtagtactcgcactgcatggggatgatcacgccgtcggcggcggtcagcgcgttgacggtgagcatcgacagcgacggcgggcagtcgatgaggatgtagtcgtagttctcgcggatcggcgccagcgcgttgcgcaggcgattttccttcatgtccatttccagcagcaccacttccgcggcggtcaggtcgcggttggccggcagcaactggtagccgccgtgttcggagaactgcatggcctcggcgaggttgcactcgccggtgagcacgtcgtagatggagtgctccaggttgtgcttgtcgatgccgctgccggtggtggcgttgccctggggatccaggtccagcaggaggacgcggcgcttggtcgccacgagggaggccgcgaggttgatacaggtcgtggtcttgccgacaccgcctttctggttggcgatcgcgaataccttagccatggttatccctgttccccctcatgctgtgcgccgcagtatcagcagatgccgctgaccttggcaaccgggtaccgccagcgcgtgctcggcttcgacccggaaatcctccgggagtgccgccagctcttcgttcggatgcacgcccttcatcgccagccagcgggtttcctggccaccgaggtggcgggtccagttggcgaagtcctccaggctgctgaaagcgcgggaaacgatgccatcgaaggggctctcgggacggaaggcttccacccggctgtgcacgacttcgaggttggccagcttcagttcgagcttcacctgggtcaggaagcgggtcttcttgccgttgctgtcgagcagggtcaggcgcttttccgggaacagaatggccagcggcacgccgggcatgccgccgccgctgccgacatccagccagttatccccagcctcggcataaggcacgatgctcaggctgtcgagcaggtggcgcgaaaccatctcgtccgggtcgcgtacggcggtcaggttgtaggccttgttccatttgatcagcagggccaggtaggccagcagctggcgttgcttgtcggcgtcgagggcgacgcctag

SEQ ID NO: 2331 - DNA, 369 bp, Pseudomonas aeruginosa
agcacgcgatcggcttgtgcacgagtggcgcgcactgccggccccttgcggctgttaaggatgcggaactggataccgcccttgtcggtggcttcggccatggcgccgccaagggcgtcgatttccttgaccagatggctcttgccgatgccgccgatggcggggttgcagctcatctgccccagggtttccacattgtgggtcaacagcagggttttcacacccatgcgcgcagccgcgagtgcggcttcggtgcctgcatggccaccgccgatcacgattacgtcaaaacgggtagggaaatccaccacgcacctcggcctgttcagaagcaggaattcaggaaagccggacagtataaggatttag

SEQ ID NO: 2332 - DNA, 1920 bp, Pseudomonas aeruginosa
cgatcgcgacgatggtttcggtggcggcttgcatgtggatatctccggatagcaagacgcccctcgagggggcgtcttgttgtggacagttttcgcgatagacgtcaggcggtcttcgcggctgcctcgatcttgcgggtaatgtaccactgctgtgcgatcgacaggcagttgttgactacccagtacagcaccagaccggctggggaaccagaggaagaagaaggtgaagatgatcggcatcagtttcatcaccttggcctgcatcgggtccggcggggtcgggttgagcatctgctggatcagcatggtgccgcccatgacgatcggcaggatgaagaacggatccttcaccgacaggtcggtgatccagccgagccacggcgcctggcgcatttccacgctttccaggagtacccagtagagggagaggaagaccggcatctggaccaggatcggcaggcagccgcccagcggattgatcttctccttcttgtacagctccatcatcgcctgggacatcttctgccgatcgtcgccgtgctgttccttgatcgcctgcatcttcggcgacaccgcgcgcatgcgcgccatcgaacggtagctggcggcggacaacgggaagaaggccagcttgatcaggacggtcagggcgatgatcgaccagccccagttgccgatcaggctgtggatatgttgcagcagccagaagatcggctgggcgatgaaccaaaggaaaccgtagtcgacggtcagttccaggcccggggagagttccttcaggtgcttctggagtttcgggccggcatacagggtcaggtcggtttccaccttgctacccgccggaacgctcagggtcgggccggtgaaaccgacgatgtagttgccctggccgtccttgcgggtcatgacctggtgctgctcgcccttggtcggaacccaggcggtcacgaagtagtgttgcagccaggcgacccagccaccctgcacggactccttgaactgttccttgtccatgtccttggtggagatcttcttgtacggcgaatccggggtccagaccgcggcgccgaggtaggtggacaccccggtggcggtggtcgaggacgggtcggcgctgccgtcgcgcttgagctgggcgaacaggttgccgctccaggtcttgccgctctggttgtcgatcaggtagctgacgccgacctgataggcgttttcattgatgcactcgatcttcttctgggccttttccttgtccgagcaatcggctttcaggccacggtggaaggtgaagcgcttgatgtagttgacaccgtcgtggctgaagctcaggtccacgaccagttcgttctggccgtcggccaactggtagctgctctgcgcactgtggaacagcgggcggccggcgctgctggcgtccgggccgtcggcaccggtgaggccgctctgcgccaggtaggtacgttcgcgaccgttgtcgaacagcgggaacggcacgtccggacggtccaggcggcgcggatactgcaacaggccgagctggacgatatcgccgccacggggatcgatggccaggtcgaggacgtcggtcttcacctggatcagcttgtcgctgaccgcaaccggcttgtcggcggcttcggtgccggccgcgctgctctgggcagtgggaacgtcactgctggtgcccgaggcggacggagtgtccggcaggccttgcgtggtgttcatcgaagcgctggcggcgggcagctcaggctgaccgtaatccttgttccactggagaaccagcaggtaggacacgactgcaagggcgacgatgagaatcgagcgttgaatgtccatggttactcggccatcgagaaagggcggtgcttgaaggaaactgacagtagcagatcgcggctacgggattgccagtga

SEQ ID NO: 2333 - DNA, 1107 bp, Pseudomonas aeruginosa
accatgcatttcaccattcaacgcgaagccctgttgaaaccgctgcaactggtcgccggcgtcgtggaacgccgccagacattgccggttctctccaacgtcctgctggtggtcgaaggccagcaactgtcgctgaccggcaccgacctcgaagtcgagctggttggtcgcgtggtactggaagatgccgccgaacccggcgagatcaccgtaccggcgcgcaagctgatggacatctgcaagagcctgccgaacgacgtgctgatcgacatccgtgtcgaagagcagaaactcctggtgaaggccgggcgtagccgcttcaccctgtccaccctgccggccaacgatttccccaccgtggaggaaggtcccggctcgctgaacttcagcattgcccagagcaagctgcgtcgcctgatcgaccgcaccagcttcgccatggcccagcaggacgtgcgttactacctcaacggcatgctgctggaagtgaacggcggtaccctgcgttccgtcgccaccgacggccaccgactggccatgtgctcgctggatgcgcagatcccgtcgcaggaccgccaccaggtgatcgtgccgcgcaaaggcatcctcgaactggctcgtctgctcaccgagcaggacggcgaagtcggtatcgtcctgggccagcaccatatccgtgccaccactggcgaattcaccttcacttcgaagctggtggacggcaagttcccggactacgaacgcgtactgccgcgcggtggcgacaagctggtggtcggtgaccgccagcaactgcgcgaagccttcagccgcaccgcgatcctctccaacgagaagtaccgcggcattcgcctgcagctttccaacggtttgctgaaaatccaggcgaacaacccggagcaggaagaggccgaggaagaagtgcaggtcgagtacaacggcggcaacctggagatcggcttcaacgtcagttacctgctcgacgtgctgggtgtgatcggtaccgagcaggtccgcttcatcctttccgattccaacagcagcgccctggtccacgaggccgacaatgacgattctgcctatgtcgtcatgccgatgcgcctctaa

SEQ ID NO: 2334 - DNA, 1110 bp, Pseudomonas aeruginosa
atgtccctgacccgcgtttcggtcaccgcggtgcgcaacctgcacccggtgaccctctccccctccccccgcatcaacatcctctacggcgataatggcagcggcaagaccagcgtgctcgaagccatccacctgctgggcctggcgcgttcattccgcagtgcgcgcttgcagccggtgatccagtacgaggaagcggcctgcaccgtattcggccaggtgatgttggccaacggcatcgccagcaacctggggatttcccgtgaacgccagggcgagttcaccattcgcatcgatgggcagaacgcccgaagtgcggctcaattagcggaaacacttccactgcaactgatcaacccggacagctttcggttgctcgagggagcgccgaagatccgccgacagttcctcgattggggagtgttccacgtggaacctcggtttctgcccgtctggcagcgcctgcagaaggcgctgcgccagcggaactcctggctccggcatggtaaactggaccccgcgtcgcaagcggcctgggaccgggaattgagcctggccagcgatgagatcgatgcctaccgcagaagctatatccaggcgttgaaaccggtattcgaggaaaccctcgccgaattggtttcactggatgacctgacccttagctactaccgaggctgggacaaggaccgggacctcctggaggtcctggcttccagcctgttacgcgaccagcagatgggccacacccaggcgggaccgcagcgtgcggatcttcgcatacggttggcaggtcataacgccgcggagattctctcgcgcggtcagcagaagctggtggtatgcgccctgcgcatcgcccaaggccatctgatcaatcgcgccaagcgcggacagtgcgtctacctggtggacgacctgccctcggaactggatgagcagcatcgaatggctctttgccgcttgcttgaagatttgggttgccaggtattcatcacctgcgtggacccgcaactattgaaagacggctggcgcacggatacgccggtatccatgttccacgtggaacatggaaaagtctctcagaccacgaccatcgggagtgaagcatga

SEQ ID NO: 2335 - DNA, 537 bp, Pseudomonas aeruginosa
cctgcacgccagcacgccgcagcaggaagtgcaggcggcgatagccaaagcgccggcgctcttgggccagttccaccagttgggcttgcagctcggtgttttgcacactggctcgcggctggtagcgcaacaccgagcgggacagcccgatcaactgacaggcacgacgctcggagatgccggttcgcgcctgcatctcctgcaccgcctcccgccgtgctgtcgggcttacccttttccccgggcgaccactttcagcgactcgatgtcgaggtgggcctcggcgagcaacttcttcaatcggctattttccagttcaagatccttcaaccgtttggcgtccgccacggtcataccgccaaacttcgcccgccaagtgtagaacgaggcatcactgaagccgtgtcggcgacacagttccttcaccggcacaccggcctccgcctgcttgaggaagtcgagaatctgctcttcggtaaaacgctttttcactgccgtctcctgctcggaaaacggactctactaagtttgacgtga

SEQ ID NO: 2336 - DNA, 330 bp, Pseudomonas aeruginosa
gaagcacgatgccaaggcggcggcggtcaagccggaaagcgtgatgaccgacgaaacccggcaactgctgaccgccttccagaagccgctgcgtacccaggccgacccctacccctacgagtcgcgggtcctgcaggggatctgggcggcggcgccgtacctgcacaacggctcggtgccgaccctggaagagttgctgaagccggccgcggagcgggtggaatccttcccggtgggctcggcctacgacgtggacaaggtcggcctcgccgcccagcagacccaattcggcagctatgtgctgaagaccaccggctgcgagcagcgtga

SEQ ID NO: 2337 - DNA, 864 bp, Pseudomonas aeruginosa
gtacggcaccagcctgtcggccgaggagaagcgtgcgctgctggagtatctgaaggtcctgtagtgaaaaaggcccggtgtcgcgaggacgccgggccttttcttcgaggcgggactggctcagccgagcagcgagatgtccgccaccccgaggaacgacccgcgcagcttggccagcagcgcatagcggttggcgcgcaccgctgcgtcgtcgacattgaccatcacatcggcgaagaacgtatccaccggctcgcgcaaggccgccaggcgggccagcgcggcgcgatagtcgcgtgccgctgccagcggcgcgacttcgctttcggcgttcgccacggcgctgcccagggccttctcggcggcttccaccagcaggctggcatccacgttcggcggaacctcgtcctcggacttggcgagaatattcgacacccgtttgttcgccgcggccagggcctcggcttcaggcaactgtcggaaggcctggacggcctgtacgcgctggtcgaagtccagcggcgagcttggcttgagcgcgcgcaccgactggtacacggccacgtccacgccttcgtcctcgtagcgcgcgcgcaggcggtcgaacacgaagtccagcacctgctcggccaggccggcggccttgaccttgtcgccgtattgctcgacggcggcgttgaccgcggctaccaggtccaggtcgagctgcttctcgatgaggatgcgcagcacgcccagcgcagcgcggcgcagcgcgtaggggtccttgctgccggtgggaagcatgccgatgccgaagataccgaccagggtatcgagcttgtcggccaccgccacggcggcgccggtcagggtcgagggtag

SEQ ID NO: 2338 - DNA, 1083 bp, Pseudomonas aeruginosa
ctcggcgccggcgccgcgcggcatgtactgctcgttgagggccagggcgacgtcttccgcttcgccgccgtgggtggcgtagtagtagccggcgatgccctgcatttcggggaactcgccgaccatctcggtcgccaggtcacacttggacaggatgccggcgcgcgaggcgttctgcgcattgccgcctatacgttcggcgatgtaggcggccaggccggagacgcgctgggccttctcgaacacggtgccgagctgggcctggaacactacgttgcgcaggcgctcattgaagctttcgagcggctgcttcttgtcctgcttgaagaagaactcggcgtcggtgaggcgcgggcgaaccaccttctcgttaccgctgacgatgttctccggcgccttgctctcgacgttggcgacggtgatgaagcgaggcagcagcttgccgttggcgtccagcaggcagaagtatttctggttgtcctgcatggtggtgatcagggcttcctgcgggacctcgaggaagcgctcctcgaaggagcagaccagcggcaccggccactcgaccagtgcagtcacttcgtcgagcaggctcggcggcacgatggcgctgccctgttgctcggcggccagttcggccacgcgcttggcgatcagctcgcggcgctcggcgaaatcggccagcacatgagcgccgcgcaggtcttccagatacgctgccgggctggaaatacgcacattgtccggattgtggaagcggtggccacgggattcgcgcccggctttctgggcgaggatctcgcactcgaccacatcgtcgccgaacagcatcaccagccattgggtcggacgcacgaactcctcgcggcgagctgcccagcgcatccgcttgggaatcggcagttcgttcaacgaggcctcgacgatgcccggcagcaggccggcggccggttggccggcgatggtctggctgaagcgcagcttcggaccgctcttgtcgatctgctgcagatccacgccgcacttcttggcgaagcccagggcggcctgggtcgggttaccgctggcgtcgaaggcggcctgtag

SEQ ID NO: 2339 - DNA, 1527 bp, Pseudomonas aeruginosa
ggagtggggtgtgccgcagcgcgatcccgacgcgctgttcgaacttctgctgctggagggcttccaggccggattgtcctggatcaccgtgctgaagaagcgcgagcgctaccgcgaggtgctgttcggcttcgacgtgcagcgggtggcacagatgagcgacgcggagatcgacgaactgatgctcgaccccggcatcattcgcaatcgggccaagctcaacgctgcgcggcagaacgcccaggcctggctggagctggacgacccggctgggttcctctggtccttcgtcggcggccagccgaagatcaaccatttcgccggtcgcgccgaggtgccggcgattaccccggaagccgaggccatgagcaaggcgctgcgcaaggccggcttcaacttcgtcgggccgaccatctgctacgccttcatgcaggccagcggcatggtcatggaccatacccaggactgcgaccgttacgcccaactcgtcggctagccgggcgctccctgacggatgcgttcggatgttccacgtggaacatcggcgcgcagcatagctggtcgccccgcttccttggctgccgccctcgccttcttcctggcgtacaatgcgcgttcgagtcgagcgaggagtgtttcgtggagaaattcaaaggtgccctggtggtgggggccctacgcctgttcgcgttattgccctggcgtgccgtgcaaggcgtcggggccggcataggctggctgatgtggaaattgccgaatcgatcccgcgaggtagtgcggatcaacctgtccaagtgcttccccgagttgtctgaaaccgaactggaaaagctggtcggacaaagcctgatggatattggccggaccctcaccgaaagtgcctgcgcctggatctggccgcctgaaaagtcgctgagatacatccgcgaggtcgaaggcatggaggtgctggaggaagcgctggcttccggcgatggcctggtcggcattaccagtcacctgggaaactgggaagtactcaaccacttctattgctcctacgccaagccgatcatcttctatcgtccgcccaagctgaaggcagtggacgagttgctgaagaagcaacgcgtgcaattgggcaatcgcgtcgcaccttccactccggagggtatcctcagtgtcatcaaggaagtgaagaaaggcggttgcgtagggattcccgccgaccccgagcccgcgcgtaccgctgggctcttcgtgccctacctgggcaccactgcattgatcagcaagttcgtcccgcagttgctttcacgcggcaaggcgcgtggagtgttcttccatgcggtgcgcctgcccgatggtagcggttacaaggtgatcctcgaagcggctccggcggacatgtacgacaaggacctggaagtgtctgtagcagccatgagccgcgagttggcgaagtatgtacgagcctatcccagccagtacatgtggagcatgaagcgcttcaagaaccgcccggatggcgagaaaaaatggtattga

SEQ ID NO: 2340 - DNA, 351 bp, Pseudomonas aeruginosa
ggaaagggcgtcggaagacgcctttttcatatccgggtactatgctcagctctgccgcctcctccgcaggtcccgagggactcgatggataatcaacgacaatacccacgaaccccgctcaagtgccgaatccgtatcagtcacccgttatttggcgagctgatggcgcagacacgcgacctctccgacaccggggtctatgtcaaacacccggatctgacccagctcccaacaggcagtgtcgttactggccaggtacaggatctgccgatcgacgcgccgatcctgcagatggaagtcgtgcgagtcgatgcggaaggcgtcggcctgcgctttctcagcgaagcctga

SEQ ID NO: 2341 - DNA, 1725 bp, Pseudomonas aeruginosa
ggacgatctccaggcgcttgctgccgtcggcggcgccgaagaccacggtggcatcgttgtagccgcactggcgggagaggaagtcgtagccgaacagtggcttgccggccggcggcaaggccacttcgagttcatggccggtgcaggaatcggccggcagcgcaggcgcggcggcctgcttttcatcgccgcccccgcacccttgcagggatgcgccgagcagcacggcggaaaggaagatcagcgggcgtttcatggtgttctcgcaagacgaagagcacgcagtttagcgccagcccggggcgttccgcatcggttgccgaatcccaccgccatgtcgcaaacgcacctccccgtggcgtgcataggcatctgggccggcagggccggtcataccatcgctggcaaagggaccgcgtgtcccgttgcagccattccggcgcggttccggcgccgcagggagacccagcgatgttcagcaagcatgaccagatccgcggctacgacgacgaactgctcgccgcgatggacgccgaagaggcccgccaggaagaccatctcgaactgatcgcctcggagaactacaccagcaagcgggtcatgcaggcgcagggcagcggcctgaccaacaagtatgccgagggctatccgggcaagcgctactacggcggctgcgaacacgtcgacaaggtcgagcagttggccatcgaccgcgccaggcagctgttcggcgccgactacgccaacgtccagccgcattccggttcctcggccaacgccgcggtgtacctggcgctgctcaacgccggcgacaccatcctcggcatgagcctggcccacggcggccatctcacccacggcgccaaggtgtcctcctccggcaagctgtacaacgccgtgcagtacggcctggacaccgctaccgggctgatcgactacgacgaattcgagcgcctggccgtggagcataagccgaagatgatcgtcgccggcttctccgcctactccaagaccctcgacttcccgcgcttccgcgccatcgccgacaaggtcggcgcctacctgttcgtcgacatggcccacgtcgccgggctggtcgccgccggcctctacccgaacccgatccccttcgccgacgtggtcaccaccaccacccacaagaccctgcgcggcccgcgcggcggcctgatcctggcgcgcgccaacgaggagatcgagaagaagctcaactccgcggtattccccggcgcccagggcggcccgctgatgcacgtgatcgcggccaaggcggtgtgcttcaaggaagcgctggagccgggcttcaaggactaccaggcgcaggtgatccgcaacgccaaggcgatggccgaggtgttcatcgggcgcggctacgacgtggtttccggcggcaccgacaaccacctgatgctgatcagcctggtgcgccagggcctgaccggcaaggaagccgacgccgccctcggccgggtcggcatcacggtgaacaagaacgctgtgccgaacgatccgcagagcccgttcgtcacctccggcatccgcatcggcaccccggccatcaccacccgcgggctgcaggaagcgcagagccgcgaactggccggctggatctgcgacatcctcgaccacctcggcgatgccgacgtggaagccaaggtcgccacccaggtcgccggtctctgcgcggacttcccggtctatcgctga

SEQ ID NO: 2342 - DNA, 639 bp, Pseudomonas aeruginosa
gccccccgaagacggtcggggagcccgacgcgccccggcccaaccctctccgcgggagagggagcaacagttcaggagcatccacatgcaacgctactccggcttcggcctgttaaagcattcactgagccatcacgagaactggcaacgcatgtggcgcacgcccacgccgaagccggtctacgacgtggtcatcgtcggcggcggcgggcacggcctggccaccgcctactacctggccaaggaacacggcatcagcaacgtggcggtagtcgagaaaggttggctgggcggcggcaacaccgcgcgcaacaccaccatcgtgcgctccaactacctgtgggacgagtccgcgctgctctacgaacacgcgatgaagctgtgggagggcctgtcccaggacctcaactacaacgtgatgttctcccagcgcggggtctacaacctctgccacaccctccaggacatgcgcgacggcgagcgccgggtcagcgccaaccgcctcaacggcgtcgacggcgaattgttgaacgcgcagcaggtggcggaggagattccctacctggactgcagcaagaacacccgctacccgatcatgggcgcgaccatccagcgtcgcggcggcgtcgcccgccatga

SEQ ID NO: 2343 - DNA, 3051 bp, Pseudomonas aeruginosa
  unsure (2880): Identity of nucleotide at the above locations are unknown.
gaagaaacccgccgtacaaggggaaccggcatgagccagatcaatcgcctgtccagcggcggccgcatcgaccgcaaccgcccgctgaccttcagcttcaacggccagcactaccagggctatgccggcgacaccctggccgccgcgctgctggccaacggcgtcgacatcgtcggccgcagcttcaagtactcgcgggcgcgcggcatcgtcgccgccggcgccgaggagcccaacgcgatcctgcagatcggctcccgcgaagccacccagatccccaacgtacgcgccacccagcaggcgctctacggcggcctggtggccaccagcaccaacggctggccgaacgtgcagaacgacctgatgggaatcttcggcaaggtcggcggcaagctgatgccgcccggtttctactacaagaccttcatgtacccgcagtcgatgtggatgacctacgagaagtacatccgcaaggccgccggcctgggccgcgcgccgaccgaggtcgatccggacagctacgactggatgaaccaccactgcgacgtgctggtggtcggcgccggcccggccggcctggccgccgccctcgccgccgctcgcagcggcgcgcgggtgattctcgccgacgagcaggaagagttcggcggcagcctgctggacacccgcgagaccctcgacggcaagcccgccgccgagtgggtcgcggacgccgtggccgagctgcaaggcctgccggaagtcatcctgctaccgcgctccacggtcaacggctaccacgaccacaacttcctcaccatccacgagcggcgcaccgaccacctcggcgaggtcgccccgctcggccaggtccgccagcgcgtgcaccgcgtgcgcgccaagcgcgtggtactggccgccggcgcccatgagcggccgctggtctacggcaacaacgacctgcccggcaacatgctcgccggcgcggtttccacctatgtacggcgctacggcgtggcaccgggcaagaaactggtgctggccaccaacaacgactacgcctaccgcgtcgccctcgactggcaggaagccggcctgcaagtggtggccatcgccgacgcccgggccaatccgcgcggcgagtggatcgaggaagcacgccaacgcggtatgcgggtgatcactggcagttcggtgatcgaggctcgcggcggcaagcgggtcagcggcgccaaggtcgcccggatcgacctgcaggccatgcgcgccagcggcggcgaatggctggactgcgacctgatcgccagctccggcggctacagcccggtcgtgcacctggcctcgcacctgggcggcaagccggaatggcgcgaggaaatcctcgccttcgtccccggcgaaggcctgcagaagcgcatctgcgccggcgccgtgaacggcgtgttcgggctcgccgaggtgctcgccgacggctaccaggccgggagtcgcgccgccctcgacgccggctacaagaccaccgccggcagcctgccgaaggtccagccgcgccgcgaggaagcgtccgtcgcgctgttccaggtgccccacgagaagcccacggcacgcgcaccgaagcagttcgtcgatccgcagaacgacgtcaccgccgccgccatcgaactggcctgccgcgagggcttcgagtccatcgagcacgtcaagcgctacaccgcgctgggcttcggcaccgaccagggcaagctgggcaacatcaacggcctggcgatcgccgcgcgggcccagggcaagagcatcgccgacaccggcaccaccatgttccgtccgaactacaccccggtgaccttcggcgccgtcgccggccgccactgcgggcacctgttcgaaccggtgcgtttcaccgccctgcacgcctggcacgtgaagaacggcgccgagttcgaggacgtcggccagtggaagcggccgtggtacttcccgcgccgcggcgaggacatgcacgccgccgtggcccgcgaatgccgcgcggtgcgcgaggcggtcggcctgctcgacgcctcgaccctgggcaagatcgacatccagggcccggacgcgcgggagttcctcaaccgggtctacaccaacgcctggaccaagctcgacgtcggcaaggcgcgctacggcctgatgtgcaaggaagacgggatggtcttcgacgacggcgtgaccgcctgcctggccgacaaccacttcgtcatgaccaccaccaccggcggcgccgcccgcgtactggagtggctggagctgtaccaccagaccgaatggccggagctgaaggtgtacttcacctcggtcaccgaccactacgcgaccctcaccctgtccggcccgaacagccgcaagctgctcgccgaagtcaccgacatcgacctggacaaggatgccttccccttcatgacctggaaggaaggcaaggtcgccggggtgccggcgcgggtgttccgcatctccttcaccggcgagctgagctacgaggtgaacgtccaggccgactacgccatgggcgtgctcgaagcgctcgccgagcacggcgcgaagtacggcctgacgccctacggcaccgagaccatgcacgtcctgcgcgccgagaagggcttcatcatcgtcccccaggacaccgatgcctcggtcaccccggacgatctcaacatgggctgggcggtgggccgcaccaagccgttctcctggatcggctgggcgcggcatgaaccgcgccgactggccgcgcgaggatcgcaagcaactggtcggactcaggccgagcaacccgcaggaggtactgcccgaaggcgcgccaactggtgttcgacaccccagcaggcgatcccgatgaagatggtcggccacgtcacctccagntacatgagcgccagcatcggccacggtttcgccctggcggtggtgaaaggcggcctcaagcgcatgggccagaaggtttacgcgccgctggcggacggccgcttcatcgaggcggagatctgctcctcggtgttttacgaccccaaaggggagcggcagaacgtggattga

SEQ ID NO: 2344 - DNA, 642 bp, Pseudomonas aeruginosa
aaacgaatgagcaaggcaaacgtctaccagcaacgccccgaacccggcgtccacgccgaatcgccgctgcaccatgccgagctgcacaagctcgccggcaagaccgccgcgaaggccggtatcgtcctgcgcgagaagaagctgctcggccacctggtgctgcgcggcgatgccgccgacccggccttcgccgccgccgtgcaccaggccctcggcctggaactgccggtggccctgaccctggtcgccagcggcgagacctcgctgcaatggctggccccggacgaatggttgctgatcgtccccggcggcgaggaatacgccgtcgaacagcgcctgcgccaggccctgggcgaggagctgcactacgcggtggtcaacgtcagcggcgggcagacgctgctcgaactgagcggagcgaacgtccgcgaactgctgatgaaatccaccagctacgacgtgcatccgagcaacttcccggtgggcaaggcggtcggcagcatcttcgccaagtcgcaatgcgtgatccgccataccggcgaggacacctgggagctggtcgtgcgccgcagcttcgccgactacttctggctctggttgcaagacgccagcgccgaatacggcctgcaggtagcggcatga

SEQ ID NO: 2345 - DNA, 936 bp, Pseudomonas aeruginosa
gcagccttcccctctccccgagaggggataccggacccggagcctcgcgatgagccgtacccccgacacctggatcctcaccgccgacagtcccagcctgctgggcaccgtcgacgtggtgacgcgctacctcttcgagcagcgctgctacgtcaccgagcaccactcgttcgacgaccgcctggcgcaacgcttcttcatccgcgtggagttccgcgccggcgacggcttcgacgaagcctccttccgcgccggactggccgaacgggtggcaccgttcggcatgcgtaccgagctgaccgcgccgggctaccgcagccaggtggcgatcatggtttccaaggccgaccactgcctgaacgacctgctctaccgccagcgcatcggccagttgccgatggacgtggtggcggtgatttccaatcacccggacctggagccgctggcgcgctggcacggcattccctaccaccacttcccgctcgacccgaacgacaagccggcccaggaagccagggtctggcaggtgctcgaagagagtggcgccgagctggtgatcctcgctcgctacatgcaggtgctgtcgccggaactgtgccggcgcctggacggctgggcgatcaacatccatcactccctgctgcccggcttcaagggcgccaagccgtaccaccaggcctaccagaagggcgtgaagctggtcggcgccaccgcccactacatcaacaacgacctcgacgaagggccgatcatcgcccagggcgtcgagacggtcgaccacgcccactaccccgaggacctaatcgccaagggccgcgacatcgagtgcctgaccctggcgcgggcggtgggctaccacatcgagcggagggtattcctcaacgccaatcggaccgtggtgctgtaagcgcgccctctcttcccaaccctcgctga

SEQ ID NO: 2346 - DNA, 630 bp, Pseudomonas aeruginosa
aggaagagggccagggagaggggcgcttcccacggcctcgcgtcccgagcaacaccgacagcccgccggctgccagcattctccggccctgtcgcgcaacagacgactttccagtgcaaagccgcgcggccgtggacgccgcgcatttgtacccacaacgacaaagaggaaacgcgtatgtctggcaatcgtggtgtggtctatctcggcccgggcaaggtcgaggtgcagaacattccctatccgaagatgcaggacccgcagggccggcagatcgaccacggggtgatcctgcgggtggtctccaccaacatctgcggctccgaccagcacatggtgcgcggccgtaccaccgcgccggaaggcctggtgctgggccacgagatcaccggcgaggtggtggagatcgggcgtggcgtggaaaccatgaagatcggcgacctggtctcggtaccgttcaacgtcgcctgcggccactgccgtacttgcaaggaacagcacaccggcgtctgcctgacggtcaatccggcgcgtgccggcggcgccctacggctacgtcgacatgggtggctgggtcggcggccaggccgaatacgtggctggtgccatacgccgacttcaacctgctga

SEQ ID NO: 2347 - DNA, 1470 bp, Pseudomonas aeruginosa
cccgatcaaccgcgtcgaacaggtacaggtcgacgacctggcctgctggcgcatccacaccgcccatggcgaggcgctgatcgcccagcagggcgcgcaactgctcagctaccagccccacgaacagccgccgctggtctggctcagcgacgaggccggctaccggcgcgggcagtcggtacgcggcggggtgccggtgtgctggccgtggttcggtccgctggagcgcaacccgcaggaagtccgcggccaggtggaagatggcctgaaggcgcccgcccacgggctggtccgggcggtcgactgggaaatcgacgacatcgccgaggaggacggcgacctctgcgtcagcttccgtctcgacgcccccgatggcctccccggctggccgcacccggcggcgctgcgcatgctgttccgcttcggcgagcgcctgaccctgcgactcaccagcgagaacctcggcagcaagccgctggtgctcagccaggcactgcacacctacttcgcggtcagcgacagccgcgagatcgccatcgagggcctggaaggcgcgcgctacatcgagaccctggagaactgggaagaacgcactcagcacggcgcggtacgggtcaagggcgaactggatcgcatctacctcggtctcgaacgcgacctgctgatcaaggacccgcgctgggaacgcagcatccacctgcacgccctcgactcgcgctcggcggtggtctggaacccctgggtggacaagtcccggcgtctctcgcagttcgccgacgacgcctggcagcagatgctctgcatcgagaccgggcgggtctgggacgacctcatggtggtcgcccccgggcgcagcgaaagctttggcgtgcagatctggagcgagccgctgaaacgaccctgagcgggtcggcgagcggacggcgcggctcgcatcgtccgccatggaccgttgcgcaggtgccggccctacaggtccgcttcctccaccaccttcacccgcgccttgtcgatggcgtaggcggcatcggccaggtcattgctcacctgctcgatcttcagcgtgccgctgacccacagcggggtgtagatatcggtcagcttcagcccctgtggataacgcaccaggacgatctggttcggcggcggcggcggcacgtggatgcaggcgcccggatagggcaccaggaagaattcggtgacgcggcccttggcgtcgttctccagcggcaccgggtagccgccgaggcggatcgccttgccatccaggctggcgacggtcttggccgaatacatcaccgccggcatctttcggtccgactgcttcaggccccccttgctggtgaaggtgccggcggcctccggggtgtcgtggacgatgtcgggcatttcttccagcgccttgcggtcggccggcggcatcagttccagccagtcggtctcgggcagttcggcgtggaccaggggtga

SEQ ID NO: 2348 - DNA, 1398 bp, Pseudomonas aeruginosa
tcacgccaaccagtgcgctcatcgtcgtgcctctctcaaatgcgccgtccggcgcgtcagaaaccaacaagccacgcttcgtcgaggggcgtggcttgtactgggccgagccggcgggcagtgccggttcgaaggcggcgcagtataccgcaaaggcaggccgggcgcgcgccgggggctaccgtccgtcccgttttttcgcgccatggcgggaaacttgccgcaactcaatgcgcgcctgccacgagcggccagactggttgtcgcggcgcgctccgagggagcggcggccgcgccggttccgcagcctgtcgcggtgcccgtcaaaggcaccgcgacaggcgctcagccccgtccaaggagatgaccatgaccctgccacagaccatgaaagccgcggtcgtgcacgcctacggcgcgccgctgcggatcgaggaagtcaaggttccgctgcccggccccgggcaggtactggtgaagatcgaagcctccggcgtctgccacaccgacctgcacgccgccgagggcgactggccggtgaagccgccgttgccgttcattcccggtcacgaaggcgtcggctacgtcgccgcggtgggcagcggagtgacccgggtgaaggaaggcgaccgggtcggcatcccctggctgtacaccgcctgcggctgctgcgagcactgcctgaccggctgggagaccctctgcgaaagccagcagaacaccggctactcggtgaacggcggctatgccgaatacgtattggccgacccgaactacgtcggaattctgccgaaaaacgtcgaattcgctgaaatcgcgccgatcctctgcgccggcgtcaccgtctacaaggggctcaagcagaccaacgcgcgccccggccagtgggtggcgatctccggcatcggcggcctcggccacgtcgccgtgcagtacgccagggccatgggcctgcacgtcgccgccatcgacatcgacgacgccaagctggaactagcgcgcaagctcggtgccagcctgacggtcaacgcccggcaggaagacccggtggaggcgatccagcgcgacatcggcggcgcccacggggtgctggtcaccgcggtatccaacagcgccttcggccaggccatcggcatggcccgccgcggcggcaccattgccctggtcggcctgccgccgggtgacttcccgacgccgatcttcgacgtggtgctcaagggcctgcacatcgccggctccatcgtcggcacccgcgcggacctgcaggaagccctcgactttgccggcgaaggcctggtcaaggcgaccatccatccgggcaagctggacgacatcaaccagatcctcgaccagatgcgcgccgggcagatcgaggggcgcatcgtcctcgagatgtga

SEQ ID NO: 2349 - DNA, 1026 bp, Pseudomonas aeruginosa
cctgcggggcggcgtcccggcgccgcccttgcctgtctactcgacgctgcccagcccgccttccagcttgcgccagagcaggcggatcgccgccttgcgcaccagcgcgcagcggtacaggcggatttcctgcggcacgaaccattgcggcccgccacagatcgccagttcgccgcgctccagttcgttgaccacgctcagccgtggcacccaggccacgcccatgccttgcagcgccatgctcttcaggctgtcggccatcgccgtctcgtagaccgtggtgtagcgcaggttgcgctggcgcagcagcaggttgaccccgcgaccgaggaaggcgctggcgctgtaggcgagcagcggcacgctctggccgttctccaggtcgaacagcggctggccctcggcgttcaccgcgcagaccggcagcatctcggtgcgccccaggtgcagcgaggggaagatctccgggtccatctgcaacgcggcgtcagggtcgtagaacgccagcatcaggtcgcagctaccctcgcgcagggaatgcaccgcctcgccgacgttggtggcgatcagccggctggcgatgttcagcccctcgttgcgcagccgcgcgatccactgcgggaagaagcccagcgccagcgagtgggcggcggcgaactgcagcacctcgccctgcccgccttccaggtggtgcaggtggcgcaccacctggccgagctgctcgaccacgctgcgcgcggtgaccaggaacagctgcccggcctcggtcagttccaccggcgtgcgctggcgattcaccagggtcaggccgagggcgtcctccaggctgcggatgcgccggctgaaggccggctgggtgacgaagcgcttctccgccgcctgggaaaagctgcgggtgccggccagggcgatgaaatcctccagccacttcagttcgaggttcacgacgggaaaggctccggtaatgcgatgacacgtccgccatcataccagcgtcacatccaacattatgccgtttgtgcatga

SEQ ID NO: 2350 - DNA, 1383 bp, Pseudomonas aeruginosa
  unsure (754),(874): Identity of nucleotide at the above locations are unknown.
ggggcacggcgacctgcggtgtcccttcttttttttcaccgctcaagacggcccgcagatcttccccgttgccgaggtgttgtgtggctgcgctcacctgtggataacgtccgcgtcatacgtcctacgaaggcatatcccctctcaacaccccgtcaacccttgctcccgccgctcctccgggaagaaatagggcctcaatacccgtaccccgacgctgttgccggcaaacgccgccaccaaccacaaccagccatgcaggctgccggacgcgatcccgctgaaatacgcgccgatgttgcagccataggccaggcgcgcgccgtagccgagcagcagcccgccgatcaccgccgccgccagcgaacggcgcgggatgtccaggttcggcgcgaagcgtccggccaggccggcggcgagcagcgcgccgaggacgatgccgatgtccatcacgctggtgatgtcttcccacagcggcgcggccagcgccttggcgttcgccggcgtctgccagaaggcccaggcgccgacgtccaggcccacgccctgggcgatcttcgcgccccacagggcgaaggccgacgtgatgccccaggggcgtccggcgaggtacagggtgaggaagttgagcagcgccagcgccaacgcgccccagaccagcgggccagggccgcggaagaagcgccgccaaccccgccattaggcgctcggcggggtatccagggtgccgtggcgggccttctccatgcgtacngtgaccccggcgatgccgatgaacaccgccaggctctacaccagcgccggtgccaggcccagttcggcgaccagcgagatcggcggcagcgacggcagggcgaaccaccagccgacatgntgggtggcgatcagcgagccgaggatgaagaacagcagggtcaccagcatccgcgcgttgccgccgccgacggtgaacagggtgccggaggcgcagccgccgcccagttgcatgccgatgccgaaaatgaaggcgccgacgatcaccgaagtaccgaccggcgagacgaaaccgctcaccggctggccgaacaggctgcccgccgccagcgccgggaagaacagcagcaccgccagcgccagcatcaccatctgcgcgcgcagcccggcgccgcgccgttcgcggatgaatacccgccaggcggaggtgaagccgaaggcggcgtggtagagggtcaggcccagggcgccgccgacgacgaagaggatggcctggcgcgcgctgaccgcgttgaacaggaacagcccgccgagcaccagcagggcgaaggcgatcaggggggcggcgagcttgcgctcgggcgcggcggaaagggcgacactcatggctactcctgggcgcgagggtga

SEQ ID NO: 2351 - DNA, 720 bp, Pseudomonas aeruginosa
tccgggggcattctagtcagtcgcgacgacgggtccaaccagggcctcccgccgccaggccttgcgcaacgcccgcagcgcctcgtcgatacgcacctcgggtactgccgggaagcccagcaccaggcccgcgcggtcgtctggcgcaacgctggagtcgtccatccagtagtcgctcaaggcgctgacttccaccccggcggctgccgccgcggcgatcagggcccgttcccgcgccaggctgtcgacccgcacgcacaggtgcagccccgcatccaccgccggcaacggctggcaacccggcgcttttggccagccccgcagcaaggcgtcgcggcgggcgcgggcggcgcggcgcatgcggcggacgtggcgctggaaatgcccctcggcgatgaagtcggccatgacccgctgggtgcccacctccgaatggcgtacctcgatggcccgccgctggcggaagcgctcgaccagcgccggcgggaccaccaggtagcccaggcgcaacgccgggaaggcgatcttgcagaaggtcccgacgtagagcacccggccctgtcggtccagcgcggccagcggcgccagcggcgtaccgctgtagcgatactcgccgtcgtagtcgtcctcgacgatccaaccgtcggcgcgctcggcccactccagcagctccaggcgccgcgccagcgacagggtgacgccggtggggtactggtgtga

SEQ ID NO: 2352 - DNA, 1671 bp, Pseudomonas aeruginosa
ccgcgcccaggtgtcgaaggggaacaggtcgaaggccggcacgccgacgcggaacgctcgcggcgcgccttccggtggcggcgccagggccgccgggccgcgcggcgcgggagcgctcggggcgacggcgggggccctgcctgggatttcctgcaactcggcaacgtaggtgccgtcgcctgtgcgcccgtcgatatagccctcggcgtgcaactgttcataggcccgcaccacggtgttgcgcgagaccttcagggcctgggccagctcgcggctggcgggcatccgcgtgcggctgccgaggcggccgtcgaggatccgttcgcgcagcgcggcgtagagctggcgggccaggccctgggcggggtcgaggtggatgccggcggcgtcgaagggcagtacggtggccatggcggtctcggagggaagaaagcgccagtgtggattggacctgtggaattgaccagcaatggatcttctagcggaccatttcccggcctagtctggaggcacctttacccggacatggaaccgagccatgagcacgtccctgcagattcgtcccgtcggcgccggcgaccacgccgcctggctgccgctgtgggagggctaccagcgcttctacaagaccgagatcgccgccgctaccagcgacgccacctggcagcgcttcctcgacgccgacgaaccgatgaacgccgccctcgcctggctcgacgagcgcgccgtgggcctggtgcactggatctaccaccgctcctgctggaccgtcggcgactactgctacctgcaggacctgttcgtcgccgagggcctgcgcggcgaaggcatagggcgccggctgatcgagcatgtctacgccgaggccggcgccgctggctgttcgcgggtgcactggctgacccacgagagcaacagcgacgcgatgaagctgtacgagcgcatcgccgacaagtccggtttccttcagtaccgcaggattctctgaggcccaccatgcgcgaacccttgaactggcgccccgtcgccactccaccccacgccccgctcgacggccgcttcgtcaagctcgaaccgctcgatccgcaacgccacggcgacgacctgtgggacgccctgcaagggcctggcgccgacccgttgctgtgggaatacctggcctacggcccgttcgccgagcgcccggcgttcgacgcctggctggccggccaggcggccagccgcgacccgctgttcttcgccgtgcgcgagcggcgcacgcagcgcgccgtcggcctgctcagctacctgcggatcacgccgaaggatggcgtcatcgaaatcggccatatcgccttcggcgcgcctatgcagcgcacaccggggtctaccgaggcggtctacctgctcgccgaactcgccctcggccgcctcggctaccgccgcctggagtggaagtgcaatgccggcaacgcccgttcgatgcgcgccgccgagcgcctgggcttcacctacgaaggcaccttccgccagcacatggtggtcaagcagcgcaaccgcgacaccgcctggttctccctgctcgacagcgaatggccggcgcgacaggcggcgttcgagcgctggctcgatccttccaacttcgacgccgaaggccgccagcggcagacgctggaggcgctgcgcgactag

SEQ ID NO: 2353 - DNA, 1341 bp, Pseudomonas aeruginosa
cccctggcagggactgccggtcgctcaacggtactccggcagccagtgcaggctggccaggatgtgcgcgaccgcgttggccacgccgaacagcagcaccagcacgatcgccggcgtgccgccccaggcgcggaacagcgggctgccgaagcgcttgcgcgaggcccgcgccatcagcgccggaacgatcaccgcccagaacgccgcggccagcccggcgaaaccgatggcgtagatgaagccgttggggaacagcagcccgccgatggtcggtgggacgaaggtcagcaacgcggtcttgaagcgcccgaagtggctgtcgtcgaacctgcacaggtcggccaggtagtcgaacaggccgagggtcacgccgaggaaggagctggccaccgccaggttggagaaggtggtgagcaacgcgttcagcgaatccgacgcggtgatccggtgcaggtattccaccagggtgccgacgttgctgccgccggcgatgatgcccttgaactgctcgcgcgggatggtgcccagggtgctggcctgccacagcaggtagatggccagggcgatcagggtgccgatccacagcgaacggctgatccgctgcgggtccttgccgtagtacttcatcaggctcggcacgttgccgtggtaaccgaaggaagtcaggcagaacggcagggtcgccagcaggtagggccagtagaccgcgtccggctcgccgctgttgaacaggatcgccggctggatgcgcccgagcaggccgctgatggagaggccgaaggtaatgatcatgccgccgagcatcagcgtggtgatgcggtccaccgcgcgggtgctccaccacaccaccagcgccaccgccagggcgaacagcagcccggcgagcttttccggcagggtcacgccgaggccgctggacagggtgtagccgatgatcgagccgccgccggagatataggcataggtgaggatatagaggacgaaggcgatgctcagcccgttgaccacattccagccctggccgagcaggtcacgggtgatggtcgagaagctcgagcccaccgggtagttgaggttggcctcgaggatcatcatccccgacagcagcatgcagaaccaggtgagcaggaacaccgccaccgaccagccgaaccagatgccggacatggcgatgggcagggagaacattccggcgccgacggcggtgccggcgatgatcatcgaaccgccgagcagcgagggccggcggctgggcgtttgagctggagaggacgacacctggacttcccgatagtcagcgcctgcggcgcgacgcgccgttgggcagaggcggcattctag

SEQ ID NO: 2354 - DNA, 2907 bp, Pseudomonas aeruginosa
gcggcgcgcgcgccgggcgcaccctggcagggcgaacagccggccgacgcggcaaccgatgccgataaaaaaaggggagcatcatgctcccccagggactttaaccgtctgtcgcggtcagcccgcaatctcgatcaggatctcgcccgggttgacccggtcgcccttggccacgtggatcgccttgaccgtaccggcgatgccggcctggacctcggtttccatcttcatcgcctcggtgatcaacaccgcctggccggccttgacgctatcgccttccttcaccagcacgtcgacgatgttgcccggcatggtggtgctgacgtggcccggctcgctggcatgcttgcggccgctggcggagccggcgacatattcgttgagcggctcgaacaccacttcttccggcatgccgtcgatggacaggtagaagtgccgcttgttgtcgctcttcacgccgaccccggtgatgtcgacgcggtaggtctcgccgtgcacgtcgatgacgaactcggtcggggtgccttccgcgccagcggcggcgacgcccttgccggtgagaatcggcagcagttcctcgggcttcagggtgccggcctcacgctcttcgaggaacttgcgcccgatgtccgggaacatcgcgtaggtgagtacgtcttcctcggacttggccaggttgccgatctcgctgcgcagcttgttcagctccggcttgatcaggtcggccgggcgcacgtcgatgacttcctcgctgccgatggcctggcgccgcagttgctcgttgacctcgccgggggccttgccataacggccctgcaggtacagcttcacttcgttggtgatggtcttgtagcgctcgccggcgagcacgttgaagaacgcctgggtgccgacgatctgcgaagtcggcgtcaccagcggcgggaaaccgaggtcggcgcggaccctcgggatttcctcgagcacctcgcccatacggttcagcgcgccctgctccttgagctggttggccaggttggaaatcatcccgcccggcacctggttgacctgtacgcgggtatccacgccggtgaattcgctctcgaactggtggtacttcttgcgcaccgcgtggaagtacatgccgatctcctggatcagctccaggtccaggccggtgtcgtagggggtgccgcgcagcgccgcgaccatcgactcggtgcccgggtggctggtgccccaggccatgctggagatcgccgtgtcgatacggtcggcgccgttttccacggccttcagctggcacatgctggcgacaccggcggtgtcatgggaatgcaccaccacgtccagcggcagggcgtccttcagggccttgaccaggtcgccggtggcatagggggtgagcaggccggccatgtccttgatggcgatggagtcgacgcccatgtcggccatcgccttgccctgggcgacgaaggcctcgatggtgtgcaccgggctggtggtgtagcagatggtgccctgggcgtgcttgccggcggccttcaccgcctcgatggagacgcgcaggttacgcacgtcgttcatcgcgtcgaagatgcggaacacgtcgatgccgttgaccgccgccttggccacgaaggcgcgcaccacatcgtcgctgtagtggcggtagccgagcaggttctgcccgcgcaggagcatctgcaggcgagtgttgggcagcgctgccttgagcttgcgcaggcgttcccacgggtcttccttgaggaagcgcacgcaggcgtcgaaggtggcgccgccccagacttccagcgaccagtagccgacgcggtcgagcttgtcgcagatcggcagcatgtcctcggtgcgcatgcgggtcgccagcagcgactggtgggcatcgcgcaggatggtatcggtgacgccggtcttcttcgcttggatggtgttgctcatgttctgctccttcccttacaggccggcgtgggccgcgatggcggtggcgatggcgatggccaggtgcgacgggttgcgcttgatcgagtactgggtcagttccgggtggctttcgacgaagctggtgttgaactggccgctgcggaattccgggttgcggaggatttcctggtagtacggcgcggtggtcttgaccccctgcacgcgcatgtcgtcgagggcgcgcaggccgcgatcgagggcctcttcccaggtcagcgcccagacgatcagcttcaggcacatcgagtcgtagtacggcgggatggtgtagccggtgtagatcgccgtgtcggtacgcacgccggggccgccgggggcgtagtagcgggtgatcttgccgaacgagggcaggaagttgttcttcgggtcctcggcgttgatgcggaactgcagggcgtagccgcgatggacgatgtcgtcctgcttgaccgacagctccagcccggaagcgatgcggatctgctcgcggaccacgtcgatgccggtgatttcctcggtgatggtgtgctccacctggacccgggtgttcatctccatgaagtacacctcgccgtcggcgagcaggaactccacggtgccggcgttctcgtagcccaccgccttggccgcgcgcaccgccaggtcgccgatataggcgcgctgctcgggggtgagctgcgggctcggggcgatctcgatgagcttctggttgcggcgctggatcgagcagtcgcgctcgaacaggtgcacggtgttgccgaaggaatcggcgaggatctgcgcctcgatgtgcttgggattgacgatgcacttctcgaggaatacctcggcgctgccgaaggccttggtcgcctcggagatcacccgcggggaacgcctgttccagctcctcgcggctgttgcagcgacggatgccgcgaccgccgccgccggaggtggccttga

SEQ ID NO: 2355 - DNA, 948 bp, Pseudomonas aeruginosa
gtcgttgatgcgtatgacattacggcagcttcaggtttttcgtgccgtatgcgagagccgctcctacagccgggcggcggaggaaatggccctgacccagccggcggtcagcctgcagatccgccaactggaagagctggtcggccagccgctgttcgagtacgtcggcaagaagctctacctgaccgatgccgccgaagccctgctgaagaccagcaccgacctgttccagcgcctggaaagcctggacatgcagctctcggacctgaagggctcgctgcagggccagttgcgcctggcggtggagtccagcgccaagtacatcaccccgcacctgttcaaggcgttccagaacctgcatccggaagtcagcctgagcctgacggtggtcaaccgcacccaggtgatcaagcgcctggccgacaaccgcgacgacctggtgatcatgtccctggtaccgcaggacatggccctggagttcctgcccttcctgaacaacccgatcatcgccgtggcgccgccggaccatccgctgtgcaacgccgcgaagctggccctgaaggacctggagcccttcccgctactggtccgcgaaccgggctccggcacccgcaaggcttgcgaggagttcttccagcaacgccgcgcgcacttctcgcagatccaggagatcgcctcgctggagtccctgcgcgaaggggtgatcgccggcctcggcctggccctgctgccgcgccatgcggcgcaccaggaactggccaacggcctgctgcgcgaactaccggtggaggaattgccgctctatcgcagctggtgcctggtgcacgccaagggcaagcgcctgagcccggtggcccaggcgttcgtcgccttcgtccgcgaggagcgggcgctgatcagccagctcgctgggcgcttcgccggccctggcggttcgagctgaggtag

SEQ ID NO: 2356 - DNA, 2532 bp, Pseudomonas aeruginosa
cggtttggcggcaggccggtgaagactgcgttatgccttcccggcggcgcctcaggacggctcgccgcgctcttcctggttcttcatcaccttcggcgacaggcgcaggctgcgcaggctgcgcttgacgctcttgaggtggttgaccaggtccgggccgcgggccatggccacgcccatcgccagcacgtcgatcaccaccaagtgggcgatgcgcgaggtcagcggggtgtagatgtcggtgtcctcgtgcacgtcgatcgccaggttgaccgtggccaggtcggccagcggggtctggctcgggcacagggtgatcagcgtggcgccggcctcgcgcaccaggttggcggtgatcagcaggtccttcgagcgacccgactgggaaatgcagatggccacgtcgctgggcttgagggtcaccgccgacatcgcctgcatgtgcgggtcggagtaggccgccgccgacagcagcaggcggaagaacttgtgctgggcatccgaggccaccgcgccggaagcgccgaagccgtagaactccacgcgctgggcgtgggcgatggcggcgatggcgcgctccagggcgtgggtgtccaggtgctcgcggacttccatcaggctgtgcagcgtggtgtcgaagatcttcaggctgaagtcggccaccgagtcgctctcatggatcgagaactggccgaagctggcgccggccgccaggctctgcgccagcttcagcttgaggtcctggaagccgctgcagccgatggcgcggcagaagcgcacgatggtcggctcgctgaccccgaccccatgggccagttcggccatggagctgtgcatgaccgacgccggatcgttgagaacgtgatcggcgaccttgagttccgacttgcggagctgttggcgggactgggctatgtgctgcagcaggttcacaggctgggctcgattctctgtagtaaccttgtagttatactacaaacagtcagccacgcccagccaacgccgtcgggagcttgccttgagtacaccagccactccaacgtcctgcgacatcctggtcttcggcggtaccggcgacctggccctgcacaagctgctgccggcgctctatcgcctgcaccgggaggaccgcctgccggccgatacgcggatcttcgccctcgcccgcagcgcgctggacaacgccgccttcctcgccctcgccgagcgcaacgtccgcgcggtggtggcgcgcagcgagttcgccgccgaacaatggaaaggcttcgccgcgcgcctcgactacctggccatggacgcctcgcagagcgccgacttcggccgtctcgcgcggcacctgaagagcagcgagggccgggtgctggtgcactacctggcgacctcgccgagcctgttcgcgccgatcgcgcagaacctctccatcgccggcctcgccgggccgcaagcgcgcatcgtgctggaaaaaccgctgggccattcgctggactcggcgagggcgatcaaccagtccatcggccgggtgttcgacgagtcgcgggtgttccgcatcgaccactacctgggcaaggaaaccgtgcagaacctgatggccctgcgcttcgccaatgcgttgttcgagccggtctggcgcgcggcgcacatcgaccatgtgcagatcagcgtcaacgagacccttggcgtggagaaccgtggcggctactacgaccacgccggggcgatgcgcgacatggtgcagaaccatctgctccagttgctctgcctggtggcgatggaggcgccggtgcgtttcgacgccgaggctgtgcgcaacgagaagctcaaggtgctgcaggcgctgaagccgatctccgggctcgacgtgcaggacaagacggtacgcggccagtacgccgccggcaggatcggcggccaggaggtgccggcgtactacttcgagaagaacgtcgacaacgacagcgataccgagaccttcgtcgcgctccaggccgaggtcgagaactggcgctgggccggggtgccgttctacctgcgcaccggcaagcgcatggcgcgcaagtgctcggaaatcgtcatccagttcaagccggtgccgcacagcctgatcgacggcggcggcgggccggccaaccgcctgtggataaggttgcagccggaggagcggatcagcgtgcaactgatggccaagaccccgggcaagggcatgcaactggaaccggtggagctggacctcaacctggccgaggccctcagccgcaacaagcggcgctgggacgcctacgagcgcctgctgctggacgtgatcgagggcgactcgacgctgttcatgcgccgcgacgaggtagaggccgcctggggctgggtcgacccgatcctcgccggctggcgcgagcactaccagagcccgcggccctacccggccggcagcaacggcccggaacaggcgcaactgctgctggaactgcagggtcgacgctggctggaatgacgcggacattgatccggctcaggatcgcccggcgcgcgctcggctag

SEQ ID NO: 2357 - DNA, 1428 bp, Pseudomonas aeruginosa
agtcgcgcgcccacgtcgttgcgagcccgaaccatgaccgccaccaccctccgccccgaactgctgtgccccgccggcaccctgaaaagcatgcgctatgccttcgcctacggcgccgatgccgtctacgccgggcagccgcgctacagcctgcgggtgcgcaacaacgatttcgaccacgcccaactggccgaaggcatcgccgaggcccacgcacttggcaagcgcttctacgtggtggtcaacatcgccccgcacaacgccaagctgaaaaccttcctgcgcgacctggagccggtggtcgccatgggtccggatgcgctgatcatgtccgatcccggcctgatcatgctggttcgccagcatttcccgcagatgcccatccacctgtcggtgcaggccaacgcggtgaactgggccgcggtgcaattctggcggcagcagggcctgacccgggtgatcctttcccgcgagctgtcgctggaggagatcgaggaaatccgccagcaggtgccggacatggagctggaagtgttcgtccacggcgccttgtgcatggcctattccgggcgctgcctgctgtccggctacatcaaccgccgcgaccccaaccagggcacctgcaccaatgcctgccgctgggaatacaaggcggtggagggccgcgaggacgagctgggcaacgtggtggcgcgggagccgaccctgggacgcggcgcgccgaccgagcaggtgttcctcctcgaggaaggcaaccgtcccggcgaaccgatggccgccttcgaggacgaacacggcacctacatcatgaattccaaggacctccgcgccgtgcagcacgtcgagcggctggcgcggatcggcgtgcactcgctgaagatcgagggccgcaccaaatcccactactacgtggcgcgcaccgcccaggtctaccgccaggcgatcgacgacgcggcggccggcaagccgttcgaccgcggcctgatggacaccgtggagtccctcgcccaccgcggctacaccgagggcttcctgcgccgccacgtgcacgacgagtaccagaactaccagcacggccattcgttgtccgagcgccagcagttcgtcggcgaactcaccggcgaacgccgcgacggactggccgaggtggaggtgaagaaccgcttccagcgcggcgacagcgtcgaactgatgactccgcgaggcaacctgagcctgcgcgtggaggacctgcgcaacgccgccggcgaggccatcgaggtggcgccgggcaatggccacgtggtctacctggcgctgccggaaggcctggacctgtgctacgcgctactgatgcgcgatctccagcccggccaggatacccgccagccgcaggccgaacgcagcggcgggtgtgccggcaagggcgcttgcggctgcgctcactga

SEQ ID NO: 2358 - DNA, 705 bp, Pseudomonas aeruginosa
agccctgttcggcttcgtcgaagcgaccgctgtagaagttggccgcagcctccaggtacgtggcgaaggccttgcctgcggccgactcgacgccttgcgcgagcacaccgcccagttcctcttgttcccagccgcaggcaccgagcaggtccaggcggctgttggccagggccttggtctccgcctcgcccagcccggcgtcacgcacctggcgaagaaacgccagcgcgctgtcctggtcgttgctgcggcagcggctgccctcgccctcgaagaattcggcgccggcgatcttttccggtagcgcttcggcgcccatctgccgggccagttcggcgagcggcgagggcgctggcgcaggcggcggtgtctcggcctcgctcgccgccgacggcgcgggcggctggctgccgtcgccgggcagcaggcggaacaggccgaacggcaccaggccgtagccttcgagcttctcttcctccgacggcggcgcctccaccagccgccagtggccggcgtcggccagcagcaggcgcaggttggcgcgggtgtcgttgcccggggcgaggaacggcagggtatcgcagacaccgccgccgaccagagaccaatcgggatagcaggagtcgtcgctgctggcctgggccagcggggagagaccggcgcccaccagcaggagggcgggaagaagcggcttcgagcgcatga

SEQ ID NO: 2359 - DNA, 2019 bp, Pseudomonas aeruginosa
agtggccggagcataaccgagcaggggcaggctgcccaaggccgggatagagcatttttccgcagccaggcccgacgctgcgccggcctgcgccgaatggcggcccggtttgcccggcttttccccgccccggtagaatgccgcgatgaacgacgacctctccctcctgctgaactccctcaacgacccgcagcgccaggccgtggccgcgccgctgggccgccaactggtcctcgccggcgccggctcgggcaagacccgcgtgctggtgcaccggatcgcctggctgatccaggtcgagcacgcctcgccctacagcatcctgtcggtgaccttcaccaacaaggcggcggcggagatgcgccaccgcatcgagcagttgctcgggatcaatccggcgggcatgtgggtcggcaccttccacggcctcgcccatcgcctgctgcgcgcgcactggcgcgaggccgggctgagcgagaacttccagatcctcgacagcgacgaccagcaacgcctggtcaagcgggtgatccgcgaactcggcctcgacgagcagcgctggccggcgcgccaggcccagtggttcatcaacgggcagaaggacgagggcctgcggccgcaacacatccagcccggcggcgacctgttcctcgccaccatgctgaagatctacgaagcctacgaggcggcctgcgcccgcgccggggtgatcgacttctccgagctgctgctgcgcgccctggacctctggcgcgaccatcccggcgtgctcgagcactaccagcggcgcttccgccatatcctggtggacgagttccaggacaccaacgccgtgcagtacgcctggctacggattctcgccaagggcggcgacagcctgatggtggtcggcgacgacgaccagtcgatctacggctggcgtggcgcacggatcgagaacatccagcagttcagcgacgacttcgccgacgccgaggtgatccgcctggagcagaactaccgttccaccgcgtcgatcctcaaggccgccaacgccctgatcgccaacaaccagggacgcctgggcaaggagttgtggaccgacggcgaggacggcgagtcgctgagcctgtacgccgcgttcaacgagcacgacgaggcgcgctacgtggtcgagtcgatcgagagcgcgctcaagggcggcctggcgcgcagcgagatcgccatcctctaccgctccaacgcccagtcgcgggtgctggaggaagccctgctgcgggagaagattccctaccgcatctacggcggccagcgcttcttcgagcgtgccgagatcaagaacgccatggcctacctgcgcctgctcgacggccgcggcaacgacgcggcgctggaacgggtggtcaacgtgccggcacgcggcatcggcgagaagaccgtggagagcatccgcgaattcgcccgcggcaacgatgtgtcgatgtgggaggcgatccgcctgatgatcgccaacaaggtcctgcccggccgcgccgccagcgccctgaccggcttcgtcgagctgatcgagaatctttcggcgaaggtcatggacatgccgctgcacctgatgacccagacggtgatcgagcagtccggactgatcagctaccacaaggaagaaaaaggcgagaaaggccaggcccgggtggagaacctcgaggaactggtcagcgccgcccgcgccttcgagaacagcgaggaagaggaagacctcaccccgctgcaggccttcctcagccacgcctccctggaggccggggaaacccaggccgacgcccacgaggacagtgtccagctgatgaccctgcacagcgccaagggcctggagttcccgctggtgttcctggtcggcatggaggaagggctgttcccgcacaagatgagcctggaggaatccggccgcctggaagaggaacgccgcctggcctacgtcggcgtcacccgcgccatgcagcgactggtcctgacctacgcggagacccgccggctctacggtag

SEQ ID NO: 2360 - DNA, 237 bp, Pseudomonas aeruginosa
ctacccaccacaagtgggaaggatcgacacatcatggaacgtaccctcggttccaacactttcgacatcgctcgctccaaccgccgcagcagcagcctgctgggcaccatgaaactgtggcagcgccgcatccagagccgtcgccagctggcccgcctggactcccgcctgctcgccgacgccggcatcagcgaagcccagcgctacgccgagctgaacaagccgttctggcgctaa

SEQ ID NO: 2361 - DNA, 894 bp, Pseudomonas aeruginosa
gcaatactggcgtgccgctggccatggcttccagcacaggcaggccgaagccttcgtagatcgaggggaagaccagcgcccgagcgcccgacatcaactcggcgacccgctcgtccggcaggtagccgagcagccgcaccgttcccgaagccagcgcctggcgcagttcgtcgtcgagcgagcgactttcccatcccggcatgccgacgatcatcagcggaaaacgctggcggaccgccgccggcagttgcccatgggcgcgcagggccagcgacaggttcttgcgcggttcgagggttcctacgcagaggaaatacccgcgcggcaccaggccatgcgcgcgcaagggctcgcgcagggactcccggtcccgcggacggaaccgcgcggcatggccgaggggcgccaccacgaagcgctcgcgcggcaggccgaaatacgcctgcgcctcgtcggcgatcgcctgcgagtcggtcaggatcaaccgcgccttttccatcccgcgcgccagccggcgttctatttcgcgcaagcgggcggcgggttgcgtcgccggataatgcaggtgggtcaggtcgtgcagggtcatcagcatcggcccgtcgaagtccagcggccagagactgggctcatggtagagatcgaccggcggccgaccgctatcgaaacgccgctgctccagccagcgtcgtgcccggtaggctccgggcaggttgcgcagccagggcgacagacgcgaatagccgggcagcgccgccgccggcaggtcgccgctccagccccagccatggaacagggaaaactcgaagtccgcgtgcgcctgcaacgcgcccagcaactcgaccaggtaatgcccgatgccggtccgcggcgcctggagaatccgcgcgttaa

SEQ ID NO: 2362 - DNA, 840 bp, Pseudomonas aeruginosa
aggccagtccggccattgcccgtggaggaacagctgctggtagctgcgcatcagcgcggtcatcggattgagttcgatcagcgagcggataccctcgggcaggatgccgatcggatagacgatcggcgtcagccagaaccagaactgcaggcagatgccgaacaactggccgacgtcgcggaagaacacgttgagcaccccgaggatcatccccagtcccgccgcgaacagcacctggatcgccagcagcggcaccagcgcgagcaatgccgcgcccggcaggcgcccgctgagggcgagaaagccgaggaacaaggcgaggatgatggcgaaattgaccccggcgttgagcagtacgatgaccggcaggcagatgcgcgggaagctgatcttcttcagcaggttggcgttctcgatgaacatgctctggctgcgcgaggtgatttccgcgaacaggccccaggtcagcaggccggcgcagagatagacgctgtaggccaggccgtcgtcgacccccggcaggcgcgcgcgcatcacctgggagaagatcaccgtgtagacgacgatcatcgacagcggattgagcaccgtccacaacgcgccgaacagcgacccgcggtagcgcgactggaactcgcgcttgacgctgccgagaacgaagccacgatagccccacaaggaacgagacaagccaagaagcatcagaccaccctgccgtactggtcctcgaagcggacgatgtcgtcctctcccaggtattcgccgctctgcacctcgatcatcaccaggtcgatgacccccgggttttccaggcgatgccggtggcccgcgggaatgtag

SEQ ID NO: 2363 - DNA, 1791 bp, Pseudomonas aeruginosa
ctgcctcctgttctgtcgatcgaacaggtcgcggtcgcgataacagaacaagaacacgatgggtcgaccagtccgccgggaaggcttccggacaacgaagcagcgcctggcctcgctcatcaccaccaagctgtcgaacgggcagtttcatcacgagatgccatgaatttcatcctttactcggatatcaacgagcgctcgatcggccacaacctcggtcgccccgaatacagctactacttcgtcctcaaggcctaccggccaatcctcgaatcgctgggacaggtccacctggtacagagcacggacgaagtcgacccgctctaccggcaactgcatgaacagggcgaagactgcctgttcctctccttcaccccgccgcacaaggcggcgcggggcctgcaatgcccgatgctgtgcgtggtcgcctgggagttcgagtcgattcccgacgtggcgtgggacggcgatccggcgcaggactggagccaggtcctggccggccatggcgcagccatcaccctctccgagcagactgcccgcgcggttcgccgggtgctgggcgaagattttccggtactggcgctgccgacgccgatctgggaggacttcgccgcgatccgccagcaaggcgaacggaatccggtcaagtccggcgagaccctgcaactcaagggctgcgtcatcgacagccgcctgctgggcctttccgccgacggcctcatcgcaccgatcagggaagagaccgaggacgagatcctcgaggtcctccccgagacgcccgccgagcccgagcccgaaccggtccctgagccagaaccagagccagagccggttcctctcgactggaggcgccgactggtcatcagcaagcactacctgctgctgtggtaccgggaagccgtcagcgacctggtacccataccggtacgccgctggctgttccgtcacctgcgccggccgctgccgcccccgccaacggcgctggaaacgctgccggagccattgccccaggccatcgagccgatgccgcccgccgagcccgagcatccgccggcgctgttgccggccgtcgaccagcaccagcaggtcgtcgtggacggggtggtctacgtctcggtgttcaatccgctggacgggcgcaagaactggcatcagctgatcaccgccttctgctgggcattccgcgacaccagcgatgccacgctggtgctgaagatgacccagagcgacctgacgacctaccacgtcgaactgctcaccctgctttcccaactgtcgccattcgcctgccgggtcatcgccctgcacggctatctcgatgccgcggagtacgcccgcttgtacggagccgccagctactacgtgaacgcctcgcgctgcgagggcctgtgcctgccgctgatggaattcatgtcctgcggcaccccggcgatcgctccggaccattcggcgatggccgactacatggacgcccaggtgggcttcgtggtccgctccagccaggagcccgcggcctggccgcaggattcgcgccggttgtacagcacccggcgctaccggccgagctgggagtccctgaaggaggcctacctggagagctaccgggtagcccgggaacagccggagcgctatcggcaactgtccgccgcggccaaccaacgcatgcgcggctactgcgccggcgacgtggtccgccagcgcctggaacccttcctttccgcccgcaaggcaacccctgcgcccggcgtcgaactggcggccaccgccacaggcaacgttccatgctga

SEQ ID NO: 2364 - DNA, 1296 bp, Pseudomonas aeruginosa
tcatcatccactccgaggaccaacaagaccaccatccggcagaacctcgggcgcccggagtacagctattacttcgtcctcaaggaattccgtccgctgctggaagagatcggccaggtggtcgaagtcagcgatcccgacgaactggtggaccgcctctaccacgactgccgcaagcgcggcgaaccctgcgtcttcctctccttctcgccgccccatcgcacgccgatccaccatgcctgcccgaccatcccggtgttcgcctgggagttcagcaccctgcccagcgaaacctggcacggcgaaccgcgccacgactggcgacatgtgctgcgccacagcggacgggccatcacccactccagcttcacggtcgacgtggtgcgcgccgccatgggtcgcgactacccggtactgagcgtgccggcgccggtctgggatcgcttcgccaaccgcgcctcgcagcaggcaggccgtcccgaagcccgggatgtgcgcctgcgcctggacggcctgctggtggacagccgccagctggacctggccgtccatgccgaccccgagccgtcggcggaggtcctggccctgccggaccgcgcggcgaaacaggtcgagctgagcctcgacggggtcatctacacctcggtgttcaacccctacgacgggcgcaagaactggcaggacatgatcagcgcgttctgcgccaccttccgcgacgagcccgacgccaccctggtgctgaaactgacccaccacaacgtcggcgaagcgctggccgacatgcttcaccacctgtacaagaaccagtcctaccgctgccgcatcgtgctgatccacggctacctcgccgacccggactacgagcggctggtcgaggccaccagctacgtggtgaacacctcctacggcgaaggccaatgcctgccgctgatggaattcatgtccagcggcaagccggccgtggctccgcgcaataccgcgatgatcgactacatcgacgccgacaacgccttcatcgtcgactcctcggaagaagccaccgcctggccccacgacccgcgcgcggcctaccgcacgctgcgctacatcaccgactgggagtcgctgtgccgggcctaccgggccagtttcgaggtcgctcgccaggagccggagcgctacgcacgcatgtccgcgcatgccagcgccagcctcgaacgcttctgcagccgcaagctggccgtggagcgcctgcgtcgcttcctcgacgaagcggcacaaggcgaccccgccgccttgcaaagcatcccggcatga

SEQ ID NO: 2365 - DNA, 2013 bp, Pseudomonas aeruginosa
tcatcgcgcgcaagccgctcgaccccggatcgtcgcggacatgagcggcaaacgcatcctcgacatcgaactgttgcgcgggctggccgtgctcggcgtggtattccaccatctgcacggcaacctgttcagcggctccccggcactgctggacggcatcaaccagcgcgtccagttctggtggggcgtggacctgttcttcgccatctccggcttcgtcatcgcccgcaccctcatcccgcaactgcgcgaggcgcccacacgccaggcattctgggaacaggcgcggtacttctggatccgccgcgccttccgcctgctgccctcggcctggctgtggctggcgctgatcctggcctgttgcctgctgctgaaccgctccggagccttcggcagcctgtcggccaacctcgcggcgagcctcgccggtttcctccaggtcgccaacttccgcttcgccgacagtttctaccgctacgaatacggtgccagcttcgtctactggagcctttccctggaggaacagttctacctcctgctgccgctgctgatcctctgcctgcgtcgctacctgggctgggccctcctggcgctggtgctggtccagttcttcagcctgcgcacgccgctgctgatggtattgcgcaccgacgccctggccatcggcgtactactcgccctcgcctccctgcagcctggctatgcccgctggaaccccaccctgctgggccgcgcctggagcgggccgttgctgctggccgccgtggccgcggccctgggcgtgctggccagcgaagcgtacagcctggtcgccgtgcggatcggcgccatcgcgctattgtgcggactgctggtgtggatagcctcctacgaccgcgactacctgctctccaacgggccgctgaagcgcttgctggtctgggtcggcgcgcgctcctatgcgatctacctgatccacatcccggcgttctatctcagtcgcgaactctgcttccgcctgggctgggacgccggcgagcggcccctgtcgctgctcgccatcagcctggtcctgatcgtcgtactcagcgagctcaactaccgcttcgtcgagagcccctgccgcgacctgggctcccgcctggtcaagcgcctgagcgccgcccgccgcgtcgccaccacttccggagccacctcatgctgaacttcctcaagaagatcgtctcgccgcccagccccgccaccgagcccgtcgccgcgccacccgcacccgcgccggtcgacccgtacatgctcgggttgcgcgacgcggtgctcagcggctggttcaaccaggagaccgacgagctgttcagcggctttccgatttccgccgaggacaccgtgctcgacgtggggtgcggcgacggcggcaacgttcatttctgcgccatgcgcggcgctcgcatcatcatcgccgacatcgacgcggaaaagatcgccaggacccgcgagcgcctggccgataccccggcccgcgaactggaatgcctggtcagcgactgcgacccgttgcccctggctgacgccacggccacccgggtggtctccaccgaggtcatcgagcacgtcgacgatccgcggcagttcctcgccgagctggtgcgggtcggccagcccggcgcactctatctgctcagcgtgccgcatcccacgtcggaagacctgcagaaagacttcgccgccgacgaatacttccgcaaacccaaccacatccgcgtgctcggcgaggagcagttcgccgcactggtgcgcgaagccgggctggaaatcctcagccacagccgctacggcttctactggtcgctgtggatgctgctgttctgggaggccaaggtcgatttcggcaatcccgaccatcccctcctcgaacactgggccaggacctggcaggcgctgctcgactcgccgcgcggcccggccatcaagcaggccctggacgccgtggtcgccaagagccaggtgatcatcgcgcgcaagcccgcccaggcgtag

SEQ ID NO: 2366 - DNA, 426 bp, Pseudomonas aeruginosa
ccatctgagtcgcccgccccgccgccgcagccgcccggctgcggcgatgacctggccgaccggccacactggctccgcgccgcacattccgttagccttggcggctgttccagtcctattccgcccaaccccatgcgttaccggttctcgttgctcttctgttgcctgctggcgcccgctgcgcacgccttcgataccacaacggcgttcaccgcgaagtccctttacgtcaccagcaagctgaccagcacgccgttcgagaacaaattgttacgcgatgcccggggcgatgcggccagcttcgtcgccagcgatggcagcatccgtggtgcgcgcctggaagcggcgctgcgctggttgcgtgtcgcgcaccccgagctggcggccagcgatcaggaactggccgaagcaattcttgcccaatag

SEQ ID NO: 2367 - DNA, 2265 bp, Pseudomonas aeruginosa
ccccctgttcgccgccctgctgctggcgctctgcgccacggccgcggaagcacgctcggtggtcgcgaccagcaatatcatcgtccgcgccctcgaccgcagcatcgacttcacttccgacaccaccacttccgtgcgcgacatgaaagtggtcaccgaggcgcgcgacgacgccgccagtttcgtcgccagcgacggcgccattcgcggcgcccagctggaagccgcgatgcggaccctgcgcagccgtctgccggaagcccgggaagcctccgaccaggtacttgccgaagccattctcgccctgtgaggaaggcctgcgcctggctgctggcgctggccctctgcggagccggcaacgcgacggcggccctgcgcctgaaactcgacgcgcctgaactggaccctgcgcagcgcgaggccagccagcaactcttggacgaagccgcggacaagttgccgccggccttccgcgaacgcctggaccgcgagatcgaggtcgagtggcgcgacgacctgcccgccaacggcatgggccaggcccgtggcccgcagcgcatcgcgctgaaccgcaagtacctggccgatctcaccgacggcagcgccgccagccgccagaccgggcgcgtgcacggcaccgagcggcgcgagctgctggcgaccctgctgcacgagctgacccacgtctacgatcgcgcgcgcctgtggtcggcggaggaaaaacgcgagatccgccgctgcacgcgccaggaagaaaccctcggccggatcgcccagcccaccgattgccgcgggcagagcggtcgccgcttcacgctctccgacgacccgcgcctgctcgatctcgccggctggccgcagcgcgccggccagcgcgggcggcgcgaggcgcacaatggcttcgtactgcgcagcccggacgtctacgagctgagcaatccgcgcgagttcgtcgcggtgaacatggagtacttcctcctcgatcccagctacgcctgccgccgcccggcgctctaccgctactaccagcaacgcttcggctgggcgccggaacacagtgcctgtgcgcagagcttcgcctacctcaacgccggccgcgacttcggccagcagccgctgggccagctcgaccccgagcgggtctacgaggtcgactacctgctggccgaggccaacgacaacctggtcagccgctggggccacaccatgctccgcctggtgatctgcgcccccggccggccgcgtggtccggactgccggctggacctcgaccagcatctggtgctgtcctaccgcgccttcgtcggcgacctgcaattgtccagctgggacggcctgaccggcgcctatccgtcgcgcctgttcgtcctgccgctgtcgcaggtgatcgaggaatacaccaaggtcgagctgcgcagcctcgcctcggtgccgctgaagctggaccgcgaggaggtcgccagcctggtcgagcgcgccgcgcagagtcactggagctacgacggccagtactacttcatctccaacaattgcgcggtggaaaccctcaagctgctgcgcagcggcatcccccggcgaccgctgcaaagcctggacagcatcaccccctacggcgtgctcgagatgctggagaaccgcaagctggccgatcccagtgtgctcgacgaccccaaggaagccctgcgcctgggctaccgcttcgactccttccgcgaccgctaccaggcgatgttcgacgtgctcaagcagcgcctgcacattccccaggacaaggtcgaggactggctggcgctgccggccagggagcgccagccctggttcgccaaggccgacctgcgcgccagcgcggcgctgctgctgctcgagcaggcctcgctgcggcgccagctgctgctcgcccaggacgagttgaagcgcctgtacctcggccatctggacaagccggccggcgaccagcgcctggaagtggccggcaagaccttccagcagatcctcgacgacagcggcttcctcagtcgtccggcggaactcctggagggcggctacggcctgccgcaggccgccgagtggaagcacctggaagagcagacccgcgaacgccaggcgcgcctgcgccggctcagcgacgacctcgaccgcgaggtccgcgccctgctcgatcccgagcgccgcgccgagctggaagccaacgaggccaacatcaaggaggtcggcgcgcacctgcgcgagctgcacaaggcggccggcgggctgatgctgccctga

SEQ ID NO: 2368 - DNA, 1047 bp, Pseudomonas aeruginosa
ccgcaatggcaaccgccggtatgggtctcgggcatggcgaatcctcctcgcgggagtgccagcataagccggacttgccctgtgccgcagccacctcgcaagatgagcggattccactatccgggggtgcccgtgaccgctctgctctactccctctggccgctgttcgccctcatcgtcggcggttacgccctgcgccgctgggactttcccggcgaagccttctggcctgccgcagaacgcctgaactacttcatcctgtttcccgcgctgctgttcagcaacctggcgaccgcgccgctggacgaccccggcctggcccgccaggccctggccgtactgctcgggctcggcgtcgcctggctcgccctgctgctctgcaagcgctggcgcggctgggacgccgggcgcttcggcgccatcgcccagggcgtattgcgcttcaacacctatctcggcctggccgcggtcggcagcctgtacggcaagccgggcctgaccctggccgcgctgatgctggcgctgatggtgccgacggtgaacgtgatgtcggtctgggcgctgaccgccgagcgcggcatcagcctgcgcgcgctgctgctgccgatcctgaagaacccgctgatcctcgcctgcctcgccggcgcactggtcaacctggccggcgtcggcctgcccggcggcagcgatcgcctgctcaacctgctggcggtggccagcctgccgctgggcctgctgtgcgtcggcgcggcgctgaaaccccaggaactcggcggcgaagtcgcggcccttggctggaactgcgcggcgcggctgctggcgatgccccttctggccttcgccatcgctcgcgggctgggcctgccgagcatggaaagcgccgtgctggtactgttcttcgccctgccgacggcgcccaccgcctatgtgctgacccgccaactgggcggcgacggccacctgatggcgggcatcattaccttgcaaacgctgctttccggcgccactctggtcggcgtactcctcgtgctgcaaggaagcccatga

SEQ ID NO: 2369 - DNA, 420 bp, Pseudomonas aeruginosa
cgacaggacgcgtcgccgccgccctcacggcgctctgcctgctctgccaaccggccttcggtttcatcaaggtgtttcccgaattcgacgacgaacccggcgccgccaccttcttctgggcggccgtcaccaccgtcggcccgttcatcggcagcaccgtcagcgcacaggagtccagcgctgacgagggcgacaagctcgtccaggcgcgggacgacgccgccagcttcgtcgccagcgacggtgcgatccgtggcgcgtacctccaggcagccttgcaggtcctgcgccaggccccggaatacgccgggtacagcgacctgcaactggccgcggcgctcctcgcgcggcagccctgatcgaccacatatccgaaattacccgcacgtttcccgccgttatccagcgaaagctgcctga

SEQ ID NO: 2370 - DNA, 1059 bp, Pseudomonas aeruginosa
accgaaggggtcggcgggcggcttcatcggcaccatcatccagatcgcgatcatcgacatcgtcttttccctggactcggtgatcaccgccgtcggcatggtctcccacgtgccggtgatggtcgcggcgatcatcgtcgcggtactggtgatgatgctctgcgccggcgccatcagcgacttcatcgacaagcacccgtcgctgaagatgctcgccctgtcgttcctcatcgtggtcggcacggtgctgatcgccgaagccttcgaagtccatgtgccgaagggctacgtctacttcgccatgggcttctccctggccgtggaggcgctgaacatccgcatgcgcggcgctgccgcgcgcaagcggggcgaagagccagtgaagctgcgcaaggaagtgctcggcgactgagccgctcaggccggctcgaaacgctcgccgcggaatacccggcgagccgcgccgcgactgatccgaccgtgggcccggcggcgctccgcgcgcagcgcgtcggccgcgctgctcgcctggtccgcgaggcgccgggcgatcagcaggatcgccaggcgtttgttggcgtgctggctacgctggctctgcaccctgacgctgatgccgctggccaggtgggcggcgcgcaccgccgagtcggtggtgttgacatgctggccgccggggccggaagagcgcagggtctcgaaacggatctcgccctccagactggccggcggcgcggcgaagcgctccgcgccgatgaaccagttcttgcgcgcatgccttgcccggtaggggctggggcagatccactggataccgccgcaccagcgctcggcgagcgcttcggcggcagtgccgcgcagccccagaagcagcgaacgccaggtgcgcggacgctcgccggccacctcctcgattacctcgacctcgacgccggcttgcgccgcctcgaggcacagccgctcgaacgccttcgccaccgccaggcagcattccgccggcccctgggccgcggagagttgcagcaggatcatcggcagcactccccacgggtcttgtag

SEQ ID NO: 2371 - DNA, 480 bp, Pseudomonas aeruginosa
tgcagatcatccgcggcggcgatccgctgctcggcaaggacatccgcaagctcgacgacgacgtcgacgccctctacaccgcgatcaagctgtatctggcaaggatgccgcgcgaggacctgtccgaacgcgacagccggcgctgggcggagatcatcgagctggcgatcaacctggagcaggccggcgacatcatcgagcacatgctcgccgccgtgcaggacaagaagacctcgcgcagccgctcgttctccgacaccggcctggaagagatcggcaccctgtaccagcagttggtctccaacctgcgcctgggtctctcggtgttcctcaacggcgacctcgacagcgccaagcgcctgcgccgggccaagcagcgcttccgtctgcaggaacggcgctacgcccatgcccatgtcgaccgcctgcaccagcaggtggtacagagcatcgagaccagctcgctgcacctggacctga

SEQ ID NO: 2372 - DNA, 438 bp, Pseudomonas aeruginosa
aaagcagctgccgcacctgctcgagcaccttttcttcagcggcctggacggcggcgacgaggccgacctggaagcccgcatgcaggccctcggcggacaatggaacgcctacaccagcgaaggcgacaccaccttcgtcatcgaggcacctgccgccacccagcggcaggtcctagacctgctgctggacaccatcacccgcaccgaactggacgagccgcgcatcgccgccgccaagcgagtgatcgagcgcgaaggcggcggccattactcgcacctgcagcgctggctcgaccgcgagaacctgggccgtggcgccatggaccaactggcggggaaattggccttggcctgttcccagcgggcgccgctggcccaggcttggcgcggagcagctggagcggctgcgcagcgactgttacgtaccgggcaacatga

SEQ ID NO: 2373 - DNA, 675 bp, Pseudomonas aeruginosa
gaccacgagctacccgagcgccgcgagctgccggcggccaacgggcatgccgaggccaggcgcaccctgatcacccggccattcggcgagggtgcgatgctgcactggatctatccggagccggacgacgccgacccggacgccatggtcctgctccaggcctatatgaacgacgcgctgtacgccgacctgcgtgtgcgtcgcggactcacctacgggccatcgaccgatcgccaggtgttcgccaaccagggcttcttcagcctcgacgcggatgtcgagcgcagcgacctacccgccaccgaggccgccctgcgcgagttgctcggcggcatccgccagcatggcctggacccgggtcgtttcaagcgggtgcaattcgccgagcgcgccaggctggcctggagcacccagggcaacgcggcgctggcggactattactggggctcgctggccgactacgaggacggccatttccccaatgaggagcgccgcctggcgaaggtcagcctgcaacaggcgaacgcgctggcgaagcggctgttcgacggcgaaggctacctgcgcatcgaaaagccgctattcgacgacgacatgctctacccattgctgctcgccgccggtctcctggccagcggcctgctctggttcggcctgcgccgccggcgcgcctga

SEQ ID NO: 2374 - DNA, 519 bp, Pseudomonas aeruginosa
tcgacatcaacgccgccgccgcagccccggcgggagccgacgcacggcatgcggcgaaacgcctcaggcgttggccagctcggcctcggcgatctccttgccgcgccggcggaacagcaccagggtggcgagcagccccagcagcgccgcgccactgagccagatgcccggggccgcgcggttgtccagggtgtggatcagccaggtgcagaccgccggggtgaaaccaccgaaggtcgccgtagccaggctgtaggcgagggagaaaccggtagtgcgcacgtccgccggcatcacctcggtcaacgccaccaccatcgcgccgttgtagctgctgtagaggaacgacagccacaactcgacgccgagcaggccggcgaaactcggctcgcggaccagccaggacagcgccgggtaggcggtcagcagtgccagcgcggaggcacccagcaacaatggcttgcgcccgatgcggtcggagaacgcgcccatcaccggcagccagatgaagttggatag

SEQ ID NO: 2375 - DNA, 993 bp, Pseudomonas aeruginosa
gccgatgcacatggtcaccagcaggctgtcgaggtccgacagttgcagttcgttcttgccgaaggtcggcgtgtaggcggtgatcaggtagaacgatacggtggtcatcaccaccatcgcggtaccggccagcactacgccgaagttctgcccgatggagcgcagcacctgcgacagcgacggtcggtgggtgcgcgcctcgaactccggcgtttcctccagcgagcgacggatgacgaacagcgccggaacgatcaggcagccgatgaagaacggcacgcgccagccccattcgcccatgtcctgcgggctcagccactggttgaggagcacgccgagcaggccggcgaaaaccaccgcgacctgctggctggccgactgccaactgacgaagaagcctttgcgtcctggcgtggcgatctccgacaggtagaccgaaacccctcccagctcgacgccggcggaaaaaccctgcaggagccggccgaacagcaccagcaacggcgccgccacgcccagcgtggcatagccgggaacgaaggcgatcagcagggtgcccatggccatcaggccgagggtgatgatcaggccctggcggcggccgtggcgatcgatgtaggcgcccaggaacaccgcacccagcggccgcatcaggaagccggcgccaaaggtggcgagggacaacatcagggaggcgaacgggttgtcgccggggaagaaggtcttggcgatggcggtggcgtagaagccatacaccatgaagtcgtacatctcgaggaagttgccactgaccacacggaaaatggcgaaacctttggatttattagaggccatgggacacacactcaggcagacacggggaagcggtccatggcggcgtcgatggccacgcaggcgggtacgtcatccatcgaccgagttgtaaccatatgtgtaaaaactcctgtcgaacaatctaaaattgcccgaaaggtgcgaattgaaggggtttga

SEQ ID NO: 2376 - DNA, 1251 bp, Pseudomonas aeruginosa
tcaggccgatcgccggatgccccggcggcacttccggcatcagccggcggaacaacggaccgagcagcaccgccaggcgctccaccagcccggccttctcggcgatgcgcagaaagccgagccagagcgtcagggtgccgaacagcaggaccatcacctcgaccgccagcttggccatggcgaacaggctctccaccatcgccgcgaacaccgtcgcatcgccgccgatcaaccagcgcgccagcgcactcgccgccgccaccaggaaaaaacccaaccacaagccgttcagcattcagaatcccccgcgttgcgcggatgatagcggcgcaggcggtgccggcgccagaaacgccgaggccccggacgatgccggggcctcctgggcgggaagccgccttattcgagggtggcctgcttgcccttggcttcgccgaccgcctgccgcaggtgcggcagcgaatcccagtagcgctggcccttggccgcgtcgtacatgccttcccacttggagatgaccagcaccgcgagggcattgccgatcacgttgagggcggtgcgcgccatgtccatgatgcggtccacgccggcgatgaaggccaggccctcgagcgggatgccgacgctgcccagggtggcgagcagcaccacgaaggatacgcccggcacgccggcgatacccttggaggtcaccatcagggtcagcaccagcatgatctgctggccgatggacaggtcgatgccgtagagctgcgcgatgaagatcgccgcgatgctctggtacagggtcgagccatcgaggttgaaggagtagccggtgggcaccacgaagctgctgatcgccttcggcgcgccgtaggcttccattttctcgatgatgcgcggcagcacggtttccgagctggcggtggaataggcgaggaccaggtcgtccttgaagatgcggatcaggcgcatgatcgagaagccgaacatccgcgcgatcaggcccagcaccaccagggcgaagaagacgatggccacgtagaccaggatcaccagcttggccagcggcagcagcgaggcgaagccgaagttggcgacggtcaccgcgatcagggcgaagacaccgataggggcgtacttcatgatcatgtgggtgaccttgaacatggtctcggaaacgccctggcaacaccttcaccagcggctcgcgcaggtcgttgggcaggctcgacaggccgaggccgaacatcaccgagaagaagatga

SEQ ID NO: 2377 - DNA, 1359 bp, Pseudomonas aeruginosa
aaagcaacgatggaaaccacttccgaaaaacaggggcgcatcctgctggtcgatgacgagtcggcgatcctgcgcactttccgttattgcctcgaagacgaaggctacagcgtggccaccgccagcagcgcgccgcaggcggaggccctgttgcagcgccaggtattcgacctgtgcttcctcgacctgcgcctgggcgaagacaacgggctcgacgttctcgcccagatgcgcgtccaggcgccatggatgcgcgtggtgatcgtcaccgcgcattcggcggtggataccgcggtcgatgccatgcaggccggcgcggtggattacctggtcaagccctgcagcccggaccaactgcgcctggccgccgccaagcaactggaggtgcgccaactgaccgcgcgcctggaggccctggaggacgaagtgcgccgccagggcgacggcctggaatcgcacagcccggccatggccgcggtactggagaccgcgcgccaggtagcggcgaccgacgccaacatcctcatcctcggcgaatccggctccggcaagggcgaactggcacgcgccatccacacctggagcaaacgcgcgaagaagccccaggtcaccatcaactgcccgtcgctgaccgccgaactgatggaaagcgaactgttcgggcacagtcgcggcgccttcaccggtgccaccgaaagcaccctgggcagggtcagccaggctgacggcggcaccctgttcctcgacgagatcggcgacttcccgctgaccttgcaacccaagctgctgcgcttcatccaggacaaggaatacgaacgcgtcggcgatccggtgacccgccgcgccgacgtacgcatccttgccgcgaccaaccgcgacctgggcgcgatggtcgcccagggccagttccgcgaggacctgctctatcgcctcaacgtgatcgtgctcaacctgcctcccctgcgcgaacgcgccgaggatatcctcggcctggccgaacgtttcctcgcccgcttcgtcaaggactacggccgccccgcccgcggcttcagcgaagccgcccgcgaggccatgcggcaatacccctggccgggcaacgtacgcgagctacgcaacgtgatcgaacgcgccagcatcatctgcaaccaggaactggtggatgtcgaccacctcggtttcagcgctgcgcaatctgccagcagcgcgccgcggatcggcgaatcgctgagcctggaagacctggagaaagcccatatcacggcggtgatggcctccagcgcgaccctcgaccaggccgccaagaccctcggtatcgatgcctcgaccctgtaccggaagcgcaagcagtatggcctatga

SEQ ID NO: 2378 - DNA, 1941 bp, Pseudomonas aeruginosa
gcagcgtggtcaggcggcgatgtgcaacacgctgcgcaggttgtccaacagcatatcgacgctgagcatgatcagcagcatgccggccaggcgctcgatggcggtcagcccgcgcgggccgaggaaacgctggaggaacgccgcctgcagcaggatcagcgcagtagcggcccaggccagcaccaccgccaggtaaagctcccacagcggaccgtcgaaggtggtgcgcagggtgatcagcatcgccagcgccgagggcccggccaccgccggggtggccaggggtaccagcagcggctcgccgtcgggcacttcgccgagcagcccttggggcgacgggaagatcaggcgcatggcgatcacgaacaggatgatgccacccgcgatcccggtcgcctcgcgggacaggccgaggccgctgaggatgtgctcgccgagggtgaggaagagcagcagcaggcccagggcgaaagccagctcgcgaaacgccacgcgcaggcggcgcccaggtgcgacgcctttcagcgcggcgaggaacacggcgatgttgccgaaggggtcggtgaccagaaagatcaggacggcgacgccgaacatatccatgggagtttccagagcgggacagccggtcattctaccgggcgggaccattctagcgagccgcggcaacacctgcaggcgagcccgtcccgagtcgtcggaatgtgcgctggtcgcccttcaggccacttccaggcggtcccggccggcgcgcttggctcgatacagcgcctggtcggcacgctcgaaaaccgcttcgccggcctcgttgccttcgaacgcggtgatgccggcggaacaggtgatgctcaggggctcgcccttgaaatggaacggacaggcggcgatcgccgcgcgcagccgttcgagcagttgccggccggcttccagggacgtggccgggagcaggacgacgaactcctcgccgccgaaacgggcgatgaaatcggcctgccgcaaccgtttgcgcaattcgccggcaatgatcttcagcaccttgtccccggccaggtggccgaagtcgtcgttgatccgcttgaagtggtcgatgtccagcaccgccagcagcagatcgccgccgtcccggtgccggcgcgccacttcctgttccaggcgctcgctgagcgccgcgcggttgggcaggccggtcagcggatcggtcagggctttctgtcgctggtcctccaggtggctgtggaacgccttggcatcctgctccatgctgttgacccgctccatcagcgcctgcaggcggccggacacctcctgttcgtgctcggcctgttcgcgctggtgttcgtccatggaggcaagcaggccgttcagccggctgtccaccgccagcttgaggctgttcaggtcggtcgcctgctgcacgctggcctgcaggccactgacctgctcacgcagcgattggtcaaagccgcgcgcgttgtccagcacgtcggtatagccggcgtgggcgtcgcccaggtggccgaggaagctttccaggcgctcgttgagttgccgcaggtattcctcgaagtcgcgctggccactgtccgccagggacagcaccagcaccgccaggtcgtcgagtaccggcaccagctcataccagttcaggctgccatcgatccgctcccgcagcgcctcggcctggggctggtggctgctcggcagggacaggccgtcgagcagccgcagcaggctggcctcgatgtgcggcgccaccgcgctgtagccgggctccggtatcggcggcggcagttcgtaggcctcgtctaccgcctgcccgtcgaggttatccacaggagtggccggagcttcgggcgcgctttcaacgtccgccggcattgcgggcgacggctccgcacccgcttcttccagcgtctcgctaaagctcaggccggccggtag

SEQ ID NO: 2379 - DNA, 900 bp, Pseudomonas aeruginosa
tcgtcctcatcagggggaacgcccgcgttctaccgcgcggaaaatgctctgtccgttcccgcgcgcgctcgaccctgggggataaagcgcacacaaaatccgcggcattatatacttccgataccgaaacggaaacgaaacagccccccgcgacaccgagtcgcacccctgtggataacccatgtcagagaagaaccccatcgtcggcctgtgccagaaggccagctttctcatcagtgccgcccaggtcgaccagtgcccccccgacgaaggcctggaagtcgctttcgccgggcgctccaatgccggcaagtcgagcgcgctgaacaccctcactcacgccaacctggcgcgcacctcgaaaaccccgggacgtacccaactgctcaatttcttcgccctggacgactcgcggcgcctggtggacctgcccggctacggctacgcgaaggtgccgatccccctgaagcagcactggcagcgccacctggaagcctacctgagcagccgcgcaagcctggccggggtgttcctgatgatggacatccgccacccgctcaccgacttcgaccgactgatgctggattgggcccaggccagccagctaccgatccatgtactgatgaccaaggccgacaagctggccttcggcgcggccaagaacgccctgctcaaggtacgccgggaagtccagcaaggctggggcgacgtcgccaccctgcaactgttctccgcgcccaagcgccagggcgtcgacgaggcgcaaatggtcctggcgcaatggctgggcctgctggacgaggaacaagaggcgttcgaggaagcctgaattccaggcaaaaaaaaccccgagcttcgtatggggagggggaagttcggggttcaagtccggaccgctag

SEQ ID NO: 2380 - DNA, 879 bp, Pseudomonas aeruginosa
ggcggggtccaggaatctgccaacactaaacactgcaaaggagcatcgaagggctcaagaagccattcgtgtgttctgactgtcggcaaaacgggaaagttcagcgcaccgcgaaaaacttttccacggcaccctcaccgggcactccggacctgctcgcaaggcccgccacacgggcctcgcaaccgttcatcagtgggcttcgtcccagttcgaaccgacacccgcctcgaccaccagcggtacgtccagggtcgccgctccgctcatcagcgggcggattccctcgcacacctgctcgaccagctcctcgcgcacttccagcaccagttcgtcgtgcacctggaggatcacccgggcatcgaggccgctttcctgcagccagttatccacagcgaccatggcgcgcttcatgatgtccgccgccgtgccctgcatcggcgcgttgatcgcggtgcgctcggcggccttgcgcatggcgccgttcttcgaatggatctccggcaggtacaggcgacggccgaacagggtttcgacgaagccctgctccgcggcctgggcgcgggtccgttccatgtacgccaggacgccggggtagcgggcgaagtaacggtcgatgtaggcctgggcctccttgcgctcgacaccgatctgcttggccaggccgaaggcgctcatgccgtagatcaatccgaagttgatcgccttggcgctgcgtcgctggtcgccgctgacgtcttccagcggcacgccgaagacttccgccgcggtggcgcggtgtacgtccaggtcgtggcggaaggcatccagcaggccatcgtccttggccaggtgggccatgatccgcagctcgatctgcgagtagtccgcggccaatag

SEQ ID NO: 2381 - DNA, 1263 bp, Pseudomonas aeruginosa
ggtatggatgcgtccggtacgcgggttgatctgctcgggcaggcggtcggtgtaggtgctcttgagcttgctcatggagcggtactgcatgatcaccttgggcagctcgaagtcctgctcggccagttcggcgagcactgcctcggcggtggacggctggccggtcgcggtcttgctcagaaccggcaggccgagcttgtcgtagaggatcgcgccgagctgcttgggcgaaccgaggttgaattcctgcccagccaggtcgtatgcctggcgctccagggcgaccatcttctcgcccagttcgcggctctggatgcccagcaggttggcgtcgaccagcgcgccgttgcgctcgatccgcgccagcaccggtaccagcggcatctcgatgtcggtcaggaccctggccagggacgggatcgcctccagcttctgccacagggcctggtgcaggcgcagggtcacgtcggcgtcctccgccgcatagggcccggcctgttcgatggcgatctggtcgaaggtcagttgcttggcgcccttgccggcgatgtcctcgaaacggatggtgctgtggccgaggtacttcagggccaggctgtccatgtcgtggcgagtggcggtggagtccagcacataggactcgagcatggtgtcgtaggctacgccccgcagcgcgatgggggtgctggcattggccaggacattgatgtcgtacttggcatgctggccgaccttgagcttcttcggatcctccagcagcggtttcaacgcacgcagcaccgcgtcacggtccagttgctccggaacgcccatgtagctgtgggccagcggcacgtaggcggcctcgccctccttcacggcgaaggacacccccaccacctgcgcctgctgggcgtcgatgctggtggtctcggtatcgaaggcgatcagctcggcctcctccagcttcttcagccaggcgtcgaatccggcctggtcgagcaccacgtcgtagtcgacctcggcctggataggcgtttccgcctcgccgttctcgccggcctccttggcctcgcgcaggaggtcgtccagccagttcttgaactccagctcgcggtacagggcgatcagcgcttcgcgctgcggctcgccgggatacagcttgtcgatctccacgtccagttcgacgtcggtcttgatggtcgccagttgataggacaggaacgcctgctcgcgattttcctcgagcttcgccggcaagcccttggcgccgcggatcggtag

SEQ ID NO: 2382 - DNA, 753 bp, Pseudomonas aeruginosa
ctcgggcaccttgtccaggctggcgtagagcacctccaggccgccaccgacaccggtcagcaggcccagcgcggttttctcgccgacacccggaacgccggggatgttgtcgaccttgtcgcccatcagggcgaggaaatcgatgatcagctcaggaccgacgccgaatttctctttcacgccatccacgtcgaggcggctaccggtcatggtgttgaccagcgtaatgtgcccgtcgaccagttgcgccatgtccttgtcgccggtggaaatcaccaccgggcggtcagccgcggcgctgctgcgcgccagggtgccgatcacgtcgtcggcctcgaccccctccacgcacagcagcggcaggccaagggcgcggacgctggcatgcagcggctcgacctggacccgcaggtcgtcgggcatcgacggccggttggccttgtactcggcgaacagctcgtcgcggaaggtcgggcccttggcgtcgaagaccaccgcgaacgggctgtccgggtactgcttgcgcaggctcaggagcatgttcagcacgcccttcaccgcaccggtgggcttgccggtcgaggtggtcagcggcggcagggcatggaaggcgcggtacaggtacgaggaaccgtccaccaggacgaggggcgcttggctcatgaggggaatcaaccttttccggagaccagggcgtgtagaatgaaccctggacgattcgataaaggagcaaggttaccatgcgtacgctga

SEQ ID NO: 2383 - DNA, 471 bp, Pseudomonas aeruginosa
ccctggtcgagcgcggcccggtgcaggacctgccgttcttcatcgaactgctcgacgtgctccacgaggacggcctgccggtgccctacgccctgcgcacccgcgacggcgaggccctgcgccgtctcgaaggcaagccggcgctgctgcaaccgcgcctggccggccgccacgagcggcagccgaacgcccaccactgccaggaagtgggcgatctgctcggccaccttcacgccgccacccgcgggcgcatcctcgaacgcccgagcgaccgtggcctgccctggatgctggaacaaggtgccaacctcgccccgcgactaccggaacaggcccgcgccctgctcgccccggccctggcggagatcgccgcgctggatgccgagcgtccagcgctgccgcgcgccaacctgcatgccgacctgttccgcgacaacgtgctgttcgacggcccgcacctggccggcctga

SEQ ID NO: 2384 - DNA, 2388 bp, Pseudomonas aeruginosa
gtggcgccgatcagggtatccgggcgctccagggtctcgtccatctgcaccaccgacgcggcttccgcggcggcggcaagggcctgctcctcggcttcgttgacgaccttgaagcccttgatcttctgcgtgatcttgactgctgacatatcgattcccccggcctcagtacttgccgtaatagccttctttcaaggcgtcgaagaggttggcggcggtatggatctcaccgtcgtactcgacctgctcgttgcccttgaactccaccacgctgccgtcctccagttcgaagcggtagcgggtcttctccaggtcggactccttgaccagcacgccctggaacgcctcgggattgaagcggaaggtggtgcagcccttgagtccctggtgccaggcgtagcggtagatgtccttgaagtcctcgaacgggtagtcggtgggcacgttggcggtcttggagatcgacgaatcgacccacttctgcgccgccgcctggatgtccacgtgctgcgccggggtgacgctgtcggcggtgatgaagtagtccggcaggcgtcgcgccgggtcgtcgctgtccggcagggcctgggcgttgaccagggtccggtaggccagcagctcgtagctgtagacctcgaccttttccttggtcttgcggccttcgcggataaggttgcgcgaataatggtgggcgaagctcggctcgataccgttggaggcattgttggccaggctcaggctgatggtcccggtcggcgcgatggagctgtggtgggtgaagcgcgcgccggtttcagccaacgcctcgatcagttccggagcatgttcggcgacccgctgcatgtagcgggaatacttggcgtgaagcacgctaccgcggatgcggtcgccggccttatagccatcggcggccatttccggacgcttgcgaagcatttccgcagtgacttcgtagtcctgcgccaggatcggcgccgggcccttctccctggccagctccagggccacttcccagcccaccagggccatttcccgcgccacttcctcggtgaatacgcaggcctcgggactgccgtagcgcagcttgagcagggtcagggtcgagcccaggccgaggaagcccatgccatgccggcgcttgccaaggatttcctggcgttgctgttccagcggcaggccgttgatttccaccacgttgtcgagcatccgggtaaacacccgcaccacttcgcggaaacggtcccagtcgaagcgcgcctcgtcgccaaatggctgctcgacgaagcaggtgaggttgaccgagccgagcagacacgagccgtacggcggcagaggctgctcgccgcaggggttggtggcgcggatcgcctcgcaccaccagttgttgttcagttcgttgacccggtcgatgaggatgaagcccggctccgcatagtcgtaggtggagaccatgatcatgtcccacaggtggcaggcgcggacctggccgtagaccttgcaggcgaccagcccgtcggcgcgctgaacgtagtcgtcctggatcggccattcgcgccagaccaccgcgttggggtcgtcgaggtcgatctcgtcgcgctccttcacgtgcaccgggaataccagcggccagtcggcgtcctgttccaccgcctgcatgaactggtcggtgatcagcaggctcaggttgaactggcgcaagcgcccgtcctcgcgcttggcgcggatgaattcgcggacgtccgggtggctgacatcgaaggtgcccatctgcgcgccgcggcggccgcctgcggagctgacggtgaagcacatcttgtcgtagatgtccatgaacgacagcggcccgctggtgtaggcaccggcaccggaaacgtaggcgccgcgcgggcgcagggtgctgaactcatagccgatgccgcagccggccttgagcgtcagcccggcctcgtggactttctcgaggatgttgtccatggagtcctggatggtcccggacaccgtgcagttgatggtcgaggtggccggcttgtgccccagggcgccggcgttggagatgatccggccggccgggatggcaccgttgcgcagggcccagaggaagcgcccgtaccagtgttcgcgggaggccttttcctcgacatcggcaagggcgcgggcgacgcgttgccaggtaccgtcgacgctggcatccaccggcgtaccgtccttgctcttgagccggtacttcttgtcccagatatcctgcgacgcgtcctgcagggcgatggtcccgcgttcggtgcggggactgcgtgcgtctgtcttggccatccgctgattaacctcccgatggttgttggggcgtccgaagccggccaccgtacgcaacatctagttatccgtacctga

SEQ ID NO: 2385 - DNA, 870 bp, Pseudomonas aeruginosa
aagccagaccgtcgaggtggtcggcctctgcggcacctgccgggaccagaaggacgcctgatggacaacgcgctggtgcggctgacccaggtcggcgtgtccttcaacggccaggcggtgctgagcgatgtcgacctggccatcgagcccggccagatcgtcaccctgatcggccccaacggcgccggcaagaccaccctggtacgcagcgtgctcggcctgctcaagccgcacgtcggcgaggtctggcgacggccgcggctgaccatcggctacatgccgcagaaactccacgtcgacgccaccctgccgctcagcgtactgcgcttcctccgcctggtacccggggtcaggcgcgagcaggcgctggcggcgttgcgcgaggtcggcgcggcgcacgtgctggagcgcccgctgcaaagcatttccggtggcgaactgcaacgcgtgctgctggcccgcgctctgctgcgcaagcccgagctactggtgctcgacgagccggtgcagggcgtcgacgtcgccggccaggccgaactctaccgcctcatcggcaaactgcgcgaccgctacggctgcggtgtgctgatggtctcccacgacctgcacctggtgatgagcgccaccgaccaggtggtctgcctgaaccgccatgtctgctgctcagggcaccccgagcaggtcagcggcgacccggccttcgtcgagctgttcggccaggacgctcgcagcctggcgatctaccaccaccatcacgaccacgcccacgacctccacggcgaggtggtcaaggccggtcccggcgccttgcctccaggcacccgcttcactcctgtccacaagcacggccccgactgcaaccatggctga

SEQ ID NO: 2386 - DNA, 1611 bp, Pseudomonas aeruginosa
cttcctgctcaacgccctcctcgccggcctcgccctggccctggtggctggccccctgggctccttcgtggtctggcggcggatggcctatttcggcgataccctgtcccacgccgcactgctcggggtagccctgggtttcctcctcgatgtcagcccgaccctggctgtgaccgtcggctgcgtgctgctcgcagtgctgctggtgaccctgcagcagcgccagccgctggccgccgacaccctgctgggcatcctcgcccacagcaccctgtcgctgggcctggtcaccctgagcttcatgaaggaagtgcgggtcgacctgatggcttacctgttcggcgatctgctggcggtaagcgccagcgacctgctgtggataatcgccggcagcgcgctggtcctggcactgatctgcttcctctggcggccgctgctggcgatcaccgtgcacgaggaactggcgaaggtggaaggcctgccggtcggagcgatccgcctggcgctgatgttgctgatcgccatcgtcatcgccgtggcgatgaagatcgtcggcgtactgctgatcacctcgctgctgatcattcccgccgccgccgcccagcgccatgcccgcagtcccgagcagatggcggtcggcgccagcctgctgggactggtcgcggtgtgcgccggcctggccctgtcctggttcaaggatacccccgccggcccctcgatcgtggtcagcgccgccggcctgttcctgctgagttttgtcctgccccgccgcacggtgtagaatctggcgattttttgaccaaacgagaacccgcaggaatgatgtcgtccttctttcgcctgctgtccgtcctggcggcggcgctgctggtcagcgcctgccagggcaatgcgtcgtcgcaaccgacgccggtggtcgcgccccaggcgcagcccgccgatccctatgccgaactgcagcaaaccctggccgccggcaagctcgaacaggccgagcaacaatggctggccctgcgcagcgcagccgccggcgacgagcgcgtcgaagcgttccgccgccagttggccgaggcctacatgcagcgcggggaaaccgcgctgcgtcaaggagacctcaacaccgccaccagcgccctcggccatgcccgcggactgatgcccaaagcgccggcgctgaccgccgggctggacggtgcgatcaaccgcgccaaggtcgatcccgcccgcgccgagcaggcccgacgcatgcagcaggcggcccagcagcagatgcagcagatcatccagacgccgcccggcggcgagctgaagccgctgcccggcgctccccacctgatcgatccgcaagcggccagcagcgccgtgcccctgccgatgctcgacggcaccggccagggcggcctcggtgcggtgctcgacgcggtggccgcggatgtcgtcgcctaccgttgcagggtgcatatcgaagtgcgccgggacagcgactatccgctggtttccgaccagctcttggcgcgggtgaagaagctctcacccgatttcgacctgcatctcagccatgtcgtacaggccgacaagccaacccgattgatacttaccccccggaattga

SEQ ID NO: 2387 - DNA, 786 bp, Pseudomonas aeruginosa
acgccgctgacgtacatgtggaggtactgcgctgatggacttcttcgaaaccatgagcttcgccaacatcgactggtacgaaatctggctggccagcgtcgacaccttctggatgctcggcggttcgctgctgttcacggtggtcctcggcctgcccctcggcgtcctgctgttccttaccgggccacggcagatgttcgagcagaaggcggtctacaccctgctctcgctagtggtgaacatcctccgttcgttgccgttcatcatcctgctgatcgtgatgatcccgctgaccgtactgatcaccggtacctcgctgggcgtcgccggggccatcccgccgctggtggtgggcgccacgccgttcttcgcgcgcctggtggaaaccgcgctgcgcgaggtcgacaagggcatcatcgaggcaacccaggcgatgggcgccagcacccggcagatcatctggaacgccctgctgccggaagcccggccgggcatcatcgccgccatcaccgtcaccgccatcaccctggtctcgtacaccgcgatggccggagtggtcggcgccggcgggctgggcgacctggcgatccgcttcggctatcagcgcttccagaccgacgtgatggtggtcacggtggtgatgctgctgatcctcgtccagattctgcaaaccgtgggcgacaagctggtggtgcacttctcgcgcaagtaagcttgccggccaagcccaaaaccctgagcgccgcggttatccacagccgccaggaacacctcgaaaggagttga

SEQ ID NO: 2388 - DNA, 1191 bp, Pseudomonas aeruginosa
acatcctcgtcgcgcggccggacaacaaggacagcgacgccatgcagaagctggccaaggccctgcacagcgccgaggtcaagcagttcatccaggagaaatacaaaggcgcggtggtaccggcgttctgagccaagccgcgtaaccgcccctggaaaaagcccggtcttcgaccgggctttttcgtttccgtcccggccgtacgtctgcctgccgtgccacgacagaggtcattcggccgtttgcgggaaatgtagtgaaaaaaacattccgtcacatattgaacaatctgaaaaattcactacacaatcgacccaccttcgaggatgccccatgcaagaactaaaacaacgcctggcctccccgcccgccgaactgacgcccgcggagcgcaaggtggtgcgtgccctgctcgatgactacccgcgcctcggcctcggtccgatgacgcgcctggcccggcacgccggagtcagcgacccgacgatcatgcgcctggtgaaaaagctcggcttcgtcggctacggcgacttccaggaagcgctgctggccgacgtcgacgaccgcctgcgctcgccgcgcaccctgctcgccgaacgccgcgagcggatgggccgcgacgacacctgggcgcgctacctcgaccaggctggccagagcctgcaacagacactcggcctgacccgccccgatgacatccagcgcctcgccgactggctgctcgacagccgcctgcgcgtgcactgccacggcggacgcttcagccgtttcctcgccggctacctggtcacccatctgcgcctgctgcgcccgcagtgccgattgctcgacgacggcgccctgctccccgaccagctctacgacctcggccgccaggacctgctggtcctgttcgactatcgccgctaccagagccaggcccagcacgtggcccaggccgccaaggcacgcggcacacggctggtgctgttcaccgacatctacgcctcgccgctgcgcgaacacgccgacctgatcgtcagttcgccagtggaatccgcctcgcccttcgactcgctggtgccggccatggcccaggtcgaggcactggtagcgaccctggtggcgcgcatgggcgcgccgctcgacgaacgcctggagggcatcgaccagctccgcaacgcgttcagcagtcatattctggaggaatga

SEQ ID NO: 2389 - DNA, 1986 bp, Pseudomonas aeruginosa
cccgatgttcagcctgccccaccactcgccgcgcgacctgccattcggccgccggcagaccgccatcctgttcgtcgacatgcagcgtgcctgggtcgagccggggcgcgacccgcacgtcgatccgcaggcagccggttacttctacgagcgcgtgcagaaccaggtgatccccaaccagcagcgcctgctcagggccatgcgcgcagtggacgagaacgtcctgcacaccgtcatcgagagcctcaccgccgatggtcgcgaccgctcgctggatcacaagctgtcggagatgcacctgcccaagggcagcccggacgccagggtgatcgacgccctggagccgaccgccaacgagatcgtgctgccgaagacttcttccggcgttttcaactccaccgccatcgactacgtactgcgcaacctcggcacccgccacctgatcgtctgcggggtggtcaccgaccagtgcgtggacatggccgtgcgcgatgccgccgaccgcggttacctggtcaccctggtcgaggatgcctgcgccacccataccccggaacgccaccaggcctgcctggaagcgatcaagggctactgctggatcagcgacaccgagaccgtcctgcaacgcatcgccgccctcggccggagcaacctgtgaaccgcctgcagccggtacgcctggtcagcttcgtcaccaccgacctggccggcatcacccgcgggcgttcgctgcccctggcgaccctggaggagcaattggccagcggttgcggctgggtaccggcgaacagctcgctgaccccgcaggacctgatcgacgagagcagcccctggggcagccacggcgacctgcgcttgctgcccgacccgaacagccgggtgcgcgtcgagcagggtcccgacgccgctgcgccggcgctcgactacctgcacggcaacctggtggaaaccgacggcacgccgtggccggcctgcccgcgcagcctgctgcgggccgaggtggaacgctatcgcgacagcggcctgcaggtcatcgcggcgttcgaacacgaattcagcctgctcggcctgcccggcgagcgtccggccgcggcgttttcgctgcaggcccagcgtgccgccgggcagttccccggctggctggtcagcgccctggcccaggctggcaccgagccggagatgttcctccccgaatacggccagcgccagtacgaggtcacctgccgcccggcgcagggcgtggccgccgccgaccgcgcggtgaacgtccgcgaggtcactcgcgaagtggcgcggcagatgggcctgcgtacctgcttcgcaccgctgccggcacccggcgcggtgaccaacggggtgcacctgcacctgagcctgcaacatgccgacggcagcccgctgctgtacgagcccggtcgacccaacgatctctccgaactcggcgagcactgggccgccggcgtgctcgcgcacctgccagcgctgtgcgcgctgaccgcgcctaccgccgcctcctacctgcgcctgaaaccccaccactggagcgccgcctacgcctgcctgggactgcgcaaccgcgaagcggcgctgcgcatctgcccggtggtgagcgtcggcggcaagccgctgggcaagcagtacaacctggaattccggccgatggacgccaccgcctgtccgcacctggcgatggccgcggtgctgatcgccggccgcctgggcatcgaacgacgcctgccgctgcgcgccctggccgatatcgatccgcacggcctcagcgacgaagagcgccaggcccgcggcatccaggccctgccggcgaccctcggcgatgcgctcgactgcctgcagcgcgacgagacgctctgcgccgagctgccaaagccgctgctggacacttacctcgccatgaagcgccacgaactggcactgacggcgggcctttccgacgacgacctgtgccgccactatgccgagctttactga

SEQ ID NO: 2390 - DNA, 1443 bp, Pseudomonas aeruginosa
ccggcgccgccggtcgccaacaacgagaaagaggcccgcttcgcgtgcggcgccgataacgacaatacgctgccttttcccgaggagcccgtcatggccatcgaacagttcggataccggcaacagctgcgccgcagcctgtccctgagcgacctgatcatctacgggatgatcttcatgatccccatcgccccgttcggggtctacggctgggtccatgccgacgcccacggcatggtgccgatggcctacctggtgggcatgctggcgatgctcttcaccgccctcagctacggagccatggccaaggcctttccgattgccggctcggtgtattcctacgcccagcgcggcatccacccccatgtcggcttcatcgccggctgggtgctgctgctcgactacctgctgatcccgccgctgctctacgtgttcagcgcgctggcgctgaaccacttgttcccggcgatccccaagctggcctggatgctgctgttcctggtctcggcgaccctggtcaacctgcgcggcatcaccttcgccgcccgcgccaacctgttgttcctgatcggagagctggtggtgctggcgatcttcctggtggtcggctaccaggcgctggaaggcggcctgggcaacggccggctgaccctcgaaccgctgtatcgcccggaagccttcgatctcggcctggtgatgaaggccgcctcgatcgccgtactgtcgttcctcggcttcgacgccatctccaccctcgccgaggaggtcaagggcgatcccgcccggcagatcggccgcgccgcgctgatcgcgctgttcatcatgggcggcatcttcatcgcgcagacctggctggccaccgacctcgccgccgggatgaacttcaagtcggcggacaccgccttctacgagatcgccgaagcggccggtggccagtggctgtcgatgctgaccgcggtagccaccgcgctggcctggggtgtcaccgtgtcgatcacctcgcaggcagcggtctcgcgcctgctctactcgatggcccgggacggcaggctgccgcgcgcgctggccagggtccatccgcgctaccagacgccgcacgtcagcctgtacctggtggcggtgctgtcgctgggaatcggctgggccttcctcgacgcaccggacgtgctcacctcactggtgaacttcggtgccctcaccggcttctgcctgctgcacctgagcgtgatcaaccactactaccgccgccagcgctccggccagtggttgcggcatctactgttcccgctggtgggcctggcgatcatcgcctacgtgctgtacagcatgagcctcgacgcacagttgctcggactggcctggatcgcggtggggctggtctacctggcgttgctgcaacgcggcgggcgccaggcaccaacggagttggcgaaggatctctga

SEQ ID NO: 2391 - DNA, 1473 bp, Pseudomonas aeruginosa
cgcctcgcgagggctggttcaggccggctcttcgccgacgaaatcgctgcggctgaggccatgccgcagcatcttttcgttgagtgtccggcgcggcagttgcagcaactccatcaccgccttgatatccccgcggcactggccgagcgcctggcgcaggcactccgcctcgaaggcttccatgcgttccgccagccccgaggtgaggccgccgccttcctcggcgtccccacgctccaggccgaggacatgacgctcggcggcgttggccagctcgcgtacattgcccggccagccgtgggccatcagccgcgccagttccgccggcgcggcgggctgcggctcgcggccgaggcgctggctggcaacgctggcgaaatgttcgaagagcagcgggatgtcctcgcgacgctcgcggatcggcggcaggcgcagctcggcgacgttcaggcgatacaccaggtcctcgcggaagcgtccggcacgtgcttcggccagcaggtcgggcttggtcgcggcaatcacccgcaggtcgacgtggatactctggttcgagccgagccgctccagttgctgctcctgcaggacgcgcagcagcttgacctgctgcgccaacggcatgctttcgatctcgtcgaggaacagggtgccgccatgggcatgctcgagcttgccgatgcgcttgccctgcgcgccggtgaacgcaccgctctcatgaccgaacagctcgctctcgaacagttgctcgggaatcgccgcgcagttcagcgccacgaacggcttgtcggcgcgcggcccgaagtcgtgcaggcagcgggcaaccagttccttgccgctgccggtctcgccacggatcaggacgttcaccggggtcggcgccagggccagaacctgccggcgcaacgcttccatcggcttggacacgccgagcagacgcgcatcgacctggtccttgagactggcctgctccttcaggcgccggttctccagcaccaggcggcgcttttccagcgcgcgccgcaaactgccgagcaggcgctcgggcgtgaagggtttctcgatgaagtcgtaggcaccctggcgcatggcctccaccgccatcggcacgtcgccgtgcccggtgaccatgatcaccggcaggtcgcgatcgaccgcctgcaggttggcgagcagttgcaggccgtccatgccgggcatgcgcacatcgctgatgaccaccccggcgaaggacttgtccaacgctcccaggcattcctcggcgcgcaggcacaggcgcacctcgaagccggacagctccagccattgctgcaccgcttcgcggatcgtcgcttcgtcgtcgacgaagatcacctggtcgctcatgtcgttacgctcgtgtcatcgggggccgccggcaggatcaggctgaacaccgctcccgcctcggcattggcgacctgcaggcggccgccgagttcgtggacgatcccatag

SEQ ID NO: 2392 - DNA, 1119 bp, Pseudomonas aeruginosa
agtgccggccaagccgcgaagcggagatcttcagctccttccccaggcggctgtggccgtcgctgggcaagatcatcacgccgacccgcgtgctctacggtgaccgcacctaccctttcgtcgccaagtcggtggcgcgctggtgctcgctcaacccccaggtcagcgcccacgtggtggtcggcggccactgcttcatgcaggaagacccggccgatgccgccgaacgcgtacgcgactttctcctgcccaatccatgaacgctccttccgtggggaatccggcgctcattcatcggtcccagggaggatgaccccacaggaccgagccatgcgccccctcctcttcagtgcccttctcctgctttccgggcatacccaggccagcgaatggaacgacagccaggccgtggacaagctattcggcgcggccggggtgaaaggcaccttcgtcctctacgatgtgcagcggcagcgctatgtcggccatgaccgggagcgcgcggaaacccgcttcgttcccgcttccacctacaaggtggcgaacagcctgatcggcttatccacaggggcggttagatccgccgacgaggttcttccctatggcggcaagccccagcgcttcaaggcctgggagcacgacatgagcctgcgcgaggcgatcaaggcatcgaacgtaccggtctaccaggaactggcgcggcgcatcggcctggagcggatgcgcgccaatgtctcgcgcctgggttacggcaacgcggaaatcggccaggttgtggataacttctggttggtgggaccgctgaagatcagcgcgatggaacagacccactttctgctccgactggcgcagggagaattgccattccccgccccggtgcagtccaccgtgcgcgccatgaccctgctggaaagcggcccgggctgggagctgcacggcaagaccggctggtgcttcgactgcacgccggaactcggctggtgggtgggctgggtgaagcgcaacgagcggctctacggcttcgccctgaacatcgacatgcccggcggcgaggccgacatcggcaagcgcgtcgaactgggcaaggccagtctcaaggctctcgggatactgccctga

SEQ ID NO: 2393 - DNA, 1518 bp, Pseudomonas aeruginosa
cccgttgacgttgctggagttttaccaggcacgccggtttcttatcaagaaatgtcaggaatggacgccagcagaggcaaacctctgcgttttcttatgaaaagctgcgaaaattcgcgaaacggcagcaggtccgaagcgggctcgaccggacaccggcagccttcctcatccgtcttcgcgaatcgcctggtagcgggcctccagctccgcgcgcagctggcggcgttgttgggcctgggcgaagcggcgcttctgctcggcggtttccagctccagcgggcggacggccaccggcttgcgctcgtcatccagggcgaccatggtgaagaaacagctgttggtatgacgcacggactgctcgcggatgttctcggtgatgaccttgacgccgatttccatggaagtccgcccggtgtagttgaccgaagcgaggaaggtcaccagttcgccgacatgcaccggctcgcggaagatcacctgatccaccgacagggtcaccacgtagcgaccggcatagcgactggcgcatgcataggcgacttcgtcgagatacttcaggagggtgccgccatggacattgccggagaaattggccatgtccggagtcatcagcacggtcatcgacagttggttgtttccgggttgcatagcgctttttctctcatcaggacgggcgggggacaccatagacgcaaacgaagacggcagcggccacaaattttcaatcgtcatgatcgaaatcgcgccgggtcgtgcagacatccgcgggcttttctagactggcccttttccaccgggaatcgctccaatgcctgccgccatacgcatccttctcctggccctggccgtgcttgccggcatcggtgccgctgccatccaggccgaggatacgccctgcgccaccgccgcggaatgcaacacgcgcggcacccaggcttatcgacaggggagttatccacaggcgctggacgccttcgcctggcaattgcgcctggccgagcgccaggagcagggcggagccgactcggaacaggcgctgaacaatctcgcgctgaccagcctcaaggccgggcaaccgggacgcgcccgcgcctggatgaacctggcgctggatcgcggctacagcggcaaagccacgcgctacaacctggaacaggttgccctgaaagtcgactatccgtccctccagggcctcgccgggcactacctgcgctacgccgggcaggccgaatgggaaagcctgcagatcgaaccggtgaagggcggctaccaggcgagcttcgccctgatgcgcatcggcaatccggagaaactgatggaatatgggcccgcggcggtcggcgagctgtccggtcggctggaggggcaaggcgcgctctaccggctgcgcagcgaaggcctgggcgccggctgcagcctgctggtatggcaggaaggcatcgacctgcgagtggtggagagccttggcgggaactgccagggttacggcggcatgggcatcgccgccgccggtaa

SEQ ID NO: 2394 - DNA, 816 bp, Pseudomonas aeruginosa
tctgttttccatgtcaattttgtgatcacaaaaatgaatgacttttcgaagtggacaggtcaggtcgcgctcatcagcggcgccggcagcgaactcggcatcggtttcgccattgcccggcggctggcccgcgaaggcgtgcgcctgctgatcaccgccagcagcgagcggattaggcaacgagcggaggaactgagcgcatgtggtcacgacgtgcgcgccgcgagcgccgacctgaccgacgaagcccaggtgcagggcctgctggactgggccgaagcccagtggggacgggtcgacatcctggtgaacaatgccggcatggcccagttggacagcgcggagcccttcagcgcagtggaagcgacctcgctgcgggattggcaactgtccctgtcgcgcaacctgaccagcgctttcctgctcacccgcggcctgctgccgggcatgcgcgagcgcggctacgggcggatcgtcaacgtcgcctccaccaccggaacccgcggcagcaacccgggcgaagccgcgtatagcgcggccaaggccggtctggtcggctggagcatgggcctggcgctggaggtggcgaagagcggcatcacggtgaacagcgtcgcgccgggctggatcgccaccgcctcgagcaccgccgaagaacgccaggccgccctggccagccccagcggacgtgccggccggcccgaagaggtggccgccgcggtggccttcctcgcctcgcccgaagccagcttcgtcaacggcgaactgctggtggtggatggcggcaactgcctgatcgaaaacaaacggagctga

SEQ ID NO: 2395 - DNA, 711 bp, Pseudomonas aeruginosa
ctcctgaaagtcaccagcgacttcctctacccggtggcggtagcggtctcggccatcaccaccctgctcaccccgtacctgatccgcgccgccgacccgctctcgcagcacctggccaacgccatgccgcagcgcatggcgaggatcttcggccactacggcgactggctgcgcagcatccagccgcagggcgaccgtgcggtgctggcggcgatgatccggcgcatcttgctgcaggtcggggtgaacctggcgctggtgatcgcgatcttcctcgccggcggttatttcgccgatacgctttccgcctggatgagccagtgggtcgcctacgacgggctacacaaggcattgatctggggcggcgcgctgctggtctcgctggccttcctgatcgccgcgtaccgcaagctcaaggccctgtcgatgctgctggccgaactcggggtcaagccggagaaagccggacgccatacggcgcgggtacgtcgggtgatctccgagataatcccgctgctgtcgctggccggcatgatggtgctgctggcggcgctcagctcgagcatcctgccgccgggcgagttgctggtcgtagtggtgctggtcgccggcctggtgatcgcagtgctctggcgctggctgatccgcgtgcattcgcggatgcagatcgcgctgatggaaaccctcgaccaggaaaagggcagccactga

SEQ ID NO: 2396 - DNA, 1623 bp, Pseudomonas aeruginosa
gagccaagcgatcccggcctgccgtcgaatcggcggataaccacgctgcggttattcgccctcgcctgcacctggtgtcgctatcggaccctttgccctgaaggatcggcggatttccgcttatccactctcccggtcggcggactcccgctcggccaagaccaccccgctcctcttccaacccagtccccacgcggctttcccgcgttggcacggcacctgctatcgagccatccaatacgtcgccctcgcgatgtgccggtgtgctgcgccctgatcagcacatccaagacaacaacgaaaagaggaaacacgatggaaagcgccaacgccatttccgcgtctgcccagccccgcaccacttcgcaacgcatcaagtcgatcttcagcggttccgtcggcaacctggtcgagtggtacgactggtacgtctacgccgccttctcgctgtacttcgcaaaggcattcttcccccagggcgacatgaccgcccaactgctgaacaccgcagctatcttcgccgtgggcttcctgatgcgcccgatcggtggctggctgatgggtatctatgccgaccgcaagggccgcaaggcggcgttgctggcctcggtgctgctgatgtgctttggctcgctgatcatcgccctgacccccagctatgaaaccatcggcgtcgccgcgccgatcctgctggtggtcgcgcgcctgctccagggcctgtcggtcggcggcgaatacggcacctccgccacctacctgagcgagatggcgaacaaggaacagcgcgggttcttctccagcttccagtacgtgaccctgatttccggccagctcatcgccctggcggtgctgatcgtcctgcaacagaccctgaccgtagaacaactggaaagctggggctggcgcgtccccttcttcatcggcgcgctgtgcgcagtggtggcgatgttcctgcgtcgcggcatggaagagaccgagtccttctcgaagaagaaggaagagccgaaggaaagcctgctgcgcaccctgctgcgccacccgaaggaagtgctgaccgtggtcggcctgaccatgggcggcaccctggccttctacacctacaccacctacatgcagaagtacctggtgaacacggtaggcatgagcaagaccgattcgaccatgatctcggctgccaccctgttcctcttcatgctgctgcagcccatcgtcggcgccctctccgacaagatcggccggcggccgatcctgatcgccttcggcgtactcggcaccgtcttcacctacccgatcctcagcacactgcacagcgtcgacagctggtggggagcgttcttcctgatcatggcggcgctggtgatcgtcagcggctacacctcgatcaatgcggtggtgaaggccgaactgttccccaccgagatccgcgccctgggcgtcggcctgccgtatgccctgaccgtgtcgatcttcggcggcaccgccgaatacgttgccttgtggttcaagagcgtcggcctggagagcggcttctactggtacgtcaccgcctgtatcgcctgctcgctgctggtctatgtgttcatgaaggacacccagaagcactcgaagatcacgaccgattga

SEQ ID NO: 2397 - DNA, 1431 bp, Pseudomonas aeruginosa
ttgagcctcgtgctcatggccccgacacactccgggcctttttatccacaggacggcgaccttcgggtcgccgtcctgctttttggcgcggcaaccgactcccccacacccgccgactgttggtctacggcacggcatcccgaccggagccctagggcgcgcaacgccggcggcgtaatcctccggtgtccctgcgttccacggcggataaccgcaagcggttattcgccctgcggctcgtcattccggcggggctggaaccttggcgcgcaaacgccgatctcctcgcgttcccacggtggaacagcgcaaggggcctgccgtccccaggcagcgaagccccgtctgcgagacctaccgggaataaaaaaccgcgctcgaaggcgcggctcttttcgttgtcagagaaccgcctcagcggcgcttctcgatcttgaagaagaacatcttggtcgcctggcgggcgacaatcttgccaccactgacacgcggctcgaaacgccacttggccatggcctggcgcacttcacggtcgaacatgcgcgacggcaccgactccagcacctggatgtcgtcaatgcggccatcgctggtgatggtgaacagcaccttcacccggccttcgataccccgggcctgggccatccggggatagaccggaggatccatgcgcaacggcttgatgtcactgtcgttgaggctgccgctgggcaggccggccggaccttgcgagccgctgggcgcggtctgcgcgccgggcgtgctctgcccgacggtaggtgcgggcggcggcggggcggcgctggacgggctgggctggctggatgcctctgtgctcggctcgggttccggcttgggtttgggttccggcttcggcttggccttgggaatggcgttttccaccggtttgggcttgggtttcggcttgggcttgggtttttccaccggcttcggcttcggcggctccggcttgggttcctcgatcttcggcggcgtcggctccggcgcggcagccggcggctgcggggtcggctcggccttcttctcgagctggacgaaattcacctgcatggtcttcggcagttcgccgtggccaaggttgagttcggccggggtcggcatcacccacaccagcgcaccgatgatcgccacatgcatcgccaccgccgcgccggaggacaaccaccagcgcgacttgggcggctcgccggggacgtcttcgggatcgctgccatgggcgtaggggatcagcacttcctcgaccgccacttcctcgtcgcggcgcgcgccggagcagtccaccacgcgcaggttgggttctccgcgctgggcattcacgcatggcagggactcgctttcgtctccctgggcgggagcagtggggtggtcttcggcgagcgcggccagcgaaaaacggtcaggcgaccgtga

SEQ ID NO: 2398 - DNA, 570 bp, Pseudomonas aeruginosa
ccgcgcacgctccagcgcaacggcaggaccggcaggcgcgcgcgcacggcgcagcgctgcgtcgcgtcgagcgtttcggatttgttcagcagcaacatgccagccgcttccagcgcctgttcctgtgcctccggcagcggttggccggaggccagcgcggcggcatccagcaccactaccaggggttgcagggccaggacgccggaccagggaggagcctgcagctgtttccacagcgccagcggatgtcccaacccggagggttcgatgaacagccggtccggccgtgcccgacgcaacaagcgaccgagccccacctggaacggcacgccattgacgcagcagaggcacccgcccgccacctcgccgatggccacgccgtcgacgtccgtggccagcagcgcggcatccaggccgatctcgccgaactcgttgaccagcaccgcccagcgctcgcccgccggcttctgcgccagcagcgagcggatcaggctggtcttgccggcccccagagggccgccgatcaggtgtgtgggtatctctcgaagcatctgcgcaaccggaatgtga

SEQ ID NO: 2399 - DNA, 1275 bp, Pseudomonas aeruginosa
cgccctcgcgaagcacctcggccagcacctggggatcgtcatcgaacgcctggcgcggcaacggtttttcctgcggcagtgcgctcatgcggcgtgcccccagtcctcgaaggggtcgtccaggccctgccagccggggatgcccaggttcatctcggcgtcatccagcaggcaggcgtccagggctgcgcgcagggccgcgaagtccaggttctgaccgatgaaaaccagctcctggcgacagtcgccgacgccttcctcccagtgccgcatgatcgcccgcaggccctcttcgtcctgtggccactgtccggtcggcacgaagcgccaccagcggcccgccaggccgtagcgcatcaggccgccggcctgcgaccagctgccggcctcgcggggccggctggcgagccagaagaagcccttggagcgcagcagccgcccctgcttcagcggattgtgcaggaaggcgtggaagcgcgcggggtggaacggccggcgcgcccggtaggccatggaggcgatgccatattcctcggtttccggcaggtgctcgccgcgcagttccttcagccagcccggcgcggacgccgcgcgatcgaaatcgaagcgaccggtatcgaggatcttcgccagcggcacctgacccatcaccatcggcaggatctccgcctcggcattgagctggcgcaggatcgccagcagttcctcgcgctgctcgctggagatcaggtcgatcttgctgaccaggatcacgtcggcgaattcgacctggtcgatcagcaggtcggtgatcgagcgctgatcctcctcaccgagggtttcgccacgactggccaggctggcggcctcctggtagtcgcggagaaaattcatcccgtcgaccaccgtgaccatggtatccagtcgcgccacgtcggacaggctgcggtccagctcgtcgcggaaggtgaaggtctcggccaccggcatcggttcggaaatcccggtggactcgatcagcaggtagtcgaagcggccttcccgggcgagacggccgacctcttccagcaggtcttcgcgcagggtgcagcagatacagccgttgctcatctccaccagccgttcttcagcgcggttcaggctgacatcgcgctggacctcgctgccatcgatattgatttcgctcatatcgttgacgatcaccgcaacccgtcggttctcgcggttcttcagcacatggttgagcagcgtgctcttgccggcgccgagaaagccggacagcacggtgacaggtag

SEQ ID NO: 2400 - DNA, 492 bp, Pseudomonas aeruginosa
caattaacaccacaatcgatggcccgccaatcgccttccggctaccctgggcccacgtcatcccgggatccaccgatgcgccgcgtcctccgcctttactgcctggccctcctgctgctcgctccggcggcacaggcgcagggctttcttcccggcacccgcccggcggaatgcgcctacctgcgtaccgttctggcctgcatggatcggctgggcaaccactacagcgtcgccaccggcggcaacgacacctggctgcgcggctacgacgcggcgagcggacgacgctgggcccagaccaatacgcgctacgggcgcctgaccttcttcagcggcatcgccagcgatggggaaatctgggtcggcctcagccgcaacatcggctggaccagcatcagccgcctgagcagttcatcgggccagcgccaacgcctgacctgcgggcgggtcagcggctgcagcgaaggccctagccgggaggctgcgcgctga

SEQ ID NO: 2401 - DNA, 447 bp, Pseudomonas aeruginosa
cattcaagccatttccaggccttgcctgcccttcttcgagttctccatgaatgccttgacgcttcccgatattgcccgccagaccaccaccgccgatcttcccctggactgggtcggcatgcagggcatcgccctccccgtgcagatcggcgggcagagggtcgccgccgaagccgatgccggtgtcagcctggacgacccgcaggcccgcggcatccatatgtcgcgcctctacctggcgctggccgaactggaacagggcgagctagacctttcccgcctgcgcgccgtcctgcaacgcttcctcgacagccacgccggcctgtcgcgtcgcgcctacctgcgcctgcgcctcgcgccgctgctgcggcgtccggcgctggtcagcccgctgagcggctggaaacgttatccactggtgctggacacgcgcctggaaggcgatga

SEQ ID NO: 2402 - DNA, 1053 bp, Pseudomonas aeruginosa
cttccaggccgaagtccatctcgagctgacctactcctcgacctgcccctgttcggcggcactggcccggcaattgatccaggagcgcttcgaccaggacttcgccggacagccgctcgatcatgccagcgtgctcgcctggctcggcagcagcgccggcatcgtcgccaccccgcacagccagcgcagcagcgcgcacctgcgcatcggcctggcggaagactgcgtcggactgcccctggaagagctggcggatctcggcgaaagcgccctcggcaccgcggtgcagactgcggtgaaacgcgccgacgagcaggccttcgccctcgccaacgggcagaacctgatgttctgcgaagacgcggtgcgccggctgcaccgcgccctgcagggttatccacaggcgagccggttctccatacgggtcgtccatgcggaaagcctgcatgcccacgacgccgtcgccgaaagccactggcagcgaggtgccgcatgatccgcaagaatccctccggcgacctgccggtgatcgacgaatcggcctatgtggacaagaccgcgatcatctgcggcaaggtgatcatccaggccaacgtcttcgtcggtccctacgcggtgatccgtgccgacgaagtcgacgccgacggcggcatgcaaccgatcgtgatcggcgccaactcgaacatccaggacggcgtggtgatccattccaagtcgggtgccgcggtgaccatcggcgagcacagctccatcgcccaccgctccatcgtccacggtccttgcgaagtcggcgaccgggtcttcatcggcttcaacagcgtgctgttcaactgccgggtcggcgatggctgcgtggtccgccacaacgcggtggtcgacggctgcgacctgccagcgggtttctacgtaccgtccaccgagcgcatcggtccgcgcaccgacctggcgagcatgccgcgggtcagcgtttccgccagcgagttctcggaagacgtggcgcgcaccaacgtcgacctggtacgcggctacaagtcgctgcagaacgagttctga

SEQ ID NO: 2403 - DNA, 222 bp, Pseudomonas aeruginosa
tggtgccggcgccgatgttgcagttggcgcccaactcggcatcgcccaggtagctcaggtggccggccttgctgccctcgcccaggcgggcattcttcagttcgacgaagttgccgacatgggcccgagcgccgagcacgctgcccggacgcaggcgggcgaacggaccggcatcgctaccctcgcccagctccgcgccttccaggtggctgttggccttga

SEQ ID NO: 2404 - DNA, 1416 bp, Pseudomonas aeruginosa
gcgcccgtcgccgggcgcacaggattacagttttttggctttctcgaccgcttcttcgataccgccgaccatgtagaacgcctgctccggcaggtgatcgtagtcgccgttgagaatgcccttgaagccagcgatggtgtccttcagggaaacgtacttgcccggcgaaccggtgaagacttccgctacgaagaacggctgggacaggaagcgctggatcttacgagcgcgcgccaccagcagcttgtcggcttcggacagttcgtccatgcccaggatcgcgatgatgtccttcagctccttgtagcgctgcagaacatactggacgccgcgagcggtgtcgtagtgatcctggccgatcaccagcggatcgagctggcgagaggtggagtccagcgggtcgaccgcggggtagatacccagcgaggcgatgtcacgggacagtacgacggtcgcgtccaggtgggcgaaggtggtcgccggggacgggtcggtgaggtcgtccgcgggaacgtatacggcctggatcgaggtgatcgagcctttcttggtggaggtgatgcgctcctgcagaacgcccatctcttcggccagggtcggctgatagcccaccgcggacggcatacggcccagcagtgcggatacttcggtaccggcgagggtgtaacggtagatgttgtcgatgaacaacagaacgtcacggccttcgtcacggaacttctcggccatggtcaggccggtcagtgcgacgcgcagacggttgcccggcggctcgttcatctggccgtataccagggctaccttgtccagtacgttggagtccttcatctcgtggtagaagtcgttaccctcacgagtacgctcgcccacacccgcgaacacggaataaccgctgtgctcgatggcgatgttacggatcagttccatcatgttgacggtcttgcccacgccggcgccgccgaacaggcctaccttgccgcccttggcgaacgggcagaccaggtcgatcaccttgatgccggtttccagcagctcgttgccgccagcctggtcggcataggacggagcttcgcggtggatgccccagcgctcttcttcgccgatgggaccggcttcgtcgatcgggttacccagtacgtccatgatccggcccagggtcgctttaccgaccggcacggagatggcagcaccagtgctgtccacgttcaggccacgcttgaggccttcggtggaacccatcgcaatggaacgaaccacgccgtcgcccagctgctgctggacttccagggtggtttcaacgccctgaaccttcagggcttcatagatgctcggcacggcatcgcgcgggaattccacgtcgatcacggcgccgatgatttgaacgatacgtccgctactcatgtctggttcctctga

SEQ ID NO: 2405 - DNA, 1050 bp, Pseudomonas aeruginosa
attttgaacctgttcttacaccgcggcagcgccgccgacgatttccgagatttcctgggtgatcgccgcctgacgcgccttgttgtagatcagctgcaaatcgctgatcagctcgccggcgttgtcggtagcgttcttcattgcaatcatccgggccgcctgctcacaggcgttgttctcaaccacggcctggtacacctgggattccacgtaacgcaccagcagcccgtcgaggagcgacttggcgtcgggttcgtagagatagtcccagtggtgcttcagctcctgatcgtcatcggccaccagcggaatcagctgttccacggtcggcttctgggtcatggtgttgacgaacttgttggagaccacgaacaggcgatcgatacggccttcgaggtatgcgtcgagcatcaccttgacactgccgatcaggtcgttgatcgaaggctcttcgccgaggtggctgatagctgccacgacgttgccgccgaaactgcggaagaacgaagcgcccttgctaccgatcacgcaaaggtcgatttccgccccttgctcgcggtagccgctcatgtccttgacgagggacttgaacaggttgatgttcagaccgccgcacagaccacggtcactgctcaccacgatgtagccgacgcgcttgacttcacgctcgaccatgaacgggtgacggtattccgggttggcgttggccagatggccgatcacctggcgaatacgctccgcgtagggacggccggccgccatgcgcatttgtgccttgcgcatcttgctcaccgccactttttccatggcattggtgatcttttgcgtgcttttgatgctcgcaatcttgctgcgaatctcttttgcgcctgccatttgacacctatcgggttagcaggcgggagcctcgcggctcccgctgcggcttaccaggtttgggtggccttgaacttctcgatgccggccttgatgcccgcgtcgatttcgtcgttgaagtcacctttctcgttgatcttcgccagcagagcggcatgctcgcgctggaagtag

SEQ ID NO: 2406 - DNA, 528 bp, Pseudomonas aeruginosa
atgcgcacgataccgtcggacacgctgacgatggtgccttcgtttcgtgcttgggaggcgacgtcgagtttctcgatgcgccccttgatgatttcactaatttcggaaggattgagttgctgcatgccgctgccccttcaaactcaagatttcaacgcttcggccagtttcgcgagcttgccgcgcaccgagccatcgattaccaagtcaccggcgcgaatgatcacgccgccgatcaggctcgcgtcttccgacgcatgtagccgcacttcgcgactgagccgggcgctgagagccttggcgagtttgtcctgctgttctttgctcaaggtgaaggcactggtgacttctacctcgaccgacttttcctgctcggccttcaactgctcgtacatctcagcgatggtcggcagcagttcgagccgcttgttctcagccacagtccggacgaagttctgggctggtgcattcagcttgtcgccgcacacatcgatcaggctctgggccttggccgaagaggtcagctga

SEQ ID NO: 2407 - DNA, 600 bp, Pseudomonas aeruginosa
ggagcgctcccaggaggagttcttccacaccttcaatgcccttctcgaaggcggccagcaggtgatcctcaccagcgaccgctatccgaaggaaatcgaaggcctggaagagcggctgaaatcccgcttcggctggggcctgacggtggccgtcgagccgccggaactggaaacccgggtggcgatcctgatgaagaaggccgagcaggcgaagatcgagctgccgcacgatgcggccttcttcatcgcccagcgcatccgttccaacgtgcgcgaactggaaggtgcgctgaagcgggtgatcgcccactcgcacttcatgggccggccgatcaccatcgagctgattcgcgagtcgctgaaggacctgttggcccttcaggacaagctggtcagcatcgacaacatccagcgcaccgtcgccgagtactacaagatcaagatatccgatctgttgtccaagcggcgttcgcgctcggtggcgcgcccgcgccaggtggccatggcgctctccaaggagctgaccaaccacagcctgccggagatcggcgtggccttcggcggtcgggatcacaccacggtgttgcacgcctgtcgtaa

SEQ ID NO: 2408 - DNA, 402 bp, Pseudomonas aeruginosa
cctgaacaactacatcgaggccgaaggcctggcgaagaagttcaagatcgccaccaccggcgacgatgcccgcgaaggcctcaccgcgatcatctcggtgaaggtaccggacccgaagttcagctcgcagaccaaggacaagctggtctcctccgaggtgaagactgcggtggaacaggagatgggcaagtacttcgccgacttcctgctggagaatcccaacgaagccaaggccgtggtcggcaagatgatcgacgccgcccgtgcccgcgaggccgcgcgcaaggcgcgcgagatgacccgccgcaagggcgcgctggacatcgccggcctgcccggcaagctggccgattgccaggaaaaggacccggcgctctccgaactgtacatcgtggagggtga

SEQ ID NO: 2409 - DNA, 999 bp, Pseudomonas aeruginosa
tttttcctgcttcagctgctgctggcgagttcgccaacttgcagcaaattctgccggggtgagattgccaatcgcgctgtgcggtcggtgttcgttgtaatcccgccgccaggccacgatgcggattctcgcttcggccagcgaacagaaccagtgctcattgaggcattcgtcccggaacttaccgttgaacgactcgatgaaggcattctgcgtgggcttaccaggctgaatcagcttcagcttgatgtcgcgctgataggcccattgatcgagtgccttgccggtgaactcgggcccctggtcggtgcggatcgctttcgggtagccgcgaaaccgcgccatctcgtccagcgcccgtgtgacgcgaaagccgctgataccgtgctccaccaggatgccgaccgactccttggtgaagtcatcgaccaccgtcaggcatttgatccgccgcccggtgctcagtgcatcgaagacgaagtccatcgaccagacctggtttggtgcgctcggcaaactcagacgttcgcgctccaccgcgacgccatggcggcggcgccgccgtttcaccatcaagccggcagcgcggtacaggcgatagatccgcttgtggttgacctgcacgccagcacgccgcagcaggaagtgcaggcggcgatagccaaagcgccggcgctcttgggccagttccaccagttgggcttgcagctcggtgttttgcacactggctcgcggctggtagcgcaacaccgagcgggacagcccgatcaactgacaggcacgacgctcggagatgccggttcgcgcctgcatctcctgcaccgcctcccgccgtgctgtcgggcttacccttttccccgggcgaccactttcagcgactcgatgtcgaggtgggcctcggcgagcaacttcttcaatcggctattttccagttcaagatccttcaaccgtttggcgtccgccacggtcataccgccaaacttcgcccgccaagtgtag

SEQ ID NO: 2410 - DNA, 1824 bp, Pseudomonas aeruginosa
tgcagtaagcgcctatcgcatgccagcacggccgaccggccgtgtttccaccacaggtggagcgggcatgacgacggggagttccggggcgtctgcccgttcccaaggacggtaaccgtgaaacgcctgaaaaagacactgcacctttcaagcttgtccctcgcttccctggctctttcttccgccgccctggcggccgctccggtcatgctcgaccagggcaaggaatggaccgaaagccaccgccaggacttctacagccgcgaccagggctcgcaggtgatgcccctgccctggctcaaggcgttgcgacagccggatggaacgcctttcctcgccgacagcctggcccgctacggctatttgcccaaccccaaggcgcccgcggaaggcctgccggtgggcttcaccgtagccggcacgggcgcccggcagatggtcggcatgacctgttcggcctgccatacccggcagatcgaggtgaagggcactgcctatcggatcgacggcggtccggcgatcgtcgacttccaggcattcctcgccgacctcgatcgcgccgtgggaccgctgaccagcgatgacgccgccttcgacgccttcgccaagcagatcctcggggccaatccgcctcccggtgcgcgcgacgctctgctcgcggcggtgaaggaatggtacgagccctatcatacgctgatcgagcgcgcgctgcccaaggacacctggggaccggcgcggctggacgcggtatcgatgatcttcaaccgccttaccgggctggatatcggcaccgcgccgccctacctgattcccgacaacatcaaggcggcggatgcgccggtgcgctatccgttcctgtggaacgcggcgcggcagaacaagacccagtggcccggcttcgccgccaacggcaacgacctgctcggcctggcgcgcaatgtcggcgaggtctacggggtgttcgccaccttccacccgcagaagagcaagttccacctgctgggcatggactacctgaagatcaactcggccaacttccacggtctgggcaagctggaagacctgatcaagaagatcggcccgccgaagtggccctgggcggtggacaagcacctggccaggaaaggcgcgctgatcttcgcccgcaagaccgacgaaggtggctgcgtggagtgccacggcatccggatcaaggacctggtgctttgggacactccgctgagggacgtcggcagcgacagccgccagcacgccatcctcgatggccaggtgcagaccggcgtgatggagggcgcgcggatgccgttcggccagccgctgaaggcgaccgacggagccttcgatgtactcgccgtagcggtggccggttcgatcctgcagcacttcgtgccgatcctcggtgagaagcacgatgccaaggcggcggcggtcaagccggaaagcgtgatgaccgacgaaacccggcaactgctgaccgccttccagaagccgctgcgtacccaggccgacccctacccctacgagtcgcgggtcctgcaggggatctgggcggcggcgccgtacctgcacaacggctcggtgccgaccctggaagagttgctgaagccggccgcggagcgggtggaatccttcccggtgggctcggcctacgacgtggacaaggtcggcctcgccgcccagcagacccaattcggcagctatgtgctgaagaccaccggctgcgagcagcgtgattccggcaacagccgctgcggccatgagtacggcaccagcctgtcggccgaggagaagcgtgcgctgctggagtatctgaaggtcctgtag

SEQ ID NO: 2411 - DNA, 480 bp, Pseudomonas aeruginosa
gcggccaggccggagacgcgctgggccttctcgaacacggtgccgagctgggcctggaacactacgttgcgcaggcgctcattgaagctttcgagcggctgcttcttgtcctgcttgaagaagaactcggcgtcggtgaggcgcgggcgaaccaccttctcgttaccgctgacgatgttctccggcgccttgctctcgacgttggcgacggtgatgaagcgaggcagcagcttgccgttggcgtccagcaggcagaagtatttctggttgtcctgcatggtggtgatcagggcttcctgcgggacctcgaggaagcgctcctcgaaggagcagaccagcggcaccggccactcgaccagtgcagtcacttcgtcgagcaggctcggcggcacgatggcgctgccctgttgctcggcggccagttcggccacgcgcttggcgatcagctcgcggcgctcggcgaaatcggccagcacatga

SEQ ID NO: 2412 - DNA, 483 bp, Pseudomonas aeruginosa
gcgccgcgcaggtcttccagatacgctgccgggctggaaatacgcacattgtccggattgtggaagcggtggccacgggattcgcgcccggctttctgggcgaggatctcgcactcgaccacatcgtcgccgaacagcatcaccagccattgggtcggacgcacgaactcctcgcggcgagctgcccagcgcatccgcttgggaatcggcagttcgttcaacgaggcctcgacgatgcccggcagcaggccggcggccggttggccggcgatggtctggctgaagcgcagcttcggaccgctcttgtcgatctgctgcagatccacgccgcacttcttggcgaagcccagggcggcctgggtcgggttaccgctggcgtcgaaggcggcctgtagcggcggaccgtctaggttgacggtacggtcgggctgctgcacggcgagttgctcgaccagcacggcgagacggcgcggcgccgcatag

SEQ ID NO: 2413 - DNA, 420 bp, Pseudomonas aeruginosa
cttccatgccgttcagccagatttcccaacccaggccccaggcgccgagggtcggcgactcccagttgtcctcgacgaagcggatgtcgtggaccagcgggtcgatgccgatggctttcagcgagccgaggtacagctcctggaagttctccgggttcggcttcaggaccacctgaaactggtagtagtgctgcaggcggttggggttctcgccgtagcgaccgtcggtggggcggcggctcggctggacgtaggcggcgttccaggtctccgggccgatggcgcggaggaaggtggcggtgtggaaggtgccggcgcccacttccatgtcgtagggctgcagcaccacgcagccctgctctgcccagtagttctgcagggcgagaatcaggtcttggaaggtgcgcacggcgggcgtag

SEQ ID NO: 2414 - DNA, 666 bp, Pseudomonas aeruginosa
tctggctcacgaaattcacctgtgctgaggcttcgatacaaaacgcggaagtatacccgattcccgcgccgcctcgcccgtccccccgatccctggaaaaccacggaaagccttatgccacgctgcttctggtgcaacgacgatcccctctacatggcctaccacgatgaggagtggggtgtgccgcagcgcgatcccgacgcgctgttcgaacttctgctgctggagggcttccaggccggattgtcctggatcaccgtgctgaagaagcgcgagcgctaccgcgaggtgctgttcggcttcgacgtgcagcgggtggcacagatgagcgacgcggagatcgacgaactgatgctcgaccccggcatcattcgcaatcgggccaagctcaacgctgcgcggcagaacgcccaggcctggctggagctggacgacccggctgggttcctctggtccttcgtcggcggccagccgaagatcaaccatttcgccggtcgcgccgaggtgccggcgattaccccggaagccgaggccatgagcaaggcgctgcgcaaggccggcttcaacttcgtcgggccgaccatctgctacgccttcatgcaggccagcggcatggtcatggaccatacccaggactgcgaccgttacgcccaactcgtcggctag

SEQ ID NO: 2415 - DNA, 387 bp, Pseudomonas aeruginosa
cctggacgttcgggggttctgcccgagcacaatagggcgagggaagcttgccagggatatccgtgcgacgaaggtgttgaactccagcagcgcggagaaaccacggaacgccgcttcctggaacaacaccgagaccacgtaggaggcgatcaacgccgggatcatgacccgggcgatgaccagccgggcagggcccttgcccagcaagcgcacggtgaggtcggtagccaggaagatgaacggaaagctgaaggcgccccaggtggtgtgccagccaaacagggtgatcggcaactgcaccaggtagttgctggcgatgatgatgaagatgtggaaggcgatcaggccggccagggtgccgcgccaggccgccggagaagaggctga

SEQ ID NO: 2416 - DNA, 1050 bp, Pseudomonas aeruginosa
ggctttccgtggttttccagggatcggggggacgggcgaggcggcgcgggaatcgggtatacttccgcgttttgtatcgaagcctcagcacaggtgaatttcgtgagccagactacgcccgccgtgcgcaccttccaagacctgattctcgccctgcagaactactgggcagagcagggctgcgtggtgctgcagccctacgacatggaagtgggcgccggcaccttccacaccgccaccttcctccgcgccatcggcccggagacctggaacgccgcctacgtccagccgagccgccgccccaccgacggtcgctacggcgagaaccccaaccgcctgcagcactactaccagtttcaggtggtcctgaagccgaacccggagaacttccaggagctgtacctcggctcgctgaaagccatcggcatcgacccgctggtccacgacatccgcttcgtcgaggacaactgggagtcgccgaccctcggcgcctggggcctgggttgggaaatctggctgaacggcatggaagtcacccagttcacctacttccagcaggtcggcggcatcgagtgctatccggtcaccggcgagatcacctacggcctggagcgcctggccatgtacctgcagggcgtggactcggtctacgacctggtctggaccgacggcccgttcggcaaggtcacctatggcgacgtgttccaccagaacgaggtggagcaatccactttcaacttcgagcacgccaacgtgccgaagctgttcgaactgttcgacttctacgaaagcgaagccaaccgcctgatcgcgctggagctgccgttgccgacctacgagatggtcctcaaggcttcgcataccttcaacctgctggatgcgcggcgcgccatctcggtcaccgagcgccagcgctacatccttcgcgtgcgtaccctggcccgcgccgtggcgcagagctacttgcaggcccgcgcgcgcctcggcttccccatggccacccccgaattgcgtgacgaagtactggccaagctgaaggaggccgaatga

SEQ ID NO: 2417 - DNA, 555 bp, Pseudomonas aeruginosa
tggtcaatgtcgacgacgcagcggtgcgcgccaaccgctatgcgctgctggccaagctgcgcgggtcgttcctcggggtggcggacatctcgctgctcggctgagccagtcccgcctcgaagaaaaggcccggcgtcctcgcgacaccgggcctttttcactacaggaccttcagatactccagcagcgcacgcttctcctcggccgacaggctggtgccgtactcatggccgcagcggctgttgccggaatcacgctgctcgcagccggtggtcttcagcacatagctgccgaattgggtctgctgggcggcgaggccgaccttgtccacgtcgtaggccgagcccaccgggaaggattccacccgctccgcggccggcttcagcaactcttccagggtcggcaccgagccgttgtgcaggtacggcgccgccgcccagatcccctgcaggacccgcgactcgtaggggtaggggtcggcctgggtacgcagcggcttctggaaggcggtcagcagttgccgggtttcgtcggtcatcacgctttccggcttga

SEQ ID NO: 2418 - DNA, 2841 bp, Pseudomonas aeruginosa
cccatgaagcccctcaaactctcccacgttcctggttgctgggtcagccagactctacccagcggccagggcgaacgccggggtatcgtcaaaatggccattgctaaagaagccgaagatcagcttcaggttcactggttcagtccggagaagaaactggcctatgtcgatgcatctgccgtgcgctcaggctttcaaaatggcatggacgtagtcgacgaaacacctggtagcggtgttcgctcactagggcagggcgtgatcatgcagcaacgtaccttggcgggaagcgagcaagtccttgtcgactttcctgagcgaggcgaacgccattggctgccctatcagtacctgcgtcaggtgaagggcgttaagcatcggtttgtcactgccagtaaaggcgaagcggtcgatgcggaacgcatgcgactgcgcatgctcgcccatgccatcaaggtatggaatgaaaacacgggggccctttctcacctagagattgaaccgctacctcatcagattcacttggtacaccacattatcgcctccggcaactacaactggttgatcgctgacgatgtgggccttgggaaaaccattgagaccggaatgctcctgcatgcgctacggcaacgagacctgatcaaacgcatcttgctggttacccccgccggcctgaccaagcagtggcaggaagagctgtaccacaagttcaagatcgaagactttgaaatctatggtgaggactttttcatcaacgaacctcgccaatggaagatgcacgactgtgtcattggctccatggatcgactcaagcaggagggtcacttggagagcctgctccaggctgagccctgggatctggtgatatttgacgaaggccatcgactcagccgtcgccagtacggccagaagctggacagctctgagcgctatgacctggcgaaaagcctacgtagtcaaaccgagcacatgcttttgctaagtgcgacccctcaccagggcatgcaagacaagtttgtcgcgctgctggaactgcttcgccccgagcgacgcaccgacctcatggcgctcaacatcaagccagaaatcctacatgacatggtgttccgcaatcacaaggcggatgtaacggatgcagaagggaacttcatcttccaaggcaaaattaccagtgccttgcaggtgcccagcagtaaggaatccatcgaattcgataaaacccttcaggactatctgcgcaaaggctatgacgcgggtgaagcactggggcgaaccggtaacgccattggtttcgtgatgaccgtctaccgcaagctggcagcctccagcgcggcggctattcaccgggcgttgtgcaaccgccttcagcgcctgctcgacgatgaggccaacggactctcggatgaagagcccagagaccaacgttatctgggtgaatgggaagaacagttcaccagtgatgcccgcgagttcttcgctggtgaagtgcagctgcttaaagacttgattgccgaagcagcagcactgaaagcaaacgacctcaaactaaagctgtttatcgaggacatcatcggcaagatccacgctgccaatgccgatgagaaggtgctgatctttaccgaataccgcaccactcaaaactatctgcgcgaagcacttgctgaccactatggcagcgaccaggtcgagctcatcaatggctccatgcaacatgctgagcgacgcgaggccatcaagcgcttcgaggagcaaggcggctttctgatttcgaccgaagcaggtggggaaggcatcaacctccagagcaaatgccacgtcatggtcaactatgacctgccctggaacccaatgcgcctcgtacaacgcattggccgcctgtatcgctatggccagaaaaagaaggttgttgtgttcaacatccagcaaaccgacagcctggatcagaacatcgtcgacctaatgtatgagcgcatcgacagcgtggttaccgacctcgccgagattcagcggcatgagttcaacgaaggcttgaaggatgaaatcctaggccagctggccgagctaattgacgtagaagacatcctgcaagaggcaacaaaactcggcatagaccgcacccgtgagcgcatcgacgaagcgctgaagcaggcgcgtactgctgctgctaaacaacgagagctgtttgcccatgccgccaccagcgaccccaatgaactgcgcgatgagctcgaaattactgtcgatcatctctacagcttcgtccttgggatgttcgatcaattgggcattgaggtcgctgagcgcagccacaaagagcggcttttgcgtatcagattgtccgagcaggtgatgcgcgacatggggctatccccgaaggcctcgcggcgtatggatgtgaccttggatcgcatgctggcagccaatcgcccagacacccacatgctcgacctcaactccaagctgatgcagtacctgctgggcaaagcctgcgagtacgactttggcggtctggctgcaatgctcaaagcaccagaactagaagagggtgctctgcttggagccatgctgcgctggcaaggccctcagggaaaacggatgcggcaagagtttgtagccattcaggtgaacgatggcaaagccaagctgaaccctgcaaaggccagccaatggctgctgacacctgccgagcacagcccccagagccccgatactgatacctccaaattgctgttcaaagtcgctgaagaaatggctaaccagcgactggctaatgccagtaaccgctatctaatacccgagaatttggactgggcctccgcaggatggacacacatccactag

SEQ ID NO: 2419 - DNA, 2070 bp, Pseudomonas aeruginosa
ctctggccgaagtggcaaataactttgcccgcctacaacctgtcacacgtccaggttcgacaccgccagcgcgttgctttcgatgaagtcgcggcgcggctccacggcatcgcccatcagggtgttgaagatctggtcggcggcgatggcgtcctcgatggtcaccttgagcatgcgccggacgttcggatccatggtggtttcccacagctgctcagggttcatctcgcccaaccccttgtatcgctggatgctgtggcgcttggtaccttcggccatcagccagtccaggccgtccttgaaggcgctgatcgggcgcttgcgctcacccttctgcacgtaggcgccgtcttccagcaggctgttcagctggtcgccgagcagcgacaccgagcggtagtcattgctggcgaagaagtcacggttgaaggtgacgtagctggacaggccgtgggccaccagttccacctcgggcagccagaggtggcgctcgcggtcttcgcgcaggctggccttgtaggtcaggccagacttctcggcggcggtcaggcgcgcctggaacttctccaaccagccctgcatggccgactcgttagccaggtcgtccaccgacacggtaggcaggtagatgaagtgctcggtcagctcctgggggtacaggcgcgacaggcgcttgagggtggcgatcaccccgcgatactcgttgaccagtttctccagcgctgccccggacaggcccggagcgtgctcgttgacgtgcaggctggcgtcttccagggccgactgggtcatgtactcttccatggcctggtcgtccttgatgtactgctcctgcttgccgcgcttgaccttgtacaacgggggctgggcgatgtagatgtagccacgctcgatcagctcgggcatctggcggaagaagaaggtcaacagcagggtgcggatgtgcgaaccgtcgacgtcagcatcggtcatgatgatgatgttgtggtagcgcagcttgtcgatgttgtactcctcgcggccgatgccacagcccagggcggtgatcagcgtaccgacctcctgggaggagagcatcttgtcgaagcgtgccttctcgacgttgaggatcttgcccttgagcggcaggatcgcctgggtccggcgattacggccctgcttggcggaaccgcccgcggagtcaccctccacgatgtacagttcggagagcgccgggtccttttcctggcaatcggccagcttgccgggcaggccggcgatgtccagcgcgcccttgcggcgggtcatctcgcgcgccttgcgcgcggcctcgcgggcacgggcggcgtcgatcatcttgccgaccacggccttggcttcgttgggattctccagcaggaagtcggcgaagtacttgcccatctcctgttccaccgcagtcttcacctcggaggagaccagcttgtccttggtctgcgagctgaacttcgggtccggtaccttcaccgagatgatcgcggtgaggccttcgcgggcatcgtcgccggtggtggcgatcttgaacttcttcgccaggccttcggcctcgatgtagttgttcaggttacgcgtcagcgccgaacggaaaccggccaggtgggtgccgccgtcacgctgcgggatgttgttggtgaagcagagcaggttctcgttgaagctgtcgttccactgcaaggcgacttccacacccacgccgtcctcttcacgctggacgttgaagtggaatacctcgttcaccgcggtcttgttggtgttcaggtactcgacgaaggccttcagaccgccttcgtacttgaacagctcctccttgccggtacgctcgtcgcgcagcaggatgccgacgccggagttgaggaaggacagctcgcggatgcgcttggccaggatgtcccaactgaagtggatgttgctgaaggtctccggggacggcttgaagtgaacttcggtgccggagccatcggtctcgcccacttcgcgcagtgggaactgcggaacgccgtggtggtagacctgttcccagaccttgttgtggcgacggatggtcaggcgtag

SEQ ID NO: 2420 - DNA, 420 bp, Pseudomonas aeruginosa
ttcatgggacagcgcgttcaccaccgagacgcccacaccgtgcaagccgccggacaccttgtaggtgttgtcgtcgaacttgccgccggcgtggaggacggtcatgatcacttccgccgcagaaaccccttcttccttgtggatatccaccggaataccgcgtccattgtcgcggacagtgatcgactcatccgtatggatggtgatgctgatttcgctgcagtaaccggccagcgcttcgtcgatggagttatccaccacctcgaacaccatgtggtgcagaccggtgccatcgtcggtgtcgccgatgtacatgccggggcgcttgcgtacggcatccagccccttcagcaccttgatgctggaagagtcgtacgtgttgttctcgctcatgcttcactcccgatggtcgtggtctga

SEQ ID NO: 2421 - DNA, 441 bp, Pseudomonas aeruginosa
cgcacgtcctgctgggccatggcgaagctggtgcggtcgatcaggcgacgcagcttgctctgggcaatgctgaagttcagcgagccgggaccttcctccacggtggggaaatcgttggccggcagggtggacagggtgaagcggctacgcccggccttcaccaggagtttctgctcttcgacacggatgtcgatcagcacgtcgttcggcaggctcttgcagatgtccatcagcttgcgcgccggtacggtgatctcgccgggttcggcggcatcttccagtaccacgcgaccaaccagctcgacttcgaggtcggtgccggtcagcgacagttgctggccttcgaccaccagcaggacgttggagagaaccggcaatgtctggcggcgttccacgacgccggcgaccagttgcagcggtttcaacagggcttcgcgttga

SEQ ID NO: 2422 - DNA, 1338 bp, Pseudomonas aeruginosa
tcccttgcctcgtgggctgcgtcaggttgtcagggtacgcagcaggttcttgtagtcctcgcggatatccgcgtcggattccctaagttgagcgatcttacgacaggcgtgcaacaccgtggtgtgatcccgaccgccgaaggccacgccgatctccggcaggctgtggttggtcagctccttggagagcgccatggccacctggcgcgggcgcgccaccgagcgcgaacgccgcttggacaacagatcggatatcttgatcttgtagtactcggcgacggtgcgctggatgttgtcgatgctgaccagcttgtcctgaagggccaacaggtccttcagcgactcgcgaatcagctcgatggtgatcggccggcccatgaagtgcgagtgggcgatcacccgcttcagcgcaccttccagttcgcgcacgttggaacggatgcgctgggcgatgaagaaggccgcatcgtgcggcagctcgatcttcgcctgctcggccttcttcatcaggatcgccacccgggtttccagttccggcggctcgacggccaccgtcaggccccagccgaagcgggatttcagccgctcttccaggccttcgatttccttcggatagcggtcgctggtgaggatcacctgctggccgccttcgagaagggcattgaaggtgtggaagaactcctcctgggagcgctccttacgggcgaagaactggatgtcgtcgatcaacagtgcgtccaccgagcggtagaagcgcttgaattcgttgatggcgttgagctgcaaggccttcaccatgtccgcgacgaaacgttccgaatgcaggtagaccaccttggcgttcgggttcttcttcagcaggtggttgcccaccgcatgcatcaggtgggtcttgcccagaccgacgccaccgtagaggaacagcgggttgtagccgtgcttgaggttgtccgccacctgccaggcggcggcgcgggccaactggttggacttgccctcgacgaagttctcgaaggtgaaggtacggttgagatagctggtgtgcttcagcgcgccttcgacctggacgttgcgctcggtgcgtaccgcaggtgcggctccggccggcatagcggcggccagcggatcgatgctgggctcttccggctcgtaggggtcgctcgacacgctggtagccgtcgtcactggcggcagctcttcacgtggcaccaccacgggcgcggccgataccggctgcactggcgccggcggcggagcaaccggaggcgggggagccacgtgggtctgcgatgggacgatggcggcgcgcggcgtacggctacgcttgctgcctattaa

SEQ ID NO: 2423 - DNA, 219 bp, Pseudomonas aeruginosa
cctgcccgttcgatttcactagaatcgccggtctctttaaacggggtcactgcgacctcaagtcgtcaacccaggtaccgaatcatgaaacgtactttccaacccagcaccctcaagcgcgctcgcgtccacggtttccgcgcccgtatggccaccaagaacggccgtcaggttctgtcgcgtcgtcgcgccaaaggccgtaagcgtctgaccgtctga

SEQ ID NO: 2424 - DNA, 1788 bp, Pseudomonas aeruginosa
cgtctatcgcgaaaactgtccacaacaagacgccccctcgaggggcgtcttgctatccggagatatccacatgcaagccgccaccgaaaccatcgtcgcgatcgctaccgcccagggccgcggcggcgtgggaatcgtccgcgtctccggacctctcgccggacagatggccgtggccgtgagcggacgccagctgaaagcccggcatgcgcattacggaccgttcctcgatgccggtgggcaggtgatcgacgaaggcctgtcactgtatttccccggcccgaactcgttcaccggcgaagacgtactcgaactgcaggggcacggcggccccgtggtactcgacctgctggtgcagcgttgtctggaactgggcgcccgccaggcgcgaccgggcgagttcagcgagcgcgcgttcctcaacgacaagctcgacctggcccaggccgaagccatcgccgatctgatcgaggccagctcggagcaggccgcgcgcaatgcattacgttccctgcagggcgaattctcacgccgggtacatgcattgaccgagcaactgatttccctgcgcatctatgtcgaagccgccatcgacttccccgaggaagaaatcgacttcctcgccgatggccatgtactggggcttctggaaaaagtacgcacagaattatccacagtgcagcgcgaagcttcccaaggcgccctgctgcgcgacggcatgaccgtggtcatcgccggacgaccgaatgccggcaagtccagcctgctgaatgccctggccggtcgcgaggcggccatcgtcacggacatagccggcaccacccgcgatgtactgcgcgaacatatccacatcgatggcatgcccctgcatgtggtggacaccgcaggcctgcgggataccgaggaccatgtggaaaagatcggcgtggaacgtgcgctgaaagccatcggcgaagccgatcgcgtgctgctggtggtggacgccaccgccccggaagcagcggacccgttttccctatggccggagtttctcgaccagcgaccggaaccgggcaaggtcaccctgatccgcaacaaggcggatttgtccacagagtccattggcctcgaggaaagcgcggacggccacgtcaccatcaccctctcggcgcgcaccggcgccggcctggagctgctgcgcgaacacctgaaggcctgcatgggcttcgaacagaccgcggaaagcggtttcagcgcccgccggcgccacttggaagcgctacgcctggcagggcaggcgctggagcatggccacagccaacttatccacaatggcgccggcgaactgctggccgaggatctgcgccaggcccagcagcacctgggcgaaatcaccggcgcattcacccccgacgacctgctgggtcgcatcttctcgagtttctgcatcggcaagtaatggggctcggcccacgccgagttgtggataaccagggcaaggttcgctgcgtactttcctttcactgtgccccttgccgccggcactcaaccacgcaggcatggattgccggcgcgccgcttcgtccccgagaaaaccatctgcgccgatgtcggtctgcatgggatggatatccacctgggagaggtttatgcacaggcaccgcgctccgatccggcgtccgcgaaggcgctgcgctgtggtcaatctctatctgctcgcccctctcgaacggcgtatctatcccgttgtctcgcctggcgctatcgccacgcgccgggacgttccgtgcacgcaagtcaacccggtaa

SEQ ID NO: 2425 - DNA, 1950 bp, Pseudomonas aeruginosa
atccttatactgtccggctttcctgaattcctgcttctgaacaggccgaggtgcgtggtggatttccctacccgttttgacgtaatcgtgatcggcggtggccatgcaggcaccgaagccgcactcgcggctgcgcgcatgggtgtgaaaaccctgctgttgacccacaatgtggaaaccctggggcagatgagctgcaaccccgccatcggcggcatcggcaagagccatctggtcaaggaaatcgacgcccttggcggcgccatggccgaagccaccgacaagggcggtatccagttccgcatccttaacagccgcaaggggccggcagtgcgcgccactcgtgcacaagccgatcgcgtgctctataaggccgctatccgccatacactggaaaaccagccgaacctgtggatattccagcaggcctgcgacgacctgatcgtcgagcaggatcaggtccgcggcgtagtgacccagatgggactgcgcttccatgccgacaacgtggtcctgactaccggcaccttcctcggcggacttatccacatcggcctggagaactactcaggcggacgcgccggcgacccgccgtccatcgcactggcgcgtcgtctgcgtgaattgccgctgcgggtcggccggctgaagaccggtacgccgccgcggatcgacgggcgcagcgtggacttctcggtgatgaccgagcagccgggcgacacgccgatcccggtgatgtccttcctcggttcgaaggaacagcatcccgagcaggtcagttgctggatcacccataccaacgcccggacccacgagatcatcgccgccaatctcgatcgttcgccgatgtattccggtgtgatcgaaggcatcggcccgcgctactgcccttcgatcgaagacaagatccatcgcttcgccgataaggaaagccaccaggtcttcctcgagccggaaggcctgacgacccacgagctgtatcccaacggcatttccacgtccctgccgttcgacgtgcaactgcagatcgtgcgttccatccgtggcatggaaaacgcccacatcgtgcggccgggctatgcgatcgagtacgacttcttcgatccccgcgatctcaggtacagcctggagaccaaggtcatcggcggcctgttcttcgccggccagatcaacggcaccaccggctacgaggaagctggcgcccagggcctgctggccggcgccaatgctgcgttgcgttcgcaaggcaaggacagctggtgcccgcgccgcgacgaggcctacatcggcgtgctggtggacgacctgatcacgctcggcacccaggagccgtaccgcatgttcacctcgcgggcggaataccgcctgatcctccgcgaggacaacgccgacctgcgtctcaccgagaagggacgcgagctgggccttgtcgacgatcggcgctgggctgccttcgaagccaagcgcgaaggtatcgaacgcgaggaacagcggctgaagagcacctgggtgcggccgaataccccgcagggcgacgccatcgccgagcgcttcggtacgccgctgacccatgaatacaatctgctcaacctgctgagccgccccgagatcgattacgccggcctggtggagatcaccggcaacgctgtggataacccccaggtggccgagcaggtggagattcgcaccaagtacgccggctacatcgaccgccagcaggaggaaatctcccgtctgcgcgccagcgaagatacccgcctgcctgtggatatcgattacctggggatttccggcctgtcgaaggaaatccagaacaagctgaaccaggcccgtccggaaaccctcggacaggcttcgcggatccccggcgtcacgccggctgcgatttcgctgttgttgatccacctgaagaagcgtgcctctggccgccaactggagcagagcgcttga

SEQ ID NO: 2426 - DNA, 213 bp, Pseudomonas aeruginosa
ccaacgatgtctccgcgcagttgcaggagcatttcggcgacaccctcttacagcaccgtcatcccgcgtaatgtgcgcctcgccgaagcccccagcttcggcatgccggcgctggtttacgacaagcaatcccgcggcgccatcgcctacctggcgctggccggcgagctggtccgccgccagcgcgccaaaggccgcgccgcaaccgcataa

SEQ ID NO: 2427 - DNA, 882 bp, Pseudomonas aeruginosa
ggaacccgcatggcagccaagaaacgtggactgggacgcgggctcgatgccctgctgggcggctcgagtcccgccaaactgcaggaggaagccgtacaggccgaccgccgcgagttgcagcagatccccctcgacctgatgcagcgcggcaagtaccagccgcgtcgcgacatggaccctcaggcgctggaggaactggcgcagtcgatcaaggcccagggcgtgatgcagcccatcgtggtgcggccgatcgccaatggccgctacgagatcattgccggcgagcggcgctggcgggccagccagcaggccggactggaaaagatcccggcgctggtgcgcgacgtgccggacgaagcggccatcgccatggcgctgatcgagaacatccagcgcgaggacctcaacccgatcgaggaagccgctgccctgcagcgcttgcagcaggagttccagctgacccagcagcaggtcgcggaagcggtcggcaagtcgcgcgcgaccattaccaacctgctgcgcctgatcggcctgccggaagagatcaagaccctgctttcccatggcgacctggagatgggccatgcccgtgcgctcctcggtctgccggcagaacggcaggtggaaggggcgcgacatgttgtcgcacatgggctgaccgtacgtcagaccgaagccctggttcggcagtggacgcatgcccctggcaagcctgcgggaccggtcaagagcgacccggacatcgcccgcctggaacagcgcctggccgagcgcctgggcgcttcggtgcagatccggcatggtcagaagggcaagggacagttggtcatccgctacagctccctggatgaactgcagggcgttctcgcccacatccgttga

SEQ ID NO: 2428 - DNA, 348 bp, Pseudomonas aeruginosa
ccatcgtctacctgtcgatggcgcacgaagacaaccattaatcgattcgcttcaacctttaaccaacacgacaaaaagtcgggaggaaaaatggaaactgtagttggactgactgctatcgccgttgctctgctgattggcctgggtgccctgggtaccgccatcggtttcggtctgctgggtggcaagttcctggaaggcgcagctcgtcagcctgaaatggttccgatgctgcaggtgaaaatgttcatcgtcgccggcctgctggacgccgtgaccatgatcggtgtgggtatcgccctgttcttcaccttcgcgaatcccttcgttggtcaaatcgccggctaa

SEQ ID NO: 2429 - DNA, 498 bp, Pseudomonas aeruginosa
cggacaacgaacgagcgaggtgttggcgtgaacattaatgcaaccctgattggccagtccgttgcgttcttcatctttgtgctgttctgcatgaagttcgtgtggcctccggtcatcgcggctctgcaagagcgtcagaagaagatcgctgacggcctggacgctgccaaccgcgcggctcgtgatctggagctggctcatgagaaagcgggccagcaactgcgcgaagccaaggctcaggcagccgaaatcgtcgaacaggcgaagaaacgcgctaaccagatcgtcgatgaagcccgcgaccaggcccgtaccgaaggcgaacgcctgaaggcccaggcccaagcggaaatcgaacaggaactgaacagcgtcaaggacgccctgcgtgcccaagtgggtgccctggccgtcaccggcgcagagaagatcctgggtgcttcgatcgacgcaaacgcgcacgagcagctggtttccaaactggcagccgagatctaa

SEQ ID NO: 2430 - DNA, 435 bp, Pseudomonas aeruginosa
ggcaagcgtatggccataacagtccattgcgacatcgtcagcgccgaggcggagatcttctccggcctggtcgagatggttatcgcgcacggcgctctgggtgacctgggtatcgccccgggccacgcgccgctgatcaccgacctgaaaccgggccccatccgcctggtcaagcagggcggcgagcaggaggtgtactacatctccggcggtttcctcgaagtccagccgaacatggtcaaggtcctcgccgacaccgtggttcgtgccggcgacctcgacgaagcggccgcccaggaagccctgaaggctgccgaaaaggcgctgcagggcaagggcgccgagttcgactacagcgccgctgccgcgcgtctggccgaagccgcagcccagctgcgcaccgtccagcaactgcgcaagaagttcggcggctga

SEQ ID NO: 2431 - DNA, 1389 bp, Pseudomonas aeruginosa
ccaccaggaacggtagtccagtccatgtcccttgaaatcgtgattctcgccgccggccagggcacccgcatgcgttcggccctgcccaaggtcctccatcccattgccggcaagccgatgctcggccacgtcatcgactgcgcgcgccagttgcagccggaacggatccacgtggtgatcggccacggcgcggatctggtgcgtgagcggatggccgccgacgacctgaatttcgtgctccaggccgaacagctcggtacgggccatgcggtggcccaggccctaccgttcctcagtgcagaccaggtgctgatcctctacggcgacgtgccgctgatccagctggacaccttgcagcgcctgctggcgcaagtcaccccggaccagttgtcgttgctcaccgtcgacatgctcgaccccaccggctacggccgcatcgtccgtgacgaccagggcgcggtgcaggccatcgtcgagcacaaggacgcgaccccggcgcagcgccagatcggcgagatcaacaccggcatcctcgcggtgccgggcaagcgccttgccgactggctcggccgcctgtccaacgacaacgcccagggcgagtactacctgaccgacgtgatcgccatggcggtcggcgacggcctggtggtggccagcgcccaaccgctggacgcgatggaagtgcagggcgtcaatgaccgcatgcaacaggcccagctggagcgtcactaccagcgcctgcgcgcagaggagctgatgcgccagggcgtgaccctgctcgatccgcagcgcctggatgtccgtggcgaaatctcggtcggccgcgacgtgctgatcgacgtcaatgtggtgctggaaggccgcgtggtgatcgaggacgacgtgcgcatcggaccgaactgcgtgattcgcgacagcgtcctgcggcgtggcgcggtgatcaaggccaacagccacctggaaggcgcggagctgggcgagggtagcgatgccggtccgttcgcccgcctgcgtccgggcagcgtgctcggcgctcgggcccatgtcggcaacttcgtcgaactgaagaatgcccgcctgggcgagggcagcaaggccggccacctgagctacctgggcgatgccgagttgggcgccaactgcaacatcggcgccggcaccatcacctgcaactacgatggcgcgaacaagttccgcaccgagctgggcgacgatgtgttcatcggctcgaacaactcgctggtggcgccgctgaagatcggcgatggcgcgacgaccgcggccggctccaccatcacccatgaggttccggcgaagaacctggccttcggccgcgcccggcagaagaacctggaaaactggaagcgcccggaaaaaatcaagaagtaa

SEQ ID NO: 2432 - DNA, 390 bp, Pseudomonas aeruginosa
cccccatccttatcgaaggcctcaagcgcctcgagtatcgcggctacgacagcgccggcgtggcggtcttcgataacgaaggcaggctgcagcgctgccgccgggtcggcaaggtcgccagcctggaggaaggcctggccggtacgccgctgctcggccgcctgggcatcgcccatacccgctgggcgacccacggcgcgccaaccgaaggcaacgcccacccgcatttctccagcgacgaactggcggtggtgcacaacggcatcatcgagaaccacgaacctctccgtgagcggctcaaggggctgggctacgtgttcacctcgcagaccgacaccgaggtcatcgtccacctgctgcaccacaagctgcagtccatcggcgacctga

SEQ ID NO: 2433 - DNA, 507 bp, Pseudomonas aeruginosa
cgctggcgcagcacctctcccgagagaagcaggccggcgaccccggtgccgttccaggcacccttggcgatcagtggcctgaggatgctccattgcctgcaccagcccagcgcatggccctcggcgcgcggtaccacggcttgcacgggaaggcgctggcgtgccatcaggaagaccagcacgcaaccgcacgagaccaacaggaagggcgccgcccagccgaagaagtccgagaggaggccggccagtgccgggccggcggcaatgccgagggtcatgccgagcatcacctggcccatggcaccggcctgtctttgcggggcgaccacctccgcgaccagggcgaaggtggtcgggatgatgattgccgaggcgatgcccccgatcacccgcaggacgacggcaatttccagggtcggggcgatgacgatggccagagtatcgaccgcgaagaggaccagggcgagcagcagcagcttcctgcgttgcatgcggtcggagaagtag

SEQ ID NO: 2434 - DNA, 438 bp, Pseudomonas aeruginosa
ccgagatcacccatcccagcctcgatgcgctgggcaaggcctacgtcgagaagcgtctcgacatcgaaggaccgatcagccaggtcatcggtatcggcgatgccctcagcgaagcgctcggcgaacccgatggcggcgcgccgccggttcgcgaaagccacgacaaggacacagacgccgaagccatccattaccactacgacctgtccaacgacttctaccagctctggctggatccggaaatggtctattcctgcgcttatttcgagaccggcaaggaagacctcgccaccgcgcaactggccaagctccgtcacctgtgccgcaagctgcgtttgcagccgggcgagaagctgctcgatgtcggttgcggttggggagggctggcgcgcctggccgctcgcgagttcggcgtcgaggtcaccggcatcacattga

SEQ ID NO: 2435 - DNA, 1044 bp, Pseudomonas aeruginosa
tctgcacgaagtcctgcgcggtcgaaggaagccgggacgcttccgcgacagcgcgacaacaacgataagaacaggagacttcccatgtcgctgagcagacgcttcggtcttttcacgcttgccgcaacggtgaccttcagtacctcggtctttgccgcgccgaccttcatcaatatcctcaccggcggcaccagcggggtctattaccccataggggtcggcctctcgcagatctacgggcacgatatccagggcgcgaaaacctcggtgcaggccaccaaggcttcggtcgagaacctcaacctgttgcaggccgggcgtggagaactggcgctggcgctgggcgactcggtcgccgacgcctggaacggggtcgccgacgccggcttcaaggcgccgttgaagaagctgcgggctatcggcaatacctatccgaactatatccaggtagtggccagccaagcctcgggcatcaagaccctggccgacctgaaaggcaagcgcatttcggtgggcgcgcccaagagcggtaccgagctgaacgcccgagcgatcttcaaggccgccggcctgagctacgaggacatgggcaaggtggagtacctgccctacgccgagtcggtggagctgatcaagaaccgccagctcgacgctacgctgcaatcctccggcctgggcatggcggccatccgcgacctggcctcgaccatgccgatcaccttcgtcgcgatcccggcggacgtggtggcgaagatcgacagcccggcctaccacgccgcgagcattcccgccggcacctacgacggccaggagcaggacgtgccgacggtggcgatcgacaatatcctggtcagccactccggggtcagcgacgagctggcctaccagatgaccaagctgatgttcgacaacctgccgcgcctggtcaccgcccatgctgccgccaaggacatcgccctggacaaggcggcgaagaacctgccgattccgctgcatcccggcgccgagcgcttctacaaggagaagggcgtactgcccgagtga

SEQ ID NO: 2436 - DNA, 1383 bp, Pseudomonas aeruginosa
gcgcccggcggtcgaactctgggcgtgtccgatacgggacccgagcgactgaacgtcctgtggataaccctgagacgccagtccacatccataaaaacgacgaagccggagctgcttccggtcataaggaaaacgtccatgcgtagctgtatatcagtcttccggccggccctgctggcactgttcgtctcggcaagcggctcggccggcgccgacgcggctgtggaaaacccgcggatcggccgtgccgccgatctctatgaactgatcccggaataccagccggacacctaccggaacatggacaaggtctatccgacccgggttatccacaaggggaccaaggtccgtccgctgccggcgggtgtggccatcgcgccgcgctaccggatcggcggcgaggaatacggcgtcgacgatttcatgcggcgcaaccgcgttggcggggtgttggtcctcaaggatggcaaggtcgccctggagcgctacggcctgggcaacgacgaacgcacgcgctggacctcgttctcggtggtcaagtcgatctcctcgaccctggtgggcgccgccgtgcagcagggcctgctggctctcgaccagcctgtggacaagtacctgccgagcctggccggctccgcctaccagggggtgacggtggagcaggtcctgcagatgagttccggggtccgctggaacgagacctatcgcgatccgaagtccgaccgcaggcagatgttcgacgcccagctcgccgaacgtcccggtggcatcctgcggctgctggcgagcctgccgcggcagtacccgagcggtacccacttcacctacagcaccggcgagtcgcacctgcagagtgagctgctgcacgcggcgacccgcattccggtgagcgactacctgtccgagcggatctgggcgcgaatgggcatggagagcgacggcttctggcaactggaatcgccggccgggcaagagatcggcagcagcggcttgagcgcgaccctgcgcgactatggccgcttcggccagttcgtcctcgagaacggggtgatcgatggcgaacgtatcctccccgaaggttgggtcgatcgtgccagtcgcgtcgaggcttcttcccacctggccccgggcaagctctacgatggcgaatacgcgctcggctacggctaccagtggtggaccttcccggtgggcgccaaggccctgcccgagcatgacggtggggccttcgaagcccagggcatcttcggccagtacctctacatcaaccgcaaggagaagatcgtggcggtggtctggagcgcctggccgaagccggagatggacgatcgcgaggaggagacctatgccttccttggcgcggcggtgaaagccctgcgctag

SEQ ID NO: 2437 - DNA, 1224 bp, Pseudomonas aeruginosa
tgccgacccttgcaatcgggtatttcgtcgatgaagcgccgtcgcctcctgcaaagcctgctcgccggcctggccctccagccgttcctggccgccagcgccaatgtacgaatccgccaggcccgggcctggaattcctcggaaagctggcgcctggtgctggaactggacggcccgccgcgttatcgaaccttttccctgcaggcccccgagcggttgatcctcgacctgcccgacgcgcaattgctcgcaacgctctccgagctgccgctggacggccccgtgcgcgccatccgcagcggccaactgggtggcggcgggacgcgcatcgtcctcgacctgcgccaggcggtcaggccgcgcagcttcgccctggaaccgcaggcgggaaagggccatcgcctggtcctggacctatatccacaggcgctggcggcgccccccgagccaatgctggcgctggcccgcccgctaccctcgacgggccgcgacatcctcgtggtggtcgatgccggccatggcggcaaggaccccggcgcggtcggtagcaagggcgagcgcgaaaaggacgtggcgctggctatcgcccgcctgctggcgcggcggatcgaccgcgagaaaggcttcaaggcgcgcctggtgcgcaacggcgacgtgttcgtcccgctgcgcaagcggccggaagtggcccggcgctacaacgccgacatgttcgtttcggtgcacgccgacgcggcgccgcgactgaccgcctccggcgcgtcggtatatgccctctccgagcatggcgccagctcgaccatggcgcgctggatggccgagcgcgagaacggcgccgacctgatcggcaacagcggcaacctgccgctacagggccgcgacaaggtactcgccggggtgatcctcgacatggccctgagttcgaccatcgccagcagcctggacctcggccacagcgttctcggccagttgtcggacgtcaccgcgctgcaccagaagcgtgtcgagcaggccggcttcgccgtgctcaagtcgccggacatcccttcgatcctggtggagaccggcttcatctcgaatcgcggcgattgtcgccggttgatggacgaacgccatcgccagcgcctggccgaggcgatcttcgctggcgtgcagggctacttccggcaacgccctcccgccggcagctacctggcggcgctcagcgcgcagcctcccggctag

SEQ ID NO: 2438 - DNA, 597 bp, Pseudomonas aeruginosa
ccgaacaggaactgcttgcccagcccgacgctgcctacatggacgaagcccagcaggacttcttccgcgacctgctgctgcgtcagcgccaggaacttcaggcgcgcatcgaaggcgaattcggcgagctgcgcgatctcgaacgccccagcgacgaggccgacctggcttcccgcgaggaacagcggcaatggcaacttcgcctgctggagcgggagaagaagctgctcgacaagatcgacgaagcgctggagcgcctggcccgcggcgactacggctggtgccaggaaaccggcgagccgatcggcctgcgccgcctgctgttgcgtcccaccgccaccctctgcatcgaggcgaaagagcgccaggagaagcgcgaacgccacgtgcggcacaactgaagaggttaccaaccgtgaaccaacgcctacctgtcaccgtgctgtccggctttctcggcgccggcaagagcacgctgctcaaccatgtgctgaagaaccgcgagaaccgacgggttgcggtgatcgtcaacgatatgagcgaaatcaatatcgatggcagcgaggtccagcgcgatgtcagcctgaaccgcgctga

SEQ ID NO: 2439 - DNA, 714 bp, Pseudomonas aeruginosa
cgccgagatgaacctgggcatccccggctggcagggcctggacgaccccttcgaggactgggggcacgccgcatgagcgcactgccgcaggaaaaaccgttgccgcgccaggcgttcgatgacgatccccaggtgctggccgaggtgcttcgcgagggcgtcaacctggcggtctggacacgccggttgagcccggcgctgcgcgacttcgccgccgccctggtgcgcaaccggccgggactggcgctgagccagacgctggagatggaagaggaacggctacccgtcttggacggcctgctcgacgcgcagcaactgccgggacaaaccgatttcctcgacgacctgggctggctggtcgaggccttctcctgcctgaccggggcgcggcgtatcggcctgcgcctgcgcgttctggataaaccgatgtgcccgcgtttccacgtcgaccacgtgccgctgcggctggtcaccacctaccagggcgccgccagcgaatggctggacgagtccggcctggaccgtcggctgcttggcggagcgcaggcggaagttgtcgatgaacagcttatccacagcttgtccacgggcgacgtggcgctgctcaagggcgaacgctgggagggtaacgaaggtgccgggctggtgcatcgctcgccgcgagcggagcccgggctggcgcgcctgctgttgaccctggactggcttgcctga

SEQ ID NO: 2440 - DNA, 732 bp, Pseudomonas aeruginosa
ccgtttttcgctggccgcgctcgccgaagaccaccccactgctcccgcccagggagacgaaagcgagtccctgccatgcgtgaatgcccagcgcggagaacccaacctgcgcgtggtggactgctccggcgcgcgccgcgacgaggaagtggcggtcgaggaagtgctgatcccctacgcccatggcagcgatcccgaagacgtccccggcgagccgcccaagtcgcgctggtggttgtcctccggcgcggcggtggcgatgcatgtggcgatcatcggtgcgctggtgtgggtgatgccgaccccggccgaactcaaccttggccacggcgaactgccgaagaccatgcaggtgaatttcgtccagctcgagaagaaggccgagccgaccccgcagccgccggctgccgcgccggagccgacgccgccgaagatcgaggaacccaagccggagccgccgaagccgaagccggtggaaaaacccaagcccaagccgaaacccaagcccaaaccggtggaaaacgccattcccaaggccaagccgaagccggaacccaaacccaagccggaacccgagccgagcacagaggcatccagccagcccagcccgtccagcgccgccccgccgccgcccgcacctaccgtcgggcagagcacgcccggcgcgcagaccgcgcccagcggctcgcaaggtccggccggcctgcccagcggcagcctcaacgacagtga

SEQ ID NO: 2441 - DNA, 1317 bp, Pseudomonas aeruginosa
ccgaggaccaccggttggcgcaggcggtggaagaggatagtgaccacacccgccaccagcatgatcacggcgaggtcctggatgaaatcgacggcatgcatggcggcggtcctcgctcggggaatgggtcggcagacgcggcgaccgggcggcctcgcagacccgcagactagcatccgcaagtgcttgatcggtgggctgaaaaaaactgtaacagacgtttcggcgaggctctgcgttgtgcttcccgggtcgccgggcggatcttcgcgcgccgatccgcgtgcatgcctgtcgtccccggcaacgaaggtgtaccctggcgccgacccgcgagccagacgcggcgggcgaaaaaacggcggccggggagcaatagcccgaaacaaaatccggctggtcctgtcgcccgtaccgccgcaacatggcgcgcgtcgattcccccaagagagaaagactacaatgcagcgtgttctcagcatcgccctcgccttctgcctggcgctgaccgtcagcctggatgccaatgccaagcgcttcggcggcggcaagagcctcggctcggcacccagccaccagacccgccaggcgcagccggccactgcgccgaacgccactgctgccgcccccaacgccgctcgtcccgccgctgccgccagcggtgcttcgcgctggctcggcccgctggccggtatcgccgcgggcggcctgctcgcttccatgttcatgggcgacggcttcgagggcatccagatgctcgacatcctgttgatcgccctggtggccttcatcgccttccgcttcatcgccgctcgccggcgccagcagaaccagggccagcctgcgatggccgggcacgcgccgatgcagcgcgaaatgccggcccaggcgccgatcttcggtggcgccgccgctgctgccgctgcgccgagcccggtgatcaacgcgccgagctggttcaacgaggagcgcttcgtcggtgccgctcgcgaacacttcatgtccctgcagcagcattgggatgccaacgagatggacaagatcgccgagttcgtcaccccgcagatgttgcaatggctgaagcaggagcgcgccgagatcggcgacgcctaccagtccacctacatcgacaacctggtcgtgcaactggacggcgtcgacgaccaggccgacaagacaatcgccaccctgaccttcagcggtgtgtcgaagacctcgcgcttcgaccagggcgaagccttcagcgaaagctggcggatggagcgcgcccagggcgagaaccagccatggctggtggccggtatccggcagaactga

SEQ ID NO: 2442 - DNA, 273 bp, Pseudomonas aeruginosa
tcatcgacgagacccacaccatctccacaggtcctggcggctgtacccgcgcctggaagctcgagccggacttcatcaccctcggcaagccgatcgccggcggcgtaccgtgctcggtgtatggttgcagcgcggcgatggccagcgccatgcaactggccagggcacgtgccagcgagcagagcgaaggccacggccacagcggcatgggtaccacgctgtcggccaacgccctggcgatgcgctgtatgcgcgccaacctggaagaggtga

SEQ ID NO: 2443 - DNA, 1476 bp, Pseudomonas aeruginosa
ccctgtgttgcccggacactcgcgaagaagatgtcgaccgcctgctctccagcctcgacgaggcgctcggcgagctgctcgccatacccggcgcgcgggaggcctgagatgcatttcgccgatccgcgggaagcccgcgagttcctcgccgcacaccccgaggtgcgcagcatcgagctgttcctgatcgacgccaacggcgtgccgcgcggcaagctgctgcatcgcgacgagctgctggcggtctacgaaagcgggcggccgctgccgagcaccatcctcggcctgaccatcaatggcgatgacgtcgaggagaccggcctggtctgggacgtcggcgatgccgattgctggaccttcccgctgcccggcagcctgaccctgcaaccctggcggcagtcaccgaccggccaggtgcaggtaagcatgcatcccgagctcgggctaccggccgcggcgggcgatccccggcatgtgttgcagcgggttatccacagcctgcaggcggagggtttccacccggtgatggcggtggagctggagttctacctgctcgaccgcgaacgcgacagcgacggccggccgttgccggcgttacagatgaatggccagcggccgcgggcgacccaggtctatggcgtctacgagctggagcagttgcagccattcctcgatgacttgtatgccgcctgcgaggcccagggcctgccggcgcgcacggcgatttcggagtacgcgccggggcaggtggaaattaccctgcagcatcgcttcgacacgctccaggcgatcgacgaaggcgtgcgctacaagcgcctggtcaagggcgtggcgaatcgccatgggttgcaggcctgcttcatggccaagccgttcgccgatctttccggcagcggcctgcacctgcacgtcagcctggccgacgccgctggcaacaatctgttcgccagcgaggacccggccgggaccccgctgctgcgccaggccatcggtggaatgaaggcgtgcctgctggagtctttggcgctgttctgtccgaacgccaactcgttccgccgcttccaggcgaacagctacgcgccgctggcgccgacctggggaatcaacaaccgcaccgtgtcgctgcgggttcccggcggcccggcgtccagccggcacatcgagcaccgcatctgcggcgccgacgccaatccctacctggcggcggcggcgttgctcgcggcggtgcgcctgggtattcgcgagcgactcgaccccggtgcgccgatcactggcaacggctacgctcaagccacccaggcgttgccgagcgactggctgaccgcgctgcgcgcgctggagggctcggcctgggcgcgcgaggcgctcggcgaggatttcctgaagatctacctggcgatcaagcaggccgaataccgtgccttcatgggcgaggtcggcgagcaggactggcgctggtatctcaaccaggcctga

SEQ ID NO: 2444 - DNA, 1452 bp, Pseudomonas aeruginosa
ctgccataccctgatgtcgaagattctcgcccgtaccggacgtctcgacgccctggtgaatgccgcgggcgtctggcgcgaggggcctgtggaaaacttcaccgaggaggatttcgacctggtcctgggagtcaacctcaaggcctccttctacatgtgccaggccgcgattccctacctgaaggaaaaccagggcagcatcgtcaacatctccagcgactccggacgccaggcctaccggggttcggcggcgtattgcgcgagcaaggcggcgctgaccatgctgagcaagaccctggcgctggaactggccgagcagggcgtgcgggtcaacgccgtgtcgccggcggatatcgccacgccgatgctcgactaccaggccgaacgctatgggatgggcaatccggatggctacaagcgcgcgctgctgaaggattatccacagggcaaggcggcacgcttcatccgcccggaagaagtcgccgagctggtctggtatctctgcggccctcaggccgaagcgatcacgggtgccgacctggcggtggacttcggcctgtccgctggccgctgagtggattttccacgggtcgctccgctggagcggcctgtggaaaagtttcagtcgtccctggcctgactggatatcttcacccagttaccggcggcggcgatgcccatgccgccgtaaccctggcagttcccgccaaggctctccaccactcgcaggtcgatgccttcctgccataccagcaggctgcagccggcgcccaggccttcgctgcgcagccggtagagcgcgccttgcccctccagccgaccggacagctcgccgaccgccgcgggcccatattccatcagtttctccggattgccgatgcgcatcagggcgaagctcgcctggtagccgcccttcaccggttcgatctgcaggctttcccattcggcctgcccggcgtagcgcaggtagtgcccggcgaggccctggagggacggatagtcgactttcagggcaacctgttccaggttgtagcgcgtggctttgccgctgtagccgcgatccagcgccaggttcatccaggcgcgggcgcgtcccggttgcccggccttgaggctggtcagcgcgagattgttcagcgcctgttccgagtcggctccgccctgctcctggcgctcggccaggcgcaattgccaggcgaaggcgtccagcgcctgtggataactcccctgtcgataagcctgggtgccgcgcgtgttgcattccgcggcggtggcgcagggcgtatcctcggcctggatggcagcggcaccgatgccggcaagcacggccagggccaggagaaggatgcgtatggcggcaggcattggagcgattcccggtggaaaagggccagtctagaaaagcccgcggatgtctgcacgacccggcgcgatttcgatcatgacgattga

SEQ ID NO: 2445 - DNA, 2016 bp, Pseudomonas aeruginosa
gaaaacgcagaggtttgcctctgctggcgtccattcctgacatttcttgataagaaaccggcgtgcctggtaaaactccagcaacgtcaacgggttaacctgtcggtatcgcgccgggtttcgccaggaaccatagccgccgtcgggtcgctcgaatgccatgggccggtcgctctgcccggctccgttggcggaaagcctttccgcctttccgccttgccgtcacgggcgcgggtccgtgatccatttcgaacgtcgtcgtccgccggccaggccgcggaggacgcgttccccgtgttgccgggagtcctgatgcaccatacgccgttactcactacactcgccgcggggttcgtcctcgccttcctcttcggggccctggccaatcgcctgcgcatttcgccgctggtcggctacttgctcgcgggcgtcctggccgggccgttcactcccggttatgtcgccgaccaggcgctgtcgcaggaaatcgccgaactcggcgtgatcctgctgatgttcggcgtcggcctgcacttctcgctcaaggacctgctctcggtgaaggccattgccattcccggggcgctggtgcagatcggcgtcgccacgctgcttggcatcggcctggccaagctgctcggctggagcttcggcggcggcctggtattcggcctgagcctgtcggtggccagtaccgtggtgctgttgcgcgccctggagcagcgccagttgctggacaccaagcgtggcaggatcgccatcggctggctgatcgtcgaggacctggcgatggtcctgaccctggtgctcctgccggcgctcgccggcaccctcggcggcaagaccgacggcggcgacgccggtctgctctggccgctgctgattaccctgggcaaggtcgccgccttcgtcgccctgatgatcttcggcggtcgccgggtggtgccctgggtgctggagaggatcgccgccagcggttcgcgggagctcttcaccctggccgtgctggccattgccctgggcatcgcctatggctcggcggtgctgttcggggtgtccttcgcgctaggcgccttcttcgccgggatgatcctcaacgagtccgaactcagccacgaggcggcggagaactcgttgccgctgcgcgacgctttcgcggtgctgttcttcgtctcggtggggatgctgttcaatccgatgatcctgttgcaggagccgctgacggtcctggccaccttcctggtcatcgtcttcggcaagtcggtggccgcctacctgatcgtccgtgctttcggccatccgaacagcaccgcactggtgatcgccgccagcctggcgcagatcggcgagttttccttcattctcatcggcctgggcattggcctcgaactggtgccggagcagagccgcgacctggtgctggccggggcgatcctgtcgatcctggtcaatccgctgctgttcatcgccatcgatcgcctgcagcaacgcaaggagcagcgcctggcggaggccgctggcggggtccgcgagatgccggcgcaggacctgccgccgccgatcctggagcgcgagcatgcggtgctgatcggtcatggccgggttggcgggttggtcagcgctcgcctgcgcaccgccgggacgcccttcgtggtagtggtggacaagcgcgacaaggccgacgaactgcgcgaacagggctacagcgtggtcctcggcaatgccgccagtcccggcgtgctggaactggccaacatcgccgaggcgcgctggttgctgatcgccattcccaacggcttcgaggccgggcagatcgccagccacgcccgcgcggtgaacccgccgctggacatcgtcgcccgggcgcatttcgacgccgaggtggactacctggagcagaacggcgccaacctggtgatcatgggcgagcgcgagatcgcctgcggcatggtccatcgcctgggactcgaccgtgacgagcgcggcgccgacgcaccgctgccgcagtcggcctga

SEQ ID NO: 2446 - DNA, 654 bp, Pseudomonas aeruginosa
cgacatgagcgaccaggtgatcttcgtcgacgacgaagcgacgatccgcgaagcggtgcagcaatggctggagctgtccggcttcgaggtgcgcctgtgcctgcgcgccgaggaatgcctgggagcgttggacaagtccttcgccggggtggtcatcagcgatgtgcgcatgcccggcatggacggcctgcaactgctcgccaacctgcaggcggtcgatcgcgacctgccggtgatcatggtcaccgggcacggcgacgtgccgatggcggtggaggccatgcgccagggtgcctacgacttcatcgagaaacccttcacgcccgagcgcctgctcggcagtttgcggcgcgcgctggaaaagcgccgcctggtgctggagaaccggcgcctgaaggagcaggccagtctcaaggaccaggtcgatgcgcgtctgctcggcgtgtccaagccgatggaagcgttgcgccggcaggttctggccctggcgccgaccccggtgaacgtcctgatccgtggcgagaccggcagcggcaaggaactggttgcccgctgcctgcacgacttcgggccgcgcgccgacaagccgttcgtggcgctgaactgcgcggcgattcccgagcaactgttcgagagcgagctgttcggtcatga

SEQ ID NO: 2447 - DNA, 852 bp, Pseudomonas aeruginosa
gagcggtgcgttcaccggcgcgcagggcaagcgcatcggcaagctcgagcatgcccatggcggcaccctgttcctcgacgagatcgaaagcatgccgttggcgcagcaggtcaagctgctgcgcgtcctgcaggagcagcaactggagcggctcggctcgaaccagagtatccacgtcgacctgcgggtgattgccgcgaccaagcccgacctgctggccgaagcacgtgccggacgcttccgcgaggacctggtgtatcgcctgaacgtcgccgagctgcgcctgccgccgatccgcgagcgtcgcgaggacatcccgctgctcttcgaacatttcgccagcgttgccagccagcgcctcggccgcgagccgcagcccgccgcgccggcggaactggcgcggctgatggcccacggctggccgggcaatgtacgcgagctggccaacgccgccgagcgtcatgtcctcggcctggagcgtggggacgccgaggaaggcggcggcctcacctcggggctggcggaacgcatggaagccttcgaggcggagtgcctgcgccaggcgctcggccagtgccgcggggatatcaaggcggtgatggagttgctgcaactgccgcgccggacactcaacgaaaagatgctgcggcatggcctcagccgcagcgatttcgtcggcgaagagccggcctgaaccagccctcgcgaggcgtcagagatccttcgccaactccgttggtgcctggcgcccgccgcgttgcagcaacgccaggtagaccagccccaccgcgatccaggccagtccgagcaactgtgcgtcgaggctcatgctgtacagcacgtaggcgatga

SEQ ID NO: 2448 - DNA, 708 bp, Pseudomonas aeruginosa
ccaggcgtaccggctgcaggcggttcacaggttgctccggccgagggcggcgatgcgttgcaggacggtctcggtgtcgctgatccagcagtagcccttgatcgcttccaggcaggcctggtggcgttccggggtatgggtggcgcaggcatcctcgaccagggtgaccaggtaaccgcggtcggcggcatcgcgcacggccatgtccacgcactggtcggtgaccaccccgcagacgatcaggtggcgggtgccgaggttgcgcagtacgtagtcgatggcggtggagttgaaaacgccggaagaagtcttcggcagcacgatctcgttggcggtcggctccagggcgtcgatcaccctggcgtccgggctgcccttgggcaggtgcatctccgacagcttgtgatccagcgagcggtcgcgaccatcggcggtgaggctctcgatgacggtgtgcaggacgttctcgtccactgcgcgcatggccctgagcaggcgctgctggttggggatcacctggttctgcacgcgctcgtagaagtaaccggctgcctgcggatcgacgtgcgggtcgcgccccggctcgacccaggcacgctgcatgtcgacgaacaggatggcggtctgccggcggccgaatggcaggtcgcgcggcgagtggtggggcaggctgaacatcgggtcattcctccagaatatgactgctga

SEQ ID NO: 2449 - DNA, 519 bp, Pseudomonas aeruginosa
ccgcggcgctcagggttttgggcttggccggcaagcttacttgcgcgagaagtgcaccaccagcttgtcgcccacggtttgcagaatctggacgaggatcagcagcatcaccaccgtgaccaccatcacgtcggtctggaagcgctgatagccgaagcggatcgccaggtcgcccagcccgccggcgccgaccactccggccatcgcggtgtacgagaccagggtgatggcggtgacggtgatggcggcgatgatgcccggccgggcttccggcagcagggcgttccagatgatctgccgggtgctggcgcccatcgcctgggttgcctcgatgatgcccttgtcgacctcgcgcagcgcggtttccaccaggcgcgcgaagaacggcgtggcgcccaccaccagcggcgggatggccccggcgacgcccagcgaggtaccggtgatcagtacggtcagcgggatcatcacgatcagcaggatgatgaacggcaacgaacggaggatgttcaccactag

SEQ ID NO: 2450 - DNA, 729 bp, Pseudomonas aeruginosa
cgctcgtcttcgtcgacccgttcggcctcgaacacgaagcggcgtgtggtcgggtgctgcggatggaggaagacatcggcgacatcgccctgctcgacgatggcgccgccgtccatgaccgcgacctggtcgcagacacgacggatcacgtccatctcgtgggtgatgaggacgatggtcagcttcagctcgcgattgatttccgccagcagttgcaggaccgaggcggtggtctgcggatcgagggcgctggtggcctcgtcgcagagcaggatgctcggccggcaggccagggcgcgagcgatgccgacgcgctgtttctgtccgccggagagctgggccggatacttgcgcgcgtggtcggacaggccgacccgcgcgagcagctcggagacccgcgcatcgacttcggcacggctgaagccgccggccaggcgcaggggcatggcgatgttgtcggcgacggtcttcgaggacagcaggttgaagtgctggaagatcatcccgacgcgctggcggaaacggcgcaggccttcggcgtcgagggcggtgacgtcttcgccctcgaccaggatgcggccgccgctgggctcctcgaggcggttgatcaggcgcagcagggtgctcttgccggcaccggaatggccgatcaggccgaaaatctgcccggcctggatgttcaggcgggtcggttgcaaggcggggatttcccgaccggcaactcgatag

SEQ ID NO: 2451 - DNA, 915 bp, Pseudomonas aeruginosa
ccagcagcgccgccgccaggacggacagcaggcgaaagaaggacgacatcattcctgcgggttctcgtttggtcaaaaaatcgccagattctacaccgtgcggcggggcaggacaaaactcagcaggaacaggccggcggcgctgaccacgatcgaggggccggcgggggtatccttgaaccaggacagggccaggccggcgcacaccgcgaccagtcccagcaggctggcgccgaccgccatctgctcgggactgcgggcatggcgctgggcggcggcggcgggaatgatcagcagcgaggtgatcagcagtacgccgacgatcttcatcgccacggcgatgacgatggcgatcagcaacatcagcgccaggcggatcgctccgaccggcaggccttccaccttcgccagttcctcgtgcacggtgatcgccagcagcggccgccagaggaagcagatcagtgccaggaccagcgcgctgccggcgattatccacagcaggtcgctggcgcttaccgccagcagatcgccgaacaggtaagccatcaggtcgacccgcacttccttcatgaagctcagggtgaccaggcccagcgacagggtgctgtgggcgaggatgcccagcagggtgtcggcggccagcggctggcgctgctgcagggtcaccagcagcactgcgagcagcacgcagccgacggtcacagccagggtcgggctgacatcgaggaggaaacccagggctaccccgagcagtgcggcgtgggacagggtatcgccgaaataggccatccgccgccagaccacgaaggagcccagggggccagccaccagggccagggcgaggccggcgaggagggcgttgagcaggaagtcagccatggttgcagtcggggccgtgcttgtggacaggagtga

SEQ ID NO: 2452 - DNA, 1539 bp, Pseudomonas aeruginosa
aggacacgccgacctgggtcagccgcaccagcgcgttgtccatcaggcgtccttctggtcccggcaggtgccgcagaggccgaccacctcgacggtctggctttcaacggcgaagccgacgctgttcgctccggcgacgatggcccggctgatatccggctgttccagctcgatcgcggtgtggcaggtgcggcagatgaggaactggccctggtggctgtgctccgggttgttgcagccgacgaacgcgttgagcgaggcgatgcggtgcaccaggccgttctcctggaggaagtccagcgcgcggtagacggtcggcggcgcggcgcggcggccgtcggtttcgctgagcaccgcgaggatatcgtaggcccccagcggcttgtggctctgccagaccagctccagcacgcgccgccgcaattcggtcaggcgtacgccctggcgcgcgcacagcgcatcggcctcggccagcgcggtgctgacgcactggctgtggtcatggggctggcaggccagcggggtcttgggcgcaatcttgtacatgggctgcgacgctcgagggtagagacgttattatattacccgctaaccacctttcatgtgagtgccgccgtgaccctgcgtccctttgccctgctgtccgcctgcttcgccctgttcctgctggcttcgccggcgcgcgccgaggtcagcgtgctgaccagcatcaaaccgctgcaactggtcgccgcggccatccaggacggcgtcggccagccggacgtactgctgccgccgggcgcctcgccgcaccagtacgccctgcgtccttccgacgtacggcggctgcgcgaggtgcaattgttctactggatcggcccggacctggagaacttcctgcccaaggtgctcgccggccgccagggcgccagcgtcgcggtgcaggacctgccgggcatgcacctgcgcaagttcgtcaatttcgaggaagaggagcatgccgggcacgacgagcacgaccatgaccatcgtcccggcatgctcgacgcccacctctggctgttgccggccaacgcccgcaccatcgccgcgcggatggccgaggacctggcccaggtcgacccggccaacgccgggcgctaccgggccaacctgaaggccttcgaggagcgcctcggcgggctcgacggcaaactccgcgaacgcctgggcaagcttgccggcaagcctttcttcgtcttccatgaagccttcgactatttcgaggaagcctacggattgcgccataccggcgtgttcgcggtatccgcggaggtccagccgggagcacgccatgtcgccgccatgcgcgcccagctgaaggccgccggtccggcctgcatcttcagcgagccgccgcttcgaccgcggctggccgacaccctcagcgaaggcctgccggtgcgcctggccgaactggacgacctgggcgtgaacgtgagcgtggacgccaacggctatgagaatcttctgaacaacctggcaggcgaatttgccggctgtctggaaaagctctga

SEQ ID NO: 2453 - DNA, 1008 bp, Pseudomonas aeruginosa
gttcagcaccctgcgcccgcgcggcgcctacgtttccggtgccggtgcctacaccagcgggccgctgtcgttcatggacatctacgacaagatgtgcttcaccgtcagctccgcaggcggccgccgcggcgcgcagatgggcaccttcgatgtcagccacccggacgtccgcgaattcatccgcgccaagcgcgaggacgggcgcttgcgccagttcaacctgagcctgctgatcaccgaccagttcatgcaggcggtggaacaggacgccgactggccgctggtattcccggtgcacgtgaaggagcgcgacgagatcgacctcgacgaccccaacgcggtggtctggcgcgaatggccgatccaggacgactacgttcagcgcgccgacgggctggtcgcctgcaaggtctacggccaggtccgcgcctgccacctgtgggacatgatcatggtctccacctacgactatgcggagccgggcttcatcctcatcgaccgggtcaacgaactgaacaacaactggtggtgcgaggcgatccgcgccaccaacccctgcggcgagcagcctctgccgccgtacggctcgtgtctgctcggctcggtcaacctcacctgcttcgtcgagcagccatttggcgacgaggcgcgcttcgactgggaccgtttccgcgaagtggtgcgggtgtttacccggatgctcgacaacgtggtggaaatcaacggcctgccgctggaacagcaacgccaggaaatccttggcaagcgccggcatggcatgggcttcctcggcctgggctcgaccctgaccctgctcaagctgcgctacggcagtcccgaggcctgcgtattcaccgaggaagtggcgcgggaaatggccctggtgggctgggaagtggccctggagctggccagggagaagggcccggcgccgatcctggcgcaggactacgaagtcactgcggaaatgcttcgcaagcgtccggaaatggccgccgatggctataa

SEQ ID NO: 2454 - DNA, 612 bp, Pseudomonas aeruginosa
aggaagccattcacgcggtattcctggatggtcttgtcgccctcctggcggatggttacgtcgggctcgccggagggcgcgtcgtcgtccgccgccatcgcgacgagcggggcgaacgccagcagtccggcgagcatcaagcggttcagcgtacgcatggtaaccttgctcctttatcgaatcgtccagggttcattctacacgccctggtctccggaaaaggttgattcccctcatgagccaagcgcccctcgtcctggtggacggttcctcgtacctgtaccgcgccttccatgccctgccgccgctgaccacctcgaccggcaagcccaccggtgcggtgaagggcgtgctgaacatgctcctgagcctgcgcaagcagtacccggacagcccgttcgcggtggtcttcgacgccaagggcccgaccttccgcgacgagctgttcgccgagtacaaggccaaccggccgtcgatgcccgacgacctgcgggtccaggtcgagccgctgcatgccagcgtccgcgcccttggcctgccgctgctgtgcgtggagggggtcgaggccgacgacgtgatcggcaccctggcgcgcagcagcgccgcggctga

SEQ ID NO: 2455 - DNA, 1407 bp, Pseudomonas aeruginosa
cgcggtgctgcgtgcgttgaaaccgctgctggaggatccgaagaagctcaaggtcggccagcatgccaagtacgacatcaatgtcctggccaatgccagcacccccatcgcgctgcggggcgtagcctacgacaccatgctcgagtcctatgtgctggactccaccgccactcgccacgacatggacagcctggccctgaagtacctcggccacagcaccatccgtttcgaggacatcgccggcaagggcgccaagcaactgaccttcgaccagatcgccatcgaacaggccgggccctatgcggcggaggacgccgacgtgaccctgcgcctgcaccaggccctgtggcagaagctggaggcgatcccgtccctggccagggtcctgaccgacatcgagatgccgctggtaccggtgctggcgcggatcgagcgcaacggcgcgctggtcgacgccaacctgctgggcatccagagccgcgaactgggcgagaagatggtcgccctggagcgccaggcatacgacctggctgggcaggaattcaacctcggttcgcccaagcagctcggcgcgatcctctacgacaagctcggcctgccggttctgagcaagaccgcgaccggccagccgtccaccgccgaggcagtgctcgccgaactggccgagcaggacttcgagctgcccaaggtgatcatgcagtaccgctccatgagcaagctcaagagcacctacaccgaccgcctgcccgagcagatcaacccgcgtaccggacgcatccatacctcataccaccaggcggtggcggctaccgggcggctgtcgtcgagcgacccgaacctgcagaacatcccgatccgtaccgcggagggccggcgcatccgccaggcgttcgtcgcgccgcagggctacaagctattggccgcggactactcgcagatcgagctgcggatcatggcccacctggccaaggacgatggcctgctggatgccttccgccacgacctggacgtacaccgcgccaccgcggcggaagtcttcggcgtgccgctggaagacgtcagcggcgaccagcgacgcagcgccaaggcgatcaacttcggattgatctacggcatgagcgccttcggcctggccaagcagatcggtgtcgagcgcaaggaggcccaggcctacatcgaccgttacttcgcccgctaccccggcgtcctggcgtacatggaacggacccgcgcccaggccgcggagcagggcttcgtcgaaaccctgttcggccgtcgcctgtacctgccggagatccattcgaagaacggcgccatgcgcaaggccgccgagcgcaccgcgatcaacgcgccgatgcagggcacggcggcggacatcatgaagcgcgccatggtcgctgtggataa

SEQ ID NO: 2456 - DNA, 480 bp, Pseudomonas aeruginosa
catgggttatccacaggggtgcgactcggtgtcgcggggggctgtttcgtttccgtttcggtatcggaagtatataatgccgcggattttgtgtgcgctttatcccccagggtcgagcgcgcgcgggaacggacagagcattttccgcgcggtagaacgcgggcgttccccctgatgaggacgatcatgaagaaactgctgctcgcagcgacagtcgttgcggtggccgttacggcgcatgcggcgcaggacccggaagcagtgttcaaccggacctgtggcgcgtgtcacgacggccagctgccgatggcgccgaaaaagggcgaccatgccgcctgggagccgcggctggccaagggcatgccgaccctggtccagcatgtgaccaacggattcaacgccatgccgccccgcggcctgtgcaccgactgcagtgccgaagactaccaggcaaccatccagtggatggtgaagaagtag

SEQ ID NO: 2457 - DNA, 609 bp, Pseudomonas aeruginosa
ctgatgaacaaacttctcgtgagtctgctgttgaccctgggtctgaccggccttgcccatgccgctggcgatgccgccgcgggccaggcgaaagccgcggtgtgcggcgcctgtcacggtgcggatggcaacagcccggcgccgaacttcccgaaactggccggccagggcgagcgttacctgctcaagcagatgcatgacatcaaggacggcaagcgtaccgtgctggaaatgaccgggctgctgaccaacctcagcgaccaggacctggccgacatcgccgcctacttcgccagccagaagatgagcgtcggcatggccgatccgaacctggtggcccagggcgaagcgctgttccgcggcggcaagatcgccgaaggcatgccggcctgcaccggttgccattccccgagcggcgtcggcatcgcaaccgccggtttcccgcacctgggcggccagcacgcgacctacgtggccaagcagctgaccgacttccgcgaaggtacccgcaccaacgacggcgacaccaagatcatgcagtccatcgccgccaagctgtcgaacaaggacatcgccgcgatttccagctacatccagggtctgcactga

SEQ ID NO: 2458 - DNA, 642 bp, Pseudomonas aeruginosa
cagtctggcggccgaaggcagcgacaaggcggtcgaccagtgcatgaaggagctgcgcgagatcctccgtcgcgacgacatggacgccggcctgtcgggcctgattccgcgcctggaaaaggccgtgctcgactccgaacagcgccgccagcaacgcacccagcagaacatcgatgctctcggcgaactggcccagcagttgctggccctggacctgccgcgggaactgcgcaagccgctgaagcagttcgcccgcgatatcgaggagcgcgcccggcagtcgcgcgagattccgatcctgctcagcgagctgagcaggctgcaacgccaggcgctggccgagcgcaagggcggcgatgccgaagacggtcgcccgagcctgttgcaacgcctgttcggcggcaaggagtcggaaaccaccgcggagccgagcgcatcggtgccgtccgttgtggcggcaagcaatacaccgatccaaccggcggcggccgcgccgtccctgccggtcgccgagcacgacgaggcgccaggcggtccgccgcagccgttgcccgcctgcacggtcgccgccatcgaaagcgcgccagcgggttgggtcggggtcgccgagcgtggcgagccgaaccagatcctgctggatga

SEQ ID NO: 2459 - DNA, 789 bp, Pseudomonas aeruginosa
gcaggtcagtggcctgcaggccagcgtgcagcaggcgaccgacctgaacagcctcaagctggcggtggacagccggctgaacggcctgcttgcctccatggacgaacaccagcgcgaacaggccgagcacgaacaggaggtgtccggccgcctgcaggcgctgatggagcgggtcaacagcatggagcaggatgccaaggcgttccacagccacctggaggaccagcgacagaaagccctgaccgatccgctgaccggcctgcccaaccgcgcggcgctcagcgagcgcctggaacaggaagtggcgcgccggcaccgggacggcggcgatctgctgctggcggtgctggacatcgaccacttcaagcggatcaacgacgacttcggccacctggccggggacaaggtgctgaagatcattgccggcgaattgcgcaaacggttgcggcaggccgatttcatcgcccgtttcggcggcgaggagttcgtcgtcctgctcccggccacgtccctggaagccggccggcaactgctcgaacggctgcgcgcggcgatcgccgcctgtccgttccatttcaagggcgagcccctgagcatcacctgttccgccggcatcaccgcgttcgaaggcaacgaggccggcgaagcggttttcgagcgtgccgaccaggcgctgtatcgagccaagcgcgccggccgggaccgcctggaagtggcctgaagggcgaccagcgcacattccgacgactcgggacgggctcgcctgcaggtgttgccgcggctcgctag

SEQ ID NO: 2460 - DNA, 813 bp, Pseudomonas aeruginosa
cgcgagaagttcaacaggtcgttgatcagcaggaccagccgcgacatctcttcgtccaccgtctggatcaggtccgcttcccgtgactccgcggggaagtccaggcgttcgcggagcaggctgaaggccatctgcatgccggtcaccggcgtacgcagttcgtgggaggcacgcaggacgaattcgctgcggacccgttcgaaggcgcgctgctcggtcacgtcgcggaccaccagcaccgcgccgacgctatgcccgccgggatgggtgaccggatacagcgaccaggccagcaggcgcgactcgccggcgacgtccaccaccaggtcgggcatcgcctcgtcctggacttcgccgagcagggccttttccaccgcctcctggacatcgacatcgctgagtatttcgtcgatccgcttgccatgggggtcgttggagacgaacagctggcggatcgcgaccgggttggcgtgttcgatgcgtccctggttgtcgaagatcaccaggccgtcgtcgatgctgtcgagtaccgcctgcaggcgccgctcgccggaaagcacctcttcgacgctggtcttgcgatactgccgcagggcctcggccatcaggccgaaacgccgggtcaactggccgacctcggcgacgttggtcatcggcagggtcacgtcgaaatcgccttcgccgatcctgtccgccgcccgcgccagggtttcgatcggcgcgccgaagcgccgggcgatgctgtgggcggtgacgaaaccgatcagcaggatggcgacgcccaccaggccaagcaggccggcgaccaggtag

SEQ ID NO: 2461 - DNA, 1446 bp, Pseudomonas aeruginosa
cgaaacatgggtaaagccaagctaagcctcgcctggcagatcgtgatcggtctggcactcggtatcgccgtcggcgcagtgctcaaccatttcagcgccgaaaaggcctggtggatcgccaacgtgctgcaaccggccggcgacatcttcatccgtctgatcaagatgatcgtggtgccgatcgtgatttcctcgctggtggtcggcatcgccggcgtcggcgacgcgaagaagcttggccgcatcggcctgaagaccatcatctacttcgagatcgtcaccaccgtcgccatcgtcgtcggcctgctgctggccaacctgttccagcccggcaccggcatcgacatgagcaccctgggtaccgtggacatttcccagtaccagaagaccacccaggaagtgcagcatgaccatgcgttcatcgcgaccatcctcaacctgattccctccaacgtcttcgccgccatcgcccgtggcgagatgctgccgatcatcttcttctcggtgatgttcggcctcggcctgtcgagcctgcccaacgacctgcgcgagccgctggtgaaggtgttgccagggcgtttccgagaccatgttcaaggtcacccacatgatcatgaagtacgcccctatcggtgtcttcgccctgatcgcggtgaccgtcgccaacttcggcttcgcctcgctgctgccgctggccaagctggtgatcctggtctacgtggccatcgtcttcttcgccctggtggtgctgggcctgatcgcgcggatgttcggcttctcgatcatgcgcctgatccgcatcttcaaggacgacctggtcctcgcctattccaccgccagctcggaaaccgtgctgccgcgcatcatcgagaaaatggaagcctacggcgcgccgaaggcgatcagcagcttcgtggtgcccaccggctactccttcaacctcgatggctcgaccctgtaccagagcatcgcggcgatcttcatcgcgcagctctacggcatcgacctgtccatcggccagcagatcatgctggtgctgaccctgatggtgacctccaagggtatcgccggcgtgccgggcgtatccttcgtggtgctgctcgccaccctgggcagcgtcggcatcccgctcgagggcctggccttcatcgccggcgtggaccgcatcatggacatggcgcgcaccgccctcaacgtgatcggcaatgccctcgcggtgctggtcatctccaagtgggaaggcatgtacgacgcggccaagggccagcgctactgggattcgctgccgcacctgcggcaggcggtcggcgaagccaagggcaagcaggccaccctcgaataaggcggcttcccgcccaggaggccccggcatcgtccggggcctcggcgtttctggcgccggcaccgcctgcgccgctatcatccgcgcaacgcgggggattctga

SEQ ID NO: 2462 - DNA, 1230 bp, Pseudomonas aeruginosa
atgctgaacggcttgtggttgggttttttcctggtggcggcggcgagtgcgctggcgcgctggttgatcggcggcgatgcgacggtgttcgcggcgatggtggagagcctgttcgccatggccaagctggcggtcgaggtgatggtcctgctgttcggcaccctgacgctctggctcggctttctgcgcatcgccgagaaggccgggctggtggagcgcctggcggtgctgctcggtccgttgttccgccggctgatgccggaagtgccgccggggcatccggcgatcggcctgatcaccctgaacttcgccgccaatggcctgggtctggacaacgccgccacgccgatcggcctgaaggcgatgaaggcgttgcaggagctcaatcccagcagcaccaccgcgagcaatgcgcagatcctcttcctggtgctcaacgcctcgtccctgaccctgctgccggtgactatcttcatgtaccgcgcgcagcagggcgcggccgatccgaccctggtattcctgccgatccccctggccaccagcgcctcgaccctggccggcctgttgtcggtggcgctgatgcagcgcctgcgcttgtgggacccggtggtgctggcctacctgatccccggcgcgttgctgctggccggcttcatggcggtgctcggcacgctctcggccaccgcgctggcgcagctgtcctcgctgctgggcaacctgacgctgttcagcctgatcgtgctgttcctgatcgtcggcgcgctgaagaaggtgccggtctacgagagcttcgtggagggggcgaaggaaggtttcgacgtcgccaggaacctgttgccgtacctggtcgcaatgctttgcgcggttggcgtgttgcgcgcctccggggcgctggaagtggtactcggcgggatacgctgggcggtcgaggggctgggttgggacagccgcttcgtcgaagcgctgcccaccgcgctggtcaagccgttctccggcagcgcggcgcgggcgatgctgctggagaccatgcagacccacggcgtcgacagtttcccggcgctggtcgccgccaccgtgcagggcagtaccgagaccaccttctacgtgctcgccgtctatttcggctcggtcggcctgcagcgcgcgcgccacgcggtgggctgcgcgctgaccgcggacctggccggggtcatcgcctccatcgccgtgtgctactggttcttcgcctga

SEQ ID NO: 2463 - DNA, 1467 bp, Pseudomonas aeruginosa
atccaaaggtttcgccattttccgtgtggtcagtggcaacttcctcgagatgtacgacttcatggtgtatggcttctacgccaccgccatcgccaagaccttcttccccggcgacaacccgttcgcctccctgatgttgtccctcgccacctttggcgccggcttcctgatgcggccgctgggtgcggtgttcctgggcgcctacatcgatcgccacggccgccgccagggcctgatcatcaccctcggcctgatggccatgggcaccctgctgatcgccttcgttcccggctatgccacgctgggcgtggcggcgccgttgctggtgctgttcggccggctcctgcagggtttttccgccggcgtcgagctgggaggggtttcggtctacctgtcggagatcgccacgccaggacgcaaaggcttcttcgtcagttggcagtcggccagccagcaggtcgcggtggttttcgccggcctgctcggcgtgctcctcaaccagtggctgagcccgcaggacatgggcgaatggggctggcgcgtgccgttcttcatcggctgcctgatcgttccggcgctgttcgtcatccgtcgctcgctggaggaaacgccggagttcgaggcgcgcacccaccgaccgtcgctgtcgcaggtgctgcgctccatcgggcagaacttcggcgtagtgctggccggtaccgcgatggtggtgatgaccaccgtatcgttctacctgatcaccgcctacacgccgaccttcggcaagaacgaactgcaactgtcggacctcgacagcctgctggtgaccatgtgcatcggcctatccaacttcatctggctgccggtgatgggcgcgttctccgaccgcatcgggcgcaagccattgttgctgggtgcctccgcgctggcactgctgaccgcctacccggcgctgtcctggctggtccgcgagccgagtttcgccggcctgctcggcgtcgagttgtggctgtcgttcctctacagcagctacaacggcgcgatggtggtggcgttgaccgaggtgatgccggcggacgtgcgcactaccggtttctccctcgcctacagcctggctacggcgaccttcggtggtttcaccccggcggtctgcacctggctgatccacaccctggacaaccgcgcggccccgggcatctggctcagtggcgcggcgctgctggggctgctcgccaccctggtgctgttccgccggcgcggcaaggagatcgccgaggccgagctggccaacgcctgaggcgtttcgccgcatgccgtgcgtcggctcccgccggggctgcggcggcggcgttgatgtcgatcaaccggagctgcgccaaaccgcgtagacaggaaggaagtggttgtaccgacttccttcccttcctggagatcgcatcatgtccaatgtacaaaatgccagccggtcttccgcgttcgcggcggtag

SEQ ID NO: 2464 - DNA, 471 bp, Pseudomonas aeruginosa
gaaatcatggcgaacaacgcgccggtcagcgcgtcgagcatgatgtcgccggtcaggctggagaacagtaccttgacgcccttggcttgggtcatcggctcggcggcggcgacgatcagctggagcgccaggatgatcaggccgaggccgatgaatacccggccgagctggccgaggcgggtctgtttgcggctgaggaagaaaatcacgccgaagaagatcagcaatggcgaaagccacgacaggtcgagggtcagcacccgcgccatcagcgcggtgccgacatcggcgccgagcatgatcgccagggccggcgccagtgccatcaggccctgggcgacgaaggaggtggccagcagggcggtggcgttgctgctttgcaccagggcggtgacgccgatgccggcggcgaacgccagcgggcgtttttccacgctgcgactgaggatgcgccgcaggtcggcgccgtag

SEQ ID NO: 2465 - DNA, 762 bp, Pseudomonas aeruginosa
tcgcctcggacagcacctggatcgaaggcaaggcgatccagcaactgcaaaccaccgccgagctggacggcatgtgccgcgtcgtcggtctcccggacctgcatcccggccgcggctatccggtcggcgcggcgttcttctccgtcggtcgcttctatccggcgctggtcggcaacgacatcggctgtggcatggccctgtgggaaaccggcctggcccccggcaagctgtcggcggacaaactggaaaagcgcctgggcaatctcgacctgccgctggacgagacctggagcgactgcatcgaagccctggatctaccggcccgcgagcactggcgcgcgctcggcacgatcggtggcggcaaccacttcgccgagctacagcaggtcgagaccgtgttcgaccaggccgccctgcacgccctcggcctcgatgccggccgcctgcaactgctggtgcacagtggctcgcgcggtctcggccaggcgatcctgcaagaacaggtcagcctgcatggccacgccggcctgctcgacggcagcctggaagcttccgcctacctggcgcgccacgccgatgcgctgcgcttcgccgagggtaaccgccagctcatcgcccggcgcattctcgaacgcttgcgctgcgacggcttggaactgctcgacatcaaccacaacctggtggcgccggcacaggtcgatggcgtcgacggctggctgcaccgcaagggcgccaccccggccgaccagggcgtgctggtga

SEQ ID NO: 2466 - DNA, 1095 bp, Pseudomonas aeruginosa
ccagcacgccaacaaacgcctggcgatcctgctgatcgcccggcgcctcgcggaccaggcgagcagcgcggccgacgcgctgcgcgcggagcgccgccgggcccacggtcggatcagtcgcggcgcggctcgccgggtattccgcggcgagcgtttcgagccggcctgagcggctcagtcgccgagcacttccttgcgcagcttcactggctcttcgccccgcttgcgcgcggcagcgccgcgcatgcggatgttcagcgcctccacggccagggagaagcccatggcgaagtagacgtagcccttcggcacatggacttcgaaggcttcggcgatcagcaccgtgccgaccacgatgaggaacgacagggcgagcatcttcagcgacgggtgcttgtcgatgaagtcgctgatggcgccggcgcagagcatcatcaccagtaccgcgacgatgatcgccgcgaccatcaccggcacgtgggagaccatgccgacggcggtgatcaccgagtccagggaaaagacgatgtcgatgatcgcgatctggatgatggtgccgatgaagccgcccgccgaccccttcggttcatcgccgctttcttcctcgccttccaggccctggtagatatccgagctgcttttccagagcaggaacaggccgccgaagaacaggatcaggtcgcgtccggagatgccctggccgaacaggtggaagaggtcggcggtcaggcgcatgacccaggtgatcgacagcaacagcaggatccgcgtcaccatcgccagggccaggccgaagaagcgggtgcgtggctgcaggtgcttcggcatgcgcccgaccaggatcgagatcatgatgatgttgtcgatgccgaggacgatctccagggcggtcagggtgaagaacgcaatccagatttccgggctggtcagccattccatgaagcggtcactcgtctcggtcagttactgaacagggggaacaggcccagcagcagggccatggcgaggattgccaggcacaccagcacggcccatttcagggtgaagcgctggtggtcgccgaagtcgatcttggccagccccaccagcaggtag

SEQ ID NO: 2467 - DNA, 729 bp, Pseudomonas aeruginosa
gggcgaacagcggccagagggagtagagcagagcggtcacgggcacccccggatagtggaatccgctcatcttgcgaggtggctgcggcacagggcaagtccggcttatgctggcactcccgcgaggaggattcgccatgcccgagacccataccggcggttgccattgcggctatctgcgctacgccgtcgccgcgccgctggacgatgtcgctcactgccactgctcgatctgccggcgcaccacaggcggcatcgtcaccacctgggccacggtgccgcgcgcggcgttccgctggctggcgggcgaaccggcggaatatgcctcgtcggccagctgcacgcgctacttctgcccgcgttgcggggccaacctggcgttgttcacccggctcagcgccgataccctggacttcaccgtggccagcctcgaccatcccgagcgcgcccccgccaaccggcacatctgggtcggcagccgcctgccatggctacacctcgacccgcagttgcccgaagaggacgaggagttcatcgccggagcggacgacccgtgagcgaagaccggaggtggcacctgtagggcgaataacgcagagcgttatccgccgtctgcgaggcgctgaaagagcgctcgggaccatgcgtcctgcaggcgcctccctcagggcagcatcagcccgccggccgccttgtgcagctcgcgcaggtgcgcgccgacctccttga

SEQ ID NO: 2468 - DNA, 459 bp, Pseudomonas aeruginosa
ggacgaagtaatagctgtactccgggcgcccgaggttctgccggatggtggtcttgttggtcctcggagtggatgatgatcagcatggaacgttgcctgtggcggtggccgccagttcgacgccgggcgcaggggttgccttgcgggcggaaaggaagggttccaggcgctggcggaccacgtcgccggcgcagtagccgcgcatgcgttggttggccgcggcggacagttgccgatagcgctccggctgttcccgggctacccggtagctctccaggtaggcctccttcagggactcccagctcggccggtagcgccgggtgctgtacaaccggcgcgaatcctgcggccaggccgcgggctcctggctggagcggaccacgaagcccacctgggcgtccatgtagtcggccatcgccgaatggtccggagcgatcgccggggtgccgcaggacatga

SEQ ID NO: 2469 - DNA, 255 bp, Pseudomonas aeruginosa
aattcatggcatctcgtgatgaaactgcccgttcgacagcttggtggtgatgagcgaggccaggcgctgcttcgttgtccggaagccttcccggcggactggtcgacccatcgtgttcttgttctgttatcgcgaccgcgacctgttcgatcgacagaacaggaggcagtcaagcacgaaatcgagaggcattctaaacatacctttcgcaaaaacgtgaaggctgacggagaaaacgtcatgccgttcgaatga

SEQ ID NO: 2470 - DNA, 1017 bp, Pseudomonas aeruginosa
tcagaacaacacgctatccggcatgacctctggaacgtcgtattcctaggaagagcgtcgccgagcgtagcatcagataaaaggcccgcttccttgactcagcgtctgttcgtcaccgggctctccggtttcgtaggcaagcatcttcaagcttatctggcagcggcccacacgccgtgggcgctccttcccgtaccgcatcgttacgacctgctggagccggattcgctgggcgacctctggccggagctgccggatgcggtcatccacctggccgggcagacctacgtgccggaggccttccgcgatcctgcgcggaccctgcagatcaacctccttggcaccctgaacctgctccaggcgcttaaggcgcggggtttctccggtaccttcctgtacatcagctccggcgacgtctacggccaggtggccgaggcggcgttgccgatccacgaggaactcatcccccacccgcgcaatccctatgcggtcagcaagctggcggccgagtcgctgtgcctgcagtggggtatcaccgaaggctggcgggtgctggtggcgcgaccgttcaaccatatcgggccggggcagaaggacagcttcgtgatcgccagcgccgcgcggcagatcgcccggatgaagcagggcttgcaggccaatcggctggaagtgggggacatcgacgtcagccgtgatttcctcgatgtccaggacgtgctgtcagcctatctgcgcctgctctcccacggcgaggcgggcgccgtctataacgtctgttccgggcaggagcagaagattcgcgagctgatcgaactgctggcggacatcgcccaggtcgagctggaaatcgttcaggaccctgccaggatgcgccgggcggaacagcggcgggttcgcggcagccatgcgcgactgcatgacaccacgggctggaagcctgaaataaccataaaacagtccctgcgggcgatcctgtccgactgggagtcacgggtacgaaaaagtaatgacttttaa

SEQ ID NO: 2471 - DNA, 1272 bp, Pseudomonas aeruginosa
actctgatgggacagatacgcgtatccggcctcggcaaggcctacaagcagtatcccaatcgctggagccggttgttcgaatggctggtgcctttcagccctccgcgccaccacctgcactggatcctgcgcgaggtcgagttcaccatcgagccgggcgaagcggtcggcatcgtcggggtcaacggcgccggcaagagcaccctgctgaagatgatcgccggcaccacccagccgacctgcggcgagatccgcgtggccggccgggtcgccgcgctgctcgagctgggcatgggcttccacccggacttcaccggccggcagaacgtcttcatggccgggcaactgctgggcatgcaggtcgaggaaatccaggcgctgatgccggagatcgaggccttcgccgaaatcgccgaggccatcgagcaaccggtgcgcacctactccagcggcatgcagatgcgcctggcgttcagcgtggcgactgcccggcggccggacatcctgatcgtcgacgaggccctgtcggttggcgatgcctatttccagcacaagagcttcgagcgcatccgcagtttccgcaaggccggcaccaccctgctgatcgtttcccacgaccgctcggcgatccagtccatctgcgactccgcgatcctcctggagcagggacggatggccatgcgcgggcggccggaagaagtgatggactactacaacgccctgctcgccgagcgcgaggggcagaccgtgcgccaggaaatgctcgccgacggccaggtacggacgatttccggcaccggcgaggcagcgatcctcgacgtacggatggtcgaccagcggcagcgcgcgctggaggtggtcgaggtaggccaggcggtgacgctggaagtcgaggtcgaggttcgccaggacatcgagcggctgatcctcggcttcatgatcaaggaccgcctcggccagccgatgtacgggatcaatacccaccgcctggacaaggcgctcaccgacctgaaggccggcgagcgcatcacctaccgcttcgccttcgacatgcgcctgggcaaggggcactactcggtggcgctgagcctgtcgcggctggactcgcacctggaccgcaacttcgaatggcgcgactacggcctggtcttccatgtcatcaacaaccgccaggaagacttcgtcggttgctcctggctgggcgccgaaacccatatcagccgctccggcgaggcggctctggaccccacttccgcggagagcactccatga

SEQ ID NO: 2472 - DNA, 1182 bp, Pseudomonas aeruginosa
tcgcgcggatcctgctcgccctcggcaaggccccggcgcatggcgaggcagtacatgcggattgcggttaacgcgcggattctccaggcgccgcggaccggcatcgggcattacctggtcgagttgctgggcgcgttgcaggcgcacgcggacttcgagttttccctgttccatggctggggctggagcggcgacctgccggcggcggcgctgcccggctattcgcgtctgtcgccctggctgcgcaacctgcccggagcctaccgggcacgacgctggctggagcagcggcgtttcgatagcggtcggccgccggtcgatctctaccatgagcccagtctctggccgctggacttcgacgggccgatgctgatgaccctgcacgacctgacccacctgcattatccggcgacgcaacccgccgcccgcttgcgcgaaatagaacgccggctggcgcgcgggatggaaaaggcgcggttgatcctgaccgactcgcaggcgatcgccgacgaggcgcaggcgtatttcggcctgccgcgcgagcgcttcgtggtggcgcccctcggccatgccgcgcggttccgtccgcgggaccgggagtccctgcgcgagcccttgcgcgcgcatggcctggtgccgcgcgggtatttcctctgcgtaggaaccctcgaaccgcgcaagaacctgtcgctggccctgcgcgcccatgggcaactgccggcggcggtccgccagcgttttccgctgatgatcgtcggcatgccgggatgggaaagtcgctcgctcgacgacgaactgcgccaggcgctggcttcgggaacggtgcggctgctcggctacctgccggacgagcgggtcgccgagttgatgtcgggcgctcgggcgctggtcttcccctcgatctacgaaggcttcggcctgcctgtgctggaagccatggccagcggcacgccagtattgctcacgcgactctccgcaatgccggaggtggccggcgaggcgggcagctatattgacccggatgatgccaatgggctatctgacatgctggtccgcatgaccgaggataccgtctactgggagtgctgccgggaagccggcctgcgacgggcggagcagttttcctggaagcgttgcgcgaatctcaccgctgcagcctatcgtcgtgccgtggagggctga

SEQ ID NO: 2473 - DNA, 1146 bp, Pseudomonas aeruginosa
atgcgggtactgcacttctacaagacctacctgagcgaaacggtaggcgggatcgaacaggtgatcttccagctttgcgagagcagcgggtcgtgggggatcgacaaccacgtcctgaccctgagcagcgatccgcatccgcctgtcgtgcccttcggcggacatgtggtgcatcgcgccaggctcgacctgcagctcgcttccaccgggttttccctgagcgtgttcaagcagttccgcgagctggcggcggaggcggacgtggtcaactaccacttcccctggccgttcatggacctggtgcatttcctcaccggtatgaacaagccgagcgtggtcacctaccattcggacatcatccgccagcgcgtcctgttgaaactgtaccggccgctgatggggcgcttccttcatagcgtcgatcggatcgcggtggcgtcgcccaactacttcagcaccagcgacgtgctccgccagtaccgggaaaagacccgggtgatcacctacggcctggacaaggcctgctacccgaagcctgcggcacagcgtctggagcactggcgagagaaactcgggccgcggttcttcctgttcgtcggggtgatgcgctactacaagggcctgcatatcctgctggatgcgttgcagggcaccgattacccggtggtgatcgtcggtgccgggccgttgcaggccgagctgtatgcccaggccgcggcgctggggttgcgcaacgtgcacttcctcggccgagtggacgacgaggacaaggtcgccctgctgcaactcagctacgccatggtctttccgtcacacttgcgttccgaggcgttcggtatctccctgctggagggcgcgatgtacggcaagccgatgatctccagcgagatcggcaccggcaccagctacatcaatatccatggcgagaccggcctggtcgtgccgcccagccagccggccgcgtttcgccaagcgatgcgctggctctgggagcatccgcagcaggcggaggaaatgggcaggaacgcggaggcccgctatcggcaactgttcaccgccgaagagatggggcgtcgctggagcgagctgtaccgtgaactgctggaggaaaaggcttcttccagatacgtgaaggccgctcggtaa

SEQ ID NO: 2474 - DNA, 1551 bp, Pseudomonas aeruginosa
aacggttcagcctcagccggccagcatgtgtccgcgttcttccaggttcaggtgccaggccagcgcctcgcgcaacagatgcggcgtgtggccgcctttcgcgcaagccgcctcgaagtagtccagcagcggtgcctggtaggacgggtggacacagttctcgatgatcacccgggcccgttcgcgaggcgccaggccgcgcaggtcggcgaggccctgctcggtgacgaggatgtcgacgtcgtgctcggtgtggtcgacgtggctgaccatcggcaccacgctggaaatgttgccgcccttggcgatcgacttggtgacgaagatcgccaggtgcgcgttgcgggcgaagtcgccggagccgccgatgccgttcatcatcttggtgccgccgacgtgggtcgagttgacgttgccgtagatgtcgaactccagcgccgtattgatgccgatgatgcccaggcgacggaccacctcggggtggttggagatttcctgcgggcgcagcaccagcttgtccttgtagcgctccaggttaccgaacacgtcggcgttgcgccgcggcgacagggtgatcgagctgcccgaggcgaagcgcagcttgccggcgtcgatcaggtcgaaggtcgagtcctgcagcacttcggagtacatggtcaggttctcgaacggcgactcgatcaggccgcacatcaccgcgttggcgatgctgccgataccggcctgcagcgggccgaggctgttgctcatgcgcccggcgtcgacctcgcgcttgaagaaatcgatcaggtggttggcgatggcctgggtctcgccgtccggcggcagcacggtggatggcgagtccggctggtcgttgatgacgatggcgacgatcttctccggcgggatcgggatcgccgtgctgccgatgcggtcgtcgacgcgggtcagcgggatcggcgtgcgggtcggccggtaggtcgggatatagatgtcgtgcaggccttccaggttggtgctgtgggccaggttgatctcgacgatgacctgcttggcgaagatcgcgaagctcgccgagttgcccaccgaggtggtcggcacgatgtggccctgctcggtgatcgcggcggcttcgatgacggcgatgtccggcagcttcagctggtggttgcgcaactgctcgacggtttccgagaggtgctggtcgatgaacatcacttcgccggcgttgatcgccttgcgcagggtgctgtcgacctggaacggcatgcgccgggcgagcacgccggcctcggtgagctgcttgtcgaggtcgttgccgaggctggcgccggtcatcaggctgatacgcagcggacgttccttggcgcgcatggccagcgcctggggtacggccttggcctcgccggcgcgggtgaaaccgctcatgccgacggtcatgccgtcctggatcaggtcggcggcttcggccgcactcatcaccttgtcgagcagggggggcaggcgcacgcgatcacggtacatggaacgaacctcagacgacgaattattaggggcccgccagtctag

SEQ ID NO: 2475 - DNA, 1773 bp, Pseudomonas aeruginosa
cagatccaggaggcaccggtggccagcccggagagcaccaggaacagccagctgcgcggcaggatgcttcccggggcctggaacttgcccaggaccgcgaggatgccgccgagggtgacgaggatcaccagggtgcggatgaaggtggcgaagtccgaatcgacccggtcgaggccgatcttggcgaagatcgcggtcagcgcggcgaacagcgccgaaagcagtgcccagaaggcccaggatgccagcatgtcgtcctcctccgggccttctccacgggctgcgccgctacagggcttccagcttggcgtagccgagcatcagccacttgctgccttcgctctcgaagttcacctgcacccgggcctgggcgccggcgccttcgaagttgaggatagtcccttcgccgaacagcgcgtggcgaacccgctggccgagggagaagggcgtctccggcaccccggcgccgctgaacaggctgccgccggcgttgcgcgaagtgccgccgtaggggcggctgacggtattggacaggcgcacttcctggatcagcgccggcgggatctcgcggatgaagcgcgaaaccttgttgtaggtctcgctaccgtagagccggcgggtctccgcgtaggtcaggaccagtcgctgcatggcgcgggtgacgccgacgtaggccaggcggcgttcctcttccaggcggccggattcctccaggctcatcttgtgcgggaacagcccttcctccatgccgaccaggaacaccagcgggaactccaggcccttggcgctgtgcagggtcatcagctggacactgtcctcgtgggcgtcggcctgggtttccccggcctccagggaggcgtggctgaggaaggcctgcagcggggtgaggtcttcctcttcctcgctgttctcgaaggcgcgggcggcgctgaccagttcctcgaggttctccacccgggcctggcctttctcgcctttttcttccttgtggtagctgatcagtccggactgctcgatcaccgtctgggtcatcaggtgcagcggcatgtccatgaccttcgccgaaagattctcgatcagctcgacgaagccggtcagggcgctggcggcgcggccgggcaggaccttgttggcgatcatcaggcggatcgcctcccacatcgacacatcgttgccgcgggcgaattcgcggatgctctccacggtcttctcgccgatgccgcgtgccggcacgttgaccacccgttccagcgccgcgtcgttgccgcggccgtcgagcaggcgcaggtaggccatggcgttcttgatctcggcacgctcgaagaagcgctggccgccgtagatgcggtagggaatcttctcccgcagcagggcttcctccagcacccgcgactgggcgttggagcggtagaggatggcgatctcgctgcgcgccaggccgcccttgagcgcgctctcgatcgactcgaccacgtagcgcgcctcgtcgtgctcgttgaacgcggcgtacaggctcagcgactcgccgtcctcgccgtcggtccacaactccttgcccaggcgtccctggttgttggcgatcagggcgttggcggccttgaggatcgacgcggtggaacggtagttctgctccaggcggatcacctcggcgtcggcgaagtcgtcgctgaactgctggatgttctcgatccgtgcgccacgccagccgtagatcgactggtcgtcgtcgccgaccaccatcaggctgtcgccgcccttggcgagaatccgtag

SEQ ID NO: 2476 - DNA, 882 bp, Pseudomonas aeruginosa
ccaggcgtactgcacggcgttggtgtcctggaactcgtccaccaggatatggcggaagcgccgctggtagtgctcgagcacgccgggatggtcgcgccagaggtccagggcgcgcagcagcagctcggagaagtcgatcaccccggcgcgggcgcaggccgcctcgtaggcttcgtagatcttcagcatggtggcgaggaacaggtcgccgccgggctggatgtgttgcggccgcaggccctcgtccttctgcccgttgatgaaccactgggcctggcgcgccggccagcgctgctcgtcgaggccgagttcgcggatcacccgcttgaccaggcgttgctggtcgtcgctgtcgaggatctggaagttctcgctcagcccggcctcgcgccagtgcgcgcgcagcaggcgatgggcgaggccgtggaaggtgccgacccacatgcccgccggattgatcccgagcaactgctcgatgcggtggcgcatctccgccgccgccttgttggtgaaggtcaccgacaggatgctgtagggcgaggcgtgctcgacctggatcagccaggcgatccggtgcaccagcacgcgggtcttgcccgagccggcgccggcgaggaccagttggcggcccagcggcgcggccacggcctggcgctgcgggtcgttgagggagttcagcaggagggagaggtcgtcgttcatcgcggcattctaccggggcggggaaaagccgggcaaaccgggccgccattcggcgcaggccggcgcagcgtcgggcctggctgcggaaaaatgctctatcccggccttgggcagcctgcccctgctcggttatgctccggccacttcaaggcaaaccactacaagaacaagcgcctatga

SEQ ID NO: 2477 - DNA, 2211 bp, Pseudomonas aeruginosa
ggacgattcatgcgctcgaagccgcttcttcccgccctcctgctggtgggcgccggtctctccccgctggcccaggccagcagcgacgactcctgctatcccgattggtctctggtcggcggcggtgtctgcgataccctgccgttcctcgccccgggcaacgacacccgcgccaacctgcgcctgctgctggccgacgccggccactggcggctggtggaggcgccgccgtcggaggaagagaagctcgaaggctacggcctggtgccgttcggcctgttccgcctgctgcccggcgacggcagccagccgcccgcgccgtcggcggcgagcgaggccgagacaccgccgcctgcgccagcgccctcgccgctcgccgaactggcccggcagatgggcgccgaagcgctaccggaaaagatcgccggcgccgaattcttcgagggcgagggcagccgctgccgcagcaacgaccaggacagcgcgctggcgtttcttcgccaggtgcgtgacgccgggctgggcgaggcggagaccaaggccctggccaacagccgcctggacctgctcggtgcctgcggctgggaacaagaggaactgggcggtgtgctcgcgcaaggcgtcgagtcggccgcaggcaaggccttcgccacgtacctggaggctgcggccaacttctacagcggtcgcttcgacgaagccgaacagggcttcaaggcgttgcaggacgtgtcgcagccctggctgaaggaaaccgccctgtacctgcaggcgcgcaccctgctcaacgccgcccagcagaacgccttcgacgacatgggcttccccgagctgcagaatgtcgacaaggctcgcctggaacagacccgcagcgccctcgaggcctacctgcaggcgtatccgaaggggctctacgccgcctcggccaagggcttgcaacggcgcgtgcattggctggccggcgaccagaagctgctggcccaggactatgccgcgcaattcgccgaagccgagcaagggcagcgcaacatggccctggaagacctggtccaggaggtcgacaacaagctcctgaccggtatccagctcggcgacatccagactccgctgctgctggcggtggccgacctggtgcagatgcgcgcccacgatccgtcgaccccgcgcagcttcacctgggaaacgctgcaggcccaacaggccagcttcgccgcgcatcccgaactgttcgcctacctgcaggcggcctatcgcttctatgtcgaccaggacccggcgaagaccctcgaagcgctgccgcaaaaggtcggcagcctcgactacgtcggcttcagccagcagaccctgcgcgggctggcgctggagcagcagaaggactggaaagccgccgaggcgctctggctggaactgttgccgcaggccgcgcagccgtaccagaagggccagttgcagctggccctggcgctcaactacgagcgcagcggccagttggaaaaggtcttcgccgaaggttcgccggtccaggagccgctgctgcgcagcatcctcctgcgcaacgtcgccgacgccgcgctgttgcgccgccaggccaagcagggcgcgacggcggaagagcgcgataccgcgctgttcactctcctttacaaggacctgcgccgcagccgcttcgccgacttcggcaaggacttcgcgctgctcggcgaaaccccctcgcagaccaagctgggcaccagcctcggctatgtctacggcgccggtaacagcctggagctgttccgctggaagagcgacaaggccgagtccggctacgtttgcccggccatcgccgagtcggccgcggcgctggccgccgatgacaaggacccgaagggcctgaactgcctgggcgaattcatcctgcgcaacggtctcgacggcatgccgctggacagccagcccgaggccaacgagctgggcggcaccccgagcggcttcaagggcgaggtgtactcccggctggatggctatcgcctggtcatggacaaccccaaggctccgcgcgaagacaaggcctacgcgctgttccgcgcgatcaactgcttcgccccggccggctacaacacctgcggccagcaggacatcccgcaggccgagcgcaagcaatggttccgtacgctcaagtcgacctacgccgacagctcctgggccaaggaactgaagtactactggtga

SEQ ID NO: 2478 - DNA, 573 bp, Pseudomonas aeruginosa
gcatcaccgggttgctcgactggggcagcaacgccgagccggcggcgatcaaccggctcaagggcgtggtcgacgaagtggtggtgcagacctaccaggggcgccacagcattcccaaccacgccgcctacctcccgcgggtcagccgcctgcaactgccgtaccggatcggcctggtccagggcggcgactggcaagcccccgactacctggaaaagagcccctggttcaggggctacgtggtgttcctgctcaaccctcagtgagcgcagccgcaagcgcccttgccggcacacccgccgctgcgttcggcctgcggctggcgggtatcctggccgggctggagatcgcgcatcagtagcgcgtagcacaggtccaggccttccggcagcgccaggtagaccacgtggccattgcccggcgccacctcgatggcctcgccggcggcgttgcgcaggtcctccacgcgcaggctcaggttgcctcgcggagtcatcagttcgacgctgtcgccgcgctggaagcggttcttcacctccacctcggccagtccgtcgcggcgttcgccggtga

SEQ ID NO: 2479 - DNA, 1521 bp, Pseudomonas aeruginosa
gccggatcaatgtccgcgtcattccagccagcgtcgaccctgcagttccagcagcagttgcgcctgttccgggccgttgctgccggccgggtagggccgcgggctctggtagtgctcgcgccagccggcgaggatcgggtcgacccagccccaggcggcctctacctcgtcgcggcgcatgaacagcgtcgagtcgccctcgatcacgtccagcagcaggcgctcgtaggcgtcccagcgccgcttgttgcggctgagggcctcggccaggttgaggtccagctccaccggttccagttgcatgcccttgcccggggtcttggccatcagttgcacgctgatccgctcctccggctgcaaccttatccacaggcggttggccggcccgccgccgccgtcgatcaggctgtgcggcaccggcttgaactggatgacgatttccgagcacttgcgcgccatgcgcttgccggtgcgcaggtagaacggcaccccggcccagcgccagttctcgacctcggcctggagcgcgacgaaggtctcggtatcgctgtcgttgtcgacgttcttctcgaagtagtacgccggcacctcctggccgccgatcctgccggcggcgtactggccgcgtaccgtcttgtcctgcacgtcgagcccggagatcggcttcagcgcctgcagcaccttgagcttctcgttgcgcacagcctcggcgtcgaaacgcaccggcgcctccatcgccaccaggcagagcaactggagcagatggttctgcaccatgtcgcgcatcgccccggcgtggtcgtagtagccgccacggttctccacgccaagggtctcgttgacgctgatctgcacatggtcgatgtgcgccgcgcgccagaccggctcgaacaacgcattggcgaagcgcagggccatcaggttctgcacggtttccttgcccaggtagtggtcgatgcggaacacccgcgactcgtcgaacacccggccgatggactggttgatcgccctcgccgagtccagcgaatggcccagcggtttttccagcacgatgcgcgcttgcggcccggcgaggccggcgatggagaggttctgcgcgatcggcgcgaacaggctcggcgaggtcgccaggtagtgcaccagcacccggccctcgctgctcttcaggtgccgcgcgagacggccgaagtcggcgctctgcgaggcgtccatggccaggtagtcgaggcgcgcggcgaagcctttccattgttcggcggcgaactcgctgcgcgccaccaccgcgcggacgttgcgctcggcgagggcgaggaaggcggcgttgtccagcgcgctgcgggcgagggcgaagatccgcgtatcggccggcaggcggtcctcccggtgcaggcgatagagcgccggcagcagcttgtgcagggccaggtcgccggtaccgccgaagaccaggatgtcgcaggacgttggagtggctggtgtactcaaggcaagctcccgacggcgttggctgggcgtggctga

SEQ ID NO: 2480 - DNA, 885 bp, Pseudomonas aeruginosa
gagcgactcggtggccgacttcagcctgaagatcttcgacaccacgctgcacagcctgatggaagtccgcgagcacctggacacccacgccctggagcgcgccatcgccgccatcgcccacgcccagcgcgtggagttctacggcttcggcgcttccggcgcggtggcctcggatgcccagcacaagttcttccgcctgctgctgtcggcggcggcctactccgacccgcacatgcaggcgatgtcggcggtgaccctcaagcccagcgacgtggccatctgcatttcccagtcgggtcgctcgaaggacctgctgatcaccgccaacctggtgcgcgaggccggcgccacgctgatcaccctgtgcccgagccagaccccgctggccgacctggccacggtcaacctggcgatcgacgtgcacgaggacaccgacatctacaccccgctgacctcgcgcatcgcccacttggtggtgatcgacgtgctggcgatgggcgtggccatggcccgcggcccggacctggtcaaccacctcaagagcgtcaagcgcagcctgcgcagcctgcgcctgtcgccgaaggtgatgaagaaccaggaagagcgcggcgagccgtcctgaggcgccgccgggaaggcataacgcagtcttcaccggcctgccgccaaaccgtcacattgctgcgcgatgctcgcgactccagccagtcggccatgggagacgcgagatgccccgtcatagcgatgccaatgcccagcacgtggattcgaaaacccgccgcaagctcgaagaccagcggcgcatgcaattccgccgggcgatcgaggaccactgcgaagaactgcgcctgcgccaggaactggccgactaccccgagctggtag

SEQ ID NO: 2481 - DNA, 1953 bp, Pseudomonas aeruginosa
ttattgatttttgttaatcaccctcacgggggtagggtaaaagcgcgaccgggagctgcctgccggtcatgcagcgaccggaatatccggatcgaccgtaccaggttcccaaccccgaagagggagacctccgtgatcaagaagatcctgatcgccaaccgcggcgagattgccgtccgcatcgtgcgcgcctgcgccgagatgggcatccgctcggtggccgtctactccgaggccgatcgccacgcgctgcacgtcaagcgcgccgacgaagcccacagcatcggcgcggacccgctggccggctacctcaacccgcgcgccctggtgaacctggcggtggaaagtggctgcgacgccctgcaccccggctatggcttcctctcggaaaatgccgagctggcggaaatctgcgccgagcgcggtatcaagttcatcggcccgtcggcgcaagtgatccgccgcatgggcgacaagaccgaagcccgccgcagcatgatcgccgccggcgtgccctgcacccccggcaccgaaggcaacgtcgccgatctcgccgaggccctgcgcgaagccgagcggatcggctacccggtgatgctcaaggccacctccggcggcggcggtcgcggcatccgtcgctgcaacagccgcgaggagctggaacaggcgttccccgcgggtgatctccgaggcgaccaaggccttcggcagcgccgaggtattcctcgagaagtgcatcgtcaatcccaagcacatcgaggcgcagatcctcgccgattccttcggcaacaccgtgcacctgttcgagcgcgactgctcgatccagcgccgcaaccagaagctcatcgagatcgccccgagcccgcagctcacccccgagcagcgcgcctatatcggcgacctggcggtgcgcgcggccaaggcggtgggctacgagaacgccggcaccgtggagttcctgctcgccgacggcgaggtgtacttcatggagatgaacacccgggtccaggtggagcacaccatcaccgaggaaatcaccggcatcgacgtggtccgcgagcagatccgcatcgcttccgggctggagctgtcggtcaagcaggacgacatcgtccatcgcggctacgccctgcagttccgcatcaacgccgaggacccgaagaacaacttcctgccctcgttcggcaagatcacccgctactacgcccccggcggccccggcgtgcgtaccgacacggcgatctacaccggctacaccatcccgccgtactacgactcgatgtgcctgaagctgatcgtctgggcgctgacctgggaagaggccctcgatcgcggcctgcgcgccctcgacgacatgcgcgtgcagggggtcaagaccaccgcgccgtactaccaggaaatcctccgcaacccggaattccgcagcggccagttcaacaccagcttcgtcgaaagccacccggaactgacccagtactcgatcaagcgcaacccgtcgcacctggccatcgccatcgccaccgccatcgcggcccacgccggcctgtaagggaaggagcagaacatgagcaacaccatccaagcgaagaagaccggcgtcaccgataccatcctgcgcgatgcccaccagtcgctgctggcgacccgcatgcgcaccgaggacatgctgccgatctgcgacaagctcgaccgcgtcggctactggtcgctggaagtctggggcggcgccaccttcgacgcctgcgtgcgcttcctcaaggaagacccgtgggaacgcctgcgcaagctcaaggcagcgctgcccaacactcgcctgcagatgctcctgcgcgggcagaacctgctcggctaccgccactacagcgacgatgtggtgcgcgccttcgtggccaaggcggcggtcaacggcatcgacgtgttccgcatcttcgacgcgatgaacgacgtgcgtaa

SEQ ID NO: 2482 - DNA, 1179 bp, Pseudomonas aeruginosa
cctgctcggccagggctggaatgtggtcaacgggctgagcatcgccttcgtcctctatatcctcacctatgcctatatctccggcggcggctcgatcatcggctacaccctgtccagcggcctcggcgtgaccctgccggaaaagctcgccgggctgctgttcgccctggcggtggcgctggtggtgtggtggagcacccgcgcggtggaccgcatcaccacgctgatgctcggcggcatgatcattaccttcggcctctccatcagcggcctgctcgggcgcatccagccggcgatcctgttcaacagcggcgagccggacgcggtctactggccctacctgctggcgaccctgccgttctgcctgacttccttcggttaccacggcaacgtgccgagcctgatgaagtactacggcaaggacccgcagcggatcagccgttcgctgtggatcggcaccctgatcgccctggccatctacctgctgtggcaggccagcaccctgggcaccatcccgcgcgagcagttcaagggcatcatcgccggcggcagcaacgtcggcaccctggtggaatacctgcaccggatcaccgcgtcggattcgctgaacgcgttgctcaccaccttctccaacctggcggtggccagctccttcctcggcgtgaccctcggcctgttcgactacctggccgacctgtgcaggttcgacgacagccacttcgggcgcttcaagaccgcgttgctgaccttcgtcccaccgaccatcggcgggctgctgttccccaacggcttcatctacgccatcggtttcgccgggctggccgcggcgttctgggcggtgatcgttccggcgctgatggcgcgggcctcgcgcaagcgcttcggcagcccgctgttccgcgcctggggcggcacgccggcgatcgtgctggtgctgctgttcggcgtggccaacgcggtcgcgcacatcctggccagcctgcactggctgccggagtaccgttgagcgaccggcagtccctgccaggggctagtcgcgcagcgcctccagcgtctgccgctggcggccttcggcgtcgaagttggaaggatcgagccagcgctcgaacgccgcctgtcgcgccggccattcgctgtcgagcagggagaaccaggcggtgtcgcggttgcgctgcttga

SEQ ID NO: 2483 - DNA, 1278 bp, Pseudomonas aeruginosa
acagttgcacgccgagggctatatcgacgggcgcacaggcgacggcacctacgttgccgagttgcaggaaatcccaggcagggcccccgccgtcgccccgagcgctcccgcgccgcgcggcccggcggccctggcgccgccaccggaaggcgcgccgcgagcgttccgcgtcggcgtgccggccttcgacctgttccccttcgacacctgggcgcggctacaggcgcgcttctggcgcaacccaccggcggactgcctgggctacggcgacccggccggcgaggcgcgcctgcgcgagctgatcgccgcctacctgcgcagcgcgcgcggcctgcgctgcgaggcggaacaggtgatcgtcacccatggcgcgcagcaggccatccgcctgtgcgcccaggtgttgctcgagaacggcgatccggtggctgtggaaaaccctggctaccgcgcggcgcgcctggccttcgccgcgaccggcgcggtaccgcacgggatcgacctcgacgccgaggggctgcgcagcgaccggctcgcgggcattgccggctgccgcctggcctatgtcacgccgtcacaccagtaccccaccggcgtcaccctgtcgctggcgcggcgcctggagctgctggagtgggccgagcgcgccgacggttggatcgtcgaggacgactacgacggcgagtatcgctacagcggtacgccgctggcgccgctggccgcgctggaccgacagggccgggtgctctacgtcgggaccttctgcaagatcgccttcccggcgttgcgcctgggctacctggtggtcccgccggcgctggtcgagcgcttccgccagcggcgggccatcgaggtacgccattcggaggtgggcacccagcgggtcatggccgacttcatcgccgaggggcatttccagcgccacgtccgccgcatgcgccgcgccgcccgcgcccgccgcgacgccttgctgcggggctggccaaaagcgccgggttgccagccgttgccggcggtggatgcggggctgcacctgtgcgtgcgggtcgacagcctggcgcgggaacgggccctgatcgccgcggcggcagccgccggggtggaagtcagcgccttgagcgactactggatggacgactccagcgttgcgccagacgaccgcgcgggcctggtgctgggcttcccggcagtacccgaggtgcgtatcgacgaggcgctgcgggcgttgcgcaaggcctggcggcgggaggccctggttggacccgtcgtcgcgactga

SEQ ID NO: 2484 - DNA, 1275 bp, Pseudomonas aeruginosa
  unsure (526),(646): Identity of nucleotide at the above locations are unknown.
ctagaatgcccccggatcaccctcgcgcccaggagtagccatgagtgtcgccctttccgccgcgcccgagcgcaagctcgccgcccccctgatcgccttcgccctgctggtgctcggcgggctgttcctgttcaacgcggtcagcgcgcgccaggccatcctcttcgtcgtcggcggcgccctgggcctgaccctctaccacgccgccttcggcttcacctccgcctggcgggtattcatccgcgaacggcgcggcgccgggctgcgcgcgcagatggtgatgctggcgctggcggtgctgctgttcttcccggcgctggcggcgggcagcctgttcggccagccggtgagcggtttcgtctcgccggtcggtacttcggtgatcgtcggcgccttcattttcggcatcggcatgcaactgggcggcggctgcgcctccggcaccctgttcaccgtcggcggcggcaacgcgcggatgctggtgaccctgctgttcttcatcctcggctcgctgatcgccacccancatgtcggctggtggttcgccctgccgtcgctgccgccgatctcgctggtcgccgaactgggcctggcaccggcgctggtgtagagcctggcggtgttcatcggcatcgccggggtcacngtacgcatggagaaggcccgccacggcaccctggataccccgccgagcgcctaatggcggggttggcggcgcttcttccgcggccctggcccgctggtctggggcgcgttggcgctggcgctgctcaacttcctcaccctgtacctcgccggacgcccctggggcatcacgtcggccttcgccctgtggggcgcgaagatcgcccagggcgtgggcctggacgtcggcgcctgggccttctggcagacgccggcgaacgccaaggcgctggccgcgccgctgtgggaagacatcaccagcgtgatggacatcggcatcgtcctcggcgcgctgctcgccgccggcctggccggacgcttcgcgccgaacctggacatcccgcgccgttcgctggcggcggcggtgatcggcgggctgctgctcggctacggcgcgcgcctggcctatggctgcaacatcggcgcgtatttcagcgggatcgcgtccggcagcctgcatggctggttgtggttggtggcggcgtttgccggcaacagcgtcggggtacgggtattgaggccctatttcttcccggaggagcggcgggagcaagggttgacggggtgttgagaggggatatgccttcgtag

SEQ ID NO: 2485 - DNA, 546 bp, Pseudomonas aeruginosa
ggatgtgacgatttcgtggccaatgctgttaaacgctgcctcatgcacaaacggcataatgttggatgtgacgctggtatgatggcggacgtgtcatcgcattaccggagcctttcccgtcgtgaacctcgaactgaagtggctggaggatttcatcgccctggccggcacccgcagcttttcccaggcggcggagaagcgcttcgtcacccagccggccttcagccggcgcatccgcagcctggaggacgccctcggcctgaccctggtgaatcgccagcgcacgccggtggaactgaccgaggccgggcagctgttcctggtcaccgcgcgcagcgtggtcgagcagctcggccaggtggtgcgccacctgcaccacctggaaggcgggcagggcgaggtgctgcagttcgccgccgcccactcgctggcgctgggcttcttcccgcagtggatcgcgcggctgcgcaacgaggggctgaacatcgccagccggctgatcgccaccaacgtcggcgaggcggtgcattccctgcgcgagggtag

SEQ ID NO: 2486 - DNA, 648 bp, Pseudomonas aeruginosa
cccccggcgcgcgcccggcctgcctttgcggtatactgcgccgccttcgaaccggcactgcccgccggctcggcccagtacaagccacgcccctcgacgaagcgtggcttgttggtttctgacgcgccggacggcgcatttgagagaggcacgacgatgagcgcactggttggcgtgatcatgggttccaaatcggactggagcaccctcagtcacaccgcggacatgctggacaagctgggcatcccctacgaagtgaaggtggtttccgcccaccgcaccccggacctgctcttccagtacgccgaggaagccgaaggccgcggcctcgaagtgatcatcgccggcgctggcggcgccgcccacctgccgggcatgtgcgcggccaagacccacctgccggtactcggcgtgccggtacagtcgtcgatgctgtcgggtgtcgactcgctgctctccatcgtgcagatgcccgccggcgtaccggtcgccaccctggccatcggcaaggccggcgcggtcaacgcggcgctgctctcggcgagcatcctcggcgccaagcacccgcagtaccacgaggcgctgaagcagttccgcgccaaccagaccgaaaccgtgctggacaatcccgacccgcgcgatgcgtga

SEQ ID NO: 2487 - DNA, 1101 bp, Pseudomonas aeruginosa
gaaggtaaggctcgaaccatgaaaatcggtgtcatcggtggcggccagctgggccgcatgctggccctggcgggaaccccgctgggcatgaacttcgctttcctcgacccggcgccggacgcctgcgcggcctccctgggcgagcacatccgcgccgactacggcgaccaggagcacctgcggcaactggccgacgaggtcgacctggtgaccttcgagttcgagagcgtgccggcggaaaccgtggccttcctctcccagttcgtgccggtctacccgaacgccgagtcgctgcgcatcgcccgcgaccgctggttcgagaagtcgatgttcaaggacctcggcattcccactccggacttcgccgacgtccagtcccaggccgacctcgatgccgccgcagccgccatcggcctgccggcggtgctcaagacccgcaccctgggctacgacggcaagggccagaaggtcctgcgccagccggccgacgtgcagggcgcgttcgccgaactgggcagcgtgccgtgcatcctcgagggcttcgtgccgttcaccggggaagtctcgctggtggcggtgcgcgctcgcgatggcgagacgcgtttctacccgctggtgcacaacacccacgacagcggcatcctcaagctctccgtggccagcagcgggcatccgttgcaggcgctggccgaggactacgtcggccgcgtgctggcccggctcgactacgtcggcgtgctggccttcgagttcttcgaggtggacggcggcctgaaggccaacgagatcgccccgcgcgtgcacaactccgggcactggaccatcgaaggcgccgagtgcagccagttcgagaaccacttgcgcgccgtcgccggcctgccgctgggctcgaccgccaaggtcggcgagagcgcgatgctcaatttcatcggcgcggtccccccggtggctcaggtggtcgccgtcgccgactgccacctgcatcactacggcaaggccttcaagaacggccgcaaggtcggccacgccaccctgcgttgtgccgaccgggcgacgctgcaggcgcgcatcgccgaggtcgaggcgctgatcgaggcgtga

SEQ ID NO: 2488 - DNA, 258 bp, Pseudomonas aeruginosa
ggagggactgtcatgggattaatcggaaccatcatcgtcggactgatcgttggtctcgttgcacgctttctgaagccaggtgacgacagcatgggctggatcatgaccatcctgctcggcatcggcggttcgctgctggccacctacggcggccaggcgatcggcttctaccaggctggccaggcggccggtttcatcggcgcggtggtcggcgccgtcgtactgctggtcatttacggcctgatcaagaagaattga

SEQ ID NO: 2489 - DNA, 1245 bp, Pseudomonas aeruginosa
cctggccgatgccgcctacgccatcgacaaggcgcgggtgaaggtggtggaggaagcggacctgtagggccggcacctgcgcaacggtccatggcggacgatgcgagccgcgccgtccgctcgccgacccgctcagggtcgtttcagcggctcgctccagatctgcacgccaaagctttcgctgcgcccgggggcgaccaccatgaggtcgtcccagacccgcccggtctcgatgcagagcatctgctgccaggcgtcgtcggcgaactgcgagagacgccgggacttgtccacccaggggttccagaccaccgccgagcgcgagtcgagggcgtgcaggtggatgctgcgttcccagcgcgggtccttgatcagcaggtcgcgttcgagaccgaggtagatgcgatccagttcgcccttgacccgtaccgcgccgtgctgagtgcgttcttcccagttctccagggtctcgatgtagcgcgcgccttccaggccctcgatggcgatctcgcggctgtcgctgaccgcgaagtaggtgtgcagtgcctggctgagcaccagcggcttgctgccgaggttctcgctggtgagtcgcagggtcaggcgctcgccgaagcggaacagcatgcgcagcgccgccgggtgcggccagccggggaggccatcgggggcgtcgagacggaagctgacgcagaggtcgccgtcctcctcggcgatgtcgtcgatttcccagtcgaccgcccggaccagcccgtgggcgggcgccttcaggccatcttccacctggccgcggacttcctgcgggttgcgctccagcggaccgaaccacggccagcacaccggcaccccgccgcgtaccgactgcccgcgccggtagccggcctcgtcgctgagccagaccagcggcggctgttcgtggggctggtagctgagcagttgcgcgccctgctgggcgatcagcgcctcgccatgggcggtgtggatgcgccagcaggccaggtcgtcgacctgtacctgttcgacgcggttgatcgggctatcggtgttcatggcggtctccgggaggcgaatggatggcagcagtatcaccgatccattttatcgccggcagttcccccggatagcgccaacgaagacgcggcccgtaggccgcgtcggttgttgccggtggttcaggccgcgcggaacaggttgtgcgggtcgatgacgaatttcttcggcaccccggcgtcaaactcgccgtag

SEQ ID NO: 2490 - DNA, 1059 bp, Pseudomonas aeruginosa
gtcctcggggtagtgggcgtggtcgaccgtctcgacgccctgggcgatgatcggcccttcgtcgaggtcgttgttgatgtagtgggcggtggcgccgaccagcttcacgcccttctggtaggcctggtggtacggcttggcgcccttgaagccgggcagcagggagtgatggatgttgatcgcccagccgtccaggcgccggcacagttccggcgacagcacctgcatgtagcgagcgaggatcaccagctcggcgccactctcttcgagcacctgccagaccctggcttcctgggccggcttgtcgttcgggtcgagcgggaagtggtggtagggaatgccgtgccagcgcgccagcggctccaggtccgggtgattggaaatcaccgccaccacgtccatcggcaactggccgatgcgctggcggtagagcaggtcgttcaggcagtggtcggccttggaaaccatgatcgccacctggctgcggtagcccggcgcggtcagctcggtacgcatgccgaacggtgccacccgttcggccagtccggcgcggaaggaggcttcgtcgaagccgtcgccggcgcggaactccacgcggatgaagaagcgttgcgccaggcggtcgtcgaacgagtggtgctcggtgacgtagcagcgctgctcgaagaggtagcgcgtcaccacgtcgacggtgcccagcaggctgggactgtcggcggtgaggatccaggtgtcgggggtacggctcatcgcgaggctccgggtccggtatcccctctcggggagaggggaaggctgctcatgccgctacctgcaggccgtattcggcgctggcgtcttgcaaccagagccagaagtagtcggcgaagctgcggcgcacgaccagctcccaggtgtcctcgccggtatggcggatcacgcattgcgacttggcgaagatgctgccgaccgccttgcccaccgggaagttgctcggatgcacgtcgtagctggtggatttcatcagcagttcgcggacgttcgctccgctcagttcgagcagcgtctgcccgccgctga

SEQ ID NO: 2491 - DNA, 405 bp, Pseudomonas aeruginosa
ccaccgcgtagtgcagctcctcgcccagggcctggcgcaggcgctgttcgacggcgtattcctcgccgccggggacgatcagcaaccattcgtccggggccagccattgcagcgaggtctcgccgctggcgaccagggtcagggccaccggcagttccaggccgagggcctggtgcacggcggcggcgaaggccgggtcggcggcatcgccgcgcagcaccaggtggccgagcagcttcttctcgcgcaggacgataccggccttcgcggcggtcttgccggcgagcttgtgcagctcggcatggtgcagcggcgattcggcgtggacgccgggttcggggcgttgctggtagacgtttgccttgctcattcgttttcaccttggggcgccgcgcgccctggtag

SEQ ID NO: 2492 - DNA, 420 bp, Pseudomonas aeruginosa
cgtcgttctgcggatcgacgaactgcttcggtgcgcgtgccgtgggcttctcgtggggcacctggaacagcgcgacggacgcttcctcgcggcgcggctggaccttcggcaggctgccggcggtggtcttgtagccggcgtcgagggcggcgcgactcccggcctggtagccgtcggcgagcacctcggcgagcccgaacacgccgttcacggcgccggcgcagatgcgcttctgcaggccttcgccggggacgaaggcgaggatttcctcgcgccattccggcttgccgcccaggtgcgaggccaggtgcacgaccgggctgtagccgccggagctggcgatcaggtcgcagtccagccattcgccgccgctggcgcgcatggcctgcaggtcgatccgggcgaccttggcgccgctga

SEQ ID NO: 2493 - DNA, 1635 bp, Pseudomonas aeruginosa
tctggctcatgccggttccccttgtacggcgggtttcttctcaccgtcggcgacgacgctgggctgctcgccgatcaggtaggtctcgaggatctcgtaggtcaccgtatggcgggtgacgttgaagtacttgcggcagccggcggcgtgcacccacagctcgtgatggaggccgcgcgggttgtcgcggaagaacatgtagtcgccccattcctcgtcgctgcaggcgttcgggtcgagcgggcgcgggatgtgggcctgacccttggcgtggaattcctcttcggaacgcagttcgccgcagtgggggcagaagatattcagcattttgtagcctccggaaactgttcttgccggttgaccggcaccctctccctgaagggcgaggggcagcggatttcgcccttcgggcggcttttgtcagtgcgccactgccgccgcgccgtgctcgtcgatcagcgcaccgctgtggaagcgttcgatggagaagggcgcggccagcggatgcggttcgcccttggccagggtggcggcgaagacgtttccggagccgggagtggccttgaagccgccggtgccccagccgcagttgaagaacaggttctgcaccggagtcttgccgatgatcgggcaggcgtccggggtggtgtcgacgatgccgccccactggcggttcatgcgtacccgcgagagcaccgggaacatctcgacgatggcttgcagggtgtgctcgatcaccgggtacgagccgcgctggccgtagccgttgtagccgtcgatgccggcgccgatgaccaggtcgcccttgtccgactggctgatgtagccatgcacggcgttggacatgatcacgctgtcgatgatcggcttcagcggctcggagaccagcgcctgcaacgggtgcgactccagcggcaggcggaagccggcgagcctggccatgtgcccggagttgccggcggtgaccaccccgacacgacgcgcgccgatgaagccgcggttggtctcgacgccgatcaccgcgccgtcctgcttgcggaagccggtgacttcggtctgctggatcaggtccacgccgagggcatcggcggcgcgggcgaagccccaggccaccgcgtcatggcgggcgacgccgccgcgacgctggatggtcgcgcccatgatcgggtagcgggtgttcttgctgcagtccaggtagggaatctcctccgccacctgctgcgcgttcaacaattcgccgtcgacgccgttgaggcggttggcgctgacccggcgctcgccgtcgcgcatgtcctggagggtgtggcagaggttgtagaccccgcgctgggagaacatcacgttgtagttgaggtcctgggacaggccctcccacagcttcatcgcgtgttcgtagagcagcgcggactcgtcccacaggtagttggagcgcacgatggtggtgttgcgcgcggtgttgccgccgcccagccaacctttctcgactaccgccacgttgctgatgccgtgttccttggccaggtagtaggcggtggccaggccgtgcccgccgccgccgacgatgaccacgtcgtagaccggcttcggcgtgggcgtgcgccacatgcgttgccagttctcgtgatggctcagtga

SEQ ID NO: 2494 - DNA, 672 bp, Pseudomonas aeruginosa
actgcgtgctcttcgtcttgcgagaacaccatgaaacgcccgctgatcttcctttccgccgtgctgctcggcgcatccctgcaagggtgcgggggcggcgatgaaaagcaggccgccgcgcctgcgctgccggccgattcctgcaccggccatgaactcgaagtggccttgccgccggccggcaagccactgttcggctacgacttcctctcccgccagtgcggctacaacgatgccaccgtggtcttcggcgccgccgacggcagcaagcgcctggagatcgtcctcaccgacaccggcctgccggcgccgccgaccgagggcgacgcggtgtcctatcgggcggcgcaggacaagctgcgcgagatgacccagaccaacctgaccctgctccacaagacccgcgagaccgcccttaagaacggcaccgccgagcgcttcggcggcgaggactacctgccgctgatcgataccacgcggatgggcgacccgctgggagtgatggtcccggccaagggcgaggagggcgtctcgaccctcagcggagtgatcaagaaccgctacgtactgaccctcagcacccgcgacacgcccaatggcggcagcgccacggcgatgcgccaggtgctggtgccgttcgtcgagcagatgaagctgaccaagctaccctga

SEQ ID NO: 2495 - DNA, 378 bp, Pseudomonas aeruginosa
aggcgatcagcgccacctgcaaggagctcggcctgcacctgcacatggacggcgcgcgcttctccaacgcctgcgccttcctcggctgctcgccggcggagctcagctggaaggccggggtcgacgtgctctgcttcggcggcaccaagaacggcatggcggtgggcgaggcgatcctgttcttcaaccgcgacctggccgaggacttcgactaccgctgcaagcaggccggccaactggcctcgaagatgcgcttcctcgccgcgccctgggtcggcgtactgcaggacgatgcctggctgcgctacgccgatcacgccaaccgctgcgcgcgcctgctggccgagctggtggccgacgttcccggcgtcagcctga

SEQ ID NO: 2496 - DNA, 288 bp, Pseudomonas aeruginosa
acggcatggaagtcacccagttcacctacttccagcaggtcggcggcatcgagtgctatccggtcaccggcgagatcacctacggcctggagcgcctggccatgtacctgcagggcgtggactcggtctacgacctggtctggaccgacggcccgttcggcaaggtcacctatggcgacgtgttccaccagaacgaggtggagcaatccactttcaacttcgagcacgccaacgtgccgaagctgttcgaactgttcgacttctacgaaagcgaagccaaccgcctga

SEQ ID NO: 2497 - DNA, 537 bp, Pseudomonas aeruginosa
cctggcgaccgagatggtcggcgagttccccgaaatgcagggcatcgccggctactactacgccacccacggcggcgaagcggaagacgtcgccctggccctcaacgagcagtacatgccgcgcggcgccggcgccgagctaccctcgaccctgaccggcgccgccgtggcggtggccgacaagctcgataccctggtcggtatcttcggcatcggcatgcttcccaccggcagcaaggacccctacgcgctgcgccgcgctgcgctgggcgtgctgcgcatcctcatcgagaagcagctcgacctggacctggtagccgcggtcaacgccgccgtcgagcaatacggcgacaaggtcaaggccgccggcctggccgagcaggtgctggacttcgtgttcgaccgcctgcgcgcgcgctacgaggacgaaggcgtggacgtggccgtgtaccagtcggtgcgcgcgctcaagccaagctcgccgctggacttcgaccagcgcgtacaggccgtccaggccttccgacagttgcctga

SEQ ID NO: 2498 - DNA, 2079 bp, Pseudomonas aeruginosa
agccgaggccctggccgcggcgaacaaacgggtgtcgaatattctcgccaagtccgaggacgaggttccgccgaacgtggatgccagcctgctggtggaagccgccgagaaggccctgggcagcgccgtggcgaacgccgaaagcgaagtcgcgccgctggcagcggcacgcgactatcgcgccgcgctggcccgcctggcggccttgcgcgagccggtggatacgttcttcgccgatgtgatggtcaatgtcgacgacgcagcggtgcgcgccaaccgctatgcgctgctggccaagctgcgcgggtcgttcctcggggtggcggacatctcgctgctcggctgagccagtcccgcctcgaagaaaaggcccggcgtcctcgcgacaccgggcctttttcactacaggaccttcagatactccagcagcgcacgcttctcctcggccgacaggctggtgccgtactcatggccgcagcggctgttgccggaatcacgctgctcgcagccggtggtcttcagcacatagctgccgaattgggtctgctgggcggcgaggccgaccttgtccacgtcgtaggccgagcccaccgggaaggattccacccgctccgcggccggcttcagcaactcttccagggtcggcaccgagccgttgtgcaggtacggcgccgccgcccagatcccctgcaggacccgcgactcgtaggggtaggggtcggcctgggtacgcagcggcttctggaaggcggtcagcagttgccgggtttcgtcggtcatcacgctttccggcttgaccgccgccgccttggcatcgtgcttctcaccgaggatcggcacgaagtgctgcaggatcgaaccggccaccgctacggcgagtacatcgaaggctccgtcggtcgccttcagcggctggccgaacggcatccgcgcgccctccatcacgccggtctgcacctggccatcgaggatggcgtgctggcggctgtcgctgccgacgtccctcagcggagtgtcccaaagcaccaggtccttgatccggatgccgtggcactccacgcagccaccttcgtcggtcttgcgggcgaagatcagcgcgcctttcctggccaggtgcttgtccaccgcccagggccacttcggcgggccgatcttcttgatcaggtcttccagcttgcccagaccgtggaagttggccgagttgatcttcaggtagtccatgcccagcaggtggaacttgctcttctgcgggtggaaggtggcgaacaccccgtagacctcgccgacattgcgcgccaggccgagcaggtcgttgccgttggcggcgaagccgggccactgggtcttgttctgccgcgccgcgttccacaggaacggatagcgcaccggcgcatccgccgccttgatgttgtcgggaatcaggtagggcggcgcggtgccgatatccagcccggtaaggcggttgaagatcatcgataccgcgtccagccgcgccggtccccaggtgtccttgggcagcgcgcgctcgatcagcgtatgatagggctcgtaccattccttcaccgccgcgagcagagcgtcgcgcgcaccgggaggcggattggccccgaggatctgcttggcgaaggcgtcgaaggcggcgtcatcgctggtcagcggtcccacggcgcgatcgaggtcggcgaggaatgcctggaagtcgacgatcgccggaccgccgtcgatccgataggcagtgcccttcacctcgatctgccgggtatggcaggccgaacaggtcatgccgaccatctgccgggcgcccgtgccggctacggtgaagcccaccggcaggccttccgcgggcgccttggggttgggcaaatagccgtagcgggccaggctgtcggcgaggaaaggcgttccatccggctgtcgcaacgccttgagccagggcaggggcatcacctgcgagccctggtcgcggctgtagaagtcctggcggtggctttcggtccattccttgccctggtcgagcatgaccggagcggccgccagggcggcggaagaaagagccagggaagcgagggacaagcttga

SEQ ID NO: 2499 - DNA, 927 bp, Pseudomonas aeruginosa
cctggaggcggcgcgggccgtcgattgtcagccggtattggtaaagaccggaaaaggtgtacgtacgctgggcaagcccttgccagagggcaccctgatattcgacgatctggcggcagtcgccagcgcattacttcagtaaggtcagaatacatgtcgacagtgcaggccatcagaaccgtcctcttttacctgctgctgtccgccagcgcgttcgtctggggcaccctcagcttcttcatcgcgccgatcctgccgttccgcgcccgctaccgcttcgtggtacagaactggtgccgcttcgcgatctggctggcccgcgtggtcgccggcatccgctacgaggtgcgcggactggagaacatcccggaaaagccctgcgtgatcctctccaagcaccagagcacctgggaaaccttcttcctctccggcttcttcgagccactcagccaggtactcaagcgcgagctgctctacgtgccgttcttcggctgggccctggccctgctcaagcccatcgccatcgaccgcagccagcccaagctggccctcaagcaactggccaagcagggcgacgagtgcctgaagaaaggcgcctgggtgctgatcttcccggaaggcacgcgtattccggtggggcagatgggcaagttctcccgcggcggcaccgccctggcggtcaacgccgggctaccggtactgccgatcgcccacaacgccgggcagtattggcccaaggccggctgggccaagtacccgggcaccatccaggtggtgatcggcccggccatgcacgccgaaggcgaaggcccgcgcgccatcgccgagctaaaccagcgcgccgaagcctgggtcagcgagaccatggccgagatcagccccatccagcagcgggtcagccatccggagccgtcggtggtctcgtga

SEQ ID NO: 2500 - DNA, 2280 bp, Pseudomonas aeruginosa
ggtagtgcgcgccctacacgccacgatttgtgcaggtctgggctgtgtcctcacggaattggtatggaaatggattgggaagcgctgttagacgaactgcggagctatgccgcatcggatccaaatgagctggagacgaagattcgcgcgtgcttgaaaggtcattcctcagaaggcctgcttcaagcagttgcgcttctaatttcccaagggcagcacgccaccgcccgaacgcatctcagtgagttccttaaaagccaccaggcagcagcagatatcggccgccgtcttgagctcattctgtatttcaagaaaagtcgcgccccccaacccctttcgcttaagagcaagcaacacaacaaagagactctgctacaagacgtcaatcacctcgtcgccgctggcaaattgcaagcggctgagtcactcctgcttgaggctatcgatacaagcgaagagcctgactttctgaacctactcagccgcgtgtacatgctgcaacgccgccctattgacggggccaaggcaatgcaacgtgcactactgctaaaacgccaacaagaggcttttgtagagccagatctagattcagaagacgacttaccgacagctagcgacctggcatttctaaatgactcagccacgtcattggcgacactggaactcccatcggtgcccagtgcccagacctcgactgtggcagtcgacaacgagctcagtttcattcaacaggcttctgcccagctccctcccttaaaccaggacggttggtgggaaaaccatgttgaacccgcctctattgaaacgactgaactcaccgatgctggtgaggagaccgacgctcttgatgcagccccggccattacagaagatgtggtggaacaggtagatgaagacgagacctcttcaccaactcctaaaaagccccttctcaaacttggcttgccaagaaaacccactgagcccggcgaatcgaaggccagcgtcaaagtattcaataaatcgggacgacctctaagaatcatccctacatcaccgttgagcccaccggggccagacactgatgagctacccgagccgccggatactgctccagtatccgaagaacctgtcatcccctccgaggttcatgacgagatcctcgacgagtacgatgatgatcttcctcaagatgaacttgagctggacgtacctagtccggtgcaaatgggcctggggcttgaagaccctgaagatgacatcgacttcgatcatgacctgcatgatctgaccatcatcgagctgggcaaagaacacgacggggacaccaacgccgctctggatgacttccgtgatctagacgatgactacgctgcctatgcctttgacccggatgaagtcttcgacaatgaggagccgtcagcagccgaatccactgattggctggcagacaagctttcccgtgaagatcgcgcacttcagaaagctgcggaactgattggaaaagccaactggccactcagcacactgcccttggttcagcagatttttgtcatgagcggctggggggcaactcgtcttgcattggagagagagatcgaaaaggggctcactcctgaggagctgatccttgctgcgcacatcaaagtgatctgggccgaaaacgatatctactggatcgccttcgataaaaccggcagtagtcgcctgtcctactacgttctgtcctggccgacagcgctgctgatcgtgcgctcctttgagtcgcttccccaggtagaagagatcgaggtcttcctcgaaaacctatttgcgtcctggtacgaaaacagcacattgcgccgcgcgtttaaagcctttgcacgctacctatggttcaggtttgccaacctggaaggttgcttgcccgccagccagcactttgatttccatgatcctcgcgagctaccagctgaggaatacggtgatctgggactttgcgacacgctagaaatcgagaagaccgagcgcctgcgggaatttggtgttttccagacaaagcatccccaggagcccagttgctacttcagtgacaagccctatgtcagagaagaagagccaagccttaatgcctcagggaaaagaaagcaggtgaaggctgatcccgcagacacagaacctctttcagatatcgaggatgacaccgcaggtatcgacggtgttgaagaggattcggctgtgcctcaatggtcagctgcaccgctcgcatctgccttgcacacacagaatatcgaccaaccttcgccaagcattgagccgtaa

SEQ ID NO: 2501 - DNA, 261 bp, Pseudomonas aeruginosa
tacccgagaatttggactgggcctccgcaggatggacacacatccactagcccgaaaagatctcttgcccctgtaaatcaacaggttactgatgacctgccccccgatttcagtatcacgtcaaacttagtagagtccgttttccgagcaggagacggcagtgaaaaagcgttttaccgaagagcagattctcgacttcctcaagcaggcggaggccggtgtgccggtgaaggaactgtgtcgccgacacggcttcagtga

SEQ ID NO: 2502 - DNA, 951 bp, Pseudomonas aeruginosa
ccgattgaagaagttgctcgccgaggcccacctcgacatcgagtcgctgaaagtggtcgcccggggaaaagggtaagcccgacagcacggcgggaggcggtgcaggagatgcaggcgcgaaccggcatctccgagcgtcgtgcctgtcagttgatcgggctgtcccgctcggtgttgcgctaccagccgcgagccagtgtgcaaaacaccgagctgcaagcccaactggtggaactggcccaagagcgccggcgctttggctatcgccgcctgcacttcctgctgcggcgtgctggcgtgcaggtcaaccacaagcggatctatcgcctgtaccgcgctgccggcttgatggtgaaacggcggcgccgccgccatggcgtcgcggtggagcgcgaacgtctgagtttgccgagcgcaccaaaccaggtctggtcgatggacttcgtcttcgatgcactgagcaccgggcggcggatcaaatgcctgacggtggtcgatgacttcaccaaggagtcggtcggcatcctggtggagcacggtatcagcggctttcgcgtcacacgggcgctggacgagatggcgcggtttcgcggctacccgaaagcgatccgcaccgaccaggggcccgagttcaccggcaaggcactcgatcaatgggcctatcagcgcgacatcaagctgaagctgattcagcctggtaagcccacgcagaatgccttcatcgagtcgttcaacggtaagttccgggacgaatgcctcaatgagcactggttctgttcgctggccgaagcgagaatccgcatcgtggcctggcggcgggattacaacgaacaccgaccgcacagcgcgattggcaatctcaccccggcagaatttgctgcaagttggcgaactcgccagcagcagctgaagcaggaaaaattaatatcaaccccagggcctactaactag

SEQ ID NO: 2503 - DNA, 582 bp, Pseudomonas aeruginosa
cgcagcttgtcgatgttgtactcctcgcggccgatgccacagcccagggcggtgatcagcgtaccgacctcctgggaggagagcatcttgtcgaagcgtgccttctcgacgttgaggatcttgcccttgagcggcaggatcgcctgggtccggcgattacggccctgcttggcggaaccgcccgcggagtcaccctccacgatgtacagttcggagagcgccgggtccttttcctggcaatcggccagcttgccgggcaggccggcgatgtccagcgcgcccttgcggcgggtcatctcgcgcgccttgcgcgcggcctcgcgggcacgggcggcgtcgatcatcttgccgaccacggccttggcttcgttgggattctccagcaggaagtcggcgaagtacttgcccatctcctgttccaccgcagtcttcacctcggaggagaccagcttgtccttggtctgcgagctgaacttcgggtccggtaccttcaccgagatgatcgcggtgaggccttcgcgggcatcgtcgccggtggtggcgatcttgaacttcttcgccaggccttcggcctcgatgtag

SEQ ID NO: 2504 - DNA, 432 bp, Pseudomonas aeruginosa
ccctcgccgcgttcaccgagcagttccagaagccgaccgaggtatttctcgttcacccaatcgaggacgaaacggttgggtgcatacacacgcaattcgtcgccttcggcttcgacctgcaagggacggatccaggtgttgaattgttgggacggcagctcatcgcggagaagatccacgcactgctgccaaagttccacggacacggatatcccccaaagattggaaaggcggcacaacgaaataagcgcctattgtagccggacgggccggacttatccacatgccgatgcgctgaggccccaagcaaatcaagaccttaataaaagcaggcaggccgacggacggtcgtcctggactttgtggataacccttgctttgaagggggtacatccctgcgcacagccgtgtggaaaaaaccgctgtggataa

SEQ ID NO: 2505 - DNA, 1512 bp, Pseudomonas aeruginosa
tcaacaactgcctgtcgatcgcacagcagtggtacattacccgcaagatcgaggcagccgcgaagaccgcctgacgtctatcgcgaaaactgtccacaacaagacgccccctcgaggggcgtcttgctatccggagatatccacatgcaagccgccaccgaaaccatcgtcgcgatcgctaccgcccagggccgcggcggcgtgggaatcgtccgcgtctccggacctctcgccggacagatggccgtggccgtgagcggacgccagctgaaagcccggcatgcgcattacggaccgttcctcgatgccggtgggcaggtgatcgacgaaggcctgtcactgtatttccccggcccgaactcgttcaccggcgaagacgtactcgaactgcaggggcacggcggccccgtggtactcgacctgctggtgcagcgttgtctggaactgggcgcccgccaggcgcgaccgggcgagttcagcgagcgcgcgttcctcaacgacaagctcgacctggcccaggccgaagccatcgccgatctgatcgaggccagctcggagcaggccgcgcgcaatgcattacgttccctgcagggcgaattctcacgccgggtacatgcattgaccgagcaactgatttccctgcgcatctatgtcgaagccgccatcgacttccccgaggaagaaatcgacttcctcgccgatggccatgtactggggcttctggaaaaagtacgcacagaattatccacagtgcagcgcgaagcttcccaaggcgccctgctgcgcgacggcatgaccgtggtcatcgccggacgaccgaatgccggcaagtccagcctgctgaatgccctggccggtcgcgaggcggccatcgtcacggacatagccggcaccacccgcgatgtactgcgcgaacatatccacatcgatggcatgcccctgcatgtggtggacaccgcaggcctgcgggataccgaggaccatgtggaaaagatcggcgtggaacgtgcgctgaaagccatcggcgaagccgatcgcgtgctgctggtggtggacgccaccgccccggaagcagcggacccgttttccctatggccggagtttctcgaccagcgaccggaaccgggcaaggtcaccctgatccgcaacaaggcggatttgtccacagagtccattggcctcgaggaaagcgcggacggccacgtcaccatcaccctctcggcgcgcaccggcgccggcctggagctgctgcgcgaacacctgaaggcctgcatgggcttcgaacagaccgcggaaagcggtttcagcgcccgccggcgccacttggaagcgctacgcctggcagggcaggcgctggagcatggccacagccaacttatccacaatggcgccggcgaactgctggccgaggatctgcgccaggcccagcagcacctgggcgaaatcaccggcgcattcacccccgacgacctgctgggtcgcatcttctcgagtttctgcatcggcaagtaa

SEQ ID NO: 2506 - DNA, 711 bp, Pseudomonas aeruginosa
tggggctcggcccacgccgagttgtggataaccagggcaaggttcgctgcgtactttcctttcactgtgccccttgccgccggcactcaaccacgcaggcatggattgccggcgcgccgcttcgtccccgagaaaaccatctgcgccgatgtcggtctgcatgggatggatatccacctgggagaggtttatgcacaggcaccgcgctccgatccggcgtccgcgaaggcgctgcgctgtggtcaatctctatctgctcgcccctctcgaacggcgtatctatcccgttgtctcgcctggcgctatcgccacgcgccgggacgttccgtgcacgcaagtcaacccggtaagcggtttatccacaagcctggaagagattctgcgaaaagagctgttgcagaccctggactccgtcgataccggccaggcggggccctcgccttcggctcccaaggcgtcccacggcgagcactcggacactacagcatggagatcgtagccaacctggcggtgtggctcggcggcgaatgccaggtcggacagatgatcaactggttcggcagttacgaccgcactagcgggctcagtgctcggctactgctgcgcaaacccgctaacgagggctccgagcgggatttccaggtctccgccaagcgccgcttcgagcgcctgtcgtcatccatcgatacgctggaaagcggcaacgactga

SEQ ID NO: 2507 - DNA, 495 bp, Pseudomonas aeruginosa
acaggggggactccccccctatactctgcgcgctattttgtgggcactttttatgccaagtcgttgatttggcagtgccgacaccagaagactgagagcgcgatggagtcccgcatgccaagtcgcctgccggcattcagattgctgctcgtccaactggtagtagtgcttgttgctgcgatctccctgtggatttcttggggaccggtagccggatattccggactgctgggagggatgatcgcctggttgccgaattgttatttcgcctacaaggcgttccgtttcagcggagcgcgggctgcccgggaaatcgttcgctctttctatgcgggcgaagccgggaaactgattctgacggcggtgctcttcgcactggcgttcgcaggcgtgaagccactgatggcgccggctctgttcggtgtctatctgctgaccctgatggtcagctggtgcgcacccctgctgatgggaaaaacatttacaagaccttag

SEQ ID NO: 2508 - DNA, 468 bp, Pseudomonas aeruginosa
ttgggggttcgcccacaccgccgagcaagccaaggaaatgggcttctgggcattccacgtagacaccctgggctggtcggtactgctcggcgtggtgttcctgttcatcttccgcctggcagccaagaaggccaccagcggccagccgggtggactgcagaacttcgtcgaggtgatggtcgagttcgtcgacaccagcgtcaaggacaccttccacgggcgcaacccgttgatcgcgcccctggccctgaccgtgttcgtctggatcttcctgctcaacctgatcgacctggtaccggtggactacctgccgatgctggccgcgaagatcaccggcgacgagcacctgttcttccgcgcggtggccaccaccgacccgaacgccaccctcggcctgtcgatctcggtgttcgcgctgatcgtcttttacagcatcaaggtcaagggcatcggcggcttcctcggtga

SEQ ID NO: 2509 - DNA, 876 bp, Pseudomonas aeruginosa
cccgataggtgtcaaatggcaggcgcaaaagagattcgcagcaagattgcgagcatcaaaagcacgcaaaagatcaccaatgccatggaaaaagtggcggtgagcaagatgcgcaaggcacaaatgcgcatggcggccggccgtccctacgcggagcgtattcgccaggtgatcggccatctggccaacgccaacccggaataccgtcacccgttcatggtcgagcgtgaagtcaagcgcgtcggctacatcgtggtgagcagtgaccgtggtctgtgcggcggtctgaacatcaacctgttcaagtccctcgtcaaggacatgagcggctaccgcgagcaaggggcggaaatcgacctttgcgtgatcggtagcaagggcgcttcgttcttccgcagtttcggcggcaacgtcgtggcagctatcagccacctcggcgaagagccttcgatcaacgacctgatcggcagtgtcaaggtgatgctcgacgcatacctcgaaggccgtatcgatcgcctgttcgtggtctccaacaagttcgtcaacaccatgacccagaagccgaccgtggaacagctgattccgctggtggccgatgacgatcaggagctgaagcaccactgggactatctctacgaacccgacgccaagtcgctcctcgacgggctgctggtgcgttacgtggaatcccaggtgtaccaggccgtggttgagaacaacgcctgtgagcaggcggcccggatgattgcaatgaagaacgctaccgacaacgccggcgagctgatcagcgatttgcagctgatctacaacaaggcgcgtcaggcggcgatcacccaggaaatctcggaaatcgtcggcggcgctgccgcggtgtaa

SEQ ID NO: 2510 - DNA, 1407 bp, Pseudomonas aeruginosa
gaacaggttcaaaattcagaggaaccagacatgagtagcggacgtatcgttcaaatcatcggcgccgtgatcgacgtggaattcccgcgcgatgccgtgccgagcatctatgaagccctgaaggttcagggcgttgaaaccaccctggaagtccagcagcagctgggcgacggcgtggttcgttccattgcgatgggttccaccgaaggcctcaagcgtggcctgaacgtggacagcactggtgctgccatctccgtgccggtcggtaaagcgaccctgggccggatcatggacgtactgggtaacccgatcgacgaagccggtcccatcggcgaagaagagcgctggggcatccaccgcgaagctccgtcctatgccgaccaggctggcggcaacgagctgctggaaaccggcatcaaggtgatcgacctggtctgcccgttcgccaagggcggcaaggtaggcctgttcggcggcgccggcgtgggcaagaccgtcaacatgatggaactgatccgtaacatcgccatcgagcacagcggttattccgtgttcgcgggtgtgggcgagcgtactcgtgagggtaacgacttctaccacgagatgaaggactccaacgtactggacaaggtagccctggtatacggccagatgaacgagccgccgggcaaccgtctgcgcgtcgcactgaccggcctgaccatggccgagaagttccgtgacgaaggccgtgacgttctgttgttcatcgacaacatctaccgttacaccctcgccggtaccgaagtatccgcactgctgggccgtatgccgtccgcggtgggctatcagccgaccctggccgaagagatgggcgttctgcaggagcgcatcacctccaccaagaaaggctcgatcacctcgatccaggccgtatacgttcccgcggacgacctcaccgacccgtccccggcgaccaccttcgcccacctggacgcgaccgtcgtactgtcccgtgacatcgcctcgctgggtatctaccccgcggtcgacccgctggactccacctctcgccagctcgatccgctggtgatcggccaggatcactacgacaccgctcgcggcgtccagtatgttctgcagcgctacaaggagctgaaggacatcatcgcgatcctgggcatggacgaactgtccgaagccgacaagctgctggtggcgcgcgctcgtaagatccagcgcttcctgtcccagccgttcttcgtagcggaagtcttcaccggttcgccgggcaagtacgtttccctgaaggacaccatcgctggcttcaagggcattctcaacggcgactacgatcacctgccggagcaggcgttctacatggtcggcggtatcgaagaagcggtcgagaaagccaaaaaactgtaa

SEQ ID NO: 2511 - DNA, 657 bp, Pseudomonas aeruginosa
agatcggcgatggcgcgacgaccgcggccggctccaccatcacccatgaggttccggcgaagaacctggccttcggccgcgcccggcagaagaacctggaaaactggaagcgcccggaaaaaatcaagaagtaacggagcggcacggatgccgaagcctgcgaaacggatcgtgctggggctgctcatagcctgggcggtgctgcccgaatggccgcggatacccgtcgaaggcgccagtgcccgcgactggaatccgcgaaccttctggttcgagccctgggggcgctccggagtgcacaagggcatcgacatcttcgcccgcagcggcacccccgtacgctccgccagctacggcctggtgctctatcgcggggagatcgccctcggcggcaaggtcgtcctggtgctggcgcccaagtggcgcctgcattactacgcccatctcgatagcctcgacgcctatccgggccagccggtccttgccggttcccgcctgggtacggtcggcaccaccggcaacgcgcgcggcaagccggcccacctgcactacgcgatcatcaccttgctgccctatccctggctggccgacgacagcacccagggttggaagaagatgttctatctcgatcccgatacggtgctgccgagccgatga

SEQ ID NO: 2512 - DNA, 894 bp, Pseudomonas aeruginosa
gaccgccgacaccctggctgccctgcgcaacgccaaggagctgggcttcctctccagcgtggcgatctgcaacgttgccaccagttcgctggtgcgcgaatccgacctgaccctgctgacccaggccggcccggaaatcggcgtggcctcgaccaaggccttcaccacccagttggtcgccctgctgctgctgaccctgggcatcggccaggtgcagaagcgcctggccgatggcgtcgaagccgagctggtggacgaactgcgtcgcctgccgacccggctgggcgaggcgctggcgatgaaccggacggtggagaaggtttccgagctgttcgccgagaagcaccacaccctgttcctcggccgtggcgcgcagttcccggtggccctggaaggcgcgctgaagctcaaggaaatttcctatatccatgccgaagcctacccggccggcgaactcaagcatggcccgctggcgctggtggacagcgacatgccggtggttaccgtggcgccgaacaacgagctggtggagaagctcaagtcgaacctgcaggaagtccgcgcccgcggcggcgaactggtggtgttcgccgacgaaggcgcgggcatcgaggctggcgagggcacccatgtggtgggcatgccgcacatcggcgacgtgctctcgccgatcctctacaccatcccgttgcaattgctctcgtaccatgtcgccgtgctcaagggcaccgacgtcgaccagccgcgcaacctggccaagtcggtcaccgtcgagtaacgccggccgcgtgcccgagaagccggggcaggcatgcggccccggcgctcgccgtcaatcgcgcaacggcagcgcctcgtcgctcctgcggctggcgaaccagtccagcacggtga

SEQ ID NO: 2513 - DNA, 1215 bp, Pseudomonas aeruginosa
gttgctgtccctgcaactgccgttgcggatccgcatcggcgatgctcaggcgttcgatctggggccggatccacaggtaaccatggtcattcgcgacccctcgctgctaaccgagatcacccatcccagcctcgatgcgctgggcaaggcctacgtcgagaagcgtctcgacatcgaaggaccgatcagccaggtcatcggtatcggcgatgccctcagcgaagcgctcggcgaacccgatggcggcgcgccgccggttcgcgaaagccacgacaaggacacagacgccgaagccatccattaccactacgacctgtccaacgacttctaccagctctggctggatccggaaatggtctattcctgcgcttatttcgagaccggcaaggaagacctcgccaccgcgcaactggccaagctccgtcacctgtgccgcaagctgcgtttgcagccgggcgagaagctgctcgatgtcggttgcggttggggagggctggcgcgcctggccgctcgcgagttcggcgtcgaggtcaccggcatcacattgagcaaggagcagctggcgctcggccgggagcgagtcaaggccgaaggcctggaggaccgagtcaccctcaagctgctggattaccgcgacctgccgcgcgatggccgcttcgacaaggtggtcagcgtcggcatgttcgagcacgtcgggcacgccaacctggggctgtacttccagcaactgtacgaggcggtgcgtcccggcggcctggtgatgaaccacggcatcacctcgcgctacaccgacggccgcccggttggcaagggggccggcgacttcatcgatcgctacgtgtttccccacggcgagctgccgcacctgtcgctggcggtggcgcggatgagcgaagccgggctggaagtagtcgacgtggaaagcctgcgtctgcactacgcccggaccctggacttctggagcgccaacctggaagccaggctgaaggaggcggctcgcctggtgcccgaggaaaccttgcggatctggcggctgtacctggccggatgcgcctacggcttcaagcgcggctggatcaacctgcaccagatcctcgccattcgcccccacgaggatggctcccacgagctgccctggtcgcggcgcgacctgtacgcctgaacgccggcgaccggctcccttgcggagccggtcgcgcaatcggtccttgctga

SEQ ID NO: 2514 - DNA, 2388 bp, Pseudomonas aeruginosa
ggcggaaaactggccgcgcgcgttgttcgccgtggccctggccttttccgtgttccaggtcgtcaccgcggcctttcccctgatttccacccaggtcctgcgggcaatgcacgtcggactgctgttgctggtggtgtacatcagctatcccgccttcggcataggtcgcccctggcagccgctggcctggttgctgggcatggccggcctgggcacggcggtctaccagtgggttttcgagggcgacctgatccagcgctccggagagctgacccaggccgacatggtcgtcggcgtggtgctgatcgtcctggtcttcgaggcggcgcgacgggtgatgggcatcgccttgccgatcatctgcgcgctgtttcttgcctatggcctgttcggcgaacacctgccgggcgacctggcccaccgcggctacggcttcgaccagatcgtcaaccagctgtcgttcggtaccgaaggtctctacggcacgccgacctacgtatcggccacctacatctatctgttcatcctgttcggcgccttcctcgagcaggccggcatgatccgcctgttcaccgatttcgccatgggcctgttcggtcaccgggtcggcgggccggccaaggtctcggtattctcctcggcgctgatgggcaccatcaccggctccggcgtggccaacgtggtcaccaccggacagttcaccatcccactgatgaagcgtttcggctacaagccggcgttcgccggcggcgtcgaggcgaccgcgagcatgggcagccaactgatgccgccggtgatgggggcggtggcgttcattatggccgagaccatcaacgtcccctacgtggagatcgccaaggcggcgctgatcccggccctgctgtatttcggctcggtgtactggatggtccacctcgaggcccgccgggccgatctaaagggcctgccgcgcgatcagtgtccgagcgcctggggtgccgtccgcgagcgctggttcctgctgattccgttgctggtgctgatcgcgctgctgttctccgggcgcacgccgctgttctccggaaccatcggcctggcgctgaccgccatcgtcatcctcggttcggcgatcatcctgcgggtgtcctcgctcggcctgcgcatcgccttctgggtggcgctggggctgctctgcgcggggttcttccgcctcggcatcggggtgatcttcgtcgtgatcgcggccctggccctggcctgctggttcgtccgtggcggccgggaaaccctgcgcatctgcgtccgcgccctcgccgaaggtgcgcgacatgcgattccggtgggcatcgcctgcaccctggtgggagtcatcatcggggtgatttcgctgaccggcatcgccaccaccttcgccagctacgtgctcgacctgggacgggagaacctgctgctgtcgctggtcctgaccatggtcacctgcctggtcctgggaatgggcatcccgaccatccccaactacatcatcaccagctccatcgccgcgccggcgctgctggaactgggggtgccgctgatcgtctcgcacatgttcgtcttctacttcggcatcctcgccgacctcacccctccggtggcgctggcctgtttcgcggccgcgccgatcgccaaggaaaggggattgaagatcagcttctgggcggtgcgcatcgccctggcgggtttcgtggtgccgttcatggcggtgtattccccggcgctgatgctgcaggaaggcggttggggggcgacgctctatgtcacctgcaaggcggtgctggccatcggcctgtggggcatggcttccatcggctacctgcaggggccgctggcctggtgggagcgcctggtggcgttcgccgcgggggccagcctggtcctggccttgccgatcagcgacgagctgggcttcgtcctcggcgcgctggtgatcggctggcacctctggcgccagcgtgcgcgcgaggcggtggcgtgatcgcgctgtgtctgggcatggccggcagcgtctgggcgacgctgccgctgcagtcgttcaccctggcctggcaacacacggtcgagaaggtgctctgggaagaagactatcgcctgagtgagcgcggcctgctgctggaagaggcccgggtgcggggcagcggggcggggatggagattcccgagggcgccgtgctgcgtgacggcgcctggcattaccaccgtggggtgccgccgctgcaaccgttgcggctggggcgcacaccggaggccggcgactaccggatctgccgtcaggggcgctgcgatgcgctggcgcgctggatcggtccgccggaccctgagcgcccggcggtcgaactctgggcgtgtccgatacgggacccgagcgactga

SEQ ID NO: 2515 - DNA, 1653 bp, Pseudomonas aeruginosa
tataacgttttaaatttcccaggttcagcccatgaccgaacaggaactgcttgcccagcccgacgctgcctacatggacgaagcccagcaggacttcttccgcgacctgctgctgcgtcagcgccaggaacttcaggcgcgcatcgaaggcgaattcggcgagctgcgcgatctcgaacgccccagcgacgaggccgacctggcttcccgcgaggaacagcggcaatggcaacttcgcctgctggagcgggagaagaagctgctcgacaagatcgacgaagcgctggagcgcctggcccgcggcgactacggctggtgccaggaaaccggcgagccgatcggcctgcgccgcctgctgttgcgtcccaccgccaccctctgcatcgaggcgaaagagcgccaggagaagcgcgaacgccacgtgcggcacaactgaagaggttaccaaccgtgaaccaacgcctacctgtcaccgtgctgtccggctttctcggcgccggcaagagcacgctgctcaaccatgtgctgaagaaccgcgagaaccgacgggttgcggtgatcgtcaacgatatgagcgaaatcaatatcgatggcagcgaggtccagcgcgatgtcagcctgaaccgcgctgaagaacggctggtggagatgagcaacggctgtatctgctgcaccctgcgcgaagacctgctggaagaggtcggccgtctcgcccgggaaggccgcttcgactacctgctgatcgagtccaccgggatttccgaaccgatgccggtggccgagaccttcaccttccgcgacgagctggaccgcagcctgtccgacgtggcgcgactggataccatggtcacggtggtcgacgggatgaattttctccgcgactaccaggaggccgccagcctggccagtcgtggcgaaaccctcggtgaggaggatcagcgctcgatcaccgacctgctgatcgaccaggtcgaattcgccgacgtgatcctggtcagcaagatcgacctgatctccagcgagcagcgcgaggaactgctggcgatcctgcgccagctcaatgccgaggcggagatcctgccgatggtgatgggtcaggtgccgctggcgaagatcctcgataccggtcgcttcgatttcgatcgcgcggcgtccgcgccgggctggctgaaggaactgcgcggcgagcacctgccggaaaccgaggaatatggcatcgcctccatggcctaccgggcgcgccggccgttccaccccgcgcgcttccacgccttcctgcacaatccgctgaagcaggggcggctgctgcgctccaagggcttcttctggctcgccagccggccccgcgaggccggcagctggtcgcaggccggcggcctgatgcgctacggcctggcgggccgctggtggcgcttcgtgccgaccggacagtggccacaggacgaagagggcctgcgggcgatcatgcggcactgggaggaaggcgtcggcgactgtcgccaggagctggttttcatcggtcagaacctggacttcgcggccctgcgcgcagccctggacgcctgcctgctggatgacgccgagatgaacctgggcatccccggctggcagggcctggacgaccccttcgaggactgggggcacgccgcatga

SEQ ID NO: 2516 - DNA, 1047 bp, Pseudomonas aeruginosa
gctcttcccagcgaccttggctctggctggcgcagaacggctccaggtagcgtgcgtcggtcgcgatgccgtagtagaagatgtcctgccgatagggcgcgttgggtaccctggcgtcgcggcagacgccgaaggcgcccgtcggacactcctcggcgaacgtcacctcgaccttctggccctgcagttgtggctggcagaagccttcgtggaacagcttggccgggatgctgcggttctgctggcagaccttcacgtcgagattcttcgcctggctatggacgatgcaggcttcggccagggccaggcccggcaggcaggacaggaagaacaggaacggacgcatgcgaggactccattgcagacgggcgcgactctagcacggggcctggctccccgcaggcaaggaccgcattgatccacaggctttcacattccggttgcgcagatgcttcgagagatacccacacacctgatcggcggccctctgggggccggcaagaccagcctgatccgctcgctgctggcgcagaagccggcgggcgagcgctgggcggtgctggtcaacgagttcggcgagatcggcctggatgccgcgctgctggccacggacgtcgacggcgtggccatcggcgaggtggcgggcgggtgcctctgctgcgtcaatggcgtgccgttccaggtggggctcggtcgcttgttgcgtcgggcacggccggaccggctgttcatcgaaccctccgggttgggacatccgctggcgctgtggaaacagctgcaggctcctccctggtccggcgtcctggccctgcaacccctggtagtggtgctggatgccgccgcgctggcctccggccaaccgctgccggaggcacaggaacaggcgctggaagcggctggcatgttgctgctgaacaaatccgaaacgctcgacgcgacgcagcgctgcgccgtgcgcgcgcgcctgccggtcctgccgttgcgctggagcgtgcgcggtcacctggcattgcgcgatctgccgaccagcgttgccggggaaggtag

SEQ ID NO: 2517 - DNA, 1083 bp, Pseudomonas aeruginosa
ttatcagaagactctacttccttacctttcacttctccgcaggtcgccctcatgtcgccacagccttcacggtcgcctgaccgtttttcgctggccgcgctcgccgaagaccaccccactgctcccgcccagggagacgaaagcgagtccctgccatgcgtgaatgcccagcgcggagaacccaacctgcgcgtggtggactgctccggcgcgcgccgcgacgaggaagtggcggtcgaggaagtgctgatcccctacgcccatggcagcgatcccgaagacgtccccggcgagccgcccaagtcgcgctggtggttgtcctccggcgcggcggtggcgatgcatgtggcgatcatcggtgcgctggtgtgggtgatgccgaccccggccgaactcaaccttggccacggcgaactgccgaagaccatgcaggtgaatttcgtccagctcgagaagaaggccgagccgaccccgcagccgccggctgccgcgccggagccgacgccgccgaagatcgaggaacccaagccggagccgccgaagccgaagccggtggaaaaacccaagcccaagccgaaacccaagcccaaaccggtggaaaacgccattcccaaggccaagccgaagccggaacccaaacccaagccggaacccgagccgagcacagaggcatccagccagcccagcccgtccagcgccgccccgccgccgcccgcacctaccgtcgggcagagcacgcccggcgcgcagaccgcgcccagcggctcgcaaggtccggccggcctgcccagcggcagcctcaacgacagtgacatcaagccgttgcgcatggatcctccggtctatccccggatggcccaggcccggggtatcgaaggccgggtgaaggtgctgttcaccatcaccagcgatggccgcattgacgacatccaggtgctggagtcggtgccgtcgcgcatgttcgaccgtgaagtgcgccaggccatggccaagtggcgtttcgagccgcgtgtcagtggtggcaagattgtcgcccgccaggcgaccaagatgttcttcttcaagatcgagaagcgccgctga

SEQ ID NO: 2518 - DNA, 1641 bp, Pseudomonas aeruginosa
cgagccgcagggcgaataaccgcttgcggttatccgccgtggaacgcagggacaccggaggattacgccgccggcgttgcgcgccctagggctccggtcgggatgccgtgccgtagaccaacagtcggcgggtgtgggggagtcggttgccgcgccaaaaagcaggacggcgacccgaaggtcgccgtcctgtggataaaaaggcccggagtgtgtcggggccatgagcacgaggctcaatcaatcggtcgtgatcttcgagtgcttctgggtgtccttcatgaacacatagaccagcagcgagcaggcgatacaggcggtgacgtaccagtagaagccgctctccaggccgacgctcttgaaccacaaggcaacgtattcggcggtgccgccgaagatcgacacggtcagggcatacggcaggccgacgcccagggcgcggatctcggtggggaacagttcggccttcaccaccgcattgatcgaggtgtagccgctgacgatcaccagcgccgccatgatcaggaagaacgctccccaccagctgtcgacgctgtgcagtgtgctgaggatcgggtaggtgaagacggtgccgagtacgccgaaggcgatcaggatcggccgccggccgatcttgtcggagagggcgccgacgatgggctgcagcagcatgaagaggaacagggtggcagccgagatcatggtcgaatcggtcttgctcatgcctaccgtgttcaccaggtacttctgcatgtaggtggtgtaggtgtagaaggccagggtgccgcccatggtcaggccgaccacggtcagcacttccttcgggtggcgcagcagggtgcgcagcaggctttccttcggctcttccttcttcttcgagaaggactcggtctcttccatgccgcgacgcaggaacatcgccaccactgcgcacagcgcgccgatgaagaaggggacgcgccagccccagctttccagttgttctacggtcagggtctgttgcaggacgatcagcaccgccagggcgatgagctggccggaaatcagggtcacgtactggaagctggagaagaacccgcgctgttccttgttcgccatctcgctcaggtaggtggcggaggtgccgtattcgccgccgaccgacaggccctggagcaggcgcgcgaccaccagcaggatcggcgcggcgacgccgatggtttcatagctgggggtcagggcgatgatcagcgagccaaagcacatcagcagcaccgaggccagcaacgccgccttgcggcccttgcggtcggcatagatacccatcagccagccaccgatcgggcgcatcaggaagcccacggcgaagatagctgcggtgttcagcagttgggcggtcatgtcgccctgggggaagaatgcctttgcgaagtacagcgagaaggcggcgtagacgtaccagtcgtaccactcgaccaggttgccgacggaaccgctgaagatcgacttgatgcgttgcgaagtggtgcggggctgggcagacgcggaaatggcgttggcgctttccatcgtgtttcctcttttcgttgttgtcttggatgtgctgatcagggcgcagcacaccggcacatcgcgagggcgacgtattggatggctcgatag

SEQ ID NO: 2519 - DNA, 723 bp, Pseudomonas aeruginosa
ccttcagcggtgtgtcgaagacctcgcgcttcgaccagggcgaagccttcagcgaaagctggcggatggagcgcgcccagggcgagaaccagccatggctggtggccggtatccggcagaactgatcccgagtggttgcggtcccttcgggggccgccgaaacccccgcttccgccagggaacgggggttttttcatctccgttggcgggttgaccgaccattcgtccggcgccatggccgaaggccagccgcgacacttgtcttgcgctcggtgcggctactgtataaaaagcgcgccacccgttgcgagagagcctgtcgtggaagacgtcatcgaaaaactgcgtgaactcaacgaaccggttccggtgcccctggaactgccggaagaagaactgctggtggaaatcgaggaagagctgctgatcggcattcccgccgagttccgcgaattcctcctgctggtcagcgatgtggtctacggccgcctggagccggtgaccgtgaccgatccgcactcgcacacctatctgcccgaagtggcggccactgcctgggacctgggcgttccgcgcgagctgatcccgctttgcgaggacgacggcagctactactgcgtggcggaggacggcgaggtggtgctctgggccgatggcgacctcaccgatgaaagctgggattcggtgtgggtttgggctcgcgacgtctggctggagagctga

SEQ ID NO: 2520 - DNA, 945 bp, Pseudomonas aeruginosa
agtcgttcctggagattctcggccatggtcagctccgggtcgccggtggcgccggaagctgggaaagcgtcaggctgcagttgcgcatgttcagctccgtttgttttcgatcaggcagttgccgccatccaccaccagcagttcgccgttgacgaagctggcttcgggcgaggcgaggaaggccaccgcggcggccacctcttcgggccggccggcacgtccgctggggctggccagggcggcctggcgttcttcggcggtgctcgaggcggtggcgatccagcccggcgcgacgctgttcaccgtgatgccgctcttcgccacctccagcgccaggcccatgctccagccgaccagaccggccttggccgcgctatacgcggcttcgcccgggttgctgccgcgggttccggtggtggaggcgacgttgacgatccgcccgtagccgcgctcgcgcatgcccggcagcaggccgcgggtgagcaggaaagcgctggtcaggttgcgcgacagggacagttgccaatcccgcagcgaggtcgcttccactgcgctgaagggctccgcgctgtccaactgggccatgccggcattgttcaccaggatgtcgacccgtccccactgggcttcggcccagtccagcaggccctgcacctgggcttcgtcggtcaggtcggcgctcgcggcgcgcacgtcgtgaccacatgcgctcagttcctccgctcgttgcctaatccgctcgctgctggcggtgatcagcaggcgcacgccttcgcgggccagccgccgggcaatggcgaaaccgatgccgagttcgctgccggcgccgctgatgagcgcgacctgacctgtccacttcgaaaagtcattcatttttgtgatcacaaaattgacatggaaaacagattatcagtgctttcaaatactgtattgacttttttgtga

SEQ ID NO: 2521 - DNA, 1266 bp, Pseudomonas aeruginosa
tgtggacggccacgcctacgtggacttctgcctgggcgataccggcagcatgttcggccattctccggcgccgatcgcccgggcgctcgccgagcagggcgcgaacggcctgaccaccatgcttccgggggaggatgccatcgtcgcaggcgagctgctggcgcagcgcttcggcctgccgttctggcaggtagcgaccaccgctaccgacgccaaccgcttcgtcctgcgctgggcgcgtgcgatcaccggtcgcaaggtggtgctggttttcgacggttgctaccacggcacggtcgacgacaccctggttcgctgccgcgacggccgcaccgtgcatcgctccggcctgctcggccaggcccacgacctcacccagttcagccgcgcggtgccgttcaacgacctccaggccctggagcgggcgctggccagcgaagacgtggccgccgtgctctgcgagccggcgatgaccaacatcggcatggtcctgccgcaacccggcttccaccagaagctgcgcgagctgacccgtcgtcacggcacgctgctgatcatcgacgagacccacaccatctccacaggtcctggcggctgtacccgcgcctggaagctcgagccggacttcatcaccctcggcaagccgatcgccggcggcgtaccgtgctcggtgtatggttgcagcgcggcgatggccagcgccatgcaactggccagggcacgtgccagcgagcagagcgaaggccacggccacagcggcatgggtaccacgctgtcggccaacgccctggcgatgcgctgtatgcgcgccaacctggaagaggtgatgaccgataccgcctacgcccacatgctgtccctggcggcgcgtctggccgagggcttccgcaggattatccacaagtacggcctggcctggtcggtgaccgagctcggcgcgcgcagcgagttccagttctgcccgcaacccccacgcgacggcgcggccgccgaggcggcgttccacgacagcctgcagatggccttgcacctgtatctgatcaaccgcggcatcctcatcacgccgttccacaacatgaccctgtgttgcccggacactcgcgaagaagatgtcgaccgcctgctctccagcctcgacgaggcgctcggcgagctgctcgccatacccggcgcgcgggaggcctgagatgcatttcgccgatccgcgggaagcccgcgagttcctcgccgcacaccccgaggtgcgcagcatcgagctgttcctga

SEQ ID NO: 2522 - DNA, 849 bp, Pseudomonas aeruginosa
acggctgccggcgttgccggtcagtcattgaagcgggcggccgattggccgtcggtgttttccacgcggcacaggagtaaggaaaagcagatgagcacgcccgtcgttcttatcactggtgcagccggcggcttgggccgggcaatcgccaagcgtttcgcccagagtcattggcgcatcgccgccacggatgtggataaggagggcctgcacgcgctgaacgcgcaggtgccgttggacgccagcggggtcgccgacctgcgcagcgcggataactgccataccctgatgtcgaagattctcgcccgtaccggacgtctcgacgccctggtgaatgccgcgggcgtctggcgcgaggggcctgtggaaaacttcaccgaggaggatttcgacctggtcctgggagtcaacctcaaggcctccttctacatgtgccaggccgcgattccctacctgaaggaaaaccagggcagcatcgtcaacatctccagcgactccggacgccaggcctaccggggttcggcggcgtattgcgcgagcaaggcggcgctgaccatgctgagcaagaccctggcgctggaactggccgagcagggcgtgcgggtcaacgccgtgtcgccggcggatatcgccacgccgatgctcgactaccaggccgaacgctatgggatgggcaatccggatggctacaagcgcgcgctgctgaaggattatccacagggcaaggcggcacgcttcatccgcccggaagaagtcgccgagctggtctggtatctctgcggccctcaggccgaagcgatcacgggtgccgacctggcggtggacttcggcctgtccgctggccgctga

SEQ ID NO: 2523 - DNA, 609 bp, Pseudomonas aeruginosa
aaaagcccgcggatgtctgcacgacccggcgcgatttcgatcatgacgattgaaaatttgtggccgctgccgtcttcgtttgcgtctatggtgtcccccgcccgtcctgatgagagaaaaagcgctatgcaacccggaaacaaccaactgtcgatgaccgtgctgatgactccggacatggccaatttctccggcaatgtccatggcggcaccctcctgaagtatctcgacgaagtcgcctatgcatgcgccagtcgctatgccggtcgctacgtggtgaccctgtcggtggatcaggtgatcttccgcgagccggtgcatgtcggcgaactggtgaccttcctcgcttcggtcaactacaccgggcggacttccatggaaatcggcgtcaaggtcatcaccgagaacatccgcgagcagtccgtgcgtcataccaacagctgtttcttcaccatggtcgccctggatgacgagcgcaagccggtggccgtccgcccgctggagctggaaaccgccgagcagaagcgccgcttcgcccaggcccaacaacgccgccagctgcgcgcggagctggaggcccgctaccaggcgattcgcgaagacggatga

SEQ ID NO: 2524 - DNA, 684 bp, Pseudomonas aeruginosa
tcatgggcgagcgcgagatcgcctgcggcatggtccatcgcctgggactcgaccgtgacgagcgcggcgccgacgcaccgctgccgcagtcggcctgacatgttgcgccgtctctacgactggaccctgcgcctggccggccatccccgcgcggagctggccctgggcggggtgaccttcgccgaaagctcgttcttcccgattccgccggacgccttgctggtgccgatggtcctggccaaccgggccaaggcctggcgctacgcggcgatctgcgcgatcagctcggtgctgggcggcatcgccggctatttcatcggcttgctgctgttcgagagcgtggccatgccgatcctggcgttctatggcttgctggagaacttcgaacaggtcgccgaacgctacaacgaactgggctggctgatggtgctgctgggcggcggcttcacgccgctgccgtacaaggtgatcaccattaccagcggagtgacccagctcgacctctggctgttcgtcggcctcagccttgtcgcccgcagcctgcgcttcgccgctacctgcgctttgctgttctgggctggcccacgcctgaagaccctgatagagcggcgtctgggcatggctttcgtgctgatggcggtgatggtggtcggtgggttgatgttggggaaatacgttctttga

SEQ ID NO: 2525 - DNA, 351 bp, Pseudomonas aeruginosa
attcgaaggcgttacgcaggtcgtcgccgagcagcaggcgagagaggaacagccccgaggccaggtcgccgaccccgaccggttgccgcgggaaggccagcagcgggcgttgcaggtgccaggcctgatcggcggccaccagcagcatctcgaaggtgtcgccggccttgcccggatagttcaggtgctttaccaggattgccctgggaccgcgtgccagcaggctccgtgccatttccacgcagtcggcgagggagttcggctggcggtcgcagaagctgtccagctccaactggttggggcacaggtagtcggcgaccgcggcggcttcttccagcaggaagtcgctga

SEQ ID NO: 2526 - DNA, 531 bp, Pseudomonas aeruginosa
gacgacttcctacagctgagtcggcgcagtatgggggctaattcacatggcgaaaacaccccccactcgctgcctgccgggagaacgggtaagctggccgtccccctacaccggattccgctcgtgaccctgggtaaccttttcgtcatgctcctgttgggcgccgccgcagcctggtggtggcgcgcccatggcgtgcgcgagcgggcgttgctgctggccaagcagcattgcgccaagcagggcgtggaactgctcgacgagaatgtcgcgcgccggcgcctgcgcctggcccgtgaccaccgtggtcagtggcggctgagccgcgagttcggtttcgaattcaccgtcagcggcgaggaacgctacgccgggcgcatcgtcatgtatggctatcacctcggcgccatcgaattggccccgcatcgcttcgaggcggccgccgaggtcgacaacccgccggtgcatagcgccgaggtgattcgcctcgacgagtggcggcagtcccggcagaaaaaggtcggcgactga

SEQ ID NO: 2527 - DNA, 1116 bp, Pseudomonas aeruginosa
aaccggccgagcaggaatgggaccagggggatagcgacatgggcggactcctcgtacggcgcgcagtgtaaccgggcgccgtgctatcgtcgccgcttcccgccgccgtttcgatccgccgatgtccttgtcccgtccactgcgcctgttcctgctgttgctgccgctgctcggcggcctgctgctgtccatggactgggcgggtcgccaggcgcggcagcaggcgctacgcgccgagggcgaacaggtgcgcaagcagctggacctctacgccggctcgctgcagaccctgatcgaacgcttccgcagcctgccggcggtactggcgctggatccggacctgcgcgcggcgctggccgggccgatcgacggcgagttgcagcagcgcctcaacctcaagctggaaagcatcaacctggccgcccgctcctccaccctggagctgctcgaccgtaccgggctggccgtggcggcgagcaactggaacctgccgaccagctacgtgggccacaactacggtttccgtccctatttccgccagaccatcgcccaaggctccggacgtttctatgcggtcggggtgatcagcgggattcccggttatttcctgtcccacgcggtgcgcgccgaggacggcagcttcctgggcgcaatcgtggtcaagctggagtttcccgatctggaacggcagtggaaccagacccccgacctggtcctggccagcgacgccaagggcatcgtgttcctcgccaaccacgccggttggcgctaccgcgaactggaaccgctggataccgtggaccgcttcgaactggcggagacccggcaatacgatcgccagcccctgacacccctgcgccaccagaccttgcgcagctacggcgaagacagccgtctggcgcgggtggaaagcgccgacggcgagaaggactacctctggcaatcgctggacctgcccaacgacggctggaccctccacttgctgcgcgacaccgcgagcatccaggacgacgtcgccaccgcgcgcctggccgccgccggcacttggctggcgctggtcttcctcggcttgttcctgcaccagcgctggcgtatcgcccgcctgcggcaacgtag

SEQ ID NO: 2528 - DNA, 1359 bp, Pseudomonas aeruginosa
cacgagcgtaacgacatgagcgaccaggtgatcttcgtcgacgacgaagcgacgatccgcgaagcggtgcagcaatggctggagctgtccggcttcgaggtgcgcctgtgcctgcgcgccgaggaatgcctgggagcgttggacaagtccttcgccggggtggtcatcagcgatgtgcgcatgcccggcatggacggcctgcaactgctcgccaacctgcaggcggtcgatcgcgacctgccggtgatcatggtcaccgggcacggcgacgtgccgatggcggtggaggccatgcgccagggtgcctacgacttcatcgagaaacccttcacgcccgagcgcctgctcggcagtttgcggcgcgcgctggaaaagcgccgcctggtgctggagaaccggcgcctgaaggagcaggccagtctcaaggaccaggtcgatgcgcgtctgctcggcgtgtccaagccgatggaagcgttgcgccggcaggttctggccctggcgccgaccccggtgaacgtcctgatccgtggcgagaccggcagcggcaaggaactggttgcccgctgcctgcacgacttcgggccgcgcgccgacaagccgttcgtggcgctgaactgcgcggcgattcccgagcaactgttcgagagcgagctgttcggtcatgagagcggtgcgttcaccggcgcgcagggcaagcgcatcggcaagctcgagcatgcccatggcggcaccctgttcctcgacgagatcgaaagcatgccgttggcgcagcaggtcaagctgctgcgcgtcctgcaggagcagcaactggagcggctcggctcgaaccagagtatccacgtcgacctgcgggtgattgccgcgaccaagcccgacctgctggccgaagcacgtgccggacgcttccgcgaggacctggtgtatcgcctgaacgtcgccgagctgcgcctgccgccgatccgcgagcgtcgcgaggacatcccgctgctcttcgaacatttcgccagcgttgccagccagcgcctcggccgcgagccgcagcccgccgcgccggcggaactggcgcggctgatggcccacggctggccgggcaatgtacgcgagctggccaacgccgccgagcgtcatgtcctcggcctggagcgtggggacgccgaggaaggcggcggcctcacctcggggctggcggaacgcatggaagccttcgaggcggagtgcctgcgccaggcgctcggccagtgccgcggggatatcaaggcggtgatggagttgctgcaactgccgcgccggacactcaacgaaaagatgctgcggcatggcctcagccgcagcgatttcgtcggcgaagagccggcctga

SEQ ID NO: 2529 - DNA, 1332 bp, Pseudomonas aeruginosa
ggtgagcacgtccggtgcgtcgaggaaggcccagccgattcccagcgacagcaccgccaccaggtacaggctgacgtgcggcgtctggtagcgcggatggaccctggccagcgcgcgcggcagcctgccgtcccgggccatcgagtagagcaggcgcgagaccgctgcctgcgaggtgatcgacacggtgacaccccaggccagcgcggtggctaccgcggtcagcatcgacagccactggccaccggccgcttcggcgatctcgtagaaggcggtgtccgccgacttgaagttcatcccggcggcgaggtcggtggccagccaggtctgcgcgatgaagatgccgcccatgatgaacagcgcgatcagcgcggcgcggccgatctgccgggcgggatcgcccttgacctcctcggcgagggtggagatggcgtcgaagccgaggaacgacagtacggcgatcgaggcggccttcatcaccaggccgagatcgaaggcttccgggcgatacagcggttcgagggtcagccggccgttgcccaggccgccttccagcgcctggtagccgaccaccaggaagatcgccagcaccaccagctctccgatcaggaacaacaggttggcgcgggcggcgaaggtgatgccgcgcaggttgaccagggtcgccgagaccaggaacagcagcatccaggccagcttggggatcgccgggaacaagtggttcagcgccagcgcgctgaacacgtagagcagcggcgggatcagcaggtagtcgagcagcagcacccagccggcgatgaagccgacatgggggtggatgccgcgctgggcgtaggaatacaccgagccggcaatcggaaaggccttggccatggctccgtagctgagggcggtgaagagcatcgccagcatgcccaccaggtaggccatcggcaccatgccgtgggcgtcggcatggacccagccgtagaccccgaacggggcgatggggatcatgaagatcatcccgtagatgatcaggtcgctcagggacaggctgcggcgcagctgttgccggtatccgaactgttcgatggccatgacgggctcctcgggaaaaggcagcgtattgtcgttatcggcgccgcacgcgaagcgggcctctttctcgttgttggcgaccggcggcgccggtcatcgcatcagagccagggatacagacgctcggcccaggcgtacaccgcatccggcgtgcgcaatccatcgttgcggatctccagcagcaccgcttccagaccgcgtgcgtcgccatgcaccggaacggtagtgtcttccgccgggtcgatcgcatag

SEQ ID NO: 2530 - DNA, 1416 bp, Pseudomonas aeruginosa
atgccgagttcggggttgtcagtaaagctcggcatagtggcggcacaggtcgtcgtcggaaaggcccgccgtcagtgccagttcgtggcgcttcatggcgaggtaagtgtccagcagcggctttggcagctcggcgcagagcgtctcgtcgcgctgcaggcagtcgagcgcatcgccgagggtcgccggcagggcctggatgccgcgggcctggcgctcttcgtcgctgaggccgtgcggatcgatatcggccagggcgcgcagcggcaggcgtcgttcgatgcccaggcggccggcgatcagcaccgcggccatcgccaggtgcggacaggcggtggcgtccatcggccggaattccaggttgtactgcttgcccagcggcttgccgccgacgctcaccaccgggcagatgcgcagcgccgcttcgcggttgcgcagtcccaggcaggcgtaggcggcgctccagtggtggggtttcaggcgcaggtaggaggcggcggtaggcgcggtcagcgcgcacagcgctggcaggtgcgcgagcacgccggcggcccagtgctcgccgagttcggagagatcgttgggtcgaccgggctcgtacagcagcgggctgccgtcggcatgttgcaggctcaggtgcaggtgcaccccgttggtcaccgcgccgggtgccggcagcggtgcgaagcaggtacgcaggcccatctgccgcgccacttcgcgagtgacctcgcggacgttcaccgcgcggtcggcggcggccacgccctgcgccgggcggcaggtgacctcgtactggcgctggccgtattcggggaggaacatctccggctcggtgccagcctgggccagggcgctgaccagccagccggggaactgcccggcggcacgctgggcctgcagcgaaaacgccgcggccggacgctcgccgggcaggccgagcaggctgaattcgtgttcgaacgccgcgatgacctgcaggccgctgtcgcgatagcgttccacctcggcccgcagcaggctgcgcgggcaggccggccacggcgtgccgtcggtttccaccaggttgccgtgcaggtagtcgagcgccggcgcagcggcgtcgggaccctgctcgacgcgcacccggctgttcgggtcgggcagcaagcgcaggtcgccgtggctgccccaggggctgctctcgtcgatcaggtcctgcggggtcagcgagctgttcgccggtacccagccgcaaccgctggccaattgctcctccagggtcgccaggggcagcgaacgcccgcgggtgatgccggccaggtcggtggtgacgaagctgaccaggcgtaccggctgcaggcggttcacaggttgctccggccgagggcggcgatgcgttgcaggacggtctcggtgtcgctgatccagcagtag

SEQ ID NO: 2531 - DNA, 210 bp, Pseudomonas aeruginosa
accgagcattttaccttgctttcttatgcattattaatatttattggtgatgaaaaatcattgaaatggaataagcgtctggtgcgctcccgacaagcgctttctgctgcggccggggcaggaccggtctcaattccggggggtaagtatcaatcgggttggcttgtcggcctgtacgacatggctgagatgcaggtcgaaatcgggtga

SEQ ID NO: 2532 - DNA, 1200 bp, Pseudomonas aeruginosa
gagcttcttcacccgcgccaagagctggtcggaaaccagcggatagtcgctgtcccggcgcacttcgatatgcaccctgcaacggtaggcgacgacatccgcggccaccgcgtcgagcaccgcaccgaggccgccctggccggtgccgtcgagcatcggcaggggcacggcgctgctggccgcttgcggatcgatcaggtggggagcgccgggcagcggcttcagctcgccgccgggcggcgtctggatgatctgctgcatctgctgctgggccgcctgctgcatgcgtcgggcctgctcggcgcgggcgggatcgaccttggcgcggttgatcgcaccgtccagcccggcggtcagcgccggcgctttgggcatcagtccgcgggcatggccgagggcgctggtggcggtgttgaggtctccttgacgcagcgcggtttccccgcgctgcatgtaggcctcggccaactggcggcggaacgcttcgacgcgctcgtcgccggcggctgcgctgcgcagggccagccattgttgctcggcctgttcgagcttgccggcggccagggtttgctgcagttcggcatagggatcggcgggctgcgcctggggcgcgaccaccggcgtcggttgcgacgacgcattgccctggcaggcgctgaccagcagcgccgccgccaggacggacagcaggcgaaagaaggacgacatcattcctgcgggttctcgtttggtcaaaaaatcgccagattctacaccgtgcggcggggcaggacaaaactcagcaggaacaggccggcggcgctgaccacgatcgaggggccggcgggggtatccttgaaccaggacagggccaggccggcgcacaccgcgaccagtcccagcaggctggcgccgaccgccatctgctcgggactgcgggcatggcgctgggcggcggcggcgggaatgatcagcagcgaggtgatcagcagtacgccgacgatcttcatcgccacggcgatgacgatggcgatcagcaacatcagcgccaggcggatcgctccgaccggcaggccttccaccttcgccagttcctcgtgcacggtgatcgccagcagcggccgccagaggaagcagatcagtgccaggaccagcgcgctgccggcgattatccacagcaggtcgctggcgcttaccgccagcagatcgccgaacaggtaa

SEQ ID NO: 2533 - DNA, 690 bp, Pseudomonas aeruginosa
ctcgggcttgcgcagcagagcgcgggccagcagcacgcgttgcagttcgccaccggaaatgctttgcagcgggcgctccagcacgtgcgccgcgccgacctcgcgcaacgccgccagcgcctgctcgcgcctgaccccgggtaccaggcggaggaagcgcagtacgctgagcggcagggtggcgtcgacgtggagtttctgcggcatgtagccgatggtcagccgcggccgtcgccagacctcgccgacgtgcggcttgagcaggccgagcacgctgcgtaccagggtggtcttgccggcgccgttggggccgatcagggtgacgatctggccgggctcgatggccaggtcgacatcgctcagcaccgcctggccgttgaaggacacgccgacctgggtcagccgcaccagcgcgttgtccatcaggcgtccttctggtcccggcaggtgccgcagaggccgaccacctcgacggtctggctttcaacggcgaagccgacgctgttcgctccggcgacgatggcccggctgatatccggctgttccagctcgatcgcggtgtggcaggtgcggcagatgaggaactggccctggtggctgtgctccgggttgttgcagccgacgaacgcgttgagcgaggcgatgcggtgcaccaggccgttctcctggaggaagtccagcgcgcggtag

SEQ ID NO: 2534 - DNA, 435 bp, Pseudomonas aeruginosa
ccagcatcaaaccgctgcaactggtcgccgcggccatccaggacggcgtcggccagccggacgtactgctgccgccgggcgcctcgccgcaccagtacgccctgcgtccttccgacgtacggcggctgcgcgaggtgcaattgttctactggatcggcccggacctggagaacttcctgcccaaggtgctcgccggccgccagggcgccagcgtcgcggtgcaggacctgccgggcatgcacctgcgcaagttcgtcaatttcgaggaagaggagcatgccgggcacgacgagcacgaccatgaccatcgtcccggcatgctcgacgcccacctctggctgttgccggccaacgcccgcaccatcgccgcgcggatggccgaggacctggcccaggtcgacccggccaacgccgggcgctaccgggccaacctga

SEQ ID NO: 2535 - DNA, 2205 bp, Pseudomonas aeruginosa
atgttgcgtacggtggccggcttcggacgccccaacaaccatcgggaggttaatcagcggatggccaagacagacgcacgcagtccccgcaccgaacgcgggaccatcgccctgcaggacgcgtcgcaggatatctgggacaagaagtaccggctcaagagcaaggacggtacgccggtggatgccagcgtcgacggtacctggcaacgcgtcgcccgcgcccttgccgatgtcgaggaaaaggcctcccgcgaacactggtacgggcgcttcctctgggccctgcgcaacggtgccatcccggccggccggatcatctccaacgccggcgccctggggcacaagccggccacctcgaccatcaactgcacggtgtccgggaccatccaggactccatggacaacatcctcgagaaagtccacgaggccgggctgacgctcaaggccggctgcggcatcggctatgagttcagcaccctgcgcccgcgcggcgcctacgtttccggtgccggtgcctacaccagcgggccgctgtcgttcatggacatctacgacaagatgtgcttcaccgtcagctccgcaggcggccgccgcggcgcgcagatgggcaccttcgatgtcagccacccggacgtccgcgaattcatccgcgccaagcgcgaggacgggcgcttgcgccagttcaacctgagcctgctgatcaccgaccagttcatgcaggcggtggaacaggacgccgactggccgctggtattcccggtgcacgtgaaggagcgcgacgagatcgacctcgacgaccccaacgcggtggtctggcgcgaatggccgatccaggacgactacgttcagcgcgccgacgggctggtcgcctgcaaggtctacggccaggtccgcgcctgccacctgtgggacatgatcatggtctccacctacgactatgcggagccgggcttcatcctcatcgaccgggtcaacgaactgaacaacaactggtggtgcgaggcgatccgcgccaccaacccctgcggcgagcagcctctgccgccgtacggctcgtgtctgctcggctcggtcaacctcacctgcttcgtcgagcagccatttggcgacgaggcgcgcttcgactgggaccgtttccgcgaagtggtgcgggtgtttacccggatgctcgacaacgtggtggaaatcaacggcctgccgctggaacagcaacgccaggaaatccttggcaagcgccggcatggcatgggcttcctcggcctgggctcgaccctgaccctgctcaagctgcgctacggcagtcccgaggcctgcgtattcaccgaggaagtggcgcgggaaatggccctggtgggctgggaagtggccctggagctggccagggagaagggcccggcgccgatcctggcgcaggactacgaagtcactgcggaaatgcttcgcaagcgtccggaaatggccgccgatggctataaggccggcgaccgcatccgcggtagcgtgcttcacgccaagtattcccgctacatgcagcgggtcgccgaacatgctccggaactgatcgaggcgttggctgaaaccggcgcgcgcttcacccaccacagctccatcgcgccgaccgggaccatcagcctgagcctggccaacaatgcctccaacggtatcgagccgagcttcgcccaccattattcgcgcaaccttatccgcgaaggccgcaagaccaaggaaaaggtcgaggtctacagctacgagctgctggcctaccggaccctggtcaacgcccaggccctgccggacagcgacgacccggcgcgacgcctgccggactacttcatcaccgccgacagcgtcaccccggcgcagcacgtggacatccaggcggcggcgcagaagtgggtcgattcgtcgatctccaagaccgccaacgtgcccaccgactacccgttcgaggacttcaaggacatctaccgctacgcctggcaccagggactcaagggctgcaccaccttccgcttcaatcccgaggcgttccagggcgtgctggtcaaggagtccgacctggagaagacccgctaccgcttcgaactggaggacggcagcgtggtggagttcaagggcaacgagcaggtcgagtacgacggtgagatccataccgccgccaacctcttcgacgccttgaaagaaggctattacggcaagtactga

SEQ ID NO: 2536 - DNA, 480 bp, Pseudomonas aeruginosa
tcgccaggtcgtagagcatccagccggagcaggcgttgtagaagtcgatcaggccggccaggtgcgggccgtcgaacagcacgttgtcgcggaacaggtcggcatgcaggttggcgcgcggcagcgctggacgctcggcatccagcgcggcgatctccgccagggccggggcgagcagggcgcgggcctgttccggtagtcgcggggcgaggttggcaccttgttccagcatccagggcaggccacggtcgctcgggcgttcgaggatgcgcccgcgggtggcggcgtgaaggtggccgagcagatcgcccacttcctggcagtggtgggcgttcggctgccgctcgtggcggccggccaggcgcggttgcagcagcgccggcttgccttcgagacggcgcagggcctcgccgtcgcgggtgcgcagggcgtagggcaccggcaggccgtcctcgtggagcacgtcgagcagttcgatga

SEQ ID NO: 2537 - DNA, 2814 bp, Pseudomonas aeruginosa
ccttgctcctttatcgaatcgtccagggttcattctacacgccctggtctccggaaaaggttgattcccctcatgagccaagcgcccctcgtcctggtggacggttcctcgtacctgtaccgcgccttccatgccctgccgccgctgaccacctcgaccggcaagcccaccggtgcggtgaagggcgtgctgaacatgctcctgagcctgcgcaagcagtacccggacagcccgttcgcggtggtcttcgacgccaagggcccgaccttccgcgacgagctgttcgccgagtacaaggccaaccggccgtcgatgcccgacgacctgcgggtccaggtcgagccgctgcatgccagcgtccgcgcccttggcctgccgctgctgtgcgtggagggggtcgaggccgacgacgtgatcggcaccctggcgcgcagcagcgccgcggctgaccgcccggtggtgatttccaccggcgacaaggacatggcgcaactggtcgacgggcacattacgctggtcaacaccatgaccggtagccgcctcgacgtggatggcgtgaaagagaaattcggcgtcggtcctgagctgatcatcgatttcctcgccctgatgggcgacaaggtcgacaacatccccggcgttccgggtgtcggcgagaaaaccgcgctgggcctgctgaccggtgtcggtggcggcctggaggtgctctacgccagcctggacaaggtgcccgagctaccgatccgcggcgccaagggcttgccggcgaagctcgaggaaaatcgcgagcaggcgttcctgtcctatcaactggcgaccatcaagaccgacgtcgaactggacgtggagatcgacaagctgtatcccggcgagccgcagcgcgaagcgctgatcgccctgtaccgcgagctggagttcaagaactggctggacgacctcctgcgcgaggccaaggaggccggcgagaacggcgaggcggaaacgcctatccaggccgaggtcgactacgacgtggtgctcgaccaggccggattcgacgcctggctgaagaagctggaggaggccgagctgatcgccttcgataccgagaccaccagcatcgacgcccagcaggcgcaggtggtgggggtgtccttcgccgtgaaggagggcgaggccgcctacgtgccgctggcccacagctacatgggcgttccggagcaactggaccgtgacgcggtgctgcgtgcgttgaaaccgctgctggaggatccgaagaagctcaaggtcggccagcatgccaagtacgacatcaatgtcctggccaatgccagcacccccatcgcgctgcggggcgtagcctacgacaccatgctcgagtcctatgtgctggactccaccgccactcgccacgacatggacagcctggccctgaagtacctcggccacagcaccatccgtttcgaggacatcgccggcaagggcgccaagcaactgaccttcgaccagatcgccatcgaacaggccgggccctatgcggcggaggacgccgacgtgaccctgcgcctgcaccaggccctgtggcagaagctggaggcgatcccgtccctggccagggtcctgaccgacatcgagatgccgctggtaccggtgctggcgcggatcgagcgcaacggcgcgctggtcgacgccaacctgctgggcatccagagccgcgaactgggcgagaagatggtcgccctggagcgccaggcatacgacctggctgggcaggaattcaacctcggttcgcccaagcagctcggcgcgatcctctacgacaagctcggcctgccggttctgagcaagaccgcgaccggccagccgtccaccgccgaggcagtgctcgccgaactggccgagcaggacttcgagctgcccaaggtgatcatgcagtaccgctccatgagcaagctcaagagcacctacaccgaccgcctgcccgagcagatcaacccgcgtaccggacgcatccatacctcataccaccaggcggtggcggctaccgggcggctgtcgtcgagcgacccgaacctgcagaacatcccgatccgtaccgcggagggccggcgcatccgccaggcgttcgtcgcgccgcagggctacaagctattggccgcggactactcgcagatcgagctgcggatcatggcccacctggccaaggacgatggcctgctggatgccttccgccacgacctggacgtacaccgcgccaccgcggcggaagtcttcggcgtgccgctggaagacgtcagcggcgaccagcgacgcagcgccaaggcgatcaacttcggattgatctacggcatgagcgccttcggcctggccaagcagatcggtgtcgagcgcaaggaggcccaggcctacatcgaccgttacttcgcccgctaccccggcgtcctggcgtacatggaacggacccgcgcccaggccgcggagcagggcttcgtcgaaaccctgttcggccgtcgcctgtacctgccggagatccattcgaagaacggcgccatgcgcaaggccgccgagcgcaccgcgatcaacgcgccgatgcagggcacggcggcggacatcatgaagcgcgccatggtcgctgtggataactggctgcaggaaagcggcctcgatgcccgggtgatcctccaggtgcacgacgaactggtgctggaagtgcgcgaggagctggtcgagcaggtgtgcgagggaatccgcccgctgatgagcggagcggcgaccctggacgtaccgctggtggtcgaggcgggtgtcggttcgaactgggacgaagcccactga

SEQ ID NO: 2538 - DNA, 2820 bp, Pseudomonas aeruginosa
cgattcgcgggagctgcccgacgacggccgcctgcgccttctcagcttcaacatccaggtcggtatcagcaccgagcgctaccgccactacctgacccgcggttggcagcacctgctgccccacgcggggcgggcgaccaacctgaagcggatcggcgaactgctcgccgactacgacctcgtcgccctccaggaagccgacggcggcagcctgcgttccggctacgtcaatcaggtcgagcacttggcccagttgggggcgttcccctactggtaccagcagctcaaccgcaacctcgggcgtatcgcccagcacagcaacggcctgctcagccgctggcggccgaccctgctggaagatcatccgttgcccggtccgccgggacgcggcgcgatcttcgtgcgctttggcgaaggcgccgacgcgctggtggtagtgatgatgcatctcgctctcggcgctcgcacccgcacccgccagctcgcctatatccgcgagctgatcggcgactaccgccatcaggtgctgatgggcgacatgaacacccacgccgtcgatcttctggaaaactcgcccctgcgcgacctcggcctgatggcgccgcaggtcgaggcgacgtttcccagctggcggccgcagcgcaatctcgatcacatcctgctcagttccgatctcgctctcgagcgggtcgacgtgctcgaccagccgatctccgaccatctgccggtatcggtggagattcgcctgccggacaacctgcgcgacaaggccttggtcgtgcgcggggatgccgggagtccgccatgagtcgcgacgacgtccagcgctggaaagacaagtacctggagaacatcgagcagcaggagcgcctgcaacggcgctgggatgcccggatcgacctgctgcgtcgcggcctggtgcgtagcagtctggcggccgaaggcagcgacaaggcggtcgaccagtgcatgaaggagctgcgcgagatcctccgtcgcgacgacatggacgccggcctgtcgggcctgattccgcgcctggaaaaggccgtgctcgactccgaacagcgccgccagcaacgcacccagcagaacatcgatgctctcggcgaactggcccagcagttgctggccctggacctgccgcgggaactgcgcaagccgctgaagcagttcgcccgcgatatcgaggagcgcgcccggcagtcgcgcgagattccgatcctgctcagcgagctgagcaggctgcaacgccaggcgctggccgagcgcaagggcggcgatgccgaagacggtcgcccgagcctgttgcaacgcctgttcggcggcaaggagtcggaaaccaccgcggagccgagcgcatcggtgccgtccgttgtggcggcaagcaatacaccgatccaaccggcggcggccgcgccgtccctgccggtcgccgagcacgacgaggcgccaggcggtccgccgcagccgttgcccgcctgcacggtcgccgccatcgaaagcgcgccagcgggttgggtcggggtcgccgagcgtggcgagccgaaccagatcctgctggatgagcctcgggaaatctggctcgacagcctgccgctaccggccggcctgagctttagcgagacgctggaagaagcgggtgcggagccgtcgcccgcaatgccggcggacgttgaaagcgcgcccgaagctccggccactcctgtggataacctcgacgggcaggcggtagacgaggcctacgaactgccgccgccgataccggagcccggctacagcgcggtggcgccgcacatcgaggccagcctgctgcggctgctcgacggcctgtccctgccgagcagccaccagccccaggccgaggcgctgcgggagcggatcgatggcagcctgaactggtatgagctggtgccggtactcgacgacctggcggtgctggtgctgtccctggcggacagtggccagcgcgacttcgaggaatacctgcggcaactcaacgagcgcctggaaagcttcctcggccacctgggcgacgcccacgccggctataccgacgtgctggacaacgcgcgcggctttgaccaatcgctgcgtgagcaggtcagtggcctgcaggccagcgtgcagcaggcgaccgacctgaacagcctcaagctggcggtggacagccggctgaacggcctgcttgcctccatggacgaacaccagcgcgaacaggccgagcacgaacaggaggtgtccggccgcctgcaggcgctgatggagcgggtcaacagcatggagcaggatgccaaggcgttccacagccacctggaggaccagcgacagaaagccctgaccgatccgctgaccggcctgcccaaccgcgcggcgctcagcgagcgcctggaacaggaagtggcgcgccggcaccgggacggcggcgatctgctgctggcggtgctggacatcgaccacttcaagcggatcaacgacgacttcggccacctggccggggacaaggtgctgaagatcattgccggcgaattgcgcaaacggttgcggcaggccgatttcatcgcccgtttcggcggcgaggagttcgtcgtcctgctcccggccacgtccctggaagccggccggcaactgctcgaacggctgcgcgcggcgatcgccgcctgtccgttccatttcaagggcgagcccctgagcatcacctgttccgccggcatcaccgcgttcgaaggcaacgaggccggcgaagcggttttcgagcgtgccgaccaggcgctgtatcgagccaagcgcgccggccgggaccgcctggaagtggcctga

SEQ ID NO: 2539 - DNA, 711 bp, Pseudomonas aeruginosa
agggcgaccagcgcacattccgacgactcgggacgggctcgcctgcaggtgttgccgcggctcgctagaatggtcccgcccggtagaatgaccggctgtcccgctctggaaactcccatggatatgttcggcgtcgccgtcctgatctttctggtcaccgaccccttcggcaacatcgccgtgttcctcgccgcgctgaaaggcgtcgcacctgggcgccgcctgcgcgtggcgtttcgcgagctggctttcgccctgggcctgctgctgctcttcctcaccctcggcgagcacatcctcagcggcctcggcctgtcccgcgaggcgaccgggatcgcgggtggcatcatcctgttcgtgatcgccatgcgcctgatcttcccgtcgccccaagggctgctcggcgaagtgcccgacggcgagccgctgctggtacccctggccaccccggcggtggccgggccctcggcgctggcgatgctgatcaccctgcgcaccaccttcgacggtccgctgtgggagctttacctggcggtggtgctggcctgggccgctactgcgctgatcctgctgcaggcggcgttcctccagcgtttcctcggcccgcgcgggctgaccgccatcgagcgcctggccggcatgctgctgatcatgctcagcgtcgatatgctgttggacaacctgcgcagcgtgttgcacatcgccgcctga

SEQ ID NO: 2540 - DNA, 807 bp, Pseudomonas aeruginosa
ccacgctgcctatctttcggagtcatcatgcgttcgttcgttctactggctttcaccctgtcgctgctggccggctgctccagcggcccgcgcctgaacaccgactacacctcggcgaaccaggacagccgcgtccagttcatcgtcctccactacacctccaccgatctgccgcattcgctgggcatcctcacccacggcggcgtcagcgcgcactacctgatcggcgacgacgagccggccaccgtctaccgcctggtggatgagaaccgccgcgcctggcacgccggggtcagtgaatggcagggccggacctggctgaacgccacctcgatcggcatcgagatcgtcaaccagggctatcgcgatacaccccaggggcgggtctggtatccgttcagcgaagcgcagatccaggcgctgatccccctgttgaaggacatcgccaagcgccacggcatcaccccggaccggatcatcggacacagcgatatcgcgccgggccgcaaggtcgatccgggtccgctgttcccctggaagcgcctcgccgacgccggcctggtgccctggccgaagcccggcgaattggcgcgccggctcgccgaactgaacggccagctgccggatgtgcgctggttccagcagcagttggcgcggcacggttacctggtgccgcagaccggcgagctggagaaggacacccgcgacgtcatcggcgctttccagatgaaataccgtccggcccgcttcgatggcgagccggacctggaaaccgccgccctgctgctggcggtgccgacttcctga

SEQ ID NO: 2541 - DNA, 1149 bp, Pseudomonas aeruginosa
ctcgcgtacgttgcccggccaggggtattgccgcatggcctcgcgggcggcttcgctgaagccgcgggcggggcggccgtagtccttgacgaagcgggcgaggaaacgttcggccaggccgaggatatcctcggcgcgttcgcgcaggggaggcaggttgagcacgatcacgttgaggcgatagagcaggtcctcgcggaactggccctgggcgaccatcgcgcccaggtcgcggttggtcgcggcaaggatgcgtacgtcggcgcggcgggtcaccggatcgccgacgcgttcgtattccttgtcctggatgaagcgcagcagcttgggttgcaaggtcagcgggaagtcgccgatctcgtcgaggaacagggtgccgccgtcagcctggctgaccctgcccagggtgctttcggtggcaccggtgaaggcgccgcgactgtgcccgaacagttcgctttccatcagttcggcggtcagcgacgggcagttgatggtgacctggggcttcttcgcgcgtttgctccaggtgtggatggcgcgtgccagttcgcccttgccggagccggattcgccgaggatgaggatgttggcgtcggtcgccgctacctggcgcgcggtctccagtaccgcggccatggccgggctgtgcgattccaggccgtcgccctggcggcgcacttcgtcctccagggcctccaggcgcgcggtcagttggcgcacctccagttgcttggcggcggccaggcgcagttggtccgggctgcagggcttgaccaggtaatccaccgcgccggcctgcatggcatcgaccgcggtatccaccgccgaatgcgcggtgacgatcaccacgcgcatccatggcgcctggacgcgcatctgggcgagaacgtcgagcccgttgtcttcgcccaggcgcaggtcgaggaagcacaggtcgaatacctggcgctgcaacagggcctccgcctgcggcgcgctgctggcggtggccacgctgtagccttcgtcttcgaggcaataacggaaagtgcgcaggatcgccgactcgtcatcgaccagcaggatgcgcccctgtttttcggaagtggtttccatcgttgctttttatcctctagggaattcactgccattcggcttctgggttag

SEQ ID NO: 2542 - DNA, 273 bp, Pseudomonas aeruginosa
ggtagtcacggtctccctgaagaaaaaatggacacaggccggttcgctaccccgatgggcccggccccgaggcggtaccgacagttccgaaggcacacaggagaaaacatcatgcttagttgggctatcacctttctgatcatcgccatcatcgctgccgtcctcgggtttggtggcatcgcaggtgccgccaccggaatcgcgaagatcctcttcgtgctgttcctggtgctcttcgtggtctcgttcttcttcggacgccgtcgcggctaa

SEQ ID NO: 2543 - DNA, 489 bp, Pseudomonas aeruginosa
ccggatgccaaggagaaagcgatgcgactcatgcgtaacctgatgaacgcactgctgctcggtgccgccgccagttcgctggcggtggcggccgacagggacggcgaataccgcttgaacgaactgcagagcaccgatgccggataccgcaaggcctggcagaacctggtggaagacgagagccgcttgcccgactgggtgatgaatctctcgggaaccgctacgccgatgcatgccgtcgacgaccagggcgacaagtatctggttggcggtctctgcgagaagtccgattgcaagggccagcgcctgctggtcgccttcgattgggacaagagtcatgcctacgggctctacgtgcaggtgcccgaagggctgccgcaggacaagtcgccgagcaagcacgccagcttccgctggctgggcaagccggaaccggcggtacagaagatcctcgacgaacaactcaaggccgatccgaactggtactga

SEQ ID NO: 2544 - DNA, 780 bp, Pseudomonas aeruginosa
aggtgttgccagggcgtttccgagaccatgttcaaggtcacccacatgatcatgaagtacgcccctatcggtgtcttcgccctgatcgcggtgaccgtcgccaacttcggcttcgcctcgctgctgccgctggccaagctggtgatcctggtctacgtggccatcgtcttcttcgccctggtggtgctgggcctgatcgcgcggatgttcggcttctcgatcatgcgcctgatccgcatcttcaaggacgacctggtcctcgcctattccaccgccagctcggaaaccgtgctgccgcgcatcatcgagaaaatggaagcctacggcgcgccgaaggcgatcagcagcttcgtggtgcccaccggctactccttcaacctcgatggctcgaccctgtaccagagcatcgcggcgatcttcatcgcgcagctctacggcatcgacctgtccatcggccagcagatcatgctggtgctgaccctgatggtgacctccaagggtatcgccggcgtgccgggcgtatccttcgtggtgctgctcgccaccctgggcagcgtcggcatcccgctcgagggcctggccttcatcgccggcgtggaccgcatcatggacatggcgcgcaccgccctcaacgtgatcggcaatgccctcgcggtgctggtcatctccaagtgggaaggcatgtacgacgcggccaagggccagcgctactgggattcgctgccgcacctgcggcaggcggtcggcgaagccaagggcaagcaggccaccctcgaataa

SEQ ID NO: 2545 - DNA, 1359 bp, Pseudomonas aeruginosa
cgtacccgcctgcgtggccatcgacgccgccatggaccgcttccccgtgtctgcctgagtgtgtgtcccatggcctctaataaatccaaaggtttcgccattttccgtgtggtcagtggcaacttcctcgagatgtacgacttcatggtgtatggcttctacgccaccgccatcgccaagaccttcttccccggcgacaacccgttcgcctccctgatgttgtccctcgccacctttggcgccggcttcctgatgcggccgctgggtgcggtgttcctgggcgcctacatcgatcgccacggccgccgccagggcctgatcatcaccctcggcctgatggccatgggcaccctgctgatcgccttcgttcccggctatgccacgctgggcgtggcggcgccgttgctggtgctgttcggccggctcctgcagggtttttccgccggcgtcgagctgggaggggtttcggtctacctgtcggagatcgccacgccaggacgcaaaggcttcttcgtcagttggcagtcggccagccagcaggtcgcggtggttttcgccggcctgctcggcgtgctcctcaaccagtggctgagcccgcaggacatgggcgaatggggctggcgcgtgccgttcttcatcggctgcctgatcgttccggcgctgttcgtcatccgtcgctcgctggaggaaacgccggagttcgaggcgcgcacccaccgaccgtcgctgtcgcaggtgctgcgctccatcgggcagaacttcggcgtagtgctggccggtaccgcgatggtggtgatgaccaccgtatcgttctacctgatcaccgcctacacgccgaccttcggcaagaacgaactgcaactgtcggacctcgacagcctgctggtgaccatgtgcatcggcctatccaacttcatctggctgccggtgatgggcgcgttctccgaccgcatcgggcgcaagccattgttgctgggtgcctccgcgctggcactgctgaccgcctacccggcgctgtcctggctggtccgcgagccgagtttcgccggcctgctcggcgtcgagttgtggctgtcgttcctctacagcagctacaacggcgcgatggtggtggcgttgaccgaggtgatgccggcggacgtgcgcactaccggtttctccctcgcctacagcctggctacggcgaccttcggtggtttcaccccggcggtctgcacctggctgatccacaccctggacaaccgcgcggccccgggcatctggctcagtggcgcggcgctgctggggctgctcgccaccctggtgctgttccgccggcgcggcaaggagatcgccgaggccgagctggccaacgcctga

SEQ ID NO: 2546 - DNA, 1263 bp, Pseudomonas aeruginosa
ggatgcgccgcaggtcggcgccgtagacccggaggattccggtgcggacgatatgcgtgccccacaccagcagggcgacggcagagagcaggtcgagcagtttcagcatggcgtggcccccctggcactacgacgaatggccaacctcgcgccaggttccgcgtgcgttgcgccgcggagcccggacaacggcgccaacggccacgatggaaaggcagcgttcaggcgagttgtaacacgaacgtcatatttggacaggcgccccccgcgggagttcgtctcggcagcccgagcggcagggcgcctacccttcattcaagcgtgcgcgccgggaaacggcgaagattttttcgccttccgttcgatgcatgcgtttgcgccacaggccatggaattagccgacaggaagggtatcctttgcaccttttaaaaagccccggtctagagggatacagaggagtggtgcggatgcgattttcggggatcagtggctgcctctcggcagcggtgttggcgctcggggtagggggagcgccggtggttcaggccgatgcgctgggcgatagcctggagcaggcgcacatccgcaaggcgaccttcgccgcgccggcctgggaaggctataccaacgccgacggcagcggtctgtactgggacctgctgaagcaggtctatgcgccctacgggctcgacgtgaaattcatcaacatgccctggaaccgcgccaacaagctgatgaccgcgggctccatggtcgatggcgtgccgggcgagatccccggcgttgagggcaagctgtacgcccagttgccgatcgacatcgagtaccacggcgtgatgcatgcggcgaagacgcccttttccggccgcgccagcctcaccggcaagcgcgtcggctggcgccacagctacaacctgatccccgcggagcagcgcgacttcaccctggtcgagtgcgtccgccccgagcgttgcaccgagcaggtccagaacggcgagctggatttcttcctcgacgagccggacgaactggaaaagcagcgcagcgaagcgcatctgccggccgacgcctacccgatcgcgcaactgccgcccggcaaggagtccttcatgaccttcgccgacagcgccagcggccggctcctgcgcgaggtctacgacgcgcgggtacggcagatggcggcgtccggcgagctgcgggcgctctaccagcgctggaacagcgaggtgcccggcgccgtgcaggctctttcggcgcagtga

SEQ ID NO: 2547 - DNA, 1107 bp, Pseudomonas aeruginosa
ccgccagctcatcgcccggcgcattctcgaacgcttgcgctgcgacggcttggaactgctcgacatcaaccacaacctggtggcgccggcacaggtcgatggcgtcgacggctggctgcaccgcaagggcgccaccccggccgaccagggcgtgctggtgatccccggctcgcgcggcgactacagctacctggtggagcctgtgccgagcgcgcagagcctgttctccctggcccacggcgccggtcgcaaatggcagcgcggcgagtgtcgggagcgtctggcggcgcgcttcagcgtcgaccagttgggccgtacgcgccttggcagcagggtgatctgtggcgaccgccaactgatctacgaggaagcgccggaagcctacaagggtatcgactcggtggtcggcgcgctgctcgaagccggcctgctgcgcctggtcgcccgcctgaagccggtgctgacctacaagacccgtggggagtgctgccgatgatcctgctgcaactctccgcggcccaggggccggcggaatgctgcctggcggtggcgaaggcgttcgagcggctgtgcctcgaggcggcgcaagccggcgtcgaggtcgaggtaatcgaggaggtggccggcgagcgtccgcgcacctggcgttcgctgcttctggggctgcgcggcactgccgccgaagcgctcgccgagcgctggtgcggcggtatccagtggatctgccccagcccctaccgggcaaggcatgcgcgcaagaactggttcatcggcgcggagcgcttcgccgcgccgccggccagtctggagggcgagatccgtttcgagaccctgcgctcttccggccccggcggccagcatgtcaacaccaccgactcggcggtgcgcgccgcccacctggccagcggcatcagcgtcagggtgcagagccagcgtagccagcacgccaacaaacgcctggcgatcctgctgatcgcccggcgcctcgcggaccaggcgagcagcgcggccgacgcgctgcgcgcggagcgccgccgggcccacggtcggatcagtcgcggcgcggctcgccgggtattccgcggcgagcgtttcgagccggcctga

SEQ ID NO: 2548 - DNA, 1482 bp, Pseudomonas aeruginosa
gggcggcggcgacgcgtcctgtcgtcatgggcttccttgcagcacgaggagtacgccgaccagagtggcgccggaaagcagcgtttgcaaggtaatgatgcccgccatcaggtggccgtcgccgcccagttggcgggtcagcacataggcggtgggcgccgtcggcagggcgaagaacagtaccagcacggcgctttccatgctcggcaggcccagcccgcgagcgatggcgaaggccagaaggggcatcgccagcagccgcgccgcgcagttccagccaagggccgcgacttcgccgccgagttcctggggtttcagcgccgcgccgacgcacagcaggcccagcggcaggctggccaccgccagcaggttgagcaggcgatcgctgccgccgggcaggccgacgccggccaggttgaccagtgcgccggcgaggcaggcgaggatcagcgggttcttcaggatcggcagcagcagcgcgcgcaggctgatgccgcgctcggcggtcagcgcccagaccgacatcacgttcaccgtcggcaccatcagcgccagcatcagcgcggccagggtcaggcccggcttgccgtacaggctgccgaccgcggccaggccgagataggtgttgaagcgcaatacgccctgggcgatggcgccgaagcgcccggcgtcccagccgcgccagcgcttgcagagcagcagggcgagccaggcgacgccgagcccgagcagtacggccagggcctggcgggccaggccggggtcgtccagcggcgcggtcgccaggttgctgaacagcagcgcgggaaacaggatgaagtagttcaggcgttctgcggcaggccagaaggcttcgccgggaaagtcccagcggcgcagggcgtaaccgccgacgatgagggcgaacagcggccagagggagtagagcagagcggtcacgggcacccccggatagtggaatccgctcatcttgcgaggtggctgcggcacagggcaagtccggcttatgctggcactcccgcgaggaggattcgccatgcccgagacccataccggcggttgccattgcggctatctgcgctacgccgtcgccgcgccgctggacgatgtcgctcactgccactgctcgatctgccggcgcaccacaggcggcatcgtcaccacctgggccacggtgccgcgcgcggcgttccgctggctggcgggcgaaccggcggaatatgcctcgtcggccagctgcacgcgctacttctgcccgcgttgcggggccaacctggcgttgttcacccggctcagcgccgataccctggacttcaccgtggccagcctcgaccatcccgagcgcgcccccgccaaccggcacatctgggtcggcagccgcctgccatggctacacctcgacccgcagttgcccgaagaggacgaggagttcatcgccggagcggacgacccgtgagcgaagaccggaggtggcacctgtag

SEQ ID NO: 2549 - DNA, 2343 bp, Pseudomonas aeruginosa
cgcagagcgttatccgccgtctgcgaggcgctgaaagagcgctcgggaccatgcgtcctgcaggcgcctccctcagggcagcatcagcccgccggccgccttgtgcagctcgcgcaggtgcgcgccgacctccttgatgttggcctcgttggcttccagctcggcgcggcgctcgggatcgagcagggcgcggacctcgcggtcgaggtcgtcgctgagccggcgcaggcgcgcctggcgttcgcgggtctgctcttccaggtgcttccactcggcggcctgcggcaggccgtagccgccctccaggagttccgccggacgactgaggaagccgctgtcgtcgaggatctgctggaaggtcttgccggccacttccaggcgctggtcgccggccggcttgtccagatggccgaggtacaggcgcttcaactcgtcctgggcgagcagcagctggcgccgcagcgaggcctgctcgagcagcagcagcgccgcgctggcgcgcaggtcggccttggcgaaccagggctggcgctccctggccggcagcgccagccagtcctcgaccttgtcctggggaatgtgcaggcgctgcttgagcacgtcgaacatcgcctggtagcggtcgcggaaggagtcgaagcggtagcccaggcgcagggcttccttggggtcgtcgagcacactgggatcggccagcttgcggttctccagcatctcgagcacgccgtagggggtgatgctgtccaggctttgcagcggtcgccgggggatgccgctgcgcagcagcttgagggtttccaccgcgcaattgttggagatgaagtagtactggccgtcgtagctccagtgactctgcgcggcgcgctcgaccaggctggcgacctcctcgcggtccagcttcagcggcaccgaggcgaggctgcgcagctcgaccttggtgtattcctcgatcacctgcgacagcggcaggacgaacaggcgcgacggataggcgccggtcaggccgtcccagctggacaattgcaggtcgccgacgaaggcgcggtaggacagcaccagatgctggtcgaggtccagccggcagtccggaccacgcggccggccgggggcgcagatcaccaggcggagcatggtgtggccccagcggctgaccaggttgtcgttggcctcggccagcaggtagtcgacctcgtagacccgctcggggtcgagctggcccagcggctgctggccgaagtcgcggccggcgttgaggtaggcgaagctctgcgcacaggcactgtgttccggcgcccagccgaagcgttgctggtagtagcggtagagcgccgggcggcggcaggcgtagctgggatcgaggaggaagtactccatgttcaccgcgacgaactcgcgcggattgctcagctcgtagacgtccgggctgcgcagtacgaagccattgtgcgcctcgcgccgcccgcgctggccggcgcgctgcggccagccggcgagatcgagcaggcgcgggtcgtcggagagcgtgaagcggcgaccgctctgcccgcggcaatcggtgggctgggcgatccggccgagggtttcttcctggcgcgtgcagcggcggatctcgcgtttttcctccgccgaccacaggcgcgcgcgatcgtagacgtgggtcagctcgtgcagcagggtcgccagcagctcgcgccgctcggtgccgtgcacgcgcccggtctggcggctggcggcgctgccgtcggtgagatcggccaggtacttgcggttcagcgcgatgcgctgcgggccacgggcctggcccatgccgttggcgggcaggtcgtcgcgccactcgacctcgatctcgcggtccaggcgttcgcggaaggccggcggcaacttgtccgcggcttcgtccaagagttgctggctggcctcgcgctgcgcagggtccagttcaggcgcgtcgagtttcaggcgcagggccgccgtcgcgttgccggctccgcagagggccagcgccagcagccaggcgcaggccttcctcacagggcgagaatggcttcggcaagtacctggtcggaggcttcccgggcttccggcagacggctgcgcagggtccgcatcgcggcttccagctgggcgccgcgaatggcgccgtcgctggcgacgaaactggcggcgtcgtcgcgcgcctcggtgaccactttcatgtcgcgcacggaagtggtggtgtcggaagtgaagtcgatgctgcggtcgagggcgcggacgatgatattgctggtcgcgaccaccgagcgtgcttccgcggccgtggcgcagagcgccagcagcagggcggcgaacagggggctatga

SEQ ID NO: 2550 - DNA, 1521 bp, Pseudomonas aeruginosa
agatcaccgaagcgccctggcgggcggcgaagagggtggcgacgccttcgccgcagccgagatcgagcagggtgtcctgggcgccgatggcgaagccggcgagcagttcgccggtttcgctgcggaaccagccatccagcaccgcatcgcgcagaccgcacatgcgtggcgacaccggctcgctcgccgcagcgggacgggaacgccagcgttggagcagggcgcggatcatgccgggatgctttgcaaggcggcggggtcgccttgtgccgcttcgtcgaggaagcgacgcaggcgctccacggccagcttgcggctgcagaagcgttcgaggctggcgctggcatgcgcggacatgcgtgcgtagcgctccggctcctggcgagcgacctcgaaactggcccggtaggcccggcacagcgactcccagtcggtgatgtagcgcagcgtgcggtaggccgcgcgcgggtcgtggggccaggcggtggcttcttccgaggagtcgacgatgaaggcgttgtcggcgtcgatgtagtcgatcatcgcggtattgcgcggagccacggccggcttgccgctggacatgaattccatcagcggcaggcattggccttcgccgtaggaggtgttcaccacgtagctggtggcctcgaccagccgctcgtagtccgggtcggcgaggtagccgtggatcagcacgatgcggcagcggtaggactggttcttgtacaggtggtgaagcatgtcggccagcgcttcgccgacgttgtggtgggtcagtttcagcaccagggtggcgtcgggctcgtcgcggaaggtggcgcagaacgcgctgatcatgtcctgccagttcttgcgcccgtcgtaggggttgaacaccgaggtgtagatgaccccgtcgaggctcagctcgacctgtttcgccgcgcggtccggcagggccaggacctccgccgacggctcggggtcggcatggacggccaggtccagctggcggctgtccaccagcaggccgtccaggcgcaggcgcacatcccgggcttcgggacggcctgcctgctgcgaggcgcggttggcgaagcgatcccagaccggcgccggcacgctcagtaccgggtagtcgcgacccatggcggcgcgcaccacgtcgaccgtgaagctggagtgggtgatggcccgtccgctgtggcgcagcacatgtcgccagtcgtggcgcggttcgccgtgccaggtttcgctgggcagggtgctgaactcccaggcgaacaccgggatggtcgggcaggcatggtggatcggcgtgcgatggggcggcgagaaggagaggaagacgcagggttcgccgcgcttgcggcagtcgtggtagaggcggtccaccagttcgtcgggatcgctgacttcgaccacctggccgatctcttccagcagcggacggaattccttgaggacgaagtaatagctgtactccgggcgcccgaggttctgccggatggtggtcttgttggtcctcggagtggatga

SEQ ID NO: 2551 - DNA, 1641 bp, Pseudomonas aeruginosa
tcagcatggaacgttgcctgtggcggtggccgccagttcgacgccgggcgcaggggttgccttgcgggcggaaaggaagggttccaggcgctggcggaccacgtcgccggcgcagtagccgcgcatgcgttggttggccgcggcggacagttgccgatagcgctccggctgttcccgggctacccggtagctctccaggtaggcctccttcagggactcccagctcggccggtagcgccgggtgctgtacaaccggcgcgaatcctgcggccaggccgcgggctcctggctggagcggaccacgaagcccacctgggcgtccatgtagtcggccatcgccgaatggtccggagcgatcgccggggtgccgcaggacatgaattccatcagcggcaggcacaggccctcgcagcgcgaggcgttcacgtagtagctggcggctccgtacaagcgggcgtactccgcggcatcgagatagccgtgcagggcgatgacccggcaggcgaatggcgacagttgggaaagcagggtgagcagttcgacgtggtaggtcgtcaggtcgctctgggtcatcttcagcaccagcgtggcatcgctggtgtcgcggaatgcccagcagaaggcggtgatcagctgatgccagttcttgcgcccgtccagcggattgaacaccgagacgtagaccaccccgtccacgacgacctgctggtgctggtcgacggccggcaacagcgccggcggatgctcgggctcggcgggcggcatcggctcgatggcctggggcaatggctccggcagcgtttccagcgccgttggcgggggcggcagcggccggcgcaggtgacggaacagccagcggcgtaccggtatgggtaccaggtcgctgacggcttcccggtaccacagcagcaggtagtgcttgctgatgaccagtcggcgcctccagtcgagaggaaccggctctggctctggttctggctcagggaccggttcgggctcgggctcggcgggcgtctcggggaggacctcgaggatctcgtcctcggtctcttccctgatcggtgcgatgaggccgtcggcggaaaggcccagcaggcggctgtcgatgacgcagcccttgagttgcagggtctcgccggacttgaccggattccgttcgccttgctggcggatcgcggcgaagtcctcccagatcggcgtcggcagcgccagtaccggaaaatcttcgcccagcacccggcgaaccgcgcgggcagtctgctcggagagggtgatggctgcgccatggccggccaggacctggctccagtcctgcgccggatcgccgtcccacgccacgtcgggaatcgactcgaactcccaggcgaccacgcacagcatcgggcattgcaggccccgcgccgccttgtgcggcggggtgaaggagaggaacaggcagtcttcgccctgttcatgcagttgccggtagagcgggtcgacttcgtccgtgctctgtaccaggtggacctgtcccagcgattcgaggattggccggtaggccttgaggacgaagtagtagctgtattcggggcgaccgaggttgtggccgatcgagcgctcgttgatatccgagtaaaggatgaaattcatggcatctcgtga

SEQ ID NO: 2552 - DNA, 486 bp, Pseudomonas aeruginosa
aggacagccgaagccgttcatgcgcctgcccgatggccagaccctgctgggcaagacctaccgacgtgccgccgggctactggccgggcatggcgaaatcgtcacggtgaccaaccgcgagcattacttccagagcaaggaccagttccaggcggcccgcctggggcggcaccgaggacatttcatcctcgaaccgaccgggcgcaacaccgctccggcgattgccgtcgccgccctggcgctgcaagccgaacatggcgacgcggcggtactggtggtgatgccggcggatcacctgatccgcaacgaggaggccttccgcgaggcggtggggcatgccgcgcgtctcgccgtcgccgggcacctggttaccttcggcgtggtgccggacgcagcggaaaccggtttcggctatatcgagctgggcgaccggctggacgagcagggggcggccaaggtgcgccgcttcgtcgagaaacccgatga

SEQ ID NO: 2553 - DNA, 1308 bp, Pseudomonas aeruginosa
caccttcgtgcagagcgacgggcgcctggtcgccacggtcggggtcgacgacctggtcgtggtggatacttccgatgcgctgctgatcgcccgcgccgaccgggtccaggaggtgcgcagggtggtgcagcggctgaaggacgagcggcacgaggcctatcggctgcatcggaccgtcaaccgtccctggggcagctataccgtcctcgaggaggggccgcgcttcaagatcaagcgaatcgtggtcaggccgggagagcgcttgtcgctgcagatgcaccatcaccgcagcgagcactggatcgtggtgcaaggcatggccagggtcaccaatggcgatggcgcgcggctggtcaacagcaacgagtcgacctacattcccgcgggccaccggcatcgcctggaaaacccgggggtcatcgacctggtgatgatcgaggtgcagagcggcgaatacctgggagaggacgacatcgtccgcttcgaggaccagtacggcagggtggtctgatgcttcttggcttgtctcgttccttgtggggctatcgtggcttcgttctcggcagcgtcaagcgcgagttccagtcgcgctaccgcgggtcgctgttcggcgcgttgtggacggtgctcaatccgctgtcgatgatcgtcgtctacacggtgatcttctcccaggtgatgcgcgcgcgcctgccgggggtcgacgacggcctggcctacagcgtctatctctgcgccggcctgctgacctggggcctgttcgcggaaatcacctcgcgcagccagagcatgttcatcgagaacgccaacctgctgaagaagatcagcttcccgcgcatctgcctgccggtcatcgtactgctcaacgccggggtcaatttcgccatcatcctcgccttgttcctcggctttctcgccctcagcgggcgcctgccgggcgcggcattgctcgcgctggtgccgctgctggcgatccaggtgctgttcgcggcgggactggggatgatcctcggggtgctcaacgtgttcttccgcgacgtcggccagttgttcggcatctgcctgcagttctggttctggctgacgccgatcgtctatccgatcggcatcctgcccgagggtatccgctcgctgatcgaactcaatccgatgaccgcgctgatgcgcagctaccagcagctgttcctccacgggcaatggccggactggccttcattgctgccgatcaccctgctggcgctgctgctgtgcgcgctcggcctgcgtctgttccgccagcgggtcggcgaaatggtggatgaactctga

SEQ ID NO: 2554 - DNA, 1866 bp, Pseudomonas aeruginosa
gcctgtcgcggctggactcgcacctggaccgcaacttcgaatggcgcgactacggcctggtcttccatgtcatcaacaaccgccaggaagacttcgtcggttgctcctggctgggcgccgaaacccatatcagccgctccggcgaggcggctctggaccccacttccgcggagagcactccatgacgcgtctgttggtcgaatgcacctatgtgttcgagcatcccaaggtcaattccggtattcagcgggtggtgcgcaacgtcatccgcgagttgccggaagccgacgagacggtggagtgcatcccggtggcaatgctcgacggcaccctgtatcaggtccacagcctggcgccgctggacccgcggccgcattcgccgctggtacgcctgcgcatcctggtggagcgagccgccaactacttctggctgggccagcgcaccctggaaaagcgccgcccgttccgttcctcgccgtgggcccggcgccttctctatgtagcctgccgcctgttcgctttcgccttcctcagcattccgctgcgcctgctcgaccgcatcctcggcaagcagcagcctgcacccgtgcgcgcgaccccgctcgaacatcgggccggcgaccaactggtcttgctggactcctcctggcacgccgatttcttcccgctggcggaacgcctcaagagcgagggtgtgggcatcgtctcggtgatctacgacctgattcccctgacccatccgcaattctgcgatgccggcctggtcaaggtgttcaaccactggttcgactggatcgcggccaccgccgacggctacgtcgcgatttccgagaccatccgcgacgaagtgcgcgcggagatgctgcggcgcatcggcccggagaaggtcgcgcaacgctggttcgattatttccacctgggttcggagctggacctggtggaggacggcgcctccgtcgagcccgatctgctgcgcatgttcaaggccaaggcgccggtattcctgatggtcagcaccatcgagccgcggaagaaccacggttacctgctggatgccttcgagcgtgcctgggcccagggttcgcaggcgcggttgtgcatcgccggacgcatcggctggaagtgcgaggcgctggtggaacgggtgcggcagcatccggagctgaacaagcgcctgttcatgttcaacgacctctccgacaagagcctggagtacgcatactcccatgccgcatcgctggtcttcccgtcctatgtggaaggtttcggcctgccgctggtggaggccatgcagcgcggcctgccggcgatgggcagcgacatcccggtgttccgcgagatcggcggcgaattcatggcctacttcgacctcgccgatccgcagaccctggcgaacctggtcacccgcttcgaagccacgggcgagttcccggccgagcgaccggtcggcgaatggcgctggatcggctggcacgaggcgagtcggcaactgatcgcgcggatcctgctcgccctcggcaaggccccggcgcatggcgaggcagtacatgcggattgcggttaacgcgcggattctccaggcgccgcggaccggcatcgggcattacctggtcgagttgctgggcgcgttgcaggcgcacgcggacttcgagttttccctgttccatggctggggctggagcggcgacctgccggcggcggcgctgcccggctattcgcgtctgtcgccctggctgcgcaacctgcccggagcctaccgggcacgacgctggctggagcagcggcgtttcgatagcggtcggccgccggtcgatctctaccatgagcccagtctctggccgctggacttcgacgggccgatgctga

SEQ ID NO: 2555 - DNA, 798 bp, Pseudomonas aeruginosa
atgtcgtgcaggccttccaggttggtgctgtgggccaggttgatctcgacgatgacctgcttggcgaagatcgcgaagctcgccgagttgcccaccgaggtggtcggcacgatgtggccctgctcggtgatcgcggcggcttcgatgacggcgatgtccggcagcttcagctggtggttgcgcaactgctcgacggtttccgagaggtgctggtcgatgaacatcacttcgccggcgttgatcgccttgcgcagggtgctgtcgacctggaacggcatgcgccgggcgagcacgccggcctcggtgagctgcttgtcgaggtcgttgccgaggctggcgccggtcatcaggctgatacgcagcggacgttccttggcgcgcatggccagcgcctggggtacggccttggcctcgccggcgcgggtgaaaccgctcatgccgacggtcatgccgtcctggatcaggtcggcggcttcggccgcactcatcaccttgtcgagcagggggggcaggcgcacgcgatcacggtacatggaacgaacctcagacgacgaattattaggggcccgccagtctagggtttccgcgatttttcgcctttataccaaggtcgaagcgcccttccgcgggtttattggcggattgccaggaccaccacgcccgctgtcacccggggctacgcccagcctttggcgcaagtcccgggcgttcgccgaggaaggccccgccgagcagtgccaccagcaccacgctgaatttgttccaccggcgccactagggacgccgggccgagcttga

SEQ ID NO: 2556 - DNA, 1773 bp, Pseudomonas aeruginosa
cctgttgcagggctggggcgtgctcggcctgatcctgctggtggcgctgctggtggtcgccgggcagatccaccggctggtgcagggcgcgctgctgcgacgcttccagacccaggcgctgaacctgcacctggaacgcgtcaacgccgaggccgaagcgctcaatcgcaagctcgcccaggaggtcggccagcggcgcctggtcgaacgcgagctgcgcgccgcccgcgacgccttgcagcgccgggtggaggcgcgcaccgaggagcttggcgcgaccagccaggcgctcagccagagcgaggcgcgcctggccatggccctggaggccagcgaactggggttgtgggactgggacctggagagcggccgggtccagcattcctatctcgaggcggtcttcagcgacgccgggggcggtcccgaggactatcgcaggctgatcgaaagcatccaccccggcgacctgccgcgcatccgtcgcgccctcgccgaacatctcaaggggcgcagcgagctgtaccgggtggagtaccgcgtgcgcgaccgggagggcggctggcgctggctggaggatcgtggccgggccatggctcgcgacccgcggggacgggtgacgcggatgctcggcacgcgcagcgacatcagcgcgcgcaagcgcctggaagagcagcagcaactggccgcgacagtgttcgaggcggccagcgagagcatcgtgatcctcgatccggcctacaacctgctggcggtcaaccaggccttcagtcgcatcaccggctatcgccgcgaggacgtggtcgggcgcaacgccagcctgctggtgaatacccccgaggcccagcgccactaccggcagatccgcgccgagctgcgccagcacgggcagtggcagggcgaactggtggatacgcggaagaatggcgatccctatccccaatggctgcagctcaacctgctgcgcgacggcaatggcgaggcgacccacatcgtcggtttcttcaccgatctcagtgcccgccgcgacgtcgaggagcgcctgcgtcacctgctgcactacgacgaactgaccggcctggccaaccgccggttgttccgcgagcggctgcacgaggcggcccagcgggcgcgccaggaggagggcgggctggccctgctgctgatcgacctggaccgcttcaagctgctcaacgacagcctcggccacgaggtcgccgaccagttgctcagggagatggcccagcgcctgcggcgcaccgcgccggaagccaacaccctggcgcgtctggccggcgacgagttcgccattctcctcgatggcggcaccggcaccgcggccctgtcgcgcctggccgaacgcctgctggtccagttgcgccagccggtgagcgtgctcggccacgagttgatcctcggcgcctcgctggggatcagcctgttttccgagcaggcacgggaaatctccgtgctgatgagccaggcgaacctggcgatgcaacatgccaagcaactcggcggcaataccttccagttcttccgcgacaacctgcaggacagcaccctcgaacgcctgcgcctggaaacccggttgcgcaaggcggtcgaggagggccagctggacgtgcattaccagcccaagctgtgcctggccagcgcccgcccggactcggtcgaggcgctggtgcgctggcaccatccggaggagggcatgatcccgccgtcgaccttcatcggcctcgccgaggagtgcgggttgatcggcgagatcggtga

SEQ ID NO: 2557 - DNA, 801 bp, Pseudomonas aeruginosa
ccggtatccagctcggcgacatccagactccgctgctgctggcggtggccgacctggtgcagatgcgcgcccacgatccgtcgaccccgcgcagcttcacctgggaaacgctgcaggcccaacaggccagcttcgccgcgcatcccgaactgttcgcctacctgcaggcggcctatcgcttctatgtcgaccaggacccggcgaagaccctcgaagcgctgccgcaaaaggtcggcagcctcgactacgtcggcttcagccagcagaccctgcgcgggctggcgctggagcagcagaaggactggaaagccgccgaggcgctctggctggaactgttgccgcaggccgcgcagccgtaccagaagggccagttgcagctggccctggcgctcaactacgagcgcagcggccagttggaaaaggtcttcgccgaaggttcgccggtccaggagccgctgctgcgcagcatcctcctgcgcaacgtcgccgacgccgcgctgttgcgccgccaggccaagcagggcgcgacggcggaagagcgcgataccgcgctgttcactctcctttacaaggacctgcgccgcagccgcttcgccgacttcggcaaggacttcgcgctgctcggcgaaaccccctcgcagaccaagctgggcaccagcctcggctatgtctacggcgccggtaacagcctggagctgttccgctggaagagcgacaaggccgagtccggctacgtttgcccggccatcgccgagtcggccgcggcgctggccgccgatgacaaggacccgaagggcctga

SEQ ID NO: 2558 - DNA, 567 bp, Pseudomonas aeruginosa
ggtctgggtggtgtaccgcgcccataccctgcgctggacgccgcagatctaccaggccgtgctgaaccaggtgcagcgctggaagcgtgccggcaacccggtggtcggcatccagatcgacttcgatgcgcgtacccgctacctcgacgagtacgtcgatttcctccgcgacctgcgccggcgcctgccccgcgaataccgcttgagcatcaccgggttgctcgactggggcagcaacgccgagccggcggcgatcaaccggctcaagggcgtggtcgacgaagtggtggtgcagacctaccaggggcgccacagcattcccaaccacgccgcctacctcccgcgggtcagccgcctgcaactgccgtaccggatcggcctggtccagggcggcgactggcaagcccccgactacctggaaaagagcccctggttcaggggctacgtggtgttcctgctcaaccctcagtgagcgcagccgcaagcgcccttgccggcacacccgccgctgcgttcggcctgcggctggcgggtatcctggccgggctggagatcgcgcatcagtag

SEQ ID NO: 2559 - DNA, 1449 bp, Pseudomonas aeruginosa
cgcgtagcacaggtccaggccttccggcagcgccaggtagaccacgtggccattgcccggcgccacctcgatggcctcgccggcggcgttgcgcaggtcctccacgcgcaggctcaggttgcctcgcggagtcatcagttcgacgctgtcgccgcgctggaagcggttcttcacctccacctcggccagtccgtcgcggcgttcgccggtgagttcgccgacgaactgctggcgctcggacaacgaatggccgtgctggtagttctggtactcgtcgtgcacgtggcggcgcaggaagccctcggtgtagccgcggtgggcgagggactccacggtgtccatcaggccgcggtcgaacggcttgccggccgccgcgtcgtcgatcgcctggcggtagacctgggcggtgcgcgccacgtagtagtgggatttggtgcggccctcgatcttcagcgagtgcacgccgatccgcgccagccgctcgacgtgctgcacggcgcggaggtccttggaattcatgatgtaggtgccgtgttcgtcctcgaaggcggccatcggttcgccgggacggttgccttcctcgaggaggaacacctgctcggtcggcgcgccgcgtcccagggtcggctcccgcgccaccacgttgcccagctcgtcctcgcggccctccaccgccttgtattcccagcggcaggcattggtgcaggtgccctggttggggtcgcggcggttgatgtagccggacagcaggcagcgcccggaataggccatgcacaaggcgccgtggacgaacacttccagctccatgtccggcacctgctggcggatttcctcgatctcctccagcgacagctcgcgggaaaggatcacccgggtcaggccctgctgccgccagaattgcaccgcggcccagttcaccgcgttggcctgcaccgacaggtggatgggcatctgcgggaaatgctggcgaaccagcatgatcaggccgggatcggacatgatcagcgcatccggacccatggcgaccaccggctccaggtcgcgcaggaaggttttcagcttggcgttgtgcggggcgatgttgaccaccacgtagaagcgcttgccaagtgcgtgggcctcggcgatgccttcggccagttgggcgtggtcgaaatcgttgttgcgcacccgcaggctgtagcgcggctgcccggcgtagacggcatcggcgccgtaggcgaaggcatagcgcatgcttttcagggtgccggcggggcacagcagttcggggcggagggtggtggcggtcatggttcgggctcgcaacgacgtgggcgcgcgactctagccgagcgcgcgccgggcgatcctgagccggatcaatgtccgcgtcattccagccagcgtcgaccctgcagttccagcagcagttgcgcctgttccgggccgttgctgccggccgggtag

SEQ ID NO: 2560 - DNA, 228 bp, Pseudomonas aeruginosa
tacgccggcacctcctggccgccgatcctgccggcggcgtactggccgcgtaccgtcttgtcctgcacgtcgagcccggagatcggcttcagcgcctgcagcaccttgagcttctcgttgcgcacagcctcggcgtcgaaacgcaccggcgcctccatcgccaccaggcagagcaactggagcagatggttctgcaccatgtcgcgcatcgccccggcgtggtcgtag

SEQ ID NO: 2561 - DNA, 921 bp, Pseudomonas aeruginosa
tataactacaaggttactacagagaatcgagcccagcctgtgaacctgctgcagcacatagcccagtcccgccaacagctccgcaagtcggaactcaaggtcgccgatcacgttctcaacgatccggcgtcggtcatgcacagctccatggccgaactggcccatggggtcggggtcagcgagccgaccatcgtgcgcttctgccgcgccatcggctgcagcggcttccaggacctcaagctgaagctggcgcagagcctggcggccggcgccagcttcggccagttctcgatccatgagagcgactcggtggccgacttcagcctgaagatcttcgacaccacgctgcacagcctgatggaagtccgcgagcacctggacacccacgccctggagcgcgccatcgccgccatcgcccacgcccagcgcgtggagttctacggcttcggcgcttccggcgcggtggcctcggatgcccagcacaagttcttccgcctgctgctgtcggcggcggcctactccgacccgcacatgcaggcgatgtcggcggtgaccctcaagcccagcgacgtggccatctgcatttcccagtcgggtcgctcgaaggacctgctgatcaccgccaacctggtgcgcgaggccggcgccacgctgatcaccctgtgcccgagccagaccccgctggccgacctggccacggtcaacctggcgatcgacgtgcacgaggacaccgacatctacaccccgctgacctcgcgcatcgcccacttggtggtgatcgacgtgctggcgatgggcgtggccatggcccgcggcccggacctggtcaaccacctcaagagcgtcaagcgcagcctgcgcagcctgcgcctgtcgccgaaggtgatgaagaaccaggaagagcgcggcgagccgtcctga

SEQ ID NO: 2562 - DNA, 954 bp, Pseudomonas aeruginosa
tgctcaaggccacctccggcggcggcggtcgcggcatccgtcgctgcaacagccgcgaggagctggaacaggcgttccccgcgggtgatctccgaggcgaccaaggccttcggcagcgccgaggtattcctcgagaagtgcatcgtcaatcccaagcacatcgaggcgcagatcctcgccgattccttcggcaacaccgtgcacctgttcgagcgcgactgctcgatccagcgccgcaaccagaagctcatcgagatcgccccgagcccgcagctcacccccgagcagcgcgcctatatcggcgacctggcggtgcgcgcggccaaggcggtgggctacgagaacgccggcaccgtggagttcctgctcgccgacggcgaggtgtacttcatggagatgaacacccgggtccaggtggagcacaccatcaccgaggaaatcaccggcatcgacgtggtccgcgagcagatccgcatcgcttccgggctggagctgtcggtcaagcaggacgacatcgtccatcgcggctacgccctgcagttccgcatcaacgccgaggacccgaagaacaacttcctgccctcgttcggcaagatcacccgctactacgcccccggcggccccggcgtgcgtaccgacacggcgatctacaccggctacaccatcccgccgtactacgactcgatgtgcctgaagctgatcgtctgggcgctgacctgggaagaggccctcgatcgcggcctgcgcgccctcgacgacatgcgcgtgcagggggtcaagaccaccgcgccgtactaccaggaaatcctccgcaacccggaattccgcagcggccagttcaacaccagcttcgtcgaaagccacccggaactgacccagtactcgatcaagcgcaacccgtcgcacctggccatcgccatcgccaccgccatcgcggcccacgccggcctgtaa

SEQ ID NO: 2563 - DNA, 1839 bp, Pseudomonas aeruginosa
gggaaggagcagaacatgagcaacaccatccaagcgaagaagaccggcgtcaccgataccatcctgcgcgatgcccaccagtcgctgctggcgacccgcatgcgcaccgaggacatgctgccgatctgcgacaagctcgaccgcgtcggctactggtcgctggaagtctggggcggcgccaccttcgacgcctgcgtgcgcttcctcaaggaagacccgtgggaacgcctgcgcaagctcaaggcagcgctgcccaacactcgcctgcagatgctcctgcgcgggcagaacctgctcggctaccgccactacagcgacgatgtggtgcgcgccttcgtggccaaggcggcggtcaacggcatcgacgtgttccgcatcttcgacgcgatgaacgacgtgcgtaacctgcgcgtctccatcgaggcggtgaaggccgccggcaagcacgcccagggcaccatctgctacaccaccagcccggtgcacaccatcgaggccttcgtcgcccagggcaaggcgatggccgacatgggcgtcgactccatcgccatcaaggacatggccggcctgctcaccccctatgccaccggcgacctggtcaaggccctgaaggacgccctgccgctggacgtggtggtgcattcccatgacaccgccggtgtcgccagcatgtgccagctgaaggccgtggaaaacggcgccgaccgtatcgacacggcgatctccagcatggcctggggcaccagccacccgggcaccgagtcgatggtcgcggcgctgcgcggcaccccctacgacaccggcctggacctggagctgatccaggagatcggcatgtacttccacgcggtgcgcaagaagtaccaccagttcgagagcgaattcaccggcgtggatacccgcgtacaggtcaaccaggtgccgggcgggatgatttccaacctggccaaccagctcaaggagcagggcgcgctgaaccgtatgggcgaggtgctcgaggaaatcccgagggtccgcgccgacctcggtttcccgccgctggtgacgccgacttcgcagatcgtcggcacccaggcgttcttcaacgtgctcgccggcgagcgctacaagaccatcaccaacgaagtgaagctgtacctgcagggccgttatggcaaggcccccggcgaggtcaacgagcaactgcggcgccaggccatcggcagcgaggaagtcatcgacgtgcgcccggccgacctgatcaagccggagctgaacaagctgcgcagcgagatcggcaacctggccaagtccgaggaagacgtactcacctacgcgatgttcccggacatcgggcgcaagttcctcgaagagcgtgaggccggcaccctgaagcccgaggaactgctgccgattctcaccggcaagggcgtcgccgccgctggcgcggaaggcaccccgaccgagttcgtcatcgacgtgcacggcgagacctaccgcgtcgacatcaccggggtcggcgtgaagagcgacaacaagcggcacttctacctgtccatcgacggcatgccggaagaagtggtgttcgagccgctcaacgaatatgtcgccggctccgccagcggccgcaagcatgccagcgagccgggccacgtcagcaccaccatgccgggcaacatcgtcgacgtgctggtgaaggaaggcgatagcgtcaaggccggccaggcggtgttgatcaccgaggcgatgaagatggaaaccgaggtccaggccggcatcgccggtacggtcaaggcgatccacgtggccaagggcgaccgggtcaacccgggcgagatcctgatcgagattgcgggctga

SEQ ID NO: 2564 - DNA, 1398 bp, Pseudomonas aeruginosa
tgctcccctttttttatcggcatcggttgccgcgtcggccggctgttcgccctgccagggtgcgcccggcgcgcgcgccgcctagaatgccgcctctgcccaacggcgcgtcgcgccgcaggcgctgactatcgggaagtccaggtgtcgtcctctccagctcaaacgcccagccgccggccctcgctgctcggcggttcgatgatcatcgccggcaccgccgtcggcgccggaatgttctccctgcccatcgccatgtccggcatctggttcggctggtcggtggcggtgttcctgctcacctggttctgcatgctgctgtcggggatgatgatcctcgaggccaacctcaactacccggtgggctcgagcttctcgaccatcacccgtgacctgctcggccagggctggaatgtggtcaacgggctgagcatcgccttcgtcctctatatcctcacctatgcctatatctccggcggcggctcgatcatcggctacaccctgtccagcggcctcggcgtgaccctgccggaaaagctcgccgggctgctgttcgccctggcggtggcgctggtggtgtggtggagcacccgcgcggtggaccgcatcaccacgctgatgctcggcggcatgatcattaccttcggcctctccatcagcggcctgctcgggcgcatccagccggcgatcctgttcaacagcggcgagccggacgcggtctactggccctacctgctggcgaccctgccgttctgcctgacttccttcggttaccacggcaacgtgccgagcctgatgaagtactacggcaaggacccgcagcggatcagccgttcgctgtggatcggcaccctgatcgccctggccatctacctgctgtggcaggccagcaccctgggcaccatcccgcgcgagcagttcaagggcatcatcgccggcggcagcaacgtcggcaccctggtggaatacctgcaccggatcaccgcgtcggattcgctgaacgcgttgctcaccaccttctccaacctggcggtggccagctccttcctcggcgtgaccctcggcctgttcgactacctggccgacctgtgcaggttcgacgacagccacttcgggcgcttcaagaccgcgttgctgaccttcgtcccaccgaccatcggcgggctgctgttccccaacggcttcatctacgccatcggtttcgccgggctggccgcggcgttctgggcggtgatcgttccggcgctgatggcgcgggcctcgcgcaagcgcttcggcagcccgctgttccgcgcctggggcggcacgccggcgatcgtgctggtgctgctgttcggcgtggccaacgcggtcgcgcacatcctggccagcctgcactggctgccggagtaccgttga

SEQ ID NO: 2565 - DNA, 729 bp, Pseudomonas aeruginosa
gcgaccggcagtccctgccaggggctagtcgcgcagcgcctccagcgtctgccgctggcggccttcggcgtcgaagttggaaggatcgagccagcgctcgaacgccgcctgtcgcgccggccattcgctgtcgagcagggagaaccaggcggtgtcgcggttgcgctgcttgaccaccatgtgctggcggaaggtgccttcgtaggtgaagcccaggcgctcggcggcgcgcatcgaacgggcgttgccggcattgcacttccactccaggcggcggtagccgaggcggccgagggcgagttcggcgagcaggtagaccgcctcggtagaccccggtgtgcgctgcataggcgcgccgaaggcgatatggccgatttcgatgacgccatccttcggcgtgatccgcaggtagctgagcaggccgacggcgcgctgcgtgcgccgctcgcgcacggcgaagaacagcgggtcgcggctggccgcctggccggccagccaggcgtcgaacgccgggcgctcggcgaacgggccgtaggccaggtattcccacagcaacgggtcggcgccaggcccttgcagggcgtcccacaggtcgtcgccgtggcgttgcggatcgagcggttcgagcttgacgaagcggccgtcgagcggggcgtggggtggagtggcgacggggcgccagttcaagggttcgcgcatggtgggcctcagagaatcctgcggtactga

SEQ ID NO: 2566 - DNA, 1563 bp, Pseudomonas aeruginosa
gccgggaaatggtccgctagaagatccattgctggtcaattccacaggtccaatccacactggcgctttcttccctccgagaccgccatggccaccgtactgcccttcgacgccgccggcatccacctcgaccccgcccagggcctggcccgccagctctacgccgcgctgcgcgaacggatcctcgacggccgcctcggcagccgcacgcggatgcccgccagccgcgagctggcccaggccctgaaggtctcgcgcaacaccgtggtgcgggcctatgaacagttgcacgccgagggctatatcgacgggcgcacaggcgacggcacctacgttgccgagttgcaggaaatcccaggcagggcccccgccgtcgccccgagcgctcccgcgccgcgcggcccggcggccctggcgccgccaccggaaggcgcgccgcgagcgttccgcgtcggcgtgccggccttcgacctgttccccttcgacacctgggcgcggctacaggcgcgcttctggcgcaacccaccggcggactgcctgggctacggcgacccggccggcgaggcgcgcctgcgcgagctgatcgccgcctacctgcgcagcgcgcgcggcctgcgctgcgaggcggaacaggtgatcgtcacccatggcgcgcagcaggccatccgcctgtgcgcccaggtgttgctcgagaacggcgatccggtggctgtggaaaaccctggctaccgcgcggcgcgcctggccttcgccgcgaccggcgcggtaccgcacgggatcgacctcgacgccgaggggctgcgcagcgaccggctcgcgggcattgccggctgccgcctggcctatgtcacgccgtcacaccagtaccccaccggcgtcaccctgtcgctggcgcggcgcctggagctgctggagtgggccgagcgcgccgacggttggatcgtcgaggacgactacgacggcgagtatcgctacagcggtacgccgctggcgccgctggccgcgctggaccgacagggccgggtgctctacgtcgggaccttctgcaagatcgccttcccggcgttgcgcctgggctacctggtggtcccgccggcgctggtcgagcgcttccgccagcggcgggccatcgaggtacgccattcggaggtgggcacccagcgggtcatggccgacttcatcgccgaggggcatttccagcgccacgtccgccgcatgcgccgcgccgcccgcgcccgccgcgacgccttgctgcggggctggccaaaagcgccgggttgccagccgttgccggcggtggatgcggggctgcacctgtgcgtgcgggtcgacagcctggcgcgggaacgggccctgatcgccgcggcggcagccgccggggtggaagtcagcgccttgagcgactactggatggacgactccagcgttgcgccagacgaccgcgcgggcctggtgctgggcttcccggcagtacccgaggtgcgtatcgacgaggcgctgcgggcgttgcgcaaggcctggcggcgggaggccctggttggacccgtcgtcgcgactgactag

SEQ ID NO: 2567 - DNA, 606 bp, Pseudomonas aeruginosa
  unsure (522): Identity of nucleotide at the above locations are unknown.
aatgcccccggatcaccctcgcgcccaggagtagccatgagtgtcgccctttccgccgcgcccgagcgcaagctcgccgcccccctgatcgccttcgccctgctggtgctcggcgggctgttcctgttcaacgcggtcagcgcgcgccaggccatcctcttcgtcgtcggcggcgccctgggcctgaccctctaccacgccgccttcggcttcacctccgcctggcgggtattcatccgcgaacggcgcggcgccgggctgcgcgcgcagatggtgatgctggcgctggcggtgctgctgttcttcccggcgctggcggcgggcagcctgttcggccagccggtgagcggtttcgtctcgccggtcggtacttcggtgatcgtcggcgccttcattttcggcatcggcatgcaactgggcggcggctgcgcctccggcaccctgttcaccgtcggcggcggcaacgcgcggatgctggtgaccctgctgttcttcatcctcggctcgctgatcgccacccancatgtcggctggtggttcgccctgccgtcgctgccgccgatctcgctggtcgccgaactgggcctggcaccggcgctggtgtag

SEQ ID NO: 2568 - DNA, 555 bp, Pseudomonas aeruginosa
tggcggggttggcggcgcttcttccgcggccctggcccgctggtctggggcgcgttggcgctggcgctgctcaacttcctcaccctgtacctcgccggacgcccctggggcatcacgtcggccttcgccctgtggggcgcgaagatcgcccagggcgtgggcctggacgtcggcgcctgggccttctggcagacgccggcgaacgccaaggcgctggccgcgccgctgtgggaagacatcaccagcgtgatggacatcggcatcgtcctcggcgcgctgctcgccgccggcctggccggacgcttcgcgccgaacctggacatcccgcgccgttcgctggcggcggcggtgatcggcgggctgctgctcggctacggcgcgcgcctggcctatggctgcaacatcggcgcgtatttcagcgggatcgcgtccggcagcctgcatggctggttgtggttggtggcggcgtttgccggcaacagcgtcggggtacgggtattgaggccctatttcttcccggaggagcggcgggagcaagggttgacggggtgttga

SEQ ID NO: 2569 - DNA, 948 bp, Pseudomonas aeruginosa
tggcggacgtgtcatcgcattaccggagcctttcccgtcgtgaacctcgaactgaagtggctggaggatttcatcgccctggccggcacccgcagcttttcccaggcggcggagaagcgcttcgtcacccagccggccttcagccggcgcatccgcagcctggaggacgccctcggcctgaccctggtgaatcgccagcgcacgccggtggaactgaccgaggccgggcagctgttcctggtcaccgcgcgcagcgtggtcgagcagctcggccaggtggtgcgccacctgcaccacctggaaggcgggcagggcgaggtgctgcagttcgccgccgcccactcgctggcgctgggcttcttcccgcagtggatcgcgcggctgcgcaacgaggggctgaacatcgccagccggctgatcgccaccaacgtcggcgaggcggtgcattccctgcgcgagggtagctgcgacctgatgctggcgttctacgaccctgacgccgcgttgcagatggacccggagatcttcccctcgctgcacctggggcgcaccgagatgctgccggtctgcgcggtgaacgccgagggccagccgctgttcgacctggagaacggccagagcgtgccgctgctcgcctacagcgccagcgccttcctcggtcgcggggtcaacctgctgctgcgccagcgcaacctgcgctacaccacggtctacgagacggcgatggccgacagcctgaagagcatggcgctgcaaggcatgggcgtggcctgggtgccacggctgagcgtggtcaacgaactggagcgcggcgaactggcgatctgtggcgggccgcaatggttcgtgccgcaggaaatccgcctgtaccgctgcgcgctggtgcgcaaggcggcgatccgcctgctctggcgcaagctggaaggcgggctgggcagcgtcgagtag

SEQ ID NO: 2570 - DNA, 441 bp, Pseudomonas aeruginosa
acaggcaagggcggcgccgggacgccgccccgcaggtcacatctcgaggacgatgcgcccctcgatctgcccggcgcgcatctggtcgaggatctggttgatgtcgtccagcttgcccggatggatggtcgccttgaccaggccttcgccggcaaagtcgagggcttcctgcaggtccgcgcgggtgccgacgatggagccggcgatgtgcaggcccttgagcaccacgtcgaagatcggcgtcgggaagtcacccggcggcaggccgaccagggcaatggtgccgccgcggcgggccatgccgatggcctggccgaaggcgctgttggataccgcggtgaccagcaccccgtgggcgccgccgatgtcgcgctggatcgcctccaccgggtcttcctgccgggcgttgaccgtcaggctggcaccgagcttgcgcgctag

SEQ ID NO: 2571 - DNA, 648 bp, Pseudomonas aeruginosa
ttccagcttggcgtcgtcgatgtcgatggcggcgacgtgcaggcccatggccctggcgtactgcacggcgacgtggccgaggccgccgatgccggagatcgccacccactggccggggcgcgcgttggtctgcttgagccccttgtagacggtgacgccggcgcagaggatcggcgcgatttcagcgaattcgacgtttttcggcagaattccgacgtagttcgggtcggccaatacgtattcggcatagccgccgttcaccgagtagccggtgttctgctggctttcgcagagggtctcccagccggtcaggcagtgctcgcagcagccgcaggcggtgtacagccaggggatgccgacccggtcgccttccttcacccgggtcactccgctgcccaccgcggcgacgtagccgacgccttcgtgaccgggaatgaacggcaacggcggcttcaccggccagtcgccctcggcggcgtgcaggtcggtgtggcagacgccggaggcttcgatcttcaccagtacctgcccggggccgggcagcggaaccttgacttcctcgatccgcagcggcgcgccgtaggcgtgcacgaccgcggctttcatggtctgtggcagggtcatggtcatctccttggacggggctga

SEQ ID NO: 2572 - DNA, 564 bp, Pseudomonas aeruginosa
ccttcgagttcgagagcgtgccggcggaaaccgtggccttcctctcccagttcgtgccggtctacccgaacgccgagtcgctgcgcatcgcccgcgaccgctggttcgagaagtcgatgttcaaggacctcggcattcccactccggacttcgccgacgtccagtcccaggccgacctcgatgccgccgcagccgccatcggcctgccggcggtgctcaagacccgcaccctgggctacgacggcaagggccagaaggtcctgcgccagccggccgacgtgcagggcgcgttcgccgaactgggcagcgtgccgtgcatcctcgagggcttcgtgccgttcaccggggaagtctcgctggtggcggtgcgcgctcgcgatggcgagacgcgtttctacccgctggtgcacaacacccacgacagcggcatcctcaagctctccgtggccagcagcgggcatccgttgcaggcgctggccgaggactacgtcggccgcgtgctggcccggctcgactacgtcggcgtgctggccttcgagttcttcgaggtggacggcggcctga

SEQ ID NO: 2573 - DNA, 624 bp, Pseudomonas aeruginosa
tcaagaagaattgatggctctggccggcccccgcgggggccggcgtttcctcacttcgccggtattcccgccatcatgcgccgcttcccgttcgcccgcctgttgctgctcgccctgttgtcctcacccctggtccacgccgaactgcccgagaccgactggctggaactgatgccgccggccgaccgcaaggcgctggaagaaatgcccgacatcgtccacgacaccccggaggccgccggcaccttcaccagcaaggggggcctgaagcagtcggaccgaaagatgccggcggtgatgtattcggccaagaccgtcgccagcctggatggcaaggcgatccgcctcggcggctacccggtgccgctggagaacgacgccaagggccgcgtcaccgaattcttcctggtgccctatccgggcgcctgcatccacgtgccgccgccgccgccgaaccagatcgtcctggtgcgttatccacaggggctgaagctgaccgatatctacaccccgctgtgggtcagcggcacgctgaagatcgagcaggtgagcaatgacctggccgatgccgcctacgccatcgacaaggcgcgggtgaaggtggtggaggaagcggacctgtag

SEQ ID NO: 2574 - DNA, 3156 bp, Pseudomonas aeruginosa
  unsure (1027): Identity of nucleotide at the above locations are unknown.
cgcgtcaccacgtcgacggtgcccagcaggctgggactgtcggcggtgaggatccaggtgtcgggggtacggctcatcgcgaggctccgggtccggtatcccctctcggggagaggggaaggctgctcatgccgctacctgcaggccgtattcggcgctggcgtcttgcaaccagagccagaagtagtcggcgaagctgcggcgcacgaccagctcccaggtgtcctcgccggtatggcggatcacgcattgcgacttggcgaagatgctgccgaccgccttgcccaccgggaagttgctcggatgcacgtcgtagctggtggatttcatcagcagttcgcggacgttcgctccgctcagttcgagcagcgtctgcccgccgctgacgttgaccaccgcgtagtgcagctcctcgcccagggcctggcgcaggcgctgttcgacggcgtattcctcgccgccggggacgatcagcaaccattcgtccggggccagccattgcagcgaggtctcgccgctggcgaccagggtcagggccaccggcagttccaggccgagggcctggtgcacggcggcggcgaaggccgggtcggcggcatcgccgcgcagcaccaggtggccgagcagcttcttctcgcgcaggacgataccggccttcgcggcggtcttgccggcgagcttgtgcagctcggcatggtgcagcggcgattcggcgtggacgccgggttcggggcgttgctggtagacgtttgccttgctcattcgttttcaccttggggcgccgcgcgccctggtagcctgtctgccttctcccttcgggaagagggccggggagaggagcgcatccctctccggtcaatccacgttctgccgctcccctttggggtcgtaaaacaccgaggagcagatctccgcctcgatgaagcggccgtccgccagcggcgcgtaaaccttctggcccatgcgcttgaggccgcctttcaccaccgccagggcgaaaccgtggccgatgctggcgctcatgtanctggaggtgacgtggccgaccatcttcatcgggatcgcctgctggggtgtcgaacaccagttggcgcgccttcgggcagtacctcctgcgggttgctcggcctgagtccgaccagttgcttgcgatcctcgcgcggccagtcggcgcggttcatgccgcgcccagccgatccaggagaacggcttggtgcggcccaccgcccagcccatgttgagatcgtccggggtgaccgaggcatcggtgtcctgggggacgatgatgaagcccttctcggcgcgcaggacgtgcatggtctcggtgccgtagggcgtcaggccgtacttcgcgccgtgctcggcgagcgcttcgagcacgcccatggcgtagtcggcctggacgttcacctcgtagctcagctcgccggtgaaggagatgcggaacacccgcgccggcaccccggcgaccttgccttccttccaggtcatgaaggggaaggcatccttgtccaggtcgatgtcggtgacttcggcgagcagcttgcggctgttcgggccggacagggtgagggtcgcgtagtggtcggtgaccgaggtgaagtacaccttcagctccggccattcggtctggtggtacagctccagccactccagtacgcgggcggcgccgccggtggtggtggtcatgacgaagtggttgtcggccaggcaggcggtcacgccgtcgtcgaagaccatcccgtcttccttgcacatcaggccgtagcgcgccttgccgacgtcgagcttggtccaggcgttggtgtagacccggttgaggaactcccgcgcgtccgggccctggatgtcgatcttgcccagggtcgaggcgtcgagcaggccgaccgcctcgcgcaccgcgcggcattcgcgggccacggcggcgtgcatgtcctcgccgcggcgcgggaagtaccacggccgcttccactggccgacgtcctcgaactcggcgccgttcttcacgtgccaggcgtgcagggcggtgaaacgcaccggttcgaacaggtgcccgcagtggcggccggcgacggcgccgaaggtcaccggggtgtagttcggacggaacatggtggtgccggtgtcggcgatgctcttgccctgggcccgcgcggcgatcgccaggccgttgatgttgcccagcttgccctggtcggtgccgaagcccagcgcggtgtagcgcttgacgtgctcgatggactcgaagccctcgcggcaggccagttcgatggcggcggcggtgacgtcgttctgcggatcgacgaactgcttcggtgcgcgtgccgtgggcttctcgtggggcacctggaacagcgcgacggacgcttcctcgcggcgcggctggaccttcggcaggctgccggcggtggtcttgtagccggcgtcgagggcggcgcgactcccggcctggtagccgtcggcgagcacctcggcgagcccgaacacgccgttcacggcgccggcgcagatgcgcttctgcaggccttcgccggggacgaaggcgaggatttcctcgcgccattccggcttgccgcccaggtgcgaggccaggtgcacgaccgggctgtagccgccggagctggcgatcaggtcgcagtccagccattcgccgccgctggcgcgcatggcctgcaggtcgatccgggcgaccttggcgccgctgacccgcttgccgccgcgagcctcgatcaccgaactgccagtgatcacccgcataccgcgttggcgtgcttcctcgatccactcgccgcgcggattggcccgggcgtcggcgatggccaccacttgcaggccggcttcctgccagtcgagggcgacgcggtaggcgtagtcgttgttggtggccagcaccagtttcttgcccggtgccacgccgtagcgccgtacataggtggaaaccgcgccggcgagcatgttgccgggcaggtcgttgttgccgtagaccagcggccgctcatgggcgccggcggccagtaccacgcgcttggcgcgcacgcggtgcacgcgctggcggacctggccgagcggggcgacctcgccgaggtggtcggtgcgccgctcgtggatggtgaggaagttgtggtcgtggtagccgttgaccgtggagcgcggtag

SEQ ID NO: 2575 - DNA, 1428 bp, Pseudomonas aeruginosa
cgttgcatgtggatgctcctgaactgttgctccctctcccgcggagagggttgggccggggcgcgtcgggctccccgaccgtcttcggggggctcagcgatagaccgggaagtccgcgcagagaccggcgacctgggtggcgaccttggcttccacgtcggcatcgccgaggtggtcgaggatgtcgcagatccagccggccagttcgcggctctgcgcttcctgcagcccgcgggtggtgatggccggggtgccgatgcggatgccggaggtgacgaacgggctctgcggatcgttcggcacagcgttcttgttcaccgtgatgccgacccggccgagggcggcgtcggcttccttgccggtcaggccctggcgcaccaggctgatcagcatcaggtggttgtcggtgccgccggaaaccacgtcgtagccgcgcccgatgaacacctcggccatcgccttggcgttgcggatcacctgcgcctggtagtccttgaagcccggctccagcgcttccttgaagcacaccgccttggccgcgatcacgtgcatcagcgggccgccctgggcgccggggaataccgcggagttgagcttcttctcgatctcctcgttggcgcgcgccaggatcaggccgccgcgcgggccgcgcagggtcttgtgggtggtggtggtgaccacgtcggcgaaggggatcgggttcgggtagaggccggcggcgaccagcccggcgacgtgggccatgtcgacgaacaggtaggcgccgaccttgtcggcgatggcgcggaagcgcgggaagtcgagggtcttggagtaggcggagaagccggcgacgatcatcttcggcttatgctccacggccaggcgctcgaattcgtcgtagtcgatcagcccggtagcggtgtccaggccgtactgcacggcgttgtacagcttgccggaggaggacaccttggcgccgtgggtgagatggccgccgtgggccaggctcatgccgaggatggtgtcgccggcgttgagcagcgccaggtacaccgcggcgttggccgaggaaccggaatgcggctggacgttggcgtagtcggcgccgaacagctgcctggcgcggtcgatggccaactgctcgaccttgtcgacgtgttcgcagccgccgtagtagcgcttgcccggatagccctcggcatacttgttggtcaggccgctgccctgcgcctgcatgacccgcttgctggtgtagttctccgaggcgatcagttcgagatggtcttcctggcgggcctcttcggcgtccatcgcggcgagcagttcgtcgtcgtagccgcggatctggtcatgcttgctgaacatcgctgggtctccctgcggcgccggaaccgcgccggaatggctgcaacgggacacgcggtccctttgccagcgatggtatga

SEQ ID NO: 2576 - DNA, 2088 bp, Pseudomonas aeruginosa
cgaagtactggccaagctgaaggaggccgaatgatgagcgccaaggatttcctggtcgaactgggcaccgaagagctgccgccaaaagccctcaacagcctcggcgaagccttcctcagcggtatcgagaagggcctcaaggctgccggtctgagctatgccgctgcgcgtttctatgcggcgccgcgccgtctcgccgtgctggtcgagcaactcgccgtgcagcagcccgaccgtaccgtcaacctagacggtccgccgctacaggccgccttcgacgccagcggtaacccgacccaggccgccctgggcttcgccaagaagtgcggcgtggatctgcagcagatcgacaagagcggtccgaagctgcgcttcagccagaccatcgccggccaaccggccgccggcctgctgccgggcatcgtcgaggcctcgttgaacgaactgccgattcccaagcggatgcgctgggcagctcgccgcgaggagttcgtgcgtccgacccaatggctggtgatgctgttcggcgacgatgtggtcgagtgcgagatcctcgcccagaaagccgggcgcgaatcccgtggccaccgcttccacaatccggacaatgtgcgtatttccagcccggcagcgtatctggaagacctgcgcggcgctcatgtgctggccgatttcgccgagcgccgcgagctgatcgccaagcgcgtggccgaactggccgccgagcaacagggcagcgccatcgtgccgccgagcctgctcgacgaagtgactgcactggtcgagtggccggtgccgctggtctgctccttcgaggagcgcttcctcgaggtcccgcaggaagccctgatcaccaccatgcaggacaaccagaaatacttctgcctgctggacgccaacggcaagctgctgcctcgcttcatcaccgtcgccaacgtcgagagcaaggcgccggagaacatcgtcagcggtaacgagaaggtggttcgcccgcgcctcaccgacgccgagttcttcttcaagcaggacaagaagcagccgctcgaaagcttcaatgagcgcctgcgcaacgtagtgttccaggcccagctcggcaccgtgttcgagaaggcccagcgcgtctccggcctggccgcctacatcgccgaacgtataggcggcaatgcgcagaacgcctcgcgcgccggcatcctgtccaagtgtgacctggcgaccgagatggtcggcgagttccccgaaatgcagggcatcgccggctactactacgccacccacggcggcgaagcggaagacgtcgccctggccctcaacgagcagtacatgccgcgcggcgccggcgccgagctaccctcgaccctgaccggcgccgccgtggcggtggccgacaagctcgataccctggtcggtatcttcggcatcggcatgcttcccaccggcagcaaggacccctacgcgctgcgccgcgctgcgctgggcgtgctgcgcatcctcatcgagaagcagctcgacctggacctggtagccgcggtcaacgccgccgtcgagcaatacggcgacaaggtcaaggccgccggcctggccgagcaggtgctggacttcgtgttcgaccgcctgcgcgcgcgctacgaggacgaaggcgtggacgtggccgtgtaccagtcggtgcgcgcgctcaagccaagctcgccgctggacttcgaccagcgcgtacaggccgtccaggccttccgacagttgcctgaagccgaggccctggccgcggcgaacaaacgggtgtcgaatattctcgccaagtccgaggacgaggttccgccgaacgtggatgccagcctgctggtggaagccgccgagaaggccctgggcagcgccgtggcgaacgccgaaagcgaagtcgcgccgctggcagcggcacgcgactatcgcgccgcgctggcccgcctggcggccttgcgcgagccggtggatacgttcttcgccgatgtgatggtcaatgtcgacgacgcagcggtgcgcgccaaccgctatgcgctgctggccaagctgcgcgggtcgttcctcggggtggcggacatctcgctgctcggctga

SEQ ID NO: 2577 - DNA, 573 bp, Pseudomonas aeruginosa
aatcgatcctttccgttcatggccaactgcgcatcgatgtcccgttccctgctgattctcgaccgcgatggagtcatcaacctcgactccgacgattacatcaagaccctcgacgagtggatccccatccccagctcgatcgaggccatcgcccgcctgagccaggccggctggaccgtcgcggtggctaccaaccagtccggcatcgcccgtggctattacgacctggcagtgctcgaggccatgcatgcgcgcttgcgcgaactggtcgcggagcagggcggcgaggtcggcctcatcgtctattgtccgcatggaccggacgacggttgcgactgccgcaagccgaagccgggtatgctgcggcagatcggcgagcactacggggtcgatctgtcgggtatctggttcgtcggcgacagcatcggtgacctggaggcggcgcgggccgtcgattgtcagccggtattggtaaagaccggaaaaggtgtacgtacgctgggcaagcccttgccagagggcaccctgatattcgacgatctggcggcagtcgccagcgcattacttcagtaa

SEQ ID NO: 2578 - DNA, 291 bp, Pseudomonas aeruginosa
agtccgttttccgagcaggagacggcagtgaaaaagcgttttaccgaagagcagattctcgacttcctcaagcaggcggaggccggtgtgccggtgaaggaactgtgtcgccgacacggcttcagtgatgcctcgttctacacttggcgggcgaagtttggcggtatgaccgtggcggacgccaaacggttgaaggatcttgaactggaaaatagccgattgaagaagttgctcgccgaggcccacctcgacatcgagtcgctgaaagtggtcgcccggggaaaagggtaa

SEQ ID NO: 2579 - DNA, 195 bp, Pseudomonas aeruginosa
tcgggctgtcccgctcggtgttgcgctaccagccgcgagccagtgtgcaaaacaccgagctgcaagcccaactggtggaactggcccaagagcgccggcgctttggctatcgccgcctgcacttcctgctgcggcgtgctggcgtgcaggtcaaccacaagcggatctatcgcctgtaccgcgctgccggcttga

SEQ ID NO: 2580 - DNA, 342 bp, Pseudomonas aeruginosa
gcggcaggatcgcctgggtccggcgattacggccctgcttggcggaaccgcccgcggagtcaccctccacgatgtacagttcggagagcgccgggtccttttcctggcaatcggccagcttgccgggcaggccggcgatgtccagcgcgcccttgcggcgggtcatctcgcgcgccttgcgcgcggcctcgcgggcacgggcggcgtcgatcatcttgccgaccacggccttggcttcgttgggattctccagcaggaagtcggcgaagtacttgcccatctcctgttccaccgcagtcttcacctcggaggagaccagcttgtccttggtctgcgagctga

SEQ ID NO: 2581 - DNA, 1197 bp, Pseudomonas aeruginosa
ttagaggcgcatcggcatgacgacataggcagaatcgtcattgtcggcctcgtggaccagggcgctgctgttggaatcggaaaggatgaagcggacctgctcggtaccgatcacacccagcacgtcgagcaggtaactgacgttgaagccgatctccaggttgccgccgttgtactcgacctgcacttcttcctcggcctcttcctgctccgggttgttcgcctggattttcagcaaaccgttggaaagctgcaggcgaatgccgcggtacttctcgttggagaggatcgcggtgcggctgaaggcttcgcgcagttgctggcggtcaccgaccaccagcttgtcgccaccgcgcggcagtacgcgttcgtagtccgggaacttgccgtccaccagcttcgaagtgaaggtgaattcgccagtggtggcacggatatggtgctggcccaggacgataccgacttcgccgtcctgctcggtgagcagacgagccagttcgaggatgcctttgcgcggcacgatcacctggtggcggtcctgcgacgggatctgcgcatccagcgagcacatggccagtcggtggccgtcggtggcgacggaacgcagggtaccgccgttcacttccagcagcatgccgttgaggtagtaacgcacgtcctgctgggccatggcgaagctggtgcggtcgatcaggcgacgcagcttgctctgggcaatgctgaagttcagcgagccgggaccttcctccacggtggggaaatcgttggccggcagggtggacagggtgaagcggctacgcccggccttcaccaggagtttctgctcttcgacacggatgtcgatcagcacgtcgttcggcaggctcttgcagatgtccatcagcttgcgcgccggtacggtgatctcgccgggttcggcggcatcttccagtaccacgcgaccaaccagctcgacttcgaggtcggtgccggtcagcgacagttgctggccttcgaccaccagcaggacgttggagagaaccggcaatgtctggcggcgttccacgacgccggcgaccagttgcagcggtttcaacagggcttcgcgttgaatggtgaaatgcatggtctagtcccttgcctcgtgggctgcgtcaggttgtcagggtacgcagcaggttcttgtagtcctcgcggatatccgcgtcggattccctaa

SEQ ID NO: 2582 - DNA, 438 bp, Pseudomonas aeruginosa
gcgtctgaccgtctgatttatccggtacgggtggtgagtcgggacttcgaccgggacaagcgtctactgacagcccggcaattcagcgcagtcttcgactctccgaccggcaaggtccccggcaagcacgtcctgctgctggcgcgcgagaacggtctcgatcacccccgcctgggcctggtgatcggcaagaagaacgtcaagctcgccgtccagcgcaatcgcctcaaacgcctgatccgcgaatcgttccgccataaccaggaaaccctggctggctgggatatcgtagtgatcgcgcgcaaaggcctgggcgaactggaaaatccggagctgcaccagcagttcggcaagctctggaaacgcctgttgcgcaatcgacctcgcacggaaagccctgctgacgcccctggcgtggccgacggtactcatgcatag

SEQ ID NO: 2583 - DNA, 1980 bp, Pseudomonas aeruginosa
ccgcgatctgctactgtcagtttccttcaagcaccgccctttctcgatggccgagtaaccatggacattcaacgctcgattctcatcgtcgcccttgcagtcgtgtcctacctgctggttctccagtggaacaaggattacggtcagcctgagctgcccgccgccagcgcttcgatgaacaccacgcaaggcctgccggacactccgtccgcctcgggcaccagcagtgacgttcccactgcccagagcagcgcggccggcaccgaagccgccgacaagccggttgcggtcagcgacaagctgatccaggtgaagaccgacgtcctcgacctggccatcgatccccgtggcggcgatatcgtccagctcggcctgttgcagtatccgcgccgcctggaccgtccggacgtgccgttcccgctgttcgacaacggtcgcgaacgtacctacctggcgcagagcggcctcaccggtgccgacggcccggacgccagcagcgccggccgcccgctgttccacagtgcgcagagcagctaccagttggccgacggccagaacgaactggtcgtggacctgagcttcagccacgacggtgtcaactacatcaagcgcttcaccttccaccgtggcctgaaagccgattgctcggacaaggaaaaggcccagaagaagatcgagtgcatcaatgaaaacgcctatcaggtcggcgtcagctacctgatcgacaaccagagcggcaagacctggagcggcaacctgttcgcccagctcaagcgcgacggcagcgccgacccgtcctcgaccaccgccaccggggtgtccacctacctcggcgccgcggtctggaccccggattcgccgtacaagaagatctccaccaaggacatggacaaggaacagttcaaggagtccgtgcagggtggctgggtcgcctggctgcaacactacttcgtgaccgcctgggttccgaccaagggcgagcagcaccaggtcatgacccgcaaggacggccagggcaactacatcgtcggtttcaccggcccgaccctgagcgttccggcgggtagcaaggtggaaaccgacctgaccctgtatgccggcccgaaactccagaagcacctgaaggaactctccccgggcctggaactgaccgtcgactacggtttcctttggttcatcgcccagccgatcttctggctgctgcaacatatccacagcctgatcggcaactggggctggtcgatcatcgccctgaccgtcctgatcaagctggccttcttcccgttgtccgccgccagctaccgttcgatggcgcgcatgcgcgcggtgtcgccgaagatgcaggcgatcaaggaacagcacggcgacgatcggcagaagatgtcccaggcgatgatggagctgtacaagaaggagaagatcaatccgctgggcggctgcctgccgatcctggtccagatgccggtcttcctctccctctactgggtactcctggaaagcgtggaaatgcgccaggcgccgtggctcggctggatcaccgacctgtcggtgaaggatccgttcttcatcctgccgatcgtcatgggcggcaccatgctgatccagcagatgctcaacccgaccccgccggacccgatgcaggccaaggtgatgaaactgatgccgatcatcttcaccttcttcttcctctggttccccagccggtctggtgctgtactgggtagtcaacaactgcctgtcgatcgcacagcagtggtacattacccgcaagatcgaggcagccgcgaagaccgcctgacgtctatcgcgaaaactgtccacaacaagacgccccctcgaggggcgtcttgctatccggagatatccacatgcaagccgccaccgaaaccatcgtcgcgatcgctaccgcccagggccgcggcggcgtgggaatcgtccgcgtctccggacctctcgccggacagatggccgtggccgtga

SEQ ID NO: 2584 - DNA, 252 bp, Pseudomonas aeruginosa
ggccgctatccgccatacactggaaaaccagccgaacctgtggatattccagcaggcctgcgacgacctgatcgtcgagcaggatcaggtccgcggcgtagtgacccagatgggactgcgcttccatgccgacaacgtggtcctgactaccggcaccttcctcggcggacttatccacatcggcctggagaactactcaggcggacgcgccggcgacccgccgtccatcgcactggcgcgtcgtctgcgtga

SEQ ID NO: 2585 - DNA, 648 bp, Pseudomonas aeruginosa
ggaaagccaccaggtcttcctcgagccggaaggcctgacgacccacgagctgtatcccaacggcatttccacgtccctgccgttcgacgtgcaactgcagatcgtgcgttccatccgtggcatggaaaacgcccacatcgtgcggccgggctatgcgatcgagtacgacttcttcgatccccgcgatctcaggtacagcctggagaccaaggtcatcggcggcctgttcttcgccggccagatcaacggcaccaccggctacgaggaagctggcgcccagggcctgctggccggcgccaatgctgcgttgcgttcgcaaggcaaggacagctggtgcccgcgccgcgacgaggcctacatcggcgtgctggtggacgacctgatcacgctcggcacccaggagccgtaccgcatgttcacctcgcgggcggaataccgcctgatcctccgcgaggacaacgccgacctgcgtctcaccgagaagggacgcgagctgggccttgtcgacgatcggcgctgggctgccttcgaagccaagcgcgaaggtatcgaacgcgaggaacagcggctgaagagcacctgggtgcggccgaataccccgcagggcgacgccatcgccgagcgcttcggtacgccgctgacccatga

SEQ ID NO: 2586 - DNA, 939 bp, Pseudomonas aeruginosa
cccccaggtggccgagcaggtggagattcgcaccaagtacgccggctacatcgaccgccagcaggaggaaatctcccgtctgcgcgccagcgaagatacccgcctgcctgtggatatcgattacctggggatttccggcctgtcgaaggaaatccagaacaagctgaaccaggcccgtccggaaaccctcggacaggcttcgcggatccccggcgtcacgccggctgcgatttcgctgttgttgatccacctgaagaagcgtgcctctggccgccaactggagcagagcgcttgatgtctgcggtaacccaacaccacgccgacgaactcgcgcgcggtgctgacgagctaggcgtcgccctcgacgccgacaagcaacgccagctgctggcctacctggccctgctgatcaaatggaacaaggcctacaacctgaccgccgtacgcgacccggacgagatggtttcgcgccacctgctcgacagcctgagcatcgtgccttatgccgaggctggggataactggctggatgtcggcagcggcggcggcatgcccggcgtgccgctggccattctgttcccggaaaagcgcctgaccctgctcgacagcaacggcaagaagacccgcttcctgacccaggtgaagctcgaactgaagctggccaacctcgaagtcgtgcacagccgggtggaagccttccgtcccgagagccccttcgatggcatcgtttcccgcgctttcagcagcctggaggacttcgccaactggacccgccacctcggtggccaggaaacccgctggctggcgatgaagggcgtgcatccgaacgaagagctggcggcactcccggaggatttccgggtcgaagccgagcacgcgctggcggtacccggttgccaaggtcagcggcatctgctgatactgcggcgcacagcatga

SEQ ID NO: 2587 - DNA, 666 bp, Pseudomonas aeruginosa
gggggaacagggataaccatggctaaggtattcgcgatcgccaaccagaaaggcggtgtcggcaagaccacgacctgtatcaacctcgcggcctccctcgtggcgaccaagcgccgcgtcctcctgctggacctggatccccagggcaacgccaccaccggcagcggcatcgacaagcacaacctggagcactccatctacgacgtgctcaccggcgagtgcaacctcgccgaggccatgcagttctccgaacacggcggctaccagttgctgccggccaaccgcgacctgaccgccgcggaagtggtgctgctggaaatggacatgaaggaaaatcgcctgcgcaacgcgctggcgccgatccgcgagaactacgactacatcctcatcgactgcccgccgtcgctgtcgatgctcaccgtcaacgcgctgaccgccgccgacggcgtgatcatccccatgcagtgcgagtactacgcgctggaggggctgaccgacctgatgaacagcatccagcgcatcggccagttgctcaacccgacgctgaagatcgagggtctgttgcggaccatgtacgatccgcgcatcagcctgaccaacgatgtctccgcgcagttgcaggagcatttcggcgacaccctcttacagcaccgtcatcccgcgtaa

SEQ ID NO: 2588 - DNA, 993 bp, Pseudomonas aeruginosa
tgtgcgcctcgccgaagcccccagcttcggcatgccggcgctggtttacgacaagcaatcccgcggcgccatcgcctacctggcgctggccggcgagctggtccgccgccagcgcgccaaaggccgcgccgcaaccgcataaggaacccgcatggcagccaagaaacgtggactgggacgcgggctcgatgccctgctgggcggctcgagtcccgccaaactgcaggaggaagccgtacaggccgaccgccgcgagttgcagcagatccccctcgacctgatgcagcgcggcaagtaccagccgcgtcgcgacatggaccctcaggcgctggaggaactggcgcagtcgatcaaggcccagggcgtgatgcagcccatcgtggtgcggccgatcgccaatggccgctacgagatcattgccggcgagcggcgctggcgggccagccagcaggccggactggaaaagatcccggcgctggtgcgcgacgtgccggacgaagcggccatcgccatggcgctgatcgagaacatccagcgcgaggacctcaacccgatcgaggaagccgctgccctgcagcgcttgcagcaggagttccagctgacccagcagcaggtcgcggaagcggtcggcaagtcgcgcgcgaccattaccaacctgctgcgcctgatcggcctgccggaagagatcaagaccctgctttcccatggcgacctggagatgggccatgcccgtgcgctcctcggtctgccggcagaacggcaggtggaaggggcgcgacatgttgtcgcacatgggctgaccgtacgtcagaccgaagccctggttcggcagtggacgcatgcccctggcaagcctgcgggaccggtcaagagcgacccggacatcgcccgcctggaacagcgcctggccgagcgcctgggcgcttcggtgcagatccggcatggtcagaagggcaagggacagttggtcatccgctacagctccctggatga

SEQ ID NO: 2589 - DNA, 912 bp, Pseudomonas aeruginosa
tgggaaaaacatttacaagaccttagagcgattgaggcaaacatggcagcagaaaccgcttcgggttacatccagcaccacttgcagaacctgaccttcgggcgtctgcctaatggtgattgggggttcgcccacaccgccgagcaagccaaggaaatgggcttctgggcattccacgtagacaccctgggctggtcggtactgctcggcgtggtgttcctgttcatcttccgcctggcagccaagaaggccaccagcggccagccgggtggactgcagaacttcgtcgaggtgatggtcgagttcgtcgacaccagcgtcaaggacaccttccacgggcgcaacccgttgatcgcgcccctggccctgaccgtgttcgtctggatcttcctgctcaacctgatcgacctggtaccggtggactacctgccgatgctggccgcgaagatcaccggcgacgagcacctgttcttccgcgcggtggccaccaccgacccgaacgccaccctcggcctgtcgatctcggtgttcgcgctgatcgtcttttacagcatcaaggtcaagggcatcggcggcttcctcggtgaactgaccctgcaccccttcagcagcaagaacatcgtcgttcagatcctgctgattccggtgaacttcctgctcgagttcgtgaccctgatcgccaagccggtttcgctggcgctgcgtctgttcggcaacatgtatgccggcgaactgatcttcattctgatcgccgtcatgttcggtagcggaatgttcctgctgagtgccctgggcgtagccctgaactgggcgtgggctgtgttccacatcctgatcatcaccctgcaggccttcatcttcatgatgctgaccatcgtctacctgtcgatggcgcacgaagacaaccattaa

SEQ ID NO: 2590 - DNA, 753 bp, Pseudomonas aeruginosa
agcccgcgaccaggcccgtaccgaaggcgaacgcctgaaggcccaggcccaagcggaaatcgaacaggaactgaacagcgtcaaggacgccctgcgtgcccaagtgggtgccctggccgtcaccggcgcagagaagatcctgggtgcttcgatcgacgcaaacgcgcacgagcagctggtttccaaactggcagccgagatctaagcgagggcgctatggcagaactgaccacgttggctcgtccctacgcaaaggcggctttcgagtacgcccaggctcatcagcaactggccgattggtcggctgcgctgggtgtgctggccgcagtgtcgcaggacgacaccgtgcgccagctgctcaaagagcctcagctgacctcttcggccaaggcccagagcctgatcgatgtgtgcggcgacaagctgaatgcaccagcccagaacttcgtccggactgtggctgagaacaagcggctcgaactgctgccgaccatcgctgagatgtacgagcagttgaaggccgagcaggaaaagtcggtcgaggtagaagtcaccagtgccttcaccttgagcaaagaacagcaggacaaactcgccaaggctctcagcgcccggctcagtcgcgaagtgcggctacatgcgtcggaagacgcgagcctgatcggcggcgtgatcattcgcgccggtgacttggtaatcgatggctcggtgcgcggcaagctcgcgaaactggccgaagcgttgaaatcttga

SEQ ID NO: 2591 - DNA, 1557 bp, Pseudomonas aeruginosa
aggggcagcggcatgcagcaactcaatccttccgaaattagtgaaatcatcaaggggcgcatcgagaaactcgacgtcgcctcccaagcacgaaacgaaggcaccatcgtcagcgtgtccgacggtatcgtgcgcatctacggtctggccgacgtcatgtacggcgagatgatcgagttcccgggcggcgtctacggtatggcgctgaacctggagcaggattccgtgggtgccgtggtcctgggtgaataccagggcctcgccgaaggcatgaacgccaagtgcaccgggcgcatcctggaggttccggtcggtccggaactgctgggtcgcgtagtcgacgcactgggcaatccgatcgacggcaagggtccgatcgacgccaaggccaccgacgcggtcgagaaggtcgctccgggcgtgatctggcgtaagtcggtagaccagccggtacagaccggctacaagtcggtcgacgccatgatcccggtaggccgtggccagcgcgagctgatcatcggcgaccgccagatcggcaagaccgccctcgcggtcgacgccatcatcaaccagaaagacagcggcattaagtgcgtctacgtggccatcggccagaagcagtccactatcgccaacgtcgtacgcaagctggaagagaacggtgccctggccaacaccatcgtggtcgccgccagcgcttccgagtccgccgccctgcaatacctggcgccgtactccggttgcaccatgggcgaatacttccgcgatcgcggtgaagacgccctgatcgtctacgacgacctgtccaagcaggccgtggcttatcgccagatctccctgctgctgcgccgtccgccgggtcgcgaagcctacccgggcgacgtgttctatctccacagccgtctgctggagcgcgcttcccgcgtttccgaagagtatgtcgagaagttcaccaacggcgccgtgaccggcaagaccggctcgctgaccgcgctgccgatcatcgagacccaggccggcgacgtttccgcgttcgttccgaccaacgtgatctcgatcaccgacggccagatcttcctggaatccgccatgttcaactcgggtatccgtccggccgtcaacgccggtatctcggtatcccgcgtaggtggcgcggcccagaccaagatcatcaagaagctgtccggcggcatccgtaccgctctggcccagtaccgtgaactggcggccttcgcccagttcgcctcggacctggacgaagcgacccgcaagcagctggagcatggtcagcgcgttaccgagctgatgaagcagaagcagtacgcgccgatgtcgatcgccgagatgtcgctgtccctgtatgccgccgagcgtggcttcctgcaggacgtcgaaatcgccaaggtcggtagcttcgagcaggcgttgatctcctacttccagcgcgagcatgccgctctgctggcgaagatcaacgagaaaggtgacttcaacgacgaaatcgacgcgggcatcaaggccggcatcgagaagttcaaggccacccaaacctggtaa

SEQ ID NO: 2592 - DNA, 774 bp, Pseudomonas aeruginosa
gtgatctcgaaacgtaatacgccgcaacgtcgccatgccatcctcgcgctgctttccgagcagggcgaggtcagcgtggacgcactcgccaagcgcttttccacctcggaagtgaccatccgcaaggacctcgccgccatggaaagccacggcctgctgttgcgtcgctacggcggtgcggtgccgatgccgcaggaactgatcggtgaagctgcgcagcccgtctcgccctacaagcaggctatcggtcgcgccgccgcggcgcgcatccgcgagcatgcgcggatcatcatcgacagtggcagcaccaccgcggcgatgatccccgaactcgggcacaagccgggcctggtggtgatgaccaactcgctgaacgtggtcaacgccctgcgcgaactggagcacgagccggtgctgctgatgaccggggggacctgggatccgcattccgagtcgttccaggggcaggttgccgagcaggtgctgcgttcctatgacttcgaccaactattcatcggtgccgacggcatcgatctcgaacgcgggacgaccacgttcaacgaattgctgggcctgagccgggtgatggccgaggtcgcccgcgaggtgatcgtcatggccgaggccgacaaggtcggtcggcgcattcccaaccaggaattgccctggagcagcatccataccctgattaccgacgagcgcctggaatcttccgcgcgcgaacagataaccgcccggggcgtcacgctgatctgcaccccggtcgaggcctga

SEQ ID NO: 2593 - DNA, 1851 bp, Pseudomonas aeruginosa
aaggagaaagaccccatgtgtggaatcgtaggcgcgatcgccgagcgcaacataacccccatccttatcgaaggcctcaagcgcctcgagtatcgcggctacgacagcgccggcgtggcggtcttcgataacgaaggcaggctgcagcgctgccgccgggtcggcaaggtcgccagcctggaggaaggcctggccggtacgccgctgctcggccgcctgggcatcgcccatacccgctgggcgacccacggcgcgccaaccgaaggcaacgcccacccgcatttctccagcgacgaactggcggtggtgcacaacggcatcatcgagaaccacgaacctctccgtgagcggctcaaggggctgggctacgtgttcacctcgcagaccgacaccgaggtcatcgtccacctgctgcaccacaagctgcagtccatcggcgacctgaccctggcgctgaaggacgcggtcaaggaattgcacggggcctatggcctggcagtgatcagcgcggcgcagccggaccgcatcgtcgccgctcgcagcggcagcccgctggtgatcggcctcgggcttggcgagaacttcctcgcttccgaccaactggcgctgcgccaggtgaccgaccgcttcatctacctggaagaaggcgatatcgccgagatccgtcgcgacagcgtgcgcctgtgggatgtccagggcaacgacgtgcagcgcgagaccgtgcagtaccacgaaggcgccgaagccgccgacaagggcgagtaccggcatttcatgctcaaggaaatccacgagcagcccagcgtcgtgcagcgtaccctggaaggccgcctcgggcagaaccaggtaatggttgaaagcttcggtccgcaggcggcggagctgttcgccaaggtccgcaacgtgcagatcgtcgcctgcggcaccagttaccacgccggcatggtcgcccgttactggctggaaagcctgaccgggattccctgccaggtggaggtcgccagcgagttccgctaccgcaaggtcgcggtgcagccggattgcctgttcgtcaccatctcccagtccggtgagaccgccgacaccctggctgccctgcgcaacgccaaggagctgggcttcctctccagcgtggcgatctgcaacgttgccaccagttcgctggtgcgcgaatccgacctgaccctgctgacccaggccggcccggaaatcggcgtggcctcgaccaaggccttcaccacccagttggtcgccctgctgctgctgaccctgggcatcggccaggtgcagaagcgcctggccgatggcgtcgaagccgagctggtggacgaactgcgtcgcctgccgacccggctgggcgaggcgctggcgatgaaccggacggtggagaaggtttccgagctgttcgccgagaagcaccacaccctgttcctcggccgtggcgcgcagttcccggtggccctggaaggcgcgctgaagctcaaggaaatttcctatatccatgccgaagcctacccggccggcgaactcaagcatggcccgctggcgctggtggacagcgacatgccggtggttaccgtggcgccgaacaacgagctggtggagaagctcaagtcgaacctgcaggaagtccgcgcccgcggcggcgaactggtggtgttcgccgacgaaggcgcgggcatcgaggctggcgagggcacccatgtggtgggcatgccgcacatcggcgacgtgctctcgccgatcctctacaccatcccgttgcaattgctctcgtaccatgtcgccgtgctcaagggcaccgacgtcgaccagccgcgcaacctggccaagtcggtcaccgtcgagtaa

SEQ ID NO: 2594 - DNA, 840 bp, Pseudomonas aeruginosa
caccaggagcgccagcaccagcaggagcatgtcttcgtcgcgcttcagataacgtcgcaggtaacccgcggcgaggttgcccacggccaggcccacgccgaaggcggcgatgctgacgcctatctgcgcggtgctgaagccgtagcgctggcgcagcacctctcccgagagaagcaggccggcgaccccggtgccgttccaggcacccttggcgatcagtggcctgaggatgctccattgcctgcaccagcccagcgcatggccctcggcgcgcggtaccacggcttgcacgggaaggcgctggcgtgccatcaggaagaccagcacgcaaccgcacgagaccaacaggaagggcgccgcccagccgaagaagtccgagaggaggccggccagtgccgggccggcggcaatgccgagggtcatgccgagcatcacctggcccatggcaccggcctgtctttgcggggcgaccacctccgcgaccagggcgaaggtggtcgggatgatgattgccgaggcgatgcccccgatcacccgcaggacgacggcaatttccagggtcggggcgatgacgatggccagagtatcgaccgcgaagaggaccagggcgagcagcagcagcttcctgcgttgcatgcggtcggagaagtagcccagcaacggcgcggcgatcgcataggagaacgcgtagctggagatcagccaagcggcgccgctggtagtggtgtggaacgcctgcgccagcggcccgagcatggaggacagcatgaactcggtcacgccgacgaagaatacggccatcgacagggccagcaggaacaggccgtcgagcttctgtga

SEQ ID NO: 2595 - DNA, 1215 bp, Pseudomonas aeruginosa
tgttcccgtcttgtgaccaggaggtttggcatgattgcacagctcccctctgagttgctgtccctgcaactgccgttgcggatccgcatcggcgatgctcaggcgttcgatctggggccggatccacaggtaaccatggtcattcgcgacccctcgctgctaaccgagatcacccatcccagcctcgatgcgctgggcaaggcctacgtcgagaagcgtctcgacatcgaaggaccgatcagccaggtcatcggtatcggcgatgccctcagcgaagcgctcggcgaacccgatggcggcgcgccgccggttcgcgaaagccacgacaaggacacagacgccgaagccatccattaccactacgacctgtccaacgacttctaccagctctggctggatccggaaatggtctattcctgcgcttatttcgagaccggcaaggaagacctcgccaccgcgcaactggccaagctccgtcacctgtgccgcaagctgcgtttgcagccgggcgagaagctgctcgatgtcggttgcggttggggagggctggcgcgcctggccgctcgcgagttcggcgtcgaggtcaccggcatcacattgagcaaggagcagctggcgctcggccgggagcgagtcaaggccgaaggcctggaggaccgagtcaccctcaagctgctggattaccgcgacctgccgcgcgatggccgcttcgacaaggtggtcagcgtcggcatgttcgagcacgtcgggcacgccaacctggggctgtacttccagcaactgtacgaggcggtgcgtcccggcggcctggtgatgaaccacggcatcacctcgcgctacaccgacggccgcccggttggcaagggggccggcgacttcatcgatcgctacgtgtttccccacggcgagctgccgcacctgtcgctggcggtggcgcggatgagcgaagccgggctggaagtagtcgacgtggaaagcctgcgtctgcactacgcccggaccctggacttctggagcgccaacctggaagccaggctgaaggaggcggctcgcctggtgcccgaggaaaccttgcggatctggcggctgtacctggccggatgcgcctacggcttcaagcgcggctggatcaacctgcaccagatcctcgccattcgcccccacgaggatggctcccacgagctgccctggtcgcggcgcgacctgtacgcctga

SEQ ID NO: 2596 - DNA, 2082 bp, Pseudomonas aeruginosa
ccccggtccgtgcggcggaccgggttccccgcgtttccggctgtagggagtcgatgcatgagcgatcatcagaacgggctgcatcttgaggcggaaaactggccgcgcgcgttgttcgccgtggccctggccttttccgtgttccaggtcgtcaccgcggcctttcccctgatttccacccaggtcctgcgggcaatgcacgtcggactgctgttgctggtggtgtacatcagctatcccgccttcggcataggtcgcccctggcagccgctggcctggttgctgggcatggccggcctgggcacggcggtctaccagtgggttttcgagggcgacctgatccagcgctccggagagctgacccaggccgacatggtcgtcggcgtggtgctgatcgtcctggtcttcgaggcggcgcgacgggtgatgggcatcgccttgccgatcatctgcgcgctgtttcttgcctatggcctgttcggcgaacacctgccgggcgacctggcccaccgcggctacggcttcgaccagatcgtcaaccagctgtcgttcggtaccgaaggtctctacggcacgccgacctacgtatcggccacctacatctatctgttcatcctgttcggcgccttcctcgagcaggccggcatgatccgcctgttcaccgatttcgccatgggcctgttcggtcaccgggtcggcgggccggccaaggtctcggtattctcctcggcgctgatgggcaccatcaccggctccggcgtggccaacgtggtcaccaccggacagttcaccatcccactgatgaagcgtttcggctacaagccggcgttcgccggcggcgtcgaggcgaccgcgagcatgggcagccaactgatgccgccggtgatgggggcggtggcgttcattatggccgagaccatcaacgtcccctacgtggagatcgccaaggcggcgctgatcccggccctgctgtatttcggctcggtgtactggatggtccacctcgaggcccgccgggccgatctaaagggcctgccgcgcgatcagtgtccgagcgcctggggtgccgtccgcgagcgctggttcctgctgattccgttgctggtgctgatcgcgctgctgttctccgggcgcacgccgctgttctccggaaccatcggcctggcgctgaccgccatcgtcatcctcggttcggcgatcatcctgcgggtgtcctcgctcggcctgcgcatcgccttctgggtggcgctggggctgctctgcgcggggttcttccgcctcggcatcggggtgatcttcgtcgtgatcgcggccctggccctggcctgctggttcgtccgtggcggccgggaaaccctgcgcatctgcgtccgcgccctcgccgaaggtgcgcgacatgcgattccggtgggcatcgcctgcaccctggtgggagtcatcatcggggtgatttcgctgaccggcatcgccaccaccttcgccagctacgtgctcgacctgggacgggagaacctgctgctgtcgctggtcctgaccatggtcacctgcctggtcctgggaatgggcatcccgaccatccccaactacatcatcaccagctccatcgccgcgccggcgctgctggaactgggggtgccgctgatcgtctcgcacatgttcgtcttctacttcggcatcctcgccgacctcacccctccggtggcgctggcctgtttcgcggccgcgccgatcgccaaggaaaggggattgaagatcagcttctgggcggtgcgcatcgccctggcgggtttcgtggtgccgttcatggcggtgtattccccggcgctgatgctgcaggaaggcggttggggggcgacgctctatgtcacctgcaaggcggtgctggccatcggcctgtggggcatggcttccatcggctacctgcaggggccgctggcctggtgggagcgcctggtggcgttcgccgcgggggccagcctggtcctggccttgccgatcagcgacgagctgggcttcgtcctcggcgcgctggtgatcggctggcacctctggcgccagcgtgcgcgcgaggcggtggcgtga

SEQ ID NO: 2597 - DNA, 552 bp, Pseudomonas aeruginosa
ctaatgccgacccttgcaatcgggtatttcgtcgatgaagcgccgtcgcctcctgcaaagcctgctcgccggcctggccctccagccgttcctggccgccagcgccaatgtacgaatccgccaggcccgggcctggaattcctcggaaagctggcgcctggtgctggaactggacggcccgccgcgttatcgaaccttttccctgcaggcccccgagcggttgatcctcgacctgcccgacgcgcaattgctcgcaacgctctccgagctgccgctggacggccccgtgcgcgccatccgcagcggccaactgggtggcggcgggacgcgcatcgtcctcgacctgcgccaggcggtcaggccgcgcagcttcgccctggaaccgcaggcgggaaagggccatcgcctggtcctggacctatatccacaggcgctggcggcgccccccgagccaatgctggcgctggcccgcccgctaccctcgacgggccgcgacatcctcgtggtggtcgatgccggccatggcggcaaggaccccggcgcggtcggtag

SEQ ID NO: 2598 - DNA, 837 bp, Pseudomonas aeruginosa
caagggcgagcgcgaaaaggacgtggcgctggctatcgcccgcctgctggcgcggcggatcgaccgcgagaaaggcttcaaggcgcgcctggtgcgcaacggcgacgtgttcgtcccgctgcgcaagcggccggaagtggcccggcgctacaacgccgacatgttcgtttcggtgcacgccgacgcggcgccgcgactgaccgcctccggcgcgtcggtatatgccctctccgagcatggcgccagctcgaccatggcgcgctggatggccgagcgcgagaacggcgccgacctgatcggcaacagcggcaacctgccgctacagggccgcgacaaggtactcgccggggtgatcctcgacatggccctgagttcgaccatcgccagcagcctggacctcggccacagcgttctcggccagttgtcggacgtcaccgcgctgcaccagaagcgtgtcgagcaggccggcttcgccgtgctcaagtcgccggacatcccttcgatcctggtggagaccggcttcatctcgaatcgcggcgattgtcgccggttgatggacgaacgccatcgccagcgcctggccgaggcgatcttcgctggcgtgcagggctacttccggcaacgccctcccgccggcagctacctggcggcgctcagcgcgcagcctcccggctagggccttcgctgcagccgctgacccgcccgcaggtcaggcgttggcgctggcccgatgaactgctcaggcggctgatgctggtccagccgatgttgcggctgaggccgacccagatttccccatcgctggcgatgccgctgaagaaggtcaggcgcccgtag

SEQ ID NO: 2599 - DNA, 423 bp, Pseudomonas aeruginosa
atttcccaggttcagcccatgaccgaacaggaactgcttgcccagcccgacgctgcctacatggacgaagcccagcaggacttcttccgcgacctgctgctgcgtcagcgccaggaacttcaggcgcgcatcgaaggcgaattcggcgagctgcgcgatctcgaacgccccagcgacgaggccgacctggcttcccgcgaggaacagcggcaatggcaacttcgcctgctggagcgggagaagaagctgctcgacaagatcgacgaagcgctggagcgcctggcccgcggcgactacggctggtgccaggaaaccggcgagccgatcggcctgcgccgcctgctgttgcgtcccaccgccaccctctgcatcgaggcgaaagagcgccaggagaagcgcgaacgccacgtgcggcacaactga

SEQ ID NO: 2600 - DNA, 999 bp, Pseudomonas aeruginosa
tccacaggctttcacattccggttgcgcagatgcttcgagagatacccacacacctgatcggcggccctctgggggccggcaagaccagcctgatccgctcgctgctggcgcagaagccggcgggcgagcgctgggcggtgctggtcaacgagttcggcgagatcggcctggatgccgcgctgctggccacggacgtcgacggcgtggccatcggcgaggtggcgggcgggtgcctctgctgcgtcaatggcgtgccgttccaggtggggctcggtcgcttgttgcgtcgggcacggccggaccggctgttcatcgaaccctccgggttgggacatccgctggcgctgtggaaacagctgcaggctcctccctggtccggcgtcctggccctgcaacccctggtagtggtgctggatgccgccgcgctggcctccggccaaccgctgccggaggcacaggaacaggcgctggaagcggctggcatgttgctgctgaacaaatccgaaacgctcgacgcgacgcagcgctgcgccgtgcgcgcgcgcctgccggtcctgccgttgcgctggagcgtgcgcggtcacctggcattgcgcgatctgccgaccagcgttgccggggaaggtagcgcgacgacctgggcggccctgccggaggcgcctgctcagttgggaacggtgctgcctgccgagcgaccgctgcgcgccgtgcgcgagcaggacggccagttcgccatcggctggcggctggcgccgtcggtgcgtttcgatcgggccgcagtggacgcctggctgaaccgtctgtccggactgcggcgagccaaggcggtgctgcattgcgcggacggttggtatgcagcgaatgccgcgccgtttgtggataactggggcaagtcctcgtggcggcgggataatcggctggaactgatcctcgccgcaggcgcggatgaaaaggcgctcgaagaggcgttcctggcgtgtcggatggtcgcggaatga

SEQ ID NO: 2601 - DNA, 450 bp, Pseudomonas aeruginosa
atttcgtccagctcgagaagaaggccgagccgaccccgcagccgccggctgccgcgccggagccgacgccgccgaagatcgaggaacccaagccggagccgccgaagccgaagccggtggaaaaacccaagcccaagccgaaacccaagcccaaaccggtggaaaacgccattcccaaggccaagccgaagccggaacccaaacccaagccggaacccgagccgagcacagaggcatccagccagcccagcccgtccagcgccgccccgccgccgcccgcacctaccgtcgggcagagcacgcccggcgcgcagaccgcgcccagcggctcgcaaggtccggccggcctgcccagcggcagcctcaacgacagtgacatcaagccgttgcgcatggatcctccggtctatccccggatggcccaggcccggggtatcgaaggccgggtga

SEQ ID NO: 2602 - DNA, 1146 bp, Pseudomonas aeruginosa
aggaagtcgctggtgactttcaggagtcatgcccagggcggcgatgatgaaggagaactcgccgatctgcgacaggcccatgccgacccgcagcgaagtgcgtccgtcgttgccggcgatgaacgcacccatgccgcaggagaacatcttgccgagcactaccgcgacggtgatcagggcgatcggccaggcgtactcgacgaggatcttcgggtctatcagcaggccgatggcgacgaagaagatcgcactgaacatgtcacggaccggctcgatcaatcgttcgatctgcaccaactggcgcgactcggccatgatcgcgccgatcaggaaggcgccgagcaccatgctgtattccagcttcaccaccagcaggcagaagccgaagcacaggccgagcacggtgaccagcagcatctcgttgctctcgaacttcgccacgtaggccagcaggcgtggcaccaggaggatgccgacgaccagcgcgacgatcatgaacaggctgagcttgccgaccgtggagaacacctcgccggtttccaccgaaccgctcacggcgattcccgacagcagggcgatgatgccgatgccgaggatgtcctcgacgatcagcacgccgaagatcagttgggcgaagcgctcgttcttcatcttcaggtcgccgagcgccttgacgatgatggtggtggaggagatcgccaggatcgcgccgaggaacagcgagtccatggtgctccactcgaagaagcgaccgatctcgaagccgatccagatcatcaggacgatttccaggaacgccgcgatgaacgccgtggcgccgacctggaagagcttgcgcaggctgaactccaggccgaggcagaacatcaggaagatcaccccgagttcggccagggtcttgatcgtgtcttcgtcgtggatcagtccgaagggcggggtgtgcgggccgatgatgaagccggcgacgatgtagccgaggaccaccggttggcgcaggcggtggaagaggatagtgaccacacccgccaccagcatgatcacggcgaggtcctggatgaaatcgacggcatgcatggcggcggtcctcgctcggggaatgggtcggcagacgcggcgaccgggcggcctcgcagacccgcagactag

SEQ ID NO: 2603 - DNA, 1233 bp, Pseudomonas aeruginosa
catccgcaagtgcttgatcggtgggctgaaaaaaactgtaacagacgtttcggcgaggctctgcgttgtgcttcccgggtcgccgggcggatcttcgcgcgccgatccgcgtgcatgcctgtcgtccccggcaacgaaggtgtaccctggcgccgacccgcgagccagacgcggcgggcgaaaaaacggcggccggggagcaatagcccgaaacaaaatccggctggtcctgtcgcccgtaccgccgcaacatggcgcgcgtcgattcccccaagagagaaagactacaatgcagcgtgttctcagcatcgccctcgccttctgcctggcgctgaccgtcagcctggatgccaatgccaagcgcttcggcggcggcaagagcctcggctcggcacccagccaccagacccgccaggcgcagccggccactgcgccgaacgccactgctgccgcccccaacgccgctcgtcccgccgctgccgccagcggtgcttcgcgctggctcggcccgctggccggtatcgccgcgggcggcctgctcgcttccatgttcatgggcgacggcttcgagggcatccagatgctcgacatcctgttgatcgccctggtggccttcatcgccttccgcttcatcgccgctcgccggcgccagcagaaccagggccagcctgcgatggccgggcacgcgccgatgcagcgcgaaatgccggcccaggcgccgatcttcggtggcgccgccgctgctgccgctgcgccgagcccggtgatcaacgcgccgagctggttcaacgaggagcgcttcgtcggtgccgctcgcgaacacttcatgtccctgcagcagcattgggatgccaacgagatggacaagatcgccgagttcgtcaccccgcagatgttgcaatggctgaagcaggagcgcgccgagatcggcgacgcctaccagtccacctacatcgacaacctggtcgtgcaactggacggcgtcgacgaccaggccgacaagacaatcgccaccctgaccttcagcggtgtgtcgaagacctcgcgcttcgaccagggcgaagccttcagcgaaagctggcggatggagcgcgcccagggcgagaaccagccatggctggtggccggtatccggcagaactgatcccgagtggttgcggtcccttcgggggccgccgaaacccccgcttccgccagggaacgggggttttttcatctccgttggcgggttga

SEQ ID NO: 2604 - DNA, 303 bp, Pseudomonas aeruginosa
ggaatttccctcgattgcgacggtcacaagggcaattccgcacttgtcgctccggatgtaggcaagtgcgctgccccgtgtggagattctatgaagttcaaagctctgttcgctgcattgctgctgaccagcctggcgggttgcgccaaccaggcggtggtcactttgcaagatggcagcgaggtcctggtcaaggatcagtcggattacgacaaatacaatgactactacgagttcgaacagctgaatggcgacaccatcctgatcaagaaggacaatgtgcgcaccattcgcccgcagtag

SEQ ID NO: 2605 - DNA, 612 bp, Pseudomonas aeruginosa
gcgagcgttgtgcctcgccctccagcgccccttccgccaccagccgttgcagggcggcgcgaaccggcatcgggctggtgccccactggttcgccaggtcgcggatcttcagtcgctcgccgggctggaaacgtccggccagcaagtcttcccgcagtcgttggtagagtcgttcctggagattctcggccatggtcagctccgggtcgccggtggcgccggaagctgggaaagcgtcaggctgcagttgcgcatgttcagctccgtttgttttcgatcaggcagttgccgccatccaccaccagcagttcgccgttgacgaagctggcttcgggcgaggcgaggaaggccaccgcggcggccacctcttcgggccggccggcacgtccgctggggctggccagggcggcctggcgttcttcggcggtgctcgaggcggtggcgatccagcccggcgcgacgctgttcaccgtgatgccgctcttcgccacctccagcgccaggcccatgctccagccgaccagaccggccttggccgcgctatacgcggcttcgcccgggttgctgccgcgggttccggtggtggaggcgacgttgacgatccgcccgtag

SEQ ID NO: 2606 - DNA, 1428 bp, Pseudomonas aeruginosa
aagttgtgcgaaataaaaaacgaggtgttcgaaatgaccgccagtggcatcgccgaagccgccgtggaaaccttcatggcccgcgagcagcaacgtttccttgcgcagaatccacagtccgtcgcgctcgccgagcgagcccggcgcgccttgttcgacggcgtaccgatgcactggatgagcgattggtcaacaccctgtccgctgttcgtggaacgtgcccacggcgcgcgtttccatgatgtggacggccacgcctacgtggacttctgcctgggcgataccggcagcatgttcggccattctccggcgccgatcgcccgggcgctcgccgagcagggcgcgaacggcctgaccaccatgcttccgggggaggatgccatcgtcgcaggcgagctgctggcgcagcgcttcggcctgccgttctggcaggtagcgaccaccgctaccgacgccaaccgcttcgtcctgcgctgggcgcgtgcgatcaccggtcgcaaggtggtgctggttttcgacggttgctaccacggcacggtcgacgacaccctggttcgctgccgcgacggccgcaccgtgcatcgctccggcctgctcggccaggcccacgacctcacccagttcagccgcgcggtgccgttcaacgacctccaggccctggagcgggcgctggccagcgaagacgtggccgccgtgctctgcgagccggcgatgaccaacatcggcatggtcctgccgcaacccggcttccaccagaagctgcgcgagctgacccgtcgtcacggcacgctgctgatcatcgacgagacccacaccatctccacaggtcctggcggctgtacccgcgcctggaagctcgagccggacttcatcaccctcggcaagccgatcgccggcggcgtaccgtgctcggtgtatggttgcagcgcggcgatggccagcgccatgcaactggccagggcacgtgccagcgagcagagcgaaggccacggccacagcggcatgggtaccacgctgtcggccaacgccctggcgatgcgctgtatgcgcgccaacctggaagaggtgatgaccgataccgcctacgcccacatgctgtccctggcggcgcgtctggccgagggcttccgcaggattatccacaagtacggcctggcctggtcggtgaccgagctcggcgcgcgcagcgagttccagttctgcccgcaacccccacgcgacggcgcggccgccgaggcggcgttccacgacagcctgcagatggccttgcacctgtatctgatcaaccgcggcatcctcatcacgccgttccacaacatgaccctgtgttgcccggacactcgcgaagaagatgtcgaccgcctgctctccagcctcgacgaggcgctcggcgagctgctcgccatacccggcgcgcgggaggcctga

SEQ ID NO: 2607 - DNA, 1734 bp, Pseudomonas aeruginosa
tccatttcgaacgtcgtcgtccgccggccaggccgcggaggacgcgttccccgtgttgccgggagtcctgatgcaccatacgccgttactcactacactcgccgcggggttcgtcctcgccttcctcttcggggccctggccaatcgcctgcgcatttcgccgctggtcggctacttgctcgcgggcgtcctggccgggccgttcactcccggttatgtcgccgaccaggcgctgtcgcaggaaatcgccgaactcggcgtgatcctgctgatgttcggcgtcggcctgcacttctcgctcaaggacctgctctcggtgaaggccattgccattcccggggcgctggtgcagatcggcgtcgccacgctgcttggcatcggcctggccaagctgctcggctggagcttcggcggcggcctggtattcggcctgagcctgtcggtggccagtaccgtggtgctgttgcgcgccctggagcagcgccagttgctggacaccaagcgtggcaggatcgccatcggctggctgatcgtcgaggacctggcgatggtcctgaccctggtgctcctgccggcgctcgccggcaccctcggcggcaagaccgacggcggcgacgccggtctgctctggccgctgctgattaccctgggcaaggtcgccgccttcgtcgccctgatgatcttcggcggtcgccgggtggtgccctgggtgctggagaggatcgccgccagcggttcgcgggagctcttcaccctggccgtgctggccattgccctgggcatcgcctatggctcggcggtgctgttcggggtgtccttcgcgctaggcgccttcttcgccgggatgatcctcaacgagtccgaactcagccacgaggcggcggagaactcgttgccgctgcgcgacgctttcgcggtgctgttcttcgtctcggtggggatgctgttcaatccgatgatcctgttgcaggagccgctgacggtcctggccaccttcctggtcatcgtcttcggcaagtcggtggccgcctacctgatcgtccgtgctttcggccatccgaacagcaccgcactggtgatcgccgccagcctggcgcagatcggcgagttttccttcattctcatcggcctgggcattggcctcgaactggtgccggagcagagccgcgacctggtgctggccggggcgatcctgtcgatcctggtcaatccgctgctgttcatcgccatcgatcgcctgcagcaacgcaaggagcagcgcctggcggaggccgctggcggggtccgcgagatgccggcgcaggacctgccgccgccgatcctggagcgcgagcatgcggtgctgatcggtcatggccgggttggcgggttggtcagcgctcgcctgcgcaccgccgggacgcccttcgtggtagtggtggacaagcgcgacaaggccgacgaactgcgcgaacagggctacagcgtggtcctcggcaatgccgccagtcccggcgtgctggaactggccaacatcgccgaggcgcgctggttgctgatcgccattcccaacggcttcgaggccgggcagatcgccagccacgcccgcgcggtgaacccgccgctggacatcgtcgcccgggcgcatttcgacgccgaggtggactacctggagcagaacggcgccaacctggtgatcatgggcgagcgcgagatcgcctgcggcatggtccatcgcctgggactcgaccgtga

SEQ ID NO: 2608 - DNA, 948 bp, Pseudomonas aeruginosa
tgttggggaaatacgttctttgagccgcctgtggatgattttcacccacaggggcggagactaaaggcgcactgcgtcgaaacgaacccttgggtgtgcgatccgatcctgcgcccgcaccagttccagctcgtagctgccgcaggcctgggtttccagcagcacttcatggaccgcggcgccggtgaattcgaaggcgttacgcaggtcgtcgccgagcagcaggcgagagaggaacagccccgaggccaggtcgccgaccccgaccggttgccgcgggaaggccagcagcgggcgttgcaggtgccaggcctgatcggcggccaccagcagcatctcgaaggtgtcgccggccttgcccggatagttcaggtgctttaccaggattgccctgggaccgcgtgccagcaggctccgtgccatttccacgcagtcggcgagggagttcggctggcggtcgcagaagctgtccagctccaactggttggggcacaggtagtcggcgaccgcggcggcttcttccagcaggaagtcgctgacttccggggccacgatgcagcctttttccgggtggcccatgaccgggtcgcagaggtacaacgcccgagggttggcctgtttgatccgtgccaccacatcgagaatggcgcggccctgggcggcgctgccgagatagccggacagcaccgcgtcgcagttgcccagttcgccgatgccggcaataccgtccaccagcgccggaatctgctccggcggcagcacctgcccggtccattgaccgtactgggtgtggttggagaattgcaccgtgttcaacggccagacgttgattccgatgcgctgcatcgggaacaccgccgcggcattgccggcgtggccgaagaccacatgggactggatggcgagcaggtggggcgtacgtggcatgagacgacttcctacagctga

SEQ ID NO: 2609 - DNA, 1854 bp, Pseudomonas aeruginosa
cgacatgggcggactcctcgtacggcgcgcagtgtaaccgggcgccgtgctatcgtcgccgcttcccgccgccgtttcgatccgccgatgtccttgtcccgtccactgcgcctgttcctgctgttgctgccgctgctcggcggcctgctgctgtccatggactgggcgggtcgccaggcgcggcagcaggcgctacgcgccgagggcgaacaggtgcgcaagcagctggacctctacgccggctcgctgcagaccctgatcgaacgcttccgcagcctgccggcggtactggcgctggatccggacctgcgcgcggcgctggccgggccgatcgacggcgagttgcagcagcgcctcaacctcaagctggaaagcatcaacctggccgcccgctcctccaccctggagctgctcgaccgtaccgggctggccgtggcggcgagcaactggaacctgccgaccagctacgtgggccacaactacggtttccgtccctatttccgccagaccatcgcccaaggctccggacgtttctatgcggtcggggtgatcagcgggattcccggttatttcctgtcccacgcggtgcgcgccgaggacggcagcttcctgggcgcaatcgtggtcaagctggagtttcccgatctggaacggcagtggaaccagacccccgacctggtcctggccagcgacgccaagggcatcgtgttcctcgccaaccacgccggttggcgctaccgcgaactggaaccgctggataccgtggaccgcttcgaactggcggagacccggcaatacgatcgccagcccctgacacccctgcgccaccagaccttgcgcagctacggcgaagacagccgtctggcgcgggtggaaagcgccgacggcgagaaggactacctctggcaatcgctggacctgcccaacgacggctggaccctccacttgctgcgcgacaccgcgagcatccaggacgacgtcgccaccgcgcgcctggccgccgccggcacttggctggcgctggtcttcctcggcttgttcctgcaccagcgctggcgtatcgcccgcctgcggcaacgtagccgggaggagctggagcgcctggtcgagcagcgcaccgccgacctgcgtaccgcgcaggacggcctggtgcaggcggccaagctggccgccctggggcagatgtcggcagccctggcccatgagatcaaccagccgctcaccgcccagcgcatgcaactggccagcctgcgcctgctgctcgacgccggacgccacgacgaggcgcgccaggcgttgccgcgcatcgaccagatgctcgaacgcatggccgcgctcaccggccacctgaagaccttcgcgcgcaagagcgccggcggcctgcgcgagcgtatcgagttgggtcacgtggtcgaacaggcgcagcagttgttgctgccgcgaatccgcgccgaacgggtggagatcgagcaggcgctgctctggccggcctgggtgatgggtgacgcgatccgcctggaacaggtgctggtcaacctgctgcgcaacgccctggatgccgttgccggccaggagcggccatggatccgcctggccctgcaacggcttggcggcgactgggtgctgagcgtcgccgacaacggcggcgggattcccgccgagcacctgggcagcgtcttcgatccgttcttcaccaccaagccggtgggagagggactcggcctcggcctggcggtatcctatgggatcgtccacgaactcggcggccgcctgcaggtcgccaatgccgaggcgggagcggtgttcagcctgatcctgccggcggcccccgatgacacgagcgtaacgacatga

SEQ ID NO: 2610 - DNA, 1041 bp, Pseudomonas aeruginosa
cctctgtcgtggcacggcaggcagacgtacggccgggacggaaacgaaaaagcccggtcgaagaccgggctttttccaggggcggttacgcggcttggctcagaacgccggtaccaccgcgcctttgtatttctcctggatgaactgcttgacctcggcgctgtgcagggccttggccagcttctgcatggcgtcgctgtccttgttgtccggccgcgcgacgaggatgttcacgtagggcgagtcgctgccttcgatggccagcgcatccttggtcgggttcagcttggcttccagggcgtagttggtattgatcagcgccatgtcgacctgggtcagcacgcgcggcagggtcgcggcttccagttcgcggatcttgatgttcttcggattgtcgacgatgtccttcggcgtggcggtgatgctcttgttgtccttgagcttgatcaccccggccttgtccagcaggagcagggcgcggccgccgttggtggcgtcgttggggatcaccacggtagcgccggaaggcagttcgtcgagcttcttgtacttgctcgagtaggcgcccagcggctcgatgtgtacgccggtcacggcgaccaggtcggtgcccttggccttgttgaactcatcgaggtacggctggtgctggaagaagttggcgtccaggcgcttttccgagacctgcacgttcggctgcacgtagtcggtgaactccttgatcttcaggtccacgccttccttggccagcagcggcttgaccacgttgaggatctccgcgtgcggcaccggggtggccgcgacggtgagggactcggcggcctgggcggcggtgaggccgagcgccgcgacagcggagaaagcagcaagcagttttttcatcttcaactcctttcgaggtgttcctggcggctgtggataaccgcggcgctcagggttttgggcttggccggcaagcttacttgcgcgagaagtgcaccaccagcttgtcgcccacggtttgcagaatctggacgaggatcagcagcatcaccaccgtga

SEQ ID NO: 2611 - DNA, 1221 bp, Pseudomonas aeruginosa
acagcagcgaaccgccgagcatccagaaggtgtcgacgctggccagccagatttcgtaccagtcgatgttggcgaagctcatggtttcgaagaagtccatcagcgcagtacctccacatgtacgtcagcggcgttcaactggctcatggcggcttccaggtcaccgccgaccagggccagggtcaactggccgtagggcgtgtccttgatgcggtcgatgcgtccggaaaggatgctgtagtcgaccccggtctgccgagccacggtgcccagcagtggcgcataggtggcttcgccgcggaaggtcaggcgcaggatgagacccggcacgtgggcgaaatcgtcgtgacgctcgtcttcgtcgacccgttcggcctcgaacacgaagcggcgtgtggtcgggtgctgcggatggaggaagacatcggcgacatcgccctgctcgacgatggcgccgccgtccatgaccgcgacctggtcgcagacacgacggatcacgtccatctcgtgggtgatgaggacgatggtcagcttcagctcgcgattgatttccgccagcagttgcaggaccgaggcggtggtctgcggatcgagggcgctggtggcctcgtcgcagagcaggatgctcggccggcaggccagggcgcgagcgatgccgacgcgctgtttctgtccgccggagagctgggccggatacttgcgcgcgtggtcggacaggccgacccgcgcgagcagctcggagacccgcgcatcgacttcggcacggctgaagccgccggccaggcgcaggggcatggcgatgttgtcggcgacggtcttcgaggacagcaggttgaagtgctggaagatcatcccgacgcgctggcggaaacggcgcaggccttcggcgtcgagggcggtgacgtcttcgccctcgaccaggatgcggccgccgctgggctcctcgaggcggttgatcaggcgcagcagggtgctcttgccggcaccggaatggccgatcaggccgaaaatctgcccggcctggatgttcaggcgggtcggttgcaaggcggggatttcccgaccggcaactcgataggtcttgtggacgtcgtggaattcgatcactgggcgaaccttgtgggtgcggcgatgctgttacggctggagcacgggcttggcgggaagcatgggcggtcagctaaaccgagcattttaccttgctttcttatgcattattaa

SEQ ID NO: 2612 - DNA, 321 bp, Pseudomonas aeruginosa
ccgatggtcagccgcggccgtcgccagacctcgccgacgtgcggcttgagcaggccgagcacgctgcgtaccagggtggtcttgccggcgccgttggggccgatcagggtgacgatctggccgggctcgatggccaggtcgacatcgctcagcaccgcctggccgttgaaggacacgccgacctgggtcagccgcaccagcgcgttgtccatcaggcgtccttctggtcccggcaggtgccgcagaggccgaccacctcgacggtctggctttcaacggcgaagccgacgctgttcgctccggcgacgatggcccggctga

SEQ ID NO: 2613 - DNA, 600 bp, Pseudomonas aeruginosa
gaatcttctgaacaacctggcaggcgaatttgccggctgtctggaaaagctctgaaaacccgtgaccgatggccgcgccctcttgcgcgcggcgtcccgatgactaaggttgtctgttgctgcctgacacaagatattgattcccgtcaggtacggataactagatgttgcgtacggtggccggcttcggacgccccaacaaccatcgggaggttaatcagcggatggccaagacagacgcacgcagtccccgcaccgaacgcgggaccatcgccctgcaggacgcgtcgcaggatatctgggacaagaagtaccggctcaagagcaaggacggtacgccggtggatgccagcgtcgacggtacctggcaacgcgtcgcccgcgcccttgccgatgtcgaggaaaaggcctcccgcgaacactggtacgggcgcttcctctgggccctgcgcaacggtgccatcccggccggccggatcatctccaacgccggcgccctggggcacaagccggccacctcgaccatcaactgcacggtgtccgggaccatccaggactccatggacaacatcctcgagaaagtccacgaggccgggctga

SEQ ID NO: 2614 - DNA, 543 bp, Pseudomonas aeruginosa
gcctggccaacaatgcctccaacggtatcgagccgagcttcgcccaccattattcgcgcaaccttatccgcgaaggccgcaagaccaaggaaaaggtcgaggtctacagctacgagctgctggcctaccggaccctggtcaacgcccaggccctgccggacagcgacgacccggcgcgacgcctgccggactacttcatcaccgccgacagcgtcaccccggcgcagcacgtggacatccaggcggcggcgcagaagtgggtcgattcgtcgatctccaagaccgccaacgtgcccaccgactacccgttcgaggacttcaaggacatctaccgctacgcctggcaccagggactcaagggctgcaccaccttccgcttcaatcccgaggcgttccagggcgtgctggtcaaggagtccgacctggagaagacccgctaccgcttcgaactggaggacggcagcgtggtggagttcaagggcaacgagcaggtcgagtacgacggtgagatccataccgccgccaacctcttcgacgccttga

SEQ ID NO: 2615 - DNA, 732 bp, Pseudomonas aeruginosa
aagaaggctattacggcaagtactgaggccgggggaatcgatatgtcagcagtcaagatcacgcagaagatcaagggcttcaaggtcgtcaacgaagccgaggagcaggcccttgccgccgccgcggaagccgcgtcggtggtgcagatggacgagaccctggagcgcccggataccctgatcggcgccacctacaagatcaagtcgccgctgttcgagcacgcgctctacgtgaccatcaacgacatggtcctcaatgcgggcacggcgcacgagcagcggcgtcccttcgagatcttcatcaactcgaagaacatggatcatttccagtggatcgtcgcacttacccgcatcatgtccgcggttttccgcaagggcggcgactgtaccttccttgtcgaggaactcaaggcggtattcgacccgcgcgggggctacctgaagaaaggcggcatctacatgccttccatcgtcgccgagatcggcggcgtgctggagcgccacctgacggccatcggcctgttgcgtggccctgaactggacgaggaacagcgtcttttcctcgcggaaaaacgcgccgcctacgaggccgcccagggcaccagcaaggtcgagccgggcgaaggcttccccgccggcgcgcaactgtgcggcaagtgcaacagcatggcggtggtacagatggacggctgcgccacctgcctcaactgcggacactcgaaatgtgggtga

SEQ ID NO: 2616 - DNA, 420 bp, Pseudomonas aeruginosa
catcaaggacggcaagcgtaccgtgctggaaatgaccgggctgctgaccaacctcagcgaccaggacctggccgacatcgccgcctacttcgccagccagaagatgagcgtcggcatggccgatccgaacctggtggcccagggcgaagcgctgttccgcggcggcaagatcgccgaaggcatgccggcctgcaccggttgccattccccgagcggcgtcggcatcgcaaccgccggtttcccgcacctgggcggccagcacgcgacctacgtggccaagcagctgaccgacttccgcgaaggtacccgcaccaacgacggcgacaccaagatcatgcagtccatcgccgccaagctgtcgaacaaggacatcgccgcgatttccagctacatccagggtctgcactgatcgctgcgtag

SEQ ID NO: 2617 - DNA, 639 bp, Pseudomonas aeruginosa
acgatgcgtaacctgattctcaccgccatgctggccatggccagcctgttcggcatggccgcccaggccgacgactataccgccggcaaggaatacgtcgagctgagcagcccggtgccggtgtcccagccgggcaagatcgaagtggtggaactgttctggtatggctgcccgcattgctacgcgttcgagccgaccatcgtgccgtggagcgagaagctgccggcagatgtccatttcgtgcgcctgcctgccctgttcggcggtatctggaacgtccatgggcagatgttcctgaccctggaaagcatgggcgtcgagcatgacgtacacaacgccgtgttcgaggcgatccacaaggagcacaagaagctcgccactccggaagaaatggccgatttcctcgccggcaagggcgtggacaaggaaaaattcctgagcacctataattcctttgccatcaagggccagatggaaaaggccaagaagctggcgatggcctaccaggtcaccggcgtaccgaccatggtggtcaatggcaaataccgcttcgacatcggctccgccggtggtccggaggaaaccctcaagctggccgactacctgatcgagaaagagcgcgcagcggccaagaagtag

SEQ ID NO: 2618 - DNA, 885 bp, Pseudomonas aeruginosa
ttcggcatgttgcgccgctggcagcgtgaacctcgggtcgcaggcagctgcgacccgcgagtgaacccctcctgtgacgattcgcgggagctgcccgacgacggccgcctgcgccttctcagcttcaacatccaggtcggtatcagcaccgagcgctaccgccactacctgacccgcggttggcagcacctgctgccccacgcggggcgggcgaccaacctgaagcggatcggcgaactgctcgccgactacgacctcgtcgccctccaggaagccgacggcggcagcctgcgttccggctacgtcaatcaggtcgagcacttggcccagttgggggcgttcccctactggtaccagcagctcaaccgcaacctcgggcgtatcgcccagcacagcaacggcctgctcagccgctggcggccgaccctgctggaagatcatccgttgcccggtccgccgggacgcggcgcgatcttcgtgcgctttggcgaaggcgccgacgcgctggtggtagtgatgatgcatctcgctctcggcgctcgcacccgcacccgccagctcgcctatatccgcgagctgatcggcgactaccgccatcaggtgctgatgggcgacatgaacacccacgccgtcgatcttctggaaaactcgcccctgcgcgacctcggcctgatggcgccgcaggtcgaggcgacgtttcccagctggcggccgcagcgcaatctcgatcacatcctgctcagttccgatctcgctctcgagcgggtcgacgtgctcgaccagccgatctccgaccatctgccggtatcggtggagattcgcctgccggacaacctgcgcgacaaggccttggtcgtgcgcggggatgccgggagtccgccatga

SEQ ID NO: 2619 - DNA, 600 bp, Pseudomonas aeruginosa
agcaggtcctcgcggaactggccctgggcgaccatcgcgcccaggtcgcggttggtcgcggcaaggatgcgtacgtcggcgcggcgggtcaccggatcgccgacgcgttcgtattccttgtcctggatgaagcgcagcagcttgggttgcaaggtcagcgggaagtcgccgatctcgtcgaggaacagggtgccgccgtcagcctggctgaccctgcccagggtgctttcggtggcaccggtgaaggcgccgcgactgtgcccgaacagttcgctttccatcagttcggcggtcagcgacgggcagttgatggtgacctggggcttcttcgcgcgtttgctccaggtgtggatggcgcgtgccagttcgcccttgccggagccggattcgccgaggatgaggatgttggcgtcggtcgccgctacctggcgcgcggtctccagtaccgcggccatggccgggctgtgcgattccaggccgtcgccctggcggcgcacttcgtcctccagggcctccaggcgcgcggtcagttggcgcacctccagttgcttggcggcggccaggcgcagttggtccgggctgcagggcttgaccaggtaa

SEQ ID NO: 2620 - DNA, 1506 bp, Pseudomonas aeruginosa
tcggcaatgccctcgcggtgctggtcatctccaagtgggaaggcatgtacgacgcggccaagggccagcgctactgggattcgctgccgcacctgcggcaggcggtcggcgaagccaagggcaagcaggccaccctcgaataaggcggcttcccgcccaggaggccccggcatcgtccggggcctcggcgtttctggcgccggcaccgcctgcgccgctatcatccgcgcaacgcgggggattctgaatgctgaacggcttgtggttgggttttttcctggtggcggcggcgagtgcgctggcgcgctggttgatcggcggcgatgcgacggtgttcgcggcgatggtggagagcctgttcgccatggccaagctggcggtcgaggtgatggtcctgctgttcggcaccctgacgctctggctcggctttctgcgcatcgccgagaaggccgggctggtggagcgcctggcggtgctgctcggtccgttgttccgccggctgatgccggaagtgccgccggggcatccggcgatcggcctgatcaccctgaacttcgccgccaatggcctgggtctggacaacgccgccacgccgatcggcctgaaggcgatgaaggcgttgcaggagctcaatcccagcagcaccaccgcgagcaatgcgcagatcctcttcctggtgctcaacgcctcgtccctgaccctgctgccggtgactatcttcatgtaccgcgcgcagcagggcgcggccgatccgaccctggtattcctgccgatccccctggccaccagcgcctcgaccctggccggcctgttgtcggtggcgctgatgcagcgcctgcgcttgtgggacccggtggtgctggcctacctgatccccggcgcgttgctgctggccggcttcatggcggtgctcggcacgctctcggccaccgcgctggcgcagctgtcctcgctgctgggcaacctgacgctgttcagcctgatcgtgctgttcctgatcgtcggcgcgctgaagaaggtgccggtctacgagagcttcgtggagggggcgaaggaaggtttcgacgtcgccaggaacctgttgccgtacctggtcgcaatgctttgcgcggttggcgtgttgcgcgcctccggggcgctggaagtggtactcggcgggatacgctgggcggtcgaggggctgggttgggacagccgcttcgtcgaagcgctgcccaccgcgctggtcaagccgttctccggcagcgcggcgcgggcgatgctgctggagaccatgcagacccacggcgtcgacagtttcccggcgctggtcgccgccaccgtgcagggcagtaccgagaccaccttctacgtgctcgccgtctatttcggctcggtcggcctgcagcgcgcgcgccacgcggtgggctgcgcgctgaccgcggacctggccggggtcatcgcctccatcgccgtgtgctactggttcttcgcctgaggtcgccaggcttcgacgtcactgggtga

SEQ ID NO: 2621 - DNA, 414 bp, Pseudomonas aeruginosa
tcgcggtataggcgaacaggccctggctgcgcaactgggcggcgccgacctgctccaggctgtcgccgggcgtgcggctctggtcgtcgaactggctgctcaccgccacttcggtcagccacagggtggccggcggtacccaggtgcggccgaaccatccggccaggcccaccgccagggtcaggccgagaagcaggaagccgcgccaccagtgctgtagcgggaaggtcacgagcaggctggggaaggacagcacgacggcgatgcccagcgacaaccggtagctttccggggtggtcaggtgcagcaggatcggcagcgaggtcagcaacaccgcgaacagggtcagggtgtggtaggcgaggaacacccaacgacgcctggacagccagcgatagtagagcggatcggtga

SEQ ID NO: 2622 - DNA, 612 bp, Pseudomonas aeruginosa
acaggaaggaagtggttgtaccgacttccttcccttcctggagatcgcatcatgtccaatgtacaaaatgccagccggtcttccgcgttcgcggcggtagagggcgaccattgggtcgagtccctcgacgatggccgccacgtgctgatccgtcccctgcgcgaggaggaccgggagcgcgaacgccagttcatcaaccggctgtccccggcgacccgccacttccgcttcctcggcgagatcaaggaagccagcccggcgctgctcgatcaactgatggacatcgactaccagcagagtatggccttcgttgccctggtgcacgaggacggtgagctgcgcgaggtcggtatcagccgatacgccgcctgctgcgaggaagggcagtgcgaatgcgcggtaaccatcgccgacgactaccagggtctgggcctcgacgccgtgctgatgcgccatctgatcgacgtggcgcggcgcaacggcttccgccagatgtattcggtggactcggcggccaaccgggcgatgcgcgacctttgttgcgcactgggctttgtcggccagcgcgacccggacgactcgacccaggtcatccaccgcctggccctgtag

SEQ ID NO: 2623 - DNA, 2250 bp, Pseudomonas aeruginosa
gcagcacgcccatgccgttttccagctggaaggcttcgacctcgctgcgctggtcggcgtacgaccaggggcagagcaggcagaacagcagcagggtggacaacgaacgcatgggccgagcctggaactgaaaataccgagaatagcggatgcttcatgacgaacctacccgcagaacggctaatgtcgcgaacggcgcgtttccgctcgctcctcggcgagcgctggctcggccagcggcgccgaggtcatgtcgtcgacttcgtcggcccagtcgtcctcgtcccgccgagtgccctcgtcggccgcgctgctcggcgcgtctggattgtccagcacggcgtaggcgatggcgcagaacagcgagttgagacgcttcatgtcgctgatcaggtccaggtgcagcgagctggtctcgatgctctgtaccacctgctggtgcaggcggtcgacatgggcatgggcgtagcgccgttcctgcagacggaagcgctgcttggcccggcgcaggcgcttggcgctgtcgaggtcgccgttgaggaacaccgagagacccaggcgcaggttggagaccaactgctggtacagggtgccgatctcttccaggccggtgtcggagaacgagcggctgcgcgaggtcttcttgtcctgcacggcggcgagcatgtgctcgatgatgtcgccggcctgctccaggttgatcgccagctcgatgatctccgcccagcgccggctgtcgcgttcggacaggtcctcgcgcggcatccttgccagatacagcttgatcgcggtgtagagggcgtcgacgtcgtcgtcgagcttgcggatgtccttgccgagcagcggatcgccgccgcggatgatctgcatcagattgttcagcatctgctcgacggtgtcgcccatgcgcagggtctcgcgcaccgcgttggccagcgccaggctcggcgtgtcgagggcggcggggtcgagatggcgcggccgggcgacgtcgtcgggaagggcacggtcgggcatcacacgggtgcagaagctggccatggcgttggtcagcggcaggcaggcgaggcagcgcgcggcgttgtagagcacgtggaaggcgatcaccagttcggctgtgctgaactgccagtgatccatccagtccgccagcggccccaccaggggcagcaccagcaggcagccggcgaccttgaacaacaggctgccgagggccacccggcgaccggcggcgttttgcgcggtggcgctgagcatggccaggatgccgctgccgaggttggcgccgaccaccaggcacagcgcgactttcagcgagatcaccttggacgcggcgagggtcgcggtaagcagcacggcggccaggctggaataggaaatcatggcgaacaacgcgccggtcagcgcgtcgagcatgatgtcgccggtcaggctggagaacagtaccttgacgcccttggcttgggtcatcggctcggcggcggcgacgatcagctggagcgccaggatgatcaggccgaggccgatgaatacccggccgagctggccgaggcgggtctgtttgcggctgaggaagaaaatcacgccgaagaagatcagcaatggcgaaagccacgacaggtcgagggtcagcacccgcgccatcagcgcggtgccgacatcggcgccgagcatgatcgccagggccggcgccagtgccatcaggccctgggcgacgaaggaggtggccagcagggcggtggcgttgctgctttgcaccagggcggtgacgccgatgccggcggcgaacgccagcgggcgtttttccacgctgcgactgaggatgcgccgcaggtcggcgccgtagacccggaggattccggtgcggacgatatgcgtgccccacaccagcagggcgacggcagagagcaggtcgagcagtttcagcatggcgtggcccccctggcactacgacgaatggccaacctcgcgccaggttccgcgtgcgttgcgccgcggagcccggacaacggcgccaacggccacgatggaaaggcagcgttcaggcgagttgtaacacgaacgtcatatttggacaggcgccccccgcgggagttcgtctcggcagcccgagcggcagggcgcctacccttcattcaagcgtgcgcgccgggaaacggcgaagattttttcgccttccgttcgatgcatgcgtttgcgccacaggccatggaattagccgacaggaagggtatcctttgcaccttttaa

SEQ ID NO: 2624 - DNA, 1221 bp, Pseudomonas aeruginosa
acgcccttcgcccttccgcgagtgcccgctcggcttcggtctgccccccggatctaccgtttcaatcacatggattggattatgggcaactacatcaagcctttgtccgcgggcgtcgcactgatcgcctcggacagcacctggatcgaaggcaaggcgatccagcaactgcaaaccaccgccgagctggacggcatgtgccgcgtcgtcggtctcccggacctgcatcccggccgcggctatccggtcggcgcggcgttcttctccgtcggtcgcttctatccggcgctggtcggcaacgacatcggctgtggcatggccctgtgggaaaccggcctggcccccggcaagctgtcggcggacaaactggaaaagcgcctgggcaatctcgacctgccgctggacgagacctggagcgactgcatcgaagccctggatctaccggcccgcgagcactggcgcgcgctcggcacgatcggtggcggcaaccacttcgccgagctacagcaggtcgagaccgtgttcgaccaggccgccctgcacgccctcggcctcgatgccggccgcctgcaactgctggtgcacagtggctcgcgcggtctcggccaggcgatcctgcaagaacaggtcagcctgcatggccacgccggcctgctcgacggcagcctggaagcttccgcctacctggcgcgccacgccgatgcgctgcgcttcgccgagggtaaccgccagctcatcgcccggcgcattctcgaacgcttgcgctgcgacggcttggaactgctcgacatcaaccacaacctggtggcgccggcacaggtcgatggcgtcgacggctggctgcaccgcaagggcgccaccccggccgaccagggcgtgctggtgatccccggctcgcgcggcgactacagctacctggtggagcctgtgccgagcgcgcagagcctgttctccctggcccacggcgccggtcgcaaatggcagcgcggcgagtgtcgggagcgtctggcggcgcgcttcagcgtcgaccagttgggccgtacgcgccttggcagcagggtgatctgtggcgaccgccaactgatctacgaggaagcgccggaagcctacaagggtatcgactcggtggtcggcgcgctgctcgaagccggcctgctgcgcctggtcgcccgcctgaagccggtgctgacctacaagacccgtggggagtgctgccgatga

SEQ ID NO: 2625 - DNA, 1416 bp, Pseudomonas aeruginosa
agcggtcactcgtctcggtcagttactgaacagggggaacaggcccagcagcagggccatggcgaggattgccaggcacaccagcacggcccatttcagggtgaagcgctggtggtcgccgaagtcgatcttggccagccccaccagcaggtaggtggagggcaccagcgggctgagcaggtgcaccggctggccgacgatcgaggcgcgggccatttccaccggggtgatgccgtattcggcggcggcctgggtgaggatcggcaggacgccgtagtagaaggcgtcgttggacatgaagaaggtgaacggcatgctcaccagcgcggtgatggtcgccaggtatgggcccagcgccggcgggatcaccgccagcaggctcttggacatggcgtcgaccatcccggtgccggagaggatgccggtgaacaccccggcggcgaagatcagcgagaccactgcgagaatgttctcggcgtgtgcgccgatgcgcttcttctgctcctggatgcacgggtagttgacgatcatggcgatgccgaaggcgatcatgaacagcaccggcatcggcagcaggccggcgatcagggtcgccatcaggaccacggtgagaatagcgttgaaccacagcagcttgggccggcgcgcctccggatactgcgactcgctgatctccgccaggtcctcatggtcggtgggcaggtgcagctcgccgagacgggcgcgctcgcgcttgccgtacatccaggcgatggcgaagatcgccagcagcccggcgatcatcgccgggatcatcggcacgaagatatccgccgggtcgacgtgcagggcactcgccgcgcgggcggtggggccaccccagggggtcatgttgagcacgccgctggagagcatgatcaggcaggccatcaccagcgggctcatgcccaggcggctgtacaacggcagtacggcggccacgcagatcatgtaggtggtcgagccgtcgccgtcgagggagacgatcatcgccagcgccgcggtgcccagcgagaccttcagcgggtcgcccttgaccagccggaggatcttgcgcaccgccgggtcgaacagcccggagtcgatcatgatggcgaagtagaggatcgcgaacatcagcatcacgccggtcggcgccagggtgcggatgccgtcgagcatcatcgggccgaggccggcggcgaaaccgccgatcagggcgaaggcgatcgggaccaggatcagcgcgatcagcgcggacaggcgcttggtcatgatcaggaacatgaaggtcgccaccatggcgaaggcgagcagggtcagcatgggttcactccggggaagacggcggacgggcgtgcggcgtgcggtcagcaggcggcgggcgggtggcgtcgcgcggacggagtgcggctgtag

SEQ ID NO: 2626 - DNA, 474 bp, Pseudomonas aeruginosa
gcggtgggcgccgtcggcagggcgaagaacagtaccagcacggcgctttccatgctcggcaggcccagcccgcgagcgatggcgaaggccagaaggggcatcgccagcagccgcgccgcgcagttccagccaagggccgcgacttcgccgccgagttcctggggtttcagcgccgcgccgacgcacagcaggcccagcggcaggctggccaccgccagcaggttgagcaggcgatcgctgccgccgggcaggccgacgccggccaggttgaccagtgcgccggcgaggcaggcgaggatcagcgggttcttcaggatcggcagcagcagcgcgcgcaggctgatgccgcgctcggcggtcagcgcccagaccgacatcacgttcaccgtcggcaccatcagcgccagcatcagcgcggccagggtcaggcccggcttgccgtacaggctgccgaccgcggccaggccgagatag

SEQ ID NO: 2627 - DNA, 501 bp, Pseudomonas aeruginosa
tggaatccgctcatcttgcgaggtggctgcggcacagggcaagtccggcttatgctggcactcccgcgaggaggattcgccatgcccgagacccataccggcggttgccattgcggctatctgcgctacgccgtcgccgcgccgctggacgatgtcgctcactgccactgctcgatctgccggcgcaccacaggcggcatcgtcaccacctgggccacggtgccgcgcgcggcgttccgctggctggcgggcgaaccggcggaatatgcctcgtcggccagctgcacgcgctacttctgcccgcgttgcggggccaacctggcgttgttcacccggctcagcgccgataccctggacttcaccgtggccagcctcgaccatcccgagcgcgcccccgccaaccggcacatctgggtcggcagccgcctgccatggctacacctcgacccgcagttgcccgaagaggacgaggagttcatcgccggagcggacgacccgtga

SEQ ID NO: 2628 - DNA, 576 bp, Pseudomonas aeruginosa
cgcatggggttgggcggaataggactggaacagccgccaaggctaacggaatgtgcggcgcggagccagtgtggccggtcggccaggtcatcgccgcagccgggcggctgcggcggcggggcgggcgactcagatggtcaggatcgcctgggccagttgcatgtcgttggcggccaggctcggcagcttgccacggatgtggcgcagtgcggcttccaggtgcgaaccgcggatgtcgccctggctggcgacgaagctggcggcgtcgtcgcgcgcttcgaggacgatcttgtcgtcgcggaaggaattggtgatgtccgaagtggcattggaggtcatgccggtggcgcggaccagggtatccgtggtgaccacgaagctgctggcgaacgcgctggaggcgcaggcgagcagggcagcggcaccgatcaggcgcagacgtttcatgtgagttgctccgaacgaagtcagcgtagacggccgcatccgcgcggccgtgtcaacgctgagactaaccaactgtgcgccacgtcaccagcggctcagcgccagaaaggtttcgaaatctctacgtag

SEQ ID NO: 2629 - DNA, 552 bp, Pseudomonas aeruginosa
tgcttgctgatgaccagtcggcgcctccagtcgagaggaaccggctctggctctggttctggctcagggaccggttcgggctcgggctcggcgggcgtctcggggaggacctcgaggatctcgtcctcggtctcttccctgatcggtgcgatgaggccgtcggcggaaaggcccagcaggcggctgtcgatgacgcagcccttgagttgcagggtctcgccggacttgaccggattccgttcgccttgctggcggatcgcggcgaagtcctcccagatcggcgtcggcagcgccagtaccggaaaatcttcgcccagcacccggcgaaccgcgcgggcagtctgctcggagagggtgatggctgcgccatggccggccaggacctggctccagtcctgcgccggatcgccgtcccacgccacgtcgggaatcgactcgaactcccaggcgaccacgcacagcatcgggcattgcaggccccgcgccgccttgtgcggcggggtgaaggagaggaacaggcagtcttcgccctgttcatgcagttgccggtag

SEQ ID NO: 2630 - DNA, 969 bp, Pseudomonas aeruginosa
cttttaagtgcactggtaactgggatcaccggtcaggacggagcgtacctggccaagctgctgctggagaagggctaccgggtccacggcctggtggcgcggcgcagcagcgacacgcgctggcgcctgcgcgaactggggatcgaaggcgatatccagtacgaggacggcgacatggccgatgcctgttcggtgcagcgcgcggtgatcaaggcgcagccgcaggaggtctacaacctggcggcacagagcttcgtcggggcttcctggaaccagccggtgaccaccgccgtcgtcgacggcctgggcgtgacccacctgctcgaggcgatccgccagttcagcccggaaacgcgcttctaccaggcttccaccagcgagatgttcggcctgatccaggccgagcgccaggacgagaacacgccgttctacccgcgcagcccctacggcgtggccaagctctatggccactggatcaccgtcaactatcgcgagagcttcggcctgcatgcctccagcggcatcctgttcaaccacgagtcgccgctgcgcggcatcgagttcgtcacgcgcaaggttaccgacgcggtggcccgcatcaagctcggcaagcagcaggaattgcgcctgggcaacgtcgacgccaagcgcgactggggctttgccggggactacgtcgaagccatgtggctgatgttgcagcaggacaaggccgacgactacgtggtggccaccggtgtcactaccaccgtgcgcgacatgtgccagatcgctttcgagcatgtgggcctggactaccgcgacttcctcaagatcgacccggcgttcttccggcccgccgaggtcgacgtgctgctgggtaatccggccaaggcccagcgtgtgctcggctggaagcccaggaccagcctggacgagctgatccggatgatggtcgaggcggacctgcgacgcgtttcccgggagtaa

SEQ ID NO: 2631 - DNA, 1443 bp, Pseudomonas aeruginosa
gccatgctgattcccgtggtgctttccggcggcgccggtacccgcctgtggccggtgtcgcgtgaaggacagccgaagccgttcatgcgcctgcccgatggccagaccctgctgggcaagacctaccgacgtgccgccgggctactggccgggcatggcgaaatcgtcacggtgaccaaccgcgagcattacttccagagcaaggaccagttccaggcggcccgcctggggcggcaccgaggacatttcatcctcgaaccgaccgggcgcaacaccgctccggcgattgccgtcgccgccctggcgctgcaagccgaacatggcgacgcggcggtactggtggtgatgccggcggatcacctgatccgcaacgaggaggccttccgcgaggcggtggggcatgccgcgcgtctcgccgtcgccgggcacctggttaccttcggcgtggtgccggacgcagcggaaaccggtttcggctatatcgagctgggcgaccggctggacgagcagggggcggccaaggtgcgccgcttcgtcgagaaacccgatgaggaaaccgcccgtcgctacgtggaaagtggcggtttcctgtggaattccgggatgttctgtttcacggcctcgaccctggtcgacgagctggcgcagcatgccccggccctgctggagcaggccagggcctgcctggccgccagtgcggcggtgaagatggccgatggcatccagcatgagctggcaggcgaagccttcgccgcgctgccggacatttccatcgactatgcgctgatggagcgctccgcgcgggtcgccgtggtgccggcggccttcgactggagcgatatcggttcctggggcgcgatgagcgcgctgctcgacgcggacgcagagggcaatcgcggcagcggcgacaccctgttcgtcgacacccgtaacaccttcgtgcagagcgacgggcgcctggtcgccacggtcggggtcgacgacctggtcgtggtggatacttccgatgcgctgctgatcgcccgcgccgaccgggtccaggaggtgcgcagggtggtgcagcggctgaaggacgagcggcacgaggcctatcggctgcatcggaccgtcaaccgtccctggggcagctataccgtcctcgaggaggggccgcgcttcaagatcaagcgaatcgtggtcaggccgggagagcgcttgtcgctgcagatgcaccatcaccgcagcgagcactggatcgtggtgcaaggcatggccagggtcaccaatggcgatggcgcgcggctggtcaacagcaacgagtcgacctacattcccgcgggccaccggcatcgcctggaaaacccgggggtcatcgacctggtgatgatcgaggtgcagagcggcgaatacctgggagaggacgacatcgtccgcttcgaggaccagtacggcagggtggtctga

SEQ ID NO: 2632 - DNA, 2790 bp, Pseudomonas aeruginosa
tgcgcagctaccagcagctgttcctccacgggcaatggccggactggccttcattgctgccgatcaccctgctggcgctgctgctgtgcgcgctcggcctgcgtctgttccgccagcgggtcggcgaaatggtggatgaactctgatgggacagatacgcgtatccggcctcggcaaggcctacaagcagtatcccaatcgctggagccggttgttcgaatggctggtgcctttcagccctccgcgccaccacctgcactggatcctgcgcgaggtcgagttcaccatcgagccgggcgaagcggtcggcatcgtcggggtcaacggcgccggcaagagcaccctgctgaagatgatcgccggcaccacccagccgacctgcggcgagatccgcgtggccggccgggtcgccgcgctgctcgagctgggcatgggcttccacccggacttcaccggccggcagaacgtcttcatggccgggcaactgctgggcatgcaggtcgaggaaatccaggcgctgatgccggagatcgaggccttcgccgaaatcgccgaggccatcgagcaaccggtgcgcacctactccagcggcatgcagatgcgcctggcgttcagcgtggcgactgcccggcggccggacatcctgatcgtcgacgaggccctgtcggttggcgatgcctatttccagcacaagagcttcgagcgcatccgcagtttccgcaaggccggcaccaccctgctgatcgtttcccacgaccgctcggcgatccagtccatctgcgactccgcgatcctcctggagcagggacggatggccatgcgcgggcggccggaagaagtgatggactactacaacgccctgctcgccgagcgcgaggggcagaccgtgcgccaggaaatgctcgccgacggccaggtacggacgatttccggcaccggcgaggcagcgatcctcgacgtacggatggtcgaccagcggcagcgcgcgctggaggtggtcgaggtaggccaggcggtgacgctggaagtcgaggtcgaggttcgccaggacatcgagcggctgatcctcggcttcatgatcaaggaccgcctcggccagccgatgtacgggatcaatacccaccgcctggacaaggcgctcaccgacctgaaggccggcgagcgcatcacctaccgcttcgccttcgacatgcgcctgggcaaggggcactactcggtggcgctgagcctgtcgcggctggactcgcacctggaccgcaacttcgaatggcgcgactacggcctggtcttccatgtcatcaacaaccgccaggaagacttcgtcggttgctcctggctgggcgccgaaacccatatcagccgctccggcgaggcggctctggaccccacttccgcggagagcactccatgacgcgtctgttggtcgaatgcacctatgtgttcgagcatcccaaggtcaattccggtattcagcgggtggtgcgcaacgtcatccgcgagttgccggaagccgacgagacggtggagtgcatcccggtggcaatgctcgacggcaccctgtatcaggtccacagcctggcgccgctggacccgcggccgcattcgccgctggtacgcctgcgcatcctggtggagcgagccgccaactacttctggctgggccagcgcaccctggaaaagcgccgcccgttccgttcctcgccgtgggcccggcgccttctctatgtagcctgccgcctgttcgctttcgccttcctcagcattccgctgcgcctgctcgaccgcatcctcggcaagcagcagcctgcacccgtgcgcgcgaccccgctcgaacatcgggccggcgaccaactggtcttgctggactcctcctggcacgccgatttcttcccgctggcggaacgcctcaagagcgagggtgtgggcatcgtctcggtgatctacgacctgattcccctgacccatccgcaattctgcgatgccggcctggtcaaggtgttcaaccactggttcgactggatcgcggccaccgccgacggctacgtcgcgatttccgagaccatccgcgacgaagtgcgcgcggagatgctgcggcgcatcggcccggagaaggtcgcgcaacgctggttcgattatttccacctgggttcggagctggacctggtggaggacggcgcctccgtcgagcccgatctgctgcgcatgttcaaggccaaggcgccggtattcctgatggtcagcaccatcgagccgcggaagaaccacggttacctgctggatgccttcgagcgtgcctgggcccagggttcgcaggcgcggttgtgcatcgccggacgcatcggctggaagtgcgaggcgctggtggaacgggtgcggcagcatccggagctgaacaagcgcctgttcatgttcaacgacctctccgacaagagcctggagtacgcatactcccatgccgcatcgctggtcttcccgtcctatgtggaaggtttcggcctgccgctggtggaggccatgcagcgcggcctgccggcgatgggcagcgacatcccggtgttccgcgagatcggcggcgaattcatggcctacttcgacctcgccgatccgcagaccctggcgaacctggtcacccgcttcgaagccacgggcgagttcccggccgagcgaccggtcggcgaatggcgctggatcggctggcacgaggcgagtcggcaactgatcgcgcggatcctgctcgccctcggcaaggccccggcgcatggcgaggcagtacatgcggattgcggttaa

SEQ ID NO: 2633 - DNA, 555 bp, Pseudomonas aeruginosa
catgctggtccgcatgaccgaggataccgtctactgggagtgctgccgggaagccggcctgcgacgggcggagcagttttcctggaagcgttgcgcgaatctcaccgctgcagcctatcgtcgtgccgtggagggctgaatgcgggtactgcacttctacaagacctacctgagcgaaacggtaggcgggatcgaacaggtgatcttccagctttgcgagagcagcgggtcgtgggggatcgacaaccacgtcctgaccctgagcagcgatccgcatccgcctgtcgtgcccttcggcggacatgtggtgcatcgcgccaggctcgacctgcagctcgcttccaccgggttttccctgagcgtgttcaagcagttccgcgagctggcggcggaggcggacgtggtcaactaccacttcccctggccgttcatggacctggtgcatttcctcaccggtatgaacaagccgagcgtggtcacctaccattcggacatcatccgccagcgcgtcctgttgaaactgtaccggccgctgatggggcgcttccttcatag

SEQ ID NO: 2634 - DNA, 3066 bp, Pseudomonas aeruginosa
gggagttcagcaggagggagaggtcgtcgttcatcgcggcattctaccggggcggggaaaagccgggcaaaccgggccgccattcggcgcaggccggcgcagcgtcgggcctggctgcggaaaaatgctctatcccggccttgggcagcctgcccctgctcggttatgctccggccacttcaaggcaaaccactacaagaacaagcgcctatgaccgtccatgtcgagcccttggcgctgccgggcggcagcaccgatgtactgcggctctacgcccgcgaaatcgccatcgagcgtacccggctcctttatctcggctcgcgcacgccgaccctgctcatgctgctcggcggcgtgaccagcgcctgcctggtgtggggcaaggtcagcagttggctgctcggcggctggctggtctggctggtgttgctcgccgtcctgcgcctgctgcaggtcgccgccttccagcaggccgacagccgtcgccaggccagccgccactggcggcggaccttcctgtgcggcgccggcgcctcgggcctgaccctggcgttcgcggtgatcatgctggtcccggccgatgccttcctccagcaggtgctggtgttcggcctggtggcggcggcgatcctctccgccagcgtcgcctatgcggtgagcctgccggccttcctcactttcgccttgccgggcctgctgccatccatcgttttcctgctgttgcagccgcatagcctgttgcagggctggggcgtgctcggcctgatcctgctggtggcgctgctggtggtcgccgggcagatccaccggctggtgcagggcgcgctgctgcgacgcttccagacccaggcgctgaacctgcacctggaacgcgtcaacgccgaggccgaagcgctcaatcgcaagctcgcccaggaggtcggccagcggcgcctggtcgaacgcgagctgcgcgccgcccgcgacgccttgcagcgccgggtggaggcgcgcaccgaggagcttggcgcgaccagccaggcgctcagccagagcgaggcgcgcctggccatggccctggaggccagcgaactggggttgtgggactgggacctggagagcggccgggtccagcattcctatctcgaggcggtcttcagcgacgccgggggcggtcccgaggactatcgcaggctgatcgaaagcatccaccccggcgacctgccgcgcatccgtcgcgccctcgccgaacatctcaaggggcgcagcgagctgtaccgggtggagtaccgcgtgcgcgaccgggagggcggctggcgctggctggaggatcgtggccgggccatggctcgcgacccgcggggacgggtgacgcggatgctcggcacgcgcagcgacatcagcgcgcgcaagcgcctggaagagcagcagcaactggccgcgacagtgttcgaggcggccagcgagagcatcgtgatcctcgatccggcctacaacctgctggcggtcaaccaggccttcagtcgcatcaccggctatcgccgcgaggacgtggtcgggcgcaacgccagcctgctggtgaatacccccgaggcccagcgccactaccggcagatccgcgccgagctgcgccagcacgggcagtggcagggcgaactggtggatacgcggaagaatggcgatccctatccccaatggctgcagctcaacctgctgcgcgacggcaatggcgaggcgacccacatcgtcggtttcttcaccgatctcagtgcccgccgcgacgtcgaggagcgcctgcgtcacctgctgcactacgacgaactgaccggcctggccaaccgccggttgttccgcgagcggctgcacgaggcggcccagcgggcgcgccaggaggagggcgggctggccctgctgctgatcgacctggaccgcttcaagctgctcaacgacagcctcggccacgaggtcgccgaccagttgctcagggagatggcccagcgcctgcggcgcaccgcgccggaagccaacaccctggcgcgtctggccggcgacgagttcgccattctcctcgatggcggcaccggcaccgcggccctgtcgcgcctggccgaacgcctgctggtccagttgcgccagccggtgagcgtgctcggccacgagttgatcctcggcgcctcgctggggatcagcctgttttccgagcaggcacgggaaatctccgtgctgatgagccaggcgaacctggcgatgcaacatgccaagcaactcggcggcaataccttccagttcttccgcgacaacctgcaggacagcaccctcgaacgcctgcgcctggaaacccggttgcgcaaggcggtcgaggagggccagctggacgtgcattaccagcccaagctgtgcctggccagcgcccgcccggactcggtcgaggcgctggtgcgctggcaccatccggaggagggcatgatcccgccgtcgaccttcatcggcctcgccgaggagtgcgggttgatcggcgagatcggtgaattcgtcctgcgccgggcctgcctgcaggccgccgagtggagccagcggggcctgaacctgcgggtctcggtgaacctctcggtccaccagttgcgccagggcgacctgctcgacgtagtgcgctcggcgcttgccgacagcggcctgccggcggcgcaactggagctggagttgaccgaaagccagtggctggacgccctcgatagtgtcctggcgaccttccgccagttgcgcgagatgggggtgaagctatcggtcgacgacttcggcaccggctattcctcgctcagctacctgaagcgcctgccgctggactacctgaagatcgaccagtcgttcgtccgcgacctgacccagaacagcgaggatgcggcgatcatccgggcgatcatcgccatggcccacagcctcgacctgaaggtggtcgccgaaggcgtggaaaccatcgaacagtgggacttcctggtggcccagcgttgcgacgagctgcagggctacctgatcggccggccgttgccggcccatgccctggaggaaggtttgcgccaggctcgttga

SEQ ID NO: 2635 - DNA, 1248 bp, Pseudomonas aeruginosa
cgccgggctgggcgaggcggagaccaaggccctggccaacagccgcctggacctgctcggtgcctgcggctgggaacaagaggaactgggcggtgtgctcgcgcaaggcgtcgagtcggccgcaggcaaggccttcgccacgtacctggaggctgcggccaacttctacagcggtcgcttcgacgaagccgaacagggcttcaaggcgttgcaggacgtgtcgcagccctggctgaaggaaaccgccctgtacctgcaggcgcgcaccctgctcaacgccgcccagcagaacgccttcgacgacatgggcttccccgagctgcagaatgtcgacaaggctcgcctggaacagacccgcagcgccctcgaggcctacctgcaggcgtatccgaaggggctctacgccgcctcggccaagggcttgcaacggcgcgtgcattggctggccggcgaccagaagctgctggcccaggactatgccgcgcaattcgccgaagccgagcaagggcagcgcaacatggccctggaagacctggtccaggaggtcgacaacaagctcctgaccggtatccagctcggcgacatccagactccgctgctgctggcggtggccgacctggtgcagatgcgcgcccacgatccgtcgaccccgcgcagcttcacctgggaaacgctgcaggcccaacaggccagcttcgccgcgcatcccgaactgttcgcctacctgcaggcggcctatcgcttctatgtcgaccaggacccggcgaagaccctcgaagcgctgccgcaaaaggtcggcagcctcgactacgtcggcttcagccagcagaccctgcgcgggctggcgctggagcagcagaaggactggaaagccgccgaggcgctctggctggaactgttgccgcaggccgcgcagccgtaccagaagggccagttgcagctggccctggcgctcaactacgagcgcagcggccagttggaaaaggtcttcgccgaaggttcgccggtccaggagccgctgctgcgcagcatcctcctgcgcaacgtcgccgacgccgcgctgttgcgccgccaggccaagcagggcgcgacggcggaagagcgcgataccgcgctgttcactctcctttacaaggacctgcgccgcagccgcttcgccgacttcggcaaggacttcgcgctgctcggcgaaaccccctcgcagaccaagctgggcaccagcctcggctatgtctacggcgccggtaa

SEQ ID NO: 2636 - DNA, 1077 bp, Pseudomonas aeruginosa
caaggacccgaagggcctgaactgcctgggcgaattcatcctgcgcaacggtctcgacggcatgccgctggacagccagcccgaggccaacgagctgggcggcaccccgagcggcttcaagggcgaggtgtactcccggctggatggctatcgcctggtcatggacaaccccaaggctccgcgcgaagacaaggcctacgcgctgttccgcgcgatcaactgcttcgccccggccggctacaacacctgcggccagcaggacatcccgcaggccgagcgcaagcaatggttccgtacgctcaagtcgacctacgccgacagctcctgggccaaggaactgaagtactactggtgaggcgctggcgagcctggctggcgggcctgttgctgggcctgccgctgttgccgtccgtcgaggccgcggtgcgcgccgaggactacggcgccttctggctgtggagcggcgtcgcgccgcagccggtgctggcgcgggccgagacgctgtacatcctgcagggacagatcagccagtcgcgccggcgccccggcgagggcgtgcggctgatcgcccagggcatctcggtgccgcgcctggcgcggggtgaggtctgggtggtgtaccgcgcccataccctgcgctggacgccgcagatctaccaggccgtgctgaaccaggtgcagcgctggaagcgtgccggcaacccggtggtcggcatccagatcgacttcgatgcgcgtacccgctacctcgacgagtacgtcgatttcctccgcgacctgcgccggcgcctgccccgcgaataccgcttgagcatcaccgggttgctcgactggggcagcaacgccgagccggcggcgatcaaccggctcaagggcgtggtcgacgaagtggtggtgcagacctaccaggggcgccacagcattcccaaccacgccgcctacctcccgcgggtcagccgcctgcaactgccgtaccggatcggcctggtccagggcggcgactggcaagcccccgactacctggaaaagagcccctggttcaggggctacgtggtgttcctgctcaaccctcagtga

SEQ ID NO: 2637 - DNA, 354 bp, Pseudomonas aeruginosa
agaaccaggaagagcgcggcgagccgtcctgaggcgccgccgggaaggcataacgcagtcttcaccggcctgccgccaaaccgtcacattgctgcgcgatgctcgcgactccagccagtcggccatgggagacgcgagatgccccgtcatagcgatgccaatgcccagcacgtggattcgaaaacccgccgcaagctcgaagaccagcggcgcatgcaattccgccgggcgatcgaggaccactgcgaagaactgcgcctgcgccaggaactggccgactaccccgagctggtagccgccgcctacctcagctcgaaccgccagggccggcgaagcgcccagcgagctggctga

SEQ ID NO: 2638 - DNA, 372 bp, Pseudomonas aeruginosa
gcaacaccatccaagcgaagaagaccggcgtcaccgataccatcctgcgcgatgcccaccagtcgctgctggcgacccgcatgcgcaccgaggacatgctgccgatctgcgacaagctcgaccgcgtcggctactggtcgctggaagtctggggcggcgccaccttcgacgcctgcgtgcgcttcctcaaggaagacccgtgggaacgcctgcgcaagctcaaggcagcgctgcccaacactcgcctgcagatgctcctgcgcgggcagaacctgctcggctaccgccactacagcgacgatgtggtgcgcgccttcgtggccaaggcggcggtcaacggcatcgacgtgttccgcatcttcgacgcgatga

SEQ ID NO: 2639 - DNA, 516 bp, Pseudomonas aeruginosa
gccaggtattcccacagcaacgggtcggcgccaggcccttgcagggcgtcccacaggtcgtcgccgtggcgttgcggatcgagcggttcgagcttgacgaagcggccgtcgagcggggcgtggggtggagtggcgacggggcgccagttcaagggttcgcgcatggtgggcctcagagaatcctgcggtactgaaggaaaccggacttgtcggcgatgcgctcgtacagcttcatcgcgtcgctgttgctctcgtgggtcagccagtgcacccgcgaacagccagcggcgccggcctcggcgtagacatgctcgatcagccggcgccctatgccttcgccgcgcaggccctcggcgacgaacaggtcctgcaggtagcagtagtcgccgacggtccagcaggagcggtggtagatccagtgcaccaggcccacggcgcgctcgtcgagccaggcgagggcggcgttcatcggttcgtcggcgtcgaggaagcgctgccaggtggcgtcgctggtag

SEQ ID NO: 2640 - DNA, 720 bp, Pseudomonas aeruginosa
tcgtcacccatggcgcgcagcaggccatccgcctgtgcgcccaggtgttgctcgagaacggcgatccggtggctgtggaaaaccctggctaccgcgcggcgcgcctggccttcgccgcgaccggcgcggtaccgcacgggatcgacctcgacgccgaggggctgcgcagcgaccggctcgcgggcattgccggctgccgcctggcctatgtcacgccgtcacaccagtaccccaccggcgtcaccctgtcgctggcgcggcgcctggagctgctggagtgggccgagcgcgccgacggttggatcgtcgaggacgactacgacggcgagtatcgctacagcggtacgccgctggcgccgctggccgcgctggaccgacagggccgggtgctctacgtcgggaccttctgcaagatcgccttcccggcgttgcgcctgggctacctggtggtcccgccggcgctggtcgagcgcttccgccagcggcgggccatcgaggtacgccattcggaggtgggcacccagcgggtcatggccgacttcatcgccgaggggcatttccagcgccacgtccgccgcatgcgccgcgccgcccgcgcccgccgcgacgccttgctgcggggctggccaaaagcgccgggttgccagccgttgccggcggtggatgcggggctgcacctgtgcgtgcgggtcgacagcctggcgcgggaacgggccctga

SEQ ID NO: 2641 - DNA, 1563 bp, Pseudomonas aeruginosa
gccttcttcgatcggctgcgctgcggcccggctgcgtcgatagccggacctgggcgcgctcgatctcgtatcggatcaggcgcgcagtggaatcaggcgcggcgcgatcatgttttccggcagcaggatgtcggccagggtggcttcgtccagcagcttttcctcgcgtaccagttccagtacgccgcggccgctctcaagggcggtcttggcgatccgcgtggagttctcgtagccgatgtacgggttcagcgcggtgaccaggccgatgctgtgctcgaccagttcgtggcagcgctcgacgttggcggtgatgccggtgatgcagtgttcgcggagcatgtccatggcgcgttgcagcaggcggatcgagtcgaagatcttgtaggcgatcagcggctccatcacgttcagttgcaactggccgccttcggccgccagggtcagggcgaggtcgttgccgatcacttcgaaggcgacctggttgaccgcttccgggatcaccgggttgaccttgcccggcatgatcgaactgcccggctggcgcggcggcaggttgatctcgttgatgccggtgcgcgggccgctggagagcaggcgcaggtcgttgcagatcttcgacagcttgaccgcggtgcgcttgagcatgccggagaacagcacgaaggcgcccatgtcggaggtggcttcgatcaggtcggcggccggtttcagcggctgcccgctgatggcggccaggcgctcgacggcgagcttctggtagccggggtcggcgttgatgccggtgccgatggcggtgccgccgaggttcacttcggtgagcagctccggcgccaggcgacgcaggcgatcgaggtcttcgccgagggtggtggcgaaagcgtggaattcctggccgagggtcatcggcacggcgtcctgcaattgggtgcggcccatcttcagtacgccggcgaattcgacgcccttggcggcgaaggcctggatcaggctgtcgaggctggccagcagggtgtcgtggccgagcagcaggcccaggcggatggcggtcgggtaggcgtcgttggtcgactgcgccatgttcacatcgttgttcgggtgcaggtacttgtactcacccttggtatggcccatggcttccagcgcgatgttcgcgatcacttcgttcgcgttcatgttggtggaggtaccggcgccgccctggatcatgtccaccacgaactgctcgtggaaatcgccgcggatcaggcgggcgcaggcctcgctgatggcggcgtgcttgtcttccgggagatggccgagctgacggttggcgtcggcggcggcctgcttgaccatggccagggcaacgaccagcttcgggtagtgcgacagcggcaccccggagaggcggaagttgttcacggcgcgcagggtctggatgccgtagtaggcgtcagcgggcacttcgagggtgccgagcaggtctttctcgatacgggaagatgcaacgggggacatgacgggatttgtctcagagggacacggccagtgccgcgatgcccactagaactaaggatgtga

SEQ ID NO: 2642 - DNA, 750 bp, Pseudomonas aeruginosa
gcgtggtcaacgaactggagcgcggcgaactggcgatctgtggcgggccgcaatggttcgtgccgcaggaaatccgcctgtaccgctgcgcgctggtgcgcaaggcggcgatccgcctgctctggcgcaagctggaaggcgggctgggcagcgtcgagtagacaggcaagggcggcgccgggacgccgccccgcaggtcacatctcgaggacgatgcgcccctcgatctgcccggcgcgcatctggtcgaggatctggttgatgtcgtccagcttgcccggatggatggtcgccttgaccaggccttcgccggcaaagtcgagggcttcctgcaggtccgcgcgggtgccgacgatggagccggcgatgtgcaggcccttgagcaccacgtcgaagatcggcgtcgggaagtcacccggcggcaggccgaccagggcaatggtgccgccgcggcgggccatgccgatggcctggccgaaggcgctgttggataccgcggtgaccagcaccccgtgggcgccgccgatgtcgcgctggatcgcctccaccgggtcttcctgccgggcgttgaccgtcaggctggcaccgagcttgcgcgctagttccagcttggcgtcgtcgatgtcgatggcggcgacgtgcaggcccatggccctggcgtactgcacggcgacgtggccgaggccgccgatgccggagatcgccacccactggccggggcgcgcgttggtctgcttgagccccttgtag

SEQ ID NO: 2643 - DNA, 1278 bp, Pseudomonas aeruginosa
ggctcgaaccatgaaaatcggtgtcatcggtggcggccagctgggccgcatgctggccctggcgggaaccccgctgggcatgaacttcgctttcctcgacccggcgccggacgcctgcgcggcctccctgggcgagcacatccgcgccgactacggcgaccaggagcacctgcggcaactggccgacgaggtcgacctggtgaccttcgagttcgagagcgtgccggcggaaaccgtggccttcctctcccagttcgtgccggtctacccgaacgccgagtcgctgcgcatcgcccgcgaccgctggttcgagaagtcgatgttcaaggacctcggcattcccactccggacttcgccgacgtccagtcccaggccgacctcgatgccgccgcagccgccatcggcctgccggcggtgctcaagacccgcaccctgggctacgacggcaagggccagaaggtcctgcgccagccggccgacgtgcagggcgcgttcgccgaactgggcagcgtgccgtgcatcctcgagggcttcgtgccgttcaccggggaagtctcgctggtggcggtgcgcgctcgcgatggcgagacgcgtttctacccgctggtgcacaacacccacgacagcggcatcctcaagctctccgtggccagcagcgggcatccgttgcaggcgctggccgaggactacgtcggccgcgtgctggcccggctcgactacgtcggcgtgctggccttcgagttcttcgaggtggacggcggcctgaaggccaacgagatcgccccgcgcgtgcacaactccgggcactggaccatcgaaggcgccgagtgcagccagttcgagaaccacttgcgcgccgtcgccggcctgccgctgggctcgaccgccaaggtcggcgagagcgcgatgctcaatttcatcggcgcggtccccccggtggctcaggtggtcgccgtcgccgactgccacctgcatcactacggcaaggccttcaagaacggccgcaaggtcggccacgccaccctgcgttgtgccgaccgggcgacgctgcaggcgcgcatcgccgaggtcgaggcgctgatcgaggcgtgagcgattgccgcccgcccatccttgggttggcgggcggcactgaacccaaggcttttctacactgtcccatggcaggcgcaatacatgcgcatacacccgtaaggagggactgtcatgggattaatcggaaccatcatcgtcggactgatcgttggtctcgttgcacgctttctgaagccaggtga

SEQ ID NO: 2644 - DNA, 687 bp, Pseudomonas aeruginosa
agcggcgatctgttcgtgcagcggggtgtccttggacaggtcggcgatctcgaagccctgtttcttggcgtgggccaggcgggtcgggttgacgtcgccgacgatcaccaccgccgcgccgagcaggcgtgccgaggccgccgcggccaggccgaccggaccggcgccggcgatgtagaccgtgctgcccgggccgacgccggcggtgaccgcgccgtggtagccggtggggaggatgtccgaaaggcaggtcaggtcgcggatcttctccatcgccgcttcgcggttgggcagtttcagcaggttgaagtcggcgtatggcaccagccacgtattcggcctggccgccgacccagccacccatgtcgacgtagccgtagggcgccgccggcacgcgccggattgaccgtcaggcagacgccggtgtgctgttccttgcaagtacggcagtggccgcaggcgacgttgaacggtaccgagaccaggtcgccgatcttcatggtttccacgccacgcccgatctccaccacctcgccggtgatctcgtggcccagcaccaggccttccggcgcggtggtacggccgcgcaccatgtgctggtcggagccgcagatgttggtggagaccacccgcaggatcaccccgtggtcgatctgccggccctgcgggtcctgcatcttcggatag

SEQ ID NO: 2645 - DNA, 291 bp, Pseudomonas aeruginosa
tcgcccagccgtccaggcgccggcacagttccggcgacagcacctgcatgtagcgagcgaggatcaccagctcggcgccactctcttcgagcacctgccagaccctggcttcctgggccggcttgtcgttcgggtcgagcgggaagtggtggtagggaatgccgtgccagcgcgccagcggctccaggtccgggtgattggaaatcaccgccaccacgtccatcggcaactggccgatgcgctggcggtagagcaggtcgttcaggcagtggtcggccttggaaaccatga

SEQ ID NO: 2646 - DNA, 1374 bp, Pseudomonas aeruginosa
gaacggcaccgccgagcgcttcggcggcgaggactacctgccgctgatcgataccacgcggatgggcgacccgctgggagtgatggtcccggccaagggcgaggagggcgtctcgaccctcagcggagtgatcaagaaccgctacgtactgaccctcagcacccgcgacacgcccaatggcggcagcgccacggcgatgcgccaggtgctggtgccgttcgtcgagcagatgaagctgaccaagctaccctgacagactgtgccggcacgtacccgtgccggcacgaccgcatggagccccacaagggctcggcaaccgttccagaggcccacatgaccgatcacacccaacagttcgccagcgacaactattccggcatctgccccgaagcctgggcggcgatggccgaagccaaccgcggccacgaacgcgcctatggcgacgaccagtggaccgcgcgtgcttcggactacttccgccagttgttcgagaccgattgcgaagtgttcttcgccttcaacggcaccgccgccaactccctggccctggctgcgctgtgccagagctaccacagcgtgatctgctcggagaccgcccacgtcgagaccgacgagtgcggcgcgccggagttcttctccaatggctccaagctgctgctggcgcagaccgaggtcggcaagctgaccccggcgtcgatccgcgacatcgctctcaagcgccaggatatccactatccgaagccgcgcgtggtgactctcacccaggccaccgaggtcggcacggtgtaccgcccggacgagctgaaggcgatcagcgccacctgcaaggagctcggcctgcacctgcacatggacggcgcgcgcttctccaacgcctgcgccttcctcggctgctcgccggcggagctcagctggaaggccggggtcgacgtgctctgcttcggcggcaccaagaacggcatggcggtgggcgaggcgatcctgttcttcaaccgcgacctggccgaggacttcgactaccgctgcaagcaggccggccaactggcctcgaagatgcgcttcctcgccgcgccctgggtcggcgtactgcaggacgatgcctggctgcgctacgccgatcacgccaaccgctgcgcgcgcctgctggccgagctggtggccgacgttcccggcgtcagcctgatgttcccggtagaagccaacggcgtgttcctgcagctttccgagccggcgatcgaagccttgcgcgcgcgcggctggcgcttctacaccttcatcggtgaaggtggcgcgcgtttcatgtgttcctgggataccgatatcgagcgggtccgcgaactggcgcgggacatccgcctggtgatgggcgcctga

SEQ ID NO: 2647 - DNA, 1251 bp, Pseudomonas aeruginosa
  unsure (58): Identity of nucleotide at the above locations are unknown.
cgccgagatgcgcgtcgccgagcgccaggtcgaactgttccgggctttcggcggcggntggcaagccgctcccagcccctcccatcaggaaaacggacaatgaaccaggcaatcagggaacccatcgaacacaccactggcgaaaccatgccagcagccacgcgccggcgccgaacctggctgctgggcggcctcgccggcgccatcgcgctcgccgccctgctggcctggtggtggagcagcggacgcttcctggagggcaccgacgatgcctatgtacgcgccgactgggtggcggtcagcgcgcaggtctccggctacgtcgccgaggttctggtggccgacgacgccgacgtccaggccggcgacctgctgctgcgcctggacccgcgcgacttccgccagcgcctgcgcgccgccgaggcccgcgaagcggcggcgcaggcggcgctggaagcccagcgcgcgaagctggagaccctcgatcggcaactgctggagcaggcgcagacgatcagccgcgcccgcgccgatggcgaagcggcgcgagccgaatggcgccgcgccgagaccgactggcgacgctaccggcaattggccgacgagcatgccaccagtcgccagcgcctggagaacgccgacgcggcgcaccagcgagcgcgggcggcggcgcggcgggcaagcgccgaggaaggccgccagcgcgccgccaaggacgtactgaagagccggcgacgcgaggcggaggcggcgctcgcccagcgccaggcggagctgcaggaagccgcggcggcgcgcgaactggcgcgccacgccctggacgataccgaaatccgcgccccattcgccggccgcgtcggccagcgcaaggtgcgcctgcgccagtacgtcacgccggggctgccgctgctggcggtggtgccgctggagcaggcctacgtggtggccaactacaaggagacccagctcgaacgcatccgtcccgggcaaccggtagagctggaggtggacacgttcggccgccgctggcgcggccgcgtcgacagcgtggcgccggcctccggcgcggtattcgcgctgctgccgccggacaacgccaccggcaacttcaccaagatcgtccagcgcttcccggtgcgtatccgcctggacgccgacgccgccgagcggggccggctgcttccggggatgtcggtgatcgccaccgtggacactcgcgaaccggacggagcctccgccgatgagcgctga

SEQ ID NO: 2648 - DNA, 948 bp, Pseudomonas aeruginosa
cgtgatcatcccctccatcgtcgtgcgcggcatcggccagccgctgatcatggtcgcgctctcggtactggcggtgaagggcctggacaaggccgaggccggctcggcctcggcgctgatctcgatgctgcgcaacctcggcggcgcgatcggcaccgcgctgctgacgcaactggtctcgctgcgcgagcgcttccactccgagcggatcggcgagaccctgacgatcttcgacggcgccctgcagcagcgcctgggcggtggccaggtgcggatacaactgccggagcagcagcaggcgctggccctgctcgaccacggggtgcgccagcaggcctacctgatggcctactccgacgccttctacctttcctgcgtggcgctcctggcctgcgccctggcctcgctgatgctgcgccagaaggactgaactcagtcgccctcggccaccccgtaggcggcgccgcggccgaaatagaggctcggcgaaacgcccagggtccggcgaaacatggcgctgaaggcgctctggctgtcgtagccgaggtccagtgcgacctcgaggatcgagtgccctgccgccagcgcatcgaggctggcgagcaggcgcatgcgccgcagccactggacgaagctgagaccggtttcgcgctggaaggcgcgggtcagggtccgcgggctgacgcccaggcgacgcgcggcatcgcccaggctccagtcggcggccggctcggcgcgcaggctgcggcacagcgccgccagtcgcggatcgaccggctgtggcacgtgcagggcgaggatcggcagcacccgcagttcatcgaggatcagctccatcacccgctcgtcgcggccacccggcgggtagtccggggcgatccgcatcgccgcgacgatcaattgccgcagcaacggcggcacgtccaccacccggcagtcccgcggtag

SEQ ID NO: 2649 - DNA, 474 bp, Pseudomonas aeruginosa
agagcccttcgcgacaggcatccgcttggtctgtcggaagtccgcgccgaatcgccgccaggcgaccgcgcaagctcgcgagccgtcgcgcggcgccggcgaagtcgagctcgccgcgctccagttggccgcccagcaggcacaggtcgtcggccatcggcagcgccagtccacgctccgccaagcgccgggcccaatgcgtctcgccggcgaagcggaactccatcagcgtggaaaacagcgccgccaggccaccgcggatcgccgggagcgcagcgctcagcgcccgcgactcggctcgaccgacacccagcaggtcgtctaccgcgtagacctcgccggccagcgtccggcgacggcgctccagttccccgtcagccgcaccggcatgccgcgcagcgaccagcgccagcgtcgccgcgcagagcgagacgagacgctggcgcacccgcccggacacggtcctgcggctga

SEQ ID NO: 2650 - DNA, 1401 bp, Pseudomonas aeruginosa
tcagcaacagcacagtggacgccgcggaaaacggcgaatccagttgcaggtagagccccaggccgagcgccagagcggcagcgccgatgctgcgcagcacgtagtccaggctgtcggtccgccagggcaacggcaacgccgcgtaccaatcgcgcccgccggacgccgacgccgccatcaaaggtactcctgcaaccagcgggtcagccgccagtgccgcgcggtccccgcctgcagcacctcgacactgccggtcatgccagcggcaagcaccacgcccgccggtacccggtcgagttcgatgcgcaccggcacgcgctgcgccaggcgtatccagctgaagttcgggctgacctgcggcaggccgctgtcggcacggctttcgttgaggtcggcgacaccgcgaccgatgctcgcgacatggccgtcgagcagcggatcgaaccccatcagcttgatcgtcgccggcgcgccgacctgtacattgcgcagcttggtttcctcgaaatagccggtgacccagaagcttcgccgatcgacgatgaagatgttggtccggcccgccgccgcgtaatcgccgggctgcacgcgcaactgcgtcacatagccgtccaccggcgagcgcaactcgctgcgccgcaggtccagccgcgcctggtcgagcgccgccccggcggcctcggcgcgggcgcgggcgatacgcagggcgcgtccggcgttggcgacctcctcgcgcgaaaccgcgccggccaactgcatgcgtcggcgccattgctcgtcacgttggcgcagggtttcccgcgcctgctccagctccgcctcgcgctggcgcacggccaggcgatagctgcgcggatcgatgcggtacagcggatcgccgcgggccacccgctggttatctgcgacgaacaccgcctcgacgctgccggagacttccggcgcaatgcggatcacctgcgcgctgacccgcccgtcgcgggtccagggcgccagcacgtaggcttgccacaactgcaacgccaggcacagggcgagcaggccgcaggcgaaggtcgcagccaccttggaaagacgaacgatggacatggggacctcggctcagaacttcagcaccagcacggacagcacgatgaacgacaggaagaaacgcagcaggccgggatgccaggcgcattccagccagcgccaggcgaggcgctccagcagcaggtagagcggcatcgccaggcacaggtagaggaacaatggcggcacgtagaggccggaaacggagacttcgctcagcatgcagggcaccagggtatcgagggcgcggagcggtcggccgctcctgtcgggttgaggagcacaggctacgggtcgtggcgatttgcaaatatcgactactcagccagaaaataa

SEQ ID NO: 2651 - DNA, 1029 bp, Pseudomonas aeruginosa
caaccgggtcaccgccaacggcaaggtctgcttcctcttcgtcgagccgggggcggcacgcctgccgagcgactgctgcaccctggccctgtcgccgctggtcctcgaactgatcctgcacctgagcgcgcaaccgcaggactatccgcacgacggcccgctcgcacgtctcgccggggtgctgctggaactcctggaacaggcgccgaccgaacagctctacctgccgctgccggacaaccgcggcctgcgccgcatcgccgacgaactgacccgcgcccccggcgaccgcgccagcatggccgaatgggccaggcgagtggcgatgagcgagcggtccctggcgcggatggtgcgccgggagaccggcatgaccttcggccagtggcgccagcaattgcagatcatcatcgccctgcagcaactgtccgccggcgtttcggtgcaacgcaccgccgagatcctcggctacgagtcggtcagctcgttcatcggcatgttccgcaaggcgctcggcagccccccggcccgctacgtgcgcgacagcatgcggcggccagccgactgaacgaaggtcgacggaaaggtcttgcagttcgtcagctgttctccccccgaggctggcactcgaagacacttctgggaataatgccgcccttttttctccaggaggatcagatggttacgcacttcttgagcgaatccggccaggcagcctgcgggcgcggcgacagcaacgtgaacggctcgagcgacgtcggccaggtcagttgcaagacctgccggcgcaccaacgccttcgcccaggcccaggaaaacgccgctccggccagtgcccctgtcacccccaccgccgctgcgccagtgatcgacaaggccgcgccgcggccgaaagccgaggccaggcccgccgccgcgcagcgccaggaccgcgatgccgcccgcaaggcctggcaggcgcgtctcaacgaattgtccgggaagaaccgcatgccgcgctcgcggcgccgcgcgcaagcctatctctga

SEQ ID NO: 2652 - DNA, 531 bp, Pseudomonas aeruginosa
attcctggtgcagcggaccgatgcccgcgtcggcgaagtcgtacacaccgttcagccgcccggcctcgctatcgaatgccatgttccagccatggccgtcgaagaagccgaagatcgaacccagcggatcggcaggcagcttggcatattcccgcaccaagcgttccgcgcgttcgcgccaggccgcaggcagcagcggcaaggcgcgcctgcgcatcgccgcaggcgactcccagggacgcaccggcaaggctccaaccgcccgcatgcgcgccggtggcagtcgatgcagctcggcgtagaagcgccccaacgcatcgccgaccgcctgccgtgcgggttcgtccaggcgccggtagtcctcgcccaggaggtaaccgccaggcagtttctcgtggcgggaaaacagcggcggtcccgcaaacacctgcggcgccggcaccggcaggctcaccgccggacgcaccaggcgtagcacggcggcctcgcgcagcagcgccgcctcggcctccgcgccgcgcggaaacttga

SEQ ID NO: 2653 - DNA, 1452 bp, Pseudomonas aeruginosa
tcgtcgtcgctcatcatcatccccgctctctcacccacgccctcgccgcgcgcatcgccgaaggcgtggtccgtgccggccattccgcggaaaccgccgatctggcggcggaaggcttcgagccgcgcttcggcctggccgaccacgccgtgcatcgcggccaggcgtcgcctcccgccgacgtcctcgccgagcaggcgcgcatcgatcgcgccgataccctggtgctggtctacccgatctactggtggtcgatgccggccctgctcaagggctggatcgatcgcgtgttctccaatggctgggccttcgactacagcatcggcggcgacctgcggaaaaagctgcagcgcctgcgcgtggtgctggtcggtgtcggcggcgccgatgccggcaccttcgagcggcacggctacgccggggcgatgcgcacccagatcgaccatggcatcttcgattactgcggcgcacgggtggtccgttccgaactgttgctggagtcggagagcgccgatccgatccggcatctggaccaggccctgcacatcggcagccagctcttcgccgcacgcggcgcgcagggggccgcccaggcgcagccgctggaagcctgaccccaggtcattcggccaggtgcatggcgaaaccggcccgctgcggggcaagttcgtcgcgcagggtcagcgccgggatcaggtagtcgccgccgttctgccggcggaacgggatcggcgcagcgcgctgcaggtcatcgaggcgccggcccaactgctcgctcagcgcggcgaaacgctccgcgtcgatccggccgctgcgatagacgacgaacggcggcaatacctcgaagccggggtaatgcaggatgccgtggtggatggggaacagcaggtcgtccatcggtccgttgataccgcgcgcggcgtagtgcgactcccagccgccggcggtgactaccagcatcgcccgcttgccctgcatccggccctcgccgtagcggtcgccccagtggctgtcggaatgttcgccgaccccgtaggcgaagccgcaggcatagacgcgatcgatccaacccttgaggatcgccggcatgctgaaccaccagagcgggaattgcaggatcagcgtatcggcccagcgcagcttgtcctgctcaccggcgatgtcgacgctctgccaaccgttctcgaaggcgcgcagggaagttgcggaaggatcgaagcgttcgctggcctcgcgctcgaggctgtcgccggcatcgagcacggccttccagcccatcgcgtagaggtccgaaacctgcaccgcatggccggccgcctcgaggcgggcgaccgcgaagtccttgagcgcaccgttgagggagcgcggctcgggatgggcatagacgatgagtacgttcatggcgggtctccggcaaaaggtgggcgcaggatcggccatcgccggatatag

SEQ ID NO: 2654 - DNA, 918 bp, Pseudomonas aeruginosa
atatccgaaattccaggtatatggatgattaatctccggcgactggacctgaacctgctggtgaccctcgacgtgctgctcaccgaacacaatgtgacgcgcgcggcggaacgcctgaatttttcccaaccctcggtgagcgtgcacctggccaagctgcgggcgatcttcgacgatcccttgctgcttcccggcccgcgcgggatgcgcccgacggcgcgggcggaggagctgcgcgagccgttacgcctggccctggaagccctggagcaggcggtggcgccggccgcgccgttcgatccgacgcagtcacggcatacctggcgcgtcgccgccaccgactacgccgagtcggcgatcctcctgccgatcctcgccagtcttcgccgccaggcgccgggcagccgcctggcggtgctggagctggcgccgacgcgaatcgtcaggcaggcggaacgcggcgagatcgacctgggcttccacaccctcgaagaatcgccgccgggactgcgctgtcgccggctgttcagcgagcgctatgtgctggccgggcgcgccgggcatccggggctgcgtcggcgaccgacgctgaagcagttctgccgcctcgagcaggcgatcgtctcgcccgacggcggcggcttcctaggtcccaccgaccaggcgctcgccgaactcggcgcggaacgccgggtggcgttgtcggtgccgcacttcctgttcctccgcgcggtgctggaaagcaccgacctggtggcgctgctgccgtcgcgactggtacgcgagcgcgacaggttgcgggtggtcgaggcgcccctggaggtgcccggctacgacctggccatgctctggcacgagcgctcgcaccgcgatccggcccatcgctggctgcgcgaactcatcgccgcctcggtgtaa

SEQ ID NO: 2655 - DNA, 582 bp, Pseudomonas aeruginosa
ggccgcgcagtccttgcgcgtctacctgtcgccctggtcctgcgggatggtcttcagcgagctgttcggcgccgacctgacccgtttcggcatctgctacctggctccggccgaggtgccggcatccgacctgacgcgcctgggacggcgcctgcgcgaagagttcccgttgctcgacagccaggtggacagcggcgcggaaggtttcgaactggtcgtccacgggcagcccgaggagagcccggcgctggaagtcggccccttcgccgacgaaaacgcgctcatcgcagcgctgctgcaacgcccgcattccctgttcgagcgcggcctgctgcgactgttccacgggcgctgcggaggacgtgcgcgctggggcgtctggctgcatcacctggtcgccgacgccgacttcgccagcgtgctgctggcccgcctggccgtgctcaacgccgaccccacgaccgaagcggcggcccccgagttcggcttcctccagcagcaatggcgcctggagcgccagctgcgcgagcgcaggaccaggctggaagactactggagcgagcgcggcgaggcgttccgtga

SEQ ID NO: 2656 - DNA, 1161 bp, Pseudomonas aeruginosa
actggcgaacctgccctgggcggagcgcgccagccattgcgaggatttccgcttggctgccacgccaggaggcggcgaagccgccctgctgacccggctcgcctgcgccctggctctcgccctggccagccagggcgccaccggcaaggtcttggcgctgaccccggtcagcctgcgcagtcgccgaggcacggcggtttccggttgctggctgaacctggtgccgctgttgctggacgccgcgaccgccgaggacaccttcgaacgacacaggctcgaggccttcgagcacagcctgctgccggcggaggccatcgccgaacgggccgggctgcgctatgccgacgcccaggtgatgatcaatgtcatcgaccagccattccgcagcgccgggttcatccaccggccgacactgaagagccgcctgccgctgaccctgaccctggtccggcgcgacgacggcggctgggacgccagcctggccagccgcttcggccgcgaacggaccctggcgctggcggcggccatggccgaggcgctacgcccatgctgatcctgctgcctgacttcatcggccacccgagctgcttccgcgggctgctggcacgcctcggcgcaacggactgccggctggtcgactaccaccggctggatgcctacgccagcatcgaagccctcgccagccaggtactcgacggcctggcggaagaaccggactggctgatcggctattccttcggcggcctggtcggctacgagatggcccgccagttgccggccagccgcctgctgatgatcgacagccacctgccctggccggccctgcggcgaatgccgccgagcgagcaataccagcgctggctgagcgccgagatgcgcgaatggatcgccctgatgagcgagcttggcgaactgcgcgaagaggtcctgctgcgcaatgtcgagctgttcggccgctggcagccccgccatcgcctcgcccgcgccagctgggtgcgctgccgggacgacgccggccgcgacccggccgccgaacgctggtgcgacctgatcgagcggctcgacaccttcccctgcgagcgtccgcaccacctggccctgcaggacccggcggtgatcgatttcatcgtccacaccgtcagcaaggagtccgtccaatga

SEQ ID NO: 2657 - DNA, 438 bp, Pseudomonas aeruginosa
agatggtcaccttcctcgcccgtttctcccgccagttcggccatgcgccgaagatccacgacttcatcagggagccgcggctggcgacgctgtcggcctcggacgcgggagcgagacgatgatccgggtcatcgactgcaccctgcgcgaggggtgccaggcccgccagtgcagcttcgacagcgcgcagtcggtccagctggcacgggaaatcgcggcgctgggggtggatatgatcgagtgcggccacccgcggatttccgcggacgaacgcgagcgggtacgcgccgtggtggcggcggtttccacgccggtgctggcccacacccgggcgcgccgggaggatatcgacgcggtgctggaaaccggtgcgcaagtgggtcgggctgttcgcctcgatcaacgcgatctcgctggaaaccaagttcaagggcatga

SEQ ID NO: 2658 - DNA, 831 bp, Pseudomonas aeruginosa
agtaccaccgccacggccccggcaagcgcttcgtcatgctcgaccggcgcctgctcgacggctcgccgttctacttcatcgcccgccagttccacgacgtcggcgacggcgggccgggccacgtcgacagccacgtacacaactgcgactcggtgttcctgttcctcggcagcgacgaggactaccgcggcctggaggtggaagtcctgctcggcggccagctgcgccgtttgcagagcccggccagcgtgttcatccccgctggcgtcgagcacagctaccgctacctcggcggcagcggcacctacatcaatttcgtccacaagggcgattaccacgagagcctactggagattacccaatgaagcagttcgacaagcacgcagacgcctacaacgtggtccgcggcaagatcgcctatccggattcgctctaccgcaacctcgccgaacgcgccccggcacgcgaagcggcgctggacatcggctgcggcaacggcgtctcgaccgtccgcctgcaaccctggttccgctacgtggaaggcagcgacctgggcgaggcgctgatcgccaaggcccgcgagaactacccggagatccgcttcagcgtgtcgccggcggaaaccttcgcgccgcaacgccgcttcgacctggtcaccagcgccacctccttctactggatggaccgcaagcaggtgctgacgcgcatggccgactggctgacccccggcgggctgttctgcgcctacaagtacgacttcccgatcgcctacgggccgctgcgcgacttcatcgagcacgaactggtgaacaagtgggccaaacaccgtga

SEQ ID NO: 2659 - DNA, 1476 bp, Pseudomonas aeruginosa
cgacaccctggagatcatgggcagttgcccgcacctgcgcgactgccgccgcgaagtgttcgccaacatcatcttcctcagcccggaggaggtcgcgctgttcttcctctccaccagctacgtgacccgctacatcgagcaggaaggcggcgaagactacgccgaccgcttcatcgccgcggtgcgcgagatcgagagcgcgccgcaggtggcggtgaacttcgacatccacgccttcaccgcgctgaatcgctgaggagccggcatgagcagcctccccgtacccgtatcgctcgacagcaccctccgccatctcggcagcgccgacccgcggcggccgttcctgatcgacgcccgcgagccggagcgaccgctggaatacacctggggcgacgccgaccgccaggtcgatgccctcgccgagcagatcgccgcgcatgcctgccgcagtgtcggcgtgctgctcgacaacagctaccgcaacctctgcctgatctatgcggtcatgcgcgcgggcaagcatctggtgctgatcgatcccgagtggggggaggccgcgaagcaggccatcgtcgacgagatgcgcctggacgcgctggccagcgaacatccgctcgagggcgcgctggccgggctgcgcctggcgctggacttcgagcgcagcgcgacgcgccggctcgaccgcgccgcgcacagccacatgatcctgttcacctcgggcaccaccggccagccgaaaggcatcgaactcagccagcaggccatgctccatgcctaccgcatcggccgcgactgcctgggcatcggcgagcacacgcgctccggttgcttctaccggatcagcggcctgggcatcctcggcatcaatttcctcttcccgctgctgtacggcggcagcgcggtgctcctgccgctgcactgctgggccgacagcgaaggcttctgggaatgcgtggaacgcttcggcatcagtttcctctacctggtgccgccggtggtcaaccacatggtcaaggaaggctccccgccgccgcgccgcttgccgttgcagcgcctgctctgcgtcgccggctcggcgcgcctggacgccgacctgcaggcggccttccagcgcgactacgcggcgctggcgaacatctacggcctcagcgagtgcggctttgccttcctcttcggcaagcgtcgcggcgatgcgttcgacaactcggtgggacctgccgtcggcctggaactcaagctgaccgaccccgacggccgcccgctggagggcagcggcgaacgcgggcgcctgtgggtgcgcacgccgagcctgttctccggctacgtcaaccgccccgacctgaccgcccaggtgctcgaggacggctggctgaacacccaggacctcgcctacttcgacgaggaccgctgcgtgcacgtcctcggccgttgcgacggcaccatcaacaagggcggcaacctgttccacctgaatga

SEQ ID NO: 2660 - DNA, 1866 bp, Pseudomonas aeruginosa
atgcgaaagggcgctcaacggcctggacgaggtgatcgacgtctgctgcctgaaggtcgactgcccgctctatggcgaaaactatgtcgccgtgatccacaccgcgccgcaggtcgagttcgccttcctgccctggctccagcagcagctcggcaccctccgcgcgccacagcgcgtggtgctgtcgcaccaggccctgccgctgaacggcgccggcaagcacgaccgccgtgcgctcgccgccctgctgcaacgggaagcctcgtgatgtgcggcatcctcggttacgtcggcaccggtttcagtgtctcgcgcttcgccggagcgctacgcctgctggcccatcgcggcccgttcggcgagggcatcgcggccttgccgaacggcgccatcggcatgacccgcctgccgatgtccggcgccgcggcggtaccgctgccgccgcaggagggccagcggcgggtcgcctacaacggcgaggtctaccaggccggctgcgaaatccatggcgagatccgcctgctgctcgacggcttgcagcgcggggtactgccggacggcatgtacgccctcgccagctgggacccgcagacccggcaattgaccctgctgcgcgacgagttcggcatcaagccgctgtactacagctaccagcccgagcgcggcctgctggccttcgcctccgagccgcgggcgctgctgcacctgctcggcggcgcccgcgccgacgccgaggcgatcgcccaggtggtcgccgccggcgtgccgctggaaggccagaccctgttccagcaggtccgtctgctgctgcccggcgaggtgttgcgcttcgatctctcccaggagcgtccgcgcctctgccagcgccagcggctggccaccgccccggccagcgaggtggacagcctcgacgagcagctcggcgaaaccctcgaacgctgccgccagaccttccgcccctgcgccctgctggtcagcggcggggtcgattccaacctgctcggcagctacctggacccgcagttgcaacgctttcacctgtgcctggaaggcgacgaggaaagcctgctgccacaccctcggctgcaacgcttcgagctgcgccaggaagccttcatgccgctgctgcgtcgcgcggtcggcaacttcggcggggcgacacggatgtccagcctgctgatgtaccagcgcctggccgacggtatcggcgagcagggctatcactgcgtgcttctcggcgaaggcgccgacgaactgttctggggctacccgcgccatctcgaactctggcgccggcgcgacgcaccggaaccgcggcgcttcgccgccgcctggttcggcgagtaccggcgcaaggccgcgctgctggcggaaccggcgggccgacgggtcgccgagcggatcgaggaactcgcccacgaggccctcggccagggcctcgaggcggcgatcggccagttcgatctgcactactcgctggagccgctgctgcgccgcgccgaccatctgctgatgtcgcgcaccatcgaagcgcgcaccccctacctgcatggcgccctggcgcagcgcgccgggcgcctccagcggatcgtcggcgacaccgccaaggcaccgctggtggcgctcctggagcagcgcgagaaacgctggcaggcgcagccgaaacggcatttccgcctgccgttcgaacgttggccgcaggccctcggggaaatgcgccggcacctcgccgaacgcctgccggcgctccacgacctcggcctggaaggcctggatgcaccgagcgtcgcggcgctgcccggcgaccagttgttcaccctcaccaccctgtcgctctggcagcaggaatacggagcctcgctatga

SEQ ID NO: 2661 - DNA, 1269 bp, Pseudomonas aeruginosa
gcggcgcagccttgccccgcgatcctcgacggggttcctcgaagcctgcctgagcatggcccggcatcgcgccttcaccctgctgttgctgtgcaacatgctggccgcgctgatctacgccaccttcgattcgaccctcgtgcagtacctcacccgcagcggtctgcccgacgtggtcaacagcatcgccctgctggtgaccatcaacgcgctgaccatagtggtcgcccagtttcccctcctccgcctgctggaaaacaccggcaccggcggccgcctgatgctcggcatgctgctcatgctcctggcccagctaggcttcgcctggaccccggtgaccctgttcgccggcctggcgctggccacggtggtgctcagcctcggcgaactgatcgtgttcccgaccttcagcgtggaggtcgaccaactgacccccgacgacttgcgcggcagctatttcggcgcggccaatctctacagcctcggcaccgcgctggcaccgctgtacggcgggatcatgctcgaccatgccggcagccaggcgctgtacctcggcctggccgcgctgtgcggggtgatcatgctgctgcaggtcggcgcggtcggcctgcgccaggccgagcgggccggcggatgaccggcgcgctgctggtctcgggatttttcctgcgccgctccgcctggtccgtggaaggcgccggctggcgaagctgcgaccatctgcgcgacgcgcccggatgcgacctggcgcattggctggaccaggccgccgccacgctggccggcgaggagcgggtgatactctgcggccacagcttcggcggctacctggcgcaatgcctggcggcccgcctgggcgagcgcgccgcgcacctgtacctgttcagcgcgctggtcagcgagggcggcggcgcgctggaaagctaccaggacagcggccaggacaatctcctcgggctatgccgcctcgacccgctcggagggcgggtccgcctggaagaccgcgccggcttcctcgaactgctcggcgccgaggtgccgaccagcgccagcgaacccgcgcaattgctgatcgacccgccgccgcaggttcgtccagcctgcccggtcacctacgtggtggcggccgccgaccggctcagcccgccgccgctgcaacgtaccttcgcccaccgcctggacgcgcgagtgcgggaatacccgggcgggcacctcgccgcactggcggacccgcgcttccttcgcgccctgatcgaatctaataattag

SEQ ID NO: 2662 - DNA, 771 bp, Pseudomonas aeruginosa
cggatgatgaccccatcaaccgcccgcaccctcgcgcaaacgagcggcgacgggcccaatggagatccgatcatgatcgaacgtcgtcccttcgaccgtctgggccatgccaaccacggctggctgaacgcgcgtcatcatttttccttcgccgactactatgacccggagcgcgaggactggggccgcctgcgggtctggaacgatgacgagatcgccgccggcagcggcttcccgccgcacccgcaccgcgacatggagatcattacctatgtccgcgaaggcgcgatcacccaccaggacagcctgggcaacaagggccgcaccgaggccggcgacgtgcaggtgatgagcgccggtaccggcatcgtccattcggagtacaacctggaagccgagaccacccggatcttccagatctggatcatcccggaccgccgcggcgaccagccgcgctggggctccaaaccgttcccgaaggccgagcgcgacggtcgtttcgtcactctcgccagcggcgacgagcaggacagcgaagcgctgcacatccgcgccgacgccgaggtcgccgcggtgaccctgaaggccggccagagcgccgagtacgccctggaaaacggtcgccgcgcctacctggtaccggccaccggcagcatcgaggtcaacggcgtgcgcgccgaggcccgcgatggcctggcggtacgcgacgaaccgaccctgaaggtcaccgccctggaagacagcgaagtgctgctggtggaagtggcctga

SEQ ID NO: 2663 - DNA, 1014 bp, Pseudomonas aeruginosa
actgcaacccctgctggagaaccacgggctgctcctgctgttcctcaacgtgctctgcgagcaggccgggctgccgatccccgcctacccggcgctgatcgtcgccggcgcgctggccatgcagggcgtcggcgcgccgctgggcgtggtcctgctggtggtggtgctcgcctgcctgctggcggacgtcgcctggtacctggccggacgccgctacggcggcttcctcctgcgcagcatctgcaaggtctcgctgtcccaggacagttgcatccgccagagccagaacatgtacctgcgggtcggtccgagggcgctgctgatgtcgaagttcctgcccggcgccagtgcgttgtccaccaccctggccggcatgacccgcacccacctgcgccgcttcctcgcctacgacgccgccggctcggcactctgggccggttccgcgctgctgctgggggtgatcttcagcgatgcggtagaccacctgctggccctgctcagcgactacgcggccatcggcgcgctgctgatcgccggcgccttcgccgccttcatcgcctggaagctctggcagcgccagcgcctgctgtcgcgcagccggcggattccgcgaatcagcgtggaggaactggaaaaccttcgcgaacaggggcaattgccggtgatcctcgatgtccgcgcccatcacgaagacgagccgagcggcattccgggagccatcccggtggagctgaacgtgtcgctgaaggacctccccggcgacctcagggacgccagcatcgtcatctattgcgcctgtccccacgaactttccgccgcgatgctcgcccagcgcctcaacgcctccggcttcacccgcacctgggcgctggccggcggcctggacgcctggcgcaaggcctacgggcaggtcgtggcgaacgcctgagcgacgcccaccgggttcagcccagggcctgcaccgccgcgccgccggcttgccgctgcggcgccggcgaggagaacaccaggtag

SEQ ID NO: 2664 - DNA, 2148 bp, Pseudomonas aeruginosa
gcggcgccgacgccggacaatccggcgccgacgatgagtacgtccaggtgttcgacaggcataaggttcctcgatcggcggaagcgtccagccgtctgctgggctgatgccctccaccctacagaggggatgccgcgcgggtatcccaaccttcgtactgcgatatccgcaaagtatggacccaggcgtgggaatcacccatgccggcgtaccggcatgggtcgggcgctaggaggcgcgggaaggtttctccggggtctccgccgctaccgcgccacggtcttccaactggtcggtctggaacagcgtctccagctcgacccgcgcctcgcgagcgcttttgatcagcgcgtcgcggtcgttgtagaacaggtgctgggaggccaggacctcttcgtcgtgccggcggaaacgacggatccgcgcgtccgcctgttcctcgctcagacccaggccgcagagcaccatgcggctcatctccaggctggagaagaaggtctcgcgcaccggctcgaccccggcgtcgagcaacaggtggacgtgctggcggttacgcgcgcgagcgatgatcttcaggtgcggatacagcttgcgcacgcgcttggccgtctcgatgttggtctccgggtcatcggtggcgatgacgaagaactcggccttctctacctgggccgcgcgaaggatctccgggcgcatcgggtcgccgtagaagatcgggatcgcgccgagggtacgggtcagctcgatggtctccaccgaggtgtccagggcgatgaacggcacgcgctgggcgcgcagcacgcgagcgacgatctggcccatgcggccgaccccggcgatcaccacgcgcggggtgtcgtcgttgtcgatgcgttccatttccggcggcggcttcgtcgcctccggctccttcgccagcaggcgcgcgaggccgagtaccagcaacggggtcagggccatcgacagggtgatggaaagcaccagcaggttgtgcaggtcgttctggaacaggccctggtcgcgggccatcttgaacacgacgaaggcgaactcgccgccggccgccaggaccacgcccaggcgcagcgccgaggccttgtcgaggccgccggaaatgcgtccgacgaagtacagcaccggcgccttcagggcgatcagcagcacggtcaggccgagcaccatccacggcgacttgagcagcaggctgatgtccgcgctcatccccacgctgatgaagaacaggccaagcaacaggcccttgaacggctcgatctgcgcctccagttcgtggcggtactccgagtcggccagcagcaagccggcgaggaaggcaccgagggccatggacacgccggccagctccatcagcagcgcggtacccatcaccaccagcagcgcagtggcggtggacatgtcctgcagcttggtttgggcgacgatgcggaacaccgggcgcagcaggtagcggccaccgaccaccaccgcggcgatgctaccgaccaccttgagggtctgggtcagttcgctgccgccggcgtcgctgtgcgcaccgctgagcagcgggatcatggcgatcagcgggatcgccgcgatgtcctggaacagcaggatggcgaaggccaggcggccatggggctgggtcagttccttgcgctcggcgaggatctgcaggccgaaggcggtggacgacagcgccaggcccaggccgagcaccaccgcgctgttcaccggttggtcgaagccgaccagggccacggtgccgatcaccacgccggtcagcagcacctgcagcaggccgacgccgaacaccgacttgcgcatcacccacaggcgccgcggcgacagctccaggccgatgatgaacagcagcaataccacgcccatctcggagatctgcgcgacgctttccgggttgtccaccaggcccagcacgctgggaccgatcagcacgccggccagcaggtagccgagcaccgcgcccagttgcaggcgcttggccagcggcaccatgaacaccgccgcgatcaggaagaccacgccggactggagaaaactgcttccgtgttccacgctcaactcccgctggcggcgctggcgccgaaccggtcgcggatggtggcgatggtctccacatccatggcgatatag

SEQ ID NO: 2665 - DNA, 996 bp, Pseudomonas aeruginosa
ggcagcgcgatccacaactgcgcggcgtgggcgtggcgctcgtcgggcagcgactcctcggtgtgggcgatgccatggccggcggtcatcaggttgacctggcccggacggatcacctggacgttgcccaggctgtcgcggtgcaacgcctcgccctggatcatccaggtgaaggtctgcaggccgatgtgcgggtgcgggcccacggccaggccgccgccgggttcgaattcggcgggaccggcatggtcgaggaagcaccaggcaccgatcatccgccgctggcgcgacggcatcagccgactgacggtgatcccgccgccgatttccgcggcacgcgcggtgacccgttgcagcaggtgttcgtggcgttccggacagtcccgcgaggaggacaggtcgcaacgctcttcggtattgctcatgttcaggctctccggtgacgaggcattcaaccgcgcaggcggcgcacccatagctgcagggcctgcaactgctgctggatcagctcgcgcgccttgtcgtcgagcagccggccctgggcgtcgaaggcgttctgcgcgctggagatcatcacttccggcttgttcagcggatgaacgtcgaggaacaccagcgtctggcgcaagtgatactgcgcccgcgcggtgccgaaacgcccggcgctggcaccgaggatcgccgccggcttgccggagaacggctgctccggcggccgcgaggcccagtcgatggcattcttcagcaccccggccatcgaatagttgtattccggggtggcgaacagcagcgcgtccgccgcgcggatctgctcgcggaagcgttccaccgcgggcgggaagccgagggcgtagacgtcctcgttgtatagcgggatgccggagatgtccgccagctcgatgctcatgcccggcgggaccaggccaatcgcctcctgcagcgccgcgctgttgtaggagccgctgcgcaggctgccggaaatgcccaataccttga

SEQ ID NO: 2666 - DNA, 810 bp, Pseudomonas aeruginosa
ccatggggtttctcctgtgcatgggggggcgtgccggaacctcgggttccggcgaagcggcgttccgatgaaaacacctggacggaaaacgacacaaggcacccgatggtcggagtgccttgtgtccgggacagcggcgaagccggcttacttcttcgtgccgaagctctggatcaggttggcgtacgccggcaggtggccgccgaggatggcaccgaagccttcgatgtcgttgcgccagtcgcggtgcagttcgcagccgacgctgaaccagttcatcagttgcgcgccggcggcggtcatgcgcgcccaggcggcgtcgcgcaccaccgggttgaaggtgccggaggcgtcggtgacgacgaatacgtcaaacccctcctccagcgccgagagggtcgggaaggctacgcagacatcggtcaccacgccggcgatgatcagttgcttcttgccggtggccttgaccgccttgacgaagtcctcgttgtcccaggcgttgatgttgccggggcgggcgatgtacggggcctgcggaaacatttccttgagttccggcaccagcgggccgttggggccatcctcgaagctggtggtgaggatggtcggcaggttgaagaacctggcgatgtcggccaatgccaggacattgttcttgaactcgtccgggctgaaatcgcggaccagggagagcaggcctgcctggtggtcgacgaacagcaccgccgcatcgttcttgtcgagtcgcttgtaggtgaaggacatggtgtttctccggtctcgggcggcgtccgtcgccgcgcggtgtga

SEQ ID NO: 2667 - DNA, 1074 bp, Pseudomonas aeruginosa
  unsure (1046): Identity of nucleotide at the above locations are unknown.
aatgcgaaaacggtgttctcgatacgagaacaatgccattccccgggcgcgctacgcttgccctgccattgtctttcccgtacgtgcgacgcgcgcatccccttaccaggagttctcccgcatgcgacagtctgcctcccgattgtttcgagattcgccatgagcctgcgccttgaagacatacaggccttcctcaacgtggtcgagctgggcagcatcagcgccgccgccgaacgcatgagcctgtccaagtccgtgatcagcaaacgcgtcagcgacctggagcgccacctcggcgtgcgcctgctctaccgctcgacgcgcaacgtcgagccgaccgaggccggcggcttcttctacaagtcggccaaggcctcgctgcaggacctgaacaacgccgcggaaagcgtggccctgcgcgagaacgacctgtgcggggaattgcgggtgatggcgccgatgagcttcggcacgctctggctggggccgctggtgatggaattcatggcgcgcaacccgcgcctggaagtggtcctgcaactggacgaccggatcgtcgacttcgagaaggaaggctacgacctggcgatccgcatcacccgcctgcaggacagctcgctgatcgcccgccaactgggcaccagccgccgggtagtgtgttgcagcccggaatacctggaacggcacggcccgctgcaacgcatcgaagacatcctctgccatccctgcatcggctacagccacaacaccccgtcgcagctatggagcttcgagccgcgggtggccggcgagccggcgcggatgatcaccccgcgcggacgcttcaacaccaacaacggccagaccatgcgcgacgccgcggtgcgtggcctgggcctggcgatgctgccgctgttcatcgccgccgaggacctggccgccggccggctggtcgaggccctcccgcaggagcggccgctggacgacctgatctacgccatgtattcgcgagcggcaaccttttcgccgaaggtgaagctgttcgtccagtttattccagcaggccntgggcagcccgccgtggggcgtgcgtga

SEQ ID NO: 2668 - DNA, 612 bp, Pseudomonas aeruginosa
gtgggcataccggagtccgcggagaggccggcgccggtgatgaccaggatgcgttcggcgcgccgcagggcctgggcgacggtagcgatcgggctgtggctgtccatggttggctcctgtcaggctggcggatcgagggaagccggcaagccgagccggcgcatgcgcccgagcagggtcgtgcgcggaatccgcaaccgggcggcggcccgggagagattgccgcgcgcctggcgcaaggcgtcttctatcaggttgcgctcctgttgcgccagcgcctcgcgcaggcctccgaccgccgcgctgttcatcgagagcgcggcctcgccgcccacggcctcggcgccgtcgtcggcgaacgccacctcatccagcagtgcgccgccctccccgtgcagcaacaggctgcgccggatcacgttttccagttgccggacgttgcccggccagtcgcaggccagcaactgcgccagcgcccgctcgccaagagcggtgacacgcgggttgaggctgcgcgcatcgcgacggacgaacgcccgtgccagcagttccacatcgccggggcgctcgcgcagcggcgggatgcacaggctgcccacgtccagacggtag

SEQ ID NO: 2669 - DNA, 507 bp, Pseudomonas aeruginosa
ctgccgtcctgcaggacccgcagcagcttgctctgcatggccatcggcatggaattgatctcgtcgaggaacaagctgccgccctgcgccagggcgaacatgcccttgcggttctcggcgccggtgaaagcgccgcgtgtggtgccgaacagggtactttccagcagcgtctcgggaatcgctgcgcagttcaggctgatcatcggaccgctgcgtcgcgggctcagggcatgggcgcgacgggcgaacagttccttgccggtgccggtctcgccatggatcagcagcggcaggtcggtggcggcgaaaacgtccaggcgctgcaactgccgcagcaggctcggcgccacgctcaggatgttcgggcaatccgccaggcctgcggcctcttcggtctcggcgacgacttcgccgagctccatcgcgccgagcaggcaaccgtcgcgcccgcgcagcgggatcgcccggtggcgatactgcaacagctcgccgccggcccccacgtag

SEQ ID NO: 2670 - DNA, 1599 bp, Pseudomonas aeruginosa
tcgaggtggacacctccgaatatcgcaagatcgacggcggcgtcagttgcatgtcgctgcgcttctgaaccatgccgcggcggaccgacccgccgcctcccgccgtcgcaccccggcgcaggctccgcctgcgcctggcgcgacataccggatgcagtttcggaggtgccacatggccgattcggacaagggaaaactggggctgccggcgctgaccgcgctggtggtgggcggcatcatcggcagcggcatcttcagcctgccgcagaacatggccgaaggcgcaggcgccggcgcgatcctgatcgcctgggcgatcaccttcgtcggcatgctgaccctgacgcggatattccagtggctgtcgaccacccgccccgaactggacgacggcgtctacggctacgcccgcgaaggcttcggcgaatacctggggttcaatgccgcctggggctactggatttccgcctgggtcggcaacgccggctacctggtggtgctgttcagcgccctcggctcgttcggcgcgctggccttcttcggcgacggaaccacctggccggcgctgctcggcgaattgacggtgctctggctgatgcatgccttcgtcctccacggcgtgcacaacgcggcgatcaccaacgccatcgtgaccctcgccaaggtggtgccgatcgccctgttcatcctctgcgtagccctggccttccgcatcgagacctttcacctggacttctggggcagcccggccctgggcaacgtcacccgccaggtggaaaccaccatgctctacaccgtctgggtattcctcggcatcgagagcgccacggtctatgccagccacgcgcggcacgcggccgatgtcagccgcgcaaccctgctcggcttcgtggtcaccctgctgttgctggtctgcgtctcggtgctgtcgctgggcgtggtgccgcagcacgaactggcgcagatgaagaacccctcgatggcccaggtgatggccgcggcggtgggcccctggggcgccacgctgatcaacgtcgggttgatcgtctcggtcggcggcgcgctgctggcctggaccatgctcgcggtggaaatgctctacctggccagccgtggcccaacgcacaccgcgccggcactgttcggccgcaccaatgcggtggaaaccccggcgccggcactgtggctgaccagcacgctgatctctgcgctgctgctggtggccttcctcaacgcctcgggctacaacgcgctgatccagttggccacctcgatggcgctgatcccctacctgctctgcgccggcttctgcctgaagctggtggcgcgccgcccgcactcgggcgcgatgctggcgctggcgctgttggggacgctctacggggtctggctgatctacgccgccgggctgaaatacctgctgctgtcgatgatcctctacgcgccaggcctgggcttcttcctgcatgcccgtcgccagcgcggcctgccggcgttcggcaatcgcgccgaaggcagcgtcgcggcgctggtgctgatcctcgcgctggcggcgctatggatgatcggcagcggtcggctgagcctctagctcaatga

SEQ ID NO: 2671 - DNA, 972 bp, Pseudomonas aeruginosa
tcgcgcatcgggaatccttgcagaccggagagaagaactgacccgcggcgcggctcagaggttcatcacgtcgaggaagcgcggcgtggcgttctcgtcgatgcgcaggttggcgaagtcgaacaggttgcggtcggccagttgcgacggcaccacgttctgcagggcgcggaacatgatctcggtacgccccggcgatttgcgttcccattccagcagcatttccttgaccacctggcgctgcaggttctcctgcgaaccgcagaggttgcaggggatgatcgggaactccttgagctgggaataggcctcgatgtccttctcgctgcaataggccagcggccggatcaccacgttgcgcccgtcgtcggccagcagcttcggcggcatggccttcagggtgccgccgtagaacatgttgaggaagaaggtctcgaggatgtcgtcgcgatggtgaccgagggccatcttggtcgcgccgatctcgtcggcgaaggtgtacagcgtgccacggcgcaggcgcgagcacagcgagcaggtggtcttgccttccgggatcttctccttgaccaccgagtaggtgtccttctcgacgatgtggtactccacgccgatcgacttcaggtactccggcaggacatgctcgggaaaaccgggctgcttctggtccatgttcaccgcgacgatctcgaagcggatcggcgcgaccttctgcaggtagagcaggatgtcgagcatggtgtagctgtccttgccgccggacaggcagaccatgaccttgtcgccatcctcgatcatgttgaagtcggtgatggcctcgccggccaggcggcgcaggcgcttctgcagtttgttctgattgaccgaaagggtgcccatggtgctctggaatccgggtgttcgaggagaaaagctggctattttacgcacaaagcgacgccgaccccagcccctcccgacgcccgatgctag

SEQ ID NO: 2672 - DNA, 603 bp, Pseudomonas aeruginosa
tcttgtcccatgactcccgacctcgaccaccgcctcgacctcgccgggcagatcctctgcctgctgcgcgagcatcccgagggactttccgaataccagttgatccagctgctgaaggcccgccattcgacgcatatcccccatcgcgaactggccgacaagctggtgctgttccgcacccatttcctcctgttcaacgcgctctaccacctgcgcgaccacctctgggccgagcgcgaggcgcacctggagatcagcccgctgagcctgcgcctgcatccttacgtggatggcacgcaggcgctggaacagggcgatccgctgcgcgactactacctcgacctgcgtcacctgggggagaccagcgaggccgacgtcgagcggctgctgcagagtttctggacgcgcatgcagggcagcgaggagaaggccgccgccctcgccctgttcgagctggaaggcgcggtcgactatcccgccatcaagctgcgctaccggcaactggtcagccagcaccatcccgaccgcggcggcagcaccgcgcgcctgcaatcgatcaacaaggcgatggaaatactgcaacgctattacagccggccgtga

SEQ ID NO: 2673 - DNA, 576 bp, Pseudomonas aeruginosa
tcgcccgctgctggagtcttcccgaatgcccgaacacctcaacgcccgcgtcgaggcctgctatcggcaggccgaacacttcttccaacgcagcttcccccgcccgaccgtcagcttccgcctgcgcggccagaaagccggggtcgcccatctcgacgagaacctgctgcgcttcaatccccagctgtaccgcgagaaccgcgagcacttcctggaacagaccgtggcccacgaagtcgcgcacctgatcgcgcaccagttgttcggcccgcgcatccgcccccacggggaggagtggcagttgatcatgcgcggcatctacggcctgccgccggaccgctgccacacctacgcggtcaagcgccgcgccaccacccgctacctgtaccgctgccattgcccggagcacaacgacttcccgttctccccgcaacgccacaccctggtggccaaggggcgccgctactactgccggcgctgcaaggcgaccctggtgttcaccggcgaagtgctccgcgagtgattcaggcgatggccccggccgccttcagctcggcgatccgttcggcggagtag

SEQ ID NO: 2674 - DNA, 420 bp, Pseudomonas aeruginosa
cccaggccttcgagcaccgccacggtgtcggcaccgagcgccgcgccgatgtggcgaggcgccggcagaccggcggaaaacttgatcggacaggccatctgcgcctggctgccgccgtccgccagcggcacccgggcgaccagcccgcgcgcctgcaactgcgggtgttccagcgcctcggagagcggcagcagcggctccacgcaggcatccagggcggcgaacaccgcctgccattcggcgaagtcgcgtttctcgaactccatctcgatctcgcgcttcagcgcccgctgctcttccggcttcggcgacaggccgcgggcggccagttccgggcggccgatggcggcgcagaattgctgcatgaactgcggttccaggctgcccaccgagaaccagcggccatcgcgggtgcggtag

SEQ ID NO: 2675 - DNA, 1440 bp, Pseudomonas aeruginosa
ctggccgaggtgccgtcgacgtgcggcggcagcacccgcaccaggtccatgcgcccgggcgactccacgcgcagcacgtccgcccccatgtcggccagcagcagcgaggcgaacggccccggcaacagggtcgagaaatccagcactttcaacgatgacaacgggcctttcatgctccctcctctgggtcgccgggcattggtcgggatcgcctgccgagcagcctatccacccgccgcgcggcgcgacatggccgtggcgtcagagcttcatgccgcggctgatgatctctttcatgatctccgaggtaccggcgaagatccgctggatgcgggcgttggcgtacatcctgcagatcggatactcccacatgtagccccagccgccatgcagttgcacgccttcgtcgaccaccttgcccagcagctcggtggtgaacagcttggcttcggcggcgacctcgggggacagcttcttctggttgtggtccatcacgcagcggtcggtgaagacctgcgccacgtcgatctgggtacgcatttcggcgagcttgaagcgggtgttctggaagtgcgcgaccggccggccgaaggcctggcgctccttcacgtagtcgatggtcgcctgcaacgccgcctcggccccggccaccgcgccgcaggcgttggtcaggcgctcctgggcgagcatgttcatcaggtagaagaagccgcccttggcgtcgcccagcaggttttccttcggcacccgcacattgttgaagaacagctcggcggtgtcctggctcttcatgccgagcttcttcaggttgcgcccgcgctcgaagccttgcatgccgcgctccaccaggaacaggcccatggcgtgcttgttcgccggatcggtcttcgccgcgacgatcaccaggtcggccagcaggccgttggagatgaacaccttggagccgttgagcagccagtggtcgcccttgtccaccgcggtgctgcgcatgccggccaggtcggagccggcggacggctcggtcatggccacggcgaggatggtctcgccacggacgatccccggcaacaggcgggccttctgctcggcgctaccgtattcggcgatgtacggcccgcacaacgccgagtgcagcgggatcatgaagcccggctcgttgatccgcgccagctcctcgcacatgatctgctcgtagcggaagtccttgagcccggcgccaccgtactcctcgtccgcccagggcagcaggaagcccatctcccccgccttcctccagacagcgcggtcgaccaccccggcctcttcccaggcgtcctggtgcggcaccacctctttgtcgagaaaggcgcggaaggcatcgcggaacaggttgtgttcggtctcgaagatctgccgttgcatgtacggggactccctgcggtcagtggttccgcagggtag

SEQ ID NO: 2676 - DNA, 1869 bp, Pseudomonas aeruginosa
ctggcgcatgtggctgcgggcgatgggggtggaggacgacccgcgcagcgagagaggtccggctttcgccgacgacctgctgctggttcgcgccgccgaggccggccagggtatcgcgctggtacgggagatccatgcccgcgccgagatcgccagcggccgcctggcggtcgccctcgagcggccctggccgagccgcttcgcctattacgcggtgagcctgccaggagcggcgcaacgagcgcccctctcgctgttcctcgcctggctgcgcgagcaggccgccgccgaggcataaaaaaacccgccacgagggcgggttcgaagggcggcagggagctcttcacttccccctgccgaacaggtttgagcttagaccgcttcgcggccgcccaccggaatatcgctggcaggcgacgaagcgttgccctcgccggccagttcgcgctgcaaggtgccctcgtcgagctgcttgcaccacttggaaaccactaccgtggccacgccgttgccgaccaggttggtcagcgcgcgggcttcggacatgaagcggtcgatgccgaggatcagcgccaggccggcgaccggcaggtggccgacggcggaaagggtcgcggcgagcacgatgaagccgctgccggtgacgccggcggcgcccttggaagcgatcagcagcaccagcagcagggtgatctggtgggtgatgtccatcggtgtatcggtggcctgggcgatgaacaccgcggccatggtcaggtagatcgaggtgccgtcgaggttgaaggagtaaccggtgggaatcaccaggccgaccaccgacttgttgcagccgagcttctccatcttgtcgatcatccgcggcagggccgactcggaagacgaggtgcccagcacgatcagcagttcctcgcggatgtacctgatgaagcgcaggatgctgaagccgtgggcgcgggcgatgccgccgaggacgatgagcacgaacaggatgcaggtgatgtagaagcacagcatcagttggccgagctgcaccagcgaacccacgccgtaggcgcccatggtgaaggccatggcgccgaacgcgccgatcggggcgactttcatgatcacgttgatgatgttgaacatcacgtgggagacgcgctcgatgaactcgaacaccggcttgccgtagctgcccaggcgatgcagggcgtagccgaagagcacggagaagaacaggacctggaggatgtcgccgttggcgaacgcgccgaccacggtgccggggatcacgttcatcaggaagtcgacagtgctctgcttctcgccggcagcggcgtaggcagcgatcttgctggtgtcgagggtgttcgggtcgacgtgcatgccggcgcccggctggaccacgttgaccactaccaggccgatgatcagggccacggtggagacgacctcgaagtacagcagcgccatgccgccggtcttgccgaccgacttcatgctctgcatgccggcgatgccggtgaccacggtgcagaagatgatcggcgcgatggccatcttgatcagtttgacgaagccgtcgccgaacggcttcatcgccaccgccgtttccgggtaccagtggccgagcgcgataccgatggcgatggcgaccagaacctgcacgtacaggctcttgtagaagggttgtttggtcatgggcagagtcctcacgggggcgcttcgccagttccctggaacgcgctcaccggtagcgttaccccccttgctggggagattttttgtcgtgaaccgccgcggcggaaccttgcccaggcattgcagaggctgtgccaggatgctctttctctaaataaaatccttatatatcaacaagttaaataa

SEQ ID NO: 2677 - DNA, 540 bp, Pseudomonas aeruginosa
aggacggcgagaagtcccgctgcaggcttacccgcttgtcgcgatagaccttgtccagcgcgtcgcacagggtctccaccagcggcgccagttgctcgcgatggcgtaccaggccgctcttgcgcaggctggcgcgctgcaactgatagcctatctgctggctcatgcgctcgatctggccctgtagcacccgcacctgctcgcggttgccgggctcctcggcgagctggtcgccgaccccctgcaagaccgccagcggcgtcttcagactgtgcgccaggtcgccgagggagtggcggtagcgctcgcgctgcttgtgctcgctgcgcaacaggcggttcagcgagtgggtcaggcgcagcagctcgcgcggatgctcctcgctcaggctctcgcgctcgccggattcgatctggtccagctcggaactcaacccgcgcatcgcccggaagccccaggtcagacccagccagagcagcccgagcaagaccagcagggcgccgccgagccacaggtagagctgctcgcggaaccccttga

SEQ ID NO: 2678 - DNA, 1020 bp, Pseudomonas aeruginosa
acagcaccgccagggcggcggcgccgagcatcagacggatgcgcagggaacggatcaccggcagcgctcggtgaacaggtagccctggccgcgcaccgtatcgatcggcttgaagccgccgcaggcctccagcttgcgccgcaggcggccgaccagcacctcgatgacgttggcgtcgcgctcctcgtcgtcggggtagagctgttccatcaggcgttccttggccaccacctgctggtgatgccgcatgaggtattcgaggatgcggtattcgtaggcggtcagcgccaccggttgctcctcgaccagcgcctgcttgcggttcaggtcgaggaccagggggccggcctcgatggtcgactggacgaaccccgaggagcgtcgcagcaacgcgttcaggcgcgcttccagttcctcgaactggaacggcttgaccacgtagtcgtcggccccggcggccaggccttcgaccttgtcctgccagttgccgcgggcggtgaggatcaggatcgggaaggacttgccctgcgaacgcagctcgcggatcaggtccaggccgctcatgcccggcaggccgaggtcgatcaccgccaggtcgtggtggtattcgctgacccggtagagggcttcctcggcatccggtaccgcgtccaccacgtgcccctgttcacccaggcgggtatagaggtggtggcgcaacagcgcctcgtcttccactaccagcagtttcatgaggttcctccggatgagatgcggccggaccttccggcccggccatcgaagcatgccctcgcgggcgctgcgcggtcatttagaacttgtagttggcgcccaggtagaattgcgagctgctgtgcaggtccagggagcccagcttgttgccgccatgcggggtcatctcggtgctggcgttggtgcgcagataacgatagccgccttcgatcgaggcattcttgctcagctcctgcaggataccggcctgcagcccggcagcgtagccgacatcgctgtcgcgcttga

SEQ ID NO: 2679 - DNA, 303 bp, Pseudomonas aeruginosa
acccgggctgaacgactcgcgtttgccggcgaacgttctgtttccaggctgccgcgcgccggctcggcgaggtttttgcccgtactgcaagtagggtctaggctttctacagtcgcctgcatagaggctgggccaatgaacgaacaacccgaccagggacgcgtcaagggcatggaagccaggctcttcctgtttctcgtgatctgcctgttcccgctgctgtccgtcgcactggtcggcggcttcggtttctgcgtctggatgtaccagctactggccggcccgcccgggccgccggcctga

SEQ ID NO: 2680 - DNA, 675 bp, Pseudomonas aeruginosa
agctcggcgccggtcggctcgtcgaactcgacctctccagcgccggctgcacgctgtgcggggaatgcgccagccgctgcgaggccggcctgttcgatggcgcgcgcccggccttcccctggatcgccacgatcggcgaagcctgcctggccctggccgggatccactgccgcagttgccaggacgcctgcgaacccgccgcgatccgcttccgcccggcccccggcggcgtcgccctggccgagctggacagccagcgctgcaacggctgcggcgcctgcctggcgccctgtccgagccaggccatccaactgcgcgcgctatccaccaaggagtctccacgacatgcctgaagccctgcagatcgccagcctcatcctgcattgccgacccgagcgactgccggcggtgaaggccaacctggcgctgctcgacggcctggagatctaccaggaaagcccgcagggcaagctgatcctggtgctggaagccgaacgcgaagaacagattctcgacaccctgggccagttgcagaacctgccaggagtgctcaacgccgtgctggtctaccacgagatcctgcacgacgacgatagcaacgacgcggcggccatgaccgaccgcgcgataccgtgctcgcccgaggagacaatcgatgaacctcacccgtcgtga

SEQ ID NO: 2681 - DNA, 2499 bp, Pseudomonas aeruginosa
attcgccaaggccaacgccgccgccatcgccgcggcggcggccggcctgccgatcctggtccgcgccagcaacctggtgaccgaggcggacgtcaccagcctggtttggaacaaggccccctgccgcttctgcggcaccggttgcagcgtgatggtcgccacccgcgacggccaggtggtagccacccatggcgacatcaaggccgaggtcaaccgcgggatcaactgcgtgaagggctacttcctgtcgaagatcatgtacggcagcgaccgcctgacccgcccactgctgcgcatgaaggacggcaagttcgacaagcagggcgagttccagccgatcagttgggaacaggccttcgacatcatggccgagaagttcaaggccgcgctcaaggccaagggaccggagtcggtcggcatgttcggctccggccagtggacggtctgggaaggctatgcggcgaacaagctgttcaaggccggcctgcgcagcaacaacatcgaccccaacgcccgccactgcatggcctcggcggtgatgggcttcatgcgcagcttcggcatggacgagccgatgggctgctactacgacatcgaggccaccgacagcttcgtcctctggggctcgaacatggccgagatgcacccggtgctctggtcgcgggtcaccgaccgccggctcagcgcgccgcaggtcaaggtcgcggtgctgtccaccttcgagcaccgcagcttcgagctggccgacttgcccatggtgttcaagccgcagaccgacctgatcatcctcaactatatcgccaaccacatcatcgagagcggcgcggtgaaccgcgacttcgtcgagcgccacgtgcgcttcgcccatggcgccgaggacatcggctacggcctgcgcccggacgacccgctggagaagaaggcgaagaacgccgacaaggccaacacctggagcgatatcgacttcaaggccttcgccgagttcgtcaagccctataccctggagcgcaccgcgcgcgaaagcggcgtgccggccgagcggctgaaggccctcgccgaactctacgccgaccccaagcgcaaggtggtgtcgttctggaccatgggcttcaaccagcacacccgcggggtctgggcgaacaacctgatctacaacatccacctgctcaccgggaagatcagcgaaccgggcaacagccccttctcgctcaccggccagccctcggcctgcggcaccgcgcgcgaggtcggcaccttctcccaccggctccccgccgacctggtggtgaccaacccgaagcaccgggaaaccgcggagaagatttggaaggtgccggccggcaccatccaggagaaggtcggcttccacgccgtgcagcagagccggatgctcaaggacggcgtgctcaacgtctactggacccaggtcagcaacaacatgcaggccggtcccaacgtgatgcaggaagtgctgcccggctggcgcaacccggacaacttcgtgatcgtctccgacgtctaccccaccgtctcggcccaggccgccgacctgatcctgcccagcgccatgtgggtggagaaggaaggcgccttcggcaatgccgagcgccgcacgcagttctggcaccagttggtgaaggcaccgggcgaagcgaagtccgacctctggcagctggtggaattctccaagcgcttcaccaccgacgaagtctggcccgcggaactgctggcgaaggcccccgagctgaagggcaagaccctctacgacgtgctgttccgcaacggccaggtcgaccgcttcccggccagcgacctggccaagggctacgccaacgacgaggtcgacgcattcggcttctatatccagaagggtctgttcgaggaatacgccgccttcggtcgcggccacggccacgacctcgcccccttcgacgcctaccacgaggcgcgcggcctgcgctggccggtggtggacggcaaggagacccgctggcgctaccgcgagggctacgacccctacgtgagcaagggcagcggcgtgcagttctatggctatccggacaagaaggcgatcgtcttcgccctgccctacgagccgccggccgaggcgccggaccaggactacccgttctggctcgccaccggccgggtgctcgaacactggcacaccgggagcatgaccgcgcgggtcccggagctgtacaaggcggtgcccgacgcgctggtctacatgcacccggaggatgcgcgccagctcaagctgcgccgcggcagcgaggtcaaggtggtgagccggcgcggcgagatccgcgcgcgggtcgagacccgcgggcgcaacaagccgccccaggggctggtgttcgtgccgttcttcgacgccaacaagctgatcaacaaggtcaccctggacgccaccgacccgatttccaagcagaccgactacaagaagtgcgccgttcgcatcgaactgctcaacctggcctgaggagcgcgccatga

SEQ ID NO: 2682 - DNA, 687 bp, Pseudomonas aeruginosa
agccgctggtcgacaaccgcttcgagaacatcgaccagatcctcgagaaagaagccgccaatgcggcgcgcaaaccctgagggaggccgcatgaaagcactcatcgcctggctggccggttactggcgggtcctgcgtcgtcccagcgtgcatttcagcctgggcttcctcaccctcggcggcttcatcgccgggatcgtcttctggggcggcttcaacaccgccctggaggcgaccaacaccgagaccttctgcatttcctgccacgagatgcgcgacaacgtgttcgtcgaactcaaggacaccatccactacagcaaccgttccggagtccgcgccacctgtcccgactgccacgtgccacacaagtggaccgacaagatcgcgcgcaagatgcaggcctccaaggaggtctggggcaagatcttcggcaccatcaacacccgcgagaaattcctcgatcaccgccgcgagctggccgagcacgaatgggcacgactcaaggccaacgattcgctggaatgccgcaactgccacaacttcgagttcatggacttcacccggcagagcgtgcgcgcgcggcagatgcactccaccgccctggccagcggcgaagccacctgcatcgactgccacaaggggatcgcccaccacctgccggacatgaccggggtgaagggctggtag

SEQ ID NO: 2683 - DNA, 1101 bp, Pseudomonas aeruginosa
aaccttgctcgggcagactggcggcggaatacgcatgccgggtgtctcgcggccgatccgccgcgtcacatccgtgcccgaacgcgctgcgccacccgcgcgtccgttttccgggcactggccgggcgttcgccggtccaagcagtgttccccgcctccgtccacaagccggagccggccccgacggtcccagaccaccgcaggaaagccgggcggccgccacccgccaccgccccgggctttccaccctcactacacgtttcggagtacaaccttgatccactggttgagcgacccgacgttctggacagccctgctgcagatcgtcgccatcgatatcctcctgggcggcgacaatgccgtagtcatcgccctcgcctgccggcacctgccggcgcaccggcgcaagcaggcgatcttcggcggcgtcgccggtgccatcctgatccgcatcctgctgctgttcttcgccctgcacctgctcgacctgccctacctcaaggtaatcggcgcgctcctgctgctgtggatcggcatcaagctgctgctgccggaggaggagaacggcgacgacatcaagggcagcacccacctgctcggcgcgatcaagaccatcatcatcgccgacgcggtgatgagcctggacaacgtcatcgccctgtccgccgcctcggccggggatttcttcctggtctccctgggcgtgctgatcagcatcccgatcatcgtctggggcagccagctgatcctgcgcctgatcgaccgcttcccgctgatcatcctcttcggcggcggcctgctcggctggatcgccggcggcatgctgctcaccgacagcgccctgaagccctggctggcgccctacgcgcaatgggattcctacctgcactacggcgcggcggccttcggcgcgctgttcgtgatcctcctcggcagcctcctggcgcgccgccagttgaagcagcggcatgccgcgccggcggacgccgccgaaagcgaaggccgctaagagcaacggggcgcccgggggcgccccgtcctctttctccggctcagatattggtgctcgccgggatccggctcggcaacaggtactcgtag

SEQ ID NO: 2684 - DNA, 816 bp, Pseudomonas aeruginosa
tcggggaccctttcacggagagatgccatgcgcctgttctgcgccctgctgctcatcgcctgcgccgccagcgcccaggccgctatccagacccgcgagatgccttaccggagcgcagacggcacgcgcatggtcggctatttcgcctacgacgacagcaagccggggatccgccctggggtcatcgtggtccacgaatggtgggggctcaacgactatgccaaacgccgcgcccgcgacctcgccgaactcggctacagcgccctggccatcgacatgtacggcgaaggcaagcacaccgagcacccgcaggacgcgatggccttcatgcaggccgcgacccgggatgccgacgccgccaaggcgcgcttcctcgccggcctggaactgctgaagcggcaaccgcagaccgatcccagccagatcgccgcgatcggctactgcttcggcggcaagatcgtcctcgacatggcccgccagggcctgccgctggccggcgtggcgagcttccacggcgccctcggcaccgccaccccggccagcaagggcagcgtcaaggccaagatcctggtggagcacggcagcgccgacagcctggtcccggccaaggacctcgacgccctgaaacaggaactgaacgccgccggcgccgactaccgggtggtgatccaggacgacgccaaacacggcttcaccaaccccgacgccgacgcgcacaaaggccacggcctggacatcggctacgaccgccaggccgaccagcgctcctgggcagacctgcaggcgttcctcaaggacatcttcgggcagggttga

SEQ ID NO: 2685 - DNA, 489 bp, Pseudomonas aeruginosa
acgaccgtctcccctccttctgcaccccactggacgaccgctggccgctgcccgtcgcgctgcccggcgtgcaactgcgcagcacccgcttcgacccggcgctgctgcaacccggcgacttcgccctggccggcatccagccgccggcgaacatcctccgcgcggtggccaagcgccaggccgagtttctcgccgggcgcctctgcgcacgcgccgccctgttcgccctcgatggccgcgcccagacgccggccgtcggcgaggaccgcgcaccggtctggccggccgcgatcagcggctcgatcacccatggcgaccgctgggccgccgccctggtggcggcgcgcggcgactggcgcgggctcggcctggacgtggaaaccctgctcgaagccgaacgggcgcgctacctgcatggcgagatactcaccgaaggcgagcgcctgcgcttcgccgacgacctggagcgacgcaccggcctgctggtga

SEQ ID NO: 2686 - DNA, 2715 bp, Pseudomonas aeruginosa
acttgcaacagacccgccggcccggcgcctgtacaccccggggggtgcggggtagcatgcgccgccccgtgttcagcgaaacatccggaacctggtttcatctctatgtcttcacgcaagatcgggctcaacctggtggtcatcgtcgccctggccgccctcttcaccggcatctgggccctgtacaaccgtccggtcagcgtaccggactggccggaacgcatctccggcctctccttctcgccgttccgcctcaaccagaacccgcagagcggccgctaccccagcgccgaacagatgcgcaccgacctggaactggtcgcccggcacacccacagcatccgcacctattcggtccagggcgcgctcggcgacatcccggcgctggccgaggcgttcggcctgcgcgtcagcctgggcatctggctcggcccggacctggccagcaacgaggccgagatcgcccgcgccatccgcatcgccaacgagtcgccgagcgtggtgcgagtgatagtcggcaacgaggcgctgttccgccgcgaggtgacggcggaacagttgatcgcctacctcgaccgggtccgcgcggcggtcaaggttccggtgaccaccgccgaacagtggcacgtctaccgcgaatacccggaactggcgcaacacgtcgacctgatcgccgcccacgtcctgccctactgggaggctacgccggtggccgacgcggtggacttcgtgctcgaacgcgcgcgcgaactcaaggccgccttcccgaggaagccgctgctgctcgccgaggtcggctggccgagcaacgggcgcatgcgcggcagcgccgaggcgacacccgcggaccaggccatctacctgcggcgcctgaccaacgcgctcaacggcgaaggctacagctacttcgtcatcgaagccttcgaccagccctggaaggtcagcgccgaaggctcggtgggcgcctactggggcgtctacaacgccgaccgcaaggccaagttcaacttcaccgggccggtggtgccgattcccaagtggcgcgccctggccatcgcctcggcggtactcgcggtactcgccttcaccctgctgctgatcgacagttcctcgatgcgccagcgcgggaggaccttcctcgccgtggtctcgttcgcctgcgcctcggtgctggtgtggatcgcctacgagtacagccagcagtacagcacctggttcagcctgaccgtcggcgcgttgctgggcgtcggcgcgctgggggtggtcatcgtgctgttcaccgaggcccacgagctggccgaggcggtctggacgcgcaagcggcgccggccattcctgccgatcaccgccgcgcaggcctatcggcccaaggtgtcgatccacgtgccctgctacaacgagccgccggaactgctgaagcagaccctcgacgcccttgcccgcctcgactacccggactacgaagtcctggtgatcgacaacaacacccgcgacccggccgtctggcagccggtcgaggcgcactgcgcgcgcctgggcgagcgcttccgcttcttccacgtcgccccgctggaaggcttcaaggccggcgcgctgaacttcgccctgggccacgtggcggcggacgtcgaggtggtcgcggtgatcgacgccgactactgcgtcgaccccgactggctcaggcacatggtgccgcacttcggcgacccgcggatcgccgtggtgcagtcgccgcaggactaccgcgaccagcacgagagcgccttcaagcggctctgctacgccgagtacaagggcttcttccacatcggcatggtcacccgcaacgaccgcgacgcgatcatcgagcacggcaccatgaccatgatccggcgcagcgtgctggacgagctgagatggccggaatggtgcatcaccgaggacgccgagctgggcctgcgggtgttcgagaagggcctgtcggccgcctacttcgagcgcagctacggcaagggggtgatgcccgataccttcatcgacttcaagaagcagcgcttccgctgggcctacggcgcgatccagatcatgaagcggcataccgacgccctgctgcgcggccgcagtcccgacggcagccgcctgacccgcggccagcgctaccacttcgtggccggctggctgccgtggatcgccgacggcctgaacatcttcttcaccctcggcgcgctgctctggtcggcggcgatgatcatcgtgcccaagcgcgtcgacccgccgctgctgatcttcgcgatcctgccgctggccctgttcgtcttcaaggtcggcaagatcctcttcctctaccggcgcaccgtcggcgtcgacctgcgcgactcgttcttcgccgccctcgccggcctgtcgctctcgcacaccattgccaaggcggtgctgtacggcttcgtcacccgcggcatcccgttcttccgcacgccgaagatgcgctccagccacggcctgctggtggccctggcggaggcccgcgaggaagtcttcgtgatgctcctgctgtggggcgcggcggccggcatcgtggcggttcagggcgtgccgagccgcgacctgctgatctgggtcgccatgctcctggtgcaatcgctgccctacctggcggcgctggtcatggccctgctctcgtcgctgccgaaaccgcgcgaggaactggccggcggcgccgagcggatcggcggttga

SEQ ID NO: 2687 - DNA, 2070 bp, Pseudomonas aeruginosa
ggtcgagcgaggcgtcgggacagccggctccgctcgcctaaacggcgtcccttcgcccgcgtttatgctttaagattccccctttccgctcgacccgctcaggatgcactccccatgaccgcctcttcgccgagtctctcgccgaccctcgaactcgcctgcgagttgatccgccgcccctccgtcacgcccctcgacgccgactgccaggccctgatgatgcgccgcctggaagccgccggcttcgccctggagccgatgcgcatcgaggaggtggacaacttctgggcacggcgcggcggcgacggcccggtgctgtgcttcgccgggcacaccgacgtggtccccaccggcccgctgcaggcctggcagcaccaacccttcgacgccctgatcgacgaccagggcatgcttctgcgggcgcggcgcggcggacatgaaaggcagcctggcgtcgatgatcgtcgccgtcgagcgcttcgtcgccgaccacccggagcacaagggtgccatcgccttcctcatcaccagcgacgaggaaggcccggcccaccacggcaccaaggcggtggtcgaacgcctcgccgcacgcggcgagcgcctggactggtgcatcgtcggcgaaccgtcgagcaccagcctggtcggcgacgtggtgaagaacggccgccgcggctcccttggagccaagctgaccatccgcggcgtacagggccatgtggcctacccgcacctggcgaagaacccgatccacctggccgccccggcgctggccgaactggcggcggaacactgggacgacggcaatgccttcttcccgccgaccagcttccaggtttccaacctgaactccggcaccggcgccaccaacgtcatccccggcgaactgaccgcgctgttcaacttccgcttctccaccgaatccaccgtcgaaggcctgcagaaacgcgtcgaggcgatcctcgacaagcacggcctggactggcacgtcgaatgggcgctgtccggcctgccgttcctcaccgagccgggcgaactgctcgatgcggtggccgccagcatcagggcggtcaccggccgcgagacccggccctcgaccagcggcggcacctccgacggacgcttcatcgccaccatgggcacccaggtggtcgaactcggcccggtcaacgccaccatccaccaggtcaacgagcgggtcctggccagcgacctggagctgctcaccgaaatctactaccagaccctggtgaggctgctcgcctgatgctgatctgcccgctctgctccgccgccctgggcgatgtcgacaacggcgtcgcctgccccgccgggcaccgcttcgaccgcgcccgccagggctacctgaacctgctgccggtgcagcacaagaaaagcctcgatccgggcgacaacgccgccatggtcgaggcccgtcgccagttcctcggcgccggccactacgcgccgctggcccggcgcctggccgaactggccgccgaacgcgcgccgcgacgctggctggatatcggctgcggcgagggctactacagcgcccggctcggcgaagccctggccggcgccgagggctacgccctggatatctcccgcgaggcggtgaaacgcgcctgccgccgcgcgccgcagttgtcctggctggtggcgagcatggcccggctgccgctggccgacgccagttgcgagctgatcgccagcgtgttcagcccgatcgactggaacgaagccgtgcgcgtcctcgcccccggcggcggcgtactgcgcctgggcccggccagcgcgcacctgctggaactgcgccagcggctctatgacgacgtgcgcgactacgccgacgacaagcacctcgccggcctgcccgcgcaactgcgcctgcgccacaccgagaccctcgagttccgcctggcgctggacagctacgacgcgcgggaaaacctcctggccatgaccccgcacggctggcgggtcaaccccgagcgccgcgcgcgaatcctggccgaacccttcgaagtcagcgtggcggtgcgctacgattggctgcaacgcgactga

SEQ ID NO: 2688 - DNA, 1548 bp, Pseudomonas aeruginosa
gaatggcgtaaagagccgctcccattgcgcctccggcacccccggcccgtcgtcctcgacatccacccggcaacgctccaggctgacccggaagctgatcctgacccgacgatcggcatgccgcagcgcattggtcagcaggttctgcaaggcccgatgcaggtagcgcggctcggcctcgatccaactgcccagctcctcaggcaccagcgcgccctcctcgcaactgaccagcacctcgcggcgcagcggggcgatctcctccaccacctggcgcaccagcgcgcccagctccaggcgctggtaggtcagcggcggcgagccctgttccaggcgtgcgtaggtgagcatctcgtcgaccagcttgtcgaggtcctggatatcgttgtccatgccctccaggtacttcaggcgggcgccgtcggtctcggcggtctcgatcatctccaggccgaagcgcaaccgcgccaccggcgtgcgcagctcgtgggacaccgcgcgaaccatctcgcgctgcaccgtcagcagccggtggatgtgctcggccatatggttgaaggccgcgcccaggcgtcccaccgagtcgccaccgcgcacctcgacgcgagtatccaggctgccgcgggcgatccgcgtggcggccgcctccaggctgcgcaggcgctgctccagacgacgcaccagcaggtaggtgatcaggccgatgaagctcaggcacagcgcgccgagcagcaacagcagctgcggcggataggggttcatctggaacagcgggcccagctccagcacccagggcgtgtcgaggatgccggcgaagatgcggatcgagtcgccgtccttgcccagcgccatcaccgtgtcgccctccaccactcgccggcgctggtcgtcgtcgaggtccagctccttgacctggagcaggtgcaccgggaagccgaagcgcttgtcgcggacgatccgcgcaaggtggtaaggctgttcgctggccgggtagcgcaccagttcgtccatcagcaggtacaccgtggcccgcgccagttgctcgctgacctgctgcacctcgccgctgagcaccaggttctcggcggcgctggcctgggtatagacggtgacggcgtgctcggcggtctgcttcaccagcacctggccgttcatcaagcgcgcgcggctgcgtccgtccatccgcagctcatccagcccgtgcagttgcaggggaatacccagcaagcggctccactgcgccagggcgcgcttgcgctcggtggcggtcatcggttgcaggttgtcggccatcaggcggaaggtgccgcgcgcaagctcctcgcggtagtgctcgccgcgcacctcgttgatccagtgcaggccgagcaggcccaggccgctgaccagcagcagggccaggagcatgccgccatagatgcgcaggaagatggatttcatcggcgagcccccggccgctgtccgctgctgttgattctggccgaccgggacgcccgcgccccggcccgcaggaaaaaagcgcctcagccctcgccgacgaacaggtag

SEQ ID NO: 2689 - DNA, 606 bp, Pseudomonas aeruginosa
tcgtcggcgcccatctccaggccgagtacctcgtccatatcgtcggtgcgcgcggtgagcatcaggatcggaccgtcgaactgcgggcgcacctggcggcagatggacaggccgtcctcgcccggcagcatcaggtcgagcaccaccaggtccgggcgttcggcgaggatacgcgccgccgccagtgcgccgttggcttcgatgtcgaccttcaggccgttgccttccaggtattcccgggtcagctcggccaggcgtcgatcgtcctcgacgatcaggatgcgccaggcttcttgctccacacagcctcctcgtatcgcggtcccggagccgccgtgcggccccctcagagcggcccgcattgtagccaatacgggggccgcgcggcagcacgcgaggaacatcttgcaaacactacatattgtgggtagggtgcgcgccccgaaaggttggggagtaggtctgcgccggtgctttccgagggcgacgaatggcattctccagcgctgccgcggcctacggacgcttcctaggactcacgcacagaagacccacactttatccacaggtttcccccagactgtcactttgcaaacaccccattag

SEQ ID NO: 2690 - DNA, 417 bp, Pseudomonas aeruginosa
acaccaacaaggacgagatcgccgtctgcaacctgggctcgatcaacctggtcaaccacatcgtcgacggcaagctggacaccgccaagctggagaagaccgtcaagaccgcggtacgcatgctcgataacgtcatcgacatcaactactactcggtcccgcaggcgcagaactccaacttcaagcaccgtccggtcggcctgggcatcatgggcttccaggacgccctgtacctgcagcacatcccctacggttcggacgcggccatcgccttcgccgaccagtccatggaagccatcagctactacgcgatccaggcttcctgcgacctggccgacgagcgcggcgcctaccagaccttccagggctcgctgtggtcgcaaggcatcctgccgatcgactcggagaagaagctga

SEQ ID NO: 2691 - DNA, 543 bp, Pseudomonas aeruginosa
agaccacctactacctccgcgccctggccgccaccagcaccgagaagtccaccatcaacaccggcaagctcaacgccgtgtcggccggtggcaacgacggcctgcaagccgccccggccgccgagccgaagccggcgccggtgccgcaggcatgcagcatcgacaaccccgactgcgaagcctgccagtgatcgcgcgtcgctgaacggcgtccgtgtcgcggccgggcaagccggactcctcgtgtgggtccggcctgcccggcgcctgacggtcgctcgtccagcgccacgctggcagcgcaaggcccctcgccagggccaggaacaatccccttcttccctccgggggagaagaacggcccggccagaccgtgccggaccaccgctttcgcgtgcacctcacgccccatatccaggccgccgagacggccgccagaccaggagagagcaagatgctgagctgggacgaattcgacaaagaagacccgaccgaagccaaggccgcgcccgccgccgcccaggccgttgcccagggccatga

SEQ ID NO: 2692 - DNA, 984 bp, Pseudomonas aeruginosa
cctcaaccagctcgtccccttcaagtacgactgggcctggcagaagtatctggatggttgcgccaaccactggatgccgcaggaagtcaacatgaacgccgacatcgccctgtggaagagcaaggacggcctcagcgaacacgagcggcgcatcgtcatgcgcaacctcggcttcttctccaccgccgactccctggtcgccaacaacctggtgctggccgtgtaccgcctgatcaccaaccccgagtgccgccagtacatcctgcgccaggccttcgaagaggcgatccacacccacgcctaccagtactgcatcgagtcgctgggcatggacgagggcgagatcttcaacatgtaccacgagatccccagcgtggcgaagaaggcctcctggggcctgaagtacacccgctcgatctccgacccgatgttccagaccggcaccccggaaaccgaccgccagttcctgcgcaacctgatcgcctactactgcgtgctggaaggcatcttcttctactgcggcttcacccagatcctctccatgggccgccgcaacaagatgaccggcaccgccgagcagttccagtacatcctccgcgacgagtcgatgcacctgaacttcggtatcgacgtgatcaaccagatcaagatcgagaacccgcacctgtgggacgcccagatgaaggacgaggcgacccagatgatcctccagggcacccagctggagatcgaatacgcgcgcgacaccatgccgcgcggggtgctggggatgaacgcggcgatgatggaggactacctgaagttcatcgccaaccggcgcctgacccagatcggcctgaaggaagagtatccggggaccaccaacccgttcccgtggatgtcggagatcatggacctgaagaaggagaagaacttcttcgagacgcgggttatcgagtaccagacgggcggagcactgagctgggattgagattctcgatttag

SEQ ID NO: 2693 - DNA, 210 bp, Pseudomonas aeruginosa
tgtgattgtcttcaagaatattcaggacagactgtcaagatagagcagcgtcaacatggaacaagccccgtcgaaacggggcttgttgatggccaactaaccggccttaaagccaggaagccccttggaagcacgccattctttaacttcctttacaactccagctgggctatcttctctattttcgttggggtagtaaagaaggtctga

SEQ ID NO: 2694 - DNA, 399 bp, Pseudomonas aeruginosa
tgccctttccatccccagcggaaccccgacatggacgccaaagctctgctcctcggcagcctctgcctggcctccccattcgccgacgcggcgacgctcgacaatgccctctccgcctgcctcaccgcccggctcggtgcaccgcacacggcggagggccagttgcacctgccactcacccttgaggcccggcgctccaccggcgaatgcggctgtacctcggcgctggtgcgatatcggctgctggccatgcatgccaatgcgaaggcacaggtccttcaggaaggtctgctcgacggtcgctacgaaggcacccgtaccctaacgttggcagcggatgcgcaactggcggcggacagcacgctcgtggtacgtcttggttgcgccgtcgccgaatga

SEQ ID NO: 2695 - DNA, 807 bp, Pseudomonas aeruginosa
ccatccaccgacccagcgaggttcgcgatgcacctgctttacccctccgcccccgaccgcagcaacgcggtcgatgaactcttcgccgaggaatatgacgcggcccgttcggcaggcttggcctgttcgctgttctgcgacgaggaactggaaagtggacgcttccgcgcccgcccggagtttccggcaaacacccaggtgctgtatcgcggctggatgctcacaccggaaaactacgctcgcctgcacggcgcgatcctcgtcgctggcggacggcccctgaccagtccacagcaatatcggcactgccattacttgccggagtggtatccgctctgtgaggacctcacgccggcgaccctgttcctgtccaggaacgccgacttcgaggcagtgttggcgcaaagcccgtggcgcgcctggttcgtcaaggaccatgtgaaatccctgaccacccagcgcggctcgaaggccaccaatgctgcggaagtgcgggaagtcctcgattcgatcgagcgttatcgaggcaccatcgaaggcggtgtatgccttcgggagttcgaggcgctgcgtgcggaaaccgaggaacgctacttcgttcttcacggccgcgctcacgggcgtctcgatgccgtcccgccgctagtggaacaggtggcacaacgtatcgattgcccgttcttttccgtcgacgtggtcgagtcgaccagtggcgagttgcgcctgatggaactcggcgatggccaggtctccgaccgcaagcaatggcccgccgcacgcttcgcggcgatgctggcacaggcatag

SEQ ID NO: 2696 - DNA, 918 bp, Pseudomonas aeruginosa
aagccctcttccgctccccgccagcctccccgcatccctcaccctagacgccccgccgctctccgccggctcgcccgacaagaaaaaccaaccgctcgatcagcctcatccttcacccatcacaggagccatcgcgatgcacctgatatcccattggatccccctggtcgccagcctcggcctgctcgccggcggctcgtccgcgtccgccgccgaggaagccttcgatctctggaacgaatgcgccaaagcctgcgtgctcgacctcaaggacggcgtgcgttccagccgcatgagcgtcgacccggccatcgccgacaccaacggccagggcgtgctgcactactccatggtcctggagggcggcaacgacgcgctcaagctggccatcgacaacgccctcagcatcaccagcgacggcctgaccatccgcctcgaaggcggcgtcgagccgaacaagccggtgcgctacagctacacgcgccaggcgcgcggcagttggtcgctgaactggctggtgccgatcggccacgagaagccttcgaacatcaaggtgttcatccacgaactgaacgccggcaaccagctcagccacatgtcgccgatctacaccatcgagatgggcgacgagttgctggcgaagctggcgcgcgatgccaccttcttcgtcagggcgcacgagagcaacgagatgcagccgacgctcgccatcagccatgccggggtcagcgtggtcatggcccaggcccagccgcgccgggaaaagcgctggagcgaatgggccagcggcaaggtgttgtgcctgctcgacccgctggacggggtctacaactacctcgcccagcagcgctgcaacctcgacgatacctgggaaggcaagatctaccgggtgctcgccggcaacccggcgaagcatga

SEQ ID NO: 2697 - DNA, 426 bp, Pseudomonas aeruginosa
cctggacatcaagcccacggtcatcagtcatcgcctgcacttccccgaaggcggcagcctggccgcgctgaccgcgcaccaggcctgccacctgccgctggagactttcacccgtcatcgccagccgcgcggctgggaacaactggagcagtgcggctatccggtgcagcggctggtcgccctctacctggcggcgcggctgtcgtggaaccaggtcgaccaggtgatccgcaacgccctggccagccccggcagcggcggcgacctgggcgaagcgatccgcgagcagccggagcaggcccgtctggccctgaccctggccgccgccgagagcgagcgcttcgtccggcagggcacaggcaacgacgaggccggcgcggccagcgccgacgtggtgagcctgacctgcccggtcgccgccggtga

SEQ ID NO: 2698 - DNA, 783 bp, Pseudomonas aeruginosa
atgcgcgggcccggcggacagcggcgacgccctgctggagcgcaactatcccactggcgcggagttcctcggcgacggcggcgacatcagcttcagcacccgcggcacgcagaactggacggtggagcggctgctccaggcgcaccgccaactggaggagcgcggctatgtgttcgtcggctaccacggcaccttcctcgaagcggcgcaaagcatcgtcttcggcggggtgcgcgcgcgcagccaggacctcgacgcgatctggcgcggtttctatatcgccggcgatccggcgctggcctacggctacgcccaggaccaggaacccgacgcgcgcggccggatccgcaacggtgccctgctgcgggtctatgtgccgcgctcgagcctgccgggcttctaccgcaccggcctgaccctggccgcgccggaggcggcgggcgaggtcgaacggctgatcggccatccgctgccgctgcgcctggacgccattaccggccccgaggaggaaggcgggcgcctggagaccattctcggctggccgctggccgagcgcaccgtggtgattccctcggcgatccccaccgacccgcgcaacgtcggcggcgacctcgacccgtccagcatccccgacaaggaacaggcgatcagcgccctgccggactacgccagccagcccggcaaaccgccgcgcgaggacctgaagtaactgccgcgaccggccggctcccttcgcaggagccggccttctcggggcctggcccatacatcaggttttcctga

SEQ ID NO: 2699 - DNA, 1629 bp, Pseudomonas aeruginosa
cctgcgtctgccacgctttcgctcgtcccggaagcggccataacaattccaatagccgacgaggactctccatgctcacccatcgcatcggtggcatccgcctttccccttccccgcagcgctcgcccggagaccgccatgactgatctccgcgatacctcccgcgacgaacgcctgctggcggcccacggctatcgccaggaactggagcgcgggctgagcctgtggtcgtccttttccgtcggcttcgccaccatctcgccggtggtgggcatctactcggtgatgtccctcggcgccatgagcatgggcccctcctgggtctgggtggtgccgctgtgcctgctgctgcagttcggcgtggcgctggtctacgccgagctgtcctcgcagtttccgctggccggcggctgctaccagtgggtgcggcgcctggtgggcgaccgcctggcctggttcaccggcttcctctacctggcttcggcgctggcctcgctgactaccgtggcctacctcggtggcttctggctcggcctgctggcgaccggcgcgccgccgtcggccaacggccaggtgctctgcggcgcgctgctgctggcgctgggactggcggtgaacctgctggggatcaacccgctgaagtacttcgtcaatgccgggatcgtcgccgaggccatcgcctccatcggtatcggcgtgctgttgctgctgttcttccgcaaccatccgctcgacctgctgttcagcggcccgggcggcacaggcgatgcggacggttcctacctggacggcgtgctgaccgcgctggcggtgggcggctgggctttcctcggcttcgacgcctgctcgcagatttccgaggaaaccaccgatgcccgcgtctccactccccgggcgatcctgcgctcgatgctggtggtgggattcaccgtgatgctcaccgccttcgccgtgaccctgtcctaccaggacatcggcgcggtggtcagcggccaggtggtcgacccggtcaccccggcggtggtggacgccttcggcgcctgggccgagcggccattcgtcgcagtggtgctgatcgccttcgtcgcctgcgtggtgtcggtgcagacctacatcggccgggcgatcttcggcatggcgcgcgacgccatcctgcccggctccgccctgctgcgccgggtcgaccggcgcaaggtgccgatggcggcgatggtctgcagcacgctgctggccagcctcggcctggccctggggctgaacgccacggcggtcggcacgctgatcgcgttcggcagcggcggtttcttcgtggtcttcctgatcgtcgccgcctgcgctctctgggcccgcctcgtcggccgctgggacccggacaagggcgccttgcgcctgggacgcgcggggctggcggtgaacgtcctggcagtcgcctggctgtcgttcgaggcgctcaacgtcgcctggccgcgggccagcctcgccccgcccgacgcgccctggttccaggtctgggcggtggtcgtggtgttctccgcgctggccgcgttcggcctgctctacatgctcatcgccaagccgcatcggcgcatcgccaccagcctcagcttcgccgctccgccggcggactga

SEQ ID NO: 2700 - DNA, 855 bp, Pseudomonas aeruginosa
ctggcgcatggccttcctgtcctcggcgggagtggtgctggcggtggccgtgctgttcttcttcctccagcgcaaccgtccgcaggacgtcggcctgccgcccgtggaggccgaggccgcgccccccgccaacgcgccccggccaagccattccggcgccctgctgaaggcgctcaggaatccccacgtgctggtcctcggcctcgcctacttcctgctcaagccggcgcgctacgcgatcctgctctggggcccggtgatcatctacgaacgcatgccggagatcggcaaggtcgcctcggccatcgtgccttcggccttcgaggtcgccgggctggccgggccgatcctcatcggcctggcctcggacaagctgttcggcgcccgccgcatgccggcctgcgtgctcagcctggcggcgctgaccgtgagcctggcgttgttcgtcccggcgatgcagagcggcagcctgtacctggtggtcggcctgctgttcatgatgggcgtcaccctctacgggccggactcgatgatcagcggcgctgccgccatcgacttcggtaccagcgaagcagccggtaccgccaccggcttcgtcaacggctgcggctcggtcggggcgatcctcggcggcctgctgccgggctacttcgacaccctcacggtgttcttcgtgttcaccgccaccgcgctgctcgccagcctgctgctggtgccgttctggaacagccggccaggcgcgtgccgcgtcgaaccgaaggcgcatgccggcgggccgctgctggcggccggcaagccgcgttgaaacctcgccgaaccaccgcccggcgccaggcgtgccgggccaatccctag

SEQ ID NO: 2701 - DNA, 864 bp, Pseudomonas aeruginosa
accccgacccggcgctgctcgggcacgcccgcgaggccggctggccagtgctggaatggcgctgagaaggcgcgccgcgctataccgccggcggcccggaagcattaccctgtagcccccccggagccccagcggagaagcgtcgatatgcgcgacgagccgtcccgccccctgacggtgatctaccagtccctgcgcgagcagatcgagcgcggcctgctcgcgcgcggcagcaagctgcccagcgaacggcaattgagcgagctgttctcgaccacccgcatcaccctgcgcgaggcgctcggccagttggaggaccagggcctgatctaccgcgaggaacgccgcggctggttcgtctcgccgcagcggctgctgtacaacccgctggtgcgcagccacttccacgcgatggtcgccgaccagggccgggtgccggagaccgaggtgctcggcgcggcgatgatcccggccagcgtcgacatctgccagcgcctggagctgccggcgctgtcgcgggtgttccagatccgccgggcgcggcgggtcgacgggcggctggtgctgtacgtcgagcactacctgaatcccgcctactttcccggcatcgagcgcttcgacctgactcgctcgctgaccgatctctacgccaaccactacggcatccgctacggccgggtgcgcttcgaaatggtcccgaccatcctcccggcggaggccgcgggaccgctgcgggtctcggtgggcagcccggcgctacagatcgtgcggatcaaccgcgaccaggcgggccgcctgatcgactgcgacctggagtactggcgccacgacgcgctgcaggtcaacgtcgaggtgcccgagtag

SEQ ID NO: 2702 - DNA, 1035 bp, Pseudomonas aeruginosa
ccgcctggcgggtttcccgccgcttccagcgcattggtcgaccgctgggcacgctgcgtcgacgctgagcggttgccgctgacggcacggcctgctaaaagcggcgacgacattcgaaaatgcgatacgaccatgagcgacagtgaaaaatcgaatagccgcctgttcgacctcgacctgctccgcgccatcgtcacggtggccgactgcggcagcttcaccactgccgccgcgcgcctgcactcgacccagtcgaccgtcagccagaaggttcgccgcttggaggaaatggccggacaccgcctgctggagcgcggcaaccgcgacgtgttgccgaccgacgccggcgatacgctgctcggctatgcccgccgcctgctggcactgaacgacgaactggccgaggcgctatccggcgccacggtggcgctgacggtacgtatcggcgtgccggacgacttcgccgccggccgtaccaccgagcgactggcggccttcaaccggcgttatccacaggtcaagctggaagtcaccagcggcatgagccgcgacctcagcgccagctacgaccgcggcgaactggacctggtgctgctcaagcagcgacgcgccagccgcgaggcactggcctgctggccggaaaagacatgctgggtggacagcgccaggaacccctgcatcgacctcgacccgctgcccatcgtcaccttcccgccgcgcggggtctaccgcgacgagatgatcgccgccctggaagcggtcggccggcgctggcacatcagcttcaccagttccagcctcagcggcctgcaatcggccatcgccgacggcatgggcatcggcctgctgccgctgcgcgcggtgagcgcaggccatgcggtgctgccgaagaacgccgggctgccggcggtggacgtgttcgaagtggcgctgctgcaccggccggcggcggatccgatggtgaaggcgctggcgcgcgtgctgtcgcgggtgctggcggaagatacccggagccgccccgcattcgaaaaatga

SEQ ID NO: 2703 - DNA, 1206 bp, Pseudomonas aeruginosa
agcgcgcgggcggcgccgcgcagggtgtgctcgcggcagagcgcgaggaagacgcgggtgtcgtcccaattcatggcggttttcctgatgcattttcgcatcagtctaatgaaaaagcgctgcgcgaccacggcatccgcgctgcttaccatgcgaaccaggtccgaaccattttcccaggagcatgcgatgagcagtacgaaccgatttcccgaacgaatgaccgccatcgagatcgcccggcccggcggccccgaggtactggtggcgaccagccggccgctgccgacgcccggcccgcgcgaggtcctggtcgaagtccgcgccgccggcgtcaacggtcccgacgtgcttcagcgcaagggcgtgtacgacccgccgcccggcgcctcggacattcccggcctggagatcgccggcatggtgcgggcggtcggcagcgaggtcagccgcttcgccgtcggcgaggcggtgatggcgttgattcccggcggcggctacgcgcagttcgcggtggccgacgagcgcaccaccctgcacctgcccgacggcctgggcatggaggaagcggcggcgctgccggaaaccttcatgaccgtctgggtcaacctgttccagcgcggtggcttcaaggccggcgagacgctgctggtccacggtggcgcctccggcatcggcaccgccgcgaccatgctgggcaaggccttcggcgcggcgaaaatctttaccacgatctccagcgaggcccagcgcgaggccagcctgcgcctcggcgctgacctggcgatcaactacaccgagcaggatttcgtcgaggaagtgctgcgcggcaccgaaggtcgcggggtcgatgtgatcgtcgatatcgttgccggcgactatgtgacgcggaactaccaggcggcggcgatgaacggacggatcgtgcagatcggcgtgatcaagggcaaggccgcagaagtcgacctgttcccgatgctgagcaagcgcctggtccatcttggctcgaccctgcgctcgcgaagccacgacgagaaaggcgcgatcatcgccgaactggagcgccaggtctggccgcacgtgcgcgccggcgctgtccggccgcaagtgttccgcaccttccccctggagcaggcgcgccaggcccacgaactgatggactccggccagcacatcggcaagatcgtcctcacgtccgctccctga

SEQ ID NO: 2704 - DNA, 1785 bp, Pseudomonas aeruginosa
ggccgctcagacctcgatatcgcccaggcgcagcgcccgcgccaccgcctgggcggtggacgccgcgccgagacggcggcgggcggcacgcaggtgattctccacggtgcgctcggaaatcatcaggatcgccgccacctccgcttgctgcttgcccagggcgatccattgcaggacttcccgctcgcgctcgctgagcgcttgcgcatcgcccgccgacacagggccgcgcaggcgcttcagggcgaagaacaggatcgggcagaaggcctgggcggcgagcttgcaaccggcattcaggtccagccgctcgccggcgaaagacaccgcgccctccagaccgttgcggccgaacaccggcacctgcatgccattgacctggccgaggtcgcggaccccacggacgatgcggtaggtcatgcgctcgggatcctccgaggggctcttcgaccagaagaacggctcgtccagttcgaggatgtgccgggtgaccggacagtgcagaagataggcgtcgcgctcctgggcgctgcgcccctcggcccagtcgccatggacgaagaacagctcgtcgatcagttcgtcctcgccggggcgggggaacaggctgcagacgatcacccggtcgaagcccaggcgtgcggcgaactccaccatctcgcggcagaccgcctcggtggtagcggccttgcgcagccgggcgacgctgtcgaagagaaggctggcgtagtcggtcatggcgcgggcattcctggctttttccgcatgatccccggcttgccggcaaaagcccataggggaaaaccctcaggcgaccgatcgtgggttaggggatttcccctatttcgccggccggcgaccccgcctatcgtcttggtgcgacctccatcacgcagaaaggaacgagccatgagcaacgagcgcgacaccagcagaaccccgacgcccgaccacgccgagcacaacgcgttctttccctcgccctattccctgagccagtacacctcggcgaagaccgacttcgacggcgccgactacccgaccccgtacaagggcggcaagaaggtgctgatgatcggtaccgacgaacgctacatcctgatgcagaacggcagcatgttctccaccggcaaccacccggtggaaatgctcctgccgatgtaccacctggacaaggccggcttcgagttcgatgtcgccacgctctccggcaacccggtgaagctggagatgtgggcgatgcccggcgaggacgaggcggtgaagagcatctacgcgaagtacctgcccaagctgaaagcgccgcggaagctcgccgacctcctggagcaggccgtcgccgacgactcgccgtacgccgcggtgttcgttcccggcggccacggcgtgctggcgggcattccgcacagccgggaggtgaaacggctgctcaatgccttcctcgccaaggaccgctacatcattaccctttgccacggtccggcctgcctgctggcaccggcggtcgaggagaagccggaggactacccgttcaaggactacgagatctgcgtgttccccgacgccctggacaccggcgccaacctagagatcggctacatgcccggtcccctgccctggctggtgggcgagaacctgcagaagctcggggtgaagatcctcaacaagggcatcaccggccaggtccaccgcgaccgcaagctgctcaccggcgacagcccgctggcctccaacaaccttggcaagctggccgccaagacccttctcgaagcgttcgcccgctga

SEQ ID NO: 2705 - DNA, 480 bp, Pseudomonas aeruginosa
tcgtcctcccttcccgccgttacggttccgggcttgcgcacaaagccgaacccaagggggcccctcatgtcactgccgccgtacctcaagcccggcgacaaggtcgtgttgtacgaccagcactgccgcttctgcacgctctggagcggtttcctggcacgccgcgccgaccaccggctgaagctgcttgccgcgcagtccgccgaaggcctggcgattctcgattggttcgggctggcacccgatcatttcaacacctggctgttcgtcgacggcgcctacgcctgcgacgacaacgatgccctgctcgaggtgctgcgcctgttgccgggcccctggcgtcacctgcgctggctgcgcctgctgccagcctggctgcgcgacgagtgccacgaggcgctacggcgcaaccgctggcgctggttcggccgccagcgcccaccccttcgtcgtcgctcctggcgtccccgtcgagcctga

SEQ ID NO: 2706 - DNA, 417 bp, Pseudomonas aeruginosa
cgcctctccgcgctggccgtggcgggttatgctgcctgcgcaccagcctgcggacccatacttgccatggcccttgacccgagccaacgccgacgactgcgccacgcgctatccgacgccttcgtcgacactctcctggagcccgaggatatcgcccggcggataaagggcgtcgacccggcgttgctggagcggttgttcttcgaggaagtggcgccggtctgccacggcaacctgctcagccccgctccggcggtatggaccgccttcgacgaggcctggctggaagaggccatcgagcgacgcctggcgcggcaaaggagctgcgccctgcgacgctggcacgagcgctgcctggtcgcctggctgcgatggcgatacgccgacacctggcgcgcgatcgccggcgctctttga

SEQ ID NO: 2707 - DNA, 1488 bp, Pseudomonas aeruginosa
aatccctttgctcgcgacaggaggaaaatatcgttaggaaacaacgttgagaggccggcaaggatacccgactggcgcacgggtcgcatcattatgacatcacgccgcccgccggcgttgccgcgaccgttcgtcgaacctatgaattccggcagtttcccttgccctcgctggcgtcccaggatcaggatttcctgtgttcgccgggaggatcctggcgtgtccatgaccagcctctgcccctccgccacgcgggaacacggtcccggcgcgaaacgcgtcctgcctctgctgttcctcacctgcctgctggatgccgctggcgtcggcctgatcgtgcccctgctgccgacgctgatcggcagcgtggcgccgctggcggtccgcgacgcggccacctggggcgccgccctggtgatgaccttcgcgctgctgcaattgttcttttcgccggtcctcggcagcctcagcgaccgcttcggacgccgccccgtcctggtcctggcgatgctcggcttcgccctcagctatctgctgctggcgctggccgacagcctctggatgctgttcctcggtcgcgcgctggccgggctcaccggcgccagcgtggccaccgcgatggcctgcgcggctgacctcggcacgcacgggcagcgcacccggcacttcggctggctgtacgccggcctcgctctgggcatgatcctcggccccgccctcggtgggctgctggcggtgcacggcacgacgctgccgctgttgctggccgccggcctgtgcctgctcaacgccctgctcgccggcctgttcctcgaggaaaccctgcccccgacgcgacgccgccgcctggacccgaggcggatgaatgccttgcgctcgatcagcggcctggctcggcaaccgggggtcggactcctgctggcggtgcttgccctggtattcctcggcttgcaggcggtgatggtggtctggccgttcttcgtgatcgagaagtttcactggagcagcgcctggatcggctactcgctggccctctacggcgtgctcgcggtgctcgcccagaccctcggcgtgaacctctgcaagcggcgcctggacgacgcccgcctgctgcgcctgggcctcgccctgcaaggctgcggcctgctgctgttcgccctggtcgactcgtcattctggctggtctgcgcgctgctgcccttcgcgctcggcagcctcgccaccccggccatgcaggggctgctctcggcccgcgtgccggtcgaccgccagggcgagttgcagggcgtgctgagcagcctgatgagcctcgccgcgatcgtcggtccgccgctgatgagcggcctgttccactggggcagcggtccgctcgcgccagtgcccctggccggcgcgccattcctcgccggcgcccttctcgttctggccgggctggtcctggcctggcaacttcgacctacgggagaagaacgatcatggaccggatag

SEQ ID NO: 2708 - DNA, 405 bp, Pseudomonas aeruginosa
acatgggcgtgctggtggtgctgttcaatcctggcgacgacgacctggaacaccttggcgaactggcggcggcgtttccgcaactgcgcttcctcgccgtcgacaactcaccgcacagcgatccgcagcgcaatgcccggctgcgcgggcaaggcatcgccgtgctgcaccacggcaaccggcagggcatcgccggcgccttcaaccaggggctcgacgcgctgttccggcgtggcgtgcagggtgtgctgctgctcgaccaggactcccgtcccggcggcgccttcctcgccgcccagtggcgcaacctgcaggcgcgcaacggtcaggcctgcctgctcggcccacggatcttcgaccggggtgaccggcgcttcctgccggccatccatctcgacggactga

SEQ ID NO: 2709 - DNA, 396 bp, Pseudomonas aeruginosa
tcctcttcggctcgtcccagggctgagccgcctcagccgggaaacgcccggcgcaacagttcgggcagcacctcgccggccggaccgacgagacagtgttcgcgcggatggcgggtgcgcaccggttgcgggttcacatgcacgacgctggcaccgtgttccagcgccagtccgggtatccgcgccgccggctgcaccacgccggaagtgccgacgctgagcaacaggtcgcactcgcaggccgcggcgaaagcctcgcgcagcgccgcctcgggcagcgcctcgccgaaccagaccacacccggccggacctgtccgccgcaggccggacaacgcggcggctcgatccgtcgtccctcttccggctcgaccgaatcgggcaaggcgtcccggtag

SEQ ID NO: 2710 - DNA, 1866 bp, Pseudomonas aeruginosa
cgcgcccagagaccgccaagggcatcgcggaaggtgggaatcccgctttccgccgacaccccggcgcccgtgaagatcaccaggcggcgggcgccggcgagcagttcgacgacagcgcgcatctcgctcctccgcttacagcgcggacaacgcgcggtattcgtcctgggcatgctggtcggtcatgccgctgacgaaatcctggagcatgcggcagcggtggtagaactcccactgccgctgcaacgggttctccgccacacctttcatggcctccaggtaagccttgatctgctggctcggcaggcgccgaaccagcagttgcggatgcggcgcggcggcctggcgaccttcggcgagggcctggaactcctcggccggcaggcgcagcagcggcgcgtagaaatccagcaggccctggatgatgcggtagccctgcaattccagggtttccacctccggatggcagaacacccattccatggccacgtccttgaacgtctggacgatggcgtgcggcaggctgccgtcctccatcagcgcgcggccgagggtgccggcatgaaccgcttcgaggttgtcgatgaactgctgggcggcgtgctggaccagcgggtggatcattttcacccgcaggcggatgaagaattcgctgaccttgttgatcggctcccgctcggccttttccagcgagtagtcgaccatccgctggaagctcatgttgtccgcgtcgccgggaatcggtgcgtccggcgaatggtggacggcaaacttcttcaccagcagatccgccaattgacggatgtcgaggatgcctttttccaccgagtcttcgatatcggccaggcaataggagatatcgtcggccgcttccatgatgtaggccacagggtggcgagtgcccgggcgcatgccgaggacttggcgcagttcgtcgacgaaggcttcctcggaaagatagaagcccggcttcttgttcaggtagtggttcgccgctgccttgtccggcttcggctcgtaggccgggcgcacgtacttgagcaggccggcggtctgcgtgtaggtgaggttcaggcgcagcagcttcaccaccaggcggatggcctgggcgttgccttcgaagtgcttgaggtcggtgagcatgcgctgctgcaacaggccgtcgccctggcccggcggtatgcggcgctcgaacagggcgtcgaggttgcgttcgaaccagtcgttgatggcgtactcgccgaaatgaccgaacggcggattgccgacgtcgtgcatcaggcaggccatttccaccaggctttccagcgcgccttccagcccgtccaggccgacctctgcggcacgcgggcccagttggcggaacagcgtgcggacgatgaaacgcccggtctgctgcacttccagggaatgggtcaggcggctgcgcaccgccgcgttgcgctccagcgggaagacctgggtcttctgctgcaagcgacgcacggcggcggaattgacgatgcgcccgcggtcgctttccaactggtagacgatgtcttgcagatcggtattcccggcatgtccgtaggtttccctgtcatgcggacgctggcgggatatccgctccttgaaatccacggcccctggcatctggcgctgttctccactcggtcggctgcgaaccccgagcctagcgcgtggcggcggtttaaccaaggtcgcgacaatccgtcccactaccgttcgcgatcccccctcttccccgggcggcggcaactggcagaataccccgctcggcaccagcgacccccgccgcagaacgggggcgccgccgatcatgcgtgcgcccagagaaacaggaacgttcagggaggttccgcatga

SEQ ID NO: 2711 - DNA, 1983 bp, Pseudomonas aeruginosa
caccgaacggctttctttcccggcacatccggtaatattcgccgcacaccgactacactggccagtcgtgccaccccgctacgttttcctggaggaaacctttttgccttcgttgcccaccttgcagcccctcgacctctacaggcgcaccctggcctgcctggtcctggcggtttcctgcctgggcggcggaggcctgtgggcggacgacgcacggacgtcggtcgagcaacgcagcaatgcggtcagccaggttctgctgggcatattcagctacgtgcgctggccgaaggagccggcggtcctgcaactctgcgtggtcggaccgaccgagtacgccgacggcctgctccgcggcatggtgcaggccaatggcaggcgcgtgcatgcggaacgccgcgcggtggacaacccggacctcggcacgctctgcaacgtgatctacctcggagtggtcgacgagcgcgagcgccagcaggtgttccgcagcctggccgggcatccggtcctgtccatcagcgagcgtggcaccgaatgcagcgtcggcagcatgttctgcctcaacgtcggcggtccgcgcatcaccttcgaggccaatctcgactccatcgcccgcagcggcgtacgcgtgcacccgagcgtattgaaactggcaaggcggcaggccactccgtgatgaaccgtcgtcgtcgctatacgggttccaatccatcgctgcgccgggtgctctatcgcgcgcacctgggcgtggcgctggtcgcggtattcaccgccgggctggcggtgaccctggtcggcctgctgaccctgcgcgcctatgccgaccccaaccagcaactgatcgcccgttccatcagctataccgtcgaagccgcggtggtcttcggcgatgcccaggccgccgaggagtccctggcgctgatcgcctccagcgaagaggtctccagcgccatcgtctacgaccgccagggacagaccctggccagttggcatcgggaaagcaccgggccgctgcacctgctggaacagcaactggcgcactggctgctcagcgcgccgaccgaacaaccgatcctgcacgacggccagaagatcggttcggtggaggtgaagggctccggcggcagcctgctgcgcttcctgctcaccggtttcgccggcatggtcctgtgcctgctgcttaccgccctgggcgccttctacctgtcgcggcggctggtacgcggtatcgtcggcccgctcgaccaactggcgaaggtcgcgcataccgtgcgccgcgaacgggatttcgagaagcgcgtaccggaagccggcatcgccgagctgagccaactgggcgaggacttcaacgccctgctcgacgaactcgaatcctggcaggcgcgcctgcaggacgagaacgcctcgctggcgcaccaggcccaccacgacagcctgaccagcctgcccaaccgcgccttcttcgaaggccgcctgagccgggcgctgcgcgatgccaacgagcatcgcgagcaattggcggtgctgttcatcgacagcgaccgcttcaaggagatcaacgaccgcctcggccatgccgccggcgacaccgtgctggtcaacatcgccatgcgcatccgtgggcagttgcgcgaaagcgacctggtggcgcgcctgggcggcgacgaattcgccgtcctgctcgcaccgctggcgtccggcgccgacgccctgcgcatcgccgacaacatcatcgccagcatgcaggcgccgatccggctcagcgacggcagcacggtgagtacctcgctgaccatcggcatcgccctctatcccgagcatgcggataccccggcggcgctgctccacgacgccgacatggcgatgtacatcgccaagcgccaggcccgcggcagccggcgcctggcggaactcaacgacccccgcatccttcaggaagaaaaggagatagacagtgctaccccagaggctccacccaagtag

SEQ ID NO: 2712 - DNA, 429 bp, Pseudomonas aeruginosa
aatatccggctacccgcccgccatcccggccggcgcggcccgtcaggaaactccatgaaactcgataaagcggcagccatcgcacagctcaaccaggccttgggcatgtccgtgctggatgccggcaacaccctgctcgcccgcttcaacaagagcaagaacgtctggtggttcgatattccgctcagccaactgaaggccggcaagttcctcaacctgctgctggcgaacccggccggcgatgcagtggagcacctgaaggtgcccaccggtttccttcgccagcagcaggacagcctggaactgcgcgacaagaacgcccgccggccgaccctcagcctggagctgagcgcggaccccggcaagcgcctgcgcgacgtccgccccggcggcgctggcctggacttcgccccgttcctccagccctga

SEQ ID NO: 2713 - DNA, 459 bp, Pseudomonas aeruginosa
tcggcaatgccgaactggtcggcgcggtcgggcgcatgccggaaccttccgacctcaagtacctgctggatccgcagttcgtcagcagctccacccagggcggcggcctcgcccacctgccactggcgctcggcctcggtggcgcgacattgctttgcgtgctgctctggcgtcgccgcggtccgcgcctgccgcgctatgcctacgcgctgccggcggcgttcctggcggcgcatgtcggcctgcaatacctgcgtccgagcgatgccgaccaatggcagcagtacaacctgccgcacaagctgctggccagcgcgctcagcagtggccaactggcggtcgaagactggctcgccgacgaccgtccggacaccccgccggacgtcgccgggctcaaccagctcgacctttccggaacgccgctgctggccggcggagggcgcgcgcgcaacgtcctga

SEQ ID NO: 2714 - DNA, 345 bp, Pseudomonas aeruginosa
ccaccccggactacgtgctgcacagccaccagaccatccgcggcctttacgccatgctctgcggcgactacagcaagctcgactcgggcacgccgaagggcgtcgagctgctcaacaacccggcccgggccagggagtgcttgcccgcccagctgcgccagcacggtttcagcacgcacttcctgcagggtgccggcctgcgcttcatggccaaggacaaggtcatgccgcatatgggcttcgacaagaccctcgggcgcgactggttccgcaacacgtcctacctggagtttccctggggcatggacgacaaggccttcttcgagggcgccgcgacctacgtga

SEQ ID NO: 2715 - DNA, 417 bp, Pseudomonas aeruginosa
agatccgcgccttgcagtatggaccgcaacggcgcccgggtgacgctgaagaccaaggaattcgaacgcgacgttcccataccggtaccggacatcccgcgcctgctcaaaggcaagccgctggacatgagcttcaccttcgacaacccggaagcgcgcaaggccttctccttccacttgctcgccgagggccgcgggatcatcgagatcagcgacttccacgtggtcacggcggccaacccggaacccgtggaaagccgcagccaggtcgccgaagcggcgaaggaacagccgctgctgagcaccctgaaaagcctgttcgccaaccgccccgaaaccgaggaagcggaacgcgcggacgcccctcgggagcgcaccgtcatccccgagcagaaggccctgatcctttcgcactga

SEQ ID NO: 2716 - DNA, 2133 bp, Pseudomonas aeruginosa
gcgagcggacgaaaaggccatctgcgcgaaccgggcgctgaacgacaaggacgtcgagatgagcgtcaagtaccacttcctccgcggcctgttcgccatgggcggccgcggcgccatgcaggaccggcagcaggactggctgcgccagcgccggcgctgcggtggcgacaccgactgcctctcccgcgcctacgcgcagcgtatcgacgagctggacaagcagtacgcgggcatcgacaagccgctctgaagctagcgtccgccggcagcgaactgcagttccgccaggcgcgcatagagcgggttctcggcgatcagccgggcatggctaccaatggccaccagccgcccctggtcgatcaccgcgatgcggtcggcgctctgtaccgtggccaggcgatgggcgatcaccagggtggtacgtccgctcatcaggcctggcagggcctgctggatcaggtgctcgctttccgcatccagggcgctggtcgcctcgtcgagcagcagcaccggcgcgtctaccagcaacgcccgggcgatcgccaggcgctggcgctggccgccggacaggccgatgccgccctcgcccaggtgggtggcgtagccctgcggcagacccaggatgaactcgtgggcatgcgcggcacgcgctgcggcctcgacctcggcggcgctggcatgcggacggccgtagcggatgttttcctcgacgcagccgaagaacagcgcggggttctgcgacaccagggcaaagctgcggcgcaagtcggccgggtccagttcgacgatcggctgtccgtccagcagcagccgtccctgctgcggatcgaagaaacgcaggagcagatcgaacagggtcgacttgccggcgccggaaggtccgaccagggccagggtttcccccggttcgacggccaggctgatgtcgtcgatggcccagtgttcgggacgggtcggataggcgaagcgcaccgcctgcaattcgatcctcccgctcacccgtgccgccagcttgcgtggttgcgctggcgggcggatctcgctgcgcgccctgagcagctcggcgatgcgctctgcggcgccggcggcgcgctgcaattcgccgatcacctcgctgagggtgccgaaggccatgccgacgatcaggctgtagaagacgaacgcggccagttcgccggccgagatgctgccggcgatcacgtcgcggccgccgacccagagcatgacgccgaccgcgccgagcaccagcacgatcaccacggtgatcagccaggcgcgctgggcgatgcgcttgcgcgcggtgtcgaaggcgcgttcgacggtgccggcgaagcgctggcgatcctgcgcctggtggttgtaggcctgcacggtcttgatctgaccgagggtttcaccgacgtagctgccgacgtcggccacccggtcctggctttcccgcgacaggctgcgcacgcggcggccgaacagcaggatcggggcgatcaccagcggcaacgccagcaccacgatgctggtcagcttggcgttggtgacgaacatcagcagcaccccgccgaccagcatcagggcattgcgcagggccatcgacagcgaggaaccgatcaccgtctgcagcagcgtagtgtcggcggtcaggcgcgactggatctcggagctacggttggtttcgtagaaaccgggatgcaactcgatcaggtggtcgaacacgcgcttgcggatatcggcgacgaagcgctcgccgatccaggacaccaggtagaagcgcacgaaggtgcccacggccaggccgagcaccagcacgaagaacagcaggatgtagcgattgagcaattcgggcgaggcggtgaggaacccctggtccaccagcaggcggatgccctggcccagggacagggtgatcgccgcggtgaacagcaacgccaccagggccccgagcatgcgccagcggtaaggcgccatgaagcgccaggccaggcgcagggcgatacgttggcgggaggagagaatggctggcatgcggcgctcgctcggcggctggggttccgcaggttagcaccgggaacgcagcgaggcgatgcatgccccggccggcagcgcgatgatatcgacgtatatatccgggcaacttag

SEQ ID NO: 2717 - DNA, 447 bp, Pseudomonas aeruginosa
cccagggcgtgggcgacctcggtcaccgagcggccttcggccaggcgcctccgcgcttcgaacaaacgcgcctgggttcgccagcgggagaaacccaggccggtctgctcggtgaacagacgcgccagggtccgcccgctggcgccgacctcacgtccccacgcctcgatgctccagtccagcgcgggttgcgccagcagcgcctcggccaccttcagcgcccgcgcatcgcgcggcatcggcaggctcgcggcgtgtgccggcgcgctcgccagttcatcgaacagtgcgcgcaacagcgtcaggtgcggcccttccaattgcaagtcggctgcccagccggtcatgcgcaggatcagttcgcgcattagcggcccgacttcgaggacctggacgctgtccggcagctcggcgaacgccgagggttcgaagtacaggctacggtag

SEQ ID NO: 2718 - DNA, 1206 bp, Pseudomonas aeruginosa
ccgtcctcgccctcccctgctgctggtgctcgccctgctagccctgccgcaagtcgccgaaaccatcctttcccccgcgctgccggccctggccagccactggcgactggacgacgctaccagccagtggaccatggcgctgttcttcgtcggtttcgcccccggcatctggctctggggctggctggccgaccgcctcggccggcgcccggctctgctcggcgggctcggcctggcggccctggcgaccttcggtgcctgggccagtaccgactattcctacctgcttgcctgtcgcctggtccagggcctcggcctggcgacctgctcggtgacggtgcaggccagcctgcgcgatgtgctgcaaggcccggcgttgatgagctatttcgtcacgctcggcgcggtgctggcctggtcgccggcagtcggccccctcggcggccagtggctggccgacctcggcgggcacccggcggtgttcgccaccctggcggtgctgctcgcctcgctggcggcgctggtcgtcccggcctggccggaaacccgtccgctgctggcgggcacgcccgagcccgcgaccctggcgatcttccgacgggtcctggccgaccgcccgctacaaacgcgcgcactgctggtggcggtgctcaatgtgctggtgttctccttctacgccgccgggccgttcatggtcggcgacctgcccggcctgggcttcggctggatcggcctggccatcgccattgccgggagcctcggtgccttgctcaaccgacgcctgccgcgcacctggaacagcgctcgccgggtacgcctgggcctggcgctggcggccgccggcgcgacagcgcagacgctgttggccgccgtcggatacgccgaaggcctgtactgggcgctgccagccctgccgatcttcatcggcttcggcgtggcgattcccaacctgctgggtccggcgctgcacgcctacgacgattgccggggacgcgccggagccctgttcgggctcgcctactacctgctgatcggcctcggactgggcgcgtccaccctgctaccgttcgaccgtccctggccgctggccgcgtactggagcctgctgggcctggtcgcactgctgctggccaggcggctgccggaatgaaagcggcgccaggtacgcccgtgcaaaccggacgaccggcccggaaagccggatag

SEQ ID NO: 2719 - DNA, 2235 bp, Pseudomonas aeruginosa
tggcacagcgcccatgcggacccgcagaacgtggccagaacgacgctcgaatcgatccagcacgccatcgaggtgaattcgtccctggcccttcccatcgccctggagaatctctcgcgtctgacccacctcgcgctgctgaccgtccccttcaacctgatccacatcctggtgttttccctcaaggacttccgcccggacctcggccatcagctctggcgccaggaaatcatgtacgcccatggcgccatggccctgctcttcggcggcatcggcctgctcgcgctatggctgcgccgccagccgcccaagctgtggcgcatgcgcctgctgatcctgctgggcggcgcagggatcataggcttcggcgtcgccatcgcctgcatcgaccagcgcatcaccagcaacatcacgccgctgctgctggcctgtttcgcctgcgccatgttcatcctgatccgcccggcctacgcggtgcccttctacggtctggcgatgctggccttcgaggtggcgatggaccacgcccaggccgacccgcaactgcgcctgtcgaaccaggccaacggcctcaccgcgttcggcctcggcctactgctgtcgctgatcctctggcacggccacgtgcgcaacctgcgccagcaacgcaagctggagttgcagcggcaggagctggaggagaagaatcgccagttggagtacctggccggtcacgaccccctgaccggcctgttcaatcgtcgcgagttcgaccagttggtgctcatggagctcgcgcgtatcgctcgccaaccgcagccgctgagcctgctgatggtcgacctggatcacttcaagtacatcaacgaccgctatgggcaccccttcggcgacgaggtcatccgccatgccgccaacctgctgcgcggcaatacccgtagcagcgacagcgtggcgcgcctgggcggggaagaattcctcctgctcctgcccgacaccgccgagcagcaggctcgcagccttgcggaaaaactccgcgaacgcctcgaaggtaccccgctggcgacgcaggacggcgtgctctgcctgaccgccagcttcggcgtggccagcctcgacggaggcggccaggccagctacgagcagctctacagcgccgccgaccaggttttctaccgggccaagagcagcggtcgcaaccgggtggaagtgattcgcctggccagcctcgcggaaaagcctgcggtaacaattgatcggccggccctgacgagcggtcggtcagccgcccgaaccttggttaagatggtccgtggcgctctagctcgccgctcttcctgcccttccgacctgcccgacctcgcccggccccatgccgcggccttgccgttggcgtcgtgcgggaagaccggcgcagcgccgttgtccgcattaccgggggagaaccatgctcaagcacctgctcgtgctcacctgtgccctgctcgccagttcctcggccctggcccaggtgatggcccgcgacctgggcgatttcgaactcaagctggccaccagtccgacccgcagcatggcccagggcctggtcaccccgggcagctccggcagtttccacggcggcctcgacctaagccacgaaagtggctggtacatcggcaactggacctccaacctcgaccccggcaagcccaccgagatcgactcctacgccggcttcaagcgcccgctgaacaaccgcctgggctacgaaatgggcctgatccgctacagccgcccggagcagccagccaacgacgcagccgaactctacggcggcctgtcgatcttcggcagccggctcggcgcggccctgagcagcgacccggggcgcaacgacaccaccctgttcgccgacctcggggtcaacccgccgttcggtttcgacgtcaccctgaagtacggcaaccatcgcctggacaacccggcgagcctcagcggcgggggctacgtgagcgtcttcaacgactggtcggtgaacctctcgcggccctggctgggcatcgacctgaacctgtcctacagcggcaccagcctgaccggcagcgattgcagcgcctactcgggacacaacagctactgcgacaccacattcatgctgaaggcgtcgcgtccgttcttctgagtcgtcagtcgtcctggcggcgggtacgctgggcgagttcgtcgagctgtttctgctcgcgcttgtcctcggcctggcgcgcctcttccaggtag

SEQ ID NO: 2720 - DNA, 1728 bp, Pseudomonas aeruginosa
cgttccagctccgccagcttctgctgtgccgcgagcaattgctgctggcacctgcccagctgggtcgcggcatcccgctcggccttgctggccatgtccaccaccggcgccagccgcgccgcgcgcttctccatgcctcagcgcgcctcaggcctgcccgccggagagcaggctcgccagccgcgcacggctttccgccaggctttcgctttcgtcgaggccctggcgcaggaactggcgcatgaccgggaagcgagcgatggccaggtcggtctcgggatcgccgccggccacgtaggcaccgacgctgatcagatcgcgactctgctggtagcgcgaccagagctgcttgaagcgctgggcgtcgcgcaggtgctcggcctcgaccacctgcggcatcacccggctgatcgaagcttcgatatcgatggccggatagtggccttcctcggccagccgccgggacaatacgaagtgcccgtcgagcacgccgcgagcggcgtcggcgatcgggtcctgctggtcgtcgccctcggagagcacggtgtagaacgcggtgatcgagccgccaccggcttcggcattgccggcgcgttccaccagcttcggcagcttggcgaacaccgatggcggataccccttggtcgccggtggctcgccgatggccagggcgatctcgcgctgggcctgggcgtagcgggtcagcgagtccatcagcagcaatacgttcttgcccttgtcgcggaagtactcggcgatccgcgtgcagtattgcgcggcacgcaggcgcatcagcggcgcgtcgtcggccggcgaggcgaccaccacagagcgcttgaggccttcctcgccgaggatctcgtcgatgaactccttcacctcgcggccccgctcgccgatcagaccgacgacgatgatgtcggccctggtgaaacgggtcatcatccccagcagcaccgacttgcccaccccggtaccggcgaacaggccgaggcgctggccgcggccgaccgtgagcaggccattgatcgagcggatgccgacgtcgagaggttcgctgatcgggtggcgcttgagcgggttgatcgtcgggccgtccatcggcacccagtcttcggcgcgcatcccgcccttgtcgtcgagggcgcggccggcgccgtcgagcacccggccgagcatcgacatgcccatcggcaggcgcccggtgtccggcagcggcacgacccgcgcgccgggcgcgatgccggcgaggctgccgaccggcatcaggtacaccttgctgccggaaaagcccatcacttcggcctccacctgcaccgggtggtagccgctttcgttgatcacgttgcagcggctgccgaccgcggcctgcaagccttcggcttcgagggtcaggccgaccatgcgcagcaggcggccctcgaccaccggctgcgccggcagcgagacagcctcggtgtagccctccaggcgcctggcgaaactggttcgctcaaggcgcatcgacgtctccgggggcgtcgaggtcgatccggatgtcgctggccagcggatgggtcgcctgttcgcgctgttgctcgaacagttgcttcactgcctgcgccaggcgcgtctcgatggtcgcgtcgatgcgactgtgctcggtctcgatgcggcagccgccgggcagcaacgaatcgtcctcgagaatccgccagctctcttcgtggcgctcgcgcagcgccttga

SEQ ID NO: 2721 - DNA, 585 bp, Pseudomonas aeruginosa
cggtctccagctcgacctcttccaccgccggcggcgccggcgcgggttcggcgaccgcgggcacctgcggcgcggcaacggccggctcgtcgcgcggctcgtcgaagctcggcaacgaccagaggccgaaggccgccacgtccttgccgcggatcagttcgctgggattgtctttgtccttgtcgtgggggaccacctcagatcatctcctcgccacccttgccgcccagcacgatatcgccggactcggccatgcgccgggcaatggtgaggatttccttctgcgcaccttccacttcgctgacccgtaccggccccttggcctccaggtcgtcgcgcagcagctcggcggcacgcttggacatgttcttgaagaccttctcgcggatcgcctcgtcggagcccttgagcgccagcaccagtacgtccgaggagacttcccggagcagcgcctggatgccacggtcgtcgacgtcggcgaggttgtcgaagacgaacatcaggtcctcgatctgtccggacaggtcttcgtcgacctcgcggatcgaatccatcagttggccttcgatggagctgtcgaggtag

SEQ ID NO: 2722 - DNA, 495 bp, Pseudomonas aeruginosa
cgcagggtccgcgggctgatgccaaggcgctcggcggcctccttgcggcggccgcgctcggtgcgcagggtatcgatgatcacctggaattcgcggcggcgcaggtcgtcgcccagcgcgccgctagcgtcctggcctgcggccggcgacggaatctcgacgctcggcggggtggccggtggcattgccggcatgggcaccggcaccggggccgcgagcggcatgccgatcggcgcggtgaggcacaggtcggcgggctggatcaggccgccctgttgcaggatcaacgcacgctggatggcgttgtcgagttcccgtacgttgcccggccaggcatgccggaccaggcactgggcggcctcggggccgagcgccaccgcgccgaggttcatcttgcggctgtgcttgcgcagcagacgctcggccagcggcaggatgtccgcagggcgttcgcgcagcggccgccaggccagcgggaagaccgacaggcgatag

SEQ ID NO: 2723 - DNA, 1575 bp, Pseudomonas aeruginosa
ccgcccagcagcagggtgtcgctgagggcttcgcgtactgcgcggtcgtcttcgaccagcaggattttggctgccatggggttactcctgaatcgcagaaagaggcgccgccggaatcagcggcaggatcaaggtggcgcaggtgccgcgccccggccgagagcgcaactgcaattgcccctggtgggcgcgcgccacggccttgaccaccgccaggccgagcccggtaccggtggtcttggtggtgaagaagggttcgcccaggcgcgccagggtcgccgggtccatacccggtccgttgtcgctgacgctgaggcgcaggctgtcggcgcgggcatagagatgcaccttcaggcgcagttcgggcccgcaagcctggatcgcgttctccaccaggttgagcacggtgcccaccagggtgtcgcgattgcacagcagctcgccgccgcgcgcctcgcactgccaacgcacctggagcccctggacatggacttcggccgccgcgcgcaggctgtcgaacagcgccttcggcgccacccggtcggtcagtggcagctcgccgcgggcgaacaccagcatgtcgcgtacctgatgctccagttcgtgcaggcgctccttcaggcgcccggcgaagcgttgctgctggtcggtcggcagcgcctgctcgctgaggtgcccggcatagagcaacgccgccgacaacggcgtgcggatctggtgggccagcgaggcgaccatccgccccagcgccgacaggcgctcgtggcgcgccagttgctcctggagacggcgggtatcggtgaggtcgttgagcaggatcagttgccccggttcgccgttcagcgagcgggtggcgatggacaggcgacgtccgtcgcgcagggaaatctcgtgaccgtcatcctcgcgcggagcgaagcagcgggcgatcacctcacgccagagcatgcccaccaacggctcgccaagcaggcccagggccgccgggttggcctcgcggaccacgccatgggcatcgatgacgatgacgccgccgggaagcaggtcgagcaggctctgcaagcggttcgccaggcgctccttttccgccagctcctccatgcgctgcgcgctgaccagggccagttgccctttcagctcggtaacgcgctcctccagcaggctgtaggactcgctgagctggctggacatctggttgaacagcgcgaaggcctgctcgaggccggcgcggctggtggcctcggccgtatcggctggctgctcggggaaggcgttgagggctggttgcattgcgtttctctcggtcggcgcgacgtcatggttctgtcggtcgacggagatatagcaatacccgtgcctaaatttttttcatttgaaaatcaaagcgttgcgaaacgacctgtcaatcatccgacaggtcgtcgtcgcgccggctcatgccgtacttgcgcatcttctccaccagcgtggtgcggcggatgcgcaggcgttcggcggcccgcgcgaccactccgccggcatcgtcgagggcctgctggatcaggccctgctcgaggttggccaggtagtccttga

SEQ ID NO: 2724 - DNA, 597 bp, Pseudomonas aeruginosa
aggcgcccttctcgtggccgaacagttcgctttccagcagttccgccgggatcgccccgcagttcaccgggacgaagggcccctcgcggcgcttggaatggtaatgcaggttgcgcgccaccacttccttgccggtgccggactcgccgaggatcagcacgctggcatcggtatcggcgacctgctgcatcatctgccgcacctgctggatcgcccggctggtgccgaccaggctgcggaacaggttcggctcgcgggagcggccgcgctcgcgggcctggtcgtacatctcgcggtagacctgggcgcgatgcagggaatcgagcagcttgttgtagctgggcggcatctccaggctggcgagcacccggcggcgcagctcctccggccagtcggccggggccggctcgccgatcagcaggatcggcaggtactcgtcccaactggccagttgcttcagcagctctaccgccccgcccttcgactcgacgctgccgagcagcacgcacagggcttcgcgactgttgctcaggcccgccgctacctctcgccaatcctcgctgttgcaggtcagctgatcttcgccgaggaagttga

SEQ ID NO: 2725 - DNA, 372 bp, Pseudomonas aeruginosa
ccggcgtcctcgtgcgaacgcccttcgaaggcccgcccggccggtccgcacaaaccgagcagccagccggcgtggcagacccgtccgtccgccgccaggagcttggcgcctaccgcgccgacttccggacgctggccatggttgagtaactgctgcagccagtccttgtcgaggatgccgctgccggcatcgagccagagcaggaattcgccgcgcgcccgggacgccgccaggttgcgcagagccccacgggacaactgcccatcgcctcgcagcacccgcacctgctcgacacccatgccttcgacggcgagcagccattcgcgaacgtcggccgcttcgccaccctgttccagcagaaggatctcgtag

SEQ ID NO: 2726 - DNA, 1287 bp, Pseudomonas aeruginosa
gccagctcgaaagcctcgccggcggtctcgtcgaatccgcccgtggcaagcagcggctcgcggcggaacaaccagtgccgggacagcccggcggggaaactgagcagaaggtcgagattcaggtccgggcgcaacgccgcgcccagctcgccgtcatccaggcgcatgagttcgtcggcgtacaccgcctggcagctctccggtgccgccagcaggtccagcgccgccaccagcaggccgctgacagtgaattcgacacccgcttcgaccaggagcaaccagtcggtatcaagccgggcaagcgcctggttgatcgtcggcaccggccccacctctggatcgaagagcatcgctccgttccgcggactcgtgcccagcggcgcgaacaggtggctctcgacacgtggatacaaattgacgtgctccaggctctgcagggtacgctccacggcctcggtatcgccgtgggcatcgagcaccagcaccgcgaagcgcggcccaccaccctgctcctgcaggaatcgatcgatcagcaccttctgcaccgcatccggccgccgcgcctccagccaggtcgacagcgtgacgctaccgaagcccgccgcccgcctcagcgcggcgagcaggttgaccggcttgaagacacgggcgtccaggcgggtgatcggtgccacccggacgaagcggttgtcgccggcctggcgataccaacccagttcgcggatagccaggcggaagtcggcatggccctgctcgccgataccgggctggtcgcgcccgatctggctgaactgctggcgggagacgcggaaacgggtcagcggccgcgacaggaacgccaggtcgccacgctgtagcaactgcgcacacatggccaggtcgccgatccagtcgatggcccggccgttgagcatcatcaggcgctcgcagatctgcagcagcgcatcgcgccgggccatcagacaactgggttcgccgatgaagttgatggtgtggtcggcgaggaacgagaccagctcgcgaccgtcgatcaggacgtcgccggcgaacgggaagcaggtcgccaggatgtccggcagcggctgcccttcctcgtcgatacgcaaccgccgcgacgaggccaggaccacgttcggctcgcgctccatcgctcccaccaacgcctcgacgcattcgggaagcaacacgtcgtcgtcgtggagaaacttgacgtactcgccctccgccaggcggatgcctttcgccgtgctgcccagctcgccgaggcgcgtctcgttgcggaagtag

SEQ ID NO: 2727 - DNA, 1437 bp, Pseudomonas aeruginosa
acctcgcgcaggtgcgcttcgctcatcatacggaccggacatagacgggagattcccgcgctatgcactaccccatggatttcgccatcgagcgccgcgaccaaggcggcacgctgctcggcgaccgtgagatcgacctggatcgcctggtgcgacaaatcggaaatcgcctgcaacgcttccaggctggcgcccaggcgctgtgggtcgcgaccgctgacgatcaattcggcgcccatccgcgcgcagctctgcgcgatggccaggcccaggccggaactggcgccggtgaccaggatgcgcctgcccgacaggctgaagggattgaaggaagtctcgtcgttcacttggctgattccgcgttcaaggcactcaggattcgatcagatcggggaacttcgccccttcgatatccaccaggcaggtaccccaggacaggccgataccgaagccgcagagcaacacgcgattgcggccggcctcgagttcccggttgatccgcgcggtcatggtcaccggcagcgaggcgccgctggtgttgccgaagtcgcgcagggtcgaaggcaccttctctaccggcaggccgagcttcttgcggatggtctcgttgatcatccggttggcctggtggaaaacgaagtagtccacttcgtccttgctcgcaccggcatagtcgagcagcttttccaccgccggcggtacgcgctgggtggagaagctgagtacggcggtgccgtcgagctgcaggtcgatggcacggtgccaatggtcgttctcgtcctcgcggaacggcatcaggtgctgcacgccgaccggttcgcgatggccgcccaccggcaggatgatggccttgtagccgctgccgtcgctgttcaggtcgaagtgcatcggcggcgcgccttcgcagaactccagcgccgtcgcggtgcccgcgtcggagaagatcggatcgttgacactggcgccgcggtcgccgaccagcacaaggcccttcttcaccccgccggcggcgatcagcgaacccagcaggttgagggcgaacggataggccgagcaacccaggttgacgtcgaaggccacggtggaatgcggcagccccaggcggtcctggaggatgatcgcggtagccggcgccaggtagtcgggagactgggtcacgacgatcagcgcatcgacctcctcgcgcttccactccaggctttccagcaggcgctcggcggcgtcgaaggccaggtcggagaagcactgccactcctgcgccatgcgccgcgtctcgatgccgatgttgcgcaccaggcgttcgcgctcggcgcgcaactgcggcttgcagtcggtcaggttggagataacgcgcttggggacgcaggtcgccatcccggcgaaacggacgttcttcagcgtggaggtggccatggtcagagtccgagcatctggtag

SEQ ID NO: 2728 - DNA, 1512 bp, Pseudomonas aeruginosa
aaggattttataaaacagaaagcctcctttcggaggcttcgggggcaacccctggccaggggttgccgctggcggcaagggccttgccggtgcccggacggcaccggcacgccgtcatcagcgcaggttgatgatggtctgggtcaccgcatcctcggtctggatggtcttggcattggcctggtagttgcgctggtggacgatgaggttcaccagttcgttggagatgtccacgttggacgcttccagcgcgccggattgcaacgcccccagggtgcccgagcgcggcgcgccgaccgccggctcgccggactccgcggactgcacccaggaggtcttgccgatcggcgtcaggccctggatgttggcgaagttcgccagcaccacctggccctgcaccttggactggccattggtgtagcgggcgaagatcaccccggtgtcgtcgatttccaggcctgccagctgaccggtggtgtagccgtcctggatcgggttgctctgggcgaacgcggtggagtactgggtggtcttgcgcatgtcgaaggagatgccgctggcggcaccggtcgcgccattccaggcgtaggtcggcggggtcttgccgtccgaggccgccggaatccagccggtgccgggagtcggcggattgccggtggccggactgaactggatcacgttggtggtcgcgtcgatgctgaagcccggcccgctggtgctgccgtccggcgcccgaaccgaggtcatctggccgctggcgtcgaaggtgacgttgaagctcatcggcgtcttgttcgacggatcgagcggattgacgccgtcgatcagcactttcatggtccagctgttctccggaatcggcggggtcgcattcgggtccggctcgttcttgatgaagaactggctcatggtgtgggagttgccctggctgtcatagatgcccagcgaagaggacgagttgtaggtagcggcgtcggacggatcgaacggcgtcacggtcggcggcttcagcgtcgagttgaggttgtacgactgctggatgctcgaggtggcctgcggcgcctgattggcgcgctcgaccttgaggtcggtgaccacgccgttctgcaactggccgttcggcccgacggcatagccctgcaggcggtagccgttgttgtcgacgatgaaatcctgcttgtcggtattgaagtagccggcgcgggtgtagctgatcgccccgttgttgctggtgacgaagaagccgttgccgttgatggccaggtccagcacgctgttggtcgagtcgatgttgccctgcttgaacatctgcgagacgtccgagagcagcacgccgctgccctgcgggttgctgcccgaacccagcaccgaggcggcgtagacgtcggcgaactccgcgcgggattgcttgaagcctacggtgccggcgttggcgatgttgttgccggtgacgttcaggccgctagaggccgcctggatgccgctcaggccgatgttgaaactcatggatag

SEQ ID NO: 2729 - DNA, 1284 bp, Pseudomonas aeruginosa
ctccttgccggaaacgccggcttactggccgatgatctgtactttggacagcgcgatgctgcccaggcctgcgaggttgagcatcagctcgccgccgttctgccccagggtgacgctgtcgacgttggccggcaggtaggtctggagcccgtaggtcttgccgtcgatcgaggtctgcgcctcgaacttgtaggtgcccggcggcatgatgttgccgctgctgtccttgccgtcccacatgaagctgacgctgccggcagcctgctggccgaggttgatgcgattgaccacggtgcccttgtcgtcgtagacgttgacccatacgttgctgctggagaccggcaggttgagggacgccttgaaggtgtccttggtgtccaccaccgacttgtcggtcgccacgatgaccttgcgccccaccagcgacgaggcttgcagggcctgcgacgactggtagttggagagaatgctctccatgctcttgttcagcgactgcacgccttccacggtgctgaactgggccagttgggcgatgaactcgccgttctgctgcggcgacatcgggtcctggttcttcaactgggccaccagcagcttgaggaattcgtccttgccaaggttgctgctgcccttgacgctctgcccggtctcggtggcgccgctgccggcggcgcgcttgctgccgttgacgttgccggtgttgctgctggtgccgctgacgttatcgatgctcatgctctactccgctcactgacccagggtcaggaccttctgcatcatctgtttggcggtattcatcatttccgcgttggtctggaaggcacggctggcggaaatcatgtcggccatttcctcgaccacgttcacattggggtaatacacgtagccgttggcatccgcggccggatggttcggctcgtagcgcggcatcagcgaactctggtcctcgacgatgcccagcacctgcacgccggcgccggagctgtcctggtcggcgaacagcgagccgctgtcgccctgggcctgctggaacatggtggagaacaccggatggcgggcgcggtaggtcttgtcgacgctggaggaaaccgtctcggcgttggcgatgttgctggccacggtgttcaggcgggtgctctgggcgctcatgccgctaccggcaatgttgaagacactggcgagggacatggcggttactctccacgcagggcgctgaccagccctttgaatttgctgttgaggaaggtgaaggacgcctggaagtgcatggcgttctcggcgtag

SEQ ID NO: 2730 - DNA, 1197 bp, Pseudomonas aeruginosa
cgatcacccggtctcctccggcccccgcggccgcgagactacaacaatgacaacacacaagaagagtggagcactatgaagaagggtactcagcgtctatcccgcctgttcgccgcgatggccattgccgggttcgccagctactccatggccgccgacaccatcaagatcgccctggctggcccggtcaccggtccggtagcccagtacggcgacatgcagcgcgccggtgcgctgatggcaatcgaacagatcaacaaggcaggcggcgtgaacggcgcgcaactcgaaggcgtgatctacgacgacgcctgcgatcccaagcaggccgtggcggtcgccaacaaggtggtcaacgacggcgtcaagttcgtggtcggccatgtctgctccagctccacccaacccgccaccgacatttacgaagacgaaggcgtgctgatgatcaccccgtcggccaccgccccggaaatcacctcgcgcggctacaagctgatcttccgcaccatcggcctggacaacatgcagggcccggtggccggcaagttcatcgccgaacgctacaaggacaagaccatcgcggtactgcacgacaagcagcagtacggcgaaggcatcgccaccgaggtgaagaagaccgtggaagacgccggcatcaaggttgccgtcttcgaaggcctgaacgccggcgacaaggacttcaacgcgctgatcagcaagctgaagaaagccggcgtgcagttcgtctacttcggcggctaccacccagaaatgggcctgctgctgcgccaggccaagcaggccgggctggacgcgcgcttcatgggcccggaaggggtcggcaacagcgaaatcaccgcgatcgccggcgacgcttcggaaggcatgctggcgaccctgccgcgcgccttcgagcaggatccgaagaacaaggccctgatcgacgccttcaaggcgaagaaccaggatccgagcggcatcttcgtcctgcccgcctactccgcggtcacagtgatcgccaagggcatcgagaaagccggcgaggccgatccggagaaggtcgccgaggccctgcgcgccaacaccttcgagactcccaccgggaacctcgggttcgacgagaagggcgacctgaagaacttcgacttcaccgtctacgagtggcacaaggacgccacccggaccgaggtcaagtaa

SEQ ID NO: 2731 - DNA, 1314 bp, Pseudomonas aeruginosa
tcctggtgctgctgttccgacctaccggcatcctcggtcgtccggaggtggaaaaagtatgagccagtccctcaagcgcgcgctgttcagcgccctcctcgtgatcctggtgtcctatccgatcctaggcctgaagctgcgcaccgtcggcatcaagctcgaggtcctcggcgccgatgcgcagaccctctggaccatcgccgcggccgccctggccatgttcgtctggcagctgttccgcgaccgcatcccgctcaagctgggtcgcggcgtcggctacaaggtcaacggcagcggcctgaagaacttcctcagcctgccatcgacccagcgctgggcggtcctcgccctggtcgtggtggctttcgtctggccgttcttcgcctcgcgcggggcggtggacatcgccaccctgatcctgatctacgtgatgctcggcatcggcctgaacatcgtggtcggcctggccggcctgctcgatctcggctacgtcggcttttacgcggtaggtgcctacacatacgcgctgctcgccgagtacgccgggttcggcttttggaccgccctgccgatcgccgggatgatggccgcgctgttcggctttctttcctcggcttcccggtgctgcgcctgcgcggcgactacctggcgatcgtgaccctcggcttcggcgagatcatccgcatcctgctgcgcaacatgaccgagatcaccggcggccccaacggcatcggctcgatccccaagccgaccctgttcggcctgaccttcgaacgccgcgcgccggaaggcatgcagaccttccacgagttcttcggcatcgcctacaacaccaactacaaggtcatcctgctctacgtggtggccctgctgctggtgctgctggccctgttcgtgatcaaccggctgatgcgcatgccgatcggtcgcgcctgggaagcgctgcgcgaggacgaagtggcctgccgcgctctcggtctcaacccgaccatcgtcaagctctccgccttcaccatcggtgccagcttcgccggtttcgccggcagcttcttcgccgcccgccagggcctggtgacgcctgagtccttcaccttcatcgagtcggcgatgatccttgcgatcgtcgtgctcggcggcatgggttcgcagctcggcgtgatactcgccgcggtggtgatggtgctgctccaggaaatgcgcgggttcaacgaataccgcatgctgatcttcggcctgaccatgatcgtgatgatgatctggcgtccccagggactgctgccgatgcaacgcccgcacctggagctgaagccatga

SEQ ID NO: 2732 - DNA, 579 bp, Pseudomonas aeruginosa
cacgacgccaggtcctgggtcacgcagactgactgcgggcaggcctgggtgtcgtcgcgattggccagttcgaacagggaaacggcgtcggccagggcggtctcaccctccagttggttgccgacccggttacgcatttcccagtggcggacgaagatttccagccacgggttgttcaacgtccggctcagcgccttgacctccggcaacagcgcctcggcgcgctccacctcgaggtcgcagacgtacgcggtgagttcgtcgatcagccgcgcactctgctcctggccggcctcacgcaggtcggcgcggagcttctccacccagttccagatatccatatgcttcagtctccatcaggcgtgttgcgaattttcttattgccccagcaggcgcttcaccgaatcggcgagtccggccagggcctggttcagcgaggtcgcgggctggccgcgtccctgtccggcgatgatcactttgaacgagcgcagcagcaacgccgcatgggccgcttcgtcgcgttcctcgccgacggccgcgagcagcgcctgcaccgccggattgtcgaggttgacgtag

SEQ ID NO: 2733 - DNA, 483 bp, Pseudomonas aeruginosa
gcttcaggccgcatggaagcggcccggagtgcaatagagccgcgtcgcggcgaaatgttcaaccctccaggccgatcaattgtcgccggctgcgctcgaaccagtcgagcaggtaatcggcgagtacctgggtgcgccgcggcaggccgccctggaacggatggacgaggaacatcggcgtgctgcgcgtctggtagtcgcgcagcaaccaggccaggcggccgtcgcccagttcgtcgtggaccatgtatgacggcagccgggcgatgccggtgccggccagcgcggctttcttcaacaggctgtagtggttgctggcgagaaagccggcaacccgtacccgctccagccgatggtggcggtgatagagccactcctcgtggccgctgtagtgcgagttcagcaggcactcgcgctcggccagctcggccgggcgttgcggctcgccgtgtcgcgccaggtaggcgggactggcgcaggtga

SEQ ID NO: 2734 - DNA, 435 bp, Pseudomonas aeruginosa
tttcctgcaggacgaacagcggccgcgccaccagccgggcgtcctgctcgaccccagagcggatcgccaggtcgaagccctcgccaaccaggtcgcgcaggccgttgtacaggtccagctcgacgcgcagcagcggatggcgttcctggaagtcctccagcagtgcatcgaacagggtctcgcccagcgagaccgggagggtcacccgcacccgtccttccgctcgctcctgcaagcgcgccaccgcctgccgcgcgcgctcggcctgcaccagcaaggcctgcgcctcgggcagcagcgcggcgccggcggcggtcagcgaaagacggcgggtggtgcggtgcaagagggtcacgccgagcttctgctcgaggacgccaatgcgcttcgacagttggcccttgctgcaaccgagacgctcggcggcgcgggtga

SEQ ID NO: 2735 - DNA, 696 bp, Pseudomonas aeruginosa
cgtgggcgcattttcgatggagtcttccctatgcgccctgcccgtctgctggtctacatcctgcaccccttgttcgccgcctgccaggtgtggaagcccgaatcgccgagcaccagtgtagacacccgcttccagggcgaactggtgaagatcaacggcgcgctgcaattccgcccctgtaccgagaagcgcctgttcagcatcgaggacgtggccaataccggcctgcgccgcgaagccgacagcctgttcgacgacggcgcccagggcctgttcgtcgacctgcgcggcaccatgggaccggccaaggtccgcggtaccgacggcaagctggaggtcagccgactgtaccgcgtgcagaacgagggccccggctgcgacgacccgaacttcaagctgctgaccttcgccgccaacggcaacgaacccttctggagcgccagggtgaacaatcagggcctgcgcctggaccgccccgaacacgagaccctggccttgccttacgtcgccgaggaactgccgaacggcagcaccagctattccagcgaggcgaacggcaagaaggtcgaattgtggatcgccccgtcgtcctgcaccgacagcatgagcggcgccttcagcagctactccgccgaactgcgcatcgatggcgagacgctgcgcggctgcgcctatccgggcgcactgggcaagtga

SEQ ID NO: 2736 - DNA, 1386 bp, Pseudomonas aeruginosa
  unsure (574): Identity of nucleotide at the above locations are unknown.
tgggcgaaatcctcggtgcgacggaagctggcgaaccccagcagccgatcgtcgcgctcggccaggacggcacgtacctcgccgtcggcgatggctcgcagatgcgcacgcaccccctcctccggcaaatggttccagggattcggcccgtggcgcagcaacaggtcggtcatggcctcgatatcgccggtttcggcagctcgcaaacggtgcatatccactccttcaaagtccagccaccagcagcccgtcgggcaacgccacgccccgctcgatgcaggcagccagcgcctcgaccaggggttccagcgcatagccctgcctggccagccagaccggatcgtaataggtggtcgcatagcgttcgccgccgtcgcagagaatcgccaccagcgaacccttctcgccggccgcgaccatttgccgtgcggccaccagggcgccgatcaggttggttccgctggagccgccgacccgccgccccaggcgtcgggccaggtaatgcatggccgccagcgaccaggcgtccggcaccttgaccatcgcgtcgatcacttccggcaggaaggacgcntggacccgcggccggccgatgccctcgatccgcgaaccgcaatccagggtcaggccacggtcgccgctgacataggcgtcgaagaacaccgaacgctcggcgtcggcgcagagtacccgggtgcagtgctggcgatagcgcacgtagcggccgagggtcgccagggtgccgccggtaccggggctggagatcagccaggtcggggtcgggtacggctcgtggcgcatctgctggaagatcgattcggcgatgttgttgttcgcccgccagtcggtggcgcgctcggcataggtgaactggtccatgaaatggccaccgctctcccgcgccaggcgttcggactcggcgtagatctgggtggggtcctccaccaggtggctctggccgccgtagaaggcgatctgggcgatcttttccttcgaggtgctggccggcatcacggcgatgaagggcaggcccagcaggcgtgcgaaataggcttcggaaatcgccgtggaaccgctcgatgcctcgatcaccggcgcggccggcctgagccagccgttgcacagcgcatagaggaacagcgagcgcgccaggcgatgcttgaggctgccggtggggtggctggactcgtccttgaagtacagttcgacgccaggcaggccgggagtctccagggggatcaaatgggtatcggcgctgcgctggaaatccgcttcgatgatgcggatcgcctcgcgggcccattggcggtggtcgacggtcatggaaactccttcagttcaggacgccggccggaggcggcggcggagcgctgcgccactggctga

SEQ ID NO: 2737 - DNA, 657 bp, Pseudomonas aeruginosa
ccaggcgcgccagggtcagcaacagggccaggccgagcagcgccaggcacagcgggatcacgtaagcgagcatgggaagatctccttcagcggcgcttcgtagcgttgcttgatctcggcgatcagcgccgccttgtccggcacgtcgaggccgtgcaccagcaaggtcttgcggtcgtcgctgaggtccgacgacaccgaccccggggtcagcgagacgatgctcaccagcacgctgatggcgaggtcgttctccagctcgatcggcacctcgacgaaggccggacgcaagcgctcgatcggtccgagggtcaggcgggcgacctggatgttggcgacgagtatgtcccacatcaccagcgccagcagcttcagcagcagcaacggatgccactcctggctgcgcccgaccagcaggcggttggtcagcagcggaatgcacacgccgaggaaggcgccgagcagccagtggccaatggcgaaggaatccaccagcagcaaccagaccagcaacagcaggacactaagcacgggatgaggcagtacgcgaagaagcggacgcggcaacgaacggctgatcatgcggtacctccgcgggtgatgatctggcgatacaggtcgaggtcgtgcaactgcgccgcggtggcctggacgtag

SEQ ID NO: 2738 - DNA, 1848 bp, Pseudomonas aeruginosa
cccggcgtaccagttgaacagcggcttgcgcaggacatagaccagcacaccgccaaccagcgccaccacgctcatcagcaatggcaggttgaaaccgtgccagatcgccaggctgtattccggcagttgcccgccaaggctggcactggcggcggcggccagcagcggcgccacggtgtagaccggcagcatgccgaccaacaggcagaggaacaccaggatctccaccggtaccttcatgtagcgcggcggctcgtggggcgggaacttcggcaaccgggccggctcgccgttgaagaacacgtcgtggatgaaacgcagcgaataggccaccgagaacacgccggccagggtcgccaccgccggcaccagccagttgaagctgcccagcaggttctggctgagggtttcgccgaagaacatctccttgctgaggaagccgttcagcagcggcaccccggccatcgccagggaggcgacgatggccagcaccgcggtatgcggcaggtacttccacatcccgttgatcaggcgcatgtcgcggctgccggtctcgtggtcgatgatcccggcggccatgaacagcgaggccttgaaggtcgcgtggttgatgatgtggaacaccgcggcgacgttcgacagcggggagtcgaggccgaacagcagggtgatcaggcccaggtggctgatcgtcgagtaggccagcagccccttcaggtcatgctggaacagtgccatgccggcccccagcaacagcgtcaccaggccgctcaggctgaccaggtagaagaaccactcggtgccggccagcgccggatacagccgggccagcaggaatacgccggccttgaccatggtcgccgagtgcaggtacgcggaaaccggggtcggcgccgccatcgcgtggggcagccagaaatggaagggaaactgcgccgacttggtaaacacgccgagcaggatcagtatcagcaccagcggatacagggcgtgggcgcggatcagctcgccagccgcgaggacctcggtgagttcgaagctgccggcgatgtggccgagcagcagcaccccggccagcagcgccaggccgccccctccggtaacggtcagggccatcctcgcacccttgcgggcgtcggaacggctgccccagaagccgatgagcaggaacgaggacaggctggtcagctcccagaagagcatcatcagcaagagattttccgcgagcaccacgccgagcatggagcccatgaacagcagcaggaaagcgaagaaacgccccatcggctcctgttcggagaggtagtagcgggcgtagaggatcaccagcaggccgatgccgaggatcagcagggcgaagaggaaaccgaggccgtccaggcgcaggctgaggttgatgccgatttccggcagccaggaatagctggcggtcagggtctgcccggcgaacaccgtgccgcgctgtccgagcaacaggatcaggccgatcagcggcgccacgccggcggacgccgcgcacaaggtgcggccgccacgctcggcaagcaggggcaacaacgcccccatgaacggcagcgcgatgatcagcgccagaatcatgggctactcctcttcgatggcggagcccccggcatgcctggccggcggtgcttccccgcggttgtcggtgcgcggccggatcgccagcagctcgaagccccatcggccaccggcaggcgcggcgcgacggaactacgattatcgcaatctatcgaacgaacgtcatggattgaattattacaaaattcaggcgttccgactgccggaaagccgaaaaaaactctgcaacggcaacgacttgaagcttag

SEQ ID NO: 2739 - DNA, 1284 bp, Pseudomonas aeruginosa
cagggtgctgcccaggtagtcgccgagcggagtgatcttcagcatcgcaccgaaggcgccgccggcgccggtgatcagcaggatcggcgcggccgactggatgccttccaccacgcgctcatggaattcctcgcgcttgctctggtccttgagcagggtgcaggccagcgccaggccgaccagcagggcgatcaccggttgaccgaggaagttcaggcaggcgaacagtacgccctcgcccagcggcttgctcgggaataccgcgaccgagccaaggcagatcaacaggatcggtacgaagatcggcgcgaacgcctgggtcgcgctgggcagcttgccgtagcgggcacgcagctcgctgaaatcctcttcggtctggacgacctggccgtcgtcgtccaggggaatgtccttgccgacgaagcgattggcccaccacatgccggccatcgcggtgacgaaggcgaccaccaggccgaccacgatcaccaggccaaggctggcgtccaggccgaggttgccggccgcggcgatcggtcccggggtcggcggcacgaaggtgtgggtggcgtagagaccggtggccagggccacgctcatggcgatggtggatatcttcatccgcgccgccagggcgttcttcagcgagttgaggatgacgaagccggaatcgcagaacaccgggatcgacaccaggtagccgatgatcgacatggtcagggtcgggaagcgttcgccgagcaggcggatcacgctttccgccatggtgatcgccgcaccgctgcgctcgaggatcaccccgatgatggtgccgagcacgatgacgatgccgatgtagccgaggatgctgccgaagccgccggtaacggtcttgacgatttccgccgtgggtacctggtaggcgaagccggcgatcagcgcggccgccagcagggcgaggaacgggtgcagcttgagtcgcgtggtggacaggacgataaaggcgatcaacgccagcaggatcaggaccagggtcatgagccgcctccttgttgttatgggtgtgggatgggcgcccaggggcgggtcattttcgctccgtcgggaccggacacgccttgtgcaacggccagaggaagacggcgctggaaggggaacattttgtgcgactgcacagtgaatcgattgatcgcccgttacccgcggcgcggaacgagcaattgcagccccagcaacaattgctggcggtgctccaggcgagcgagatcgagcccgctgatcgaagcgatgcgctccagtcggtag

SEQ ID NO: 2740 - DNA, 987 bp, Pseudomonas aeruginosa
ggccggaccacctccggcgcgccggtgatgccgagcacgccgaccagccgctcggcgtgcagcaacggcaggttcacccctggccgcaccccgcgcaggcaggcggcggcctgctcgtcgatttccaccacccgccggttggccagcaccagttgcgccccttcgtggcgggtatgcaggcgcgatggatcgccgctgccgatgatcatgccctgggcatccatcacattgatgttgtgcggcaggatcgccatcgcccgatcgacgatgtgctgcgccagcgtcgaatccagttcgaacatggaggactcagggcgccaggcgttcgcgcagccagccgccgtcctggcgtcgatagtcgagacggtcgtgcaggcggctcggccgcccctgccagaactcgatgcgctgcggcaggagacggtagccgccccagtgctcgggacagctcggcggctggtcggcgaaacgccgctcggtgtccgcgagcagccgttccagctcggcgcgatcggcgatgacccggctctgcggcgaggcccaggcgcccaggcgactgcccagcggacgcacctggtagtaggcgtcggattcctcgggagtgaccttctcgacgctgccttcgatgcgcacctggcgctccagcgccggccagaagaaggtcatggccgcccgcggattggccgccagttgccggcccttggcgctttcgtagttggtgaagaaggtgaagccgcgctcgtcgaggcccttgagcaggaggatacggcaatgcggatagccgtcggcgtcgacggtggccagggtcatggcgttgggttcgaccggcaggcgctcggtcttcaccgcgtcgtcgaaccactggcggaacaggctgaagggatcgctaggggcgttggcctcgctgaggccatcgcgggtgtactcgcggcgcatatcggccagggactgggtcatggcgcatctccagggggaaatgcgccatag

SEQ ID NO: 2741 - DNA, 1227 bp, Pseudomonas aeruginosa
aagttaaccaacggattacagacactcccccgcgacacgcgccagctgctgcgcccgcggatccatcagcacatacggccccaaggcgttgctgacaaaggaaaaagccaggtcgcgctcgggatcggcgaagccgatcgagccacccgccccagggtggccgaaggccttggggccgagtccgtaggtcgcattggccacgcccggttggtcgagcatggtgccgaggccgaagcgggtccgggtcagcaaggtccgatcctcgcctaccgcgtgttcgtgggccaactggcccagcagttcatcttccagcaaacgtccctgcaacaggccgctatagaagccggcgagcgcgcgcgcgttgccatggccattggcggccggctgctgcatgcgtcgccattccggcttgttggtgctggtgaggatcgacggcggattggtgaaggcacgggtggtcagcgccaatggctcgctcatcatggtcttcagcatgcgctgggcggcagcgtcgccgaggctgcccttgctccgtgccatgtgggcgacgcggccgaactggctgtcgtccaggccgacatggaaatccaggcccagcggtgccgcggtgcgcgccacgatggcctcgcccggctcgcggccgtcgacccggcggatcacctcgccgagcagccagccataggtaatcggtgcatagccgtgcgcttcgccaggcgtccaccagggctcctcggcggccagtgccgtggtcatcgcctgccagtcgtagagtgcctcgggcggcatctgctcgcgcagcgccggcaggccggcgcgatggcagagcaactggcgcacgctgatcgctgccttgccggccgcggcgaactcgggccagtagtgtgccaccggcgcgtccagttcgagcttgccctcggccaccagttgcagcacggcaacggcggtgaaggtcttggtgcaggagaacagattgaggatggtgtcgcgctgccagggctgctcgccgtccttgtccgcgacgccgccccagaggtcgaccaccgtctcgccaccgacctccaggcacaacgccgcgccgcgctcctgcggattgtcgaaaagccgggcgaaggcctcggcaagcggggcgaaacggctgtcacagtggccttggggcgtcatgggcaagttccggtgggaaagtggtcggggcattcttccagccctcggcggccttgtgaaccctga

SEQ ID NO: 2742 - DNA, 660 bp, Pseudomonas aeruginosa
ccagccaccagcgcccgccacgtttttccgtgcggaagaaaccgctggcttcgaacaccggcccacccagcaggccgccgaaacggtcgcgcgccggtgtctgccgttcccagtcgcggagctgtgcggcctcggccgcataggcgctgcgcaactgttcgtcggaacgaatcttttccggccagtcggcgcggctgtactggccatagcgatcgatcaggccggtcaggatgctccgctccaccgccctccctgtgcgtatgccgaaacgtccgagcaggatgctctggggagcttgcggcgagcgcagggacaggctcagcgctccgaccctggcgcggtccagcgagccctccacgcgtggcgccagcagcacccgctggccttcgaccatctgtggcatcggcggccccgcacgcatgcccagagcctctggcgaaaccgcccgcaacggcaccagcagggtctgcggcgggcctgccggtagctcgatggatgcctgcagccccggcgcgccctgctcgccctcgatcgcgacctccagggtcatgtcccagctcatcgcgttctggatgcgcaggctcacgtagtccgctgcggaccagtcccaacggcccagcgccggactcatgcgcaaggtgggccgttgcgccgggctga

SEQ ID NO: 2743 - DNA, 1620 bp, Pseudomonas aeruginosa
ctggataaattttcagtggttcgacagggcggctatgataacgcgcttcgtcacaaccgccagcggagatcgccgaatgaccccctacgccctcgtctacgccctgcatgtcctggccgccctggtctgggtcggaggcatgttcttcgcctggacgattcttcgtccggcggccgtcgccgcgctggaggccccagcccgcctgggcctgtggctggaggtgttccgccgtttcttccattgggtctgggctgcggtgatcctgctgccgatcagcggcgtcggcatgctgcacctgagcttcaacggtttcgccggcgcgccgcgctacgtacaggtaatgatggggctctacgtcgccatgctggcactgttcctgcgggtgcaggcgctgcaagtgccggaactgcgccgcgcggtgcaggcccaggactggccggcaggcgggcaggcgctggggaagatccgccgcaccgtcggcttcaacctgctcctcggcctgttgctgatagccctggtagcggcacgcccgagcctctgaaccggcgatgcgccggaagccgtgctgccggcctctcctcagaagcgcacgacgtccaggctgccgtcgctgccgttggtgccgttcgcgccgtcctctccgctgcgccccgcacgaccggcatccaccgagtagatccagcaaccggtggcgttgtccgccgcacccggtttgccggccttgcctccagcgccgccgacgccgccttgcagacgggtttgcaagcgctccagaggaaaatcgcccggcacttccagacgaatccgaccgcccgccccgcccggaccgccgtcgcttccggattggccgtcgccacctttcagcgcgctgccccagaggcagccggaggccttgccggaagccccgtccaggccatcgtagcctggagcgccgacgccaccgcgggcgtccagcagcaggctttccacctccaccgcctgcaggcgcaaggtcaggtcgcggccgttaccggcgctttgccggaaggtgccggtcgcgccgggcgcggaaatgatgctgccatcggccaggcggccgctgacgacttcgatgctgattcgctcctcgcctggcgccacgccgatccgggcgttcttcgccatgtgcagttcctcgatgcgcaggacgctgacctccagcggaatcagcagggcggcatcctcgccgatctccactctgcgcaggcgcagctcctgggcccgcttgggcaggcgcatcaccgagttcgcctgcaccttcacggttccgccgataccctgctggcgtgccggcggcgcctcggccgaaaacgcggcgccagcccaggccaggggaacgaccaggaacaatccgagcatggccttacgcatgatcgtcctccttgtcctgcggtaactcgctggccgggctcaacgccggcaacgcaagcatgtggaagaccccgaacagcaagacctggagacgatccagccagggatgcgcgcgcgctttcaggcgtcctccgaggacgagaatctcgatcaggtggatcaacaggatcaggccgccggctatcgacaacagccagttcagcggataggcgaacggatgcagcagattga

SEQ ID NO: 2744 - DNA, 843 bp, Pseudomonas aeruginosa
acgccaagttctgggccaacccggaaaacttcggcaagtactggtggtaaccatgacccaaccctcttgcccctgcggcagcggcgacccgctcgacgattgctgcggccgctatcaccagggacatcccgcgcctaccgcggaagccctgatgcgctcgcgctacagcgcctacgccctcggactggtggactatctgcgcgacaccacgctgccggcgcaacaggccggcctcgatctcgacggcatccgcgcctggagccacggcagcacctggctcggtctggaggtggaaaaccacgaggtgctcggcggccagccggagcatgcgcgagtcaccttcgtcgcgcgctggcacgacgccgagggggaacatgcccatcgcgaatgttccggcttcgtccagcgcaacggtcgctggtacttcctcgatccgaccgtggccctgaaactcggccgcaacgacccctgcccctgcggcgccggcggcaagctgaagaaatgctgcggtccatggatcacctgatgcattcgctcgccagctatatccgcgccatccatgccctgccctcgccagtctcgataagcgatgcgcaggtcgaagagcaacagcgctgcgaggacggcgtcgagatccacagctgcgaagcgctctaccgtttcgacaacggcgtgcgcctgcgccagcactgcgagcgcgacctcctgccaagcagcggggcctgcgaggaatgctggatcggctacgaagtgctggattccgccgggcgggaaatcagcccacgctacaagcacttcgtcaacgcctgccaggaacgcttctggttgcgcatgcacgcctga

SEQ ID NO: 2745 - DNA, 969 bp, Pseudomonas aeruginosa
gatgctgcgccaggctgcgcggtttgggcgttgacgagcgctcgggtagaatgcgcagccttttcatccgggccccatccccatgctgctgaccgtgctctacatcatcgccatcaccgccgaagccatgaccggcgcgctgtcggccggccggcgcagcatggacctgttcggcgtggtgctgatcgcctgcgtcaccgccctgggcggcggctcggtacgcgacatgctgttgggccattacccgctgacctgggtccgtcacccggaatacctggcgctgaccgcagtcgccgcgctggtgacagtgttcatcgcgccgctgatgcgccacctgcgctcgctgttcctggtactcgacgcggttggcctggtggccttcaccctgatcggctgccaggtcagcctggaaatgggccacagcctgctgatcgcggcgatcagcggggtgatcaccggggtgttcggcggcattctccgcgacatcctgtgcaacgacgtacccttgatattccgccgcgaactctatgccagcgtgtccttcgccagcgcctggtgctacctgatctgcgtggagctggaactgccttccgagcaggcgatgctgatcaccctgttcagcggcttcctgttccgcctgctggccatccgcttccactgggaaatgcccaagttcgtctaccaggacgatttcgaccactgaagcaagcgcctgccccctggccgacgcgttcctccaacccctcgcctgtccccgatgccacggcctcgcgacgcggttatccgccccacgccctggcttgtcgcaggccgctgcccgcctcagtcctgcaggcgcaggtggctggtgtccggagccggagccgctggctcggagcgtgcctggcccatgtcgctaccgaccggggcgacgctgaagcggctcaggtcgagtttcggcgcctcggcttcggccttggcgtcctgtag

SEQ ID NO: 2746 - DNA, 234 bp, Pseudomonas aeruginosa
ttcccggcgatttcatcccagaataggtccaccatgagtcaggaaccccacgtacacggcccgaactgcaaccacgaccacgatcatcatcacgatcatggccatggtcatgtccatggtccgcactgcaaccacagccacgagccggtgcgcaatccgctcaaggccgtaggccgcaacgatccctgcccctgcggcagcgagaagaaattcaagaagtgccacggcgcctga

SEQ ID NO: 2747 - DNA, 2589 bp, Pseudomonas aeruginosa
cgtagcgcctctcgacgcgaccactcccgcaggagcccccaccccatggcctcgccagccttcatgcgttttcttccccgttgcggcgccgccgcggccttcggcaccctcctgggcctggccggttgccagtcctggctcgacgatcgctacgccgacagcctgccgccgacctccggcgtacaaccgatcaagggcctggcgcaaaacgtatcgatccggcgcaacgcgctgggcatgccactgatcgaaaccggcaccttccatgacgcgctgttcgccctgggctacgtacacgcctccgaccgcctgagccagatggtcagcctgcgcctgctggcccagggacggctggccgagatggtcggccccggcgcgctggagatcgaccgtttcatgcgtaccgtgaacctgcgccaggccgcggagatccagtacaggaacgcctcgccgcgcctgcaacgcttcttcgaggtctacgcgcgcggggtcaacgcctacctgtatcgctatcgcgacaagctgccgatggacctggcccagtccggctaccgtccggaatactggaagcccgaggactcggccctggtcttcgccctgctcaacttcggcctggcggtgaacctgcaggaagaaatcgcctcgctgacgctcgcgcagaaggtcggcagcgacaagctggcctggctgacgccgacctatcccgacgaaaacctgccgttcgacgaggcggaaaagctcaagggcctgcgcctggacgggcaggttcccggcctcgcgggcgtcgagggcgcggcgcggcaggtcgcagcgctgagcatgctcggggtcgccgcctcgaacaactgggctatcgcgccgcaacgcagccgcagcggcaagagcctgatggccaacgacacccacctgccgctgagcatgccgtcggtgtggaactacgtgcagatccgctcgcccaagtaccaggccgcgggcgtttccatcgccggtctgccgggcgtggtggcgggcttcaacggcaagctggcctggggcatgaccatggtcctgggcgacaatcaggatctctacctggaacagctgcgacgccagggcaaccggctctattacctggccgacggcaagtggcagccaacccgcgaacgccaggaaaccttcttcatcaagggccagcggccgatccgcgaggtcatccacgaaacccgccatggcccgctgctcaacagcgccctgggcgagcgcaagaacatcctccagccgctgccgctgaagagcggctacggactggcctaccggagcatccagcaggaagccgacaagaccctggacggcttcttcgacctgtcgcgggccaagaccatcgagcaggccttcgacgccacccgcgagattcgcgcgatgccgctgaacatcgtgttcgccgacgaaaagcacatcggctggcaggtcaccggacgctatccgaaccgcaaggaaggtcgtggcctgctgccctcccctggctgggacagccgctacgactgggatggctatgccgacccgatcctccacccgtccgaccaggacccgcagcggggctggctgggtaccgccaaccaccgcaccgtgcagcccggctacggcgcccagttgtccaattcctggtactacccggagcgcgccgagcgcatcgcccagctcgccggtgccagcaagagccacgacacccagagcatgatccgcatgcagtacgaccagacctcgctgttcgtcgccaagttgcaagccatgttcgacaatcccggcatggcgctgccgctgcgccaggccatcgacgccttgccggaggcgcaacgcagccgggcgcgggaggcctacgaccggctgatggcgttcgacggcaagctgacagccagctccagcgacgccgcgctgtacggcgccttcctccacgagagcgccaggcagatattcctcgacgagctaggaccggaggacggccctgcctggaaagccttcgtcgagaccgccaacctctcctactcggcgcaagccgaccacctgctcgggcgcgacgacagtccgttctgggacgatacccgcactccgcagaaggaggacaagccggcaatcctcgcgcgcagcctcgccgccgccgtggagttctgcgaacagcgactggggagcgagcgcaaggcctggcaatggggcaagctgcacacctacgaatggcagagcgacagctcgaaaatggccccctacctgggcgccggcgagcgcgccggactcggcgcgatcaagggctatctcgatcgcggaccctatccggccggcggcgaccacaccacgctggacgtatcggcctacggctggggccaggacttcgacacttggctgatcccggcgatgcggctgatcgtcgacttcggccagagcgaaccgatgatcggcgtgaacagcagcggccaatccggcaatccggccagcccgcactacgccgacggtatcgacgcctggctcaaggggcgctacgtcagcttcccgttccagccacagaacctcgagcgcgtttacggcaacaagcggctgacgctcactcccgctcgctga

SEQ ID NO: 2748 - DNA, 399 bp, Pseudomonas aeruginosa
ctttcctccacccgcttctcgaacgcctggatgcgctccttcagtggatcgagcatctgccccaggcgctgctggctggtctcggcgaaacgctgttcgcgttcgtcgaagatctttcccgccagttcggcgaactgtgcccgcaactcgtcgcgggccgactgcaggtcggtcaggcgctgctggtggctttcctgctgctcgcgaagttccgcagccagcgcagcccgttcggaagccaggcgacgcacttcctcttcccggccctggcgctcgctggcccaacgtgcctccgccagggacgcccgttgccgctcctcccccatcaactcggcttcccgacgcagcgcggcgacctcgccggagagcctggcatggcgctcgccgagttgctggtaa

SEQ ID NO: 2749 - DNA, 549 bp, Pseudomonas aeruginosa
  unsure (488),(491),(500),(505),(506),(507),(508),(509),(512),(513): Identity of nucleotide at the above locations are unknown.
gcctccctactggtctccaactgcgcattcagcccgtcctgggccagttgcgcggtcgccagtcgctcgccgagcaacgccatctcgcgctccgccaggctggcccttctctgtagctgccatgccaggccggccaggggaatcgcggcagccagcaggccaagcaacaggttcggtagatcgacgggcatggggcactccagcggaaaacgacgcaacacccgcctggcaggcgcgcgtgcagcggattctaggttcttgggaaaagaccgtcgagcgaatagcgccgcgccgaacgagcactccgcttccgagctgtgcgtaccccatgcgcaggacatttcagatacttccataacggaagccatcgccctgcgcccgtcaccacggggagacgtaggcggcacgctgtcgcgcgagacgcaagccccgggcccggggccggggcagcgcgcgacccccccggaacaggaagcctttaagagagnggncccggggancccannnnntcnngagggtgtccacgacgcaccgggtaagggcggggag

SEQ ID NO: 2750 - DNA, 231 bp, Pseudomonas aeruginosa
  unsure (186): Identity of nucleotide at the above locations are unknown.
cgtgccctcgacgagcagcgccacgcctaccggttggcgcgcagcaagtatcgcgccggcgccctcgatgccctcgagctgctcgacagcccacgcagcctggtcgccgaccgggcgcgcctggttgacgccgagatgcgcgtcgccgagcgccaggtcgaactgttccgggctttcggcggcggntggcaagccgctcccagcccctcccatcaggaaaacggacaatga

SEQ ID NO: 2751 - DNA, 1554 bp, Pseudomonas aeruginosa
tcgccaccgtggacactcgcgaaccggacggagcctccgccgatgagcgctgacgacaaggtatcgctgcgtgcctgggtcgccgtcaccggcggcctgttcggctgcttcatggccggcatgaacgtgcacgtcaccagcgcggcgctgccggagatagaaggcgcgctgggagccaccttcgaggagggctcgtggatctccaccgcctatctggtcgcggaaatcagcatgatcccgcttaccgcctggctggtggaagtgttctccttgcgccgggtgatgctcctcggctcgctggtgttcctgctcagttcgctgagctgcgcgctggcgccgaacctgtcgacgctgatcctgatccgggtgatccagggggcttcgggggcggtgctgatcccgctgtcgatgcaactgatcctcaccgagctgccgtccagccggatacccctcggcatggcgctgttcagcctttccaacagcgtggcccaggccgccggcccgtcgatcggcggctggctggcggatgcctattcctggcgctggatctttctcctgcaactgttgccggggatcgccctgctggccgcggtggcctggtcgatccgcccccgcgacggcgaccgcgaacgcctgcgccaggccgactggctcggcatcggcgcgatggtcgccggcctcggcgcgctgcagatagtgctggaggaaggtggccgccgcgactggttcgagtccggcttcatccgcaccttcgccgtcctcgccgtgctcgccctgctgctcttcgtacagcgccaactgtggggcgcgcggccgttcatcaacctgcgcctgctgggcagctacaacttcggcgtgtccagcctggcgatggcggtgttcggcgcggcgaccttcggcctggtgttcctggtgcccaactacctgtcccagttgcagggtttcaacgcccggcagatcggcgacagcctgatcctctacggcctcgtgcaactgctcctggcgccgctgctgccgcgcctgatgcgctggctgaaccccaagctgctggtggccggcggcttcgcgatcatggccctgggctgctggatgggcgcgcacctgaacgccgacgcgggacgtaacgtgatcatcccctccatcgtcgtgcgcggcatcggccagccgctgatcatggtcgcgctctcggtactggcggtgaagggcctggacaaggccgaggccggctcggcctcggcgctgatctcgatgctgcgcaacctcggcggcgcgatcggcaccgcgctgctgacgcaactggtctcgctgcgcgagcgcttccactccgagcggatcggcgagaccctgacgatcttcgacggcgccctgcagcagcgcctgggcggtggccaggtgcggatacaactgccggagcagcagcaggcgctggccctgctcgaccacggggtgcgccagcaggcctacctgatggcctactccgacgccttctacctttcctgcgtggcgctcctggcctgcgccctggcctcgctgatgctgcgccagaaggactga

SEQ ID NO: 2752 - DNA, 888 bp, Pseudomonas aeruginosa
tcctgggcaataggcgaagaccggaccgggtggaaggcaggtcgatcagcatcgggcgggccttggcgggcagtgggggcgctgtctttttaccagccgcgccatgctaacgaccagtcccggcgaagcacgccggcgctcgccgcgacgcggcgagcgcgctaccctggccgccccggcgtggcgcgactacctggcgtatccgccgcgccatccctccccaagtacaggagcgaaaccagcatggcctcttacgcggaactgttcgatatcggagaagacttcgccgccttcctcggccatggcctgggccccggaacagggcgcggtcgcgtggttccggcagaagctggaaagcaacgggctgccgagcgcgctgacggaacgcctgcaacgcatcgaacggcgctatcgcctgctggtcgccggggaaatgtggtgcccggactgccagatcaacctggccgcgctggatttcgcgcagcgcctgcaaccgaacatcgagctggcgatcatttccaagggccgcgccgaggacgacctgcgccagcgcctggcgctggagcgaatcccgattccgctggtactggtgctggacgaggagttcaacctgctcggacgcttcgtcgaacggccgcaggcggtgctcgacggcggtccgcaggcgcttgcggcgtacaaggcgggcgactacctggagcacgccatcggcgacgtcctggcgatcatcgaaggcgcggcgcgctgagacagcgccttcgcccgcttctcagtgccgcgaacagcccgcgccaaggcctcggtactgcaagcgatgtaggcgtccggcgctgtcgcggtagagcatcaccagcggcaccacgccacaggtggccggcaccggcgtga

SEQ ID NO: 2753 - DNA, 1656 bp, Pseudomonas aeruginosa
cagaaggaatttgcagagcaatgcggcaggtatcacgtagagcgtgccgcgaatgaaattgcgcgtgccctcggcgggaaagggcgaggctgccagcagcgtgcagtaggggccgagcaccgccagcagggtcggcccctggtcccacccgctgaggaaccacagggcgccgccgaccagcatcgccagccaggctcgcgcgccgttgcgcaaggcctcgcggtaatgtcgatggaaggccgctgggcggacgtcggcgcgggcccggccgtcgagccgggcgaacccccgcagggcggcctgcaggtcatccagttgctcgtcgagacgctccatgaagagcccttcgcgacaggcatccgcttggtctgtcggaagtccgcgccgaatcgccgccaggcgaccgcgcaagctcgcgagccgtcgcgcggcgccggcgaagtcgagctcgccgcgctccagttggccgcccagcaggcacaggtcgtcggccatcggcagcgccagtccacgctccgccaagcgccgggcccaatgcgtctcgccggcgaagcggaactccatcagcgtggaaaacagcgccgccaggccaccgcggatcgccgggagcgcagcgctcagcgcccgcgactcggctcgaccgacacccagcaggtcgtctaccgcgtagacctcgccggccagcgtccggcgacggcgctccagttccccgtcagccgcaccggcatgccgcgcagcgaccagcgccagcgtcgccgcgcagagcgagacgagacgctggcgcacccgcccggacacggtcctgcggctgaagagcacggtcaccaggctcaggcagcagaccccgacgattaccgccgaggcgcgggtgacgatgtgctcgaaggccgcctcgggctcgaccatggccgatcccagcgccaggcacacggtgtagccggcgaccaccgcggcggtggcgtagaagtgccggaccaggctcatgacgccgacgcagagacccagccagaaacccagggcgacgacgaacagcagcatcttctgggcgaacagcgcggtcaggacgaaggcagcgagcgtgccgaccagggtacccacggcgcgccaccagcccttgccgaccaccgctccctgcaccggattgatcagcaacagcacagtggacgccgcggaaaacggcgaatccagttgcaggtagagccccaggccgagcgccagagcggcagcgccgatgctgcgcagcacgtagtccaggctgtcggtccgccagggcaacggcaacgccgcgtaccaatcgcgcccgccggacgccgacgccgccatcaaaggtactcctgcaaccagcgggtcagccgccagtgccgcgcggtccccgcctgcagcacctcgacactgccggtcatgccagcggcaagcaccacgcccgccggtacccggtcgagttcgatgcgcaccggcacgcgctgcgccaggcgtatccagctgaagttcgggctgacctgcggcaggccgctgtcggcacggctttcgttgaggtcggcgacaccgcgaccgatgctcgcgacatggccgtcgagcagcggatcgaaccccatcagcttgatcgtcgccggcgcgccgacctgtacattgcgcagcttggtttcctcgaaatag

SEQ ID NO: 2754 - DNA, 894 bp, Pseudomonas aeruginosa
ggagcacaggctacgggtcgtggcgatttgcaaatatcgactactcagccagaaaataatcgaattcggacaaccataggacctgccgtgagccgtgaaccgcagacctacctcgcccaacgcttcgatcccgacgcgctcggccagccggccctggccctgcagctggaggcccggcacaacgacaccgaagtgccggtgcaccggcatcgcaagggccagctggtggtggcctgccgcggcggcatcacctgcacggtgcccgatggcctgtggatggtgccggccggtttcggtgtgtggattcccggcggcatcgcccatagcaaccgggtcaccgccaacggcaaggtctgcttcctcttcgtcgagccgggggcggcacgcctgccgagcgactgctgcaccctggccctgtcgccgctggtcctcgaactgatcctgcacctgagcgcgcaaccgcaggactatccgcacgacggcccgctcgcacgtctcgccggggtgctgctggaactcctggaacaggcgccgaccgaacagctctacctgccgctgccggacaaccgcggcctgcgccgcatcgccgacgaactgacccgcgcccccggcgaccgcgccagcatggccgaatgggccaggcgagtggcgatgagcgagcggtccctggcgcggatggtgcgccgggagaccggcatgaccttcggccagtggcgccagcaattgcagatcatcatcgccctgcagcaactgtccgccggcgtttcggtgcaacgcaccgccgagatcctcggctacgagtcggtcagctcgttcatcggcatgttccgcaaggcgctcggcagccccccggcccgctacgtgcgcgacagcatgcggcggccagccgactga

SEQ ID NO: 2755 - DNA, 654 bp, Pseudomonas aeruginosa
cctgcgttcctccagcaacggcgaccagggcctgatcaccggctactacgaaccggtctaccacggcagcctgagccagggcgaaaaaaccccggtgccggtctacggcgtaccggacgacctggtggtggtcgcgctggaaagcgtctacccggaactcaagggcaagcgcctgcgcggacgcctggaaggccgggtgctgaaaccctacgacgacgccgcgacgatccgcgacaacggctccagcgcgccggtgctcgcctggctgggcgacccgatggacctgcagttcctgcagatccagggttccgggcgcatccagctggaagacggccggcaactgcgcatcggctacggcgaccagaatggccacccgtacaagccggtcggccgctggctggtcgagcagggcctggtgccgaaggaagagatcagcatgaagcgcatccgcgactgggccgaggccaatccgcagcgggtctccgaactgctggcgagcaatcccagcttcgtgttcttcagcctgcgcccggacagcgacgaaagtccgcgcggctcgctgaacgtaccgctgaccgacggctacagcgtggccatcgaccgcaaggtgattccgctgggcagcctgatgtggctgtccaccacccgccctga

SEQ ID NO: 2756 - DNA, 426 bp, Pseudomonas aeruginosa
cgacggcagcgcggtggtccgtccggtggcggcccaggataccggcggggccatcgtcggcgaggtccgcgccgatctgttctggggcaccggcgacgccgccggcgaactcgccggacacatgaagcagccgggccggctctggctgctatggcccaagggggcgccgctgcccgcctcctgaaaacctccggccggtgcctacgcacccggccgggacggctggccaacgcaacgccagcgagcgcccgacaccgccgaccagcatcgacggcgccgggcgcgcttgcggcagcaaccattcaaacgatgaatgacgccgcagaatcttctgtgatgatcgccgcgccagccggacctccgcgcctcgccgcagcggccaggccccccgaaaccacttgtccgtgctacccccggcaggcgtag

SEQ ID NO: 2757 - DNA, 3291 bp, Pseudomonas aeruginosa
gtcgacggcactccgtatttccataacggtttttccgggcaaggcgcctcgacgcttgccgctcgcgtgagcgagccggtgggcggcggacgactggcagagcccgggaagactcggtcgccgtcttcgcgaaaaaccaaaaatccttcatttagccgaagaagccggcagatggactcattttttcgaaaaaaggcgattgccagaatgtcccagaactccctgctcgacctgtacgcgcacccgacggtggtggcccgcttcagcgaaatggcagcgcttcatccccatcgcgaagccatcagggaccgtttcggaagtgtcgactatcggcaactcctggatagcgccgaacaactttcagactatcttctcgagcattatccgcagccgggagtttgtcttggagtgtacggcgaatattctcgggaaagcattacctgcctgctcgccatactgttatccggccatcactacttatatatagacctgaaacaaccggcggcctggaatgcagagttgtgccggcaggtcgactgccgcctgatcctcgactgctcgaccacgccgacgccggccaacggtcttccctgcgtcccggtcaggcacctgcctgccgctccagcctcggtcgcccggccatgcttcgcggcggaccagatcgcctacatcaacttctcctcgggcaccaccggccgcccgaaagccatcgcctgcacccacgccggcattacccgcctgtgcctgggccagtcgttcctcgcgttcgctccgcagatgcgcttcctggtgaactcgccgctgtccttcgatgcggcgaccctggagatctggggtgcgctgctcaacggcggctgctgcgtgctgaacgacctcggccccctcgacccgggcgtactgcgccagttgatcggcgagcgcggagccgacagcgccttggctcaccggcctcgctgttcaacaccctggtggaacctcgacccgggactgtctcggcggctttcgccagttgctcaccggcggcgacatcctctcggtgccgcacgtgcgccgggcgctgctgcggcatccgcgactgcacttggtgaatggctacggaccgacggagaacaccaccttcacctgctgccatgtcgtcaccgacgacgacctcgaggaagacgacatccccatcggcaaggccatcgccggcaccgcggtgctcctgctcgacgagcaaggacaggagatcgccgagcccgaccgggccggggagatcgtcgccttcggcgccggcctggcgcagggttatcggaacgatgcggcgcgcacccgcgccagcttcgtcgagttgccctatcgcggccgcctcctgcgtgcctaccgtaccggcgaccgcgctcgctacgacgagcagggccggctgcgcttcatcggccgcggcgatggccaggtcaagctgaacggctatcgcctcgacctccccgccctggaacagcgcttccgccgccagccgggcatcctcgactgcgccctgctggtccgcgagcgcaacggcgtcaagcaactgctctgcgcctggacgggaaaagccgacaccagcccgcaggccctgctccgccaactgcccacctggcagcgcccgcatgcctgcgtccgggtcgaggccttgcccttgacggcacacggcaagctggaccgcgccgccctgctgcgccgcctggaagaaccgctggagcgctgcgccagcgcgctcgatcccgaccaacgcggctgcgcgcagctgtggagcgaattgctgggttgcgaggtcggcgccgccgaccaggatttcttcctctgcggcggcaactcgttgctcgccctgcaactggtcgccctctgtcaatcggcgggtacgggagcaaacctgggactcgccgacttgcaggcaaactcgcgcctcgaccagttcagccgtctcctgcgcagccacggcctggcgccggagcgtctgctggaacgggcggcgacgccggagcagccgctggtgctgtcgaggagcgcggcatgaacgtcggtctctccgcggaggtgcgctaccactggttccgcgagcacctggtggtggtcggcgattggcaccgcctgtccccctccgagcgcgaccgcctgcggcaccaaccgatgccggatgaggccgcgcagtccttgcgcgtctacctgtcgccctggtcctgcgggatggtcttcagcgagctgttcggcgccgacctgacccgtttcggcatctgctacctggctccggccgaggtgccggcatccgacctgacgcgcctgggacggcgcctgcgcgaagagttcccgttgctcgacagccaggtggacagcggcgcggaaggtttcgaactggtcgtccacgggcagcccgaggagagcccggcgctggaagtcggccccttcgccgacgaaaacgcgctcatcgcagcgctgctgcaacgcccgcattccctgttcgagcgcggcctgctgcgactgttccacgggcgctgcggaggacgtgcgcgctggggcgtctggctgcatcacctggtcgccgacgccgacttcgccagcgtgctgctggcccgcctggccgtgctcaacgccgaccccacgaccgaagcggcggcccccgagttcggcttcctccagcagcaatggcgcctggagcgccagctgcgcgagcgcaggaccaggctggaagactactggagcgagcgcggcgaggcgttccgtgaactggcgaacctgccctgggcggagcgcgccagccattgcgaggatttccgcttggctgccacgccaggaggcggcgaagccgccctgctgacccggctcgcctgcgccctggctctcgccctggccagccagggcgccaccggcaaggtcttggcgctgaccccggtcagcctgcgcagtcgccgaggcacggcggtttccggttgctggctgaacctggtgccgctgttgctggacgccgcgaccgccgaggacaccttcgaacgacacaggctcgaggccttcgagcacagcctgctgccggcggaggccatcgccgaacgggccgggctgcgctatgccgacgcccaggtgatgatcaatgtcatcgaccagccattccgcagcgccgggttcatccaccggccgacactgaagagccgcctgccgctgaccctgaccctggtccggcgcgacgacggcggctgggacgccagcctggccagccgcttcggccgcgaacggaccctggcgctggcggcggccatggccgaggcgctacgcccatgctga

SEQ ID NO: 2758 - DNA, 3027 bp, Pseudomonas aeruginosa
tcgatttcatcgtccacaccgtcagcaaggagtccgtccaatgaaacactatcggcaggtggtatccccgcaattgcgccaacaggcgctggactggatcctcgccgcggcgcagcggccggacccggcgctggaaccggaattcgacatcgccgacgacgagcgccgcgaggcgaagaaggtgcgcaacctgcaccgccacgacccgctcttctgggacgactggttcgcccgctccgggctcgacgcgctggtccgcgaccatctgcgcaagccgcgcctgctgcgccacgcggcgttcatcaagcgccacgccgacgagtcctacatcccgctgcaccaggacatcgcgctatgggagaagcgctacgaaagcgcgcagaccttctgggtcgccctgaccccgtcgcggaacgacaacggtgggatgttctattaccccgacgaccgcacgatcttcccccacgagttcgacctcgcctacccgatgttcaagtgcatcgacctccaggccaacggcatttcccgcgagcaactggtggatgccgagctggacgccggcgacgtcctggtctggcccgcccgcaccgcacatggcagccacaacaaccgcagcggcgagctgcgcatcggcatgccgatcgtcttcgtcgaggacgacgaattccaccaactgaatcgagaggacagcatgaaaacctggatcgcttccaacctgaaaagcgtgttcccggacgaagcaatcaccgaggacaacctcgaccactatcttccgcagctgtgcgactactcgctgaagatggtcaccttcctcgcccgtttctcccgccagttcggccatgcgccgaagatccacgacttcatcagggagccgcggctggcgacgctgtcggcctcggacgcgggagcgagacgatgatccgggtcatcgactgcaccctgcgcgaggggtgccaggcccgccagtgcagcttcgacagcgcgcagtcggtccagctggcacgggaaatcgcggcgctgggggtggatatgatcgagtgcggccacccgcggatttccgcggacgaacgcgagcgggtacgcgccgtggtggcggcggtttccacgccggtgctggcccacacccgggcgcgccgggaggatatcgacgcggtgctggaaaccggtgcgcaagtgggtcgggctgttcgcctcgatcaacgcgatctcgctggaaaccaagttcaagggcatgagccgcgaggaggtgctcgaactgttccacgacgcgatccgctacgcccgcgaacgcggcctgcgggtccgggccacggtggaagacgccgcgcgcacctcggtcagcgacctggtcagcatgatcgccaccgcgcgcgacgccggcgccgatcgcatctgcttcgccgacagcgtcggcatcctgctgccggacgagaccttcgacgtgctctcgctgctgcgtcacgagttccccgacgtggtcttcgagtaccacgtgcacaacgaccgcggcctggccctgggcaataccctggcggcgatccaggccggggtccagtggcactcggcgagctgcaacgggatcggcgaacgcgccgggatcaccgacaccttccagttgctgaccctgctgcacaccaagttcgccgccgaccgcttcaacctgaagaacgtcctcgcggtctccgagctggtcgaggcgcacagccggatcaagcgttcaccgatgcacccggtggtcggcgagaacgccttcgtccatgtcgcccgcctgcaccagttggccatgcaggaaaaccaggacgcctacagcgccttcgatccggaactgatcaacggccgcgtctcgctgcaacgctacacgccgatgcaccgccaatccctgttcctcacgcctttcgagaagtccgccagcgaactgaagtaccaccgccacggccccggcaagcgcttcgtcatgctcgaccggcgcctgctcgacggctcgccgttctacttcatcgcccgccagttccacgacgtcggcgacggcgggccgggccacgtcgacagccacgtacacaactgcgactcggtgttcctgttcctcggcagcgacgaggactaccgcggcctggaggtggaagtcctgctcggcggccagctgcgccgtttgcagagcccggccagcgtgttcatccccgctggcgtcgagcacagctaccgctacctcggcggcagcggcacctacatcaatttcgtccacaagggcgattaccacgagagcctactggagattacccaatgaagcagttcgacaagcacgcagacgcctacaacgtggtccgcggcaagatcgcctatccggattcgctctaccgcaacctcgccgaacgcgccccggcacgcgaagcggcgctggacatcggctgcggcaacggcgtctcgaccgtccgcctgcaaccctggttccgctacgtggaaggcagcgacctgggcgaggcgctgatcgccaaggcccgcgagaactacccggagatccgcttcagcgtgtcgccggcggaaaccttcgcgccgcaacgccgcttcgacctggtcaccagcgccacctccttctactggatggaccgcaagcaggtgctgacgcgcatggccgactggctgacccccggcgggctgttctgcgcctacaagtacgacttcccgatcgcctacgggccgctgcgcgacttcatcgagcacgaactggtgaacaagtgggccaaacaccgtgatccgcgcctgacccgctatgacgacaccctggagatcatgggcagttgcccgcacctgcgcgactgccgccgcgaagtgttcgccaacatcatcttcctcagcccggaggaggtcgcgctgttcttcctctccaccagctacgtgacccgctacatcgagcaggaaggcggcgaagactacgccgaccgcttcatcgccgcggtgcgcgagatcgagagcgcgccgcaggtggcggtgaacttcgacatccacgccttcaccgcgctgaatcgctga

SEQ ID NO: 2759 - DNA, 1488 bp, Pseudomonas aeruginosa
ggagccggcatgagcagcctccccgtacccgtatcgctcgacagcaccctccgccatctcggcagcgccgacccgcggcggccgttcctgatcgacgcccgcgagccggagcgaccgctggaatacacctggggcgacgccgaccgccaggtcgatgccctcgccgagcagatcgccgcgcatgcctgccgcagtgtcggcgtgctgctcgacaacagctaccgcaacctctgcctgatctatgcggtcatgcgcgcgggcaagcatctggtgctgatcgatcccgagtggggggaggccgcgaagcaggccatcgtcgacgagatgcgcctggacgcgctggccagcgaacatccgctcgagggcgcgctggccgggctgcgcctggcgctggacttcgagcgcagcgcgacgcgccggctcgaccgcgccgcgcacagccacatgatcctgttcacctcgggcaccaccggccagccgaaaggcatcgaactcagccagcaggccatgctccatgcctaccgcatcggccgcgactgcctgggcatcggcgagcacacgcgctccggttgcttctaccggatcagcggcctgggcatcctcggcatcaatttcctcttcccgctgctgtacggcggcagcgcggtgctcctgccgctgcactgctgggccgacagcgaaggcttctgggaatgcgtggaacgcttcggcatcagtttcctctacctggtgccgccggtggtcaaccacatggtcaaggaaggctccccgccgccgcgccgcttgccgttgcagcgcctgctctgcgtcgccggctcggcgcgcctggacgccgacctgcaggcggccttccagcgcgactacgcggcgctggcgaacatctacggcctcagcgagtgcggctttgccttcctcttcggcaagcgtcgcggcgatgcgttcgacaactcggtgggacctgccgtcggcctggaactcaagctgaccgaccccgacggccgcccgctggagggcagcggcgaacgcgggcgcctgtgggtgcgcacgccgagcctgttctccggctacgtcaaccgccccgacctgaccgcccaggtgctcgaggacggctggctgaacacccaggacctcgcctacttcgacgaggaccgctgcgtgcacgtcctcggccgttgcgacggcaccatcaacaagggcggcaacctgttccacctgaatgaatgcgaaagggcgctcaacggcctggacgaggtgatcgacgtctgctgcctgaaggtcgactgcccgctctatggcgaaaactatgtcgccgtgatccacaccgcgccgcaggtcgagttcgccttcctgccctggctccagcagcagctcggcaccctccgcgcgccacagcgcgtggtgctgtcgcaccaggccctgccgctgaacggcgccggcaagcacgaccgccgtgcgctcgccgccctgctgcaacgggaagcctcgtga

SEQ ID NO: 2760 - DNA, 576 bp, Pseudomonas aeruginosa
ccctgctgcgcgacgagttcggcatcaagccgctgtactacagctaccagcccgagcgcggcctgctggccttcgcctccgagccgcgggcgctgctgcacctgctcggcggcgcccgcgccgacgccgaggcgatcgcccaggtggtcgccgccggcgtgccgctggaaggccagaccctgttccagcaggtccgtctgctgctgcccggcgaggtgttgcgcttcgatctctcccaggagcgtccgcgcctctgccagcgccagcggctggccaccgccccggccagcgaggtggacagcctcgacgagcagctcggcgaaaccctcgaacgctgccgccagaccttccgcccctgcgccctgctggtcagcggcggggtcgattccaacctgctcggcagctacctggacccgcagttgcaacgctttcacctgtgcctggaaggcgacgaggaaagcctgctgccacaccctcggctgcaacgcttcgagctgcgccaggaagccttcatgccgctgctgcgtcgcgcggtcggcaacttcggcggggcgacacggatgtccagcctgctga

SEQ ID NO: 2761 - DNA, 2061 bp, Pseudomonas aeruginosa
cgcggaggctctcctgcgccagcgcctgcatcacgaactggagcatggaagcggcgtgctgctgcacgattccgcgctgctgcgcggactcgccgaggacgaattccagcgggtgttccgcgcattctgccaatggctgggacgcaccgtggcgatcaaccgcaacggcgagtacctcaaggaagtgcgcgacctcggcctgcgcgacgcccgcgacgcgccgcagcgcggccacctgaccagccaggaactggccttccactccgatcgcgccgacctcacggtgctcgcctgctggtcgccggcacgccggggcggcgccttccgcatccgttcctcggccgacgtcctcgccaccctggaagccgccaatccggcctggctgcccctgctcggccagccgatcccccacgacctgcgcgacgaaggcgacgccgactacgcgctggtgccgctgctcacggaaaccccgcggaccttcgtcttgcgctatatccgcaagttcaacgaatcggtgacgcgccacgggctaagcctcgccccgcaggtgcgaagcatgctcgacggcctggacgaggcgatcgaacgcgccgacggctatgccgaactggacttcagcaagggcatgctggtgctggtgaacaaccacaccaccctgcacgcgcgcaccgagttcagcgacgacgagcggcagcgccgctgcctgctgcgctgctggctgagcagcgagttcacccgcgaactgccggaaagcttcctgccgctgttccaccaggtagccgccggcagcctgcgcggcggcatccgtcccctcgcccaggagccccgcccgtgagcgacaacaccttcagcgtgcaacgcttccgcgccctgccgacggaaatccacgtgatgctcgtcggtacgctgctgacccgcggcgcctacttcatggtctggccgttcctggcattgctgctgtggcgcgagttccggctgtccgccagcgccatcggcctgctgctggcgctggcgaccgtctgcggcgcgctcagcggcatctacaccggctggctgtcggaccgtttcgggcgcaagcgcctgatcttcttcggcaccagcctcagcgggctttccttcgtgttgctgggcttcagcggccagccgctgtcctacggactggcgatctccggggtgagcatcggctgcgccctgctcgaatccagttgcaaggcgctgatcggcgaccgcgtcgaggatcgccgctcgcgggaactggcgctctactgccggtacttcctgatcaacctcggcgccgccctcggcccgctgatcggcctgactctcggcgtcgccgcccaggccggcaccttcctggtcaccgcgctggtctacttctgctacggcctgctgctctggcgcctgctgcaccacctcgaacttaagcggcgcagccttgccccgcgatcctcgacggggttcctcgaagcctgcctgagcatggcccggcatcgcgccttcaccctgctgttgctgtgcaacatgctggccgcgctgatctacgccaccttcgattcgaccctcgtgcagtacctcacccgcagcggtctgcccgacgtggtcaacagcatcgccctgctggtgaccatcaacgcgctgaccatagtggtcgcccagtttcccctcctccgcctgctggaaaacaccggcaccggcggccgcctgatgctcggcatgctgctcatgctcctggcccagctaggcttcgcctggaccccggtgaccctgttcgccggcctggcgctggccacggtggtgctcagcctcggcgaactgatcgtgttcccgaccttcagcgtggaggtcgaccaactgacccccgacgacttgcgcggcagctatttcggcgcggccaatctctacagcctcggcaccgcgctggcaccgctgtacggcgggatcatgctcgaccatgccggcagccaggcgctgtacctcggcctggccgcgctgtgcggggtgatcatgctgctgcaggtcggcgcggtcggcctgcgccaggccgagcgggccggcggatga

SEQ ID NO: 2762 - DNA, 1155 bp, Pseudomonas aeruginosa
aggtcaccgccctggaagacagcgaagtgctgctggtggaagtggcctgacccgacagcccctcgcccccacgggcgaggggctgctttcgttgcgccccagcctctctcgacgcagcggcgttatccgccgcaacgcctccggccctgccgactgggttcttcccagcttcacgcttcgcgctcacactacccgcagaagaattcgagaggctctgccatgcgtgaactgcaacccctgctggagaaccacgggctgctcctgctgttcctcaacgtgctctgcgagcaggccgggctgccgatccccgcctacccggcgctgatcgtcgccggcgcgctggccatgcagggcgtcggcgcgccgctgggcgtggtcctgctggtggtggtgctcgcctgcctgctggcggacgtcgcctggtacctggccggacgccgctacggcggcttcctcctgcgcagcatctgcaaggtctcgctgtcccaggacagttgcatccgccagagccagaacatgtacctgcgggtcggtccgagggcgctgctgatgtcgaagttcctgcccggcgccagtgcgttgtccaccaccctggccggcatgacccgcacccacctgcgccgcttcctcgcctacgacgccgccggctcggcactctgggccggttccgcgctgctgctgggggtgatcttcagcgatgcggtagaccacctgctggccctgctcagcgactacgcggccatcggcgcgctgctgatcgccggcgccttcgccgccttcatcgcctggaagctctggcagcgccagcgcctgctgtcgcgcagccggcggattccgcgaatcagcgtggaggaactggaaaaccttcgcgaacaggggcaattgccggtgatcctcgatgtccgcgcccatcacgaagacgagccgagcggcattccgggagccatcccggtggagctgaacgtgtcgctgaaggacctccccggcgacctcagggacgccagcatcgtcatctattgcgcctgtccccacgaactttccgccgcgatgctcgcccagcgcctcaacgcctccggcttcacccgcacctgggcgctggccggcggcctggacgcctggcgcaaggcctacgggcaggtcgtggcgaacgcctga

SEQ ID NO: 2763 - DNA, 756 bp, Pseudomonas aeruginosa
aagatcgggatcgcgccgagggtacgggtcagctcgatggtctccaccgaggtgtccagggcgatgaacggcacgcgctgggcgcgcagcacgcgagcgacgatctggcccatgcggccgaccccggcgatcaccacgcgcggggtgtcgtcgttgtcgatgcgttccatttccggcggcggcttcgtcgcctccggctccttcgccagcaggcgcgcgaggccgagtaccagcaacggggtcagggccatcgacagggtgatggaaagcaccagcaggttgtgcaggtcgttctggaacaggccctggtcgcgggccatcttgaacacgacgaaggcgaactcgccgccggccgccaggaccacgcccaggcgcagcgccgaggccttgtcgaggccgccggaaatgcgtccgacgaagtacagcaccggcgccttcagggcgatcagcagcacggtcaggccgagcaccatccacggcgacttgagcagcaggctgatgtccgcgctcatccccacgctgatgaagaacaggccaagcaacaggcccttgaacggctcgatctgcgcctccagttcgtggcggtactccgagtcggccagcagcaagccggcgaggaaggcaccgagggccatggacacgccggccagctccatcagcagcgcggtacccatcaccaccagcagcgcagtggcggtggacatgtcctgcagcttggtttgggcgacgatgcggaacaccgggcgcagcaggtag

SEQ ID NO: 2764 - DNA, 501 bp, Pseudomonas aeruginosa
cggccaccgaccaccaccgcggcgatgctaccgaccaccttgagggtctgggtcagttcgctgccgccggcgtcgctgtgcgcaccgctgagcagcgggatcatggcgatcagcgggatcgccgcgatgtcctggaacagcaggatggcgaaggccaggcggccatggggctgggtcagttccttgcgctcggcgaggatctgcaggccgaaggcggtggacgacagcgccaggcccaggccgagcaccaccgcgctgttcaccggttggtcgaagccgaccagggccacggtgccgatcaccacgccggtcagcagcacctgcagcaggccgacgccgaacaccgacttgcgcatcacccacaggcgccgcggcgacagctccaggccgatgatgaacagcagcaataccacgcccatctcggagatctgcgcgacgctttccgggttgtccaccaggcccagcacgctgggaccgatcagcacgccggccagcaggtag

SEQ ID NO: 2765 - DNA, 411 bp, Pseudomonas aeruginosa
cgatcgggctgtggctgtccatggttggctcctgtcaggctggcggatcgagggaagccggcaagccgagccggcgcatgcgcccgagcagggtcgtgcgcggaatccgcaaccgggcggcggcccgggagagattgccgcgcgcctggcgcaaggcgtcttctatcaggttgcgctcctgttgcgccagcgcctcgcgcaggcctccgaccgccgcgctgttcatcgagagcgcggcctcgccgcccacggcctcggcgccgtcgtcggcgaacgccacctcatccagcagtgcgccgccctccccgtgcagcaacaggctgcgccggatcacgttttccagttgccggacgttgcccggccagtcgcaggccagcaactgcgccagcgcccgctcgccaagagcggtga

SEQ ID NO: 2766 - DNA, 276 bp, Pseudomonas aeruginosa
ggctgcgcgcatcgcgacggacgaacgcccgtgccagcagttccacatcgccggggcgctcgcgcagcggcgggatgcacaggctgcccacgtccagacggtagtacaggtcctcgcgcaggcgtccctcggcgatcgcctggcgcggcggctggttgctcgccgcgatcaggcgcacatcggcccgctgcgggctcaggctgcccagaggcaggtagctgccgtcctgcaggacccgcagcagcttgctctgcatggccatcggcatggaattga

SEQ ID NO: 2767 - DNA, 495 bp, Pseudomonas aeruginosa
tcatcggaccgctgcgtcgcgggctcagggcatgggcgcgacgggcgaacagttccttgccggtgccggtctcgccatggatcagcagcggcaggtcggtggcggcgaaaacgtccaggcgctgcaactgccgcagcaggctcggcgccacgctcaggatgttcgggcaatccgccaggcctgcggcctcttcggtctcggcgacgacttcgccgagctccatcgcgccgagcaggcaaccgtcgcgcccgcgcagcgggatcgcccggtggcgatactgcaacagctcgccgccggcccccacgtaggcctgcagcgtatcgatcgacggccgcccttcggccaggcaacgcaacagcgtgctttgctcggccgccagccagggagcgctctgcaacaggtgcatacccaacgcccgctgcgggtcgagaccatcgagcaggccgctggcacggttgtagtagacgaagcgaccggaggggtcgaccaccgtga

SEQ ID NO: 2768 - DNA, 2598 bp, Pseudomonas aeruginosa
ccggttgccgcaggccgtcgaaaatcggcgccaggcagtccaccaaccaggccagttcaccgcttcgcgtggaaatcgtcggctcctcgacaagcgccatgctctccccctcggtttcccggatgtcgaaatctcgtcagttgtcccatcttcgacgcagcgcgaccgagcatccttggcgtggatcaaccaagccctcggaaaaccaggaaaatcctccgatttatcaaggatttccaaggcaattcccgggcgttggctggcgcgtggcttgcaacgacctcgtcgtccccacacgaggaaaatcgtcatgttcaagcacatcatcgctcgcacgcccgcccgcagcctggtcgacggcctgacctccagccacctcggcaagccggactacgccaaggccctggagcagcacaacgcctacatccgcgccttgcagacctgcgacgtggacatcaccctgctgccgccggacgaacgcttccccgactcggtgttcgtcgaggacccggtgctctgcacctcgcgctgcgccatcatcacccgccccggcgccgaatcgcggcgcggcgagaccgagatcatcgaggaaaccgtgcagcgcttctatccgggcaaggtcgagcgcatcgaggcacccggcacggtggaagccggcgacatcatgatggtcggcgaccacttctacatcggcgaatcggcccgcaccaacgccgagggcgcccggcagatgatcgcgatcctggagaaacatggcctcagcggctcggtggtgcgcctggaaaaggtcctgcacctgaagaccgggctcgcctacctggaacacaacaacctgctggccgccggcgagttcgtcagcaagccggagttccaggacttcaacatcatcgagatccccgaagaggagtcctacgccgccaactgcatctgggtcaacgaaagggtgatcatgcccgccggctatccccggacccgcgagaagatcgcccgcctcggctaccgggtgatcgaggtggacacctccgaatatcgcaagatcgacggcggcgtcagttgcatgtcgctgcgcttctgaaccatgccgcggcggaccgacccgccgcctcccgccgtcgcaccccggcgcaggctccgcctgcgcctggcgcgacataccggatgcagtttcggaggtgccacatggccgattcggacaagggaaaactggggctgccggcgctgaccgcgctggtggtgggcggcatcatcggcagcggcatcttcagcctgccgcagaacatggccgaaggcgcaggcgccggcgcgatcctgatcgcctgggcgatcaccttcgtcggcatgctgaccctgacgcggatattccagtggctgtcgaccacccgccccgaactggacgacggcgtctacggctacgcccgcgaaggcttcggcgaatacctggggttcaatgccgcctggggctactggatttccgcctgggtcggcaacgccggctacctggtggtgctgttcagcgccctcggctcgttcggcgcgctggccttcttcggcgacggaaccacctggccggcgctgctcggcgaattgacggtgctctggctgatgcatgccttcgtcctccacggcgtgcacaacgcggcgatcaccaacgccatcgtgaccctcgccaaggtggtgccgatcgccctgttcatcctctgcgtagccctggccttccgcatcgagacctttcacctggacttctggggcagcccggccctgggcaacgtcacccgccaggtggaaaccaccatgctctacaccgtctgggtattcctcggcatcgagagcgccacggtctatgccagccacgcgcggcacgcggccgatgtcagccgcgcaaccctgctcggcttcgtggtcaccctgctgttgctggtctgcgtctcggtgctgtcgctgggcgtggtgccgcagcacgaactggcgcagatgaagaacccctcgatggcccaggtgatggccgcggcggtgggcccctggggcgccacgctgatcaacgtcgggttgatcgtctcggtcggcggcgcgctgctggcctggaccatgctcgcggtggaaatgctctacctggccagccgtggcccaacgcacaccgcgccggcactgttcggccgcaccaatgcggtggaaaccccggcgccggcactgtggctgaccagcacgctgatctctgcgctgctgctggtggccttcctcaacgcctcgggctacaacgcgctgatccagttggccacctcgatggcgctgatcccctacctgctctgcgccggcttctgcctgaagctggtggcgcgccgcccgcactcgggcgcgatgctggcgctggcgctgttggggacgctctacggggtctggctgatctacgccgccgggctgaaatacctgctgctgtcgatgatcctctacgcgccaggcctgggcttcttcctgcatgcccgtcgccagcgcggcctgccggcgttcggcaatcgcgccgaaggcagcgtcgcggcgctggtgctgatcctcgcgctggcggcgctatggatgatcggcagcggtcggctgagcctctag

SEQ ID NO: 2769 - DNA, 585 bp, Pseudomonas aeruginosa
tcctgcaccccggacgagcggtcgtcccgacgcctgcgcccgccctcctgtctccggcataatcgcccgctgctggagtcttcccgaatgcccgaacacctcaacgcccgcgtcgaggcctgctatcggcaggccgaacacttcttccaacgcagcttcccccgcccgaccgtcagcttccgcctgcgcggccagaaagccggggtcgcccatctcgacgagaacctgctgcgcttcaatccccagctgtaccgcgagaaccgcgagcacttcctggaacagaccgtggcccacgaagtcgcgcacctgatcgcgcaccagttgttcggcccgcgcatccgcccccacggggaggagtggcagttgatcatgcgcggcatctacggcctgccgccggaccgctgccacacctacgcggtcaagcgccgcgccaccacccgctacctgtaccgctgccattgcccggagcacaacgacttcccgttctccccgcaacgccacaccctggtggccaaggggcgccgctactactgccggcgctgcaaggcgaccctggtgttcaccggcgaagtgctccgcgagtga

SEQ ID NO: 2770 - DNA, 570 bp, Pseudomonas aeruginosa
tggccacgtagatcagccgcgggttcgccgccttcagcgcctcgtagccgacgccgagcttgtccatcacccccggacggaactgttcgaggacgatgtcgtattcgcgtaccagctccagcaccacctcgcgtgcgccctgccgcttcaggtcgaggccgatggaacgcttgttgcggttcaggtaggcatgactggccgaggtgccgtcgacgtgcggcggcagcacccgcaccaggtccatgcgcccgggcgactccacgcgcagcacgtccgcccccatgtcggccagcagcagcgaggcgaacggccccggcaacagggtcgagaaatccagcactttcaacgatgacaacgggcctttcatgctccctcctctgggtcgccgggcattggtcgggatcgcctgccgagcagcctatccacccgccgcgcggcgcgacatggccgtggcgtcagagcttcatgccgcggctgatgatctctttcatgatctccgaggtaccggcgaagatccgctggatgcgggcgttggcgtacatcctgcagatcggatactcccacatgtag

SEQ ID NO: 2771 - DNA, 492 bp, Pseudomonas aeruginosa
aagaagccgcccttggcgtcgcccagcaggttttccttcggcacccgcacattgttgaagaacagctcggcggtgtcctggctcttcatgccgagcttcttcaggttgcgcccgcgctcgaagccttgcatgccgcgctccaccaggaacaggcccatggcgtgcttgttcgccggatcggtcttcgccgcgacgatcaccaggtcggccagcaggccgttggagatgaacaccttggagccgttgagcagccagtggtcgcccttgtccaccgcggtgctgcgcatgccggccaggtcggagccggcggacggctcggtcatggccacggcgaggatggtctcgccacggacgatccccggcaacaggcgggccttctgctcggcgctaccgtattcggcgatgtacggcccgcacaacgccgagtgcagcgggatcatgaagcccggctcgttgatccgcgccagctcctcgcacatgatctgctcgtag

SEQ ID NO: 2772 - DNA, 1122 bp, Pseudomonas aeruginosa
actgtcgctgtagagctggagggaaggcatggcaagtatcctagcagcgctggactatccggcgcctgggcgatgggggcggcgccgaccggggaaaccgcctcggccgcttcccgcacaccgaagaaagcagctaggctaaagtctctcgtttcgccacacatgctgaagcccaggtcggcggatgaaaaacgatcctttctacaacctgtttatagaaaaactgaattcatgggtgccgtcctcccgctcctcgcgctacgcgctttcgtcgaaaccgcccgccatggcaatctcacccgcgcggccgcggccatgggcgtcactcccggcgcggtaagccagcagctcagggctctgcaggcgcgcaccggcgtcgtcctgttccagcgcttcagccatggcatgcgcctgacgccggagggcgagcaggtctatcccggcctccgccaggccttcgagcagatcaccgcgagccttgcccagctggaggcgatcaatgcccgccagaccctcacggtcagcaccgagccctccttcgccgccacatggctggtgccgcgcctcggtcaattcagcgcgtcgcacccgcaggtggaagtccgcgtggaggctacggcactgctcgccgacctgcgccgggaacgaatcgacgtcgccatccgccacgggctcggcgactaccccggactcgacgtgcaggcgctgatggccccgccgctgatcccggtggccagcccgcgcctgctggcggaaggccctgagatccgcgaagcgatcgattgcctggcatacccgctgttgcaggagtcggagcgcaatgactggcgcatgtggctgcgggcgatgggggtggaggacgacccgcgcagcgagagaggtccggctttcgccgacgacctgctgctggttcgcgccgccgaggccggccagggtatcgcgctggtacgggagatccatgcccgcgccgagatcgccagcggccgcctggcggtcgccctcgagcggccctggccgagccgcttcgcctattacgcggtgagcctgccaggagcggcgcaacgagcgcccctctcgctgttcctcgcctggctgcgcgagcaggccgccgccgaggcataa

SEQ ID NO: 2773 - DNA, 1185 bp, Pseudomonas aeruginosa
gcgcaccatcgccagccatttcgtccgcgccgcgttgcgcggggccacgcgccaaggcctggacggccccgccctgctgcgtcgcgccggcatccagccggccctgctggacgaaccgcgggcacgcatcgcgccggagcagttcacccgcctgatgcagttgctctgggaagtgctggacgacgaatacatgggcttcggcgaagtccgcagcaagcgcggcaccttcgccatgatgtgccacaccctgattcattgccggaccctggaaaaggccctgcagcgcggcgaactgttctacggcctgttcccccaggcgccgctgatccacctgcggcgcgacggcgacctggtgcgcctgagcctcgaggaacgccacctgtcggacccggatcactttctcgccgaaagcctgctggtgatctggcaccgcctcgccagttggctgatcggccagcgcatccgcctggaggaagccaccttcagctacccggcgccggaccaccaggccgagtacgacctgctgtttccctgcccccggcggttttccgccggctgcaccagcctgctgttcgccgcccgctacctgggcatgccgctgctgcaggacgaacgcaccctcaagcagttcctccagcactctcccgccgacctgctggcgcgcccggacggcggcgacagcctgaccagccagatccgccgcctgctcggccgcgactgccggcgctggccggacctcgaccaggtcgcccgccaactgcacatgagttcgcagaccctgcgacgccacctgcgcgaggaaggcggcagcttccagcaactcaaggaccacctgcggcgcgacctggcgatctaccacctgggtcgggacgagctgtcgatccaggacatcgccgagcagctcggcttttccgagccctcggccttccatcgcgcgttcaagaagtggaccggcctcacccccggcgcgtaccggcaccaggcggaagcctgaagctcagcccaactcctggcgacgaagcccgctgcgcagttggtcgagcaccgtggcgaacggctgcggccgcccgaccgcgtagccctgggcgaaatccaccccgaggcgcgccaggtgatcgaggatttcccggctctcgacgaactcggccacagtcaccgcgcccaggcggtgggcgatctggttga

SEQ ID NO: 2774 - DNA, 852 bp, Pseudomonas aeruginosa
cacccgcacctgctcgcggttgccgggctcctcggcgagctggtcgccgaccccctgcaagaccgccagcggcgtcttcagactgtgcgccaggtcgccgagggagtggcggtagcgctcgcgctgcttgtgctcgctgcgcaacaggcggttcagcgagtgggtcaggcgcagcagctcgcgcggatgctcctcgctcaggctctcgcgctcgccggattcgatctggtccagctcggaactcaacccgcgcatcgcccggaagccccaggtcagacccagccagagcagcccgagcaagaccagcagggcgccgccgagccacaggtagagctgctcgcggaaccccttgagcaggctctcgaactcgctgaccgattgcatggtgacgatgctgtaggccgcctgcttgccgcgcagcaggtcgatctcgacgtcgaacacgaagaactcctcgcccttcgcatcgcgggtggtgtggaattcgttgccgcggccgtcgtagcgcggcgtgtagttgatcgactcgtcggccgccgaggtggagcgccagagcagatcgccattctggtcgtagatatagccgaggaccttggcctccggcaggttgaactcctccaccggcaggtgctcgggcatcaccaggcggcccttctccacccgcgccgccgagaccagggtcgccacgtcggcggccaggcgctgctcgatggtgttctccagggctatgccgaaggcccgctgcagggccggcagcagcgccagcatgaacagcaccgccagggcggcggcgccgagcatcagacggatgcgcagggaacggatcaccggcagcgctcggtgaacaggtag

SEQ ID NO: 2775 - DNA, 2544 bp, Pseudomonas aeruginosa
ccgaccgcgcgataccgtgctcgcccgaggagacaatcgatgaacctcacccgtcgtgaattcgccaaggccaacgccgccgccatcgccgcggcggcggccggcctgccgatcctggtccgcgccagcaacctggtgaccgaggcggacgtcaccagcctggtttggaacaaggccccctgccgcttctgcggcaccggttgcagcgtgatggtcgccacccgcgacggccaggtggtagccacccatggcgacatcaaggccgaggtcaaccgcgggatcaactgcgtgaagggctacttcctgtcgaagatcatgtacggcagcgaccgcctgacccgcccactgctgcgcatgaaggacggcaagttcgacaagcagggcgagttccagccgatcagttgggaacaggccttcgacatcatggccgagaagttcaaggccgcgctcaaggccaagggaccggagtcggtcggcatgttcggctccggccagtggacggtctgggaaggctatgcggcgaacaagctgttcaaggccggcctgcgcagcaacaacatcgaccccaacgcccgccactgcatggcctcggcggtgatgggcttcatgcgcagcttcggcatggacgagccgatgggctgctactacgacatcgaggccaccgacagcttcgtcctctggggctcgaacatggccgagatgcacccggtgctctggtcgcgggtcaccgaccgccggctcagcgcgccgcaggtcaaggtcgcggtgctgtccaccttcgagcaccgcagcttcgagctggccgacttgcccatggtgttcaagccgcagaccgacctgatcatcctcaactatatcgccaaccacatcatcgagagcggcgcggtgaaccgcgacttcgtcgagcgccacgtgcgcttcgcccatggcgccgaggacatcggctacggcctgcgcccggacgacccgctggagaagaaggcgaagaacgccgacaaggccaacacctggagcgatatcgacttcaaggccttcgccgagttcgtcaagccctataccctggagcgcaccgcgcgcgaaagcggcgtgccggccgagcggctgaaggccctcgccgaactctacgccgaccccaagcgcaaggtggtgtcgttctggaccatgggcttcaaccagcacacccgcggggtctgggcgaacaacctgatctacaacatccacctgctcaccgggaagatcagcgaaccgggcaacagccccttctcgctcaccggccagccctcggcctgcggcaccgcgcgcgaggtcggcaccttctcccaccggctccccgccgacctggtggtgaccaacccgaagcaccgggaaaccgcggagaagatttggaaggtgccggccggcaccatccaggagaaggtcggcttccacgccgtgcagcagagccggatgctcaaggacggcgtgctcaacgtctactggacccaggtcagcaacaacatgcaggccggtcccaacgtgatgcaggaagtgctgcccggctggcgcaacccggacaacttcgtgatcgtctccgacgtctaccccaccgtctcggcccaggccgccgacctgatcctgcccagcgccatgtgggtggagaaggaaggcgccttcggcaatgccgagcgccgcacgcagttctggcaccagttggtgaaggcaccgggcgaagcgaagtccgacctctggcagctggtggaattctccaagcgcttcaccaccgacgaagtctggcccgcggaactgctggcgaaggcccccgagctgaagggcaagaccctctacgacgtgctgttccgcaacggccaggtcgaccgcttcccggccagcgacctggccaagggctacgccaacgacgaggtcgacgcattcggcttctatatccagaagggtctgttcgaggaatacgccgccttcggtcgcggccacggccacgacctcgcccccttcgacgcctaccacgaggcgcgcggcctgcgctggccggtggtggacggcaaggagacccgctggcgctaccgcgagggctacgacccctacgtgagcaagggcagcggcgtgcagttctatggctatccggacaagaaggcgatcgtcttcgccctgccctacgagccgccggccgaggcgccggaccaggactacccgttctggctcgccaccggccgggtgctcgaacactggcacaccgggagcatgaccgcgcgggtcccggagctgtacaaggcggtgcccgacgcgctggtctacatgcacccggaggatgcgcgccagctcaagctgcgccgcggcagcgaggtcaaggtggtgagccggcgcggcgagatccgcgcgcgggtcgagacccgcgggcgcaacaagccgccccaggggctggtgttcgtgccgttcttcgacgccaacaagctgatcaacaaggtcaccctggacgccaccgacccgatttccaagcagaccgactacaagaagtgcgccgttcgcatcgaactgctcaacctggcctga

SEQ ID NO: 2776 - DNA, 516 bp, Pseudomonas aeruginosa
ggagcgcgccatgaaacctctgctgactgccctgctcctcgtcctgctcggcgcccccgcagccttcgccgccgacctcggctacccgctggacgcgcccgcccccgacggccgccgccccggcggcacgctggccgaaagccgccccgcgccgccgctggcggccgaggaaaacaaggacctgaaacgcgagcgcaactaccccgagcagccgccgaccattccccacagcatcgtcggctatcgcatcgacaaggacagcaacaagtgcctgtcctgccacagccgcgccaacagcgcgcgaacccaggcggtgatgatcagcatcacccactacatggaccgcgacggccagccgctggccgccgtctcgccgcgccgctacttctgcgtgcagtgccatgtgccgcaacaggacgtaaagccgctggtcgacaaccgcttcgagaacatcgaccagatcctcgagaaagaagccgccaatgcggcgcgcaaaccctgagggaggccgcatga

SEQ ID NO: 2777 - DNA, 573 bp, Pseudomonas aeruginosa
aagcactcatcgcctggctggccggttactggcgggtcctgcgtcgtcccagcgtgcatttcagcctgggcttcctcaccctcggcggcttcatcgccgggatcgtcttctggggcggcttcaacaccgccctggaggcgaccaacaccgagaccttctgcatttcctgccacgagatgcgcgacaacgtgttcgtcgaactcaaggacaccatccactacagcaaccgttccggagtccgcgccacctgtcccgactgccacgtgccacacaagtggaccgacaagatcgcgcgcaagatgcaggcctccaaggaggtctggggcaagatcttcggcaccatcaacacccgcgagaaattcctcgatcaccgccgcgagctggccgagcacgaatgggcacgactcaaggccaacgattcgctggaatgccgcaactgccacaacttcgagttcatggacttcacccggcagagcgtgcgcgcgcggcagatgcactccaccgccctggccagcggcgaagccacctgcatcgactgccacaaggggatcgcccaccacctgccggacatga

SEQ ID NO: 2778 - DNA, 1224 bp, Pseudomonas aeruginosa
agggctggtagcgccgcccgcggaccgggcggcgcggcgcaatcagggctgggcgcccttcagcgcctcgaggatcttgcgcccggcgcgaccgtcggccggggtcaggccgaggcgcttctgctcggcctggatcgccttgcgcgtgctggtgccgatcagcccgtcggcctcgccgatgtcgtagccgcgcgccagcaacgccttctgcaattgcttgcgctcgagccggctgatgcccgggtcgtcggtcggccaggacgccaccaggccgctgccgccgcgcaggcggtcggaaagcagggcgatggccagcgcgtagctttccgcggcgttgtaggaatagatcgcatcgtagttgcgatagaccaggaaggccgggccctgggccccggccggcaggaggatcgcggccttctcgtcgccgcccggcagcggctggccgtcgacccgcctcacctcacgggcgacccaggccgacagcggctggcgcttgccgcgcccggccaggctggcggggaagtcggccggcaccttcacttcatagccccacggctgtcccgtgcgccagccagccttcttcaggtagttggcggtggaaccgagggcatccggcacgctgcctaccaggtcgcggcgaccgtcgccgtcgaagtccacggcgatccgcgcgtaggtcgatggcatgaactgggtatggccgaaggccccggcccaggagccggtgatgccggcgtcgcggatgtcgccggcctgcaacagcttcagggtggcgaggaactcgccctggaagaacgactggcggcgcccgtagcaggacagggtcgacagcgaggtcagcagcggacgcttgccgaagatccgcccgtagtcgctttccacgccccacaccgccaccaccgtgtacttgtccacgccgtagcgcgcggccacctggtcgagcagcttgtcgtgctgggcgagcatcgccttgccatcgctgacccgctgctcgtccaccagaccggccaggtagtcccacagcggggtggtgaactccggctgcgcgtcgagcaggtcgagcacgctgaggtcggcctgcaggccgctggtgaagcgctcataactgtcggcggaaatgccctgcgcctgggccttcttctgcaggccggcgaaggatggaaggaagctcgatgcgtcgggttgcgccacgggccaggcgggtatcatggccaccgaggataa

SEQ ID NO: 2779 - DNA, 1020 bp, Pseudomonas aeruginosa
aaggcgggtgaaaccttgctcgggcagactggcggcggaatacgcatgccgggtgtctcgcggccgatccgccgcgtcacatccgtgcccgaacgcgctgcgccacccgcgcgtccgttttccgggcactggccgggcgttcgccggtccaagcagtgttccccgcctccgtccacaagccggagccggccccgacggtcccagaccaccgcaggaaagccgggcggccgccacccgccaccgccccgggctttccaccctcactacacgtttcggagtacaaccttgatccactggttgagcgacccgacgttctggacagccctgctgcagatcgtcgccatcgatatcctcctgggcggcgacaatgccgtagtcatcgccctcgcctgccggcacctgccggcgcaccggcgcaagcaggcgatcttcggcggcgtcgccggtgccatcctgatccgcatcctgctgctgttcttcgccctgcacctgctcgacctgccctacctcaaggtaatcggcgcgctcctgctgctgtggatcggcatcaagctgctgctgccggaggaggagaacggcgacgacatcaagggcagcacccacctgctcggcgcgatcaagaccatcatcatcgccgacgcggtgatgagcctggacaacgtcatcgccctgtccgccgcctcggccggggatttcttcctggtctccctgggcgtgctgatcagcatcccgatcatcgtctggggcagccagctgatcctgcgcctgatcgaccgcttcccgctgatcatcctcttcggcggcggcctgctcggctggatcgccggcggcatgctgctcaccgacagcgccctgaagccctggctggcgccctacgcgcaatgggattcctacctgcactacggcgcggcggccttcggcgcgctgttcgtgatcctcctcggcagcctcctggcgcgccgccagttgaagcagcggcatgccgcgccggcggacgccgccgaaagcgaaggccgctaa

SEQ ID NO: 2780 - DNA, 429 bp, Pseudomonas aeruginosa
gagcaacggggcgcccgggggcgccccgtcctctttctccggctcagatattggtgctcgccgggatccggctcggcaacaggtactcgtagggcctgcggcgcgcctggttgcgcgtgcgaatggtcgcctcgacctccttcaggcgtgcctggaagcgctccagcgggccgccgctggcggtcacccgcctgtccgaaaacaccggcgcgtaggggaacccggtctgccggtagtcgcccaggcgaccgtggtagaccgaaccgagcaggtgatagatgttcaccttctccagcgccaccagggtcggcggcatcatcttcaaccaatcggcctcgctcttgccgcctggcgagtccggtgccggcgccgcgctcatggcacagatggctggtgcgtaggtcatcatcgaaggctggggaaaattga

SEQ ID NO: 2781 - DNA, 594 bp, Pseudomonas aeruginosa
tggccgggcggccctggggaatggtcaggttccaggtactcaggtcaggcatccagacggtgtcctagcgaggggaagggactcgcccatagggtagatgagcggcgcacgctttgcctggccgaatggcccgcgtttgagcggcgcaaggccggcaccgagggttttccccgcgtcccgcgcacaagcgtctatcttgatcggggaccctttcacggagagatgccatgcgcctgttctgcgccctgctgctcatcgcctgcgccgccagcgcccaggccgctatccagacccgcgagatgccttaccggagcgcagacggcacgcgcatggtcggctatttcgcctacgacgacagcaagccggggatccgccctggggtcatcgtggtccacgaatggtgggggctcaacgactatgccaaacgccgcgcccgcgacctcgccgaactcggctacagcgccctggccatcgacatgtacggcgaaggcaagcacaccgagcacccgcaggacgcgatggccttcatgcaggccgcgacccgggatgccgacgccgccaaggcgcgcttcctcgccggcctggaactgctga

SEQ ID NO: 2782 - DNA, 858 bp, Pseudomonas aeruginosa
ctggtgggccacgtcgggaaccggcacaatgcgcgccatgaacgaccgtctcccctccttctgcaccccactggacgaccgctggccgctgcccgtcgcgctgcccggcgtgcaactgcgcagcacccgcttcgacccggcgctgctgcaacccggcgacttcgccctggccggcatccagccgccggcgaacatcctccgcgcggtggccaagcgccaggccgagtttctcgccgggcgcctctgcgcacgcgccgccctgttcgccctcgatggccgcgcccagacgccggccgtcggcgaggaccgcgcaccggtctggccggccgcgatcagcggctcgatcacccatggcgaccgctgggccgccgccctggtggcggcgcgcggcgactggcgcgggctcggcctggacgtggaaaccctgctcgaagccgaacgggcgcgctacctgcatggcgagatactcaccgaaggcgagcgcctgcgcttcgccgacgacctggagcgacgcaccggcctgctggtgaccctggcgttctcgctgaaggaaagcctgttcaaggcgctctatccgctggtgggcaagcgcttctatttcgaacatgcggaactgctggaatggcgcgccgacggccaggcccggctgcgcctgctcaccgacctgtcgccggagtggcgccacggcagcgagctggacgcccagttcgccgtgctcgacgaacgcctgctcagcctggtggcggtcggcgcctgatcaggcgttccccggcgtgcgccgcgacggccgcagcgcgcggccgtccgccaggcgctcgacggcgcgggcggcggcgaccatgccgaaggtggcggtga

SEQ ID NO: 2783 - DNA, 456 bp, Pseudomonas aeruginosa
catgcgccgccccgtgttcagcgaaacatccggaacctggtttcatctctatgtcttcacgcaagatcgggctcaacctggtggtcatcgtcgccctggccgccctcttcaccggcatctgggccctgtacaaccgtccggtcagcgtaccggactggccggaacgcatctccggcctctccttctcgccgttccgcctcaaccagaacccgcagagcggccgctaccccagcgccgaacagatgcgcaccgacctggaactggtcgcccggcacacccacagcatccgcacctattcggtccagggcgcgctcggcgacatcccggcgctggccgaggcgttcggcctgcgcgtcagcctgggcatctggctcggcccggacctggccagcaacgaggccgagatcgcccgcgccatccgcatcgccaacgagtcgccgagcgtggtgcgagtga

SEQ ID NO: 2784 - DNA, 873 bp, Pseudomonas aeruginosa
tcgacgaccagggcatgcttctgcgggcgcggcgcggcggacatgaaaggcagcctggcgtcgatgatcgtcgccgtcgagcgcttcgtcgccgaccacccggagcacaagggtgccatcgccttcctcatcaccagcgacgaggaaggcccggcccaccacggcaccaaggcggtggtcgaacgcctcgccgcacgcggcgagcgcctggactggtgcatcgtcggcgaaccgtcgagcaccagcctggtcggcgacgtggtgaagaacggccgccgcggctcccttggagccaagctgaccatccgcggcgtacagggccatgtggcctacccgcacctggcgaagaacccgatccacctggccgccccggcgctggccgaactggcggcggaacactgggacgacggcaatgccttcttcccgccgaccagcttccaggtttccaacctgaactccggcaccggcgccaccaacgtcatccccggcgaactgaccgcgctgttcaacttccgcttctccaccgaatccaccgtcgaaggcctgcagaaacgcgtcgaggcgatcctcgacaagcacggcctggactggcacgtcgaatgggcgctgtccggcctgccgttcctcaccgagccgggcgaactgctcgatgcggtggccgccagcatcagggcggtcaccggccgcgagacccggccctcgaccagcggcggcacctccgacggacgcttcatcgccaccatgggcacccaggtggtcgaactcggcccggtcaacgccaccatccaccaggtcaacgagcgggtcctggccagcgacctggagctgctcaccgaaatctactaccagaccctggtgaggctgctcgcctga

SEQ ID NO: 2785 - DNA, 240 bp, Pseudomonas aeruginosa
acgatccgccggacgatggacagtcccaggccatgcccgccggaagcacgggtccggctatcgtccaggcgtaggaatggcgtaaagagccgctcccattgcgcctccggcacccccggcccgtcgtcctcgacatccacccggcaacgctccaggctgacccggaagctgatcctgacccgacgatcggcatgccgcagcgcattggtcagcaggttctgcaaggcccgatgcaggtag

SEQ ID NO: 2786 - DNA, 288 bp, Pseudomonas aeruginosa
gtctgcgccggtgctttccgagggcgacgaatggcattctccagcgctgccgcggcctacggacgcttcctaggactcacgcacagaagacccacactttatccacaggtttcccccagactgtcactttgcaaacaccccattagcgcattatcttgtatccccatcgtcgccaccccctatatgttgggtttcgagcgcacgaacggctacaacggaaccaaccgcgcacggaccactctgatggctccggcggctccgcaaaaaagcattttccagacgtactga

SEQ ID NO: 2787 - DNA, 1431 bp, Pseudomonas aeruginosa
cggtcgctcgtccagcgccacgctggcagcgcaaggcccctcgccagggccaggaacaatccccttcttccctccgggggagaagaacggcccggccagaccgtgccggaccaccgctttcgcgtgcacctcacgccccatatccaggccgccgagacggccgccagaccaggagagagcaagatgctgagctgggacgaattcgacaaagaagacccgaccgaagccaaggccgcgcccgccgccgcccaggccgttgcccagggccatgacaagctggacgacgaagccgccggctcggtggaagaagcgcgcgccgtttccgccgacgactccgacgccgtcgcccgcgccaagaaggccctgaacgacctcgacatccaggaaggcctggacgacctcgaaggctccgccgcgcgcgtgcaggtcggcgacaagcagatgatcaacgcccgcgctgacctcaaccagctcgtccccttcaagtacgactgggcctggcagaagtatctggatggttgcgccaaccactggatgccgcaggaagtcaacatgaacgccgacatcgccctgtggaagagcaaggacggcctcagcgaacacgagcggcgcatcgtcatgcgcaacctcggcttcttctccaccgccgactccctggtcgccaacaacctggtgctggccgtgtaccgcctgatcaccaaccccgagtgccgccagtacatcctgcgccaggccttcgaagaggcgatccacacccacgcctaccagtactgcatcgagtcgctgggcatggacgagggcgagatcttcaacatgtaccacgagatccccagcgtggcgaagaaggcctcctggggcctgaagtacacccgctcgatctccgacccgatgttccagaccggcaccccggaaaccgaccgccagttcctgcgcaacctgatcgcctactactgcgtgctggaaggcatcttcttctactgcggcttcacccagatcctctccatgggccgccgcaacaagatgaccggcaccgccgagcagttccagtacatcctccgcgacgagtcgatgcacctgaacttcggtatcgacgtgatcaaccagatcaagatcgagaacccgcacctgtgggacgcccagatgaaggacgaggcgacccagatgatcctccagggcacccagctggagatcgaatacgcgcgcgacaccatgccgcgcggggtgctggggatgaacgcggcgatgatggaggactacctgaagttcatcgccaaccggcgcctgacccagatcggcctgaaggaagagtatccggggaccaccaacccgttcccgtggatgtcggagatcatggacctgaagaaggagaagaacttcttcgagacgcgggttatcgagtaccagacgggcggagcactgagctgggattga

SEQ ID NO: 2788 - DNA, 627 bp, Pseudomonas aeruginosa
cggaaatgcctatcaccaatcccatatctccatccacaccgcttcatcccaccacctccccggaggtgcgccatgtctgacaccctcctccaccccagccgtttcacccaccaccatcgggtcctgcacgccgtgctgctggatgaggaaggctggttcgtgctctccgacctggtacggctgctgggccgttacctgggcggtcgggcgccggcggcgttgtgtgacgaggcgccgtggccgctggcaacggcggagcagcgcgagcgcttgttcgccctctgccatgcactggaacggcacctggatgccgatcagtggcggatcgcctggctccatgacgaacgccacgggccacgccaggactgcctggtcagcgagtccgggctctacgctctgctctggctcgcagtgcctggcgcggcacggggtttgcgccgttgggtcagcggctcggtgctgccacgcctgcgcagccagtcccgccccaacgccacgccccagcgcgccgtgctgcactggaaaaccgccgagatcgacaccctgcactggcaaggcaagacctggatccccctctccgactgcccccaactcctcgacagtccacgcccgctgatccgggcctga

SEQ ID NO: 2789 - DNA, 240 bp, Pseudomonas aeruginosa
gactcctcggtagggaactttttcttattgtttgtgtatatgtcttcaacaaactcaagaaactctttttccgtatattcggaaatcttggacttcatatcacttccctcccttgtggatttctatatgacgttttggcgttactgcaacaaggttccccatattgtaaacgccgcctccatctgctactcgaaccttgtggtggatttcgatctttattctcccgccagcctgttctga

SEQ ID NO: 2790 - DNA, 2304 bp, Pseudomonas aeruginosa
tggaactcggcgatggccaggtctccgaccgcaagcaatggcccgccgcacgcttcgcggcgatgctggcacaggcatagtcggaaccgctgcaatcccaacccgaccaagctccccttgatcgatcctgaggggggctcgtcactcgcccagtgccttaattactctcatccaaagcccaggaacggttgtccgtcccctcgcccatggatatttcttccactctgcaatccagttcataaatcccataaaagccctcttccgctccccgccagcctccccgcatccctcaccctagacgccccgccgctctccgccggctcgcccgacaagaaaaaccaaccgctcgatcagcctcatccttcacccatcacaggagccatcgcgatgcacctgatatcccattggatccccctggtcgccagcctcggcctgctcgccggcggctcgtccgcgtccgccgccgaggaagccttcgatctctggaacgaatgcgccaaagcctgcgtgctcgacctcaaggacggcgtgcgttccagccgcatgagcgtcgacccggccatcgccgacaccaacggccagggcgtgctgcactactccatggtcctggagggcggcaacgacgcgctcaagctggccatcgacaacgccctcagcatcaccagcgacggcctgaccatccgcctcgaaggcggcgtcgagccgaacaagccggtgcgctacagctacacgcgccaggcgcgcggcagttggtcgctgaactggctggtgccgatcggccacgagaagccttcgaacatcaaggtgttcatccacgaactgaacgccggcaaccagctcagccacatgtcgccgatctacaccatcgagatgggcgacgagttgctggcgaagctggcgcgcgatgccaccttcttcgtcagggcgcacgagagcaacgagatgcagccgacgctcgccatcagccatgccggggtcagcgtggtcatggcccaggcccagccgcgccgggaaaagcgctggagcgaatgggccagcggcaaggtgttgtgcctgctcgacccgctggacggggtctacaactacctcgcccagcagcgctgcaacctcgacgatacctgggaaggcaagatctaccgggtgctcgccggcaacccggcgaagcatgacctggacatcaagcccacggtcatcagtcatcgcctgcacttccccgaaggcggcagcctggccgcgctgaccgcgcaccaggcctgccacctgccgctggagactttcacccgtcatcgccagccgcgcggctgggaacaactggagcagtgcggctatccggtgcagcggctggtcgccctctacctggcggcgcggctgtcgtggaaccaggtcgaccaggtgatccgcaacgccctggccagccccggcagcggcggcgacctgggcgaagcgatccgcgagcagccggagcaggcccgtctggccctgaccctggccgccgccgagagcgagcgcttcgtccggcagggcacaggcaacgacgaggccggcgcggccagcgccgacgtggtgagcctgacctgcccggtcgccgccggtgaatgcgcgggcccggcggacagcggcgacgccctgctggagcgcaactatcccactggcgcggagttcctcggcgacggcggcgacatcagcttcagcacccgcggcacgcagaactggacggtggagcggctgctccaggcgcaccgccaactggaggagcgcggctatgtgttcgtcggctaccacggcaccttcctcgaagcggcgcaaagcatcgtcttcggcggggtgcgcgcgcgcagccaggacctcgacgcgatctggcgcggtttctatatcgccggcgatccggcgctggcctacggctacgcccaggaccaggaacccgacgcgcgcggccggatccgcaacggtgccctgctgcgggtctatgtgccgcgctcgagcctgccgggcttctaccgcaccggcctgaccctggccgcgccggaggcggcgggcgaggtcgaacggctgatcggccatccgctgccgctgcgcctggacgccattaccggccccgaggaggaaggcgggcgcctggagaccattctcggctggccgctggccgagcgcaccgtggtgattccctcggcgatccccaccgacccgcgcaacgtcggcggcgacctcgacccgtccagcatccccgacaaggaacaggcgatcagcgccctgccggactacgccagccagcccggcaaaccgccgcgcgaggacctgaagtaa

SEQ ID NO: 2791 - DNA, 507 bp, Pseudomonas aeruginosa
acgtcctggcagtcgcctggctgtcgttcgaggcgctcaacgtcgcctggccgcgggccagcctcgccccgcccgacgcgccctggttccaggtctgggcggtggtcgtggtgttctccgcgctggccgcgttcggcctgctctacatgctcatcgccaagccgcatcggcgcatcgccaccagcctcagcttcgccgctccgccggcggactgacccgcacgcgccggccgttccggcgcctcctccggttgttcccgcacgctggcttcgcgcccggcggggcccggctcatcctgctttcacggagcatcgccatgagcgacctgcattactggaactaccccaccgatatcctctgcggcgtcggcgccctggaacaactgccgaggcgttgcgcgctggcgggcgcacgccggcccctgctggtcaccgatcccggcatgctcgccctgtagcccctgcgcctggtgcgcgagtgcctgtaacgcgccgggttcgaccatga

SEQ ID NO: 2792 - DNA, 993 bp, Pseudomonas aeruginosa
cgcgctgatcgctctcggcggcggcagcgccctcgacgcggccaagggaatcgccctgctcagccgcgatccgcacggcctcgaacgcttcgaatggacacagacgctgcgcagctatccgaccctcgccgactacccgctgctcggcctgccgccgctgctggcgcttcccacgaccgccggcaccggctcggaactgggacgcgaggcggtgctgaccgacacgcaactgggcatcaagcgggtcgtcggccaccgcgagctgctggccgcctgcgtattcctcgacccgcgcctgacccgcgggttgccgccgacgctgagcgccgccaccggcatggacgccctcacccatcacctggaggcgctgttctcgccgctctaccatccgatgtcggcgggcatcgccctggaaggcgtgcgcctggtcaggcagcacctggaaaacgccgtgcgcgacggcaacgacctcgccgcccgggaaggcatgctggtagcctcggccagcgccgcagtggcattccagaaggggcttggcggggtccacgccctggcccacccgctgggcgctcgccatcacctgcaccacggcctgctgaacgccgtgctgctgccctacgttctgctggccaaccgcccggcgatagaagccgacgccgcgcgcctggcgcgctacctggaactcgacgaagcgagcttcgacggcctgctggcgtggatcctcgaactgcgcgcgcgcatcggcatcccggcgaacctcgccgccctcggtctggatggcgaggacgcgcaatgggtgggcgagcaggcgctggccgacctatcgtcctcggcgaccaacgccctgccgctcgatgcccgggattatgcgcgcatctaccgccaggcggtggccgggactctcgcctgagcgctcaggaccccaggccgtggacctgcagcaggtcgtcgatgaaggcgcgggcggcttcgctgagggggcgcccggcatag

SEQ ID NO: 2793 - DNA, 1590 bp, Pseudomonas aeruginosa
accataaaaatacccagtgctagattgaccttcgccagccggcccagcctgaccggatcggcgccacgcaccgccaccaagccttcacaatccatctcagcctcggcaggaccgagcaggagcgcgtcgacagccaaccttgcgcacgaaaaaagtcatgggaaaggcatctggcctagaccatgcatccggacagctttgcagcagcacaacaagaacaacctccccgcactgtctagacccatagggacccacatgaacaaccacaacggtaccctgcaccgtggctggcaatcgctccagcgctggcgcatccagatcttcgtcatcacctggctggcctacgccgccttctacttcacccgcaaggccttctcggtggccaagctcggcatcgccgaagacccctccttcgagctcgacaagagcgccatggccgatctcgatgccctctacctggccgcctacgccgtgggccagttcatgtggggggtgttcgccgaccgcttcggcacccgcgtggtggtgctcggcggtttgctcacctcggcgctggcggcgctggtgatgggtaccttcgccaccctgccgatcttcgccgcctgcatggtggtccagggcctggcgcagtccaccggctggtcggggctgtgcaagaacatcggcgccttcttcgccacctacgagcgaggccgcgtgctcggcctgtggagtacctgctacgccttcggcgggctggtggcgacgccgttcgccggctggtgcgcctaccggttgacgcatgactggcgcatggccttcctgtcctcggcgggagtggtgctggcggtggccgtgctgttcttcttcctccagcgcaaccgtccgcaggacgtcggcctgccgcccgtggaggccgaggccgcgccccccgccaacgcgccccggccaagccattccggcgccctgctgaaggcgctcaggaatccccacgtgctggtcctcggcctcgcctacttcctgctcaagccggcgcgctacgcgatcctgctctggggcccggtgatcatctacgaacgcatgccggagatcggcaaggtcgcctcggccatcgtgccttcggccttcgaggtcgccgggctggccgggccgatcctcatcggcctggcctcggacaagctgttcggcgcccgccgcatgccggcctgcgtgctcagcctggcggcgctgaccgtgagcctggcgttgttcgtcccggcgatgcagagcggcagcctgtacctggtggtcggcctgctgttcatgatgggcgtcaccctctacgggccggactcgatgatcagcggcgctgccgccatcgacttcggtaccagcgaagcagccggtaccgccaccggcttcgtcaacggctgcggctcggtcggggcgatcctcggcggcctgctgccgggctacttcgacaccctcacggtgttcttcgtgttcaccgccaccgcgctgctcgccagcctgctgctggtgccgttctggaacagccggccaggcgcgtgccgcgtcgaaccgaaggcgcatgccggcgggccgctgctggcggccggcaagccgcgttga

SEQ ID NO: 2794 - DNA, 771 bp, Pseudomonas aeruginosa
aacctcgccgaaccaccgcccggcgccaggcgtgccgggccaatccctagcgaacaaggaaccgcctatgccacttgccctcttcgacctcgacgacaccctgatcgacggcgactgcgcgaccctctgggggcgctacatgaccgaactgggctgggtcgagaagaccgccttcctgcaccaggaacgccgcctcatggaactctatgccgagggccggctggccatggaggactacatggacttcagcctggcgcccatcgccggccgcaccccggcggagatcgccggcgccgtcgaggatttcgtcgcgcggatcatagccccgcgcatccacgccgacgccctgcgctgcctggaacgccaccgccaggccggcgaccgcctgctgatcatctccgcctcggcgcacttccttgtcagcgccatcggccgccggctgggggtggacgaggtgctggcgatcgacatcgaggagcgcgacggcctctacaccgggcgcacccgcggcaccctcacctaccgcgagggcaaggtccgtcgcctcgaagcctggctggcccaggagggcgagacgctggccggcgcgaccttctattccgactcgcgcaacgacctgccgctgctctcgcgggtcgaccggccgcacacggtgaaccccgacccggcgctgctcgggcacgcccgcgaggccggctggccagtgctggaatggcgctgagaaggcgcgccgcgctataccgccggcggcccggaagcattaccctgtag

SEQ ID NO: 2795 - DNA, 870 bp, Pseudomonas aeruginosa
gccggtagcaagacaacaacgaggaaacgctccatgtccaagtccagctactacgcgccgcacggcgggcacccggcacagaccgagctgctcaccgaccgggcgatgttcaccgaagcctatgccgtgattcccaagggggtgatgcgcgatatcgtcaccagccacctgccgttctgggacaacatgcgcatgtgggtgatcgcccgcccgctgtccggcttcgccgagaccttctcgcagtacatcgtcgaactggcgcccaacggtggcagggacaaaccggagcaggatccccacgcccaggccgtggtgttcctcgtcgagggcgagctgagcctgaccctgcagggccaggtccacgccatgcagccgggcggataccccttcattccgccgggcgccgactacaaggtgcgcaataccaccggccagcacacccgcttccactggatccgcaagcactaccagaaggtcgacggcgtaccgctgccggaagccttcgtcaccaacgagcaggacatccagccgctggtgatgccggacaccgaaggccgctggagcaccacccgcttcgtcgacatgagcgacatgcgccacgacatgcacgtcaacatcgtcaacttcgagccgggcggcgtgatccccttcgccgagacccacgtgatggagcacggcctgtacgtgctggaaggcaaggcggtgtaccgcctgaaccaggactgggtcgaggtggaggccggcgacttcatgtggctgcgcgccttctgcccgcaggcctgctattcgggcggcccggggcgcttccgctacctgctgtacaaggatgtcaaccggcacatgcgcctgaccctcaatgcgccgcattga

SEQ ID NO: 2796 - DNA, 483 bp, Pseudomonas aeruginosa
gggcgggacaggctgaaagggaacccggcgccatggcgccgggtttttcgtttgcggaaggcgcccagcccttcgtcagctccgggcgcggaggacttcagggcgaaccgaacatggccgtccagtagattcccgcgtcgctcttcggatcggtggcgtaggccgcgcccagctcgcggtagccggggttcatcaggttggcgcagtggcccgggctggccagccagccgtcgaccaccttgtccaccccgtcctggccggcggcgatgttttcgccgatcagcccgccgctgtagccggccagctcggcgcggtcgccgggggtgcggccgtcgcggtcgaggtggtcgaagaagttgccgttggccatcgcccgcgaatgcgcttcggcggcgccgccaagggtggcgttccaggccagcggctgggccgctgcgtaaggtttgccaccgcactggcgggcttgcccgcgggcggcgttga

SEQ ID NO: 2797 - DNA, 654 bp, Pseudomonas aeruginosa
ccacccggccgtcgcggatcggctcgccgcccagggtcagttcgcgctggctgtgccaatagggttcgtacatcaccaggtcgtggccgcggaaacgctcgccgggcaccggtacgccgttgcgccgcaggtagtccgcggaagcgaacaggcccatgggccaactggcgagttttctcaggatcaaatcgggattttccggccgcagggtgcgaatcgcgatgtcggtctcgcgcttgggcagatcgaccacggccgaagcgctgtcgagcagcacgcggatatccgggtgttcaaggtgcaggcgggccagggcgggtagcacgaagtcgacggccagggagtcggtggtggacaaccgcacctcgccggacagtcggtggtccatcccgcgggtccgccgcagcaactccagggccgagcgttccatcttctcggccagttcgaaggccgcctcgccggccggggtcagcaggtagccggacgaggtgcgcaggaacagggtcgagcccagcgccgcctccagcgacgccagccgccggcccaccgtggcctggtcgacgtgaagcgcgcgggcggcgccgcgcagggtgtgctcgcggcagagcgcgaggaagacgcgggtgtcgtcccaattcatggcggttttcctga

SEQ ID NO: 2798 - DNA, 984 bp, Pseudomonas aeruginosa
ccggcgcttcctgccggccatccatctcgacggactgacgctcaggcaattgtctctggacggcctgacgaccccgcagcgcacctcgttcctgatctcctccggctgcctgctgacccgcgaggcctaccagcgcctcggccacttcgacgaggaactgttcatcgaccacgtggacaccgaatacagcctgcgcgcccaggcgctggacgtgcccctgtacgtcgacccgcggctggtcctcgagcaccgcatcggcacgcgcaagacccgccgcctcggcggtctcagcctcagcgcgatgaaccacgccccgctgcgccgctactacctggcgcgcaacggcctgctggtcctgcgccgctacgcccggtcctcgccgctggccctgctggcgaacctgccgaccctgacccagggcctcgcggtgctcctgctcgaacgcgacaagctgctcaagctgcgctgcctgggctggggcctgtgggacggcctgcggggacgcggcggcgcgctggagaccaaccgcccgcgcctgctgaagcgcctcgccggcccggccgtggcgtccgtagcttccggcaaggccaaggcctagtcggcgaaacgcattcccgcatagggcgcttgccggcacgccgcgagccggctgcgcaggtcgccgacgtgggcctccaggcgatggccgtccgggtcgaggaagtagaacgaatcgccctcgctgcggttctgcttccattcgcgcacgccatgcgcgcgcagctgcgcggcgaagcgggcgaaatccgcggcggcgatgccgaaggcgtagtgcgtgtagtccgcggccggcccaccgtactgcggctcccgggacaggcacagccacagcgaacccagttcgagataggcgccctggtcccagcgcgcttccaggcgaaagccgagaagatcgcggtagaaggcgatgctggccggcaggtcggcgacgccagggtcaggtga

SEQ ID NO: 2799 - DNA, 1056 bp, Pseudomonas aeruginosa
agtaatcgctccgtgccgccgggcgcattgccggcaagcgttttcccgatctgcaggagtatttccatgagtgttgaaagcattcgcatcgagggtatcgacacgccggtctcgcgcatcggcctcggcacctgggccatcggcggctggatgtggggcggcgctgacgacgcgacgtcggtggaaaccatccggcgtgcggtggaatccgggatcaacctgatcgacaccgcgccggtctatggcttcggccattccgaggaggtcgtcggcaaggccttgcagggcctgcgcgacaaggcggtgatcgccaccaaggcggcgctggagtggagcgacgcgggcatccaccgcaacgcctccgccgcacgcatccgccgggaggtcgaggactcgctgcggcggctgaaaaccgatcgtatcgacctgtaccagattcactggccggacccgctggtggcgcacgaggaaaccgccggcgaactggagcgcctgcgccgcgacggcaagatcctcgccatcggcgtgagcaactattcgccggaacagatggacgggttccgccagttcgctccgctggccagcgtgcagccaccctacaacctgttcgagcgcgccatcgacgccgacgtgctgccctacgccgagcgtaacggcatcgtcgtgctggcctacggagcgctgtgccgcggcctgctttccggacggatgaacgccgagacccgcttcgatggcgacgacctgcgcaagtccgacccgaagttccagcagccccgcttcgcccagtacctggcagcggtcgcgcaactggaggaactggctcgcgagcgctatggcaagtcggtgctggccctggccatccgctggattctcgatcgcggccctacggtggcgctgtggggggcgcgcaagccggagcagttgaacggcatcgccgacgccttcggctggcgcctggacgacgaggccatggcccgcatcgagcggatcctcgccgagaccatccaggatccggtcggtcccgagttcatggcgccgcccagccgcaacgcctga

SEQ ID NO: 2800 - DNA, 876 bp, Pseudomonas aeruginosa
tcggacggccggggcggcaacgcccctggccgctggcctgacggagcggcggaaggcaaaatggcggtttttctcaaggactgccggatcagttatggaaaacgtctacaagaccccggaagcgcccctggtggaaacccgcggcgcgaagcgggcgcatttcttcgtcacttccctgggcaagatgagcgtgctcttcctcgtcaccctggggctgtacggcgtgtactggatgtacaagcactggaaggcccagcaaccgcagatggagcggcggatcagcccggtatggcgggcgatcttcggcatcttctttttccacgccctcgcccggcggatccaccaggccctgccggaagagcgccaggcactatggagcccgagcaaggatgcgacctgggcggtgctgctgacggtcgcggcgaacctgatcagccacctcaccgatgtggtccccgcgctggagccctactcgctgccctcgctcctgctgctgctcacgccgctgatcccgatgcgcaacatccagcgccaggccaacctcgccagcggcgacccgcagggcacgggcaacgccggctattcgggctacaacctgctgttcatcgtgctcggcgcgctctactggctgctgatcctgatcggttccgcggtgatcctcttcggctcgtcccagggctgagccgcctcagccgggaaacgcccggcgcaacagttcgggcagcacctcgccggccggaccgacgagacagtgttcgcgcggatggcgggtgcgcaccggttgcgggttcacatgcacgacgctggcaccgtgttccagcgccagtccgggtatccgcgccgccggctgcaccacgccggaagtgccgacgctga

SEQ ID NO: 2801 - DNA, 681 bp, Pseudomonas aeruginosa
tttgacaccgaacggctttctttcccggcacatccggtaatattcgccgcacaccgactacactggccagtcgtgccaccccgctacgttttcctggaggaaacctttttgccttcgttgcccaccttgcagcccctcgacctctacaggcgcaccctggcctgcctggtcctggcggtttcctgcctgggcggcggaggcctgtgggcggacgacgcacggacgtcggtcgagcaacgcagcaatgcggtcagccaggttctgctgggcatattcagctacgtgcgctggccgaaggagccggcggtcctgcaactctgcgtggtcggaccgaccgagtacgccgacggcctgctccgcggcatggtgcaggccaatggcaggcgcgtgcatgcggaacgccgcgcggtggacaacccggacctcggcacgctctgcaacgtgatctacctcggagtggtcgacgagcgcgagcgccagcaggtgttccgcagcctggccgggcatccggtcctgtccatcagcgagcgtggcaccgaatgcagcgtcggcagcatgttctgcctcaacgtcggcggtccgcgcatcaccttcgaggccaatctcgactccatcgcccgcagcggcgtacgcgtgcacccgagcgtattgaaactggcaaggcggcaggccactccgtga

SEQ ID NO: 2802 - DNA, 510 bp, Pseudomonas aeruginosa
acagtgctaccccagaggctccacccaagtagattgcttgccctcgccctgttcagccttgtgctgggcctggccggttgccagaccaagccgccgcagaccggcctgagcgccgagcagatcgccgtgctccaggagcagggcttcgaactccgcgacgaaggctgggagttcggcatgtcgagcaaggtgctgttcggcaacaatctcgaccgtctcaatcccgacagccgcaacaccctgaccaagatcgcccgcgccctgctcgcggtagacatcgacaaggtccgcctggaaggccacaccgacaactacggcgacgaaggctacaatcaaaagctctccgaacggcgcgccgaatcggtggccgcggtattccgcgaagccggcatgccggcggccaacatcgaggtccgcggccttggcatgagcaagcccgtggccgataacaagacccgcgccggccgcagcgagaaccgccgcgtcgccatcatcgttcccgccgagtaa

SEQ ID NO: 2803 - DNA, 939 bp, Pseudomonas aeruginosa
tcctgcgctcgcgggctgcgtacggcccacccgtacctggcccgtccatcgcccggccccgccactaccccgcttccggcctatgttgaaggaagaagccagcagaccggcgtaccggccgccgctgccgcggatgctagactgaatgctgcgcaagaaaccgacaatcccggccgacctgccgcttgcgggtgctccgggattcaccgacagggggtatcgacctttgcctgttcgcccaaggaacaggccgtcagacgatgggaggcatgccatgaaccggcattactacatcagcgacaacctcgacgagctggaacggctcgaagccgaactggaagccagcggcatcgccaccgagcagatccacgtcctcagcgaaaaggacgcggagaccggccagcgccatctgcacgaagtctctccgttcatgaagaaggatgtggtccgctccggccgtgtcggcctgctggtcggcctcgtcctggccatcgtcgccgtggccttcgcctatgccagcggctggacggaaaccgccgccggctggattccggtgatcttcctcggcgccatgctctgcgcgttctgcctgtgggaaggcagcttcttcggcctgcagcgcaccaaccgcgccttccgtcccttcgaagaacgcctgcaccaggggcagcacctgttcttcgtcgatgtgaagaacgcccaggagccgatcctggtcaacgtggtcagccaccacccgcgcctgcaggacgccggcaccggccccgcggtctctccgctgctgctgggctggcagcaacgctggcggcagttccggcggatggtctgagcggcggggcctgcgcaccgcgcaggtcctgcggcgtccctccggctgctagaatatccggctacccgcccgccatcccggccggcgcggcccgtcaggaaactccatga

SEQ ID NO: 2804 - DNA, 2016 bp, Pseudomonas aeruginosa
accctaaagacttttttggaacatccttatcaaggattctcgctgccgctcatcaggagttcctgtgcgtccactcagccgttggctctcatcttgcggctcgcttctggcgctggccgcgctgttcctggtcgttcccctcgccggccgctactggctcggctggtcgacgccgttcggctatctctcggacctggccctcggcagcctgctggtgctgctcctgcatcgacgctccctgtggttcgcgctcccggtcatgctgctctggtgcctgttcctgatcggcaatgccgaactggtcggcgcggtcgggcgcatgccggaaccttccgacctcaagtacctgctggatccgcagttcgtcagcagctccacccagggcggcggcctcgcccacctgccactggcgctcggcctcggtggcgcgacattgctttgcgtgctgctctggcgtcgccgcggtccgcgcctgccgcgctatgcctacgcgctgccggcggcgttcctggcggcgcatgtcggcctgcaatacctgcgtccgagcgatgccgaccaatggcagcagtacaacctgccgcacaagctgctggccagcgcgctcagcagtggccaactggcggtcgaagactggctcgccgacgaccgtccggacaccccgccggacgtcgccgggctcaaccagctcgacctttccggaacgccgctgctggccggcggagggcgcgcgcgcaacgtcctgatcgtggccatggagggaatccccggcgcgtatatcgccgccaaccgcgccgccatcaacagcagctaccacgaagcgccgatgcccagactgagtggctgggccgaacgggcgatgaccaccccggactacgtgctgcacagccaccagaccatccgcggcctttacgccatgctctgcggcgactacagcaagctcgactcgggcacgccgaagggcgtcgagctgctcaacaacccggcccgggccagggagtgcttgcccgcccagctgcgccagcacggtttcagcacgcacttcctgcagggtgccggcctgcgcttcatggccaaggacaaggtcatgccgcatatgggcttcgacaagaccctcgggcgcgactggttccgcaacacgtcctacctggagtttccctggggcatggacgacaaggccttcttcgagggcgccgcgacctacgtgaagcagctgcgccagcagaagaaaccctggatgctgaccctgctcaccgtcggcacccaccagccctactcggcgcctgccgactacctggcccgctacccgagcgccaagcaggccgcggtggcctatctcgacgacgcgatcgacgccttcctcgccgacctggagaaacagggcgtgttgcgcgacaccctggtggtgctcacttccgacgaatcccacggtgtcgaccaggtgcgcctcgcctcggcctggggcttcaacctggtactggcaccggaacaggcggcgctgccgccgatcaagagcggcgtctacggccacgtcgacctcgccgcgtccgtcctcgactatttcggctaccgcgtgccggcggggatttccgggcgctcgctgttccgcgactacgccagcggccgcgaaatgatgtcctacaccaacggcatgctgcgccaccacgacggcaaggacaccttcgtcgaatgcgatttccagcaggtctgccggcgctaccgcagcgagggcttcatcgccgacgaagccgagttcctcggtcgcttcagcggtcgccaggcacgcctggtcagccagcgcgccgccgtcctcgaccactccgtgcaacaggccggccagttgggccaggagttccagttcgccacccacgaacgcatccgcctgaagccggaaacccacaacgactggaccgacaacctgatcggcgcgcaatacctggaaatgccgaagaacagcaggaccacggtcaccctgaagatccgcgccttgcagtatggaccgcaacggcgcccgggtga

SEQ ID NO: 2805 - DNA, 453 bp, Pseudomonas aeruginosa
tcctttcgcactgaccgcgccggagcggcccgcccggccgccgcgcgctccccgctgaacccagcgccgtcgcgggcgtcgaagattcgcaagcaaccaggcgaaacggagaacggcatgaagcacctggcattcctcgccctcggcggactcctgctggcgcccctggccgaagcggccagcttcgattgcgaaaaggctgagcgagcggacgaaaaggccatctgcgcgaaccgggcgctgaacgacaaggacgtcgagatgagcgtcaagtaccacttcctccgcggcctgttcgccatgggcggccgcggcgccatgcaggaccggcagcaggactggctgcgccagcgccggcgctgcggtggcgacaccgactgcctctcccgcgcctacgcgcagcgtatcgacgagctggacaagcagtacgcgggcatcgacaagccgctctga

SEQ ID NO: 2806 - DNA, 213 bp, Pseudomonas aeruginosa
tgcagagacaggtccccggatatggccatcatgaagaaaaccgtcgcgccgaaagccgccaagccggctcccgcggtcgaaacccgcgagtccatcgaagcgcaggtcgccgccttcctccaggccggcggcgagatccagaagatcgccaagggcgtcagcggccaggtctacggcccgtcgcggcagatcaccatcagcaagaagcgctga

SEQ ID NO: 2807 - DNA, 549 bp, Pseudomonas aeruginosa
ccggccacttcccgccgccgttccggcgcggccgtcctcgccggcctcggcataggtcaggtagaccagccggtcctcggcgaaccccggcgacaaggcgacgtcgagcagtcccccctggccgctggcgaagaccctgggtacgccttccagcggcgccgacaactgtccctcgggactgacgaaacgcaagctgccgggccgctcggtgaccaatatgccctggttgtccggcaggaaggcgacggcccagggataggccagaccgccaaccaccggggtgacctcgacggcgcccagctcgctgtcgtggcgaccggcgtccaccgcctcgaccgacggagcgagcagcgcgacggcgctcagcaggatggcattcaaagacaggcccggcatgcgttctctccttccccaagcgaaaaacaccactctagtcgcagatccgccgcgcctggcggtccgcacacgggctgtaacaaacccgcccctcaaagcaaggcgaccatttccttgagagtcaccgcccaggtgcccttggcattgatatag

SEQ ID NO: 2808 - DNA, 798 bp, Pseudomonas aeruginosa
gttgggaccgagcgggcgccgaatcattcctcggcgcccatcgccacaacgagtaaactggcggtctttcattccagtagcctcgccatgaccgacccgatccgcctgtccaaacgcctcgccgaactcaccgcctgctcgcgccgcgaagccgagctgtacatcgagggcggctgggtcagcgtcgacggcgaagtgatcgaggagccacagttcaaggtgctcgaccagcgcgtggagctgctgccgggcgcccgcgcggaaacgattgaaccggccaccctgctgttgcacaagccggccggctggcgccacgacgatttcgaaggcctgctcgctgcggggcggcgctggagcgatgaccccagtcccttgcgagcgctgaaaaaacacttcgcccgccagcgtcccacccttgcgctggacagcgaggcttcggggctggtggtgttcagccagcagcacggcgtactgcgcaagctggtggacgacggtgcacggctggagcaggaatacctggtcgaggtcgccggcgacctggccgccggcggcctcgagcgcctgcgccacggcctcgcctaccagggccgcaggctatcgccgtgcaaggtcagttggcagaacgaaagccacctgcgcttcgccctcaaagacgtgctgcccggccagttgcgcttcatgtgcgaaagcgaggggctggaagtgcggagcatccgccgcctgcgcatcggcgcgctgtcgctggccaggctaccgctcggcgaatggcgctacctcggcctccacgaacgcttctga

SEQ ID NO: 2809 - DNA, 435 bp, Pseudomonas aeruginosa
acagacgcgccagggtccgcccgctggcgccgacctcacgtccccacgcctcgatgctccagtccagcgcgggttgcgccagcagcgcctcggccaccttcagcgcccgcgcatcgcgcggcatcggcaggctcgcggcgtgtgccggcgcgctcgccagttcatcgaacagtgcgcgcaacagcgtcaggtgcggcccttccaattgcaagtcggctgcccagccggtcatgcgcaggatcagttcgcgcattagcggcccgacttcgaggacctggacgctgtccggcagctcggcgaacgccgagggttcgaagtacaggctacggtaggcgaagcggccgtgcaggaccgtgcgatgcggcacgccggccggcagccaggcggcctggagcggcgtcaattggcaaatgcgctcggcgaaatacagcgtga

SEQ ID NO: 2810 - DNA, 1392 bp, Pseudomonas aeruginosa
cgctaccggccgccatgtacagcaactgcgcgcgccggtggcaatgccagtcgctgcggtggccggtgctgtcgacctcgaggccgaccaccgggcagcgggcgagatcgggatcctcgacccgttcgtagggatagcgcggcaccttgtcctcttcgcgatgttttccgtcctgaccgcagcattctgccaggcgcaggcggcctaggcttggctcttttttccggagccatcatgcctgaccgtcctcgccctcccctgctgctggtgctcgccctgctagccctgccgcaagtcgccgaaaccatcctttcccccgcgctgccggccctggccagccactggcgactggacgacgctaccagccagtggaccatggcgctgttcttcgtcggtttcgcccccggcatctggctctggggctggctggccgaccgcctcggccggcgcccggctctgctcggcgggctcggcctggcggccctggcgaccttcggtgcctgggccagtaccgactattcctacctgcttgcctgtcgcctggtccagggcctcggcctggcgacctgctcggtgacggtgcaggccagcctgcgcgatgtgctgcaaggcccggcgttgatgagctatttcgtcacgctcggcgcggtgctggcctggtcgccggcagtcggccccctcggcggccagtggctggccgacctcggcgggcacccggcggtgttcgccaccctggcggtgctgctcgcctcgctggcggcgctggtcgtcccggcctggccggaaacccgtccgctgctggcgggcacgcccgagcccgcgaccctggcgatcttccgacgggtcctggccgaccgcccgctacaaacgcgcgcactgctggtggcggtgctcaatgtgctggtgttctccttctacgccgccgggccgttcatggtcggcgacctgcccggcctgggcttcggctggatcggcctggccatcgccattgccgggagcctcggtgccttgctcaaccgacgcctgccgcgcacctggaacagcgctcgccgggtacgcctgggcctggcgctggcggccgccggcgcgacagcgcagacgctgttggccgccgtcggatacgccgaaggcctgtactgggcgctgccagccctgccgatcttcatcggcttcggcgtggcgattcccaacctgctgggtccggcgctgcacgcctacgacgattgccggggacgcgccggagccctgttcgggctcgcctactacctgctgatcggcctcggactgggcgcgtccaccctgctaccgttcgaccgtccctggccgctggccgcgtactggagcctgctgggcctggtcgcactgctgctggccaggcggctgccggaatga

SEQ ID NO: 2811 - DNA, 837 bp, Pseudomonas aeruginosa
ctcgccgctcttcctgcccttccgacctgcccgacctcgcccggccccatgccgcggccttgccgttggcgtcgtgcgggaagaccggcgcagcgccgttgtccgcattaccgggggagaaccatgctcaagcacctgctcgtgctcacctgtgccctgctcgccagttcctcggccctggcccaggtgatggcccgcgacctgggcgatttcgaactcaagctggccaccagtccgacccgcagcatggcccagggcctggtcaccccgggcagctccggcagtttccacggcggcctcgacctaagccacgaaagtggctggtacatcggcaactggacctccaacctcgaccccggcaagcccaccgagatcgactcctacgccggcttcaagcgcccgctgaacaaccgcctgggctacgaaatgggcctgatccgctacagccgcccggagcagccagccaacgacgcagccgaactctacggcggcctgtcgatcttcggcagccggctcggcgcggccctgagcagcgacccggggcgcaacgacaccaccctgttcgccgacctcggggtcaacccgccgttcggtttcgacgtcaccctgaagtacggcaaccatcgcctggacaacccggcgagcctcagcggcgggggctacgtgagcgtcttcaacgactggtcggtgaacctctcgcggccctggctgggcatcgacctgaacctgtcctacagcggcaccagcctgaccggcagcgattgcagcgcctactcgggacacaacagctactgcgacaccacattcatgctgaaggcgtcgcgtccgttcttctga

SEQ ID NO: 2812 - DNA, 630 bp, Pseudomonas aeruginosa
cgggtcagcgagtccatcagcagcaatacgttcttgcccttgtcgcggaagtactcggcgatccgcgtgcagtattgcgcggcacgcaggcgcatcagcggcgcgtcgtcggccggcgaggcgaccaccacagagcgcttgaggccttcctcgccgaggatctcgtcgatgaactccttcacctcgcggccccgctcgccgatcagaccgacgacgatgatgtcggccctggtgaaacgggtcatcatccccagcagcaccgacttgcccaccccggtaccggcgaacaggccgaggcgctggccgcggccgaccgtgagcaggccattgatcgagcggatgccgacgtcgagaggttcgctgatcgggtggcgcttgagcgggttgatcgtcgggccgtccatcggcacccagtcttcggcgcgcatcccgcccttgtcgtcgagggcgcggccggcgccgtcgagcacccggccgagcatcgacatgcccatcggcaggcgcccggtgtccggcagcggcacgacccgcgcgccgggcgcgatgccggcgaggctgccgaccggcatcaggtacaccttgctgccggaaaagcccatcacttcggcctccacctgcaccgggtggtag

SEQ ID NO: 2813 - DNA, 2103 bp, Pseudomonas aeruginosa
gcatcttgcggatgtagccgtcggcaccgacgccgaggctggtctggtcgccgaccacttcgacgaactcgcccatcacctgctcgacctgttcgcgatgcacgttgcgcatcgacgccatggccacgccgacccgctgcacctctttcggtcccatgtgccgcagcacctgcgccgcgtcggtctcgccgagcgacaggagcaggatggcggccttgtcgaccttggtcagtttggcggcgagacgattctcactcatggcgcttactcatcggcgttgatccactctttcacgacctgggcgacgcggcccgggtcctgtgcgaccaggttcttgatcgcgttcaattgcgcatcatacccctccgtggggctcggcaggaggatgctcgacggcccgccgatgctcacccggtcgtcggccagcgagccttccaggccactctcgcccagcgccaggtcaccgtcgcgaccgccgccgccggccagcgacttgcccttgccgccgccggtgatgttgctcagcaccggacgcagtacgccgaacaccaggaccaggatgaacagcacgccgagcacctgcttgacgatgtcccagaaccacggctgcgagtagaacggaatgctgtcgatctcttcggcctgggccggggcgaacggcgcgttgatcacgctgacgctgtcgccgcggctggcgtcgtagcccaccgagtcctgtaccaggcgggtgaagcgcgccagttcgtcggcgctccagggctggtggctgacctcgccggtcttcgcgtcgaccttcatctggtcgtccagcaccaccgccaccgacagtcggcgcaagcgtccctgctgctgcttggtgtagctgatcgagcggtccagttcgtagttgcgggtggtctggtcgcgcttgtcggtcgggtacggcgccagctccggcttgccggtcttcggatcgatgatggtctggccgttggcgtccttcagcggctggcccggcgcgacgtagtcggccggcgcgctggcggtggcctgctgcggcgcgctggccgggcccggcggctggttcgacagcgcccccggcacgccctgcgggccggacgaattctgccgttcctcgttgttgcgttgctcgctgcgcagggccggttggtccgggttgtacatctccgaggtcgactcgaccgcgctgaagtcaacgtcggcggacacctcggccttgtagcgaccgttgcccagcaccggttgcaggatattgtgcacgcgctgggtgagcaggccttccatgcgccgggtgaagtcgaactgcttgccggccatggtcagctcggagagttcctgctggtcggagagcaggttgcccttctggtcgaccacggtgacctgcgacttgtccagctccggcacactggtggcgaccaggttgacgatcgccatcacctggctcggctccaggctgcgacccggatacagctcgaccagcaccgaggcgctgggcttgcggtcgtcgcggacgaacaccgaactcttcgggatcgccaggtgcacgcgggcggccttgacgttgttcaggctcgacacggtgcgcgccagctcgccttccaggccgcggcggtagttggtggcttccatgaactggctggtgcccagcgcctgttccttgtcgaggatctcgaaaccgacgttgttgtcggtcggcgccacgccggcggaggccaccttcatgcgtgcccggccgaggtcgtcggccttgaccagcagcgcgccggagttgggttcgaccttgtagggaatgtccgccgcggtcagcgcttccaccacacggttcgcgtcgaccccgttgaggctgccatagagcggcttgtagtccggctgctgggaccagagcacgacggcgaagccgatcgccacgctggcggcgagaccgaccagcaggccgatctggcgcagcatggtcatctcggaaaggttgtcgaggaacgacagtcccgggaaggatttcttcagcatcccggcaccgccgctcttggcgggaacctggctgtcgatcagtgcatcggccatgaactagttatcctcgcgccgctcagaccggcatctgcatga

SEQ ID NO: 2814 - DNA, 1590 bp, Pseudomonas aeruginosa
caatacccgtgcctaaatttttttcatttgaaaatcaaagcgttgcgaaacgacctgtcaatcatccgacaggtcgtcgtcgcgccggctcatgccgtacttgcgcatcttctccaccagcgtggtgcggcggatgcgcaggcgttcggcggcccgcgcgaccactccgccggcatcgtcgagggcctgctggatcaggccctgctcgaggttggccaggtagtccttgaggtccaggccttcggccggcagcatcgccggcgcgtccattcccggcagcccggcgttgatcgccgcgcgctcttccagctcttcgcgcaggctgctggcgagttgctcgtcctcgtcgtcgacatggcggaatttcttcggcagttcgccgaccccgatcaccccgtagggatgcatgatcgccaggcgctccaccaggttcgccagttcgcggacgttgcccggccagtcgtggcggcagagcgacatgatggccgccgagttgaagcggatcgacccgcgcttctcgtgctccatccgcgagatcagttcgttgagcagcagtgcgatgtcttccacccgctcgcgcagcggcgccatctcgatggggaatacgttgaggcggtagtagaggtcttcgcggaaagtgccgtcctcgatcatcttctcgaggttcttgtgggtcgcggcgatgatccgcacgtcgacgttctgcgtcttgttgctgccgaccctttcgaaggtgcgctcctgcagcacgcgcagcagcttgacctgcatcggcagcggcatgtcgccgatctcgtcgaggaacagggtgccgccgttggccagctcgaagcgtccggcacgactggtgatggcaccggtgaaggcgcccttctcgtggccgaacagttcgctttccagcagttccgccgggatcgccccgcagttcaccgggacgaagggcccctcgcggcgcttggaatggtaatgcaggttgcgcgccaccacttccttgccggtgccggactcgccgaggatcagcacgctggcatcggtatcggcgacctgctgcatcatctgccgcacctgctggatcgcccggctggtgccgaccaggctgcggaacaggttcggctcgcgggagcggccgcgctcgcgggcctggtcgtacatctcgcggtagacctgggcgcgatgcagggaatcgagcagcttgttgtagctgggcggcatctccaggctggcgagcacccggcggcgcagctcctccggccagtcggccggggccggctcgccgatcagcaggatcggcaggtactcgtcccaactggccagttgcttcagcagctctaccgccccgcccttcgactcgacgctgccgagcagcacgcacagggcttcgcgactgttgctcaggcccgccgctacctctcgccaatcctcgctgttgcaggtcagctgatcttcgccgaggaagttgagaatgactgccaggtcgcgactgcgatcgagattgtcgtcaatcagcaagagtttggtttcgcgccacattttgatcagctgccttgcatcgaatgggtctcgctcgacccgaaagagggctgggactaa

SEQ ID NO: 2815 - DNA, 1929 bp, Pseudomonas aeruginosa
gacgcgacatcagcttttcttcacaaggccaggcaggctgctaagagcctgggccatgcgtccgctggtctggttgagctggccgatcaactggtccatggcggtgaactgcttgagcaaacgatcctgcaactgctcgacccggcgattgagcgcttcgcgctgggtatccaccgacttgatggtgtcctgcaatccatccaggcgctgctggagcacaccgccggtctgggtgtaaggcgtgagcttgtcgtcgagacgcttcatcaggccggtatcgccggtgaacagagcagaaaccgactcgaacttgtccttcagaaccttgtcgagtttcttgtcgtcgatttccagggtgccgtctttcttggtggtgatacccatgtcggcgagcatgcgaacatcggtaccttgccccggctggaccatctcgttgcgcatggtggtgagcaggttgcgcacgctgctgtcaccgaccaaggcaccgaccacgggagccttgtcgtcgcccaccttggtcacgccggtcagttccgaagtcacgccgaccagcttgttgtaggcctcgacgaacttcttgatgttgtccttgacgccgccacggtcctgctcgaccgagatggtgatcggcttgttggtgtcggtgaccgtcttcagctcgaaggtgacgccgttgatgaccttgtcgaccgtattggtcggactttccagggtcaggccgtcgatgctgaacttggcattcttcgcctgggtgatatagccgctgctgctggaagaggtaccgtccaactgggacagggtcagcttgccatcggcgccgacgctgccgatgttgaagttctccaggccggaactgccctggacgaacacgtccttgccggcgccggaatccttgccggtgaagaccagtcgcgaggttccgtctccagggttgttgacgatgttggcggtaatgcccttgtccttcagctgcgcgttgagcgagtcgcgcacttcggcgagggtcgcgcccgccgcgacgtttaccgtgacaccggcatcgtcggcaccctgcttgatggtcagggttccgctggaagtggtcttgtagccatcggcaaacgacgcggtggccaccttgctgacgctggccagctgggtcacttcgagcttgtagatacccggcagggcgtccttggtcgcggtggcggtggcgaacttctcgtcgctggtactcgccgagcgcttctggaacagctcgggcttgttcagttccttgaggatggtctgcaggtcggagatcgcgctcttgagctggccgatgccggtgaacttggcggtggtgtcgctttccagacgcttgagctgcgcctccttcggcgccttctcggccgccaccagggtggaaacgatgttcttgatatcaaggcccgagttgtagccgttgatcgtcgtactgttcgccatcttgcttcacctcgtcagctcattgacgctttgtccttccaattccaacagacactcaaaagacgtgccaattccgctcaggcttccgccttgaacagcaggctgcgcgcttcgtccagtcgctctgccaggcgcagggcctcttcggaagggatttgccggatgacttctccggaagtcgaatcggtcaccttgaccactacccgccccgtggagtcgtccaggctgaaactcagatcacgacggatgctctgggtgaacttctcgatggaggaaaccgcctcctcgaccgcagcgcgttgctccttgtcgcccatcctgacgtcgcccgtccgttgcgcgcttgcgctggcggccgcctcgccggcctggccggccgggcgtgcgccatcggaagaagacgccgagccgaacagccggattaccggagcagccgtcgaattgttgacattgctgacgtccatcgtcgctacctctcaatga

SEQ ID NO: 2816 - DNA, 1692 bp, Pseudomonas aeruginosa
cctcgccgaagcttagcgcagcaggctcagaaccgactgcggcagctggttggcctgggccaggatcgcggtgccggcttgttgcagcacttggttcttggtcaggttggcggtttcggctgcgaagtcggtgtcttcgatccggccgcgagcagccgatacgttctcaccgatgttcttcaggttgttgatggtgttgtcgaagcggttctgcaccgcaccgaggtcggcacgctgggcgtcgatctgcttgatcgcctcgtcgatcaccagcacggcggactgagcgcccttcgcggtggagatgtcgatcttggcgacggtgtcgttggtcttggcgaaagcggtagcggaaggggttacgccagccgcggtgcctacgccggtgctgccggtgtcagcgatgacaacgccggaaaccgcgctagtgatcgcaccggagccatccttgccagctttggaaacatagctgatggtatcgccgtcgctgaaggcaccgatgccgacgttggcgtcgttgaccgctgcggcgatcttggcagccgcctgctcggcggtttcgttgcccttcatgtcgaccttgacgttcacggcgctgccgccggtgatgccgatcgcgatgtcgacggtgcccgaagcggttgcagcagtgaccgcgccgccgccgtcagccttgaagtaggtgccgttcagcgactctgcgctcatctcgtcgatgccgacgctgatgatttcgttggcggccgaacccacctggaagctggcgacgccgaaggaaccgtcgagcagcttgcggccaccgaaggtggtggtgttgctgatacgatccagttctttctgcagttgcttcacttcgccgttcagagcggtacgctcggagtcgctgttggagccgttggccgactgcagggacaggtcacgcatacgctgcaggatgttggtcgactgctgcagggcgccttcagcggtctgcgccagggagataccgtcgttggcgttcttggtagccacgttcaggccgttgacctggctggtcagacggttggcgatctgcaggccggcggcgtcgtccttggcgctgttgatgcgcgaaccggtggacagacgctgcagcgaagtgttcagcgacgcggaagagttgttcaggttccgctgagtgttcagcgaagcgatgttggtgttgacggtcaaggccatcttgatgccctccaaggacgatatgtttgcctgagcttgcgacctcgggtgggcatcgcccaggcacccctaaagttcgcattcgtgatctttatcggcgcttccctggggagctttaggttttttttgaccatcctcgtttttcatgcatcggccccgtcggaggggttcgcgcaaggcctcccgagcgctgcggacagcgacggaaagccccgccggccgctcagtccggcatccaggcacgataccaggcgcgcaaatgctcgccgtcgagcatccaatccgccagcacccgttcgcgcaggttatcccctgccctggccgcggcatccaggtcgcgggtatgcatgcggatcgcctccacccagtcgcggaaacggttcttcacccgcgtcaccggcagatcgtcctggtagcagcgcacgtcgctgcagaccaccgggaaaccgcaggcgccgtattccagcaggcgcagattgctcttgcactcgttga

SEQ ID NO: 2817 - DNA, 465 bp, Pseudomonas aeruginosa
aaccgccttcggcctgcaacgaaaagcccgggttataggcgggatcgcgtgccaacaacggtagccagcgcgcgtacagcgcatcttcttcctcgacgctcgccgccgtcgtggcaggcgcatcgagcaacagccgcgcacgcggcgtccatacgttcaggtagcccgcctggaccgcccgcaggcagatgtcgacatcgtcccagcgcgtcagcgcctcgtcgaaaccgcccaattcgaggaacaactcgcggcgcatcaacaggcattcgccagccaccgccgagtagttctggtccacctgcaggcgctgcaggtaaccggcgtcctcgtgcgaacgcccttcgaaggcccgcccggccggtccgcacaaaccgagcagccagccggcgtggcagacccgtccgtccgccgccaggagcttggcgcctaccgcgccgacttccggacgctggccatggttga

SEQ ID NO: 2818 - DNA, 1263 bp, Pseudomonas aeruginosa
caacggcgtacttcatggagtccctcatccgatgggcggaaactgcgttttccgcgacatttaaccgaccctaccccgccagaaatcccgcgagttcatggcaagtcggctggcggcctccgcccgcagcagagctccatcgctatcggaaaacaggcggttccagctttcagcggaaaacgaatagaacgtgtcacgctccaggttgaacagcgcggtgaacttcaacgagtaccagctcatatacggctcaagggccaggaggcgcgcctgtgcaaaacggtaagagtcggccagggattccacaggaaagcccagacgccgggcataatctcgccagagcgcagattcgaaggtgtactgagacagctcctggtaatgccgctccggcgacagttccagccgatcggacagctcgtcggcggcccagtctgccggacgcggatcctcgggcagggaccagagcgccagcatatcctcggttcttgcaatcatcgctttctccgagaagtggaacggcatgtactgccaggaagcacccagcgaaaccgcgatcttcccggcattgcggccatgcgagaagagtccgttgagcgcctggtgaagcgaaccatgaagaatgttgtcgctgcggcaacgaacagcgaactcgatccccttgtccgccaggcgctgtacacccaagcgtgccgaacgcaggatcacattgcggttcatcaagccgagattctccggctgtggaaccaatatcaactcatccagccaggggcgacagcgctcgagcaattcgctggactgatggtcccaggtcaccatgcactggtaggcggacgggaaatgcgagcggttccaggccagcaccagcggcgtgaagtcgaacgccaggccctggacgaaaatacccatccgactggaaggcagatcgcgcctcatcgtcagacttgggagcagctcggcgacgtcctgcatttcatcgagcagcgccacgttgcccggatcgaaatcgatagcgcgtaccgtgcggaacctgccatgaaactgactgatctggttcatcacttcggggaagtggttggccatgaccacgatcaaggtgtgctccagcgattcctgttcgagtgcagacggcgcccgaacttccacgccgtggatgcgcttcccctgattttcgggatagggacagatagtgtattgcaggttcaggtactcgctcacacacgggtagaaatcctggaaaaactgccccgccccccatccgactag

SEQ ID NO: 2819 - DNA, 300 bp, Pseudomonas aeruginosa
ttgggcagctcccggggaatcctgcccggcaacaaccattcgcagtgtcgccccacccgggtgtcggcgagcgcgacgctgcccgcacccagcgtgctgccctggccgatctccactcgccgtcccaactgcacgccagcgagcagcgtgctacaggttccgacccggcagtcctcctccaccaggacctgcagctccagccaactgccagtgccgatgcgggcacgaccggcgagcacgcaaccggcgccgacgaacacgttgcccagcagtcgcacgccttcgccgacgatggcctga

SEQ ID NO: 2820 - DNA, 285 bp, Pseudomonas aeruginosa
gcaggttcagcaactcgtcctcgcgctggcgcaactcgctggccagcgacttcttgtcgttggagtccagtgcgccgtcgccggcctggccggcgatctcacggatgcgctggaggacgttgccaaccgaacggaggatggtttcttcctggctcaggctgttcttcgcctcggtcatgccggtcttgtactgctcgttcaacccctgctcctggtccaggcgcaacaggcgtaccgaaccgaccgggtcgtccgccggtgtcaggatgcgcttgccggtgctga

SEQ ID NO: 2821 - DNA, 1431 bp, Pseudomonas aeruginosa
cacagtcggatccaccggcgacggaccgctggtgagggtcggcgcgccgatcttgccggtgccgcggttttcggtggtcgactcggtacgcgcggtaccggcgaacgccagttgcgaggcattcttcagcgtcgcctcgatatccgccgcgccacgccgggtcggctgcagggtgaagcggtcgccggcagccgggagctggtcgagggtcaggttgaagccctggtcgacgccgttggcatccttgaacgagagggtgtagggaccggtaccgctgaccgtgacctgcatgcttgcgtcgtcgcccaggcgccgcgcggtgaaactggtgccgtcgaagtccaggcggaaatcgctggaattcagcttgctggtatcggtgatgttcaggttggcgtggacattaccggtgttgccattcttcgccaggacccgcagcgcggtgatgtccggatcgttgatgtcgccgaacaggttggcgccggccttgccggccaggtcgaggccctgccccagctgcttgttgatggtatcggcgagggtgatcgccaactgcccgagcttgttgtagctgctgtccagggcgctgttgcggtaggccagcaagccacccatctcgccgccggacaccaggccggtgacgttctgtatggagttgccgttgctcagttgcacctggtagcgggtcgggtcatccagcccgggcaccacgctcagggtcgacacggtattgcccaccaccagcggctggccgctaccgatgaacaggctgacgctgttgtcgtcctgggtgaccgcggtcaccccgatcatctcggacagcttgcgcacggcttcgtcgcgcgcatccatcaggtcgttgggcaccgcgcccgccgacttggccttggcgatggcatcgttgtagctggccacgctctgcgacagatggttgacctgcgaagccagcgcgcccagttgctggttgatcaggctgttctgcttgtccaactggtcgtagagggtattgaaggtcttgcccagcccctcggcctgggcaagcactgcctcgcgcgcttcggtcgaggagggattgttggcggcggcctgcagtgcggcgaagaagcgctgcatggccgggctgacgccggtggtggtgttggacaacaggccgtcgagctgctcgatctggctacggaatgcgctcaactcgctgttctggctggtggcgttgcgcaactggccggtgaggaagtcgctggccaggcggcgcacgtcgacgatctggctgcccgagcccatgtagccggcaccgctgaactgcgggacctgggtctgctggatggcatcctggcgactgtagcccggcgtcttgacgttggtgatgttgtgcccggtgatggtcagccaggtctggctggtgccgaggccggacaggcctatcgagagtag

SEQ ID NO: 2822 - DNA, 1380 bp, Pseudomonas aeruginosa
gtcggacatgggtcagttcctccttgctcaacccagaggcggcgtgccggcggcggcgacggcctggtaggtctgcatctgtctggcgatctgcgccaccttgcgggcgtactgcggatcggtggcgtagccggcgcgctgcagttcctgcatgaagcgctcggggttggcggcgctgtccagggcgttctggtagcggtcgttgccctggaggaagctgacgtagtcgtggaagctctgctcgaacgacgagtaggagcggaacgccgcgacttccttgaccgccttgccgccttcgtattcggtggtgagagcgcgcgccgaggcaccatcccagcggctgccggtcttgatgccgaacaggttgtggctgctgccgccatcctgctggcggatgatcgatttgccccagccggtctccagcgcggcctgggccaccaggtagcgggcatcgacgccgatccgctcggcggccttctgggccatcggcagcatggtggcgatgaactcgtcggccgaggcgaacatcgacttgcccttggccagcggcggctgggcgatgcgccggctgccctggctgtcgacgccatcggtggagaaaccgcggcggctcgccgccgggtagctctgcgccggcaggtagctgtcctggcccaggctctgcatctggctggcggccggcgaggcggagggaacgatgccggcgagcatgcgctcggccagcttgcccggcagcgccaggcgcctctggttgagcagcttcgagtcgtcgcggccggcttccggcatcggcagggccttgccggcctgcgcgctggggttgctcggccagcgaccggcgccgttctcggcgacccgggcgaacgggttttcgccgtttcccctggagccttgcttcatcttcgacaactggcgcaccagcacgtcggccaggccgatgccgccggcattcttcgacaggctcaccgacagttgctggtcgtacatgtcctggtactgcttggtggtctggctgttcatgaaattgccgtcgcccagcgcttcgttggccgaacgcatggatttgagcatctcgttgaggaacagcgattcgaattcctgggcgaccttgcggatgttcgcctcgccgtcgcggtccttgccgaccttgagctggttgaggcggttgagatcggtataggagccgctgtcggggcctgcgccgataccgctgagcaaacgggaatccatggcgtcgtcctcagatcacgatcaagtcggcctgcaacgcgccggcctgcttcagggcttcgaggatcgccatcaggtcgctcggcgcggcgccgacctggttcaccgcgcggacgatgtcgtccagggtggtgccgggaccgaacttga

SEQ ID NO: 2823 - DNA, 1545 bp, Pseudomonas aeruginosa
acttggtcatcgcgagcgtcctcagaacggccacagcgggctgaggaagaagcggtccagccagcccggctgactggcatcggcgaaggcgccggtgccggagtaggtgatccgggcgtcggccacgcgggtcgaggacacggtgttgtcggtggcgatatcgtcggcgcggaccaggccggcgatgcgcaccagctcgttgccggtgttcagggtcatccacttctcgccgcgcacggagaggatgccgttgggcagcacctcggccacggtcacggtgatcgagccggtcaggctgttgctctgccccgcctggctatcgcccttggcgtcgcgcgagccgccgtattcggcgctgaggctgaggtcgccgccgccgatcgggttgttggtggtcatgccgctaccgaacagcgaggtcagccccatcttggtcttgctgtccttctggatatcggagttggctttcttgctcgcctgggtcttctcgttgagggtgatggtaatgatgtcgcccacgcggaaggccttgcggtcgtcgtaaaggttctgctcgaagccggcctggtagatcgcgccgttgttctgcgcggcgggcagcggggtgcgcggcagcaccggcgcgtagtacggatcgttcggcttcggcggtggattgacgcaaccgcccagggcggtggcgatgccaagcagggagacgatcatcagccggttcatatcaagctacctcgcggcgtacagccagggcccggtcagggcccgtcaaagattctgggtgacgaaggacaacatctggtcggcggtggagatgaccttggagttcatctcgtaggcgcgctgggtggtgatcatgttcaccagttcctcgaccacgttgacgttggagttttccagggtgttctgggcaaccgtgccgaggccgttgagacccggcgtaccgacctgcggcgcgccgctggagccggtttccaggaacaggttgttgccgatggcctgcaggccggccgggttgatgaagtcggcggtctggatgttgccgatcacctgcggctgggcgttgccggtggtggtcaccgagacggtgccgtcctggccgacggtgaaggtctgggtctcgttgggcaccacgatcgctggctccagggcgaagccgttggaggtgacgatctgcccgtcggagttcaggtggaagctgccgtcgcgggtgtaggacacggtgccgtccggcagcaggacctggaagaagccgcgcccgttgaccgccatgtccagcggctgctcggtggtctgcaggctgcccggggtgaagatcttctgggtgccgacgacgcgcacaccggtacccagttgcaggcccgaaggcagctcgctgtcctgggtcgactggccgcccggctggcgccggatctggtacagcaggtcctggaactccgcgcggtcgcgcttgaagccggtggtggatacgttggccaggttgttggaaatggtggtcaggttcatgtcctgggcggacagaccggtcttgctgacccacagtgccgataa

SEQ ID NO: 2824 - DNA, 1482 bp, Pseudomonas aeruginosa
cggcctgaccgtcggcagcacctatgcgctgatcgcgatcggctacaccatggtctacggcatcatcggcatgatcaacttcgcccacggcgaggtgtacatgatcggctcgtacatcgccttcatcgccatcaccctgctggcgatgatggggctggacagcgttccgctgatgatgctcgccgcattcgccgccagcatcatcgtcaccagtgccttcggctacagcatcgagcgggtcgcctaccgcccgttgcgcggcggcaaccgcctgatcccgctgatctccgcgatcggcatgtcgatcttcctgcagaacgccgtgatgctctcgcaggactccaaggaaaaggccatcccgaccctgctgcccggcaacttcgtgttcggcgaaagcagcatgaacggcgtggtgatctcctatatgcagatcctgatcttcgtcgtcaccttcctggtgatgttcggcctcaccctgttcatctcccgctcccgcctgggccgcgcctgccgcgcctgcgccgaggacctgaagatgaccaacctgctgggtatcaacagcaacaacatcatcgccctcaccttcgtcatcggcgccgccctggccgccgtcgccgcggtgctgctgggcatgcagtacggcgtgatcaaccccgggatcggcttcctcgccgggatcaaggcgttcaccgccgcggtgctcggcggcatcggcagcatccccggcgccatgctcggcggcctgctgctgggcgtcgccgaagccttcggcgccgacgtgttcggcgaccagtacaaggacgtggtggccttcggcctgctgatcctggtgctgctgttccgacctaccggcatcctcggtcgtccggaggtggaaaaagtatgagccagtccctcaagcgcgcgctgttcagcgccctcctcgtgatcctggtgtcctatccgatcctaggcctgaagctgcgcaccgtcggcatcaagctcgaggtcctcggcgccgatgcgcagaccctctggaccatcgccgcggccgccctggccatgttcgtctggcagctgttccgcgaccgcatcccgctcaagctgggtcgcggcgtcggctacaaggtcaacggcagcggcctgaagaacttcctcagcctgccatcgacccagcgctgggcggtcctcgccctggtcgtggtggctttcgtctggccgttcttcgcctcgcgcggggcggtggacatcgccaccctgatcctgatctacgtgatgctcggcatcggcctgaacatcgtggtcggcctggccggcctgctcgatctcggctacgtcggcttttacgcggtaggtgcctacacatacgcgctgctcgccgagtacgccgggttcggcttttggaccgccctgccgatcgccgggatgatggccgcgctgttcggctttctttcctcggcttcccggtgctgcgcctgcgcggcgactacctggcgatcgtga

SEQ ID NO: 2825 - DNA, 1476 bp, Pseudomonas aeruginosa
agccatgagccgaccgattctcgaagtgagcggcctgaccatgcgcttcggcggcctgctggccgtcaacggcgtcaacctgaaggtcgaggaaaagcaggtggtctcgatgatcggcccgaacggcgccggcaagaccaccgtgttcaactgcctgaccggcttctaccagcccaccggcggcctgatccgcctcgacggcgaggagatccagggcctgcccggtcacaagatcgctcgcaagggcgtggtgcggaccttccagaacgtccgcctgttcaaggaaatgaccgcggtggagaacctgctggtcgcccagcaccgccacctcaacaccaacttcctcgccggcctgttcaagaccccggcattccgccgcagcgagcgcgaggccatggagtacgccgcgcactggctggaggaagtcaaccttaccgagttcgccaaccgcagcgccggcaccctcgcctacggccagcagcgacgcctggagattgcccgctgcatgatgacccgcccgcggatcctcatgctcgacgagccggccgccggcctcaacccgaaggagaccgacgacctcaaggcgctgatcgccaagctgcgcagcgagcacaacgtgacggtattgctgatcgagcacgacatgaagctggtgatgagcatttccgaccatatcgtggtgatcaaccagggcgcccccctggccgacgggacgccggagcagatccgcgacaacccggacgtgatcaaggcttatctgggggaagcgtgagcatgctgagtttcgacaaggtttccacctactacggcaagatccaggcgctgcacgacgtcagcgtggaagtgaagaagggcgagatcgtcaccctgatcggcgccaacggcgccggcaagtcgaccctgctgatgacgctctgcggctcgccgcaggcggccagcggcagcatccgctacgaaggcgaggaactggtcggcctgccctcctccaccatcatgcgcaagagcatcgcggtggtcccggaaggccgccgggtcttctcccgcctgacggtggaagaaaacctggcgatgggcggcttcttcaccgacaaggacgactaccaggtgcagatggacaaggtgctggaactcttcccgcgcctgaaggaacgctacgaacagcgcgccgggaccatgtccggcggcgaacagcagatgctcgccatcggccgcgcgctgatgagcaagccaaagctgttgctgttggacgaaccttcgctcggcctggcgccgatcatcatccagcagatcttcgagatcatcgagcagttgcgtcgcgaaggcgtcaccgtgttcctcgtcgagcagaacgccaaccaggcgttgaagctcgccgatcgcgcctacgtgctggagaacggccggatcgtcatgcacgacaccggcgccgccctgctgaccaacccgaaggtgcgcgacgcctacctcggcggctga

SEQ ID NO: 2826 - DNA, 645 bp, Pseudomonas aeruginosa
cctggtagtcgcggttgctgtgcacccagaccttccagccgcgcgcgtcgagcgtttcgcggaaggcgtcgaaggcctcgtcgcccggatagacgccgtccaccagccagctcggcgagtaaccaccgctctcgaggacgtgcaccaccgcataggtgggaacgaaacgcttgcgctcctcctcgtcttccggagccggatagatcaggccggcgtcgaacaccacccagtcaccgacccgctggctgcgattgcccggcgcgttctcgaggacccgcgcggtcaccgggccggtgcgccgggcgtagtagtcgagcgcttcgccatcctcgatgtaacggacgatcacccagccccagtcttcctcgatcggtccgtcgccggcggcgaactccatgcccatgccggcagcgacctcgcgcagcatcgtccagtcgcgcgcggcgctggcggcggtcatctggtcccactgcaccgactgcggctcctccagcttgccggccagacgctggtaggccagcgccgcctcggcgaagcgatcctgctccatcagcgccttacccagcaggctgtgggctcccagcgagccgggagaaatttccagcaccgattggcaggcgcgctccagctccggccagtcgttga

SEQ ID NO: 2827 - DNA, 429 bp, Pseudomonas aeruginosa
gcaggtagtaggccagttgctgctcctcgtcggtgtggcgctcgacgtactcccagagcaggtcgatggcctcgtcgtcggcggagcaggcctgtagcgccgaggcggccacttcgcgcaaggcggtgtcgtcgggccgctcggccagcgcctggagcagccactgcacttctttctccgggttgcgcggcgcgtcttcgctgccctgcgcagccagccagtcgagcaactccgcagccggcaccggcagctcctgctgctgcggcgcggcatcgatctcctccctcaacccggcgagcaactggctggcgccccgatcgcgctgcaactgttgagcatgctgttcggccagcgccaggtggcgcctggcgctccataccgaaccgcgttgcaacgcgaggcggatggcctggctggcaacatcgatga

SEQ ID NO: 2828 - DNA, 525 bp, Pseudomonas aeruginosa
tgttgttccactccgctccctcgaccttctcctccatctcgccgatcagggccagcgcctgttccgcgcgccccaggttcagcaggatcgccacgcgcatctccaggaggctgtcgaatacctcctcgccggcggcgaggatcttcttctcctgttcggccaggaaggccagggcatcttcgccgcgcccgtcgtcgagcagcgcctcggccttctcgttgctcaggcagtggaagcaggcccaggtcgggtcgatccgcgccagggtctcgtcgcacacctcgatgcgctcctccacccagcccgggccgtcgacgttggcgtagcacgacgccaggtcctgggtcacgcagactgactgcgggcaggcctgggtgtcgtcgcgattggccagttcgaacagggaaacggcgtcggccagggcggtctcaccctccagttggttgccgacccggttacgcatttcccagtggcggacgaagatttccagccacgggttgttcaacgtccggctcagcgccttga

SEQ ID NO: 2829 - DNA, 843 bp, Pseudomonas aeruginosa
agcgggcgatcaccagttgctcctcggcgccgcccaggtgttcggccagccagccggtctcgcgctcgggcagtcggtcgaggcggaacaactggcggttgccctgctcggtgcccagctccaccaggcgcatccccttggcctgcgcccagcgacggaggaagggtaccaccgcatagcgattgccatgggccaccggtacgcccatggcacggaacagcatttcctcgaagccgctgtcgttgtccagcagcacatgcaccgctccgcgcgaaaggagttcggaagccgggaggtcgccctgggaggtgggtacgcgcaggctgtccatcatcagcgcgaacagacgctcgtcgcacaacgccgctcccagcagggcctcgttgtgccgcagcaggacccgccgccaggcctccggctgctgccgcgccacctcgccgagcccggcgatcagcgcctcggccagcgcatgctggatcgccgcgtaatggtcgtcacgctgcaggtcctcgcggctggcggtgggcgtcaggcggttcgattcgatcaccccgccgacgaacccggcccaggacggcagcaggtcgcgggcgtcatcgtcgagcagcatgccgcggaggaaaaccgagagattgcggttgtcgctggtgccataggtgccgccgtcctggatccacagcaggccctgcacgtcgacccgctcgtccgggcgcaccggcaggcagcagatcggctcgaagtcgtgctcgaagcgtgcggcgaactccaggtcgcggcgctgccgttgcagcgggtgcagcgcggcgtcggcggccagccgccacggcggcggctccgggttga

SEQ ID NO: 2830 - DNA, 1425 bp, Pseudomonas aeruginosa
cggcagccgggcgatgccggtgccggccagcgcggctttcttcaacaggctgtagtggttgctggcgagaaagccggcaacccgtacccgctccagccgatggtggcggtgatagagccactcctcgtggccgctgtagtgcgagttcagcaggcactcgcgctcggccagctcggccgggcgttgcggctcgccgtgtcgcgccaggtaggcgggactggcgcaggtgatttcctgcaggacgaacagcggccgcgccaccagccgggcgtcctgctcgaccccagagcggatcgccaggtcgaagccctcgccaaccaggtcgcgcaggccgttgtacaggtccagctcgacgcgcagcagcggatggcgttcctggaagtcctccagcagtgcatcgaacagggtctcgcccagcgagaccgggagggtcacccgcacccgtccttccgctcgctcctgcaagcgcgccaccgcctgccgcgcgcgctcggcctgcaccagcaaggcctgcgcctcgggcagcagcgcggcgccggcggcggtcagcgaaagacggcgggtggtgcggtgcaagagggtcacgccgagcttctgctcgaggacgccaatgcgcttcgacagttggcccttgctgcaaccgagacgctcggcggcgcgggtgaaactgcccaggtcgtggagtacggcgaaggcggcgagatcgtccaggtccttcacgattgtttccctatgaaaacggtaggttgtcgattgacaggattatccatggcaaaagcgactctacactggaaaccactcaccttcactcaacgagaggcctgtatgaaaatcatcctgatcggcgccagcggcacccttggcaagggtatcgacaaagaactctgcgagcgccacgagatcgtccgggtaggcaacagcagcggcgatttccaggtcgacatcagcgactcagactccattcgcgccctgttcgagaaaaccggtcgcttcgacgcgctggtcgccgcggtcggcaaggtgcacttcggcgccctggaggaaatgggcgaggcgcaataccagctcggcctgcgcgacaagctgatgggccaggtcaacctggtactgctcggccgcgagtacgccaacgacgggggctccttcaccctcaccagcggcgtgctcgccgagcagccgatccgcttcggcagttcggcgagcatggtcaactgcgccgtcgagggcttcgtccgcggcgcagccctggagttgccgcgcggcctgcgcatcaacgccgtcagcccgaccgtggtcagcgaggcgctgcccggctacgcgccctacttccgtggcttcaagccggttccggcggcggacgccgcgctgggttacgcacgcagcgtggaaggcgcgcagaccggccaggtgtaccgcatctggtaa

SEQ ID NO: 2831 - DNA, 456 bp, Pseudomonas aeruginosa
gcgatatttctcaggagaggcggtcggcgtagcaggtcggcgaactgcccggctgctggcggtccagctcctcctcgaggaactcggccagcaccacggcattgttgtgctgctggtcgtgggcgccgtagagcagcgtcagggtgccctcccgagcgctgtcgagcaggccccaccaatgttccgggtgcgcctgcaactcggcgcggtagtgttcgcggaagctgtcgaagagtgccggatcgtggcagaactgcttgcgcacctcgttggagggcgccacgtccttcagccagtcgtccatggccagggcttccttgcggatgccgcgcggccacagccggtccaccagtacgcgccggccatcggcgggcgacgccggttcgtatacacgcttgcattggatcattgatcgactccctggttgcgatgaagtccgatccggacttgagctag

SEQ ID NO: 2832 - DNA, 666 bp, Pseudomonas aeruginosa
ccgtggaccatgaaggcggcgcgcaccttgaggcggatgaaactcatcgcacggctctgcgctggagggaaagattgcgatggcacactgtcgagcgccccgagccgttcggtcgccgcgccggatcggcgtaggtttccagctcgacgaagccggccttgcgcatcattcccgccgacgccaggttctcttcgtgacgatcgatatagacgtcctcgatgccttcgtcggccagttgggccagcaccgcctccagcaacgcgctgccgagcccctggccggccgccgccggatgcactaccgcctcgcagatgtaggcccgcggcgcatcggcacgctgcggctggtaatgggcgaaatcctcggtgcgacggaagctggcgaaccccagcagccgatcgtcgcgctcggccaggacggcacgtacctcgccgtcggcgatggctcgcagatgcgcacgcaccccctcctccggcaaatggttccagggattcggcccgtggcgcagcaacaggtcggtcatggcctcgatatcgccggtttcggcagctcgcaaacggtgcatatccactccttcaaagtccagccaccagcagcccgtcgggcaacgccacgccccgctcgatgcaggcagccagcgcctcgaccaggggttccagcgcatag

SEQ ID NO: 2833 - DNA, 435 bp, Pseudomonas aeruginosa
cgttgcttgatctcggcgatcagcgccgccttgtccggcacgtcgaggccgtgcaccagcaaggtcttgcggtcgtcgctgaggtccgacgacaccgaccccggggtcagcgagacgatgctcaccagcacgctgatggcgaggtcgttctccagctcgatcggcacctcgacgaaggccggacgcaagcgctcgatcggtccgagggtcaggcgggcgacctggatgttggcgacgagtatgtcccacatcaccagcgccagcagcttcagcagcagcaacggatgccactcctggctgcgcccgaccagcaggcggttggtcagcagcggaatgcacacgccgaggaaggcgccgagcagccagtggccaatggcgaaggaatccaccagcagcaaccagaccagcaacagcaggacactaagcacgggatga

SEQ ID NO: 2834 - DNA, 408 bp, Pseudomonas aeruginosa
gccagcagcgccaccagcatgccgaccccgccggccagcgccacgtcgcgcaagccgcgcagggtggaggactccgccggagtgcgcgagggcaggaaatacagcgccagcatcagcaggaccatggtcaccacttccaccgacaactgggtcagcgccaggtccggggccgagaagcgagcgaaggccagggccaccagcaggccggcgacgctgaggatcaatagcgcgaccaggcgcatacgatggaacagcgccgtggccaggccgctgaaggccagcaccagcatgcccagggcggtgataccgtccagcggggtcagcccgcgcgagccggtcagcctcgccagcggtgccagctcgaccgccaccacgaccagcgccgcgcccagcagccaggccaggtag

SEQ ID NO: 2835 - DNA, 996 bp, Pseudomonas aeruginosa
ctggcggtcagggtctgcccggcgaacaccgtgccgcgctgtccgagcaacaggatcaggccgatcagcggcgccacgccggcggacgccgcgcacaaggtgcggccgccacgctcggcaagcaggggcaacaacgcccccatgaacggcagcgcgatgatcagcgccagaatcatgggctactcctcttcgatggcggagcccccggcatgcctggccggcggtgcttccccgcggttgtcggtgcgcggccggatcgccagcagctcgaagccccatcggccaccggcaggcgcggcgcgacggaactacgattatcgcaatctatcgaacgaacgtcatggattgaattattacaaaattcaggcgttccgactgccggaaagccgaaaaaaactctgcaacggcaacgacttgaagcttagcaagacaacgccggcagtggttcggcgctacaacgaaaacggccggcgaaatgccggccgcgggataacgtgggaagaatcagtgggcgacgcggctggtgccgttgacggtcaggatgcgcacgcgctcgccgacgcggaagatctggccctggtcgacctgctggacataggcgcgggtgctgccgtcgtcttcgcgcacggtgatctcgacgccctgggtgcgcgtcaggccttcttcggtagccgcgcccagcaggccgccagcgaccgcgccgatgatggccgcgacgtagctgcccttgccgccgcccaccgcgctgccggcgacaccgccgacgccggcaccggcgatggaaccgatcggggtcttggtgccttcgatcttgaccgggcgcaaggcctggatggtgcccatgcgtacagtctgcacggtacgggcttcctcacggctgtaggtatcgccggtgaggctggattggcagccgccaagagccagggccatggcggtgaaggaagcaacgatcaaggcagacttgcgcataacggcatctccgaaagggataactga

SEQ ID NO: 2836 - DNA, 645 bp, Pseudomonas aeruginosa
ctatctgttacagcgactggccgaggccaaggccagcaaggtgaagcggcgcgacctgccggcctggctggagcgcgccgccgccgactacccttcccgcgaagcctgagccaggcgccagagccgggcgatctgctcggcgcgcgcctccagttccgccgccgctccggcacaggcctgctccaggctgatcggtcccggcgccaggctgaacgccgcatcgatgccggcgtcgtgcaggcgctggtagccgtcgcccaggctgccggccagggctaccacgggaacgccggcctggcgcgcgatccgcgccacgcccaccggggtcttgccgtgcaggctctgcgcatccaggcggccctcgccggtcagcaccaggtcggcaccgaccagcgcatcggccagcccggccagctccgccaccagttcgatgcctgggcggaaacgcgcgcggaggaatgccctcgcggcgaaacccaggccgccggcggcgccgacgcccggcacccggctgaagtcctcgccaagggtcgccacgaccaccttggcgaagtgcgccagggcggcatccagttgcgccacctgttcggcgctggcgcccttctgcggaccgaacaccgccgaagcgccgcgcggcccgcatag

SEQ ID NO: 2837 - DNA, 714 bp, Pseudomonas aeruginosa
cgggttgtcgacgtctgcggcgacttccaccgcgacatccaccaggcgcggatccagcccgcccaggtcgagactgtgcaggccagccagcgcggcgccgccgggcgccagttcctcgccgtcggcagccaggaaacgcacgccgagcgcgcccagcaggccggcgccggcatcgttggtagcgctgccgccgaggccgaggataatcttccgcgccccggcgtccagcgccgcacggatcagctcgccagtgccacggctgctgctgcgcgtggcgtcgcggcggtcgcgcgggaccaggtgcaagccgctggcggaagccatttcgatcactgcggtggcgtcgtccagccagccccagtgcgccagggtcggctcaccgagcgggccttcgacccggcattcgcgacgttcgccggcggtggcggcgagtaccgcatcgaccgtgccttcgccgccgtccgccagtggccgcagcaacacctcggcctgcgggaagactcgccgccagccgcgggcgatagcctcggcgacgtcgggcgcggacaggctttccttgaacgaatcaggagcaatcacgattttcatcagtcacctcgcagggccgggagtccccggccccgcttcaatcagagcagcacaaggctgagcagccataccgcgagcataccggcgataccctggaccagggtcgccagggtctgggcgcgatag

SEQ ID NO: 2838 - DNA, 498 bp, Pseudomonas aeruginosa
acagcaggctggcgaggcggtgtccgtccagggtcacgacccgccgaccgggcaaccggctgcgcgcatagtccagcaggtcgcgcgcggcgcaggccgaggcgcgcagctcggccaggtcatgcgccgggtcgccggcacacaggcgcgccacgccccagccgcgcgcgtcggcgcgctccagccagtgctcgagcgtatctgcgtgggctaccggccggcaccagaacaccaggcgctcgcccagcgccgcgctccagtgctccgcccggccgccgagtgccgccagcaggcgagcctggcaaggcagcggatcggcatgctcgggcagctccaggaagaccgcctggcgcggccagtgcatggccagccccaggtgttcggcatcggccgccagcgccccgaggccgtggccgggatcgagcaactggcgcagccaggcttcgtgacgctggcgttgccagtgtcgctcgtcctgcatctggcgctgttccatga

SEQ ID NO: 2839 - DNA, 1671 bp, Pseudomonas aeruginosa
gtactggaaccagtgggcgccgacgatatacggactcttcagcgccgcctccaggaacgttcggtaggagtcgccgcgcgcccgctcattggccgcctcgctgacaccaccccagaacggaccgcgatcccgcgagccgaagtggaactcgctgatcagcaccggcttgtccagccgcgccagcagggagtcgtccaggccctgcccgggcaacggcgtatagaggttgaaactgaggaggtcgcaataccgggcgcaggaggtgatcgcctcgggagtgctgacggcgaagcggccgccgagcaggaggtggttcggtgcgtgccattgcagggcgtcgcgcagggtcttgaagtaagcgtcggcatacagccggaggaaggcgctgtagtcctcggcgatggccggatgcccctcgcccggcagcggagccgcgtagcccggcgcctccagggcctcccaggcggccagctcgatgccccaggcctcggccaatgcctcatggcccaggtacttggctttcaattgcttgacgaaggcgcgcttcgccggactgtccatggacagcgtcaaggctccgaaagcgaggccgtagcgcgccagggccgagccgtcgcgcccggcccaggccagttcgttgtcggcgtagtagccgagcagccagggatcgtcgcggtggtcgcgagcagcgatggcgatgacgcgctcggcggccatggcgaagcgcgggtcgaagggatcgggcatgggtccccaccagtcgaaaccgctgctgaccgtggcgtagtcgccggcgatcgacagcggcaggctgtagggcatccgcgcctgtgcggcgagcgccggatcgctccagttgccgaggctgttgaaaccccatgccgagaggcgctccagggtgcgctggcgccattcgccggcgagctggtcggcactcgcctggggagcgatgcgctggcgattggcaccgaggaaatcgaaccagcggccatgcccgaagcgccgcccggcctgcgcggcgacgccgcggcggtcgtcgccctcaccgaagaatgcggccagcggctcaccctccgccggcagttcggcgaacatcggctcgcgtccttcgacgtaggtccggctgccgtcggcggtcaccgcattaacgcccagcgaccagaacggatgtccttccggagtaaccagccaccagcgcccgccacgtttttccgtgcggaagaaaccgctggcttcgaacaccggcccacccagcaggccgccgaaacggtcgcgcgccggtgtctgccgttcccagtcgcggagctgtgcggcctcggccgcataggcgctgcgcaactgttcgtcggaacgaatcttttccggccagtcggcgcggctgtactggccatagcgatcgatcaggccggtcaggatgctccgctccaccgccctccctgtgcgtatgccgaaacgtccgagcaggatgctctggggagcttgcggcgagcgcagggacaggctcagcgctccgaccctggcgcggtccagcgagccctccacgcgtggcgccagcagcacccgctggccttcgaccatctgtggcatcggcggccccgcacgcatgcccagagcctctggcgaaaccgcccgcaacggcaccagcagggtctgcggcgggcctgccggtag

SEQ ID NO: 2840 - DNA, 2823 bp, Pseudomonas aeruginosa
ctccatcccggcctgggcaaatgccgggaattcctgatgcggctcggacgtgaaggctggcgccctcccgcgcaggccagcgcgtcaggcgatttcccggcggaacggcggcaatgcattgaggatagccttgccgtagcgctgggtgaccacgcggcgatccagcagggtgatggtgccgcggtcctgctcggtgcgcagcagccgcccgcaggcctggaccaaccgcagcgaagcgtctggcacggcgatctccatgaacggattgccgccgcgcgcctcgatccactcggccagcgccgcctccaccgggtcgtcgggtaccgcgaagggaatcttggcgatcaccacgtgttcgcaataggcccccggcaggtccacgccttcggcgaaactggcgaggccgaagagcacgctgtcctcgccgtcgtcgactcgcgacttgtgcttgttcagggtttcctgcttggacaggttgccctggatgaacacccgcttgcgccagtcgcggtcgagaccgtcgaagacttcctgcatctgcttgcgcgaggagaacagcaccaggctgccgcgcgcgcccttcaccagttccggcagctcgcgaatgatcgccgcggtgtgctcggcggcgttgcgcggatccgccttgaggtcggggacccgcaataccccggcctcggcatggtggaaggggctcggcaccaccgcggtgaccgcgttgcgcggcaggcccgcgcgcatgcggtagcggtcgaaggtgcccaacgcggtcagggtcgccgaggtcaccagcacgccataggcgacgttccacaggttgcggcgcagggtctcggcggcgaggatcgggctggcgttggcttcgatgtcgtagaagctgccgctctcggcgagggtcagccagcgcgccatcggcgggctgtcctgcgggtcctcgcaggtgaaggcggtccacagttcccagttgccctgggcgcgcgccaaaagactaccgaacagcgggtaccactcctccgcctggtggctggcgatgccgccggcgccttcgccgtccatcgcctccttgaggatatcggtgaggcgggtgaacaggtcggtcagcttggagaagcctttcttcagctcgatgcccatctcgcggatatgctcggggaccaccccgccgacgaaacggtgacgcggccgctcgcgaccttccatgtcctcgccggcgcggaaatcgccgatctcttcgcaggcggtgaacatgaactgctgctgggtcttgatctcccgggccagctccggcacctgttcgatcaggcggccgaggtcgcccggcagcgggtgctgggcgagcagcttggtgaggttcttggcgatctgctccagccagtcggcggtagcgcgcaggcgggtgaaatgggcgaaatggccaatcgccttgtccggcaggtgatggccctcgtcgaacacgtagagggtctcgcgcggatcgggcaggatggcgccgccgcccagggccaggtcagccaggaccaggtcgtggttggtgacgatcacgtcgaccttggtcatcccttcgcgcgccttgtagaaggcgcactgctggaagttcgggcaatgtcggttggtgcactggctgtgatcggtggtgagctgcgcccaatgcgcgtcgtcgatcgcctccggccagctgtcgcggtcgccgtcccagcggttgccggccaggcgttcgatcatctggttgaacagcttgctgctggtctcgtcgacatcgatgttgaaaccgtcgtcggcgaacagttgcgccgtcgcgctctgcgcctggccttcctgcagcagcacgtcgagcttggacaggcacaggtagcgcccgcggcccttggccagggcgaagctgaaggccagcccgctgttgcgcagcaggtcgggaagatccttgtggacgatctgctcctgcagggcgacggtcgcggtggctatcaccaggcgcttgccactggccttggcgcaggcgatcgccgccaggctgtaggccacggtcttgccggtaccggttccggcctccaccgcgaccaccgccggctcgccctcgcggtgcccctcctcgtcctccttgatcgcgccgagggccttggccacttcggcgatcatcaggcgctggccatagcgaggcttcagctccttggcttcgagaaagcgggtgtaggcaccctggatctgggacttgagttcggcgctgagcatggaattcctgggcccggcgcgcagcggaagacgaatccgccggcgcgccatagctggataaattttcagtggttcgacagggcggctatgataacgcgcttcgtcacaaccgccagcggagatcgccgaatgaccccctacgccctcgtctacgccctgcatgtcctggccgccctggtctgggtcggaggcatgttcttcgcctggacgattcttcgtccggcggccgtcgccgcgctggaggccccagcccgcctgggcctgtggctggaggtgttccgccgtttcttccattgggtctgggctgcggtgatcctgctgccgatcagcggcgtcggcatgctgcacctgagcttcaacggtttcgccggcgcgccgcgctacgtacaggtaatgatggggctctacgtcgccatgctggcactgttcctgcgggtgcaggcgctgcaagtgccggaactgcgccgcgcggtgcaggcccaggactggccggcaggcgggcaggcgctggggaagatccgccgcaccgtcggcttcaacctgctcctcggcctgttgctgatagccctggtagcggcacgcccgagcctctga

SEQ ID NO: 2841 - DNA, 1065 bp, Pseudomonas aeruginosa
ggagtaaagaccccagccgaaaaaagcgccagcactaggccatgcaggcgcttcaggctagtcttggcgaatcccaggagagtgttttcccatgagcgaaccgatttctccccgcaccccgcagcaggccctggccgcgttgctcgcccgctacgcgccgaagcgcttgctgctggtcggcgccagccggctgccggcggtggaggccttcatccacaaccatccccagtgccaactggcgcacagcccggcggcggcattgcccgccgaactggccggccagcgcttcgacctggcgctgttcgtcgattgcctggaacacctgccgcagcgcaccggtctgcagttgctcgcgggcgtgcgcaacctgaacgccagccgggtcgccgtactggtcgacctcgaggccagcgactggcaggaaaccgacttcttcgccctcgccatgcagaacagcgaacgcttccagcgcgaaggccagacgctgaccctgtacacctacgacctgtacgaatacaagcaggtccccgattggctgaacgccaagttctgggccaacccggaaaacttcggcaagtactggtggtaaccatgacccaaccctcttgcccctgcggcagcggcgacccgctcgacgattgctgcggccgctatcaccagggacatcccgcgcctaccgcggaagccctgatgcgctcgcgctacagcgcctacgccctcggactggtggactatctgcgcgacaccacgctgccggcgcaacaggccggcctcgatctcgacggcatccgcgcctggagccacggcagcacctggctcggtctggaggtggaaaaccacgaggtgctcggcggccagccggagcatgcgcgagtcaccttcgtcgcgcgctggcacgacgccgagggggaacatgcccatcgcgaatgttccggcttcgtccagcgcaacggtcgctggtacttcctcgatccgaccgtggccctgaaactcggccgcaacgacccctgcccctgcggcgccggcggcaagctgaagaaatgctgcggtccatggatcacctga

SEQ ID NO: 2842 - DNA, 654 bp, Pseudomonas aeruginosa
aatgcgcagccttttcatccgggccccatccccatgctgctgaccgtgctctacatcatcgccatcaccgccgaagccatgaccggcgcgctgtcggccggccggcgcagcatggacctgttcggcgtggtgctgatcgcctgcgtcaccgccctgggcggcggctcggtacgcgacatgctgttgggccattacccgctgacctgggtccgtcacccggaatacctggcgctgaccgcagtcgccgcgctggtgacagtgttcatcgcgccgctgatgcgccacctgcgctcgctgttcctggtactcgacgcggttggcctggtggccttcaccctgatcggctgccaggtcagcctggaaatgggccacagcctgctgatcgcggcgatcagcggggtgatcaccggggtgttcggcggcattctccgcgacatcctgtgcaacgacgtacccttgatattccgccgcgaactctatgccagcgtgtccttcgccagcgcctggtgctacctgatctgcgtggagctggaactgccttccgagcaggcgatgctgatcaccctgttcagcggcttcctgttccgcctgctggccatccgcttccactgggaaatgcccaagttcgtctaccaggacgatttcgaccactga

SEQ ID NO: 2843 - DNA, 684 bp, Pseudomonas aeruginosa
agtcttccgttcgtagcccatcgacgagccggagacgcaccgatgatcgacctgtactactggaccaccccgaacggccacaagattactcttttcctggaagaaaccggcctgccctacgccatccatccgatcaacatcagccagggcgaccagttccaggcggatttcctgaaggtgtcgccgaacaacaagattcccgccatcgtcgatcgccaaccggccgacggcggcgctcccctgtcgctgttcgagtccggcgccatcctgctctatctcgcggaaaagaccggacgcttcctcgccaaggacctgcgcgcgcgccaggaaaccctgcagtggctgttctggcagatgggcgggctggggccgatggcagggcagaaccaccatttcaaccgcttcgccccggagaagattccctacgccatcgaccggtacgtcaaggaaaccgcgcgcctgtacggcgttctcgaccagcgcctggcggaccgcgccttcgtcgccggcgacgactacagcatcgccgacatggccatctatccgtggatcgtcccgcaccagtggcaggagcaggatctcgccgacttcccgcacctgcagcgctggttcgagagcattcgccagcgtccggcgacgcaacgcgcctatgctttggtggagcgcatcaatccgccgaagtag

SEQ ID NO: 2844 - DNA, 411 bp, Pseudomonas aeruginosa
gaccggaggacggccctgcctggaaagccttcgtcgagaccgccaacctctcctactcggcgcaagccgaccacctgctcgggcgcgacgacagtccgttctgggacgatacccgcactccgcagaaggaggacaagccggcaatcctcgcgcgcagcctcgccgccgccgtggagttctgcgaacagcgactggggagcgagcgcaaggcctggcaatggggcaagctgcacacctacgaatggcagagcgacagctcgaaaatggccccctacctgggcgccggcgagcgcgccggactcggcgcgatcaagggctatctcgatcgcggaccctatccggccggcggcgaccacaccacgctggacgtatcggcctacggctggggccaggacttcgacacttggctga

SEQ ID NO: 2845 - DNA, 819 bp, Pseudomonas aeruginosa
gctgctgcagacgctccagttccttgctcagggagaaacgctcgcgcgcttcctgctggtagctttcctccacccgcttctcgaacgcctggatgcgctccttcagtggatcgagcatctgccccaggcgctgctggctggtctcggcgaaacgctgttcgcgttcgtcgaagatctttcccgccagttcggcgaactgtgcccgcaactcgtcgcgggccgactgcaggtcggtcaggcgctgctggtggctttcctgctgctcgcgaagttccgcagccagcgcagcccgttcggaagccaggcgacgcacttcctcttcccggccctggcgctcgctggcccaacgtgcctccgccagggacgcccgttgccgctcctcccccatcaactcggcttcccgacgcagcgcggcgacctcgccggagagcctggcatggcgctcgccgagttgctggtaagcctccctactggtctccaactgcgcattcagcccgtcctgggccagttgcgcggtcgccagtcgctcgccgagcaacgccatctcgcgctccgccaggctggcccttctctgtagctgccatgccaggccggccaggggaatcgcggcagccagcaggccaagcaacaggttcggtagatcgacgggcatggggcactccagcggaaaacgacgcaacacccgcctggcaggcgcgcgtgcagcggattctaggttcttgggaaaagaccgtcgagcgaatagcgccgcgccgaacgagcactccgcttccgagctgtgcgtaccccatgcgcaggacatttcagatacttccataa

SEQ ID NO: 2846 - DNA, 1371 bp, Pseudomonas aeruginosa
  unsure (185): Identity of nucleotide at the above locations are unknown.
gtgccctcgacgagcagcgccacgcctaccggttggcgcgcagcaagtatcgcgccggcgccctcgatgccctcgagctgctcgacagcccacgcagcctggtcgccgaccgggcgcgcctggttgacgccgagatgcgcgtcgccgagcgccaggtcgaactgttccgggctttcggcggcggntggcaagccgctcccagcccctcccatcaggaaaacggacaatgaaccaggcaatcagggaacccatcgaacacaccactggcgaaaccatgccagcagccacgcgccggcgccgaacctggctgctgggcggcctcgccggcgccatcgcgctcgccgccctgctggcctggtggtggagcagcggacgcttcctggagggcaccgacgatgcctatgtacgcgccgactgggtggcggtcagcgcgcaggtctccggctacgtcgccgaggttctggtggccgacgacgccgacgtccaggccggcgacctgctgctgcgcctggacccgcgcgacttccgccagcgcctgcgcgccgccgaggcccgcgaagcggcggcgcaggcggcgctggaagcccagcgcgcgaagctggagaccctcgatcggcaactgctggagcaggcgcagacgatcagccgcgcccgcgccgatggcgaagcggcgcgagccgaatggcgccgcgccgagaccgactggcgacgctaccggcaattggccgacgagcatgccaccagtcgccagcgcctggagaacgccgacgcggcgcaccagcgagcgcgggcggcggcgcggcgggcaagcgccgaggaaggccgccagcgcgccgccaaggacgtactgaagagccggcgacgcgaggcggaggcggcgctcgcccagcgccaggcggagctgcaggaagccgcggcggcgcgcgaactggcgcgccacgccctggacgataccgaaatccgcgccccattcgccggccgcgtcggccagcgcaaggtgcgcctgcgccagtacgtcacgccggggctgccgctgctggcggtggtgccgctggagcaggcctacgtggtggccaactacaaggagacccagctcgaacgcatccgtcccgggcaaccggtagagctggaggtggacacgttcggccgccgctggcgcggccgcgtcgacagcgtggcgccggcctccggcgcggtattcgcgctgctgccgccggacaacgccaccggcaacttcaccaagatcgtccagcgcttcccggtgcgtatccgcctggacgccgacgccgccgagcggggccggctgcttccggggatgtcggtgatcgccaccgtggacactcgcgaaccggacggagcctccgccgatga

SEQ ID NO: 2847 - DNA, 735 bp, Pseudomonas aeruginosa
gcgaagaccggaccgggtggaaggcaggtcgatcagcatcgggcgggccttggcgggcagtgggggcgctgtctttttaccagccgcgccatgctaacgaccagtcccggcgaagcacgccggcgctcgccgcgacgcggcgagcgcgctaccctggccgccccggcgtggcgcgactacctggcgtatccgccgcgccatccctccccaagtacaggagcgaaaccagcatggcctcttacgcggaactgttcgatatcggagaagacttcgccgccttcctcggccatggcctgggccccggaacagggcgcggtcgcgtggttccggcagaagctggaaagcaacgggctgccgagcgcgctgacggaacgcctgcaacgcatcgaacggcgctatcgcctgctggtcgccggggaaatgtggtgcccggactgccagatcaacctggccgcgctggatttcgcgcagcgcctgcaaccgaacatcgagctggcgatcatttccaagggccgcgccgaggacgacctgcgccagcgcctggcgctggagcgaatcccgattccgctggtactggtgctggacgaggagttcaacctgctcggacgcttcgtcgaacggccgcaggcggtgctcgacggcggtccgcaggcgcttgcggcgtacaaggcgggcgactacctggagcacgccatcggcgacgtcctggcgatcatcgaaggcgcggcgcgctga

SEQ ID NO: 2848 - DNA, 438 bp, Pseudomonas aeruginosa
gcccggagcaaccaggcgaggtcggtgaggatcgcggccaggcgccactcgccggcggccgccaggcgggcgccggcacggcgtgcgtgccgcgcggcgagcggcggatcgcgatggcggacggcgatggctcgcagtgcgcgctcgatccaccgcgcatccgcggcggccgggtcgagcccggccagggcgcgccacaggcgccgcgactcgcggccgagttgcagggatacgaagcccaggcgcagggccagcgcgctgcgcggatgttccatgccatgcagcgcgcccaactgggcgatgcgatgctgctggcgggcctgccaggcatgcgcgtcgaaaccggcgcgacgacgcagcaaggcgagggtctcgcggcgcagatggtcgagcagcgacgccgaatgccgttccaggtccttcggcagcaggcggtag

SEQ ID NO: 2849 - DNA, 444 bp, Pseudomonas aeruginosa
tgtcgatggaaggccgctgggcggacgtcggcgcgggcccggccgtcgagccgggcgaacccccgcagggcggcctgcaggtcatccagttgctcgtcgagacgctccatgaagagcccttcgcgacaggcatccgcttggtctgtcggaagtccgcgccgaatcgccgccaggcgaccgcgcaagctcgcgagccgtcgcgcggcgccggcgaagtcgagctcgccgcgctccagttggccgcccagcaggcacaggtcgtcggccatcggcagcgccagtccacgctccgccaagcgccgggcccaatgcgtctcgccggcgaagcggaactccatcagcgtggaaaacagcgccgccaggccaccgcggatcgccgggagcgcagcgctcagcgcccgcgactcggctcgaccgacacccagcaggtcgtctaccgcgtag

SEQ ID NO: 2850 - DNA, 420 bp, Pseudomonas aeruginosa
agatgttggtccggcccgccgccgcgtaatcgccgggctgcacgcgcaactgcgtcacatagccgtccaccggcgagcgcaactcgctgcgccgcaggtccagccgcgcctggtcgagcgccgccccggcggcctcggcgcgggcgcgggcgatacgcagggcgcgtccggcgttggcgacctcctcgcgcgaaaccgcgccggccaactgcatgcgtcggcgccattgctcgtcacgttggcgcagggtttcccgcgcctgctccagctccgcctcgcgctggcgcacggccaggcgatagctgcgcggatcgatgcggtacagcggatcgccgcgggccacccgctggttatctgcgacgaacaccgcctcgacgctgccggagacttccggcgcaatgcggatcacctgcgcgctga

SEQ ID NO: 2851 - DNA, 903 bp, Pseudomonas aeruginosa
ccttcggccagtggcgccagcaattgcagatcatcatcgccctgcagcaactgtccgccggcgtttcggtgcaacgcaccgccgagatcctcggctacgagtcggtcagctcgttcatcggcatgttccgcaaggcgctcggcagccccccggcccgctacgtgcgcgacagcatgcggcggccagccgactgaacgaaggtcgacggaaaggtcttgcagttcgtcagctgttctccccccgaggctggcactcgaagacacttctgggaataatgccgcccttttttctccaggaggatcagatggttacgcacttcttgagcgaatccggccaggcagcctgcgggcgcggcgacagcaacgtgaacggctcgagcgacgtcggccaggtcagttgcaagacctgccggcgcaccaacgccttcgcccaggcccaggaaaacgccgctccggccagtgcccctgtcacccccaccgccgctgcgccagtgatcgacaaggccgcgccgcggccgaaagccgaggccaggcccgccgccgcgcagcgccaggaccgcgatgccgcccgcaaggcctggcaggcgcgtctcaacgaattgtccgggaagaaccgcatgccgcgctcgcggcgccgcgcgcaagcctatctctgagcggtagcggtacttcgcggcggatgtccgcacgcggtcatatccgtcctgcccagcccaaccgcgcgtcccctcatcaggccaggccctgcgcctccgccagggccaggccgtcgagggcgccggcgagcatctccggcagatggcgcggctcgtcggccagctcggccagctccgacaaccgatgcgccgccgtcagcaaggcgatccgccgacgctccaggcgccgaccgctgaagcgctcgtag

SEQ ID NO: 2852 - DNA, 684 bp, Pseudomonas aeruginosa
gttttacccagactatcgacttgccccccttcccgcaattcccggaggaattcgcccatgcatgccctgatcgtcgtcgctcatcatcatccccgctctctcacccacgccctcgccgcgcgcatcgccgaaggcgtggtccgtgccggccattccgcggaaaccgccgatctggcggcggaaggcttcgagccgcgcttcggcctggccgaccacgccgtgcatcgcggccaggcgtcgcctcccgccgacgtcctcgccgagcaggcgcgcatcgatcgcgccgataccctggtgctggtctacccgatctactggtggtcgatgccggccctgctcaagggctggatcgatcgcgtgttctccaatggctgggccttcgactacagcatcggcggcgacctgcggaaaaagctgcagcgcctgcgcgtggtgctggtcggtgtcggcggcgccgatgccggcaccttcgagcggcacggctacgccggggcgatgcgcacccagatcgaccatggcatcttcgattactgcggcgcacgggtggtccgttccgaactgttgctggagtcggagagcgccgatccgatccggcatctggaccaggccctgcacatcggcagccagctcttcgccgcacgcggcgcgcagggggccgcccaggcgcagccgctggaagcctga

SEQ ID NO: 2853 - DNA, 921 bp, Pseudomonas aeruginosa
tctccggcgactggacctgaacctgctggtgaccctcgacgtgctgctcaccgaacacaatgtgacgcgcgcggcggaacgcctgaatttttcccaaccctcggtgagcgtgcacctggccaagctgcgggcgatcttcgacgatcccttgctgcttcccggcccgcgcgggatgcgcccgacggcgcgggcggaggagctgcgcgagccgttacgcctggccctggaagccctggagcaggcggtggcgccggccgcgccgttcgatccgacgcagtcacggcatacctggcgcgtcgccgccaccgactacgccgagtcggcgatcctcctgccgatcctcgccagtcttcgccgccaggcgccgggcagccgcctggcggtgctggagctggcgccgacgcgaatcgtcaggcaggcggaacgcggcgagatcgacctgggcttccacaccctcgaagaatcgccgccgggactgcgctgtcgccggctgttcagcgagcgctatgtgctggccgggcgcgccgggcatccggggctgcgtcggcgaccgacgctgaagcagttctgccgcctcgagcaggcgatcgtctcgcccgacggcggcggcttcctaggtcccaccgaccaggcgctcgccgaactcggcgcggaacgccgggtggcgttgtcggtgccgcacttcctgttcctccgcgcggtgctggaaagcaccgacctggtggcgctgctgccgtcgcgactggtacgcgagcgcgacaggttgcgggtggtcgaggcgcccctggaggtgcccggctacgacctggccatgctctggcacgagcgctcgcaccgcgatccggcccatcgctggctgcgcgaactcatcgccgcctcggtgtaacgcggcgatacgcttcggtcgtcgccgcggtttga

SEQ ID NO: 2854 - DNA, 1191 bp, Pseudomonas aeruginosa
cgggcttcgatccaccaccaggaagtccttggcgtgaagtttccgttccatccctggcgccgcctgctgctctgcgcgctccctttcgccgccctgctgacggcatgcgacgacggcaagaaagagcccccgcccaaacccgccgaagtcaccacctacaacagcgtgccctgggacgccctgccggccaccagcgacgccgacctgctcgccggcttcaatgcctggcgctcggcctgcgcgcggctggccaaggacccggtatggggcgagccctgtgcgagcgccacgacggtcgccgccgatccgacggcggtgcgcgcgttcctccaggagcggatgcaggtctatagcctgcgttcctccagcaacggcgaccagggcctgatcaccggctactacgaaccggtctaccacggcagcctgagccagggcgaaaaaaccccggtgccggtctacggcgtaccggacgacctggtggtggtcgcgctggaaagcgtctacccggaactcaagggcaagcgcctgcgcggacgcctggaaggccgggtgctgaaaccctacgacgacgccgcgacgatccgcgacaacggctccagcgcgccggtgctcgcctggctgggcgacccgatggacctgcagttcctgcagatccagggttccgggcgcatccagctggaagacggccggcaactgcgcatcggctacggcgaccagaatggccacccgtacaagccggtcggccgctggctggtcgagcagggcctggtgccgaaggaagagatcagcatgaagcgcatccgcgactgggccgaggccaatccgcagcgggtctccgaactgctggcgagcaatcccagcttcgtgttcttcagcctgcgcccggacagcgacgaaagtccgcgcggctcgctgaacgtaccgctgaccgacggctacagcgtggccatcgaccgcaaggtgattccgctgggcagcctgatgtggctgtccaccacccgccctgacgacggcagcgcggtggtccgtccggtggcggcccaggataccggcggggccatcgtcggcgaggtccgcgccgatctgttctggggcaccggcgacgccgccggcgaactcgccggacacatgaagcagccgggccggctctggctgctatggcccaagggggcgccgctgcccgcctcctga

SEQ ID NO: 2855 - DNA, 1122 bp, Pseudomonas aeruginosa
tcggcgagcgcggagccgacagcgccttggctcaccggcctcgctgttcaacaccctggtggaacctcgacccgggactgtctcggcggctttcgccagttgctcaccggcggcgacatcctctcggtgccgcacgtgcgccgggcgctgctgcggcatccgcgactgcacttggtgaatggctacggaccgacggagaacaccaccttcacctgctgccatgtcgtcaccgacgacgacctcgaggaagacgacatccccatcggcaaggccatcgccggcaccgcggtgctcctgctcgacgagcaaggacaggagatcgccgagcccgaccgggccggggagatcgtcgccttcggcgccggcctggcgcagggttatcggaacgatgcggcgcgcacccgcgccagcttcgtcgagttgccctatcgcggccgcctcctgcgtgcctaccgtaccggcgaccgcgctcgctacgacgagcagggccggctgcgcttcatcggccgcggcgatggccaggtcaagctgaacggctatcgcctcgacctccccgccctggaacagcgcttccgccgccagccgggcatcctcgactgcgccctgctggtccgcgagcgcaacggcgtcaagcaactgctctgcgcctggacgggaaaagccgacaccagcccgcaggccctgctccgccaactgcccacctggcagcgcccgcatgcctgcgtccgggtcgaggccttgcccttgacggcacacggcaagctggaccgcgccgccctgctgcgccgcctggaagaaccgctggagcgctgcgccagcgcgctcgatcccgaccaacgcggctgcgcgcagctgtggagcgaattgctgggttgcgaggtcggcgccgccgaccaggatttcttcctctgcggcggcaactcgttgctcgccctgcaactggtcgccctctgtcaatcggcgggtacgggagcaaacctgggactcgccgacttgcaggcaaactcgcgcctcgaccagttcagccgtctcctgcgcagccacggcctggcgccggagcgtctgctggaacgggcggcgacgccggagcagccgctggtgctgtcgaggagcgcggcatga

SEQ ID NO: 2856 - DNA, 540 bp, Pseudomonas aeruginosa
cgcgcctgggacggcgcctgcgcgaagagttcccgttgctcgacagccaggtggacagcggcgcggaaggtttcgaactggtcgtccacgggcagcccgaggagagcccggcgctggaagtcggccccttcgccgacgaaaacgcgctcatcgcagcgctgctgcaacgcccgcattccctgttcgagcgcggcctgctgcgactgttccacgggcgctgcggaggacgtgcgcgctggggcgtctggctgcatcacctggtcgccgacgccgacttcgccagcgtgctgctggcccgcctggccgtgctcaacgccgaccccacgaccgaagcggcggcccccgagttcggcttcctccagcagcaatggcgcctggagcgccagctgcgcgagcgcaggaccaggctggaagactactggagcgagcgcggcgaggcgttccgtgaactggcgaacctgccctgggcggagcgcgccagccattgcgaggatttccgcttggctgccacgccaggaggcggcgaagccgccctgctga

SEQ ID NO: 2857 - DNA, 1470 bp, Pseudomonas aeruginosa
cttcatcggccacccgagctgcttccgcgggctgctggcacgcctcggcgcaacggactgccggctggtcgactaccaccggctggatgcctacgccagcatcgaagccctcgccagccaggtactcgacggcctggcggaagaaccggactggctgatcggctattccttcggcggcctggtcggctacgagatggcccgccagttgccggccagccgcctgctgatgatcgacagccacctgccctggccggccctgcggcgaatgccgccgagcgagcaataccagcgctggctgagcgccgagatgcgcgaatggatcgccctgatgagcgagcttggcgaactgcgcgaagaggtcctgctgcgcaatgtcgagctgttcggccgctggcagccccgccatcgcctcgcccgcgccagctgggtgcgctgccgggacgacgccggccgcgacccggccgccgaacgctggtgcgacctgatcgagcggctcgacaccttcccctgcgagcgtccgcaccacctggccctgcaggacccggcggtgatcgatttcatcgtccacaccgtcagcaaggagtccgtccaatgaaacactatcggcaggtggtatccccgcaattgcgccaacaggcgctggactggatcctcgccgcggcgcagcggccggacccggcgctggaaccggaattcgacatcgccgacgacgagcgccgcgaggcgaagaaggtgcgcaacctgcaccgccacgacccgctcttctgggacgactggttcgcccgctccgggctcgacgcgctggtccgcgaccatctgcgcaagccgcgcctgctgcgccacgcggcgttcatcaagcgccacgccgacgagtcctacatcccgctgcaccaggacatcgcgctatgggagaagcgctacgaaagcgcgcagaccttctgggtcgccctgaccccgtcgcggaacgacaacggtgggatgttctattaccccgacgaccgcacgatcttcccccacgagttcgacctcgcctacccgatgttcaagtgcatcgacctccaggccaacggcatttcccgcgagcaactggtggatgccgagctggacgccggcgacgtcctggtctggcccgcccgcaccgcacatggcagccacaacaaccgcagcggcgagctgcgcatcggcatgccgatcgtcttcgtcgaggacgacgaattccaccaactgaatcgagaggacagcatgaaaacctggatcgcttccaacctgaaaagcgtgttcccggacgaagcaatcaccgaggacaacctcgaccactatcttccgcagctgtgcgactactcgctgaagatggtcaccttcctcgcccgtttctcccgccagttcggccatgcgccgaagatccacgacttcatcagggagccgcggctggcgacgctgtcggcctcggacgcgggagcgagacgatga

SEQ ID NO: 2858 - DNA, 1251 bp, Pseudomonas aeruginosa
tcgagtgcggccacccgcggatttccgcggacgaacgcgagcgggtacgcgccgtggtggcggcggtttccacgccggtgctggcccacacccgggcgcgccgggaggatatcgacgcggtgctggaaaccggtgcgcaagtgggtcgggctgttcgcctcgatcaacgcgatctcgctggaaaccaagttcaagggcatgagccgcgaggaggtgctcgaactgttccacgacgcgatccgctacgcccgcgaacgcggcctgcgggtccgggccacggtggaagacgccgcgcgcacctcggtcagcgacctggtcagcatgatcgccaccgcgcgcgacgccggcgccgatcgcatctgcttcgccgacagcgtcggcatcctgctgccggacgagaccttcgacgtgctctcgctgctgcgtcacgagttccccgacgtggtcttcgagtaccacgtgcacaacgaccgcggcctggccctgggcaataccctggcggcgatccaggccggggtccagtggcactcggcgagctgcaacgggatcggcgaacgcgccgggatcaccgacaccttccagttgctgaccctgctgcacaccaagttcgccgccgaccgcttcaacctgaagaacgtcctcgcggtctccgagctggtcgaggcgcacagccggatcaagcgttcaccgatgcacccggtggtcggcgagaacgccttcgtccatgtcgcccgcctgcaccagttggccatgcaggaaaaccaggacgcctacagcgccttcgatccggaactgatcaacggccgcgtctcgctgcaacgctacacgccgatgcaccgccaatccctgttcctcacgcctttcgagaagtccgccagcgaactgaagtaccaccgccacggccccggcaagcgcttcgtcatgctcgaccggcgcctgctcgacggctcgccgttctacttcatcgcccgccagttccacgacgtcggcgacggcgggccgggccacgtcgacagccacgtacacaactgcgactcggtgttcctgttcctcggcagcgacgaggactaccgcggcctggaggtggaagtcctgctcggcggccagctgcgccgtttgcagagcccggccagcgtgttcatccccgctggcgtcgagcacagctaccgctacctcggcggcagcggcacctacatcaatttcgtccacaagggcgattaccacgagagcctactggagattacccaatga

SEQ ID NO: 2859 - DNA, 537 bp, Pseudomonas aeruginosa
tcctgttcacctcgggcaccaccggccagccgaaaggcatcgaactcagccagcaggccatgctccatgcctaccgcatcggccgcgactgcctgggcatcggcgagcacacgcgctccggttgcttctaccggatcagcggcctgggcatcctcggcatcaatttcctcttcccgctgctgtacggcggcagcgcggtgctcctgccgctgcactgctgggccgacagcgaaggcttctgggaatgcgtggaacgcttcggcatcagtttcctctacctggtgccgccggtggtcaaccacatggtcaaggaaggctccccgccgccgcgccgcttgccgttgcagcgcctgctctgcgtcgccggctcggcgcgcctggacgccgacctgcaggcggccttccagcgcgactacgcggcgctggcgaacatctacggcctcagcgagtgcggctttgccttcctcttcggcaagcgtcgcggcgatgcgttcgacaactcggtgggacctgccgtcggcctggaactcaagctga

SEQ ID NO: 2860 - DNA, 2616 bp, Pseudomonas aeruginosa
acggcgccggcaagcacgaccgccgtgcgctcgccgccctgctgcaacgggaagcctcgtgatgtgcggcatcctcggttacgtcggcaccggtttcagtgtctcgcgcttcgccggagcgctacgcctgctggcccatcgcggcccgttcggcgagggcatcgcggccttgccgaacggcgccatcggcatgacccgcctgccgatgtccggcgccgcggcggtaccgctgccgccgcaggagggccagcggcgggtcgcctacaacggcgaggtctaccaggccggctgcgaaatccatggcgagatccgcctgctgctcgacggcttgcagcgcggggtactgccggacggcatgtacgccctcgccagctgggacccgcagacccggcaattgaccctgctgcgcgacgagttcggcatcaagccgctgtactacagctaccagcccgagcgcggcctgctggccttcgcctccgagccgcgggcgctgctgcacctgctcggcggcgcccgcgccgacgccgaggcgatcgcccaggtggtcgccgccggcgtgccgctggaaggccagaccctgttccagcaggtccgtctgctgctgcccggcgaggtgttgcgcttcgatctctcccaggagcgtccgcgcctctgccagcgccagcggctggccaccgccccggccagcgaggtggacagcctcgacgagcagctcggcgaaaccctcgaacgctgccgccagaccttccgcccctgcgccctgctggtcagcggcggggtcgattccaacctgctcggcagctacctggacccgcagttgcaacgctttcacctgtgcctggaaggcgacgaggaaagcctgctgccacaccctcggctgcaacgcttcgagctgcgccaggaagccttcatgccgctgctgcgtcgcgcggtcggcaacttcggcggggcgacacggatgtccagcctgctgatgtaccagcgcctggccgacggtatcggcgagcagggctatcactgcgtgcttctcggcgaaggcgccgacgaactgttctggggctacccgcgccatctcgaactctggcgccggcgcgacgcaccggaaccgcggcgcttcgccgccgcctggttcggcgagtaccggcgcaaggccgcgctgctggcggaaccggcgggccgacgggtcgccgagcggatcgaggaactcgcccacgaggccctcggccagggcctcgaggcggcgatcggccagttcgatctgcactactcgctggagccgctgctgcgccgcgccgaccatctgctgatgtcgcgcaccatcgaagcgcgcaccccctacctgcatggcgccctggcgcagcgcgccgggcgcctccagcggatcgtcggcgacaccgccaaggcaccgctggtggcgctcctggagcagcgcgagaaacgctggcaggcgcagccgaaacggcatttccgcctgccgttcgaacgttggccgcaggccctcggggaaatgcgccggcacctcgccgaacgcctgccggcgctccacgacctcggcctggaaggcctggatgcaccgagcgtcgcggcgctgcccggcgaccagttgttcaccctcaccaccctgtcgctctggcagcaggaatacggagcctcgctatgacaaccatccatcgtcgccccgcgccctggcggggcaacgcggtgttctgcgcttcggccgctttcgccgccggcctggaaacgctgttcgcgcgcctgctggagcggcgtcccgcggatagcgcggaggctctcctgcgccagcgcctgcatcacgaactggagcatggaagcggcgtgctgctgcacgattccgcgctgctgcgcggactcgccgaggacgaattccagcgggtgttccgcgcattctgccaatggctgggacgcaccgtggcgatcaaccgcaacggcgagtacctcaaggaagtgcgcgacctcggcctgcgcgacgcccgcgacgcgccgcagcgcggccacctgaccagccaggaactggccttccactccgatcgcgccgacctcacggtgctcgcctgctggtcgccggcacgccggggcggcgccttccgcatccgttcctcggccgacgtcctcgccaccctggaagccgccaatccggcctggctgcccctgctcggccagccgatcccccacgacctgcgcgacgaaggcgacgccgactacgcgctggtgccgctgctcacggaaaccccgcggaccttcgtcttgcgctatatccgcaagttcaacgaatcggtgacgcgccacgggctaagcctcgccccgcaggtgcgaagcatgctcgacggcctggacgaggcgatcgaacgcgccgacggctatgccgaactggacttcagcaagggcatgctggtgctggtgaacaaccacaccaccctgcacgcgcgcaccgagttcagcgacgacgagcggcagcgccgctgcctgctgcgctgctggctgagcagcgagttcacccgcgaactgccggaaagcttcctgccgctgttccaccaggtagccgccggcagcctgcgcggcggcatccgtcccctcgcccaggagccccgcccgtga

SEQ ID NO: 2861 - DNA, 684 bp, Pseudomonas aeruginosa
tcatgctgctgcaggtcggcgcggtcggcctgcgccaggccgagcgggccggcggatgaccggcgcgctgctggtctcgggatttttcctgcgccgctccgcctggtccgtggaaggcgccggctggcgaagctgcgaccatctgcgcgacgcgcccggatgcgacctggcgcattggctggaccaggccgccgccacgctggccggcgaggagcgggtgatactctgcggccacagcttcggcggctacctggcgcaatgcctggcggcccgcctgggcgagcgcgccgcgcacctgtacctgttcagcgcgctggtcagcgagggcggcggcgcgctggaaagctaccaggacagcggccaggacaatctcctcgggctatgccgcctcgacccgctcggagggcgggtccgcctggaagaccgcgccggcttcctcgaactgctcggcgccgaggtgccgaccagcgccagcgaacccgcgcaattgctgatcgacccgccgccgcaggttcgtccagcctgcccggtcacctacgtggtggcggccgccgaccggctcagcccgccgccgctgcaacgtaccttcgcccaccgcctggacgcgcgagtgcgggaatacccgggcgggcacctcgccgcactggcggacccgcgcttccttcgcgccctgatcgaatctaa

SEQ ID NO: 2862 - DNA, 837 bp, Pseudomonas aeruginosa
cgagatcgccgccggcagcggcttcccgccgcacccgcaccgcgacatggagatcattacctatgtccgcgaaggcgcgatcacccaccaggacagcctgggcaacaagggccgcaccgaggccggcgacgtgcaggtgatgagcgccggtaccggcatcgtccattcggagtacaacctggaagccgagaccacccggatcttccagatctggatcatcccggaccgccgcggcgaccagccgcgctggggctccaaaccgttcccgaaggccgagcgcgacggtcgtttcgtcactctcgccagcggcgacgagcaggacagcgaagcgctgcacatccgcgccgacgccgaggtcgccgcggtgaccctgaaggccggccagagcgccgagtacgccctggaaaacggtcgccgcgcctacctggtaccggccaccggcagcatcgaggtcaacggcgtgcgcgccgaggcccgcgatggcctggcggtacgcgacgaaccgaccctgaaggtcaccgccctggaagacagcgaagtgctgctggtggaagtggcctgacccgacagcccctcgcccccacgggcgaggggctgctttcgttgcgccccagcctctctcgacgcagcggcgttatccgccgcaacgcctccggccctgccgactgggttcttcccagcttcacgcttcgcgctcacactacccgcagaagaattcgagaggctctgccatgcgtgaactgcaacccctgctggagaaccacgggctgctcctgctgttcctcaacgtgctctgcgagcaggccgggctgccgatccccgcctacccggcgctga

SEQ ID NO: 2863 - DNA, 1743 bp, Pseudomonas aeruginosa
aggacctccccggcgacctcagggacgccagcatcgtcatctattgcgcctgtccccacgaactttccgccgcgatgctcgcccagcgcctcaacgcctccggcttcacccgcacctgggcgctggccggcggcctggacgcctggcgcaaggcctacgggcaggtcgtggcgaacgcctgagcgacgcccaccgggttcagcccagggcctgcaccgccgcgccgccggcttgccgctgcggcgccggcgaggagaacaccaggtagccgtcctcgaccttgccgtagcgcagcagcgccaggtcgaggacgtagttctggtaaagcttccagggcatccggtcgccctgcttgggtatgcgctcggcggcgcgctggatgtagccggagtcgaggttgaggaagggctcctcgcgcacgtcgccggtgctgtcgcgggcggtcacctggcgcatgccggtggcatccatgtgattgatcaggcggcagaagtattcgctggagaggtccgctttgagcgtccaactggcgttggtatagccgaccaccgccgccaggtttggcaggtcgcgcagcatgatgccgcgatagcccatgctctggttgacctggaacggcttgccgtcgaccgccagctcggcgccgccgaacatcaccaggtcgaggccggtggcggtgacgatgatgtccgcctccagcacctcgccggtcttcaggcgaatgccccgctcgacgaagcggtcgatgtgctcggtgaccaccgacgccttgcccttgcgcagcaccttgaacaggtcgccgtccggcaccgcgcagacccgctcgtcccacggcttgtagcgcgggctgaagtgacgcatgtcgaagcgtttgcccagttgcaggctggccagcttgagcagggccttgcggaccaggccggggaaggtcctggcgagcatgaagaagaccatctgcatggccacgttgcgcgcccgcgcctggcggtagatccaggtttccggaaggaagcggcggaggaaattggagatcgcgtccttctgcggcagggtgatcacgtaggatggcgagcgctgcagcatggtgacgtgggcggccttgtcggtcagcgacggcaccagggtcacggcggtcgcgccgctaccgatcaccaccaccttcttgccgctgtagtcgaggtcctcgggccacagctgcggatggacgacctgcccggcgaagtcctcgcgaccgacgaattccggggtatagccggcctcgtagcggtagtagccggtgcacatcagcaggaactgcgcggtcatgcgcagcggctcgggctcgtcgccgcgctgcacgtcgaggttccagcgcgcattggcggaatcccagtcggccctgagcacccggtggcggtagcggatcttccggtcgatgccgttctcccgtgcggtctcctcgatgtagcggcggatcgacggaccgtcggcgatggccttgggatcgctccatggcttgaagttgtagccgagggtgaacatgtccgagtcggaacggatgccggggtagcggaacaggtcccaggtaccgcccatcgccgcgcgcccttcgagcagggcgaagctcttgccggggcaatgcttcatcaggtggtaggcggcgccgacgccggacaatccggcgccgacgatgagtacgtccaggtgttcgacaggcataaggttcctcgatcggcggaagcgtccagccgtctgctgggctga

SEQ ID NO: 2864 - DNA, 2790 bp, Pseudomonas aeruginosa
agcggcgccagttcgccatggatctcgatcagccgctcgggccggcgagccggcctggcgatggaagccgtcgatgttctgggtcagcacccaacattccggcttgtgcttctgcaactcggcgatggcttcgtggccggcgttgggtcgggccgccaggcaagccttgccaagttccgcgaggtacttccagcacagcgccggatcgcgccgcagcatcggtccggaaagtgccgcctcgatcggcaggccctcttccgtgcgaccgttgtagagaccgccgaggccgcgataggtgggcataccggagtccgcggagaggccggcgccggtgatgaccaggatgcgttcggcgcgccgcagggcctgggcgacggtagcgatcgggctgtggctgtccatggttggctcctgtcaggctggcggatcgagggaagccggcaagccgagccggcgcatgcgcccgagcagggtcgtgcgcggaatccgcaaccgggcggcggcccgggagagattgccgcgcgcctggcgcaaggcgtcttctatcaggttgcgctcctgttgcgccagcgcctcgcgcaggcctccgaccgccgcgctgttcatcgagagcgcggcctcgccgcccacggcctcggcgccgtcgtcggcgaacgccacctcatccagcagtgcgccgccctccccgtgcagcaacaggctgcgccggatcacgttttccagttgccggacgttgcccggccagtcgcaggccagcaactgcgccagcgcccgctcgccaagagcggtgacacgcgggttgaggctgcgcgcatcgcgacggacgaacgcccgtgccagcagttccacatcgccggggcgctcgcgcagcggcgggatgcacaggctgcccacgtccagacggtagtacaggtcctcgcgcaggcgtccctcggcgatcgcctggcgcggcggctggttgctcgccgcgatcaggcgcacatcggcccgctgcgggctcaggctgcccagaggcaggtagctgccgtcctgcaggacccgcagcagcttgctctgcatggccatcggcatggaattgatctcgtcgaggaacaagctgccgccctgcgccagggcgaacatgcccttgcggttctcggcgccggtgaaagcgccgcgtgtggtgccgaacagggtactttccagcagcgtctcgggaatcgctgcgcagttcaggctgatcatcggaccgctgcgtcgcgggctcagggcatgggcgcgacgggcgaacagttccttgccggtgccggtctcgccatggatcagcagcggcaggtcggtggcggcgaaaacgtccaggcgctgcaactgccgcagcaggctcggcgccacgctcaggatgttcgggcaatccgccaggcctgcggcctcttcggtctcggcgacgacttcgccgagctccatcgcgccgagcaggcaaccgtcgcgcccgcgcagcgggatcgcccggtggcgatactgcaacagctcgccgccggcccccacgtaggcctgcagcgtatcgatcgacggccgcccttcggccaggcaacgcaacagcgtgctttgctcggccgccagccagggagcgctctgcaacaggtgcatacccaacgcccgctgcgggtcgagaccatcgagcaggccgctggcacggttgtagtagacgaagcgaccggaggggtcgaccaccgtgaccggttgccgcaggccgtcgaaaatcggcgccaggcagtccaccaaccaggccagttcaccgcttcgcgtggaaatcgtcggctcctcgacaagcgccatgctctccccctcggtttcccggatgtcgaaatctcgtcagttgtcccatcttcgacgcagcgcgaccgagcatccttggcgtggatcaaccaagccctcggaaaaccaggaaaatcctccgatttatcaaggatttccaaggcaattcccgggcgttggctggcgcgtggcttgcaacgacctcgtcgtccccacacgaggaaaatcgtcatgttcaagcacatcatcgctcgcacgcccgcccgcagcctggtcgacggcctgacctccagccacctcggcaagccggactacgccaaggccctggagcagcacaacgcctacatccgcgccttgcagacctgcgacgtggacatcaccctgctgccgccggacgaacgcttccccgactcggtgttcgtcgaggacccggtgctctgcacctcgcgctgcgccatcatcacccgccccggcgccgaatcgcggcgcggcgagaccgagatcatcgaggaaaccgtgcagcgcttctatccgggcaaggtcgagcgcatcgaggcacccggcacggtggaagccggcgacatcatgatggtcggcgaccacttctacatcggcgaatcggcccgcaccaacgccgagggcgcccggcagatgatcgcgatcctggagaaacatggcctcagcggctcggtggtgcgcctggaaaaggtcctgcacctgaagaccgggctcgcctacctggaacacaacaacctgctggccgccggcgagttcgtcagcaagccggagttccaggacttcaacatcatcgagatccccgaagaggagtcctacgccgccaactgcatctgggtcaacgaaagggtgatcatgcccgccggctatccccggacccgcgagaagatcgcccgcctcggctaccgggtgatcgaggtggacacctccgaatatcgcaagatcgacggcggcgtcagttgcatgtcgctgcgcttctga

SEQ ID NO: 2865 - DNA, 786 bp, Pseudomonas aeruginosa
ccgaaagggtgcccatggtgctctggaatccgggtgttcgaggagaaaagctggctattttacgcacaaagcgacgccgaccccagcccctcccgacgcccgatgctagtcttgtcccatgactcccgacctcgaccaccgcctcgacctcgccgggcagatcctctgcctgctgcgcgagcatcccgagggactttccgaataccagttgatccagctgctgaaggcccgccattcgacgcatatcccccatcgcgaactggccgacaagctggtgctgttccgcacccatttcctcctgttcaacgcgctctaccacctgcgcgaccacctctgggccgagcgcgaggcgcacctggagatcagcccgctgagcctgcgcctgcatccttacgtggatggcacgcaggcgctggaacagggcgatccgctgcgcgactactacctcgacctgcgtcacctgggggagaccagcgaggccgacgtcgagcggctgctgcagagtttctggacgcgcatgcagggcagcgaggagaaggccgccgccctcgccctgttcgagctggaaggcgcggtcgactatcccgccatcaagctgcgctaccggcaactggtcagccagcaccatcccgaccgcggcggcagcaccgcgcgcctgcaatcgatcaacaaggcgatggaaatactgcaacgctattacagccggccgtgaagcttcgatttgctctaaacccgcgagcgacgcgggctcgggccgttcctatactgcgacataaggtcgcatag

SEQ ID NO: 2866 - DNA, 618 bp, Pseudomonas aeruginosa
gaacgaggaggaaacggcatgatccatcatgtatgggggctcttcacccatcccgatcaggaatggcaggaaatccgtggcgaagaagaaagcatcagccacatgtacctgacccacatcctgatcctggctgccattccggcgatttccgcctatatcggcacgacccaggtcggctgggtggtcggcggcggcgatccggtcaagttgacccaggccagcgcgttgcagatgacggtcctcacctacctggcgatgctcgccggggtggcggtgatgggcgcgttcatccactggatggcgcggacctacgacgccaacccgagcctgacccagtgcatcgtgttcgccgcctacaacgccacgccgctgttcatcgccgggctggcggcgctgtatccgcacctctggctgggaatgatcgtcggggtggcggcgatcagctacacggtctacctgctctacgtggggattcccaccttcatgaacatccacaaggacgaaggcttcctgttctccagctcggtgctggcggtgggcctggtggtgctggtggcgatgatcgccctgtcggtgatcctctggggcagcggggtcggcccggaatacaccagctga

SEQ ID NO: 2867 - DNA, 1386 bp, Pseudomonas aeruginosa
  unsure (1027): Identity of nucleotide at the above locations are unknown.
tcatgcgcggcatctacggcctgccgccggaccgctgccacacctacgcggtcaagcgccgcgccaccacccgctacctgtaccgctgccattgcccggagcacaacgacttcccgttctccccgcaacgccacaccctggtggccaaggggcgccgctactactgccggcgctgcaaggcgaccctggtgttcaccggcgaagtgctccgcgagtgattcaggcgatggccccggccgccttcagctcggcgatccgttcggcggagtagcccaggccttcgagcaccgccacggtgtcggcaccgagcgccgcgccgatgtggcgaggcgccggcagaccggcggaaaacttgatcggacaggccatctgcgcctggctgccgccgtccgccagcggcacccgggcgaccagcccgcgcgcctgcaactgcgggtgttccagcgcctcggagagcggcagcagcggctccacgcaggcatccagggcggcgaacaccgcctgccattcggcgaagtcgcgtttctcgaactccatctcgatctcgcgcttcagcgcccgctgctcttccggcttcggcgacaggccgcgggcggccagttccgggcggccgatggcggcgcagaattgctgcatgaactgcggttccaggctgcccaccgagaaccagcggccatcgcgggtgcggtagtagtcgtagaagctgccgccgttcagcgccagcgcctccatctccggctcgaccccggccgcgagatagccggcgccggccatgccgttcaggctgaaggcgcagtcggtcatgctgatgtcgacgaactgcccctcgccggtctgctgccggtggatgaccgccgccagcaggcccatcacgccatgcagcgaaccgccggcgaggtccgccagttgtacccccagcggcaacgggccacgttcgcggcgcccggtgtagctggcgacgccggccaacgccaggtagttgatgtcatgcccggcgcgctcgcggtacggcccggtctggccgtanccggtgatggccacgtagatcagccgcgggttcgccgccttcagcgcctcgtagccgacgccgagcttgtccatcacccccggacggaactgttcgaggacgatgtcgtattcgcgtaccagctccagcaccacctcgcgtgcgccctgccgcttcaggtcgaggccgatggaacgcttgttgcggttcaggtaggcatgactggccgaggtgccgtcgacgtgcggcggcagcacccgcaccaggtccatgcgcccgggcgactccacgcgcagcacgtccgcccccatgtcggccagcagcagcgaggcgaacggccccggcaacagggtcgagaaatccagcactttcaacgatga

SEQ ID NO: 2868 - DNA, 1125 bp, Pseudomonas aeruginosa
gcgtggcggattaccgcccggcgggccggctgtgccgcgcgagcatggcgggagtccgccaccacccttgtcgtcttccgggtggcgccctaccatcgccgttccaacaacaaggacgccgccatgcgtgagcgcaccatcgccagccatttcgtccgcgccgcgttgcgcggggccacgcgccaaggcctggacggccccgccctgctgcgtcgcgccggcatccagccggccctgctggacgaaccgcgggcacgcatcgcgccggagcagttcacccgcctgatgcagttgctctgggaagtgctggacgacgaatacatgggcttcggcgaagtccgcagcaagcgcggcaccttcgccatgatgtgccacaccctgattcattgccggaccctggaaaaggccctgcagcgcggcgaactgttctacggcctgttcccccaggcgccgctgatccacctgcggcgcgacggcgacctggtgcgcctgagcctcgaggaacgccacctgtcggacccggatcactttctcgccgaaagcctgctggtgatctggcaccgcctcgccagttggctgatcggccagcgcatccgcctggaggaagccaccttcagctacccggcgccggaccaccaggccgagtacgacctgctgtttccctgcccccggcggttttccgccggctgcaccagcctgctgttcgccgcccgctacctgggcatgccgctgctgcaggacgaacgcaccctcaagcagttcctccagcactctcccgccgacctgctggcgcgcccggacggcggcgacagcctgaccagccagatccgccgcctgctcggccgcgactgccggcgctggccggacctcgaccaggtcgcccgccaactgcacatgagttcgcagaccctgcgacgccacctgcgcgaggaaggcggcagcttccagcaactcaaggaccacctgcggcgcgacctggcgatctaccacctgggtcgggacgagctgtcgatccaggacatcgccgagcagctcggcttttccgagccctcggccttccatcgcgcgttcaagaagtggaccggcctcacccccggcgcgtaccggcaccaggcggaagcctga

SEQ ID NO: 2869 - DNA, 2856 bp, Pseudomonas aeruginosa
agctcagcccaactcctggcgacgaagcccgctgcgcagttggtcgagcaccgtggcgaacggctgcggccgcccgaccgcgtagccctgggcgaaatccaccccgaggcgcgccaggtgatcgaggatttcccggctctcgacgaactcggccacagtcaccgcgcccaggcggtgggcgatctggttgatggagtcgacgatggcctggtccaccgggctcttgtccaggttgcggacgaagctgccgtcgatcttgatcacgtcgacgacgaaattcttcaggtaattgaaggaactcaggccggagccgaagtcgtccagcgccaccttgcagccgaggtcgcgcagcttggcgacgatccgcgaagccaccgacaactggttcatcaacgccgtctcggtcagctcgaagtacaggcgctccggcctcagcggcgagtgttcgatgcgatccagcaggtaaggcaggaacagcgggtcgttgagcgagttgccggacaggttgatgccgatgctcaggccctccaccgcggcgatccgcgcgccgaagttgatcagcgcctcgttgatcacccagcggtcgatgctggccatcaggttgaagcgctcggcggccgggatgaaggcgcccggcggagtcatctggccatccggatcgtacagtcgcagcagcagctcgtagtgccggtcgccgtcgcggcgggggccgaccgggacgatctcctgcgcctgcaactggaagcggtcgttctccagggcctcgcgcagcccgctggcgaggagtatgtcgcggtgctggcgctccacttcctcatggccgaactggtacaccgaaacccggttgcgcccggcatgcttggccgcgtagcaggccacgtcggcctggctcatcagttcgctggtgctgcgcgaggtggcggtaagggcggtgataccgatgctcgcgcccacgtcgtagagccgcccttcccaggggaagcgcaccgagcagatctgctcgatgagcttgctcgccacctgctccgcctccgccaggtcgcaatcgaacagcagcaggccgaactcatcgccgcccagccgcgccagggtgtcggaggcgcgggtgcggtcggcgagaatccggctcagctcgcgcagcagcatgtcgcccgccgcgtgcccggcggaatcgttgaccaccttgaagcggtcgaggtcgatgaagcacagcgcatgctgggtcgcccgctcctgggcgttggccagggcgcgttgcagctcctcctcgaacttggtgcggttgaacagcccggtgagggcatcgtgggaggcgtgatagctcagctcgcgctgcatcgcccgggccttggtgacgttctggaacaccagcacggtgccgatgatctcgccatcgcgggtgcgcaccggcgccgcgcaattctggatatcgtgctgctcgcccttgcggctgatcagcgtggcgccgtcctccaggtagaacacccgggtgttctgcaggcagcgtcgcaccgggctttccagggcctcgccggtgtcgctgtcgagcacgttgaagaccagttcgtggggcgcgccgatggcgtcctgcaaggtccagccggtcatcgcctcggccaccgggttcatgaaggtcacgcggccgccggcgtcggtggtcaacacggcatcgcctatggaatacagggtcacctgcaggcgttccttttcctcgtgcagggtttccgccagggtgcggatctcggtgatgtcgctgttgatgccgatcatccgcaccggacggttgtcctcgtcgcgcgtcagcgtggcgatcgcccgcaggtggcgaacctcgcggttggggcggacgatacggaactcgcagtcgaatttctgcaacccgctgacggcgcgctccagctcgcgcagcacgcggtcgtgatcctcggcatgcaggctcgccttccactgctccacggcggtctccccgggaccgctgcggatgccgtacaggtcgaacatgcggaaatcccagtgcaggcggttgcgcgccaggtcccactcccagatgccgatctgcccggcgtcggtggccagcttgatccgttcggcgaggcgctcgcgctccagctcggcacgcttgcgactgtcgatatcctccacctgggtgacgaagtactgggcgactccctcctcgtcgcgcaccagcgacacgctgatgcgcgcccagaaggtttcgccgtcctggcgcaggtagcgcttctccatctggtaggagttgatacgcccggcgagcaggtcgcgcaccaggtcgaggtccagttccaggtcgtccacataggtgatctcctggaacgactgctcgcccaggcgttcggcggaatagccgagcatccggcacagcgcctcgttgaccttgaacagccgcccctccagcgacaccagggccatgccgatcgccgagaattccatggcgccgcggaactgcgcctcgccgatggccacctgatgctgctcgcggcggctgcgctccatgatcaccgagaccaggaaggcgggaatgagggtcaaggccatcggcaggtacagcagcggctcgccgaaacgctgctgggacgactcggggaggaacacgccgagggcgatcagcacggcgatgaaacaggtgttcaggcaaccgatcagcgcggtgccgaacacgctggtgctggcggcggccaccagcagcggcaggagcacgtagatgaaggcgtagggcaggcgcgtcagggccacgaagctgatcaccagggtcaccagcaggagcatcgcgttgtccactcccgcccgccccgacagagcgtgacgccaggccgccaggttgctggccatgcataa

SEQ ID NO: 2870 - DNA, 702 bp, Pseudomonas aeruginosa
gctttctacagtcgcctgcatagaggctgggccaatgaacgaacaacccgaccagggacgcgtcaagggcatggaagccaggctcttcctgtttctcgtgatctgcctgttcccgctgctgtccgtcgcactggtcggcggcttcggtttctgcgtctggatgtaccagctactggccggcccgcccgggccgccggcctgaggtcgggtatgagcagtcgccgagagctgttccgccgcctcggcgggcacccgccgacgcgtcgcccgccgtggaccgccgccgacttcgccgcaggctgcacaggctgcgccgcctgcgtcgaggcctgcccggaaggcgtgctgaagctcggcgccggtcggctcgtcgaactcgacctctccagcgccggctgcacgctgtgcggggaatgcgccagccgctgcgaggccggcctgttcgatggcgcgcgcccggccttcccctggatcgccacgatcggcgaagcctgcctggccctggccgggatccactgccgcagttgccaggacgcctgcgaacccgccgcgatccgcttccgcccggcccccggcggcgtcgccctggccgagctggacagccagcgctgcaacggctgcggcgcctgcctggcgccctgtccgagccaggccatccaactgcgcgcgctatccaccaaggagtctccacgacatgcctga

SEQ ID NO: 2871 - DNA, 597 bp, Pseudomonas aeruginosa
tcaacaaggtcaccctggacgccaccgacccgatttccaagcagaccgactacaagaagtgcgccgttcgcatcgaactgctcaacctggcctgaggagcgcgccatgaaacctctgctgactgccctgctcctcgtcctgctcggcgcccccgcagccttcgccgccgacctcggctacccgctggacgcgcccgcccccgacggccgccgccccggcggcacgctggccgaaagccgccccgcgccgccgctggcggccgaggaaaacaaggacctgaaacgcgagcgcaactaccccgagcagccgccgaccattccccacagcatcgtcggctatcgcatcgacaaggacagcaacaagtgcctgtcctgccacagccgcgccaacagcgcgcgaacccaggcggtgatgatcagcatcacccactacatggaccgcgacggccagccgctggccgccgtctcgccgcgccgctacttctgcgtgcagtgccatgtgccgcaacaggacgtaaagccgctggtcgacaaccgcttcgagaacatcgaccagatcctcgagaaagaagccgccaatgcggcgcgcaaaccctga

SEQ ID NO: 2872 - DNA, 1107 bp, Pseudomonas aeruginosa
atgagcggcgcacgctttgcctggccgaatggcccgcgtttgagcggcgcaaggccggcaccgagggttttccccgcgtcccgcgcacaagcgtctatcttgatcggggaccctttcacggagagatgccatgcgcctgttctgcgccctgctgctcatcgcctgcgccgccagcgcccaggccgctatccagacccgcgagatgccttaccggagcgcagacggcacgcgcatggtcggctatttcgcctacgacgacagcaagccggggatccgccctggggtcatcgtggtccacgaatggtgggggctcaacgactatgccaaacgccgcgcccgcgacctcgccgaactcggctacagcgccctggccatcgacatgtacggcgaaggcaagcacaccgagcacccgcaggacgcgatggccttcatgcaggccgcgacccgggatgccgacgccgccaaggcgcgcttcctcgccggcctggaactgctgaagcggcaaccgcagaccgatcccagccagatcgccgcgatcggctactgcttcggcggcaagatcgtcctcgacatggcccgccagggcctgccgctggccggcgtggcgagcttccacggcgccctcggcaccgccaccccggccagcaagggcagcgtcaaggccaagatcctggtggagcacggcagcgccgacagcctggtcccggccaaggacctcgacgccctgaaacaggaactgaacgccgccggcgccgactaccgggtggtgatccaggacgacgccaaacacggcttcaccaaccccgacgccgacgcgcacaaaggccacggcctggacatcggctacgaccgccaggccgaccagcgctcctgggcagacctgcaggcgttcctcaaggacatcttcgggcagggttgaaccctgcgccgacgcataaaaaaacgggagtccccggagggactcccgtcttgaaaggtcgagacaggacagtatcccgtcatcaacaaacaacctcacctgcattccacaggaatgcgcggcgcagtctgtcaaaaccgggcctcgcggtccgttttcctttgttgcgcttttgcaatcttgtgtaa

SEQ ID NO: 2873 - DNA, 768 bp, Pseudomonas aeruginosa
gcgccgcgtgactggtgggccacgtcgggaaccggcacaatgcgcgccatgaacgaccgtctcccctccttctgcaccccactggacgaccgctggccgctgcccgtcgcgctgcccggcgtgcaactgcgcagcacccgcttcgacccggcgctgctgcaacccggcgacttcgccctggccggcatccagccgccggcgaacatcctccgcgcggtggccaagcgccaggccgagtttctcgccgggcgcctctgcgcacgcgccgccctgttcgccctcgatggccgcgcccagacgccggccgtcggcgaggaccgcgcaccggtctggccggccgcgatcagcggctcgatcacccatggcgaccgctgggccgccgccctggtggcggcgcgcggcgactggcgcgggctcggcctggacgtggaaaccctgctcgaagccgaacgggcgcgctacctgcatggcgagatactcaccgaaggcgagcgcctgcgcttcgccgacgacctggagcgacgcaccggcctgctggtgaccctggcgttctcgctgaaggaaagcctgttcaaggcgctctatccgctggtgggcaagcgcttctatttcgaacatgcggaactgctggaatggcgcgccgacggccaggcccggctgcgcctgctcaccgacctgtcgccggagtggcgccacggcagcgagctggacgcccagttcgccgtgctcgacgaacgcctgctcagcctggtggcggtcggcgcctga

SEQ ID NO: 2874 - DNA, 861 bp, Pseudomonas aeruginosa
tcaggcgttccccggcgtgcgccgcgacggccgcagcgcgcggccgtccgccaggcgctcgacggcgcgggcggcggcgaccatgccgaaggtggcggtgaccatcatcaccgcgccgaagccgccggcgcagtccagcttcaccccttcgccgacgaaactcttcgactggcacaccgtgccgtccggcttcgggtagcgcagttgttcgctggagaacacgcagggcacgctgtaggtgcgccccggcgtgcgcgagaagttgtagtcgcggcgcagggtggaacgcaccttggccgccagcgggtcgttgaaggtcttgttcaggtcggcgacctggatctgcgtcgggtcgacctggccaccggcgccgccggtggtgatcaccgggatcttgcgccgcttgcaccaggcgatcagcgcggccttggcggccacgctatcgatgcagtcgatcaggtagtcgaagtcgacgatgtactcggccatggtctcgcgggtgacgaaatcggccaccgcgtggacccggcaggccgggttgatggcccggatgcgcgccgccatcacctcgaccttggccttgcccaccgagccttcgatggcatgcacctggcggttggtgttggtcacgcagacatcgtcgaggtcgaacagggaaatctcgccgacgccgctgcgggccagcgcttccgccgcccaggaaccgaccccgccgatgccgaccaccgcgacgtggctatcggccaggcgttgcagcccctcgcgaccgtacaaccggccgataccgccgaagcgctgttcatccacctgcatcaccaaccacctctgaaaccgaatcgcggattgccgcgcgcattataa

SEQ ID NO: 2875 - DNA, 2814 bp, Pseudomonas aeruginosa
aaagccgcggccgccgcgtcgcctgcgttcttacggctcgtcgcgcaggccggactagacttgcaacagacccgccggcccggcgcctgtacaccccggggggtgcggggtagcatgcgccgccccgtgttcagcgaaacatccggaacctggtttcatctctatgtcttcacgcaagatcgggctcaacctggtggtcatcgtcgccctggccgccctcttcaccggcatctgggccctgtacaaccgtccggtcagcgtaccggactggccggaacgcatctccggcctctccttctcgccgttccgcctcaaccagaacccgcagagcggccgctaccccagcgccgaacagatgcgcaccgacctggaactggtcgcccggcacacccacagcatccgcacctattcggtccagggcgcgctcggcgacatcccggcgctggccgaggcgttcggcctgcgcgtcagcctgggcatctggctcggcccggacctggccagcaacgaggccgagatcgcccgcgccatccgcatcgccaacgagtcgccgagcgtggtgcgagtgatagtcggcaacgaggcgctgttccgccgcgaggtgacggcggaacagttgatcgcctacctcgaccgggtccgcgcggcggtcaaggttccggtgaccaccgccgaacagtggcacgtctaccgcgaatacccggaactggcgcaacacgtcgacctgatcgccgcccacgtcctgccctactgggaggctacgccggtggccgacgcggtggacttcgtgctcgaacgcgcgcgcgaactcaaggccgccttcccgaggaagccgctgctgctcgccgaggtcggctggccgagcaacgggcgcatgcgcggcagcgccgaggcgacacccgcggaccaggccatctacctgcggcgcctgaccaacgcgctcaacggcgaaggctacagctacttcgtcatcgaagccttcgaccagccctggaaggtcagcgccgaaggctcggtgggcgcctactggggcgtctacaacgccgaccgcaaggccaagttcaacttcaccgggccggtggtgccgattcccaagtggcgcgccctggccatcgcctcggcggtactcgcggtactcgccttcaccctgctgctgatcgacagttcctcgatgcgccagcgcgggaggaccttcctcgccgtggtctcgttcgcctgcgcctcggtgctggtgtggatcgcctacgagtacagccagcagtacagcacctggttcagcctgaccgtcggcgcgttgctgggcgtcggcgcgctgggggtggtcatcgtgctgttcaccgaggcccacgagctggccgaggcggtctggacgcgcaagcggcgccggccattcctgccgatcaccgccgcgcaggcctatcggcccaaggtgtcgatccacgtgccctgctacaacgagccgccggaactgctgaagcagaccctcgacgcccttgcccgcctcgactacccggactacgaagtcctggtgatcgacaacaacacccgcgacccggccgtctggcagccggtcgaggcgcactgcgcgcgcctgggcgagcgcttccgcttcttccacgtcgccccgctggaaggcttcaaggccggcgcgctgaacttcgccctgggccacgtggcggcggacgtcgaggtggtcgcggtgatcgacgccgactactgcgtcgaccccgactggctcaggcacatggtgccgcacttcggcgacccgcggatcgccgtggtgcagtcgccgcaggactaccgcgaccagcacgagagcgccttcaagcggctctgctacgccgagtacaagggcttcttccacatcggcatggtcacccgcaacgaccgcgacgcgatcatcgagcacggcaccatgaccatgatccggcgcagcgtgctggacgagctgagatggccggaatggtgcatcaccgaggacgccgagctgggcctgcgggtgttcgagaagggcctgtcggccgcctacttcgagcgcagctacggcaagggggtgatgcccgataccttcatcgacttcaagaagcagcgcttccgctgggcctacggcgcgatccagatcatgaagcggcataccgacgccctgctgcgcggccgcagtcccgacggcagccgcctgacccgcggccagcgctaccacttcgtggccggctggctgccgtggatcgccgacggcctgaacatcttcttcaccctcggcgcgctgctctggtcggcggcgatgatcatcgtgcccaagcgcgtcgacccgccgctgctgatcttcgcgatcctgccgctggccctgttcgtcttcaaggtcggcaagatcctcttcctctaccggcgcaccgtcggcgtcgacctgcgcgactcgttcttcgccgccctcgccggcctgtcgctctcgcacaccattgccaaggcggtgctgtacggcttcgtcacccgcggcatcccgttcttccgcacgccgaagatgcgctccagccacggcctgctggtggccctggcggaggcccgcgaggaagtcttcgtgatgctcctgctgtggggcgcggcggccggcatcgtggcggttcagggcgtgccgagccgcgacctgctgatctgggtcgccatgctcctggtgcaatcgctgccctacctggcggcgctggtcatggccctgctctcgtcgctgccgaaaccgcgcgaggaactggccggcggcgccgagcggatcggcggttgaggtcgagcgaggcgtcgggacagccggctccgctcgcctaa

SEQ ID NO: 2876 - DNA, 579 bp, Pseudomonas aeruginosa
ggctgctcgcctgatgctgatctgcccgctctgctccgccgccctgggcgatgtcgacaacggcgtcgcctgccccgccgggcaccgcttcgaccgcgcccgccagggctacctgaacctgctgccggtgcagcacaagaaaagcctcgatccgggcgacaacgccgccatggtcgaggcccgtcgccagttcctcggcgccggccactacgcgccgctggcccggcgcctggccgaactggccgccgaacgcgcgccgcgacgctggctggatatcggctgcggcgagggctactacagcgcccggctcggcgaagccctggccggcgccgagggctacgccctggatatctcccgcgaggcggtgaaacgcgcctgccgccgcgcgccgcagttgtcctggctggtggcgagcatggcccggctgccgctggccgacgccagttgcgagctgatcgccagcgtgttcagcccgatcgactggaacgaagccgtgcgcgtcctcgcccccggcggcggcgtactgcgcctgggcccggccagcgcgcacctgctggaactgcgccagcggctctatga

SEQ ID NO: 2877 - DNA, 639 bp, Pseudomonas aeruginosa
cgacgtgcgcgactacgccgacgacaagcacctcgccggcctgcccgcgcaactgcgcctgcgccacaccgagaccctcgagttccgcctggcgctggacagctacgacgcgcgggaaaacctcctggccatgaccccgcacggctggcgggtcaaccccgagcgccgcgcgcgaatcctggccgaacccttcgaagtcagcgtggcggtgcgctacgattggctgcaacgcgactgaccgtccccgaggaccccatgcgccaaccggatatcgagatctacctgaaagacgccgagcacgcggccgtcgccgcctggctggaacaggcgctgggaccctgcggcccatggcaggagcacggccagaccctcaagtgcaccgcccgcggcgagcacggcgcggtgcgcgtcacctggctgccgaaggcggtgggcaagtggcacagcctgttcttggagagcgacagcacgccctgggacgacgacctcgcctgcgccaaggccgcgcatgccgcgctcggcgtggagatccgctgcgcgccgggcggctgggaggaaaaccagggcgaagaggacgccgaccgctggctgcgggtcgacgccgggggcgtcgaggaaattacctggcgcaccgcctga

SEQ ID NO: 2878 - DNA, 978 bp, Pseudomonas aeruginosa
ccagcagcagggccaggagcatgccgccatagatgcgcaggaagatggatttcatcggcgagcccccggccgctgtccgctgctgttgattctggccgaccgggacgcccgcgccccggcccgcaggaaaaaagcgcctcagccctcgccgacgaacaggtagcccttgctgcgcacggtcttgatcagccgcgggtgcatcgggtcgtcgccgatcttcgggcggatccgcgagatgcgcacgtcgatggagcggtcctggccgtcgtactcgatgccgcgcagggcgttgaagatctcctcgcgggagagaatccgcccggcgttcgccgccagcagccagagcaggtcgaattcggcgctggtcagctcgatggtggtcccgtccagccaggcctcgcgcatcgcgttgtcgatcaccaggcgaccgaacgccaggcgtttgctgtccgccgccggggcgcccgcttccggcgcctcgctgcgccgcaacagggcacggatgcgcgccagcagcacacgcgggcgcaccggcttgcacacgtagtcgtcggcgcccatctccaggccgagtacctcgtccatatcgtcggtgcgcgcggtgagcatcaggatcggaccgtcgaactgcgggcgcacctggcggcagatggacaggccgtcctcgcccggcagcatcaggtcgagcaccaccaggtccgggcgttcggcgaggatacgcgccgccgccagtgcgccgttggcttcgatgtcgaccttcaggccgttgccttccaggtattcccgggtcagctcggccaggcgtcgatcgtcctcgacgatcaggatgcgccaggcttcttgctccacacagcctcctcgtatcgcggtcccggagccgccgtgcggccccctcagagcggcccgcattgtagccaatacgggggccgcgcggcagcacgcgaggaacatcttgcaaacactacatattgtgggtag

SEQ ID NO: 2879 - DNA, 2997 bp, Pseudomonas aeruginosa
agcagccgccgcgaggccggctgcccggctctttatcgattcaagggaatgggcgccccggcgcccgctagcaaaaccattacgagaacgtggagatacccacccatgcataccgacaccacacgcgagaacccgcaggccagcgcgccgcaggccgccgattcgtcgcaggatctggccgccaccgcgccgggccagctacgcgtgatcaagcgcaacggcaccgtagtcccctacaccgatgacaagatcaccgtggccatcaccaaggcgttcctcgccgtggaaggcggcaccgccgccgcctcgtcgcgtatccatgacaccgtgcgccgcctgaccgagcaggtcaccgccaccttcaagcgccgcatgccgtccggcggcaccatccacatcgaagagatccaggaccaggtcgaactggccctgatgcgcgccggcgagcagaaggtcgcccgcgactacgtgatctaccgcgaagcccgcgccgccgagcgcaagaacgccggcgccgccagcgacgtcgcccagccgcacccgagcatccgcatcacccgcgccgacggcagcctgtcgccgctgaaaaaggccgccgtgaacaccatcatcagcgaaccctgccaaaggcctgcccgaggtggacggcgccctgatcgagcgcgagacctgaaaaactctacgacggcgtcgccgaaaaaggacgtcaacaccgccctggtgatgaccgcgcgcaccctggtcgagcgcgagccgaactactcctacgtcaccgcccgcctgctgatggacaccctgcgcgccgaagccctgggcttcctcggcgtggccgagagcgccacccatcacgagatggccgagctgtacgccaaggccctgccggcctacatcgagaaaggcgccgagttcgagctggtcgatgccaagctgaaggaattcgacctggagaaactgggcaaggccatcgatcacgagcgcgaccagcagttcacttacctcggcctgcagaccctgtacgaccgctacttcatccacaaggacggcatccgcttcgaactgccgcagatcttcttcatgcgcgtggccatgggcctggccatcgaggagaaggaccgcgaggcacgtgccatcgagttctacaacctgctgtcgtccttcgactacatgagttccacccccaccctgttcaacgccggcaccctgcgtccgcagctctccagctgctacctgaccaccgtgccggacgacctgtcgggcatctacggcgccatccacgacaacgccatgctgtcgaaattcgccggcggcctgggcaacgactggaccccggtgcgcgcgctgggctcctacatcaagggcaccaacggcaagtcccagggcgtcgtgcccttcctgaaagtggtcaacgacaccgcggtcgcggtcaaccagggcggcaagcgcaagggcgcggtctgcgcctacctggagacctggcacctggacatcgaggaattcctcgagctgcgcaagaacaccggtgacgaccgtcgtcgtacccacgacatgaacaccgccaactggatccccgacctgttcatgaagcgcgtcttcgacgacggctcctggaccctcttctcgccgtccgacgtccccgacctgcacgacctctacggcaaggccttcgaggagcgctacgagtactacgaggccctggccagctacggcaagctgaagctgcacaaggtcgtccaggccaaggacctgtggcgcaagatgctctccatgctgttcgagaccggccacccgtggctgaccttcaaggacccgtgcaacctgcgcagcccgcagcagcacgtgggcgtggtgcacagctcgaacctctgcaccgagatcaccctgaacaccaacaaggacgagatcgccgtctgcaacctgggctcgatcaacctggtcaaccacatcgtcgacggcaagctggacaccgccaagctggagaagaccgtcaagaccgcggtacgcatgctcgataacgtcatcgacatcaactactactcggtcccgcaggcgcagaactccaacttcaagcaccgtccggtcggcctgggcatcatgggcttccaggacgccctgtacctgcagcacatcccctacggttcggacgcggccatcgccttcgccgaccagtccatggaagccatcagctactacgcgatccaggcttcctgcgacctggccgacgagcgcggcgcctaccagaccttccagggctcgctgtggtcgcaaggcatcctgccgatcgactcggagaagaagctgatcgaagagcgcggcgccaagtacatcgaagtcgacctgtcggaaaccctcgactgggcgccgctgcgcgagcgcgtacagaaaggcatccgcaactcgaacatcatggccatcgcgccgaccgcgaccatcgccaacatcaccggcgtctcgcagtcgatcgagccgacctaccagaacctgtacgtgaagtcgaacctctccggcgagttcaccgtgatcaacccctacctggtgcgcgacctcaaggcccgcggcctgtgggacccggtcatggtcaacgacctgaagtactacgacggttccgtgcagcagatcgagcgcatcccgcaggacctcaaggacctctacgccaccgcgttcgaagtcgagacccgctggatcgtcgaagccgccagccgtcgccagaagtggatcgaccaggcccagtcgctgaacctgtacatcgccggcgcctcgggcaagaagctcgacgtgacctaccgcatggcctggttccgcggcctgaagaccacctactacctccgcgccctggccgccaccagcaccgagaagtccaccatcaacaccggcaagctcaacgccgtgtcggccggtggcaacgacggcctgcaagccgccccggccgccgagccgaagccggcgccggtgccgcaggcatgcagcatcgacaaccccgactgcgaagcctgccagtga

SEQ ID NO: 2880 - DNA, 1767 bp, Pseudomonas aeruginosa
cgatataacgaaaccactgatctagagccagtcagtaagggattaaatatggcaaacaagactgacaatcttccagacttccttcaggactacgcatctctttttagtcatttccaaggccagatggatggtttaacaaccgttcaaattggagataaatttgcctctttagcagaacatttgattcctcataccgaggcaggctcagactttgaaagagcaacaaagtcaaaaaagagctgggacaaaggtgtagacctaatatttcaacacaaagaaattaacggcgtagagctaagagtacagtcaaaatacaccatttcgtcagtagatgatgtagacttaattataagcaaattccaagagtacgactcaaaagatgcaaccaacaaacaacatgaactagacctactaggatcattagaagaagatagtcgacagacaagcaaatacctgataataacctcctcgaaaatatcaaacataatagcaaagttcttagagagccaacgtccatcaagatttttccttgagagaataaaaaaagaaaaacgctttcattatatcgatggaatagaaatactaaccactatacagagcatatatagaagtacatacattcgcccccaagaaacaaaactaatattccaaacgcctcacatcagggttaacaatgtatacattggagtactaccttgcaacgaacttcgacgcgtatacgaagaagctggtgactctatattctttgaaaacattcgtgaatggttaggattccaaggaaaaaaagtaaaatccggcggggttcgtgaaacagtcaatgaagcaatagcatcaacactcgaagactcgccagagaaaatgctcgaaagaaataacggcatagtaatcagagcatcacaagtggaggaaacctcaaactcatccttgaaactaagagatgctagtattgtaaacggctgccagactactatgagtgtatttttcgtcaatcctaccgatggacatgtgctagcaaaaattgtagagacagaagattcatgggagatagctaaggcggccaatttccagacagaaatagaacgaatagaacttgaactagccagatatctaagaccacaacttgccagatctgttggagcagagaataattttaaattcgaccaaaaagaagtaacaaaaggcaaatcagcctttgctctactcgaccaaatatataaagatgaaatttgctatgatgaactaaaatcgatatttatcggactattttcacgctctgcaaacaatgcgatatcgccaaactataccgagcttagaattgatgtacttcaaaacttcgaaagagactctgaaaaatctaaattcctagaggctcttttcgtgctccacagcaaatcatctacggcgatggagtctttgaaagatggtttgttaaaacctgaaattatggatctatttaaaagattttggaaagaagacaaaccatcatatagggcatttgtcacactcttagccatattcagcgcccttgacaaaaaaaatcgcaggtttgaagactacaacgacataaagagcggaataataaaactagcaggacaaatagaaatcgaccccggcgaatacatagaaacatatataaaagcctttaaaactatagcgctagacgtcctcaaaggcagcgaggacaaggataaaatgctgcaaagcatgtatcatcacattggctcaatgaattttgaaaatgctttactatccatgtcactattgtaa

SEQ ID NO: 2881 - DNA, 1269 bp, Pseudomonas aeruginosa
cactcccttttcgcctcccggcgagtcacttttgccagtcgcggcaaaagtaaccaaaaacgcttgcccctgcatccggccccagtcgcttcgcgactggggttccctccctccatcgccgttccgggggcacgccgccacggtccttcgtggaccgaggcggctttcgcggcatcctgccgctcaaccccctacacgacgattccgctcggcctcctgatggggcggaccggagcgtcggatatttctctggaagaggtagggcaaatcacgcacagcgtgattcgcaagatggggcagagttgccaagcgccgggcggcgcaggtttggtaaaaagccttgtttcatgtggtttctttgatagagagagtctttcagcttcgctcattccgctcggttgtttcgttcctctcgtctcaatactctgccaccggcgcctaagaaacgctaaaccacgcagcggccagaccgctcccgacagccaagcggcttttttgagtctgcggtattctctcgccctcaaaatctctgcgacgccgggagtggacgaatacaagacccgaaagggaaatatgtccggccctctgcgtggggttttcttaactcccggcaccccagccccaagaaagctggtcacatcacgcagaggtaacggaaatgcctatcaccaatcccatatctccatccacaccgcttcatcccaccacctccccggaggtgcgccatgtctgacaccctcctccaccccagccgtttcacccaccaccatcgggtcctgcacgccgtgctgctggatgaggaaggctggttcgtgctctccgacctggtacggctgctgggccgttacctgggcggtcgggcgccggcggcgttgtgtgacgaggcgccgtggccgctggcaacggcggagcagcgcgagcgcttgttcgccctctgccatgcactggaacggcacctggatgccgatcagtggcggatcgcctggctccatgacgaacgccacgggccacgccaggactgcctggtcagcgagtccgggctctacgctctgctctggctcgcagtgcctggcgcggcacggggtttgcgccgttgggtcagcggctcggtgctgccacgcctgcgcagccagtcccgccccaacgccacgccccagcgcgccgtgctgcactggaaaaccgccgagatcgacaccctgcactggcaaggcaagacctggatccccctctccgactgcccccaactcctcgacagtccacgcccgctga

SEQ ID NO: 2882 - DNA, 417 bp, Pseudomonas aeruginosa
acgccggcaaccagctcagccacatgtcgccgatctacaccatcgagatgggcgacgagttgctggcgaagctggcgcgcgatgccaccttcttcgtcagggcgcacgagagcaacgagatgcagccgacgctcgccatcagccatgccggggtcagcgtggtcatggcccaggcccagccgcgccgggaaaagcgctggagcgaatgggccagcggcaaggtgttgtgcctgctcgacccgctggacggggtctacaactacctcgcccagcagcgctgcaacctcgacgatacctgggaaggcaagatctaccgggtgctcgccggcaacccggcgaagcatgacctggacatcaagcccacggtcatcagtcatcgcctgcacttccccgaaggcggcagcctggccgcgctga

SEQ ID NO: 2883 - DNA, 438 bp, Pseudomonas aeruginosa
cctgcccggtcgccgccggtgaatgcgcgggcccggcggacagcggcgacgccctgctggagcgcaactatcccactggcgcggagttcctcggcgacggcggcgacatcagcttcagcacccgcggcacgcagaactggacggtggagcggctgctccaggcgcaccgccaactggaggagcgcggctatgtgttcgtcggctaccacggcaccttcctcgaagcggcgcaaagcatcgtcttcggcggggtgcgcgcgcgcagccaggacctcgacgcgatctggcgcggtttctatatcgccggcgatccggcgctggcctacggctacgcccaggaccaggaacccgacgcgcgcggccggatccgcaacggtgccctgctgcgggtctatgtgccgcgctcgagcctgccgggcttctaccgcaccggcctga

SEQ ID NO: 2884 - DNA, 1725 bp, Pseudomonas aeruginosa
tctccgcgatacctcccgcgacgaacgcctgctggcggcccacggctatcgccaggaactggagcgcgggctgagcctgtggtcgtccttttccgtcggcttcgccaccatctcgccggtggtgggcatctactcggtgatgtccctcggcgccatgagcatgggcccctcctgggtctgggtggtgccgctgtgcctgctgctgcagttcggcgtggcgctggtctacgccgagctgtcctcgcagtttccgctggccggcggctgctaccagtgggtgcggcgcctggtgggcgaccgcctggcctggttcaccggcttcctctacctggcttcggcgctggcctcgctgactaccgtggcctacctcggtggcttctggctcggcctgctggcgaccggcgcgccgccgtcggccaacggccaggtgctctgcggcgcgctgctgctggcgctgggactggcggtgaacctgctggggatcaacccgctgaagtacttcgtcaatgccgggatcgtcgccgaggccatcgcctccatcggtatcggcgtgctgttgctgctgttcttccgcaaccatccgctcgacctgctgttcagcggcccgggcggcacaggcgatgcggacggttcctacctggacggcgtgctgaccgcgctggcggtgggcggctgggctttcctcggcttcgacgcctgctcgcagatttccgaggaaaccaccgatgcccgcgtctccactccccgggcgatcctgcgctcgatgctggtggtgggattcaccgtgatgctcaccgccttcgccgtgaccctgtcctaccaggacatcggcgcggtggtcagcggccaggtggtcgacccggtcaccccggcggtggtggacgccttcggcgcctgggccgagcggccattcgtcgcagtggtgctgatcgccttcgtcgcctgcgtggtgtcggtgcagacctacatcggccgggcgatcttcggcatggcgcgcgacgccatcctgcccggctccgccctgctgcgccgggtcgaccggcgcaaggtgccgatggcggcgatggtctgcagcacgctgctggccagcctcggcctggccctggggctgaacgccacggcggtcggcacgctgatcgcgttcggcagcggcggtttcttcgtggtcttcctgatcgtcgccgcctgcgctctctgggcccgcctcgtcggccgctgggacccggacaagggcgccttgcgcctgggacgcgcggggctggcggtgaacgtcctggcagtcgcctggctgtcgttcgaggcgctcaacgtcgcctggccgcgggccagcctcgccccgcccgacgcgccctggttccaggtctgggcggtggtcgtggtgttctccgcgctggccgcgttcggcctgctctacatgctcatcgccaagccgcatcggcgcatcgccaccagcctcagcttcgccgctccgccggcggactgacccgcacgcgccggccgttccggcgcctcctccggttgttcccgcacgctggcttcgcgcccggcggggcccggctcatcctgctttcacggagcatcgccatgagcgacctgcattactggaactaccccaccgatatcctctgcggcgtcggcgccctggaacaactgccgaggcgttgcgcgctggcgggcgcacgccggcccctgctggtcaccgatcccggcatgctcgccctgtag

SEQ ID NO: 2885 - DNA, 1011 bp, Pseudomonas aeruginosa
cgcgccgggttcgaccatgacctgtgccacgaactgtcgagcaaccccagcctcgctgaagtccacggcggcgccaggcgcttcgaggctggcgggcatgacgcgctgatcgctctcggcggcggcagcgccctcgacgcggccaagggaatcgccctgctcagccgcgatccgcacggcctcgaacgcttcgaatggacacagacgctgcgcagctatccgaccctcgccgactacccgctgctcggcctgccgccgctgctggcgcttcccacgaccgccggcaccggctcggaactgggacgcgaggcggtgctgaccgacacgcaactgggcatcaagcgggtcgtcggccaccgcgagctgctggccgcctgcgtattcctcgacccgcgcctgacccgcgggttgccgccgacgctgagcgccgccaccggcatggacgccctcacccatcacctggaggcgctgttctcgccgctctaccatccgatgtcggcgggcatcgccctggaaggcgtgcgcctggtcaggcagcacctggaaaacgccgtgcgcgacggcaacgacctcgccgcccgggaaggcatgctggtagcctcggccagcgccgcagtggcattccagaaggggcttggcggggtccacgccctggcccacccgctgggcgctcgccatcacctgcaccacggcctgctgaacgccgtgctgctgccctacgttctgctggccaaccgcccggcgatagaagccgacgccgcgcgcctggcgcgctacctggaactcgacgaagcgagcttcgacggcctgctggcgtggatcctcgaactgcgcgcgcgcatcggcatcccggcgaacctcgccgccctcggtctggatggcgaggacgcgcaatgggtgggcgagcaggcgctggccgacctatcgtcctcggcgaccaacgccctgccgctcgatgcccgggattatgcgcgcatctaccgccaggcggtggccgggactctcgcctga

SEQ ID NO: 2886 - DNA, 993 bp, Pseudomonas aeruginosa
tcagcggcgctgccgccatcgacttcggtaccagcgaagcagccggtaccgccaccggcttcgtcaacggctgcggctcggtcggggcgatcctcggcggcctgctgccgggctacttcgacaccctcacggtgttcttcgtgttcaccgccaccgcgctgctcgccagcctgctgctggtgccgttctggaacagccggccaggcgcgtgccgcgtcgaaccgaaggcgcatgccggcgggccgctgctggcggccggcaagccgcgttgaaacctcgccgaaccaccgcccggcgccaggcgtgccgggccaatccctagcgaacaaggaaccgcctatgccacttgccctcttcgacctcgacgacaccctgatcgacggcgactgcgcgaccctctgggggcgctacatgaccgaactgggctgggtcgagaagaccgccttcctgcaccaggaacgccgcctcatggaactctatgccgagggccggctggccatggaggactacatggacttcagcctggcgcccatcgccggccgcaccccggcggagatcgccggcgccgtcgaggatttcgtcgcgcggatcatagccccgcgcatccacgccgacgccctgcgctgcctggaacgccaccgccaggccggcgaccgcctgctgatcatctccgcctcggcgcacttccttgtcagcgccatcggccgccggctgggggtggacgaggtgctggcgatcgacatcgaggagcgcgacggcctctacaccgggcgcacccgcggcaccctcacctaccgcgagggcaaggtccgtcgcctcgaagcctggctggcccaggagggcgagacgctggccggcgcgaccttctattccgactcgcgcaacgacctgccgctgctctcgcgggtcgaccggccgcacacggtgaaccccgacccggcgctgctcgggcacgcccgcgaggccggctggccagtgctggaatggcgctga

SEQ ID NO: 2887 - DNA, 900 bp, Pseudomonas aeruginosa
ccgcctgttcgacctcgacctgctccgcgccatcgtcacggtggccgactgcggcagcttcaccactgccgccgcgcgcctgcactcgacccagtcgaccgtcagccagaaggttcgccgcttggaggaaatggccggacaccgcctgctggagcgcggcaaccgcgacgtgttgccgaccgacgccggcgatacgctgctcggctatgcccgccgcctgctggcactgaacgacgaactggccgaggcgctatccggcgccacggtggcgctgacggtacgtatcggcgtgccggacgacttcgccgccggccgtaccaccgagcgactggcggccttcaaccggcgttatccacaggtcaagctggaagtcaccagcggcatgagccgcgacctcagcgccagctacgaccgcggcgaactggacctggtgctgctcaagcagcgacgcgccagccgcgaggcactggcctgctggccggaaaagacatgctgggtggacagcgccaggaacccctgcatcgacctcgacccgctgcccatcgtcaccttcccgccgcgcggggtctaccgcgacgagatgatcgccgccctggaagcggtcggccggcgctggcacatcagcttcaccagttccagcctcagcggcctgcaatcggccatcgccgacggcatgggcatcggcctgctgccgctgcgcgcggtgagcgcaggccatgcggtgctgccgaagaacgccgggctgccggcggtggacgtgttcgaagtggcgctgctgcaccggccggcggcggatccgatggtgaaggcgctggcgcgcgtgctgtcgcgggtgctggcggaagatacccggagccgccccgcattcgaaaaatgaatatgctggattccaacatttaa

SEQ ID NO: 2888 - DNA, 1578 bp, Pseudomonas aeruginosa
aagggaacccggcgccatggcgccgggtttttcgtttgcggaaggcgcccagcccttcgtcagctccgggcgcggaggacttcagggcgaaccgaacatggccgtccagtagattcccgcgtcgctcttcggatcggtggcgtaggccgcgcccagctcgcggtagccggggttcatcaggttggcgcagtggcccgggctggccagccagccgtcgaccaccttgtccaccccgtcctggccggcggcgatgttttcgccgatcagcccgccgctgtagccggccagctcggcgcggtcgccgggggtgcggccgtcgcggtcgaggtggtcgaagaagttgccgttggccatcgcccgcgaatgcgcttcggcggcgccgccaagggtggcgttccaggccagcggctgggccgctgcgtaaggtttgccaccgcactggcgggcttgcccgcgggcggcgttgatccgttccaggagcttctgcccttccgcctgccaatcgcccatgccgccgcgcagcaatggccgggcgaggacgatgcgccagtcgcggtcctggcggctgacgccgacgtcgacgaattgcgggtcgagcaccacgcggcagaagctttcctgcagcgccttcatcgccgcgccggcatcgcgcggcccggaaaggctgatcgactgcacgttgaccatcgggtaggcggcctgcgccatcgcctgctgcaggtcgccggcggcattcaccggcaaggccaggcgcggatcggcggccagcggcggcagttcgccgctggcctgcccgccgcaggactgcacctggccacggtaggcgttgatcgcctcgaccagttgcgcctcgtcggcggcactggcggccgctgcgagcgccagtccgagcgtcagtacggccaaacgcgggatgcttgggattgccatggaaatctcctcgatctgatggcgcctatgatgcgcgattccgcggcgcgccgccgcattcgaccggaacccggcgccggcgttgcaggctcaggccggcgcttcggcgaacgcctccaccagccgctcgatcaccgcgcggacccgcgcggtgtggcgcaggtccttgtgggtaaccatccacacctcgtatggccggcgtcgctcacgctgcggccagacccgcaccagtccgtcgcgctcgcccatgtacagcggcagctcgcagagccccaggccacgcgccagggcctggcgcaccatcatgttggaattcaccgcgatgaccacccggccgtcgcggatcggctcgccgcccagggtcagttcgcgctggctgtgccaatagggttcgtacatcaccaggtcgtggccgcggaaacgctcgccgggcaccggtacgccgttgcgccgcaggtagtccgcggaagcgaacaggcccatgggccaactggcgagttttctcaggatcaaatcgggattttccggccgcagggtgcgaatcgcgatgtcggtctcgcgcttgggcagatcgaccacggccgaagcgctgtcgagcagcacgcggatatccgggtgttcaaggtgcaggcgggccagggcgggtag

SEQ ID NO: 2889 - DNA, 1023 bp, Pseudomonas aeruginosa
cacgaagtcgacggccagggagtcggtggtggacaaccgcacctcgccggacagtcggtggtccatcccgcgggtccgccgcagcaactccagggccgagcgttccatcttctcggccagttcgaaggccgcctcgccggccggggtcagcaggtagccggacgaggtgcgcaggaacagggtcgagcccagcgccgcctccagcgacgccagccgccggcccaccgtggcctggtcgacgtgaagcgcgcgggcggcgccgcgcagggtgtgctcgcggcagagcgcgaggaagacgcgggtgtcgtcccaattcatggcggttttcctgatgcattttcgcatcagtctaatgaaaaagcgctgcgcgaccacggcatccgcgctgcttaccatgcgaaccaggtccgaaccattttcccaggagcatgcgatgagcagtacgaaccgatttcccgaacgaatgaccgccatcgagatcgcccggcccggcggccccgaggtactggtggcgaccagccggccgctgccgacgcccggcccgcgcgaggtcctggtcgaagtccgcgccgccggcgtcaacggtcccgacgtgcttcagcgcaagggcgtgtacgacccgccgcccggcgcctcggacattcccggcctggagatcgccggcatggtgcgggcggtcggcagcgaggtcagccgcttcgccgtcggcgaggcggtgatggcgttgattcccggcggcggctacgcgcagttcgcggtggccgacgagcgcaccaccctgcacctgcccgacggcctgggcatggaggaagcggcggcgctgccggaaaccttcatgaccgtctgggtcaacctgttccagcgcggtggcttcaaggccggcgagacgctgctggtccacggtggcgcctccggcatcggcaccgccgcgaccatgctgggcaaggccttcggcgcggcgaaaatctttaccacgatctccagcgaggcccagcgcgaggccagcctgcgcctcggcgctga

SEQ ID NO: 2890 - DNA, 594 bp, Pseudomonas aeruginosa
ccgcacagaaagaaaactctgacagcacaccgactagtcgtcctcccttcccgccgttacggttccgggcttgcgcacaaagccgaacccaagggggcccctcatgtcactgccgccgtacctcaagcccggcgacaaggtcgtgttgtacgaccagcactgccgcttctgcacgctctggagcggtttcctggcacgccgcgccgaccaccggctgaagctgcttgccgcgcagtccgccgaaggcctggcgattctcgattggttcgggctggcacccgatcatttcaacacctggctgttcgtcgacggcgcctacgcctgcgacgacaacgatgccctgctcgaggtgctgcgcctgttgccgggcccctggcgtcacctgcgctggctgcgcctgctgccagcctggctgcgcgacgagtgccacgaggcgctacggcgcaaccgctggcgctggttcggccgccagcgcccaccccttcgtcgtcgctcctggcgtccccgtcgagcctgacgcctctccgcgctggccgtggcgggttatgctgcctgcgcaccagcctgcggacccatacttgccatggcccttga

SEQ ID NO: 2891 - DNA, 1818 bp, Pseudomonas aeruginosa
cctcggcacgcacgggcagcgcacccggcacttcggctggctgtacgccggcctcgctctgggcatgatcctcggccccgccctcggtgggctgctggcggtgcacggcacgacgctgccgctgttgctggccgccggcctgtgcctgctcaacgccctgctcgccggcctgttcctcgaggaaaccctgcccccgacgcgacgccgccgcctggacccgaggcggatgaatgccttgcgctcgatcagcggcctggctcggcaaccgggggtcggactcctgctggcggtgcttgccctggtattcctcggcttgcaggcggtgatggtggtctggccgttcttcgtgatcgagaagtttcactggagcagcgcctggatcggctactcgctggccctctacggcgtgctcgcggtgctcgcccagaccctcggcgtgaacctctgcaagcggcgcctggacgacgcccgcctgctgcgcctgggcctcgccctgcaaggctgcggcctgctgctgttcgccctggtcgactcgtcattctggctggtctgcgcgctgctgcccttcgcgctcggcagcctcgccaccccggccatgcaggggctgctctcggcccgcgtgccggtcgaccgccagggcgagttgcagggcgtgctgagcagcctgatgagcctcgccgcgatcgtcggtccgccgctgatgagcggcctgttccactggggcagcggtccgctcgcgccagtgcccctggccggcgcgccattcctcgccggcgcccttctcgttctggccgggctggtcctggcctggcaacttcgacctacgggagaagaacgatcatggaccggatagacatgggcgtgctggtggtgctgttcaatcctggcgacgacgacctggaacaccttggcgaactggcggcggcgtttccgcaactgcgcttcctcgccgtcgacaactcaccgcacagcgatccgcagcgcaatgcccggctgcgcgggcaaggcatcgccgtgctgcaccacggcaaccggcagggcatcgccggcgccttcaaccaggggctcgacgcgctgttccggcgtggcgtgcagggtgtgctgctgctcgaccaggactcccgtcccggcggcgccttcctcgccgcccagtggcgcaacctgcaggcgcgcaacggtcaggcctgcctgctcggcccacggatcttcgaccggggtgaccggcgcttcctgccggccatccatctcgacggactgacgctcaggcaattgtctctggacggcctgacgaccccgcagcgcacctcgttcctgatctcctccggctgcctgctgacccgcgaggcctaccagcgcctcggccacttcgacgaggaactgttcatcgaccacgtggacaccgaatacagcctgcgcgcccaggcgctggacgtgcccctgtacgtcgacccgcggctggtcctcgagcaccgcatcggcacgcgcaagacccgccgcctcggcggtctcagcctcagcgcgatgaaccacgccccgctgcgccgctactacctggcgcgcaacggcctgctggtcctgcgccgctacgcccggtcctcgccgctggccctgctggcgaacctgccgaccctgacccagggcctcgcggtgctcctgctcgaacgcgacaagctgctcaagctgcgctgcctgggctggggcctgtgggacggcctgcggggacgcggcggcgcgctggagaccaaccgcccgcgcctgctgaagcgcctcgccggcccggccgtggcgtccgtagcttccggcaaggccaaggcctag

SEQ ID NO: 2892 - DNA, 873 bp, Pseudomonas aeruginosa
gcatggggggctccttgcaaggtttggcgggaggacgattcaggcacgccccagccagtcgccgcggatcatttccatcagttggcgcaagccgggttgcggctggcgtcggctcggataatagaggcagaacggcgcgcccatcgaggtccagtcgggcaataccagttgcagccggccgctacgcagctcctcggcgattcccacttccaggcagtaggccaggccaatgccgtccagggccgcggcgaccgccgtattgctttcgttgacgctgaaagggccgggcacgtcgacctcgaccatccgctcgccgtcgcccagttcccatttgtagaacgagttgtcgcccaggcgcatgcggatgcaggcgtgccgcaacaggtcgtccggccgctggggcacgccgtggcgcgccaggtaatcgggcgacgcggccaccacccagcgcagctccccggtcaatggcaccgcgaccatgtcctggggcaccgtgccgccgtaacggatgccggcgtcgtagccgtcggcgacgatgtcgaccatgcggtcctccaccgaaagttccagttgcaggtccggatacgcctcggtgaagcgcctgaggaccggccccagcagcagccgcgaggcatcgcgcggcacgttcaggcgcagccggcccaccggcgaggtgcgataggcatcgagctcgccgagcgcctcgccgatcacctggaaaccatcctccagcttggccgccagcgcgctgccggcatcggtcggcaccaccgaacggctggtacggttgagcagcttcaccccgagccgcgcctcgaggttgcgcatgctgtggctcagcgccgaggtactgacacccagctcctgggctga

SEQ ID NO: 2893 - DNA, 813 bp, Pseudomonas aeruginosa
acggcatcgccgacgccttcggctggcgcctggacgacgaggccatggcccgcatcgagcggatcctcgccgagaccatccaggatccggtcggtcccgagttcatggcgccgcccagccgcaacgcctgatcggacggccggggcggcaacgcccctggccgctggcctgacggagcggcggaaggcaaaatggcggtttttctcaaggactgccggatcagttatggaaaacgtctacaagaccccggaagcgcccctggtggaaacccgcggcgcgaagcgggcgcatttcttcgtcacttccctgggcaagatgagcgtgctcttcctcgtcaccctggggctgtacggcgtgtactggatgtacaagcactggaaggcccagcaaccgcagatggagcggcggatcagcccggtatggcgggcgatcttcggcatcttctttttccacgccctcgcccggcggatccaccaggccctgccggaagagcgccaggcactatggagcccgagcaaggatgcgacctgggcggtgctgctgacggtcgcggcgaacctgatcagccacctcaccgatgtggtccccgcgctggagccctactcgctgccctcgctcctgctgctgctcacgccgctgatcccgatgcgcaacatccagcgccaggccaacctcgccagcggcgacccgcagggcacgggcaacgccggctattcgggctacaacctgctgttcatcgtgctcggcgcgctctactggctgctgatcctgatcggttccgcggtgatcctcttcggctcgtcccagggctga

SEQ ID NO: 2894 - DNA, 489 bp, Pseudomonas aeruginosa
ccaaggtcgcgacaatccgtcccactaccgttcgcgatcccccctcttccccgggcggcggcaactggcagaataccccgctcggcaccagcgacccccgccgcagaacgggggcgccgccgatcatgcgtgcgcccagagaaacaggaacgttcagggaggttccgcatgagcatcacatccaccgacatctgccaggccgccgatgccctcaaggggttcgtcggtttcaaccgcaagaccggccgctacattgtgcgtttcagcgaagactccttcggcatggacgtagccgacgacagcatcacgcccaccagcgagttcgtctggagttcggtacgcgacgacgtcatgcgcctgggccgcgagcagttgcagatcctgctggaacagaacatcaacgaacgactgaacatcggcgagccgctactggtctatctgcgccgccaggacctgccggaaatcaccgcacaacgccagttgcgctga

SEQ ID NO: 2895 - DNA, 264 bp, Pseudomonas aeruginosa
gcgccgtcgatcgccgcccgcgccgggcgctgcgccacgcattatgctggaagcgtccgccgccgtccggcgccgcggacgccatcggccatccggcgcgccacgcaggtgctgcgtggggaggtgaacgccatgagcaagggactgaacgcgaagaaggaaactcgtaggaaaccgctgaaaaccgcccaggagaaacgcctggcgaaacgagcgaaaaaacacgctccggcggtgccgctcggcaccccatcgcggagctga

SEQ ID NO: 2896 - DNA, 1413 bp, Pseudomonas aeruginosa
aactggcaaggcggcaggccactccgtgatgaaccgtcgtcgtcgctatacgggttccaatccatcgctgcgccgggtgctctatcgcgcgcacctgggcgtggcgctggtcgcggtattcaccgccgggctggcggtgaccctggtcggcctgctgaccctgcgcgcctatgccgaccccaaccagcaactgatcgcccgttccatcagctataccgtcgaagccgcggtggtcttcggcgatgcccaggccgccgaggagtccctggcgctgatcgcctccagcgaagaggtctccagcgccatcgtctacgaccgccagggacagaccctggccagttggcatcgggaaagcaccgggccgctgcacctgctggaacagcaactggcgcactggctgctcagcgcgccgaccgaacaaccgatcctgcacgacggccagaagatcggttcggtggaggtgaagggctccggcggcagcctgctgcgcttcctgctcaccggtttcgccggcatggtcctgtgcctgctgcttaccgccctgggcgccttctacctgtcgcggcggctggtacgcggtatcgtcggcccgctcgaccaactggcgaaggtcgcgcataccgtgcgccgcgaacgggatttcgagaagcgcgtaccggaagccggcatcgccgagctgagccaactgggcgaggacttcaacgccctgctcgacgaactcgaatcctggcaggcgcgcctgcaggacgagaacgcctcgctggcgcaccaggcccaccacgacagcctgaccagcctgcccaaccgcgccttcttcgaaggccgcctgagccgggcgctgcgcgatgccaacgagcatcgcgagcaattggcggtgctgttcatcgacagcgaccgcttcaaggagatcaacgaccgcctcggccatgccgccggcgacaccgtgctggtcaacatcgccatgcgcatccgtgggcagttgcgcgaaagcgacctggtggcgcgcctgggcggcgacgaattcgccgtcctgctcgcaccgctggcgtccggcgccgacgccctgcgcatcgccgacaacatcatcgccagcatgcaggcgccgatccggctcagcgacggcagcacggtgagtacctcgctgaccatcggcatcgccctctatcccgagcatgcggataccccggcggcgctgctccacgacgccgacatggcgatgtacatcgccaagcgccaggcccgcggcagccggcgcctggcggaactcaacgacccccgcatccttcaggaagaaaaggagatagacagtgctaccccagaggctccacccaagtagattgcttgccctcgccctgttcagccttgtgctgggcctggccggttgccagaccaagccgccgcagaccggcctga

SEQ ID NO: 2897 - DNA, 684 bp, Pseudomonas aeruginosa
atgctgcgcaagaaaccgacaatcccggccgacctgccgcttgcgggtgctccgggattcaccgacagggggtatcgacctttgcctgttcgcccaaggaacaggccgtcagacgatgggaggcatgccatgaaccggcattactacatcagcgacaacctcgacgagctggaacggctcgaagccgaactggaagccagcggcatcgccaccgagcagatccacgtcctcagcgaaaaggacgcggagaccggccagcgccatctgcacgaagtctctccgttcatgaagaaggatgtggtccgctccggccgtgtcggcctgctggtcggcctcgtcctggccatcgtcgccgtggccttcgcctatgccagcggctggacggaaaccgccgccggctggattccggtgatcttcctcggcgccatgctctgcgcgttctgcctgtgggaaggcagcttcttcggcctgcagcgcaccaaccgcgccttccgtcccttcgaagaacgcctgcaccaggggcagcacctgttcttcgtcgatgtgaagaacgcccaggagccgatcctggtcaacgtggtcagccaccacccgcgcctgcaggacgccggcaccggccccgcggtctctccgctgctgctgggctggcagcaacgctggcggcagttccggcggatggtctga

SEQ ID NO: 2898 - DNA, 447 bp, Pseudomonas aeruginosa
agcggcagccatcgcacagctcaaccaggccttgggcatgtccgtgctggatgccggcaacaccctgctcgcccgcttcaacaagagcaagaacgtctggtggttcgatattccgctcagccaactgaaggccggcaagttcctcaacctgctgctggcgaacccggccggcgatgcagtggagcacctgaaggtgcccaccggtttccttcgccagcagcaggacagcctggaactgcgcgacaagaacgcccgccggccgaccctcagcctggagctgagcgcggaccccggcaagcgcctgcgcgacgtccgccccggcggcgctggcctggacttcgccccgttcctccagccctgagcggaaacctcagcgcggcagttcgatgcgttccggatggatcaggatcaggcctttcttgtagaggccgccgatggccttcttga

SEQ ID NO: 2899 - DNA, 2427 bp, Pseudomonas aeruginosa
agacttttttggaacatccttatcaaggattctcgctgccgctcatcaggagttcctgtgcgtccactcagccgttggctctcatcttgcggctcgcttctggcgctggccgcgctgttcctggtcgttcccctcgccggccgctactggctcggctggtcgacgccgttcggctatctctcggacctggccctcggcagcctgctggtgctgctcctgcatcgacgctccctgtggttcgcgctcccggtcatgctgctctggtgcctgttcctgatcggcaatgccgaactggtcggcgcggtcgggcgcatgccggaaccttccgacctcaagtacctgctggatccgcagttcgtcagcagctccacccagggcggcggcctcgcccacctgccactggcgctcggcctcggtggcgcgacattgctttgcgtgctgctctggcgtcgccgcggtccgcgcctgccgcgctatgcctacgcgctgccggcggcgttcctggcggcgcatgtcggcctgcaatacctgcgtccgagcgatgccgaccaatggcagcagtacaacctgccgcacaagctgctggccagcgcgctcagcagtggccaactggcggtcgaagactggctcgccgacgaccgtccggacaccccgccggacgtcgccgggctcaaccagctcgacctttccggaacgccgctgctggccggcggagggcgcgcgcgcaacgtcctgatcgtggccatggagggaatccccggcgcgtatatcgccgccaaccgcgccgccatcaacagcagctaccacgaagcgccgatgcccagactgagtggctgggccgaacgggcgatgaccaccccggactacgtgctgcacagccaccagaccatccgcggcctttacgccatgctctgcggcgactacagcaagctcgactcgggcacgccgaagggcgtcgagctgctcaacaacccggcccgggccagggagtgcttgcccgcccagctgcgccagcacggtttcagcacgcacttcctgcagggtgccggcctgcgcttcatggccaaggacaaggtcatgccgcatatgggcttcgacaagaccctcgggcgcgactggttccgcaacacgtcctacctggagtttccctggggcatggacgacaaggccttcttcgagggcgccgcgacctacgtgaagcagctgcgccagcagaagaaaccctggatgctgaccctgctcaccgtcggcacccaccagccctactcggcgcctgccgactacctggcccgctacccgagcgccaagcaggccgcggtggcctatctcgacgacgcgatcgacgccttcctcgccgacctggagaaacagggcgtgttgcgcgacaccctggtggtgctcacttccgacgaatcccacggtgtcgaccaggtgcgcctcgcctcggcctggggcttcaacctggtactggcaccggaacaggcggcgctgccgccgatcaagagcggcgtctacggccacgtcgacctcgccgcgtccgtcctcgactatttcggctaccgcgtgccggcggggatttccgggcgctcgctgttccgcgactacgccagcggccgcgaaatgatgtcctacaccaacggcatgctgcgccaccacgacggcaaggacaccttcgtcgaatgcgatttccagcaggtctgccggcgctaccgcagcgagggcttcatcgccgacgaagccgagttcctcggtcgcttcagcggtcgccaggcacgcctggtcagccagcgcgccgccgtcctcgaccactccgtgcaacaggccggccagttgggccaggagttccagttcgccacccacgaacgcatccgcctgaagccggaaacccacaacgactggaccgacaacctgatcggcgcgcaatacctggaaatgccgaagaacagcaggaccacggtcaccctgaagatccgcgccttgcagtatggaccgcaacggcgcccgggtgacgctgaagaccaaggaattcgaacgcgacgttcccataccggtaccggacatcccgcgcctgctcaaaggcaagccgctggacatgagcttcaccttcgacaacccggaagcgcgcaaggccttctccttccacttgctcgccgagggccgcgggatcatcgagatcagcgacttccacgtggtcacggcggccaacccggaacccgtggaaagccgcagccaggtcgccgaagcggcgaaggaacagccgctgctgagcaccctgaaaagcctgttcgccaaccgccccgaaaccgaggaagcggaacgcgcggacgcccctcgggagcgcaccgtcatccccgagcagaaggccctgatcctttcgcactgaccgcgccggagcggcccgcccggccgccgcgcgctccccgctga

SEQ ID NO: 2900 - DNA, 564 bp, Pseudomonas aeruginosa
gcgtcaagtaccacttcctccgcggcctgttcgccatgggcggccgcggcgccatgcaggaccggcagcaggactggctgcgccagcgccggcgctgcggtggcgacaccgactgcctctcccgcgcctacgcgcagcgtatcgacgagctggacaagcagtacgcgggcatcgacaagccgctctgaagctagcgtccgccggcagcgaactgcagttccgccaggcgcgcatagagcgggttctcggcgatcagccgggcatggctaccaatggccaccagccgcccctggtcgatcaccgcgatgcggtcggcgctctgtaccgtggccaggcgatgggcgatcaccagggtggtacgtccgctcatcaggcctggcagggcctgctggatcaggtgctcgctttccgcatccagggcgctggtcgcctcgtcgagcagcagcaccggcgcgtctaccagcaacgcccgggcgatcgccaggcgctggcgctggccgccggacaggccgatgccgccctcgcccaggtgggtggcgtagccctgcggcagacccaggatga

SEQ ID NO: 2901 - DNA, 501 bp, Pseudomonas aeruginosa
agaaaaccgtcgcgccgaaagccgccaagccggctcccgcggtcgaaacccgcgagtccatcgaagcgcaggtcgccgccttcctccaggccggcggcgagatccagaagatcgccaagggcgtcagcggccaggtctacggcccgtcgcggcagatcaccatcagcaagaagcgctgaacgcccgcccctcgccggggactacgaaggggatggcaggccggcacgcagatgtgccacgctccatcccctttttcattgcctgaatcccgagcccttcatgcctggccatcccgatccactgcacggcgtcaccctggaaaaactgctcaccgaactggtcgcccaccacggctgggcggagcttggcaaacgggtcgacattcgttgtttcaggaacgacccgagcatcaagtccagcctcgccttcctgcgcaagacgccctgggcccgggaaaaggtcgaggcgctctacgtccagctcaagcgcaaccaaggctga

SEQ ID NO: 2902 - DNA, 660 bp, Pseudomonas aeruginosa
  unsure (490): Identity of nucleotide at the above locations are unknown.
aggctagcgcgccaaccccaggcgcagcaattgcccgtccttctggtcggtgagcaggtagagatagccgtccgggccctgccgcacgtcgcggatgcgcaccccgagatcgcccagcaggcgctcttcgtggacgatccggtcgccatccagttgcaggcggatcagttcctgcgtcgccagcgcgccgatgaacaaattatgctgccaggccgggaagcgctgcgcatcgtagaacgccatgccgctgatcgccggcgacttctcccagacatggtgcggcgcctcggtaccttcgacggccttgcccctggcttcggggatcggcagcagggtgtagttgattccatgggtcgccagcggccagccgtagttcccgccggcctggggtatgttgatctcgtcgccgccgcgcgggccgtgctcgtgggtccagagccggccggtccagggattcagcgcggcgccctgctggttgcggtggccatanctccaaatctccggccgcgcgtcggcacggccgacgaagggattgtccttgggaacgccgccgtccggatacaggcggacgatcttgccctgcaacttgtccaggtcctgcgaggtgctgcgctgattgttctcgccgagggcgatgaacaggtggcccttgccgtctaa

SEQ ID NO: 2903 - DNA, 873 bp, Pseudomonas aeruginosa
aaaaacacttcgcccgccagcgtcccacccttgcgctggacagcgaggcttcggggctggtggtgttcagccagcagcacggcgtactgcgcaagctggtggacgacggtgcacggctggagcaggaatacctggtcgaggtcgccggcgacctggccgccggcggcctcgagcgcctgcgccacggcctcgcctaccagggccgcaggctatcgccgtgcaaggtcagttggcagaacgaaagccacctgcgcttcgccctcaaagacgtgctgcccggccagttgcgcttcatgtgcgaaagcgaggggctggaagtgcggagcatccgccgcctgcgcatcggcgcgctgtcgctggccaggctaccgctcggcgaatggcgctacctcggcctccacgaacgcttctgagcgctcattcgaggccacgcagggcgcgccccggcgactgcccgcagacccgccggtacatggcgatgaacgcgctgtcgctggcgtagcccagggcgtgggcgacctcggtcaccgagcggccttcggccaggcgcctccgcgcttcgaacaaacgcgcctgggttcgccagcgggagaaacccaggccggtctgctcggtgaacagacgcgccagggtccgcccgctggcgccgacctcacgtccccacgcctcgatgctccagtccagcgcgggttgcgccagcagcgcctcggccaccttcagcgcccgcgcatcgcgcggcatcggcaggctcgcggcgtgtgccggcgcgctcgccagttcatcgaacagtgcgcgcaacagcgtcaggtgcggcccttccaattgcaagtcggctgcccagccggtcatgcgcaggatcagttcgcgcattag

SEQ ID NO: 2904 - DNA, 1125 bp, Pseudomonas aeruginosa
tcggcctcggactgggcgcgtccaccctgctaccgttcgaccgtccctggccgctggccgcgtactggagcctgctgggcctggtcgcactgctgctggccaggcggctgccggaatgaaagcggcgccaggtacgcccgtgcaaaccggacgaccggcccggaaagccggatagggcggccgtcgcgacgctgctatgctgtgatggcacagcgcccatgcggacccgcagaacgtggccagaacgacgctcgaatcgatccagcacgccatcgaggtgaattcgtccctggcccttcccatcgccctggagaatctctcgcgtctgacccacctcgcgctgctgaccgtccccttcaacctgatccacatcctggtgttttccctcaaggacttccgcccggacctcggccatcagctctggcgccaggaaatcatgtacgcccatggcgccatggccctgctcttcggcggcatcggcctgctcgcgctatggctgcgccgccagccgcccaagctgtggcgcatgcgcctgctgatcctgctgggcggcgcagggatcataggcttcggcgtcgccatcgcctgcatcgaccagcgcatcaccagcaacatcacgccgctgctgctggcctgtttcgcctgcgccatgttcatcctgatccgcccggcctacgcggtgcccttctacggtctggcgatgctggccttcgaggtggcgatggaccacgcccaggccgacccgcaactgcgcctgtcgaaccaggccaacggcctcaccgcgttcggcctcggcctactgctgtcgctgatcctctggcacggccacgtgcgcaacctgcgccagcaacgcaagctggagttgcagcggcaggagctggaggagaagaatcgccagttggagtacctggccggtcacgaccccctgaccggcctgttcaatcgtcgcgagttcgaccagttggtgctcatggagctcgcgcgtatcgctcgccaaccgcagccgctgagcctgctgatggtcgacctggatcacttcaagtacatcaacgaccgctatgggcaccccttcggcgacgaggtcatccgccatgccgccaacctgctgcgcggcaatacccgtag

SEQ ID NO: 2905 - DNA, 1617 bp, Pseudomonas aeruginosa
gcgtcctggcggatcgcctcgatctcctccagcgtcggcggcttgacggtctccagctcgacctcttccaccgccggcggcgccggcgcgggttcggcgaccgcgggcacctgcggcgcggcaacggccggctcgtcgcgcggctcgtcgaagctcggcaacgaccagaggccgaaggccgccacgtccttgccgcggatcagttcgctgggattgtctttgtccttgtcgtgggggaccacctcagatcatctcctcgccacccttgccgcccagcacgatatcgccggactcggccatgcgccgggcaatggtgaggatttccttctgcgcaccttccacttcgctgacccgtaccggccccttggcctccaggtcgtcgcgcagcagctcggcggcacgcttggacatgttcttgaagaccttctcgcggatcgcctcgtcggagcccttgagcgccagcaccagtacgtccgaggagacttcccggagcagcgcctggatgccacggtcgtcgacgtcggcgaggttgtcgaagacgaacatcaggtcctcgatctgtccggacaggtcttcgtcgacctcgcggatcgaatccatcagttggccttcgatggagctgtcgaggtagttcatgatgtccgccgcgcgcttgaccccgcccatggtggtgcgggtggcgttggaattgccggcgaactgcttctccaggatcaggttgagttccttcagcgccgagggctgcacggtgttcagcgaggagacgcgcaggacgatatccaggcgcaccttgtggtcgaaatggctgagcacctcggcggcctggtcgggatcgaggtaggcgaccacgatggcctggatctgcgggtgttcgtaacggatcacgtcggccacggcacgcggctccatccacttcaggctgtccaggccgctggtgctgccgccgaggaggatgcggtcgatcaggttgttggccttgtcctcgccgagggcctgggtgagcatcttgcggatgtagccgtcggcaccgacgccgaggctggtctggtcgccgaccacttcgacgaactcgcccatcacctgctcgacctgttcgcgatgcacgttgcgcatcgacgccatggccacgccgacccgctgcacctctttcggtcccatgtgccgcagcacctgcgccgcgtcggtctcgccgagcgacaggagcaggatggcggccttgtcgaccttggtcagtttggcggcgagacgattctcactcatggcgcttactcatcggcgttgatccactctttcacgacctgggcgacgcggcccgggtcctgtgcgaccaggttcttgatcgcgttcaattgcgcatcatacccctccgtggggctcggcaggaggatgctcgacggcccgccgatgctcacccggtcgtcggccagcgagccttccaggccactctcgcccagcgccaggtcaccgtcgcgaccgccgccgccggccagcgacttgcccttgccgccgccggtgatgttgctcagcaccggacgcagtacgccgaacaccaggaccaggatgaacagcacgccgagcacctgcttgacgatgtcccagaaccacggctgcgagtag

SEQ ID NO: 2906 - DNA, 2142 bp, Pseudomonas aeruginosa
ttatcctcgcgccgctcagaccggcatctgcatgatgtcttggtaggcctggaccagtttgttgcgcacctgggtcatggcctggaacgacacgctggccttctggctggcgatcatcacgtcggtcaggtcgacgccgctctggccgacctcgaaggcgttggccatcgcggtggaggcctgctgggtctcgttcaccttgtccacggcctgggagagcatttccgaaaagctcggcgcccccgcttcggccggcgcctgagccggtttggccttggccatggcttccatttgcatggaacgcatttccagcatcagacgattgaactcgacaccctgactcatgactcttcctccaacagccgcggcttttttgacgccgcccggcactttgcagaggagttagcaacaagggtgccaagtcgcccccaaggcccggcatcggcgttcgccgccaatgcccgcgaccgctgcagggtccgtccctgctccggttatcggcaggcgcgcacgctcgaacagccccgggcgacgaccggcggcggacgcaaaaggcccgcacgaggcgggcctggggaatatggcgagcactcagatggcgtagagataggcctccacgtccatccccgcgtcgcgcatctgggcgagcttgtagcgcagggtccgcgggctgatgccaaggcgctcggcggcctccttgcggcggccgcgctcggtgcgcagggtatcgatgatcacctggaattcgcggcggcgcaggtcgtcgcccagcgcgccgctagcgtcctggcctgcggccggcgacggaatctcgacgctcggcggggtggccggtggcattgccggcatgggcaccggcaccggggccgcgagcggcatgccgatcggcgcggtgaggcacaggtcggcgggctggatcaggccgccctgttgcaggatcaacgcacgctggatggcgttgtcgagttcccgtacgttgcccggccaggcatgccggaccaggcactgggcggcctcggggccgagcgccaccgcgccgaggttcatcttgcggctgtgcttgcgcagcagacgctcggccagcggcaggatgtccgcagggcgttcgcgcagcggccgccaggccagcgggaagaccgacaggcgatagtagaggtcctcgcggaaacgccccgccgcgacttccgccgcgaggtcgcggttggtcgtggcaagcacgcggatatccaggttgatcggcttgcgcgcaccgacccgctccacctcgcgctcctgcaatacgcgcaacagcttggcctgcaggccgaggggcatttccgatatctcgtcgagaagaatggtgccgccgtcggccagctcgaacttgccgggctgggcggcaatggcgccggtgaaggaacctttctcgtggccgaacagggtggcctcgagcatgttgtccgggatcgccgcgcagttgatcgcgatgaacggcttgccggcacgcggcgattgctggtggatatagttcgccaggacttccttgccggtcccggactcgccggagatcagcacggtggaatcgctgcgcgcgacccgcgcggccagttccagcaactgccggctggccggctccagggccaccggaccatcctcctcgctgcccggcaactggcccagcgcatggcgtgccaccaggtcgagcagcgcccgcgcctcgaacggcttgaccaggtagtcggcggcgccctggcgcatcgccttgacggcgcgatcgaccgcgccgtaggcggtcatcagcaacaccggcaggtgcgggtagcgtgtacggatcaggccgagcaactggtgcccgtccatgcccggcatgttcacgtcgctgatcaccaggctgaaggcttcgcgggccaggaccggcagcgccgcctccgccgagtccacggcgacgaactcgtgaccgcccagcagcagggtgtcgctgagggcttcgcgtactgcgcggtcgtcttcgaccagcaggattttggctgccatggggttactcctgaatcgcagaaagaggcgccgccggaatcagcggcaggatcaaggtggcgcaggtgccgcgccccggccgagagcgcaactgcaattgcccctggtgggcgcgcgccacggccttga

SEQ ID NO: 2907 - DNA, 195 bp, Pseudomonas aeruginosa
tgcaggttgcgcgccaccacttccttgccggtgccggactcgccgaggatcagcacgctggcatcggtatcggcgacctgctgcatcatctgccgcacctgctggatcgcccggctggtgccgaccaggctgcggaacaggttcggctcgcgggagcggccgcgctcgcgggcctggtcgtacatctcgcggtag

SEQ ID NO: 2908 - DNA, 543 bp, Pseudomonas aeruginosa
aaaacccctacagaccgcatggaaagcagtactggcaggggttttgggggatatgtaaatttttccgaaaagccttgcgccaaagtaacggcacaaagccatgaaaaacttatccgaacatctggtagaccttggcgccttgcttcgactggttcagctggatcagatcggtggccagcttgcgctgctcgccctggcagacatcgatcagctcgcgatacagcgccagcagctcttccatccgcgcccgcaaggtggcttcgtcctgtacatcgagcatcgcctcgtcgacggcctggcggcaacgctggtcgagttcaccgatggcctcccagttctggctggccagggcaacgcgcagggcgctaccggtttcttcaaggatctgtacagctgcactcattgcttggtccctctggggatgcctctcagggggcaatcgcatcccaaccggatttgatgttgcgcaacagctcggaaacttcctcgagcttgcccgcgtcgttcttcaagttggcttccgtcagtcgcatcgacatgtag

SEQ ID NO: 2909 - DNA, 1383 bp, Pseudomonas aeruginosa
ctgctgcagccagtccttgtcgaggatgccgctgccggcatcgagccagagcaggaattcgccgcgcgcccgggacgccgccaggttgcgcagagccccacgggacaactgcccatcgcctcgcagcacccgcacctgctcgacacccatgccttcgacggcgagcagccattcgcgaacgtcggccgcttcgccaccctgttccagcagaaggatctcgtagttgggataggcggtattctccagcacggtttctacgcaacgctggagctgcgccaggcgctccccggccagcaccaggatgctgaccggcggttgcccggcgtggccgtagtccagctcgtagcgccccggcagccggcttccgactgtcgcctgcgcgtagccacgggcacgcaggtggccttcgatcgccgcacgctcggcggtgctgttctgcaggcgcagcgctgggccagacagcagtggctcgctgatgtgtccgatacagcccaggccccgctgctcgacgagacgcaactggtaggccagctcgaaagcctcgccggcggtctcgtcgaatccgcccgtggcaagcagcggctcgcggcggaacaaccagtgccgggacagcccggcggggaaactgagcagaaggtcgagattcaggtccgggcgcaacgccgcgcccagctcgccgtcatccaggcgcatgagttcgtcggcgtacaccgcctggcagctctccggtgccgccagcaggtccagcgccgccaccagcaggccgctgacagtgaattcgacacccgcttcgaccaggagcaaccagtcggtatcaagccgggcaagcgcctggttgatcgtcggcaccggccccacctctggatcgaagagcatcgctccgttccgcggactcgtgcccagcggcgcgaacaggtggctctcgacacgtggatacaaattgacgtgctccaggctctgcagggtacgctccacggcctcggtatcgccgtgggcatcgagcaccagcaccgcgaagcgcggcccaccaccctgctcctgcaggaatcgatcgatcagcaccttctgcaccgcatccggccgccgcgcctccagccaggtcgacagcgtgacgctaccgaagcccgccgcccgcctcagcgcggcgagcaggttgaccggcttgaagacacgggcgtccaggcgggtgatcggtgccacccggacgaagcggttgtcgccggcctggcgataccaacccagttcgcggatagccaggcggaagtcggcatggccctgctcgccgataccgggctggtcgcgcccgatctggctgaactgctggcgggagacgcggaaacgggtcagcggccgcgacaggaacgccaggtcgccacgctgtag

SEQ ID NO: 2910 - DNA, 348 bp, Pseudomonas aeruginosa
ttcggtaggcaggctcgagacaggggttatgagaggctgcggcaggcgcgcatgggtttcgcaatccgcaagcaggcgtactggatggcaggctacgcggagatcaatcaggctggcgtcgagatccgactgggtattcaacgcgactaccactggccgggtacgccggatataggactcgagggcctggcggtgcctgaccacgcctgtgccagcccccagcagcaatacttccctgccttccagccagtcgcatggggaccaaatccctttcggcgtttcatcatagagatgacgggcactgacgagcatgtcgcgacggaagctctgtccaccttgccgacgtag

SEQ ID NO: 2911 - DNA, 489 bp, Pseudomonas aeruginosa
ctgcccctcggcaccgaacgaccaggcatggtacgggcagaccagcggtcgctggccggtgcattcggtctggatcgccgacagacgatgcggacactggttgagaaaggcccgaatgccggactcggtacgctgcaccacgaccggcacgccggcgatcttgcgggtgaagaactggttgcgctcgcgcaccatcgaactgaagccgacgaagatccagagcctgccgaacagcctttcgcgctccagcgcgagcgtctgcggctcggtgtagtgcgctgcgtccagcgcatggcgagtcatgtccacatccacaaccttcacttgctgaaaataacccgggccggattgccgaccacggtctgtccggccgccacgtccttgaacaccaccgcgcccatgcccaccacggcgtcttcgccgatactgacgtcgcgggcgatcatcgccccggagttgatcaccgcgcgatcgcccaccttcacgtag

SEQ ID NO: 2912 - DNA, 1140 bp, Pseudomonas aeruginosa
tgctcgccgccgcggcatggcggcggaagcgatcaggccggcgacgaactcgacgtctgcggcggccagcccgggatagatcggcaggcacagcacccgcgaggaaatcgaccgcgccaccggaagattggcgggcgccgccgagggcagcgaatggtacatggggaagtcgctgatgagtgggtagaagtagcgccgcaccagcacatccctgtcgcgcaggcgctggtacagctcgtcgcgcgaaagcggaaaatcgtcttccaccaggatcgggaaataggcgttgttggcgaaggtctgggtaccaggccggaggcactggatgccagggacgccggccagcaggcgccgatagcgctcggcgatctccctgcgctgctccagggcctggtcgacgtgcttgagttgcagcagcccgaaggcagcgccgacctcgttgagcttgccgttgatgccgggcatgaccaccgtgacctcgtcgacgaagccgaaattcttaaggtggttgaggcgttgccgggtgttttcgtccgagcagatgatcgcaccgccctcgaaggtgttgaacaccttggtggcatggaagctgaggatgctcaggtcgccgtggcgcagcacgctgccgccggcgtcgcgcacggcgaaggcatgcgcggcatcgtagatgaccttcaggtggtggatatcggcgatccgctggatcgcctcgacatcgcaggggttgccgtagcaatgcaccggcaggatcgcggtggtctgcggggtgatcgccgcctcgatccgcgacgggtcgagattcatggagtcctgatcgatgtccacgaagatcggcttgagcccgttccacagcagcgcgtggctggtggcgacgaaggagtacggcgtggtgatcacctcgccggtcacccgcaatgcctgcagcgcggtgatgagcgccagggtggcgttggcgaagagcacgatgtgcttcacccccaggtattcgcacagggcctcttccaacgcatggtgcatgtcgcccccgttggtcaggaagcggctctcccagatcttttccaggtaggggatgaactcttccaggggcggcagcagcgggctggtgaccgggatcgtcttgttgttcatgtagggccctga

SEQ ID NO: 2913 - DNA, 1422 bp, Pseudomonas aeruginosa
cggagtcatgggccctgttccacagagggactgtcacttcaggtagttgaacaggctcaacccctggatcttcacgtagctctgctgcgcggcatccatgatggtggactgcaacgacagccgcgacaacgcctcggcgtagtccaggtcctggatctgcgacatcaccgacgcattcaccagcttcacatcgtcgatgaaggtctcggtgctttccacggtattcaggcgcgcgccgatcttgccctggccgccatccacggcggcagccacggcggagaggttggtcagggccaccgccgtcgcatcgcggatggcgtcgttgccggcctggttgtcggtggagctttccagggccttgcgcaggtccgacaccacgttcagcaggctgcgcttctcgctgcccggcttgtagttgacgttgaactcgtcgcccgccttcggcgtgccgtcgatcgtcacgctgacgccggcgtagagcaccttgtcgatggtcttcgggtcgtcgtcgatggcgcccttggacaattgccaggccggcggcgaattcggatcgtaggtggtccagtcatagcccggaggcaggctcttcggatcgtagaccacatactccttgtcgctgacgaagtggatgttgaagccgtcggttgccgcaggcggattgctcgccgggaactggctgtcgaaggccagctcgtcctcgaccaggccgaccgagatgcgaccgtcgccggtattgccagccgccgccttggtatcgagacgagcggcattgacgatgtcctcgaacagtaccttgccgctgtcgctgaccggaatccgcgtgctgctggcgatctgcacctcgcgctggctctcgtcgcccatgtagctgtaggtgccgtcctcgttgcgcacgaacggctgcaccgagccctgggacccggaaaacaggtatttgccactcgcgtcgcggctgttgagcaggttcagcaactcgtcctcgcgctggcgcaactcgctggccagcgacttcttgtcgttggagtccagtgcgccgtcgccggcctggccggcgatctcacggatgcgctggaggacgttgccaaccgaacggaggatggtttcttcctggctcaggctgttcttcgcctcggtcatgccggtcttgtactgctcgttcaacccctgctcctggtccaggcgcaacaggcgtaccgaaccgaccgggtcgtccgccggtgtcaggatgcgcttgccggtgctgatctgctcgaaggtacggttcaggtccgcgtagttgcgggaaatcccgttgaccgagttgttgaaggcctggatggtggaaatgcgcatggtggcggtctcgctggcttaggccccgtcgagagaactcaacggaacgctccaatcagggtatcgaacagagtgcgggcaacttga

SEQ ID NO: 2914 - DNA, 1233 bp, Pseudomonas aeruginosa
gagccgctgtcggggcctgcgccgataccgctgagcaaacgggaatccatggcgtcgtcctcagatcacgatcaagtcggcctgcaacgcgccggcctgcttcagggcttcgaggatcgccatcaggtcgctcggcgcggcgccgacctggttcaccgcgcggacgatgtcgtccagggtggtgccgggaccgaacttgaacatcggcttggtctcctcctcggcgttcacccgcgagcgtggcaccaccgcagtctggccgttggagaaggcaccgggctggctgacgatcgggtcctcggtgatgctcacggtcaggctgccgtgggtgacggcggccggcgataccttgacgtcctggccgatgacgatggtgccggtgcgcgaattgatgatgaccttggccaccgcctcgcccggctgcacgtcgaggttctccaggatcgacaggtagtcgacccgctggttcgggtcgagcggcgcgctgacccgcaccgagccgccgtccaccgcatgggcgacgcccggaccgagcagttcgttgatgcggtcgacgatgcgcttggcagtggtgaagtccgggcggttgaggttcagcgtcaggctgttgccctggtcgaagccgctcggcaccgcgcgttcgacggtggcgccggccgggatacgtccggcggacggtacgttgacggtgatcttcgagccgtcgcggccttcggcgtcgaagccgccgaccaccaggttgccctgggcgaccgcgtagacctggccgtcgatacctttcagcggagtcatcagcaggctgccgccgcgcaggctcttggcgttgccgatggacgacacggtgacgtcgatcggctggcccggcttggcgaacggcggcaggtcggcatgcaccgataccgcggcgacgttcttcaactgcacgttgccgacgttggccggcaccttgatgccgaactgcgccagcatgttgttgaaggtctgcagggtgaacggcgtctgcgtggtctggtcgccgctgccgctcaggccgaccaccaggccatagccgatcaactggttggtccgcacgccctggatgctggcgatatccttcaaccgctcggcctgggccgcgccggcggccaggagcagcgcggcgagggccagcaggtgcttgaacttggtcatcgcgagcgtcctcagaacggccacagcgggctgaggaagaagcggtccagccagcccggctga

SEQ ID NO: 2915 - DNA, 438 bp, Pseudomonas aeruginosa
gtgatccgggcgtcggccacgcgggtcgaggacacggtgttgtcggtggcgatatcgtcggcgcggaccaggccggcgatgcgcaccagctcgttgccggtgttcagggtcatccacttctcgccgcgcacggagaggatgccgttgggcagcacctcggccacggtcacggtgatcgagccggtcaggctgttgctctgccccgcctggctatcgcccttggcgtcgcgcgagccgccgtattcggcgctgaggctgaggtcgccgccgccgatcgggttgttggtggtcatgccgctaccgaacagcgaggtcagccccatcttggtcttgctgtccttctggatatcggagttggctttcttgctcgcctgggtcttctcgttgagggtgatggtaatgatgtcgcccacgcggaaggccttgcggtcgtcgtaa

SEQ ID NO: 2916 - DNA, 1704 bp, Pseudomonas aeruginosa
agacactggcgagggacatggcggttactctccacgcagggcgctgaccagccctttgaatttgctgttgaggaaggtgaaggacgcctggaagtgcatggcgttctcggcgtagttggcctgctcgatctgggcgtcgacagtgttctggtcgatcgacggctggaccgggatgcggtactgcaggctgccctcgcccatgccgaaaccttcggcggcgatatgccgctcgttggtggtgcggatggcgaaggtacccttggcggccttgtccttctgctcggcgagaaccgcggcgaagtccaggtcgcgagccttgtagttcggggtatcggcgttggccaggttgttggccagcacttcggcgcgctgggcgcggaagctgagggcctgctggtggataccgagtgctctgtcgaaactgatgctcatggctgcgaacctgtttgccggtgtggctttcgtcgccaacacttcagcaaggcccgtgccaaattattaaaaacctttatattcaataacttgagtttatttaagagcaacccggaagcggcaagcggcaagccgtttccgcttgccggcaagggtggcaagcccctggaacggcctctccggcaaacgaaaaaaggcccgatatcgtcgatatcgggcctttcccatgcttccggccgccggggacacggctcactcgtggcgaatgatccgctcgagatccaccggttcgccgggatgggcatgcagcttggcgcgaatatcctcgaacatcgcatcgtattccttgtgcacccgggtgatcgcgccgaacttcgggtgcaggccgtgcttctgggcgacccgcgtggcatcgctggcgaagttgaaggcggtatcgcgcggcagctcgaaggagtcgctgaacggcttgccgtcgatctcgccgtccatgtcgaagtgcacataggcgccggattcggcgttctgccgcacctcgtagcggatatggatattgatgtcctgctggtcgaggccgggcaggctgaccagatggaggtggcctggttcgaacatgacgaatctcctggtgggaatcggaatcagtctagccagggtcgagcgaaagaaaaccgccctggatcagtgcaacgtcgctttttccgcgcgttcctgaatgaccacccagggcgccaccaccaccgcccagagggtcgggtcgcgttcgatgaaatccttggccgcatcctccccgaccttgctcaggccgccgccggaaagccaggcggcgaccttctcgcggtcgtccccggccagggcctcggcgacttccaccaggtccagcgcggcatcgacctggagcaaggcgccacgggcgaaaaacggttgcagctcggcccaggaaatgaccgcggtctcgccgagcagcttggcatagagggtgctagtttgttctgtcatgggatctacctggattgcatgggcgccatgataacgcccgccggtagcccacgacagccgaagggaaaccgggcccagggaggtgaggcaggtccgcgccgtttttctatacgtttatgtcaaccaggcgacacgactcacgggagctcgccgtgccgtgcttttcaagcgacgaagcgccgctctacactgtaccggtacagttcccggggtccgtccatgacgatcacccggtctcctccggcccccgcggccgcgagactacaacaatga

SEQ ID NO: 2917 - DNA, 1197 bp, Pseudomonas aeruginosa
caacacacaagaagagtggagcactatgaagaagggtactcagcgtctatcccgcctgttcgccgcgatggccattgccgggttcgccagctactccatggccgccgacaccatcaagatcgccctggctggcccggtcaccggtccggtagcccagtacggcgacatgcagcgcgccggtgcgctgatggcaatcgaacagatcaacaaggcaggcggcgtgaacggcgcgcaactcgaaggcgtgatctacgacgacgcctgcgatcccaagcaggccgtggcggtcgccaacaaggtggtcaacgacggcgtcaagttcgtggtcggccatgtctgctccagctccacccaacccgccaccgacatttacgaagacgaaggcgtgctgatgatcaccccgtcggccaccgccccggaaatcacctcgcgcggctacaagctgatcttccgcaccatcggcctggacaacatgcagggcccggtggccggcaagttcatcgccgaacgctacaaggacaagaccatcgcggtactgcacgacaagcagcagtacggcgaaggcatcgccaccgaggtgaagaagaccgtggaagacgccggcatcaaggttgccgtcttcgaaggcctgaacgccggcgacaaggacttcaacgcgctgatcagcaagctgaagaaagccggcgtgcagttcgtctacttcggcggctaccacccagaaatgggcctgctgctgcgccaggccaagcaggccgggctggacgcgcgcttcatgggcccggaaggggtcggcaacagcgaaatcaccgcgatcgccggcgacgcttcggaaggcatgctggcgaccctgccgcgcgccttcgagcaggatccgaagaacaaggccctgatcgacgccttcaaggcgaagaaccaggatccgagcggcatcttcgtcctgcccgcctactccgcggtcacagtgatcgccaagggcatcgagaaagccggcgaggccgatccggagaaggtcgccgaggccctgcgcgccaacaccttcgagactcccaccgggaacctcgggttcgacgagaagggcgacctgaagaacttcgacttcaccgtctacgagtggcacaaggacgccacccggaccgaggtcaagtaagcatcgttgcagtacggagcccacgtcacccaccgtgggctttgttttag

SEQ ID NO: 2918 - DNA, 936 bp, Pseudomonas aeruginosa
cgagagagtcccatgcccgagatttatcattacctacaacaattggttaacggcctgaccgtcggcagcacctatgcgctgatcgcgatcggctacaccatggtctacggcatcatcggcatgatcaacttcgcccacggcgaggtgtacatgatcggctcgtacatcgccttcatcgccatcaccctgctggcgatgatggggctggacagcgttccgctgatgatgctcgccgcattcgccgccagcatcatcgtcaccagtgccttcggctacagcatcgagcgggtcgcctaccgcccgttgcgcggcggcaaccgcctgatcccgctgatctccgcgatcggcatgtcgatcttcctgcagaacgccgtgatgctctcgcaggactccaaggaaaaggccatcccgaccctgctgcccggcaacttcgtgttcggcgaaagcagcatgaacggcgtggtgatctcctatatgcagatcctgatcttcgtcgtcaccttcctggtgatgttcggcctcaccctgttcatctcccgctcccgcctgggccgcgcctgccgcgcctgcgccgaggacctgaagatgaccaacctgctgggtatcaacagcaacaacatcatcgccctcaccttcgtcatcggcgccgccctggccgccgtcgccgcggtgctgctgggcatgcagtacggcgtgatcaaccccgggatcggcttcctcgccgggatcaaggcgttcaccgccgcggtgctcggcggcatcggcagcatccccggcgccatgctcggcggcctgctgctgggcgtcgccgaagccttcggcgccgacgtgttcggcgaccagtacaaggacgtggtggccttcggcctgctgatcctggtgctgctgttccgacctaccggcatcctcggtcgtccggaggtggaaaaagtatga

SEQ ID NO: 2919 - DNA, 498 bp, Pseudomonas aeruginosa
tggccgcgctgttcggctttctttcctcggcttcccggtgctgcgcctgcgcggcgactacctggcgatcgtgaccctcggcttcggcgagatcatccgcatcctgctgcgcaacatgaccgagatcaccggcggccccaacggcatcggctcgatccccaagccgaccctgttcggcctgaccttcgaacgccgcgcgccggaaggcatgcagaccttccacgagttcttcggcatcgcctacaacaccaactacaaggtcatcctgctctacgtggtggccctgctgctggtgctgctggccctgttcgtgatcaaccggctgatgcgcatgccgatcggtcgcgcctgggaagcgctgcgcgaggacgaagtggcctgccgcgctctcggtctcaacccgaccatcgtcaagctctccgccttcaccatcggtgccagcttcgccggtttcgccggcagcttcttcgccgcccgccagggcctggtgacgcctga

SEQ ID NO: 2920 - DNA, 996 bp, Pseudomonas aeruginosa
gtccttcaccttcatcgagtcggcgatgatccttgcgatcgtcgtgctcggcggcatgggttcgcagctcggcgtgatactcgccgcggtggtgatggtgctgctccaggaaatgcgcgggttcaacgaataccgcatgctgatcttcggcctgaccatgatcgtgatgatgatctggcgtccccagggactgctgccgatgcaacgcccgcacctggagctgaagccatgagccgaccgattctcgaagtgagcggcctgaccatgcgcttcggcggcctgctggccgtcaacggcgtcaacctgaaggtcgaggaaaagcaggtggtctcgatgatcggcccgaacggcgccggcaagaccaccgtgttcaactgcctgaccggcttctaccagcccaccggcggcctgatccgcctcgacggcgaggagatccagggcctgcccggtcacaagatcgctcgcaagggcgtggtgcggaccttccagaacgtccgcctgttcaaggaaatgaccgcggtggagaacctgctggtcgcccagcaccgccacctcaacaccaacttcctcgccggcctgttcaagaccccggcattccgccgcagcgagcgcgaggccatggagtacgccgcgcactggctggaggaagtcaaccttaccgagttcgccaaccgcagcgccggcaccctcgcctacggccagcagcgacgcctggagattgcccgctgcatgatgacccgcccgcggatcctcatgctcgacgagccggccgccggcctcaacccgaaggagaccgacgacctcaaggcgctgatcgccaagctgcgcagcgagcacaacgtgacggtattgctgatcgagcacgacatgaagctggtgatgagcatttccgaccatatcgtggtgatcaaccagggcgcccccctggccgacgggacgccggagcagatccgcgacaacccggacgtgatcaaggcttatctgggggaagcgtga

SEQ ID NO: 2921 - DNA, 2412 bp, Pseudomonas aeruginosa
ctgcgggcaggcctgggtgtcgtcgcgattggccagttcgaacagggaaacggcgtcggccagggcggtctcaccctccagttggttgccgacccggttacgcatttcccagtggcggacgaagatttccagccacgggttgttcaacgtccggctcagcgccttgacctccggcaacagcgcctcggcgcgctccacctcgaggtcgcagacgtacgcggtgagttcgtcgatcagccgcgcactctgctcctggccggcctcacgcaggtcggcgcggagcttctccacccagttccagatatccatatgcttcagtctccatcaggcgtgttgcgaattttcttattgccccagcaggcgcttcaccgaatcggcgagtccggccagggcctggttcagcgaggtcgcgggctggccgcgtccctgtccggcgatgatcactttgaacgagcgcagcagcaacgccgcatgggccgcttcgtcgcgttcctcgccgacggccgcgagcagcgcctgcaccgccggattgtcgaggttgacgtagagccggctcggctggcgattgtcgagcttgcgggtgaactgccgggccaggcgcaacgccgcggtggaaatacgcttgtcggcctcgtcgtcctccagtcgccgcttgagttcggcgtcgcggtcgggcaccatcacaagcggcaattcctcggggctgaagcgggcgatcaccagttgctcctcggcgccgcccaggtgttcggccagccagccggtctcgcgctcgggcagtcggtcgaggcggaacaactggcggttgccctgctcggtgcccagctccaccaggcgcatccccttggcctgcgcccagcgacggaggaagggtaccaccgcatagcgattgccatgggccaccggtacgcccatggcacggaacagcatttcctcgaagccgctgtcgttgtccagcagcacatgcaccgctccgcgcgaaaggagttcggaagccgggaggtcgccctgggaggtgggtacgcgcaggctgtccatcatcagcgcgaacagacgctcgtcgcacaacgccgctcccagcagggcctcgttgtgccgcagcaggacccgccgccaggcctccggctgctgccgcgccacctcgccgagcccggcgatcagcgcctcggccagcgcatgctggatcgccgcgtaatggtcgtcacgctgcaggtcctcgcggctggcggtgggcgtcaggcggttcgattcgatcaccccgccgacgaacccggcccaggacggcagcaggtcgcgggcgtcatcgtcgagcagcatgccgcggaggaaaaccgagagattgcggttgtcgctggtgccataggtgccgccgtcctggatccacagcaggccctgcacgtcgacccgctcgtccgggcgcaccggcaggcagcagatcggctcgaagtcgtgctcgaagcgtgcggcgaactccaggtcgcggcgctgccgttgcagcgggtgcagcgcggcgtcggcggccagccgccacggcggcggctccgggttgatcgactgggcgtcgccgccgacgtggatcggctcgcgcagcagcacgcagtagcgttcgaggatctcgcgcaggcgcgcggcctgggtcagcgcactgtattcgtcctgcagttcgagggtgatctcggtgcctaccgggcgcgccggcatcggcgtcacgctgtattgctcggcgttgctggagacgtagcagaagcccagttccggctgctggtaggacgtggtccgcacgctgacccggcgggccaggacgaaagcggagaggaagcccaggccgaacatgccgatcagcccgctgtcctcgtggccggactggcgcagtccgcgggtgtagccgacgccgacggtggccaggtaggcgtggatttcgtgctcggtgagcccggcgccggtgtcgacgatgcgcacggtgttgctggcactgtcgccgatcacctcgattcgcgacggcccttgccagtcgggctgctccaggcggcgacggaggatcgagtcgtgggcgttctgcaccagctcgcgcaacgccacggtgggcgtggaatagaggtgcttgctgagcaccgacatcacgccgttgaggtcgactccagcgcgacggatctggggagtgttcgattgcggaaagctgctttgcatgtccctatccaagcgttcgatgaatggcgtccgctcgcacgcgagcggtccggtgcgggattctgccacgttccgtcacgttccttgtgcaacgacgtgcccgcgatgagcttcaggccgcatggaagcggcccggagtgcaatagagccgcgtcgcggcgaaatgttcaaccctccaggccgatcaattgtcgccggctgcgctcgaaccagtcgagcaggtaa

SEQ ID NO: 2922 - DNA, 525 bp, Pseudomonas aeruginosa
gcgggactggcgcaggtgatttcctgcaggacgaacagcggccgcgccaccagccgggcgtcctgctcgaccccagagcggatcgccaggtcgaagccctcgccaaccaggtcgcgcaggccgttgtacaggtccagctcgacgcgcagcagcggatggcgttcctggaagtcctccagcagtgcatcgaacagggtctcgcccagcgagaccgggagggtcacccgcacccgtccttccgctcgctcctgcaagcgcgccaccgcctgccgcgcgcgctcggcctgcaccagcaaggcctgcgcctcgggcagcagcgcggcgccggcggcggtcagcgaaagacggcgggtggtgcggtgcaagagggtcacgccgagcttctgctcgaggacgccaatgcgcttcgacagttggcccttgctgcaaccgagacgctcggcggcgcgggtgaaactgcccaggtcgtggagtacggcgaaggcggcgagatcgtccaggtccttcacgattgtttccctatga

SEQ ID NO: 2923 - DNA, 750 bp, Pseudomonas aeruginosa
tgggccaggtcaacctggtactgctcggccgcgagtacgccaacgacgggggctccttcaccctcaccagcggcgtgctcgccgagcagccgatccgcttcggcagttcggcgagcatggtcaactgcgccgtcgagggcttcgtccgcggcgcagccctggagttgccgcgcggcctgcgcatcaacgccgtcagcccgaccgtggtcagcgaggcgctgcccggctacgcgccctacttccgtggcttcaagccggttccggcggcggacgccgcgctgggttacgcacgcagcgtggaaggcgcgcagaccggccaggtgtaccgcatctggtaagcgatatttctcaggagaggcggtcggcgtagcaggtcggcgaactgcccggctgctggcggtccagctcctcctcgaggaactcggccagcaccacggcattgttgtgctgctggtcgtgggcgccgtagagcagcgtcagggtgccctcccgagcgctgtcgagcaggccccaccaatgttccgggtgcgcctgcaactcggcgcggtagtgttcgcggaagctgtcgaagagtgccggatcgtggcagaactgcttgcgcacctcgttggagggcgccacgtccttcagccagtcgtccatggccagggcttccttgcggatgccgcgcggccacagccggtccaccagtacgcgccggccatcggcgggcgacgccggttcgtatacacgcttgcattggatcattga

SEQ ID NO: 2924 - DNA, 747 bp, Pseudomonas aeruginosa
ggccagcgcctggctgccgggagcgaccgactgcaaaagcatgaccttgccgaagaaccccgacaatggcggcagaccggcaacggcgatggcgccgatgaagaaagccccgccgagcaaccgaggattctgcaacgccgggccctggaccaggtcgccggccttgtcgccgcgctggcgggcgaccaggtcggcgagcaggaacaggccaccggcgatccaggtactgtgcagcaggtagtacagcgacgccgccagcgcccgctcgctgcccaacgccacgccagccaggagggttccggcggagaccaccaccaggtaggccagcaggctttgcagggtccgcgccgccaaggcaccgatcgcgcccaggccaagggtcgccagggccagcggccagagccaggcctgcgccaggttggccagctcgccggcggcatcgccgaagaccagcgtgtagacccgcaggatcgagtagatgccgaccttggtcatgatcgcgaacagcgccgccaccggcgcgctggccgcggcataggcgcgcggcagccagaagtacagcggcaacagcgccgccttcagggcgaacaccaccagcagcaggagcccggctgccgccagcagcggcgcgcgctcggcatctgccatggcgatcttctgcgccatgtcggacatgttcagggtgccggtgaggccatacagggtacccacggcgatcaggaagaacgccgagccgaccaggtttag

SEQ ID NO: 2925 - DNA, 711 bp, Pseudomonas aeruginosa
gatcacgtagtgcaagcccgagcgcacccgctccgcgccgccgccatgcaggagcaacgcgtaggaggcgatcaggagtatctcgaagaacacgaacaggttgaacaggtcgccggtcaggaaggcgccgttgataccgagcagctggaactggaacaacgcgtggaaatgcttgcccaggcggtcgtcgccacgcagcgcgtagatcagcgcggcgctgccgagcaccgcggtggccagcagcatcagggcggcgagacgatcgagcatgagcacgatgccgaacggcgcggcccagttgcccagggcatagacgctcaggtcgccgctggcggccgtacgtatcagcagcaggctcagggggatcagtgccagcgccgcgagcaacgacaggccgcgctgccagcgctcggccagcggcaacagcagcaggctgccggcaaacagggggagcaggatcggcaggatcagccaatggctcatgggcgcggctcctcctcgtccgggcgtccatctacgtggtcgctgccgaggtcaccgaggccacgcagggccaggaccacgacaaaggcggtcatggcgaagccgatgacgatggcggtcagcaccagcgcctggggcaacggatcaccatactccccgggagtgccgatcaccgcgacgctgccgccgagccggcccatggcgaacaggaacaggttgaccgcgtag

SEQ ID NO: 2926 - DNA, 264 bp, Pseudomonas aeruginosa
gcgcccgcagaaggaacagccatggactatttcatcatcgtcgtcaccaccgccgccggcctgtatttccactggtggatctactggcgcatccgccgctggatggaccgcgacctggcgctgtcattcgccggcgacgacccgcaaaagcgtgactatctgttacagcgactggccgaggccaaggccagcaaggtgaagcggcgcgacctgccggcctggctggagcgcgccgccgccgactacccttcccgcgaagcctga

SEQ ID NO: 2927 - DNA, 1044 bp, Pseudomonas aeruginosa
ccgtcgcccaggctgccggccagggctaccacgggaacgccggcctggcgcgcgatccgcgccacgcccaccggggtcttgccgtgcaggctctgcgcatccaggcggccctcgccggtcagcaccaggtcggcaccgaccagcgcatcggccagcccggccagctccgccaccagttcgatgcctgggcggaaacgcgcgcggaggaatgccctcgcggcgaaacccaggccgccggcggcgccgacgcccggcacccggctgaagtcctcgccaagggtcgccacgaccaccttggcgaagtgcgccagggcggcatccagttgcgccacctgttcggcgctggcgcccttctgcggaccgaacaccgccgaagcgccgcgcggcccgcatagcgggttgtcgacgtctgcggcgacttccaccgcgacatccaccaggcgcggatccagcccgcccaggtcgagactgtgcaggccagccagcgcggcgccgccgggcgccagttcctcgccgtcggcagccaggaaacgcacgccgagcgcgcccagcaggccggcgccggcatcgttggtagcgctgccgccgaggccgaggataatcttccgcgccccggcgtccagcgccgcacggatcagctcgccagtgccacggctgctgctgcgcgtggcgtcgcggcggtcgcgcgggaccaggtgcaagccgctggcggaagccatttcgatcactgcggtggcgtcgtccagccagccccagtgcgccagggtcggctcaccgagcgggccttcgacccggcattcgcgacgttcgccggcggtggcggcgagtaccgcatcgaccgtgccttcgccgccgtccgccagtggccgcagcaacacctcggcctgcgggaagactcgccgccagccgcgggcgatagcctcggcgacgtcgggcgcggacaggctttccttgaacgaatcaggagcaatcacgattttcatcagtcacctcgcagggccgggagtccccggccccgcttcaatcagagcagcacaaggctga

SEQ ID NO: 2928 - DNA, 1488 bp, Pseudomonas aeruginosa
gccgcctccttgttgttatgggtgtgggatgggcgcccaggggcgggtcattttcgctccgtcgggaccggacacgccttgtgcaacggccagaggaagacggcgctggaaggggaacattttgtgcgactgcacagtgaatcgattgatcgcccgttacccgcggcgcggaacgagcaattgcagccccagcaacaattgctggcggtgctccaggcgagcgagatcgagcccgctgatcgaagcgatgcgctccagtcggtagcgcaggctgttgcgatggatccccagcgcctgggcacaggcctgggcgtgcccgtcatgggcgcaccaggactccagggtagcggccagcgaaccttgcggatcgtggtcgagcaaccgctgcaagggcgccagcagctgccgcacctgccaactgtcgcgctggctgaacagcaggctggcgaggcggtgtccgtccagggtcacgacccgccgaccgggcaaccggctgcgcgcatagtccagcaggtcgcgcgcggcgcaggccgaggcgcgcagctcggccaggtcatgcgccgggtcgccggcacacaggcgcgccacgccccagccgcgcgcgtcggcgcgctccagccagtgctcgagcgtatctgcgtgggctaccggccggcaccagaacaccaggcgctcgcccagcgccgcgctccagtgctccgcccggccgccgagtgccgccagcaggcgagcctggcaaggcagcggatcggcatgctcgggcagctccaggaagaccgcctggcgcggccagtgcatggccagccccaggtgttcggcatcggccgccagcgccccgaggccgtggccgggatcgagcaactggcgcagccaggcttcgtgacgctggcgttgccagtgtcgctcgtcctgcatctggcgctgttccatgagcatttccgctgccatccgcaccagctcggcatagggccggaccacctccggcgcgccggtgatgccgagcacgccgaccagccgctcggcgtgcagcaacggcaggttcacccctggccgcaccccgcgcaggcaggcggcggcctgctcgtcgatttccaccacccgccggttggccagcaccagttgcgccccttcgtggcgggtatgcaggcgcgatggatcgccgctgccgatgatcatgccctgggcatccatcacattgatgttgtgcggcaggatcgccatcgcccgatcgacgatgtgctgcgccagcgtcgaatccagttcgaacatggaggactcagggcgccaggcgttcgcgcagccagccgccgtcctggcgtcgatagtcgagacggtcgtgcaggcggctcggccgcccctgccagaactcgatgcgctgcggcaggagacggtagccgccccagtgctcgggacagctcggcggctggtcggcgaaacgccgctcggtgtccgcgagcagccgttccagctcggcgcgatcggcgatga

SEQ ID NO: 2929 - DNA, 711 bp, Pseudomonas aeruginosa
acgaaaacgggggcttcgacgcccccgttctgctccgcgccgcctgcgtcattcgcgcttgatgaggatttccacccggcgattctcggcccgcccttcgcgagtcttgttgtcggcgaccggctggctttcgcccaatccctgcacgccgacgatgatgctcgaaggcaccccggcatcaatcagatagttcgcaacggcattcgcgcgccgttccgacagcttctggttgtaggcatcggaaccgacgctgtcggtatgcccggtgatactcaggcgcgtactggccgcctcgcctttcaggcgttcggcgatgccgttgagcttctcgctgtcggcggcgtccaccttcgacgaatcgaaggcgaagtgcaggtcgcgcacgacaatggtttcttccttgacgacgggaggcggcggcgcgacttcctcgaccggctgcggaggcggcggcgcgacctgttcgccggcaccgtgcacccagcaataggcggcaccgacgccaccgccgatcagggcgccccagccggcccagctgctgctttcgatcgcgcccaggccggcgccggtaacacaccaccgaccgccgcacaggtcggccagtcgcttttctgcaaccctgcgcaaccggtcagcaagccgctgaccagaatcaggggtaaagcggtcctcgtgatgctcattggaactctcctcgtggatcggttgtaa

SEQ ID NO: 2930 - DNA, 528 bp, Pseudomonas aeruginosa
tcttggcgaatcccaggagagtgttttcccatgagcgaaccgatttctccccgcaccccgcagcaggccctggccgcgttgctcgcccgctacgcgccgaagcgcttgctgctggtcggcgccagccggctgccggcggtggaggccttcatccacaaccatccccagtgccaactggcgcacagcccggcggcggcattgcccgccgaactggccggccagcgcttcgacctggcgctgttcgtcgattgcctggaacacctgccgcagcgcaccggtctgcagttgctcgcgggcgtgcgcaacctgaacgccagccgggtcgccgtactggtcgacctcgaggccagcgactggcaggaaaccgacttcttcgccctcgccatgcagaacagcgaacgcttccagcgcgaaggccagacgctgaccctgtacacctacgacctgtacgaatacaagcaggtccccgattggctgaacgccaagttctgggccaacccggaaaacttcggcaagtactggtggtaa

SEQ ID NO: 2931 - DNA, 546 bp, Pseudomonas aeruginosa
gttgcagcacaatcactgcttgttaaactggggcgtctcggggggaatagcatgaattaccaggcgcaaatgataagaattatcagcctaataatggcgtggggagttctctcccatctctcgggctgcagctggatgaccggcagcttcgaagaccccgacgtcaagctgctgaaggtggaagtggtcaaggcacgcttgctggaacaggagttcgtgatgcgcttccgcatcgacaaccccaacgatttcagcctgccggtacgcggcctgcagtacgccgtgcaactgaacgacatccagctcgcagaaggcgagtccggccagtggttcacggttcccgcccacggccacgaggtattcgacgtgccggtgcgaaccaatctctggcgccacatgaaatacatcgtcaagctccttgagcgtcccgaggagccgatccgctaccgcctgcagggcgaagtgaagaccggactgatgttcggccgcagcgtgcacctgagacgaaatggcgagataattcccggcgatttcatcccagaatag

SEQ ID NO: 2932 - DNA, 591 bp, Pseudomonas aeruginosa
aggtgtcgccgaacaacaagattcccgccatcgtcgatcgccaaccggccgacggcggcgctcccctgtcgctgttcgagtccggcgccatcctgctctatctcgcggaaaagaccggacgcttcctcgccaaggacctgcgcgcgcgccaggaaaccctgcagtggctgttctggcagatgggcgggctggggccgatggcagggcagaaccaccatttcaaccgcttcgccccggagaagattccctacgccatcgaccggtacgtcaaggaaaccgcgcgcctgtacggcgttctcgaccagcgcctggcggaccgcgccttcgtcgccggcgacgactacagcatcgccgacatggccatctatccgtggatcgtcccgcaccagtggcaggagcaggatctcgccgacttcccgcacctgcagcgctggttcgagagcattcgccagcgtccggcgacgcaacgcgcctatgctttggtggagcgcatcaatccgccgaagtagcgagtcccgagccggcctgcggacgtcctcgcggacgaccgcaggcggagcttgcgcagccctgcgctcctcactaacgtag

SEQ ID NO: 2933 - DNA, 3876 bp, Pseudomonas aeruginosa
cgcgctgttcgccctgggctacgtacacgcctccgaccgcctgagccagatggtcagcctgcgcctgctggcccagggacggctggccgagatggtcggccccggcgcgctggagatcgaccgtttcatgcgtaccgtgaacctgcgccaggccgcggagatccagtacaggaacgcctcgccgcgcctgcaacgcttcttcgaggtctacgcgcgcggggtcaacgcctacctgtatcgctatcgcgacaagctgccgatggacctggcccagtccggctaccgtccggaatactggaagcccgaggactcggccctggtcttcgccctgctcaacttcggcctggcggtgaacctgcaggaagaaatcgcctcgctgacgctcgcgcagaaggtcggcagcgacaagctggcctggctgacgccgacctatcccgacgaaaacctgccgttcgacgaggcggaaaagctcaagggcctgcgcctggacgggcaggttcccggcctcgcgggcgtcgagggcgcggcgcggcaggtcgcagcgctgagcatgctcggggtcgccgcctcgaacaactgggctatcgcgccgcaacgcagccgcagcggcaagagcctgatggccaacgacacccacctgccgctgagcatgccgtcggtgtggaactacgtgcagatccgctcgcccaagtaccaggccgcgggcgtttccatcgccggtctgccgggcgtggtggcgggcttcaacggcaagctggcctggggcatgaccatggtcctgggcgacaatcaggatctctacctggaacagctgcgacgccagggcaaccggctctattacctggccgacggcaagtggcagccaacccgcgaacgccaggaaaccttcttcatcaagggccagcggccgatccgcgaggtcatccacgaaacccgccatggcccgctgctcaacagcgccctgggcgagcgcaagaacatcctccagccgctgccgctgaagagcggctacggactggcctaccggagcatccagcaggaagccgacaagaccctggacggcttcttcgacctgtcgcgggccaagaccatcgagcaggccttcgacgccacccgcgagattcgcgcgatgccgctgaacatcgtgttcgccgacgaaaagcacatcggctggcaggtcaccggacgctatccgaaccgcaaggaaggtcgtggcctgctgccctcccctggctgggacagccgctacgactgggatggctatgccgacccgatcctccacccgtccgaccaggacccgcagcggggctggctgggtaccgccaaccaccgcaccgtgcagcccggctacggcgcccagttgtccaattcctggtactacccggagcgcgccgagcgcatcgcccagctcgccggtgccagcaagagccacgacacccagagcatgatccgcatgcagtacgaccagacctcgctgttcgtcgccaagttgcaagccatgttcgacaatcccggcatggcgctgccgctgcgccaggccatcgacgccttgccggaggcgcaacgcagccgggcgcgggaggcctacgaccggctgatggcgttcgacggcaagctgacagccagctccagcgacgccgcgctgtacggcgccttcctccacgagagcgccaggcagatattcctcgacgagctaggaccggaggacggccctgcctggaaagccttcgtcgagaccgccaacctctcctactcggcgcaagccgaccacctgctcgggcgcgacgacagtccgttctgggacgatacccgcactccgcagaaggaggacaagccggcaatcctcgcgcgcagcctcgccgccgccgtggagttctgcgaacagcgactggggagcgagcgcaaggcctggcaatggggcaagctgcacacctacgaatggcagagcgacagctcgaaaatggccccctacctgggcgccggcgagcgcgccggactcggcgcgatcaagggctatctcgatcgcggaccctatccggccggcggcgaccacaccacgctggacgtatcggcctacggctggggccaggacttcgacacttggctgatcccggcgatgcggctgatcgtcgacttcggccagagcgaaccgatgatcggcgtgaacagcagcggccaatccggcaatccggccagcccgcactacgccgacggtatcgacgcctggctcaaggggcgctacgtcagcttcccgttccagccacagaacctcgagcgcgtttacggcaacaagcggctgacgctcactcccgctcgctgaacggacggcgcggaacttttcctccgcgccgtggctctgaacagccgacttactccatgatcatcttcagggcgtccttccggacgcccttcttttatccccctcccggaaagcctccgttttctcgaaagcccgggcacgggatcgaaccgatctcactcctctccggcctcttccacgggcgccaccagcgcccggtccagccagtccgtcggcaggctcttgctggcgcgggcaccgagcagcttgagttgctcgctgcgactgatcaggttgccacgtccctcggtgagcttgttgcgcgccgcggcataggccttgtccagttgctgcaggcgcgaaccgacctcatcgaggtcctgaacgaagagcacgaacttgtcatacagcgaaccggcacgttcggcgatttcccgcgcattctggttctgccgctcctggcgccagaggctgtcgattacccgcagggtggccagcagggtggtcgggctgacgatcacgatattctgcgcgaaggcgtcctggaacaggttcggctcggcctgcagagccgtcgagaaagccgcctcgatcggcatgaacagcaggacgaagtcgaggctgtgcaatccttccaggcgtcgatagtccttgccggagaggcctttcacatggttgcgcaacgacgttacgtgctgcttcagcgcctgctggcgcagcagatcgtcgtcagcggcgatgtactgctggtaggccgtgagactgaccttggcatccaccaccacctgcttgtcgccgggcaggcggatcagcacgtccggctggaagcgttcgccctcggcacccttcaggctgacctgggtctcgtattcccggcctttttccaggcctgcatgctcgagcacccgctccagcaccagttcgccccagttgccctgggtcttctggcccttgagcgcgcgggtcaggttggtcgcttcctcgcccaggcgcaggttgagctgctgcagacgctccagttccttgctcagggagaaacgctcgcgcgcttcctgctggtagctttcctccacccgcttctcgaacgcctggatgcgctccttcagtggatcgagcatctgccccaggcgctgctggctggtctcggcgaaacgctgttcgcgttcgtcgaagatctttcccgccagttcggcgaactgtgcccgcaactcgtcgcgggccgactgcaggtcggtcaggcgctgctggtggctttcctgctgctcgcgaagttccgcagccagcgcagcccgttcggaagccaggcgacgcacttcctcttcccggccctggcgctcgctggcccaacgtgcctccgccagggacgcccgttgccgctcctcccccatcaactcggcttcccgacgcagcgcggcgacctcgccggagagcctggcatggcgctcgccgagttgctggtaagcctccctactggtctccaactgcgcattcagcccgtcctgggccagttgcgcggtcgccagtcgctcgccgagcaacgccatctcgcgctccgccaggctggcccttctctgtag

SEQ ID NO: 2934 - DNA, 738 bp, Pseudomonas aeruginosa
ggaggcttaccagcaactcggcgagcgccatgccaggctctccggcgaggtcgccgcgctgcgtcgggaagccgagttgatgggggaggagcggcaacgggcgtccctggcggaggcacgttgggccagcgagcgccagggccgggaagaggaagtgcgtcgcctggcttccgaacgggctgcgctggctgcggaacttcgcgagcagcaggaaagccaccagcagcgcctgaccgacctgcagtcggcccgcgacgagttgcgggcacagttcgccgaactggcgggaaagatcttcgacgaacgcgaacagcgtttcgccgagaccagccagcagcgcctggggcagatgctcgatccactgaaggagcgcatccaggcgttcgagaagcgggtggaggaaagctaccagcaggaagcgcgcgagcgtttctccctgagcaaggaactggagcgtctgcagcagctcaacctgcgcctgggcgaggaagcgaccaacctgacccgcgcgctcaagggccagaagacccagggcaactggggcgaactggtgctggagcgggtgctcgagcatgcaggcctggaaaaaggccgggaatacgagacccaggtcagcctgaagggtgccgagggcgaacgcttccagccggacgtgctgatccgcctgcccggcgacaagcaggtggtggtggatgccaaggtcagtctcacggcctaccagcagtacatcgccgctga

SEQ ID NO: 2935 - DNA, 2076 bp, Pseudomonas aeruginosa
ctcgtcgaggaatatctgcctggcgctctcgtggaggaaggcgccgtacagcgcggcgtcgctggagctggctgtcagcttgccgtcgaacgccatcagccggtcgtaggcctcccgcgcccggctgcgttgcgcctccggcaaggcgtcgatggcctggcgcagcggcagcgccatgccgggattgtcgaacatggcttgcaacttggcgacgaacagcgaggtctggtcgtactgcatgcggatcatgctctgggtgtcgtggctcttgctggcaccggcgagctgggcgatgcgctcggcgcgctccgggtagtaccaggaattggacaactgggcgccgtagccgggctgcacggtgcggtggttggcggtacccagccagccccgctgcgggtcctggtcggacgggtggaggatcgggtcggcatagccatcccagtcgtagcggctgtcccagccaggggagggcagcaggccacgaccttccttgcggttcggatagcgtccggtgacctgccagccgatgtgcttttcgtcggcgaacacgatgttcagcggcatcgcgcgaatctcgcgggtggcgtcgaaggcctgctcgatggtcttggcccgcgacaggtcgaagaagccgtccagggtcttgtcggcttcctgctggatgctccggtaggccagtccgtagccgctcttcagcggcagcggctggaggatgttcttgcgctcgcccagggcgctgttgagcagcgggccatggcgggtttcgtggatgacctcgcggatcggccgctggcccttgatgaagaaggtttcctggcgttcgcgggttggctgccacttgccgtcggccaggtaatagagccggttgccctggcgtcgcagctgttccaggtagagatcctgattgtcgcccaggaccatggtcatgccccaggccagcttgccgttgaagcccgccaccacgcccggcagaccggcgatggaaacgcccgcggcctggtacttgggcgagcggatctgcacgtagttccacaccgacggcatgctcagcggcaggtgggtgtcgttggccatcaggctcttgccgctgcggctgcgttgcggcgcgatagcccagttgttcgaggcggcgaccccgagcatgctcagcgctgcgacctgccgcgccgcgccctcgacgcccgcgaggccgggaacctgcccgtccaggcgcaggcccttgagcttttccgcctcgtcgaacggcaggttttcgtcgggataggtcggcgtcagccaggccagcttgtcgctgccgaccttctgcgcgagcgtcagcgaggcgatttcttcctgcaggttcaccgccaggccgaagttgagcagggcgaagaccagggccgagtcctcgggcttccagtattccggacggtagccggactgggccaggtccatcggcagcttgtcgcgatagcgatacaggtaggcgttgaccccgcgcgcgtagacctcgaagaagcgttgcaggcgcggcgaggcgttcctgtactggatctccgcggcctggcgcaggttcacggtacgcatgaaacggtcgatctccagcgcgccggggccgaccatctcggccagccgtccctgggccagcaggcgcaggctgaccatctggctcaggcggtcggaggcgtgtacgtagcccagggcgaacagcgcgtcatggaaggtgccggtttcgatcagtggcatgcccagcgcgttgcgccggatcgatacgttttgcgccaggcccttgatcggttgtacgccggaggtcggcggcaggctgtcggcgtagcgatcgtcgagccaggactggcaaccggccaggcccaggagggtgccgaaggccgcggcggcgccgcaacggggaagaaaacgcatgaaggctggcgaggccatggggtgggggctcctgcgggagtggtcgcgtcgagaggcgctacgttagtgaggagcgcagggctgcgcaagctccgcctgcggtcgtccgcgaggacgtccgcaggccggctcgggactcgctacttcggcggattgatgcgctccaccaaagcatag

SEQ ID NO: 2936 - DNA, 687 bp, Pseudomonas aeruginosa
cctgaacggacccgccggccgatttgccggacccagtcactccacgcgtggctgtcgatgggtacaatcgctcgacgaaacgccagggccgccatgccgagcggcccttcactcggagagatgccaatgagccgctttgaaatcgccttttccggccagttggtcgccggcgcccgtcccgaggtggtcaaggccaacctggccaagctgttccaggccgacgcgcagcgtatcgaactgctgttctccggccgccgggtggtgatcaagaacaacctcgatgccgcctccgcggaaaaataccgcagcgtgctggagcgagcgggagcgatcgccgtggtcgccgagatggaggtcgaggaggtggtcatggcgccgccgcctgcgcagacgactcccgtggaggccccgcagacccgcgccgatactggtaccagcgcgcccgccggacgcttgcaggtagcgccgcgggacggctacatggcggcgttcgccgaggtcgatgcgccggatttcggcctggctccggtaggcgccgacctacaggacgccaaggccgaagccgaggcgccgaaactcgacctgagccgcttcagcgtcgccccggtcggtagcgacatgggccaggcacgctccgagccagcggctccggctccggacaccagccacctgcgcctgcaggactga

SEQ ID NO: 2937 - DNA, 252 bp, Pseudomonas aeruginosa
aggcctccaccgccggcagccggctggcgccgaccagcagcaagcgcttcggcgcgtagcgggcgagcaacgcggccagggcctgctgcggggtgcggggagaaatcggttcgctcatgggaaaacactctcctgggattcgccaagactagcctgaagcgcctgcatggcctagtgctggcgcttttttcggctggggtctttactccctatttgtcggttacaaccgatccacgaggagagttccaatga

SEQ ID NO: 2938 - DNA, 849 bp, Pseudomonas aeruginosa
gcccggccagcgagttaccgcaggacaaggaggacgatcatgcgtaaggccatgctcggattgttcctggtcgttcccctggcctgggctggcgccgcgttttcggccgaggcgccgccggcacgccagcagggtatcggcggaaccgtgaaggtgcaggcgaactcggtgatgcgcctgcccaagcgggcccaggagctgcgcctgcgcagagtggagatcggcgaggatgccgccctgctgattccgctggaggtcagcgtcctgcgcatcgaggaactgcacatggcgaagaacgcccggatcggcgtggcgccaggcgaggagcgaatcagcatcgaagtcgtcagcggccgcctggccgatggcagcatcatttccgcgcccggcgcgaccggcaccttccggcaaagcgccggtaacggccgcgacctgaccttgcgcctgcaggcggtggaggtggaaagcctgctgctggacgcccgcggtggcgtcggcgctccaggctacgatggcctggacggggcttccggcaaggcctccggctgcctctggggcagcgcgctgaaaggtggcgacggccaatccggaagcgacggcggtccgggcggggcgggcggtcggattcgtctggaagtgccgggcgattttcctctggagcgcttgcaaacccgtctgcaaggcggcgtcggcggcgctggaggcaaggccggcaaaccgggtgcggcggacaacgccaccggttgctggatctactcggtggatgccggtcgtgcggggcgcagcggagaggacggcgcgaacggcaccaacggcagcgacggcagcctggacgtcgtgcgcttctga

SEQ ID NO: 2939 - DNA, 567 bp, Pseudomonas aeruginosa
ccgccgacggcagccggacctacgtcgaaggacgcgagccgatgttcgccgaactgccggcggagggtgagccgctggccgcattcttcggtgagggcgacgaccgccgcggcgtcgccgcgcaggccgggcggcgcttcgggcatggccgctggttcgatttcctcggtgccaatcgccagcgcatcgctccccaggcgagtgccgaccagctcgccggcgaatggcgccagcgcaccctggagcgcctctcggcatggggtttcaacagcctcggcaactggagcgatccggcgctcgccgcacaggcgcggatgccctacagcctgccgctgtcgatcgccggcgactacgccacggtcagcagcggtttcgactggtggggacccatgcccgatcccttcgacccgcgcttcgccatggccgccgagcgcgtcatcgccatcgctgctcgcgaccaccgcgacgatccctggctgctcggctactacgccgacaacgaactggcctgggccgggcgcgacggctcggccctggcgcgctacggcctcgctttcggagccttga

SEQ ID NO: 2940 - DNA, 1455 bp, Pseudomonas aeruginosa
accaaccggccagcgggcgtctgctggacggcgagaacggccatatcggcctggtcgggatcacgggcttgccgttcgccggcttcgtcgacacggtgcgccgaagcaaccttgccgccctgtcgcgactgtcggcgatggccaggtccatgcctgccgtcgagcctctgccgccgcgcgaggattcagccggttcatgagcgcgcattcaccgccgcccgcttgcggcgaacccctcttatgtcagggttcacaaggccgccgagggctggaagaatgccccgaccactttcccaccggaacttgcccatgacgccccaaggccactgtgacagccgtttcgccccgcttgccgaggccttcgcccggcttttcgacaatccgcaggagcgcggcgcggcgttgtgcctggaggtcggtggcgagacggtggtcgacctctggggcggcgtcgcggacaaggacggcgagcagccctggcagcgcgacaccatcctcaatctgttctcctgcaccaagaccttcaccgccgttgccgtgctgcaactggtggccgagggcaagctcgaactggacgcgccggtggcacactactggcccgagttcgccgcggccggcaaggcagcgatcagcgtgcgccagttgctctgccatcgcgccggcctgccggcgctgcgcgagcagatgccgcccgaggcactctacgactggcaggcgatgaccacggcactggccgccgaggagccctggtggacgcctggcgaagcgcacggctatgcaccgattacctatggctggctgctcggcgaggtgatccgccgggtcgacggccgcgagccgggcgaggccatcgtggcgcgcaccgcggcaccgctgggcctggatttccatgtcggcctggacgacagccagttcggccgcgtcgcccacatggcacggagcaagggcagcctcggcgacgctgccgcccagcgcatgctgaagaccatgatgagcgagccattggcgctgaccacccgtgccttcaccaatccgccgtcgatcctcaccagcaccaacaagccggaatggcgacgcatgcagcagccggccgccaatggccatggcaacgcgcgcgcgctcgccggcttctatagcggcctgttgcagggacgtttgctggaagatgaactgctgggccagttggcccacgaacacgcggtaggcgaggatcggaccttgctgacccggacccgcttcggcctcggcaccatgctcgaccaaccgggcgtggccaatgcgacctacggactcggccccaaggccttcggccaccctggggcgggtggctcgatcggcttcgccgatcccgagcgcgacctggctttttcctttgtcagcaacgccttggggccgtatgtgctgatggatccgcgggcgcagcagctggcgcgtgtcgcgggggagtgtctgtaa

SEQ ID NO: 2941 - DNA, 1155 bp, Pseudomonas aeruginosa
cgagttcaccctcgaacgccgcgacaacgcattgatcgtcatcgcccccgccgactactcgttcaatcccaagcgccacaccatgctgatgccgatcaccctcaacccgctgggcaaggtcgccaagatggcccaggccgatccgcagagcggtatcctggtactcggccataccgacagcaccggcagcaaggcggtcaacgacaagctgagcttcgagcgtgcccagtcggtggcggcgatcttccgcctcagcggcctgaaaggcgaccaattgcgcctgaagggggtcggttccgacatgccgcgcgcggacaacgccagcgccgccggccgcgcccagaaccgtcgcgtcgaagtgctctatacccagcgcgccagcctgctgtccctggcccagggcaactgagccgaaccggggcagggcgcttggcgccattgtcccggatcaagcgcgaggcggagtctgcggttaagctatggcgcatttccccctggagatgcgccatgacccagtccctggccgatatgcgccgcgagtacacccgcgatggcctcagcgaggccaacgcccctagcgatcccttcagcctgttccgccagtggttcgacgacgcggtgaagaccgagcgcctgccggtcgaacccaacgccatgaccctggccaccgtcgacgccgacggctatccgcattgccgtatcctcctgctcaagggcctcgacgagcgcggcttcaccttcttcaccaactacgaaagcgccaagggccggcaactggcggccaatccgcgggcggccatgaccttcttctggccggcgctggagcgccaggtgcgcatcgaaggcagcgtcgagaaggtcactcccgaggaatccgacgcctactaccaggtgcgtccgctgggcagtcgcctgggcgcctgggcctcgccgcagagccgggtcatcgccgatcgcgccgagctggaacggctgctcgcggacaccgagcggcgtttcgccgaccagccgccgagctgtcccgagcactggggcggctaccgtctcctgccgcagcgcatcgagttctggcaggggcggccgagccgcctgcacgaccgtctcgactatcgacgccaggacggcggctggctgcgcgaacgcctggcgccctga

SEQ ID NO: 2942 - DNA, 723 bp, Pseudomonas aeruginosa
gtcctccatgttcgaactggattcgacgctggcgcagcacatcgtcgatcgggcgatggcgatcctgccgcacaacatcaatgtgatggatgcccagggcatgatcatcggcagcggcgatccatcgcgcctgcatacccgccacgaaggggcgcaactggtgctggccaaccggcgggtggtggaaatcgacgagcaggccgccgcctgcctgcgcggggtgcggccaggggtgaacctgccgttgctgcacgccgagcggctggtcggcgtgctcggcatcaccggcgcgccggaggtggtccggccctatgccgagctggtgcggatggcagcggaaatgctcatggaacagcgccagatgcaggacgagcgacactggcaacgccagcgtcacgaagcctggctgcgccagttgctcgatcccggccacggcctcggggcgctggcggccgatgccgaacacctggggctggccatgcactggccgcgccaggcggtcttcctggagctgcccgagcatgccgatccgctgccttgccaggctcgcctgctggcggcactcggcggccgggcggagcactggagcgcggcgctgggcgagcgcctggtgttctggtgccggccggtagcccacgcagatacgctcgagcactggctggagcgcgccgacgcgcgcggctggggcgtggcgcgcctgtgtgccggcgacccggcgcatga

SEQ ID NO: 2943 - DNA, 1680 bp, Pseudomonas aeruginosa
cgggcacgcccaggcctgtgcccaggcgctggggatccatcgcaacagcctgcgctaccgactggagcgcatcgcttcgatcagcgggctcgatctcgctcgcctggagcaccgccagcaattgttgctggggctgcaattgctcgttccgcgccgcgggtaacgggcgatcaatcgattcactgtgcagtcgcacaaaatgttccccttccagcgccgtcttcctctggccgttgcacaaggcgtgtccggtcccgacggagcgaaaatgacccgcccctgggcgcccatcccacacccataacaacaaggaggcggctcatgaccctggtcctgatcctgctggcgttgatcgcctttatcgtcctgtccaccacgcgactcaagctgcacccgttcctcgccctgctggcggccgcgctgatcgccggcttcgcctaccaggtacccacggcggaaatcgtcaagaccgttaccggcggcttcggcagcatcctcggctacatcggcatcgtcatcgtgctcggcaccatcatcggggtgatcctcgagcgcagcggtgcggcgatcaccatggcggaaagcgtgatccgcctgctcggcgaacgcttcccgaccctgaccatgtcgatcatcggctacctggtgtcgatcccggtgttctgcgattccggcttcgtcatcctcaactcgctgaagaacgccctggcggcgcggatgaagatatccaccatcgccatgagcgtggccctggccaccggtctctacgccacccacaccttcgtgccgccgaccccgggaccgatcgccgcggccggcaacctcggcctggacgccagccttggcctggtgatcgtggtcggcctggtggtcgccttcgtcaccgcgatggccggcatgtggtgggccaatcgcttcgtcggcaaggacattcccctggacgacgacggccaggtcgtccagaccgaagaggatttcagcgagctgcgtgcccgctacggcaagctgcccagcgcgacccaggcgttcgcgccgatcttcgtaccgatcctgttgatctgccttggctcggtcgcggtattcccgagcaagccgctgggcgagggcgtactgttcgcctgcctgaacttcctcggtcaaccggtgatcgccctgctggtcggcctggcgctggcctgcaccctgctcaaggaccagagcaagcgcgaggaattccatgagcgcgtggtggaaggcatccagtcggccgcgccgatcctgctgatcaccggcgccggcggcgccttcggtgcgatgctgaagatcactccgctcggcgactacctgggcagcaccctgtcagcgttgggcatcggcctgttcatgccgttcgtggtggcggccgcgctgaagaccgcacagggctcgaccaccgtggcgctggtcaccacctcggcgctggtcgctccgctgctgccgcagctcggcctggacagcgagatgggccgggtgctgacggtcatggcgatcggtgccggagcgatgacggtgtcccacgccaatgacagcttcttctgggtggtcacacagttcagccgcatgaccgtatccactgcctatcgcgcccagaccctggcgaccctggtccagggtatcgccggtatgctcgcggtatggctgctcagccttgtgctgctctga

SEQ ID NO: 2944 - DNA, 2805 bp, Pseudomonas aeruginosa
cccatgattctggcgctgatcatcgcgctgccgttcatgggggcgttgttgcccctgcttgccgagcgtggcggccgcaccttgtgcgcggcgtccgccggcgtggcgccgctgatcggcctgatcctgttgctcggacagcgcggcacggtgttcgccgggcagaccctgaccgccagctattcctggctgccggaaatcggcatcaacctcagcctgcgcctggacggcctcggtttcctcttcgccctgctgatcctcggcatcggcctgctggtgatcctctacgcccgctactacctctccgaacaggagccgatggggcgtttcttcgctttcctgctgctgttcatgggctccatgctcggcgtggtgctcgcggaaaatctcttgctgatgatgctcttctgggagctgaccagcctgtcctcgttcctgctcatcggcttctggggcagccgttccgacgcccgcaagggtgcgaggatggccctgaccgttaccggagggggcggcctggcgctgctggccggggtgctgctgctcggccacatcgccggcagcttcgaactcaccgaggtcctcgcggctggcgagctgatccgcgcccacgccctgtatccgctggtgctgatactgatcctgctcggcgtgtttaccaagtcggcgcagtttcccttccatttctggctgccccacgcgatggcggcgccgaccccggtttccgcgtacctgcactcggcgaccatggtcaaggccggcgtattcctgctggcccggctgtatccggcgctggccggcaccgagtggttcttctacctggtcagcctgagcggcctggtgacgctgttgctgggggccggcatggcactgttccagcatgacctgaaggggctgctggcctactcgacgatcagccacctgggcctgatcaccctgctgttcggcctcgactccccgctgtcgaacgtcgccgcggtgttccacatcatcaaccacgcgaccttcaaggcctcgctgttcatggccgccgggatcatcgaccacgagaccggcagccgcgacatgcgcctgatcaacgggatgtggaagtacctgccgcataccgcggtgctggccatcgtcgcctccctggcgatggccggggtgccgctgctgaacggcttcctcagcaaggagatgttcttcggcgaaaccctcagccagaacctgctgggcagcttcaactggctggtgccggcggtggcgaccctggccggcgtgttctcggtggcctattcgctgcgtttcatccacgacgtgttcttcaacggcgagccggcccggttgccgaagttcccgccccacgagccgccgcgctacatgaaggtaccggtggagatcctggtgttcctctgcctgttggtcggcatgctgccggtctacaccgtggcgccgctgctggccgccgccgccagtgccagccttggcgggcaactgccggaatacagcctggcgatctggcacggtttcaacctgccattgctgatgagcgtggtggcgctggttggcggtgtgctggtctatgtcctgcgcaagccgctgttcaactggtacgccgggttaccggaggtggacgccaagctggtcttcgagcagcaggtgcaacgtgtggtggccctggccgcgcgcctgaccgcctggctggagaacgggtcgctgcagcgctacctggcctggctgctgggcgcggcgctggtcgtggtggcggtcgagctggcaccgctggcgaggctgaccggctcgcgcgggctgaccccgctggacggtatcaccgccctgggcatgctggtgctggccttcagcggcctggccacggcgctgttccatcgtatgcgcctggtcgcgctattgatcctcagcgtcgccggcctgctggtggccctggccttcgctcgcttctcggccccggacctggcgctgacccagttgtcggtggaagtggtgaccatggtcctgctgatgctggcgctgtatttcctgccctcgcgcactccggcggagtcctccaccctgcgcggcttgcgcgacgtggcgctggccggcggggtcggcatgctggtggcgctgctggcctacgcggtgctgacccggccctacgagagcatcgccggattcttcgtcgagaacagcgtctccgggggcggcggctacaacgtggtcaacgtcatcctggtggacttccgtggtttcgataccctcggcgagatcagcgtgctggcgatcgccggcgtcggcatctacgcgatgctcgccggtttcgccctgcacaagccgacctgcgacccgcagggtcgcaactgggcccacgccaagcacccgctgatcctggaaaccctgtcgcgggtgctgctgccgctggcgttgctgatctcggtgttcatcttcctgcgcggccacaacctgccgggcggaggtttcatcgccggcctggtgactgccatcgccctggtgctgcagtacatcgccagcggctcgcagtgggtcgagcagcgcctgccgctgaactatgcggccatggctggcgccggagtgctgatcgccgggctcaccgggctcggcagctggctgttcggctatccgttcctgacttccgcgttcggccacttcgagttgccgctgatcggcgagatcgagctggccacggcgatgctgttcgacctcggcgtgtacctcaccgtggtcggtgccgcgctgctgatcctgtcctacctcggcaagctcagcctgatgcctgaacccgtcgcacaagaggaggcgctctga

SEQ ID NO: 2945 - DNA, 1362 bp, Pseudomonas aeruginosa
atggacgcccggacgaggaggagccgcgcccatgagccattggctgatcctgccgatcctgctccccctgtttgccggcagcctgctgctgttgccgctggccgagcgctggcagcgcggcctgtcgttgctcgcggcgctggcactgatccccctgagcctgctgctgatacgtacggccgccagcggcgacctgagcgtctatgccctgggcaactgggccgcgccgttcggcatcgtgctcatgctcgatcgtctcgccgccctgatgctgctggccaccgcggtgctcggcagcgccgcgctgatctacgcgctgcgtggcgacgaccgcctgggcaagcatttccacgcgttgttccagttccagctgctcggtatcaacggcgccttcctgaccggcgacctgttcaacctgttcgtgttcttcgagatactcctgatcgcctcctacgcgttgctcctgcatggcggcggcgcggagcgggtgcgctcgggcttgcactacgtgatcctaaacctggtcggctcggcgttcttcctgatcgccgtgggtaccctgtatggcctcaccggcaccctgaacatgtccgacatggcgcagaagatcgccatggcagatgccgagcgcgcgccgctgctggcggcagccgggctcctgctgctggtggtgttcgccctgaaggcggcgctgttgccgctgtacttctggctgccgcgcgcctatgccgcggccagcgcgccggtggcggcgctgttcgcgatcatgaccaaggtcggcatctactcgatcctgcgggtctacacgctggtcttcggcgatgccgccggcgagctggccaacctggcgcaggcctggctctggccgctggccctggcgacccttggcctgggcgcgatcggtgccttggcggcgcggaccctgcaaagcctgctggcctacctggtggtggtctccgccggaaccctcctggctggcgtggcgttgggcagcgagcgggcgctggcggcgtcgctgtactacctgctgcacagtacctggatcgccggtggcctgttcctgctcgccgacctggtcgcccgccagcgcggcgacaaggccggcgacctggtccagggcccggcgttgcagaatcctcggttgctcggcggggctttcttcatcggcgccatcgccgttgccggtctgccgccattgtcggggttcttcggcaaggtcatgcttttgcagtcggtcgctcccggcagccaggcgctggccctatggagcgtggtactgggcagcggcctggtggcgctggtggcgttgagccgggccggcagcacgctgttctggcgcaccgggcataccgtgctcggtag

SEQ ID NO: 2946 - DNA, 690 bp, Pseudomonas aeruginosa
cgccgaactggaccacggccgcttgttcgcctgcatcctgttgctctccgccggcccgttgctggtgttcgccgcgaagccgctgctggcctacgtccaggccaccgcggcgcagttgcacgacctcgacctgtatcgccagatcatcacccgcggaggtaccgcatgatcagccgttcgttgccgcgtccgcttcttcgcgtactgcctcatcccgtgcttagtgtcctgctgttgctggtctggttgctgctggtggattccttcgccattggccactggctgctcggcgccttcctcggcgtgtgcattccgctgctgaccaaccgcctgctggtcgggcgcagccaggagtggcatccgttgctgctgctgaagctgctggcgctggtgatgtgggacatactcgtcgccaacatccaggtcgcccgcctgaccctcggaccgatcgagcgcttgcgtccggccttcgtcgaggtgccgatcgagctggagaacgacctcgccatcagcgtgctggtgagcatcgtctcgctgaccccggggtcggtgtcgtcggacctcagcgacgaccgcaagaccttgctggtgcacggcctcgacgtgccggacaaggcggcgctgatcgccgagatcaagcaacgctacgaagcgccgctgaaggagatcttcccatgctcgcttacgtga

SEQ ID NO: 2947 - DNA, 1113 bp, Pseudomonas aeruginosa
  unsure (765): Identity of nucleotide at the above locations are unknown.
actgaaggagtttccatgaccgtcgaccaccgccaatgggcccgcgaggcgatccgcatcatcgaagcggatttccagcgcagcgccgatacccatttgatccccctggagactcccggcctgcctggcgtcgaactgtacttcaaggacgagtccagccaccccaccggcagcctcaagcatcgcctggcgcgctcgctgttcctctatgcgctgtgcaacggctggctcaggccggccgcgccggtgatcgaggcatcgagcggttccacggcgatttccgaagcctatttcgcacgcctgctgggcctgcccttcatcgccgtgatgccggccagcacctcgaaggaaaagatcgcccagatcgccttctacggcggccagagccacctggtggaggaccccacccagatctacgccgagtccgaacgcctggcgcgggagagcggtggccatttcatggaccagttcacctatgccgagcgcgccaccgactggcgggcgaacaacaacatcgccgaatcgatcttccagcagatgcgccacgagccgtacccgaccccgacctggctgatctccagccccggtaccggcggcaccctggcgaccctcggccgctacgtgcgctatcgccagcactgcacccgggtactctgcgccgacgccgagcgttcggtgttcttcgacgcctatgtcagcggcgaccgtggcctgaccctggattgcggttcgcggatcgagggcatcggccggccgcgggtccangcgtccttcctgccggaagtgatcgacgcgatggtcaaggtgccggacgcctggtcgctggcggccatgcattacctggcccgacgcctggggcggcgggtcggcggctccagcggaaccaacctgatcggcgccctggtggccgcacggcaaatggtcgcggccggcgagaagggttcgctggtggcgattctctgcgacggcggcgaacgctatgcgaccacctattacgatccggtctggctggccaggcagggctatgcgctggaacccctggtcgaggcgctggctgcctgcatcgagcggggcgtggcgttgcccgacgggctgctggtggctggactttga

SEQ ID NO: 2948 - DNA, 891 bp, Pseudomonas aeruginosa
ggacatgcaaagcagctttccgcaatcgaacactccccagatccgtcgcgctggagtcgacctcaacggcgtgatgtcggtgctcagcaagcacctctattccacgcccaccgtggcgttgcgcgagctggtgcagaacgcccacgactcgatcctccgtcgccgcctggagcagcccgactggcaagggccgtcgcgaatcgaggtgatcggcgacagtgccagcaacaccgtgcgcatcgtcgacaccggcgccgggctcaccgagcacgaaatccacgcctacctggccaccgtcggcgtcggctacacccgcggactgcgccagtccggccacgaggacagcgggctgatcggcatgttcggcctgggcttcctctccgctttcgtcctggcccgccgggtcagcgtgcggaccacgtcctaccagcagccggaactgggcttctgctacgtctccagcaacgccgagcaatacagcgtgacgccgatgccggcgcgcccggtaggcaccgagatcaccctcgaactgcaggacgaatacagtgcgctgacccaggccgcgcgcctgcgcgagatcctcgaacgctactgcgtgctgctgcgcgagccgatccacgtcggcggcgacgcccagtcgatcaacccggagccgccgccgtggcggctggccgccgacgccgcgctgcacccgctgcaacggcagcgccgcgacctggagttcgccgcacgcttcgagcacgacttcgagccgatctgctgcctgccggtgcgcccggacgagcgggtcgacgtgcagggcctgctgtggatccaggacggcggcacctatggcaccagcgacaaccgcaatctctcggttttcctccgcggcatgctgctcgacgatga

SEQ ID NO: 2949 - DNA, 939 bp, Pseudomonas aeruginosa
cgaccattacgcggcgatccagcatgcgctggccgaggcgctgatcgccgggctcggcgaggtggcgcggcagcagccggaggcctggcggcgggtcctgctgcggcacaacgaggccctgctgggagcggcgttgtgcgacgagcgtctgttcgcgctgatgatggacagcctgcgcgtacccacctcccagggcgacctcccggcttccgaactcctttcgcgcggagcggtgcatgtgctgctggacaacgacagcggcttcgaggaaatgctgttccgtgccatgggcgtaccggtggcccatggcaatcgctatgcggtggtacccttcctccgtcgctgggcgcaggccaaggggatgcgcctggtggagctgggcaccgagcagggcaaccgccagttgttccgcctcgaccgactgcccgagcgcgagaccggctggctggccgaacacctgggcggcgccgaggagcaactggtgatcgcccgcttcagccccgaggaattgccgcttgtgatggtgcccgaccgcgacgccgaactcaagcggcgactggaggacgacgaggccgacaagcgtatttccaccgcggcgttgcgcctggcccggcagttcacccgcaagctcgacaatcgccagccgagccggctctacgtcaacctcgacaatccggcggtgcaggcgctgctcgcggccgtcggcgaggaacgcgacgaagcggcccatgcggcgttgctgctgcgctcgttcaaagtgatcatcgccggacagggacgcggccagcccgcgacctcgctgaaccaggccctggccggactcgccgattcggtgaagcgcctgctggggcaataagaaaattcgcaacacgcctgatggagactgaagcatatggatatctggaactgggtggagaagctccgcgccgacctgcgtga

SEQ ID NO: 2950 - DNA, 492 bp, Pseudomonas aeruginosa
ctgggtggtgttcgacgccggcctgatctatccggctccggaagacgaggaggagcgcaagcgtttcgttcccacctatgcggtggtgcacgtcctcgagagcggtggttactcgccgagctggctggtggacggcgtctatccgggcgacgaggccttcgacgccttccgcgaaacgctcgacgcgcgcggctggaaggtctgggtgcacagcaaccgcgactaccaggtcaccgatgccagcagcggcgaggaactgcgggcgatctacttcaccgtcgcgacacccgcgcagcaggcgccgcgcgacctgcaccaggcgttgcaggaggccaccgggcaatggccgcaccgcatgtgctggctgcgcctggcggaagcggcggaggtcgacacccagccgcacctggacgctatcgagcgctacggcctgtagccggtacgcctcggcataaaaaaacggcccgtgagggccgttttcgtatgcgctga

SEQ ID NO: 2951 - DNA, 858 bp, Pseudomonas aeruginosa
cggccagcaggccgccgaagcgcatggtcaggccgctcacttcgagaatcggtcggctcatggcttcagctccaggtgcgggcgttgcatcggcagcagtccctggggacgccagatcatcatcacgatcatggtcaggccgaagatcagcatgcggtattcgttgaacccgcgcatttcctggagcagcaccatcaccaccgcggcgagtatcacgccgagctgcgaacccatgccgccgagcacgacgatcgcaaggatcatcgccgactcgatgaaggtgaaggactcaggcgtcaccaggccctggcgggcggcgaagaagctgccggcgaaaccggcgaagctggcaccgatggtgaaggcggagagcttgacgatggtcgggttgagaccgagagcgcggcaggccacttcgtcctcgcgcagcgcttcccaggcgcgaccgatcggcatgcgcatcagccggttgatcacgaacagggccagcagcaccagcagcagggccaccacgtagagcaggatgaccttgtagttggtgttgtaggcgatgccgaagaactcgtggaaggtctgcatgccttccggcgcgcggcgttcgaaggtcaggccgaacagggtcggcttggggatcgagccgatgccgttggggccgccggtgatctcggtcatgttgcgcagcaggatgcggatgatctcgccgaagccgagggtcacgatcgccaggtagtcgccgcgcaggcgcagcaccgggaagccgaggaaagaaagccgaacagcgcggccatcatcccggcgatcggcagggcggtccaaaagccgaacccggcgtactcggcgagcagcgcgtatgtgtag

SEQ ID NO: 2952 - DNA, 1320 bp, Pseudomonas aeruginosa
acgttcggctcgcgggtgtggggccggaacgctgctgagacccgtcacgatccggcgcgcggcgggccggcgggaggcaggggaaagccgcgctcccgtccaccaggagtgaacgctgccggtcttcgcctgcccttgccgggccgccgctcgcggaatcatgcgggtactaaaacaaagcccacggtgggtgacgtgggctccgtactgcaacgatgcttacttgacctcggtccgggtggcgtccttgtgccactcgtagacggtgaagtcgaagttcttcaggtcgcccttctcgtcgaacccgaggttcccggtgggagtctcgaaggtgttggcgcgcagggcctcggcgaccttctccggatcggcctcgccggctttctcgatgcccttggcgatcactgtgaccgcggagtaggcgggcaggacgaagatgccgctcggatcctggttcttcgccttgaaggcgtcgatcagggccttgttcttcggatcctgctcgaaggcgcgcggcagggtcgccagcatgccttccgaagcgtcgccggcgatcgcggtgatttcgctgttgccgaccccttccgggcccatgaagcgcgcgtccagcccggcctgcttggcctggcgcagcagcaggcccatttctgggtggtagccgccgaagtagacgaactgcacgccggctttcttcagcttgctgatcagcgcgttgaagtccttgtcgccggcgttcaggccttcgaagacggcaaccttgatgccggcgtcttccacggtcttcttcacctcggtggcgatgccttcgccgtactgctgcttgtcgtgcagtaccgcgatggtcttgtccttgtagcgttcggcgatgaacttgccggccaccgggccctgcatgttgtccaggccgatggtgcggaagatcagcttgtagccgcgcgaggtgatttccggggcggtggccgacggggtgatcatcagcacgccttcgtcttcgtaaatgtcggtggcgggttgggtggagctggagcagacatggccgaccacgaacttgacgccgtcgttgaccaccttgttggcgaccgccacggcctgcttgggatcgcaggcgtcgtcgtagatcacgccttcgagttgcgcgccgttcacgccgcctgccttgttgatctgttcgattgccatcagcgcaccggcgcgctgcatgtcgccgtactgggctaccggaccggtgaccgggccagccagggcgatcttgatggtgtcggcggccatggagtagctggcgaacccggcaatggccatcgcggcgaacaggcgggatag

SEQ ID NO: 2953 - DNA, 897 bp, Pseudomonas aeruginosa
agtgttggcgacgaaagccacaccggcaaacaggttcgcagccatgagcatcagtttcgacagagcactcggtatccaccagcaggccctcagcttccgcgcccagcgcgccgaagtgctggccaacaacctggccaacgccgataccccgaactacaaggctcgcgacctggacttcgccgcggttctcgccgagcagaaggacaaggccgccaagggtaccttcgccatccgcaccaccaacgagcggcatatcgccgccgaaggtttcggcatgggcgagggcagcctgcagtaccgcatcccggtccagccgtcgatcgaccagaacactgtcgacgcccagatcgagcaggccaactacgccgagaacgccatgcacttccaggcgtccttcaccttcctcaacagcaaattcaaagggctggtcagcgccctgcgtggagagtaaccgccatgtccctcgccagtgtcttcaacattgccggtagcggcatgagcgcccagagcacccgcctgaacaccgtggccagcaacatcgccaacgccgagacggtttcctccagcgtcgacaagacctaccgcgcccgccatccggtgttctccaccatgttccagcaggcccagggcgacagcggctcgctgttcgccgaccaggacagctccggcgccggcgtgcaggtgctgggcatcgtcgaggaccagagttcgctgatgccgcgctacgagccgaaccatccggccgcggatgccaacggctacgtgtattaccccaatgtgaacgtggtcgaggaaatggccgacatgatttccgccagccgtgccttccagaccaacgcggaaatgatgaataccgccaaacagatgatgcagaaggtcctgaccctgggtcagtga

SEQ ID NO: 2954 - DNA, 717 bp, Pseudomonas aeruginosa
agcatgagcatcgataacgtcagcggcaccagcagcaacaccggcaacgtcaacggcagcaagcgcgccgccggcagcggcgccaccgagaccgggcagagcgtcaagggcagcagcaaccttggcaaggacgaattcctcaagctgctggtggcccagttgaagaaccaggacccgatgtcgccgcagcagaacggcgagttcatcgcccaactggcccagttcagcaccgtggaaggcgtgcagtcgctgaacaagagcatggagagcattctctccaactaccagtcgtcgcaggccctgcaagcctcgtcgctggtggggcgcaaggtcatcgtggcgaccgacaagtcggtggtggacaccaaggacaccttcaaggcgtccctcaacctgccggtctccagcagcaacgtatgggtcaacgtctacgacgacaagggcaccgtggtcaatcgcatcaacctcggccagcaggctgccggcagcgtcagcttcatgtgggacggcaaggacagcagcggcaacatcatgccgccgggcacctacaagttcgaggcgcagacctcgatcgacggcaagacctacgggctccagacctacctgccggccaacgtcgacagcgtcaccctggggcagaacggcggcgagctgatgctcaacctcgcaggcctgggcagcatcgcgctgtccaaagtacagatcatcggccagtaa

SEQ ID NO: 2955 - DNA, 1416 bp, Pseudomonas aeruginosa
gccggcgtttccggcaaggagctatccatgagtttcaacatcggcctgagcggcatccaggcggcctctagcggcctgaacgtcaccggcaacaacatcgccaacgccggcaccgtaggcttcaagcaatcccgcgcggagttcgccgacgtctacgccgcctcggtgctgggttcgggcagcaacccgcagggcagcggcgtgctgctctcggacgtctcgcagatgttcaagcagggcaacatcgactcgaccaacagcgtgctggacctggccatcaacggcaacggcttcttcgtcaccagcaacaacggggcgatcagctacacccgcgccggctacttcaataccgacaagcaggatttcatcgtcgacaacaacggctaccgcctgcagggctatgccgtcgggccgaacggccagttgcagaacggcgtggtcaccgacctcaaggtcgagcgcgccaatcaggcgccgcaggccacctcgagcatccagcagtcgtacaacctcaactcgacgctgaagccgccgaccgtgacgccgttcgatccgtccgacgccgctacctacaactcgtcctcttcgctgggcatctatgacagccagggcaactcccacaccatgagccagttcttcatcaagaacgagccggacccgaatgcgaccccgccgattccggagaacagctggaccatgaaagtgctgatcgacggcgtcaatccgctcgatccgtcgaacaagacgccgatgagcttcaacgtcaccttcgacgccagcggccagatgacctcggttcgggcgccggacggcagcaccagcgggccgggcttcagcatcgacgcgaccaccaacgtgatccagttcagtccggccaccggcaatccgccgactcccggcaccggctggattccggcggcctcggacggcaagaccccgccgacctacgcctggaatggcgcgaccggtgccgccagcggcatctccttcgacatgcgcaagaccacccagtactccaccgcgttcgcccagagcaacccgatccaggacggctacaccaccggtcagctggcaggcctggaaatcgacgacaccggggtgatcttcgcccgctacaccaatggccagtccaaggtgcagggccaggtggtgctggcgaacttcgccaacatccagggcctgacgccgatcggcaagacctcctgggtgcagtccgcggagtccggcgagccggcggtcggcgcgccgcgctcgggcaccctgggggcgttgcaatccggcgcgctggaagcgtccaacgtggacatctccaacgaactggtgaacctcatcgtccaccagcgcaactaccaggccaatgccaagaccatccagaccgaggatgcggtgacccagaccatcatcaacctgcgctga

SEQ ID NO: 2956 - DNA, 972 bp, Pseudomonas aeruginosa
cggcgtgccggtgccgtccgggcaccggcaaggcccttgccgccagcggcaacccctggccaggggttgcccccgaagcctccgaaaggaggctttctgttttataaaatccttttaaatcaatgtattaattgttttttcgaattctggcacggcgcttgctggataacctgcaagaaagcccggcggattgtgccggtgcctggaggattcgatggacaagatgctgtacgtctccatgagcggggccagccagaacaccctggcgatgcgtgctcatgccaacaacctggcgaacatctcgaccagcggctttcgtcgcgacttcgagcaggcgcgttcgatgcaggtgttcggcgacagcttcccggcgcgggtattcgccatgagcgagcggcccggtaccgatttcagccatggcagcctccaggaaaccggcaacgagctggacatcgccatcgacggcgacggcttcgtcgcggtccaggcgccggatggcagcgaggcctacgtgcgtaccgccggcatgcatatcgacgccctcggcatgctgcgcaccggcgacggcttgccggtgctcggcaacggtgggccgatcgccgtgccgccggaggaaaaggtggagatcggccaggacggcaccatcagcatccgcgcccttggcgagaaccccaacgtggtcgccgtggtggaccggatcaaactggtcaacccgaacctgaagcagatggagaagggtaccgacggcctgctgcactacaagccgcagccgggcgagcaggcgccgctggccgacgccaacgtgaaggtggtctccggtttcctggaaagcagcaacgtgaacgcggtggaagagatgaccgcgatcctctcgctgtcccgtcaattcgagctgcacgtgaagatgatgcgcaccgccgaggacgattcggcggccatggcgcgggttttgcaaatcagctaatcacttga

SEQ ID NO: 2957 - DNA, 1533 bp, Pseudomonas aeruginosa
acaccggcaacgagctggtgcgcatcgccggcctggtccgcgccgacgatatcgccaccgacaacaccgtgtcctcgacccgcgtggccgacgcccggatcacctactccggcaccggcgccttcgccgatgccagtcagccgggctggctggaccgcttcttcctcagcccgctgtggccgttctgaggacgctcgcgatgaccaagttcaagcacctgctggccctcgccgcgctgctcctggccgccggcgcggcccaggccgagcggttgaaggatatcgccagcatccagggcgtgcggaccaaccagttgatcggctatggcctggtggtcggcctgagcggcagcggcgaccagaccacgcagacgccgttcaccctgcagaccttcaacaacatgctggcgcagttcggcatcaaggtgccggccaacgtcggcaacgtgcagttgaagaacgtcgccgcggtatcggtgcatgccgacctgccgccgttcgccaagccgggccagccgatcgacgtcaccgtgtcgtccatcggcaacgccaagagcctgcgcggcggcagcctgctgatgactccgctgaaaggtatcgacggccaggtctacgcggtcgcccagggcaacctggtggtcggcggcttcgacgccgaaggccgcgacggctcgaagatcaccgtcaacgtaccgtccgccggacgtatcccggccggcgccaccgtcgaacgcgcggtgccgagcggcttcgaccagggcaacagcctgacgctgaacctcaaccgcccggacttcaccactgccaagcgcatcgtcgaccgcatcaacgaactgctcggtccgggcgtcgcccatgcggtggacggcggctcggtgcgggtcagcgcgccgctcgacccgaaccagcgggtcgactacctgtcgatcctggagaacctcgacgtgcagccgggcgaggcggtggccaaggtcatcatcaattcgcgcaccggcaccatcgtcatcggccaggacgtcaaggtatcgccggccgccgtcacccacggcagcctgaccgtgagcatcaccgaggacccgatcgtcagccagcccggtgccttctccaacggccagactgcggtggtgccacgctcgcgggtgaacgccgaggaggagaccaagccgatgttcaagttcggtcccggcaccaccctggacgacatcgtccgcgcggtgaaccaggtcggcgccgcgccgagcgacctgatggcgatcctcgaagccctgaagcaggccggcgcgttgcaggccgacttgatcgtgatctgaggacgacgccatggattcccgtttgctcagcggtatcggcgcaggccccgacagcggctcctataccgatctcaaccgcctcaaccagctcaaggtcggcaaggaccgcgacggcgaggcgaacatccgcaaggtcgcccaggaattcgaatcgctgttcctcaacgagatgctcaaatccatgcgttcggccaacgaagcgctgggcgacggcaatttcatga

SEQ ID NO: 2958 - DNA, 909 bp, Pseudomonas aeruginosa
agcaaggctccaggggaaacggcgaaaacccgttcgcccgggtcgccgagaacggcgccggtcgctggccgagcaaccccagcgcgcaggccggcaaggccctgccgatgccggaagccggccgcgacgactcgaagctgctcaaccagaggcgcctggcgctgccgggcaagctggccgagcgcatgctcgccggcatcgttccctccgcctcgccggccgccagccagatgcagagcctgggccaggacagctacctgccggcgcagagctacccggcggcgagccgccgcggtttctccaccgatggcgtcgacagccagggcagccggcgcatcgcccagccgccgctggccaagggcaagtcgatgttcgcctcggccgacgagttcatcgccaccatgctgccgatggcccagaaggccgccgagcggatcggcgtcgatgcccgctacctggtggcccaggccgcgctggagaccggctggggcaaatcgatcatccgccagcaggatggcggcagcagccacaacctgttcggcatcaagaccggcagccgctgggatggtgcctcggcgcgcgctctcaccaccgaatacgaaggcggcaaggcggtcaaggaagtcgcggcgttccgctcctactcgtcgttcgagcagagcttccacgactacgtcagcttcctccagggcaacgaccgctaccagaacgccctggacagcgccgccaaccccgagcgcttcatgcaggaactgcagcgcgccggctacgccaccgatccgcagtacgcccgcaaggtggcgcagatcgccagacagatgcagacctaccaggccgtcgccgccgccggcacgccgcctctgggttgagcaaggaggaactgacccatgtccgacctactctcgatag

SEQ ID NO: 2959 - DNA, 1098 bp, Pseudomonas aeruginosa
agacctgatcaaggctcgcacggtgggcgacctctaccagatgctcggactctgaccatggccacctccacgctgaagaacgtccgtttcgccgggatggcgacctgcgtccccaagcgcgttatctccaacctgaccgactgcaagccgcagttgcgcgccgagcgcgaacgcctggtgcgcaacatcggcatcgagacgcggcgcatggcgcaggagtggcagtgcttctccgacctggccttcgacgccgccgagcgcctgctggaaagcctggagtggaagcgcgaggaggtcgatgcgctgatcgtcgtgacccagtctcccgactacctggcgccggctaccgcgatcatcctccaggaccgcctggggctgccgcattccaccgtggccttcgacgtcaacctgggttgctcggcctatccgttcgccctcaacctgctgggttcgctgatcgccgccggcggggtgaagaagggccttgtgctggtcggcgaccgcggcgccagtgtcaacgatccgatcttctccgacgcgggcaccgcgacggcgctggagttctgcgaaggcgcgccgccgatgcacttcgacctgaacagcgacggcagcggctacaaggccatcatcctgccggtgggcggccatcgcgaaccggtcggcgtgcagcacctgatgccgttccgcgaggacgagaacgaccattggcaccgtgccatcgacctgcagctcgacggcaccgccgtactcagcttctccacccagcgcgtaccgccggcggtggaaaagctgctcgactatgccggtgcgagcaaggacgaagtggactacttcgttttccaccaggccaaccggatgatcaacgagaccatccgcaagaagctcggcctgccggtagagaaggtgccttcgaccctgcgcgacttcggcaacaccagcggcgcctcgctgccggtgaccatgaccgcgcggatcaaccgggaactcgaggccggccgcaatcgcgtgttgctctgcggcttcggtatcggcctgtcctggggtacctgcctggtggatatcgaaggggcgaagttccccgatctgatcgaatcctga

SEQ ID NO: 2960 - DNA, 765 bp, Pseudomonas aeruginosa
cgtgatcggcgaggacaccctggttctggaacgcctccaggaggggctgggcgcacattcgccgccgttcatgcacggcgactacgaggtgcagctggtgcgccagcacctgtggtatcgcgcgcaggtactgggggagagggcatgaagcagacgatcatcgtcggggaagggcgcgcgctcgaacgggcggacagtaccgcgcgggaacggggactggaacaccgggtcctggagctgaatgctgcggatcgacacaacttcgatattgcgcctctgctcgaacgctaccccgctgcggaaagcgaagtattcgtggcgctggacgagcgggcggtgaactacgcccgccacaagctcatcgcggacatccgcctggcgggctaccggctattcgatatcgtctcgcctcaggccatcgtcggcgaaggcgtgcgactgctgggcaacgtgttcgtcggcgccggttgcgtgctcgccggtcgtgcccgcatcggcactggcagttggctggagctgcaggtcctggtggaggaggactgccgggtcggaacctgtagcacgctgctcgctggcgtgcagttgggacggcgagtggagatcggccagggcagcacgctgggtgcgggcagcgtcgcgctcgccgacacccgggtggggcgacactgcgaatggttgttgccgggcaggattccccgggagctgcccaattactccttttacgatgaactcatgcccgatggggcgcgcatcctgaacaattga

SEQ ID NO: 2961 - DNA, 879 bp, Pseudomonas aeruginosa
acaggctctcgtcagcatcgtcatgccgacctacaagctggagtacttcgaggatgccctcgacagcgtgctcgggcagacctatccggccctggagctgatcatctgcgacgacagcagcgacgagcggatcgccacgctggtcgagcagaagcgcgcctccgcggcattcccgatccgctacttccgcaacgagacgcgcctcggcgagctgggcagcacggcgaaaggcatccgcctggcggagggcgagtacgtcaagtttctccacgacgacgacgtgttgcttcccgaatgcgtcgaggcgttggtgggagcgatggagcgcgagccgaacgtggtcctggcctcgtcgcggcggttgcgtatcgacgaggaagggcagccgctgccggacatcctggcgacctgcttcccgttcgccggcgacgtcctgatcgacggtcgcgagctggtctcgttcctcgccgaccacaccatcaacttcatcggcgaacccagttgtctgatggcccggcgcgatgcgctgctgcagatctgcgagcgcctgatgatgctcaacggccgggccatcgactggatcggcgacctggccatgtgtgcgcagttgctacagcgtggcgacctggcgttcctgtcgcggccgctgacccgtttccgcgtctcccgccagcagttcagccagatcgggcgcgaccagcccggtatcggcgagcagggccatgccgacttccgcctggctatccgcgaactgggttggtatcgccaggccggcgacaaccgcttcgtccgggtggcaccgatcacccgcctggacgcccgtgtcttcaagccggtcaacctgctcgccgcgctgaggcgggcggcgggcttcggtag

SEQ ID NO: 2962 - DNA, 399 bp, Pseudomonas aeruginosa
gaggtagcgacgatggacgtcagcaatgtcaacaattcgacggctgctccggtaatccggctgttcggctcggcgtcttcttccgatggcgcacgcccggccggccaggccggcgaggcggccgccagcgcaagcgcgcaacggacgggcgacgtcaggatgggcgacaaggagcaacgcgctgcggtcgaggaggcggtttcctccatcgagaagttcacccagagcatccgtcgtgatctgagtttcagcctggacgactccacggggcgggtagtggtcaaggtgaccgattcgacttccggagaagtcatccggcaaatcccttccgaagaggccctgcgcctggcagagcgactggacgaagcgcgcagcctgctgttcaaggcggaagcctga

SEQ ID NO: 2963 - DNA, 399 bp, Pseudomonas aeruginosa
agaacgacgcgggcaagctcgaggaagtttccgagctgttgcgcaacatcaaatccggttgggatgcgattgccccctgagaggcatccccagagggaccaagcaatgagtgcagctgtacagatccttgaagaaaccggtagcgccctgcgcgttgccctggccagccagaactgggaggccatcggtgaactcgaccagcgttgccgccaggccgtcgacgaggcgatgctcgatgtacaggacgaagccaccttgcgggcgcggatggaagagctgctggcgctgtatcgcgagctgatcgatgtctgccagggcgagcagcgcaagctggccaccgatctgatccagctgaaccagtcgaagcaaggcgccaaggtctaccagatgttcggataa

SEQ ID NO: 2964 - DNA, 1287 bp, Pseudomonas aeruginosa
aaaaaatttaggcacgggtattgctatatctccgtcgaccgacagaaccatgacgtcgcgccgaccgagagaaacgcaatgcaaccagccctcaacgccttccccgagcagccagccgatacggccgaggccaccagccgcgccggcctcgagcaggccttcgcgctgttcaaccagatgtccagccagctcagcgagtcctacagcctgctggaggagcgcgttaccgagctgaaagggcaactggccctggtcagcgcgcagcgcatggaggagctggcggaaaaggagcgcctggcgaaccgcttgcagagcctgctcgacctgcttcccggcggcgtcatcgtcatcgatgcccatggcgtggtccgcgaggccaacccggcggccctgggcctgcttggcgagccgttggtgggcatgctctggcgtgaggtgatcgcccgctgcttcgctccgcgcgaggatgacggtcacgagatttccctgcgcgacggacgtcgcctgtccatcgccacccgctcgctgaacggcgaaccggggcaactgatcctgctcaacgacctcaccgatacccgccgtctccaggagcaactggcgcgccacgagcgcctgtcggcgctggggcggatggtcgcctcgctggcccaccagatccgcacgccgttgtcggcggcgttgctctatgccgggcacctcagcgagcaggcgctgccgaccgaccagcagcaacgcttcgccgggcgcctgaaggagcgcctgcacgaactggagcatcaggtacgcgacatgctggtgttcgcccgcggcgagctgccactgaccgaccgggtggcgccgaaggcgctgttcgacagcctgcgcgcggcggccgaagtccatgtccaggggctccaggtgcgttggcagtgcgaggcgcgcggcggcgagctgctgtgcaatcgcgacaccctggtgggcaccgtgctcaacctggtggagaacgcgatccaggcttgcgggcccgaactgcgcctgaaggtgcatctctatgcccgcgccgacagcctgcgcctcagcgtcagcgacaacggaccgggtatggacccggcgaccctggcgcgcctgggcgaacccttcttcaccaccaagaccaccggtaccgggctcggcctggcggtggtcaaggccgtggcgcgcgcccaccaggggcaattgcagttgcgctctcggccggggcgcggcacctgcgccaccttgatcctgccgctgattccggcggcgcctctttctgcgattcaggagtaa

SEQ ID NO: 2965 - DNA, 1239 bp, Pseudomonas aeruginosa
ccccatggcagccaaaatcctgctggtcgaagacgaccgcgcagtacgcgaagccctcagcgacaccctgctgctgggcggtcacgagttcgtcgccgtggactcggcggaggcggcgctgccggtcctggcccgcgaagccttcagcctggtgatcagcgacgtgaacatgccgggcatggacgggcaccagttgctcggcctgatccgtacacgctacccgcacctgccggtgttgctgatgaccgcctacggcgcggtcgatcgcgccgtcaaggcgatgcgccagggcgccgccgactacctggtcaagccgttcgaggcgcgggcgctgctcgacctggtggcacgccatgcgctgggccagttgccgggcagcgaggaggatggtccggtggccctggagccggccagccggcagttgctggaactggccgcgcgggtcgcgcgcagcgattccaccgtgctgatctccggcgagtccgggaccggcaaggaagtcctggcgaactatatccaccagcaatcgccgcgtgccggcaagccgttcatcgcgatcaactgcgcggcgatcccggacaacatgctcgaggccaccctgttcggccacgagaaaggttccttcaccggcgccattgccgcccagcccggcaagttcgagctggccgacggcggcaccattcttctcgacgagatatcggaaatgcccctcggcctgcaggccaagctgttgcgcgtattgcaggagcgcgaggtggagcgggtcggtgcgcgcaagccgatcaacctggatatccgcgtgcttgccacgaccaaccgcgacctcgcggcggaagtcgcggcggggcgtttccgcgaggacctctactatcgcctgtcggtcttcccgctggcctggcggccgctgcgcgaacgccctgcggacatcctgccgctggccgagcgtctgctgcgcaagcacagccgcaagatgaacctcggcgcggtggcgctcggccccgaggccgcccagtgcctggtccggcatgcctggccgggcaacgtacgggaactcgacaacgccatccagcgtgcgttgatcctgcaacagggcggcctgatccagcccgccgacctgtgcctcaccgcgccgatcggcatgccgctcgcggccccggtgccggtgcccatgccggcaatgccaccggccaccccgccgagcgtcgagattccgtcgccggccgcaggccaggacgctag

SEQ ID NO: 2966 - DNA, 1053 bp, Pseudomonas aeruginosa
gaatcgtctcgccgccaaactgaccaaggtcgacaaggccgccatcctgctcctgtcgctcggcgagaccgacgcggcgcaggtgctgcggcacatgggaccgaaagaggtgcagcgggtcggcgtggccatggcgtcgatgcgcaacgtgcatcgcgaacaggtcgagcaggtgatgggcgagttcgtcgaagtggtcggcgaccagaccagcctcggcgtcggtgccgacggctacatccgcaagatgctcacccaggccctcggcgaggacaaggccaacaacctgatcgaccgcatcctcctcggcggcagcaccagcggcctggacagcctgaagtggatggagccgcgtgccgtggccgacgtgatccgttacgaacacccgcagatccaggccatcgtggtcgcctacctcgatcccgaccaggccgccgaggtgctcagccatttcgaccacaaggtgcgcctggatatcgtcctgcgcgtctcctcgctgaacaccgtgcagccctcggcgctgaaggaactcaacctgatcctggagaagcagttcgccggcaattccaacgccacccgcaccaccatgggcggggtcaagcgcgcggcggacatcatgaactacctcgacagctccatcgaaggccaactgatggattcgatccgcgaggtcgacgaagacctgtccggacagatcgaggacctgatgttcgtcttcgacaacctcgccgacgtcgacgaccgtggcatccaggcgctgctccgggaagtctcctcggacgtactggtgctggcgctcaagggctccgacgaggcgatccgcgagaaggtcttcaagaacatgtccaagcgtgccgccgagctgctgcgcgacgacctggaggccaaggggccggtacgggtcagcgaagtggaaggtgcgcagaaggaaatcctcaccattgcccggcgcatggccgagtccggcgatatcgtgctgggcggcaagggtggcgaggagatgatctgaggtggtcccccacgacaaggacaaagacaatcccagcgaactga

SEQ ID NO: 2967 - DNA, 1443 bp, Pseudomonas aeruginosa
agcaactgttcgagcaacagcgcgaacaggcgacccatccgctggccagcgacatccggatcgacctcgacgcccccggagacgtcgatgcgccttgagcgaaccagtttcgccaggcgcctggagggctacaccgaggctgtctcgctgccggcgcagccggtggtcgagggccgcctgctgcgcatggtcggcctgaccctcgaagccgaaggcttgcaggccgcggtcggcagccgctgcaacgtgatcaacgaaagcggctaccacccggtgcaggtggaggccgaagtgatgggcttttccggcagcaaggtgtacctgatgccggtcggcagcctcgccggcatcgcgcccggcgcgcgggtcgtgccgctgccggacaccgggcgcctgccgatgggcatgtcgatgctcggccgggtgctcgacggcgccggccgcgccctcgacgacaagggcgggatgcgcgccgaagactgggtgccgatggacggcccgacgatcaacccgctcaagcgccacccgatcagcgaacctctcgacgtcggcatccgctcgatcaatggcctgctcacggtcggccgcggccagcgcctcggcctgttcgccggtaccggggtgggcaagtcggtgctgctggggatgatgacccgtttcaccagggccgacatcatcgtcgtcggtctgatcggcgagcggggccgcgaggtgaaggagttcatcgacgagatcctcggcgaggaaggcctcaagcgctctgtggtggtcgcctcgccggccgacgacgcgccgctgatgcgcctgcgtgccgcgcaatactgcacgcggatcgccgagtacttccgcgacaagggcaagaacgtattgctgctgatggactcgctgacccgctacgcccaggcccagcgcgagatcgccctggccatcggcgagccaccggcgaccaaggggtatccgccatcggtgttcgccaagctgccgaagctggtggaacgcgccggcaatgccgaagccggtggcggctcgatcaccgcgttctacaccgtgctctccgagggcgacgaccagcaggacccgatcgccgacgccgctcgcggcgtgctcgacgggcacttcgtattgtcccggcggctggccgaggaaggccactatccggccatcgatatcgaagcttcgatcagccgggtgatgccgcaggtggtcgaggccgagcacctgcgcgacgcccagcgcttcaagcagctctggtcgcgctaccagcagagtcgcgatctgatcagcgtcggtgcctacgtggccggcggcgatcccgagaccgacctggccatcgctcgcttcccggtcatgcgccagttcctgcgccagggcctcgacgaaagcgaaagcctggcggaaagccgtgcgcggctggcgagcctgctctccggcgggcaggcctga

SEQ ID NO: 2968 - DNA, 510 bp, Pseudomonas aeruginosa
ggcgcgctgaggcatggagaagcgcgcggcgcggctggcgccggtggtggacatggccagcaaggccgagcgggatgccgcgacccagctgggcaggtgccagcagcaattgctcgcggcacagcagaagctggcggagctggaacgctaccgcaacgactaccagcagcaatggatcagccagggccagaagggcgtcagcggccagtggctgatgaactaccagcgcttcctctcgcaactggagaccgccgtcgcccagcaggccaacagcgtgacctggcaccgcgaggcggtggacaaggcgcggctcaactggcaggagagatacgcccgcctggaagggctgcgcaagctggtcgagcgctacctggaagaggcgcgccaggccgaggacaagcgcgagcagaaacagctcgacgaactcgcccagcgtacccgccgccaggacgactgacgactcagaagaacggacgcgacgccttcagcatgaatgtggtgtcgcagtag

SEQ ID NO: 2969 - DNA, 669 bp, Pseudomonas aeruginosa
ccgaccgctcgtcagggccggccgatcaattgttaccgcaggcttttccgcgaggctggccaggcgaatcacttccacccggttgcgaccgctgctcttggcccggtagaaaacctggtcggcggcgctgtagagctgctcgtagctggcctggccgcctccgtcgaggctggccacgccgaagctggcggtcaggcagagcacgccgtcctgcgtcgccagcggggtaccttcgaggcgttcgcggagtttttccgcaaggctgcgagcctgctgctcggcggtgtcgggcaggagcaggaggaattcttccccgcccaggcgcgccacgctgtcgctgctacgggtattgccgcgcagcaggttggcggcatggcggatgacctcgtcgccgaaggggtgcccatagcggtcgttgatgtacttgaagtgatccaggtcgaccatcagcaggctcagcggctgcggttggcgagcgatacgcgcgagctccatgagcaccaactggtcgaactcgcgacgattgaacaggccggtcagggggtcgtgaccggccaggtactccaactggcgattcttctcctccagctcctgccgctgcaactccagcttgcgttgctggcgcaggttgcgcacgtggccgtgccagaggatcagcgacagcagtag

SEQ ID NO: 2970 - DNA, 510 bp, Pseudomonas aeruginosa
gcgaggccgtggcgcaggcgctcgaggccgccggcggccaggtcgccggcgacctcgaccaggtattcctgctccagccgtgcaccgtcgtccaccagcttgcgcagtacgccgtgctgctggctgaacaccaccagccccgaagcctcgctgtccagcgcaagggtgggacgctggcgggcgaagtgttttttcagcgctcgcaagggactggggtcatcgctccagcgccgccccgcagcgagcaggccttcgaaatcgtcgtggcgccagccggccggcttgtgcaacagcagggtggccggttcaatcgtttccgcgcgggcgcccggcagcagctccacgcgctggtcgagcaccttgaactgtggctcctcgatcacttcgccgtcgacgctgacccagccgccctcgatgtacagctcggcttcgcggcgcgagcaggcggtgagttcggcgaggcgtttggacaggcggatcgggtcggtcatggcgaggctactggaatga

SEQ ID NO: 2971 - DNA, 645 bp, Pseudomonas aeruginosa
ggaaccggagaggagaccctcatgcagtcacgcctgatcgatggcctggaatgggacctggacgaggatggcagcggcggcctgtgcaacgtccatggcgacaaggtccatctgcgccagggcgacatggacggcgcctgcgggccctactgcctggtcatggcgatgctggtccgcggccaactgcgccggcgccaggccaagggcctggagcgggtcgacagtcgcagtcgctacgggcgcctgatgaaggcgctggaccagcacggcccgctgctgcgcgtcggcaccaccggcgtcgacctgctggagctgctggccgagatcaacgataccgagcatttcgccctcaagggcgaggggcgcaggttggtccggcacacccgcgaatacctggaggccggctttccggtagtgctcggtttccacggccgcaagggcagcgatatccgccactggggcctggccatcggcatgagcgagcgcgccttcctgctcctcgacccggcccacgacctgccgcgcgggcaggcctggaacgcggtgatcaccagcgaggcgcatggttcccggttcggctatcgctatatcaatgccaagggcacctgggcggtgactctcaaggaaatggtcgccttgctttga

SEQ ID NO: 2972 - DNA, 1800 bp, Pseudomonas aeruginosa
cctgcggaaccccagccgccgagcgagcgccgcatgccagccattctctcctcccgccaacgtatcgccctgcgcctggcctggcgcttcatggcgccttaccgctggcgcatgctcggggccctggtggcgttgctgttcaccgcggcgatcaccctgtccctgggccagggcatccgcctgctggtggaccaggggttcctcaccgcctcgcccgaattgctcaatcgctacatcctgctgttcttcgtgctggtgctcggcctggccgtgggcaccttcgtgcgcttctacctggtgtcctggatcggcgagcgcttcgtcgccgatatccgcaagcgcgtgttcgaccacctgatcgagttgcatcccggtttctacgaaaccaaccgtagctccgagatccagtcgcgcctgaccgccgacactacgctgctgcagacggtgatcggttcctcgctgtcgatggccctgcgcaatgccctgatgctggtcggcggggtgctgctgatgttcgtcaccaacgccaagctgaccagcatcgtggtgctggcgttgccgctggtgatcgccccgatcctgctgttcggccgccgcgtgcgcagcctgtcgcgggaaagccaggaccgggtggccgacgtcggcagctacgtcggtgaaaccctcggtcagatcaagaccgtgcaggcctacaaccaccaggcgcaggatcgccagcgcttcgccggcaccgtcgaacgcgccttcgacaccgcgcgcaagcgcatcgcccagcgcgcctggctgatcaccgtggtgatcgtgctggtgctcggcgcggtcggcgtcatgctctgggtcggcggccgcgacgtgatcgccggcagcatctcggccggcgaactggccgcgttcgtcttctacagcctgatcgtcggcatggccttcggcaccctcagcgaggtgatcggcgaattgcagcgcgccgccggcgccgcagagcgcatcgccgagctgctcagggcgcgcagcgagatccgcccgccagcgcaaccacgcaagctggcggcacgggtgagcgggaggatcgaattgcaggcggtgcgcttcgcctatccgacccgtcccgaacactgggccatcgacgacatcagcctggccgtcgaaccgggggaaaccctggccctggtcggaccttccggcgccggcaagtcgaccctgttcgatctgctcctgcgtttcttcgatccgcagcagggacggctgctgctggacggacagccgatcgtcgaactggacccggccgacttgcgccgcagctttgccctggtgtcgcagaaccccgcgctgttcttcggctgcgtcgaggaaaacatccgctacggccgtccgcatgccagcgccgccgaggtcgaggccgcagcgcgtgccgcgcatgcccacgagttcatcctgggtctgccgcagggctacgccacccacctgggcgagggcggcatcggcctgtccggcggccagcgccagcgcctggcgatcgcccgggcgttgctggtagacgcgccggtgctgctgctcgacgaggcgaccagcgccctggatgcggaaagcgagcacctgatccagcaggccctgccaggcctgatgagcggacgtaccaccctggtgatcgcccatcgcctggccacggtacagagcgccgaccgcatcgcggtgatcgaccaggggcggctggtggccattggtagccatgcccggctgatcgccgagaacccgctctatgcgcgcctggcggaactgcagttcgctgccggcggacgctag

SEQ ID NO: 2973 - DNA, 870 bp, Pseudomonas aeruginosa
aatgccgccccttcgacagggggagacaacatggcggtcatcgggcgtttcaattcactgcaggtggtcaagcacacggagttcgggctctatctcgacggtacccagcacggcgagatcctcctgcccaagcgctatgtgccgaaggaccagcccagcgaagtgggcgactggctcaacgtgttcatctacctggacagcgacgaccgcctgatcgccaccacccagacgcccaaggtccaggtcggcggtttcgccagcctgaaggtcgtggagatcaaccggatcggcctgttcctcgactggggcctgcccaaggacctgctgctgccgcattcggaagagaagcgtccgttgcaggtcggcgactactgcgtggtctacgtctacctggacaagcgcaccaaccgcatcaccgccaccgcacgcctggaccgccagctggacaacctgccgccgcgctacagcgtcggccaggcggtcgacctgctggtggtggagcgtaccgagatgggcttcaaggcgatcatcgagggcaagcactggggcctgatccacaagaacgaggcgttcaagttcctccgcagcggcatgcgcgaacagggctacatcaaggaattgcgcgcggacggcaagatcgcccttagcctgcagccggtcggcgccgaggccgccgtcgagctgagccagcagattctcgcccggctgctggaggccggcggcagcctgccgctcagcgacaagagttcgccggaagatatccaccggctcttcggggtcagcaaggggaccttcaagaaggccatcggcggcctctacaagaaaggcctgatcctgatccatccggaacgcatcgaactgccgcgctga

SEQ ID NO: 2974 - DNA, 1821 bp, Pseudomonas aeruginosa
ttgtcggtgtggccttccaggcggaccttgtcgatgtctaccgcgagcagggcgcgggcgatcttggtcagggtgttgcggctgtcgggattgagacggtcgagattgttgccgaacagcaccttgctcgacatgccgaactcccagccttcgtcgcggagttcgaagccctgctcctggagcacggcgatctgctcggcgctcaggccggtctgcggcggcttggtctggcaaccggccaggcccagcacaaggctgaacagggcgagggcaagcaatctacttgggtggagcctctggggtagcactgtctatctccttttcttcctgaaggatgcgggggtcgttgagttccgccaggcgccggctgccgcgggcctggcgcttggcgatgtacatcgccatgtcggcgtcgtggagcagcgccgccggggtatccgcatgctcgggatagagggcgatgccgatggtcagcgaggtactcaccgtgctgccgtcgctgagccggatcggcgcctgcatgctggcgatgatgttgtcggcgatgcgcagggcgtcggcgccggacgccagcggtgcgagcaggacggcgaattcgtcgccgcccaggcgcgccaccaggtcgctttcgcgcaactgcccacggatgcgcatggcgatgttgaccagcacggtgtcgccggcggcatggccgaggcggtcgttgatctccttgaagcggtcgctgtcgatgaacagcaccgccaattgctcgcgatgctcgttggcatcgcgcagcgcccggctcaggcggccttcgaagaaggcgcggttgggcaggctggtcaggctgtcgtggtgggcctggtgcgccagcgaggcgttctcgtcctgcaggcgcgcctgccaggattcgagttcgtcgagcagggcgttgaagtcctcgcccagttggctcagctcggcgatgccggcttccggtacgcgcttctcgaaatcccgttcgcggcgcacggtatgcgcgaccttcgccagttggtcgagcgggccgacgataccgcgtaccagccgccgcgacaggtagaaggcgcccagggcggtaagcagcaggcacaggaccatgccggcgaaaccggtgagcaggaagcgcagcaggctgccgccggagcccttcacctccaccgaaccgatcttctggccgtcgtgcaggatcggttgttcggtcggcgcgctgagcagccagtgcgccagttgctgttccagcaggtgcagcggcccggtgctttcccgatgccaactggccagggtctgtccctggcggtcgtagacgatggcgctggagacctcttcgctggaggcgatcagcgccagggactcctcggcggcctgggcatcgccgaagaccaccgcggcttcgacggtatagctgatggaacgggcgatcagttgctggttggggtcggcataggcgcgcagggtcagcaggccgaccagggtcaccgccagcccggcggtgaataccgcgaccagcgccacgcccaggtgcgcgcgatagagcacccggcgcagcgatggattggaacccgtatagcgacgacgacggttcatcacggagtggcctgccgccttgccagtttcaatacgctcgggtgcacgcgtacgccgctgcgggcgatggagtcgagattggcctcgaaggtgatgcgcggaccgccgacgttgaggcagaacatgctgccgacgctgcattcggtgccacgctcgctgatggacaggaccggatgcccggccaggctgcggaacacctgctggcgctcgcgctcgtcgaccactccgaggtag

SEQ ID NO: 2975 - DNA, 1734 bp, Pseudomonas aeruginosa
tgctcatgcggaacctccctgaacgttcctgtttctctgggcgcacgcatgatcggcggcgcccccgttctgcggcgggggtcgctggtgccgagcggggtattctgccagttgccgccgcccggggaagaggggggatcgcgaacggtagtgggacggattgtcgcgaccttggttaaaccgccgccacgcgctaggctcggggttcgcagccgaccgagtggagaacagcgccagatgccaggggccgtggatttcaaggagcggatatcccgccagcgtccgcatgacagggaaacctacggacatgccgggaataccgatctgcaagacatcgtctaccagttggaaagcgaccgcgggcgcatcgtcaattccgccgccgtgcgtcgcttgcagcagaagacccaggtcttcccgctggagcgcaacgcggcggtgcgcagccgcctgacccattccctggaagtgcagcagaccgggcgtttcatcgtccgcacgctgttccgccaactgggcccgcgtgccgcagaggtcggcctggacgggctggaaggcgcgctggaaagcctggtggaaatggcctgcctgatgcacgacgtcggcaatccgccgttcggtcatttcggcgagtacgccatcaacgactggttcgaacgcaacctcgacgccctgttcgagcgccgcataccgccgggccagggcgacggcctgttgcagcagcgcatgctcaccgacctcaagcacttcgaaggcaacgcccaggccatccgcctggtggtgaagctgctgcgcctgaacctcacctacacgcagaccgccggcctgctcaagtacgtgcgcccggcctacgagccgaagccggacaaggcagcggcgaaccactacctgaacaagaagccgggcttctatctttccgaggaagccttcgtcgacgaactgcgccaagtcctcggcatgcgcccgggcactcgccaccctgtggcctacatcatggaagcggccgacgatatctcctattgcctggccgatatcgaagactcggtggaaaaaggcatcctcgacatccgtcaattggcggatctgctggtgaagaagtttgccgtccaccattcgccggacgcaccgattcccggcgacgcggacaacatgagcttccagcggatggtcgactactcgctggaaaaggccgagcgggagccgatcaacaaggtcagcgaattcttcatccgcctgcgggtgaaaatgatccacccgctggtccagcacgccgcccagcagttcatcgacaacctcgaagcggttcatgccggcaccctcggccgcgcgctgatggaggacggcagcctgccgcacgccatcgtccagacgttcaaggacgtggccatggaatgggtgttctgccatccggaggtggaaaccctggaattgcagggctaccgcatcatccagggcctgctggatttctacgcgccgctgctgcgcctgccggccgaggagttccaggccctcgccgaaggtcgccaggccgccgcgccgcatccgcaactgctggttcggcgcctgccgagccagcagatcaaggcttacctggaggccatgaaaggtgtggcggagaacccgttgcagcggcagtgggagttctaccaccgctgccgcatgctccaggatttcgtcagcggcatgaccgaccagcatgcccaggacgaataccgcgcgttgtccgcgctgtaa

SEQ ID NO: 2976 - DNA, 819 bp, Pseudomonas aeruginosa
atgtggctcaatgctgcattgacctccgagaactgccaggagccctggaatgccggctttcacccgttccgaactcgccgacctgaacgtcttcatgaccatcgtccggcgccgcagcttccgtcactcagcccaggagctgggtgtcagtacctcggcgctgagccacagcatgcgcaacctcgaggcgcggctcggggtgaagctgctcaaccgtaccagccgttcggtggtgccgaccgatgccggcagcgcgctggcggccaagctggaggatggtttccaggtgatcggcgaggcgctcggcgagctcgatgcctatcgcacctcgccggtgggccggctgcgcctgaacgtgccgcgcgatgcctcgcggctgctgctggggccggtcctcaggcgcttcaccgaggcgtatccggacctgcaactggaactttcggtggaggaccgcatggtcgacatcgtcgccgacggctacgacgccggcatccgttacggcggcacggtgccccaggacatggtcgcggtgccattgaccggggagctgcgctgggtggtggccgcgtcgcccgattacctggcgcgccacggcgtgccccagcggccggacgacctgttgcggcacgcctgcatccgcatgcgcctgggcgacaactcgttctacaaatgggaactgggcgacggcgagcggatggtcgaggtcgacgtgcccggccctttcagcgtcaacgaaagcaatacggcggtcgccgcggccctggacggcattggcctggcctactgcctggaagtgggaatcgccgaggagctgcgtag

SEQ ID NO: 2977 - DNA, 723 bp, Pseudomonas aeruginosa
cggccggctgcaactggtattgcccgactggacctcgatgggcgcgccgttctgcctctattatccgagccgacgccagccgcaacccggcttgcgccaactgatggaaatgatccgcggcgactggctggggcgtgcctgaatcgtcctcccgccaaaccttgcaaggagccccccatgctcaccggtctcaatcacctgaccctggcgtcgccgacctgccggccagcatcgccttctaccgcgatcttctcggctttcgcctggaagcgcgctgggaccagggcgcctatctcgaactgggttcgctgtggctgtgcctgtcccgggagccgcagtacggtgggccggccgcggactacacgcactacgccttcggcatcgccgccgcggatttcgcccgcttcgccgcgcagctgcgcgcgcatggcgtgcgcgaatggaagcagaaccgcagcgagggcgattcgttctacttcctcgacccggacggccatcgcctggaggcccacgtcggcgacctgcgcagccggctcgcggcgtgccggcaagcgccctatgcgggaatgcgtttcgccgactaggccttggccttgccggaagctacggacgccacggccgggccggcgaggcgcttcagcaggcgcgggcggttggtctccagcgcgccgccgcgtccccgcaggccgtcccacaggccccagcccaggcagcgcagcttga

SEQ ID NO: 2978 - DNA, 1071 bp, Pseudomonas aeruginosa
cgagtcgaccagggcgaacagcagcaggccgcagccttgcagggcgaggcccaggcgcagcaggcgggcgtcgtccaggcgccgcttgcagaggttcacgccgagggtctgggcgagcaccgcgagcacgccgtagagggccagcgagtagccgatccaggcgctgctccagtgaaacttctcgatcacgaagaacggccagaccaccatcaccgcctgcaagccgaggaataccagggcaagcaccgccagcaggagtccgacccccggttgccgagccaggccgctgatcgagcgcaaggcattcatccgcctcgggtccaggcggcggcgtcgcgtcgggggcagggtttcctcgaggaacaggccggcgagcagggcgttgagcaggcacaggccggcggccagcaacagcggcagcgtcgtgccgtgcaccgccagcagcccaccgagggcggggccgaggatcatgcccagagcgaggccggcgtacagccagccgaagtgccgggtgcgctgcccgtgcgtgccgaggtcagccgcgcaggccatcgcggtggccacgctggcgccggtgagcccggccagcgcgcgaccgaggaacagcatccagaggctgtcggccagcgccagcagcagatagctgagggcgaagccgagcatcgccaggaccaggacggggcggcgtccgaagcggtcgctgaggctgccgaggaccggcgaaaagaacaattgcagcagcgcgaaggtcatcaccagggcggcgccccaggtggccgcgtcgcggaccgccagcggcgccacgctgccgatcagcgtcggcagcaggggcacgatcaggccgacgccagcggcatccagcaggcaggtgaggaacagcagaggcaggacgcgtttcgcgccgggaccgtgttcccgcgtggcggaggggcagaggctggtcatggacacgccaggatcctcccggcgaacacaggaaatcctgatcctgggacgccagcgagggcaagggaaactgccggaattcataggttcgacgaacggtcgcggcaacgccggcgggcggcgtga

SEQ ID NO: 2979 - DNA, 816 bp, Pseudomonas aeruginosa
cgatattttcctcctgtcgcgagcaaagggatttcaataacgcccagaaaaggaaagctacctgccgtgctcgcctgcatggcatcgctggcgggctgcaacatcaacccggcgaaccagggctcggtgtcgtcctggttctccatgcgcgccggcgatccgcccagtttcgtcaccggcgtggtcggcttcgagaacaccggcagcaacgacccgtccacccgcctgaccctgcgtttccgcgatcccgcctccaagacccatgcggcccacgtcaccacctcgtcgtactccgagctgttcagcctcgcactgacgccgcgctactacgagctttacgagttcgaggtgaggtacctgtcctataccgtcacccgcgagaccggtgcgtacgaggagcgctgcgaggccaacggcgaggcgctggagaagacggtccagaaaaggaagcgcagcgtcacccacacggcggtgaacgtggagtccaactgtcgttctacgccgctgaccaagaccgactactactacgagacctatacctccaagccgttctccgcgccgttccgtgccgagagcttcgccaccaactacatcggcgacttccgcgtgcagtgcagctacaaggagaagaagggcaagaccctcgtcgacagctgccatctcaactacggcgccgtcagccgcgatcgggtggatgcctgggtggcgcagatgaacgaggcagacaaggacaagcgcgagccgctgccgccggtacgccagcaggcggtcgacacgaagaaggccggcaagctcatccattcggtatttcgctga

SEQ ID NO: 2980 - DNA, 801 bp, Pseudomonas aeruginosa
gggttttcccctatgggcttttgccggcaagccggggatcatgcggaaaaagccaggaatgcccgcgccatgaccgactacgccagccttctcttcgacagcgtcgcccggctgcgcaaggccgctaccaccgaggcggtctgccgcgagatggtggagttcgccgcacgcctgggcttcgaccgggtgatcgtctgcagcctgttcccccgccccggcgaggacgaactgatcgacgagctgttcttcgtccatggcgactgggccgaggggcgcagcgcccaggagcgcgacgcctatcttctgcactgtccggtcacccggcacatcctcgaactggacgagccgttcttctggtcgaagagcccctcggaggatcccgagcgcatgacctaccgcatcgtccgtggggtccgcgacctcggccaggtcaatggcatgcaggtgccggtgttcggccgcaacggtctggagggcgcggtgtctttcgccggcgagcggctggacctgaatgccggttgcaagctcgccgcccaggccttctgcccgatcctgttcttcgccctgaagcgcctgcgcggccctgtgtcggcgggcgatgcgcaagcgctcagcgagcgcgagcgggaagtcctgcaatggatcgccctgggcaagcagcaagcggaggtggcggcgatcctgatgatttccgagcgcaccgtggagaatcacctgcgtgccgcccgccgccgtctcggcgcggcgtccaccgcccaggcggtggcgcgggcgctgcgcctgggcgatatcgaggtctga

SEQ ID NO: 2981 - DNA, 1107 bp, Pseudomonas aeruginosa
gcggcctcagggagcggacgtgaggacgatcttgccgatgtgctggccggagtccatcagttcgtgggcctggcgcgcctgctccagggggaaggtgcggaacacttgcggccggacagcgccggcgcgcacgtgcggccagacctggcgctccagttcggcgatgatcgcgcctttctcgtcgtggcttcgcgagcgcagggtcgagccaagatggaccaggcgcttgctcagcatcgggaacaggtcgacttctgcggccttgcccttgatcacgccgatctgcacgatccgtccgttcatcgccgccgcctggtagttccgcgtcacatagtcgccggcaacgatatcgacgatcacatcgaccccgcgaccttcggtgccgcgcagcacttcctcgacgaaatcctgctcggtgtagttgatcgccaggtcagcgccgaggcgcaggctggcctcgcgctgggcctcgctggagatcgtggtaaagattttcgccgcgccgaaggccttgcccagcatggtcgcggcggtgccgatgccggaggcgccaccgtggaccagcagcgtctcgccggccttgaagccaccgcgctggaacaggttgacccagacggtcatgaaggtttccggcagcgccgccgcttcctccatgcccaggccgtcgggcaggtgcagggtggtgcgctcgtcggccaccgcgaactgcgcgtagccgccgccgggaatcaacgccatcaccgcctcgccgacggcgaagcggctgacctcgctgccgaccgcccgcaccatgccggcgatctccaggccgggaatgtccgaggcgccgggcggcgggtcgtacacgcccttgcgctgaagcacgtcgggaccgttgacgccggcggcgcggacttcgaccaggacctcgcgcgggccgggcgtcggcagcggccggctggtcgccaccagtacctcggggccgccgggccgggcgatctcgatggcggtcattcgttcgggaaatcggttcgtactgctcatcgcatgctcctgggaaaatggttcggacctggttcgcatggtaagcagcgcggatgccgtggtcgcgcagcgctttttcattag

SEQ ID NO: 2982 - DNA, 1032 bp, Pseudomonas aeruginosa
gcgccatcagatcgaggagatttccatggcaatcccaagcatcccgcgtttggccgtactgacgctcggactggcgctcgcagcggccgccagtgccgccgacgaggcgcaactggtcgaggcgatcaacgcctaccgtggccaggtgcagtcctgcggcgggcaggccagcggcgaactgccgccgctggccgccgatccgcgcctggccttgccggtgaatgccgccggcgacctgcagcaggcgatggcgcaggccgcctacccgatggtcaacgtgcagtcgatcagcctttccgggccgcgcgatgccggcgcggcgatgaaggcgctgcaggaaagcttctgccgcgtggtgctcgacccgcaattcgtcgacgtcggcgtcagccgccaggaccgcgactggcgcatcgtcctcgcccggccattgctgcgcggcggcatgggcgattggcaggcggaagggcagaagctcctggaacggatcaacgccgcccgcgggcaagcccgccagtgcggtggcaaaccttacgcagcggcccagccgctggcctggaacgccacccttggcggcgccgccgaagcgcattcgcgggcgatggccaacggcaacttcttcgaccacctcgaccgcgacggccgcacccccggcgaccgcgccgagctggccggctacagcggcgggctgatcggcgaaaacatcgccgccggccaggacggggtggacaaggtggtcgacggctggctggccagcccgggccactgcgccaacctgatgaaccccggctaccgcgagctgggcgcggcctacgccaccgatccgaagagcgacgcgggaatctactggacggccatgttcggttcgccctgaagtcctccgcgcccggagctgacgaagggctgggcgccttccgcaaacgaaaaacccggcgccatggcgccgggttccctttcagcctgtcccgccctcaatgcggcgcattgagggtcaggcgcatgtgccggttgacatccttgtacagcaggtag

SEQ ID NO: 2983 - DNA, 549 bp, Pseudomonas aeruginosa
cgcctcggccagttcgtcgttcagtgccagcaggcggcgggcatagccgagcagcgtatcgccggcgtcggtcggcaacacgtcgcggttgccgcgctccagcaggcggtgtccggccatttcctccaagcggcgaaccttctggctgacggtcgactgggtcgagtgcaggcgcgcggcggcagtggtgaagctgccgcagtcggccaccgtgacgatggcgcggagcaggtcgaggtcgaacaggcggctattcgatttttcactgtcgctcatggtcgtatcgcattttcgaatgtcgtcgccgcttttagcaggccgtgccgtcagcggcaaccgctcagcgtcgacgcagcgtgcccagcggtcgaccaatgcgctggaagcggcgggaaacccgccaggcggtcatgcatgcgccaggaacaggaccgcggagcgctactcgggcacctcgacgttgacctgcagcgcgtcgtggcgccagtactccaggtcgcagtcgatcaggcggcccgcctggtcgcggttgatccgcacgatctgtag

SEQ ID NO: 2984 - DNA, 897 bp, Pseudomonas aeruginosa
cgccgggctgcccaccgagacccgcagcggtcccgcggcctccgccgggaggatggtcgggaccatttcgaagcgcacccggccgtagcggatgccgtagtggttggcgtagagatcggtcagcgagcgagtcaggtcgaagcgctcgatgccgggaaagtaggcgggattcaggtagtgctcgacgtacagcaccagccgcccgtcgacccgccgcgcccggcggatctggaacacccgcgacagcgccggcagctccaggcgctggcagatgtcgacgctggccgggatcatcgccgcgccgagcacctcggtctccggcacccggccctggtcggcgaccatcgcgtggaagtggctgcgcaccagcgggttgtacagcagccgctgcggcgagacgaaccagccgcggcgttcctcgcggtagatcaggccctggtcctccaactggccgagcgcctcgcgcagggtgatgcgggtggtcgagaacagctcgctcaattgccgttcgctgggcagcttgctgccgcgcgcgagcaggccgcgctcgatctgctcgcgcagggactggtagatcaccgtcagggggcgggacggctcgtcgcgcatatcgacgcttctccgctggggctccgggggggctacagggtaatgcttccgggccgccggcggtatagcgcggcgcgccttctcagcgccattccagcactggccagccggcctcgcgggcgtgcccgagcagcgccgggtcggggttcaccgtgtgcggccggtcgacccgcgagagcagcggcaggtcgttgcgcgagtcggaatagaaggtcgcgccggccagcgtctcgccctcctgggccagccaggcttcgaggcgacggaccttgccctcgcggtaggtga

SEQ ID NO: 2985 - DNA, 1137 bp, Pseudomonas aeruginosa
accaaaagcagggcgaaacgattcgattttttcgagggattgcctgggattggtgcattttcttgtcctggcggcacctttgggcgggacttttctacgtattttcaagaaattggaatagaccagattttcgatgatacgccagcgcctctggtgcgccgtgcgccgccgctggatggccgcgtgtcgcggcgctcggctagactgcgggacctcgcgccggatcggaccgccatgctgagaaacgtcaccgacctagacctgcgtctgttgcgcatcttcgcctgcgtggtgaagtgcggcggtttcaccgcggcccaggccgagctgaacatgagccagtcgaacatcagcatgcacatcgccagcctggagaagcgcctcggctaccggctctgcgagcgcggcaagggcggtttccgactgaccgccaagggtcgccgggtgctggaggcttcgcgaacgatgttcgacgccatcggcctgtttcgcgaccaggcgcaggcgttgtccggacgtttggtcggggagctgtacctgggcctcgcggacaatctcgcgaccttgccccaggcccgtttcggcgatgcgctggcgcgcttccagcggcgcgaccaggatgttcaactgaaccttttcgtcaattcgcccaccgagctggaactggcggtgatcgaaggcgagctggacctggcgatctcctatttcagccgttcgcggccgagcctcgaataccgcccgctgtatcgcgaagagatcggcgtgttctgcggcgatcgccatccgctgttcgccgaggcgcagccgaccctggagcggatcgccgcctgtgactgggtgatgcacggcttcctgccggaaaacctggtcctgccgctacgcccgtcgcgcagccgcgccaccgcctaccacatggaagcggtcgcccatgccgtgctggccggcacccacctgggctacctgccgacccattacgccgaagcctggatcgagcgtgggcggatgcgcgcgctgttgccggagcggctgagctacccggtggagcacagcatgatcgtctatgccgggcgccccctcagcgaagccgcccgcgccttcatcgacgacctgctgcaggtccacggcctggggtcctga

SEQ ID NO: 2986 - DNA, 1629 bp, Pseudomonas aeruginosa
gccgggccccgccgggcgcgaagccagcgtgcgggaacaaccggaggaggcgccggaacggccggcgcgtgcgggtcagtccgccggcggagcggcgaagctgaggctggtggcgatgcgccgatgcggcttggcgatgagcatgtagagcaggccgaacgcggccagcgcggagaacaccacgaccaccgcccagacctggaaccagggcgcgtcgggcggggcgaggctggcccgcggccaggcgacgttgagcgcctcgaacgacagccaggcgactgccaggacgttcaccgccagccccgcgcgtcccaggcgcaaggcgcccttgtccgggtcccagcggccgacgaggcgggcccagagagcgcaggcggcgacgatcaggaagaccacgaagaaaccgccgctgccgaacgcgatcagcgtgccgaccgccgtggcgttcagccccagggccaggccgaggctggccagcagcgtgctgcagaccatcgccgccatcggcaccttgcgccggtcgacccggcgcagcagggcggagccgggcaggatggcgtcgcgcgccatgccgaagatcgcccggccgatgtaggtctgcaccgacaccacgcaggcgacgaaggcgatcagcaccactgcgacgaatggccgctcggcccaggcgccgaaggcgtccaccaccgccggggtgaccgggtcgaccacctggccgctgaccaccgcgccgatgtcctggtaggacagggtcacggcgaaggcggtgagcatcacggtgaatcccaccaccagcatcgagcgcaggatcgcccggggagtggagacgcgggcatcggtggtttcctcggaaatctgcgagcaggcgtcgaagccgaggaaagcccagccgcccaccgccagcgcggtcagcacgccgtccaggtaggaaccgtccgcatcgcctgtgccgcccgggccgctgaacagcaggtcgagcggatggttgcggaagaacagcagcaacagcacgccgataccgatggaggcgatggcctcggcgacgatcccggcattgacgaagtacttcagcgggttgatccccagcaggttcaccgccagtcccagcgccagcagcagcgcgccgcagagcacctggccgttggccgacggcggcgcgccggtcgccagcaggccgagccagaagccaccgaggtaggccacggtagtcagcgaggccagcgccgaagccaggtagaggaagccggtgaaccaggccaggcggtcgcccaccaggcgccgcacccactggtagcagccgccggccagcggaaactgcgaggacagctcggcgtagaccagcgccacgccgaactgcagcagcaggcacagcggcaccacccagacccaggaggggcccatgctcatggcgccgagggacatcaccgagtagatgcccaccaccggcgagatggtggcgaagccgacggaaaaggacgaccacaggctcagcccgcgctccagttcctggcgatagccgtgggccgccagcaggcgttcgtcgcgggaggtatcgcggagatcagtcatggcggtctccgggcgagcgctgcggggaaggggaaaggcggatgccaccgatgcgatgggtga

SEQ ID NO: 2987 - DNA, 288 bp, Pseudomonas aeruginosa
aaatccacaagggagggaagtgatatgaagtccaagatttccgaatatacggaaaaagagtttcttgagtttgttgaagacatatacacaaacaataagaaaaagttccctaccgaggagtctcatattcaagccgtgcttgaatttaaaaaactaacggaacacccaagcggctcagaccttctttactaccccaacgaaaatagagaagatagcccagctggagttgtaaaggaagttaaagaatggcgtgcttccaaggggcttcctggctttaaggccggttag

SEQ ID NO: 2988 - DNA, 273 bp, Pseudomonas aeruginosa
atgagcatggcacttattgatcttgcaagaaattttttggatggatcgttaagcggaaagagtttcacaaaaaaattctttgaaatgtggcgtagcgaaggtgcgtcaggcttgctgaaaaaggatgatgataatcttggcgcttgcctcaggcttatgtttggaatggcagattgcttcacggatggaccgaaggataatgatggtgagataaatgaagaggagctaaagcaggaagttagagggcttttgaagaaatataaatatatctag

SEQ ID NO: 2989 - DNA, 963 bp, Pseudomonas aeruginosa
gcgtgggtgtggatcgcctcttcgaaggcctggcgcaggatgtactggcggcactcggggttggtgatcaggcggtacacggccagcaccaggttgttggcgaccagggagtcggcggtggagaagaagccgaggttgcgcatgacgatgcgccgctcgtgttcgctgaggccgtccttgctcttccacagggcgatgtcggcgttcatgttgacttcctgcggcatccagtggttggcgcaaccatccagatacttctgccaggcccagtcgtacttgaaggggacgagctggttgaggtcagcgcgggcgttgatcatctgcttgtcgccgacctgcacgcgcgcggcggagccttcgaggtcgtccaggccttcctggatgtcgaggtcgttcagggccttcttggcgcgggcgacggcgtcggagtcgtcggcggaaacggcgcgcgcttcttccaccgagccggcggcttcgtcgtccagcttgtcatggccctgggcaacggcctgggcggcggcgggcgcggccttggcttcggtcgggtcttctttgtcgaattcgtcccagctcagcatcttgctctctcctggtctggcggccgtctcggcggcctggatatggggcgtgaggtgcacgcgaaagcggtggtccggcacggtctggccgggccgttcttctcccccggagggaagaaggggattgttcctggccctggcgaggggccttgcgctgccagcgtggcgctggacgagcgaccgtcaggcgccgggcaggccggacccacacgaggagtccggcttgcccggccgcgacacggacgccgttcagcgacgcgcgatcactggcaggcttcgcagtcggggttgtcgatgctgcatgcctgcggcaccggcgccggcttcggctcggcggccggggcggcttgcaggccgtcgttgccaccggccgacacggcgttga

SEQ ID NO: 2990 - DNA, 2523 bp, Pseudomonas aeruginosa
tgtttgcaagatgttcctcgcgtgctgccgcgcggcccccgtattggctacaatgcgggccgctctgagggggccgcacggcggctccgggaccgcgatacgaggaggctgtgtggagcaagaagcctggcgcatcctgatcgtcgaggacgatcgacgcctggccgagctgacccgggaatacctggaaggcaacggcctgaaggtcgacatcgaagccaacggcgcactggcggcggcgcgtatcctcgccgaacgcccggacctggtggtgctcgacctgatgctgccgggcgaggacggcctgtccatctgccgccaggtgcgcccgcagttcgacggtccgatcctgatgctcaccgcgcgcaccgacgatatggacgaggtactcggcctggagatgggcgccgacgactacgtgtgcaagccggtgcgcccgcgtgtgctgctggcgcgcatccgtgccctgttgcggcgcagcgaggcgccggaagcgggcgccccggcggcggacagcaaacgcctggcgttcggtcgcctggtgatcgacaacgcgatgcgcgaggcctggctggacgggaccaccatcgagctgaccagcgccgaattcgacctgctctggctgctggcggcgaacgccgggcggattctctcccgcgaggagatcttcaacgccctgcgcggcatcgagtacgacggccaggaccgctccatcgacgtgcgcatctcgcggatccgcccgaagatcggcgacgacccgatgcacccgcggctgatcaagaccgtgcgcagcaagggctacctgttcgtcggcgagggctgaggcgcttttttcctgcgggccggggcgcgggcgtcccggtcggccagaatcaacagcagcggacagcggccgggggctcgccgatgaaatccatcttcctgcgcatctatggcggcatgctcctggccctgctgctggtcagcggcctgggcctgctcggcctgcactggatcaacgaggtgcgcggcgagcactaccgcgaggagcttgcgcgcggcaccttccgcctgatggccgacaacctgcaaccgatgaccgccaccgagcgcaagcgcgccctggcgcagtggagccgcttgctgggtattcccctgcaactgcacgggctggatgagctgcggatggacggacgcagccgcgcgcgcttgatgaacggccaggtgctggtgaagcagaccgccgagcacgccgtcaccgtctatacccaggccagcgccgccgagaacctggtgctcagcggcgaggtgcagcaggtcagcgagcaactggcgcgggccacggtgtacctgctgatggacgaactggtgcgctacccggccagcgaacagccttaccaccttgcgcggatcgtccgcgacaagcgcttcggcttcccggtgcacctgctccaggtcaaggagctggacctcgacgacgaccagcgccggcgagtggtggagggcgacacggtgatggcgctgggcaaggacggcgactcgatccgcatcttcgccggcatcctcgacacgccctgggtgctggagctgggcccgctgttccagatgaacccctatccgccgcagctgctgttgctgctcggcgcgctgtgcctgagcttcatcggcctgatcacctacctgctggtgcgtcgtctggagcagcgcctgcgcagcctggaggcggccgccacgcggatcgcccgcggcagcctggatactcgcgtcgaggtgcgcggtggcgactcggtgggacgcctgggcgcggccttcaaccatatggccgagcacatccaccggctgctgacggtgcagcgcgagatggttcgcgcggtgtcccacgagctgcgcacgccggtggcgcggttgcgcttcggcctggagatgatcgagaccgccgagaccgacggcgcccgcctgaagtacctggagggcatggacaacgatatccaggacctcgacaagctggtcgacgagatgctcacctacgcacgcctggaacagggctcgccgccgctgacctaccagcgcctggagctgggcgcgctggtgcgccaggtggtggaggagatcgccccgctgcgccgcgaggtgctggtcagttgcgaggagggcgcgctggtgcctgaggagctgggcagttggatcgaggccgagccgcgctacctgcatcgggccttgcagaacctgctgaccaatgcgctgcggcatgccgatcgtcgggtcaggatcagcttccgggtcagcctggagcgttgccgggtggatgtcgaggacgacgggccgggggtgccggaggcgcaatgggagcggctctttacgccattcctacgcctggacgatagccggacccgtgcttccggcgggcatggcctgggactgtccatcgtccggcggatcgtctactggcatggcggccgggcctccatcggccgcagcgagactctgggcggtgcctgcttcaccctggcctggccgcgcaaggcgggtctgcgcgaccgctga

SEQ ID NO: 2991 - DNA, 510 bp, Pseudomonas aeruginosa
atttcggtgagcagctccaggtcgctggccaggacccgctcgttgacctggtggatggtggcgttgaccgggccgagttcgaccacctgggtgcccatggtggcgatgaagcgtccgtcggaggtgccgccgctggtcgagggccgggtctcgcggccggtgaccgccctgatgctggcggccaccgcatcgagcagttcgcccggctcggtgaggaacggcaggccggacagcgcccattcgacgtgccagtccaggccgtgcttgtcgaggatcgcctcgacgcgtttctgcaggccttcgacggtggattcggtggagaagcggaagttgaacagcgcggtcagttcgccggggatgacgttggtggcgccggtgccggagttcaggttggaaacctggaagctggtcggcgggaagaaggcattgccgtcgtcccagtgttccgccgccagttcggccagcgccggggcggccaggtggatcgggttcttcgccaggtgcgggtag

SEQ ID NO: 2992 - DNA, 654 bp, Pseudomonas aeruginosa
gccacatggccctgtacgccgcggatggtcagcttggctccaagggagccgcggcggccgttcttcaccacgtcgccgaccaggctggtgctcgacggttcgccgacgatgcaccagtccaggcgctcgccgcgtgcggcgaggcgttcgaccaccgccttggtgccgtggtgggccgggccttcctcgtcgctggtgatgaggaaggcgatggcacccttgtgctccgggtggtcggcgacgaagcgctcgacggcgacgatcatcgacgccaggctgcctttcatgtccgccgcgccgcgcccgcagaagcatgccctggtcgtcgatcagggcgtcgaagggttggtgctgccaggcctgcagcgggccggtggggaccacgtcggtgtgcccggcgaagcacagcaccgggccgtcgccgccgcgccgtgcccagaagttgtccacctcctcgatgcgcatcggctccagggcgaagccggcggcttccaggcggcgcatcatcagggcctggcagtcggcgtcgaggggcgtgacggaggggcggcggatcaactcgcaggcgagttcgagggtcggcgagagactcggcgaagaggcggtcatggggagtgcatcctgagcgggtcgagcggaaagggggaatcttaa

SEQ ID NO: 2993 - DNA, 2673 bp, Pseudomonas aeruginosa
agcataaacgcgggcgaagggacgccgtttaggcgagcggagccggctgtcccgacgcctcgctcgacctcaaccgccgatccgctcggcgccgccggccagttcctcgcgcggtttcggcagcgacgagagcagggccatgaccagcgccgccaggtagggcagcgattgcaccaggagcatggcgacccagatcagcaggtcgcggctcggcacgccctgaaccgccacgatgccggccgccgcgccccacagcaggagcatcacgaagacttcctcgcgggcctccgccagggccaccagcaggccgtggctggagcgcatcttcggcgtgcggaagaacgggatgccgcgggtgacgaagccgtacagcaccgccttggcaatggtgtgcgagagcgacaggccggcgagggcggcgaagaacgagtcgcgcaggtcgacgccgacggtgcgccggtagaggaagaggatcttgccgaccttgaagacgaacagggccagcggcaggatcgcgaagatcagcagcggcgggtcgacgcgcttgggcacgatgatcatcgccgccgaccagagcagcgcgccgagggtgaagaagatgttcaggccgtcggcgatccacggcagccagccggccacgaagtggtagcgctggccgcgggtcaggcggctgccgtcgggactgcggccgcgcagcagggcgtcggtatgccgcttcatgatctggatcgcgccgtaggcccagcggaagcgctgcttcttgaagtcgatgaaggtatcgggcatcacccccttgccgtagctgcgctcgaagtaggcggccgacaggcccttctcgaacacccgcaggcccagctcggcgtcctcggtgatgcaccattccggccatctcagctcgtccagcacgctgcgccggatcatggtcatggtgccgtgctcgatgatcgcgtcgcggtcgttgcgggtgaccatgccgatgtggaagaagcccttgtactcggcgtagcagagccgcttgaaggcgctctcgtgctggtcgcggtagtcctgcggcgactgcaccacggcgatccgcgggtcgccgaagtgcggcaccatgtgcctgagccagtcggggtcgacgcagtagtcggcgtcgatcaccgcgaccacctcgacgtccgccgccacgtggcccagggcgaagttcagcgcgccggccttgaagccttccagcggggcgacgtggaagaagcggaagcgctcgcccaggcgcgcgcagtgcgcctcgaccggctgccagacggccgggtcgcgggtgttgttgtcgatcaccaggacttcgtagtccgggtagtcgaggcgggcaagggcgtcgagggtctgcttcagcagttccggcggctcgttgtagcagggcacgtggatcgacaccttgggccgataggcctgcgcggcggtgatcggcaggaatggccggcgccgcttgcgcgtccagaccgcctcggccagctcgtgggcctcggtgaacagcacgatgaccacccccagcgcgccgacgcccagcaacgcgccgacggtcaggctgaaccaggtgctgtactgctggctgtactcgtaggcgatccacaccagcaccgaggcgcaggcgaacgagaccacggcgaggaaggtcctcccgcgctggcgcatcgaggaactgtcgatcagcagcagggtgaaggcgagtaccgcgagtaccgccgaggcgatggccagggcgcgccacttgggaatcggcaccaccggcccggtgaagttgaacttggccttgcggtcggcgttgtagacgccccagtaggcgcccaccgagccttcggcgctgaccttccagggctggtcgaaggcttcgatgacgaagtagctgtagccttcgccgttgagcgcgttggtcaggcgccgcaggtagatggcctggtccgcgggtgtcgcctcggcgctgccgcgcatgcgcccgttgctcggccagccgacctcggcgagcagcagcggcttcctcgggaaggcggccttgagttcgcgcgcgcgttcgagcacgaagtccaccgcgtcggccaccggcgtagcctcccagtagggcaggacgtgggcggcgatcaggtcgacgtgttgcgccagttccgggtattcgcggtagacgtgccactgttcggcggtggtcaccggaaccttgaccgccgcgcggacccggtcgaggtaggcgatcaactgttccgccgtcacctcgcggcggaacagcgcctcgttgccgactatcactcgcaccacgctcggcgactcgttggcgatgcggatggcgcgggcgatctcggcctcgttgctggccaggtccgggccgagccagatgcccaggctgacgcgcaggccgaacgcctcggccagcgccgggatgtcgccgagcgcgccctggaccgaataggtgcggatgctgtgggtgtgccgggcgaccagttccaggtcggtgcgcatctgttcggcgctggggtagcggccgctctgcgggttctggttgaggcggaacggcgagaaggagaggccggagatgcgttccggccagtccggtacgctgaccggacggttgtacagggcccagatgccggtgaagagggcggccagggcgacgatgaccaccaggttgagcccgatcttgcgtga

SEQ ID NO: 2994 - DNA, 1335 bp, Pseudomonas aeruginosa
tcgcggccggccagaccggtgcgcggtcctcgccgacggccggcgtctgggcgcggccatcgagggcgaacagggcggcgcgtgcgcagaggcgcccggcgagaaactcggcctggcgcttggccaccgcgcggaggatgttcgccggcggctggatgccggccagggcgaagtcgccgggttgcagcagcgccgggtcgaagcgggtgctgcgcagttgcacgccgggcagcgcgacgggcagcggccagcggtcgtccagtggggtgcagaaggaggggagacggtcgttcatggcgcgcattgtgccggttcccgacgtggcccaccagtcacgcggcgcttacacaagattgcaaaagcgcaacaaaggaaaacggaccgcgaggcccggttttgacagactgcgccgcgcattcctgtggaatgcaggtgaggttgtttgttgatgacgggatactgtcctgtctcgacctttcaagacgggagtccctccggggactcccgtttttttatgcgtcggcgcagggttcaaccctgcccgaagatgtccttgaggaacgcctgcaggtctgcccaggagcgctggtcggcctggcggtcgtagccgatgtccaggccgtggcctttgtgcgcgtcggcgtcggggttggtgaagccgtgtttggcgtcgtcctggatcaccacccggtagtcggcgccggcggcgttcagttcctgtttcagggcgtcgaggtccttggccgggaccaggctgtcggcgctgccgtgctccaccaggatcttggccttgacgctgcccttgctggccggggtggcggtgccgagggcgccgtggaagctcgccacgccggccagcggcaggccctggcgggccatgtcgaggacgatcttgccgccgaagcagtagccgatcgcggcgatctggctgggatcggtctgcggttgccgcttcagcagttccaggccggcgaggaagcgcgccttggcggcgtcggcatcccgggtcgcggcctgcatgaaggccatcgcgtcctgcgggtgctcggtgtgcttgccttcgccgtacatgtcgatggccagggcgctgtagccgagttcggcgaggtcgcgggcgcggcgtttggcatagtcgttgagcccccaccattcgtggaccacgatgaccccagggcggatccccggcttgctgtcgtcgtaggcgaaatagccgaccatgcgcgtgccgtctgcgctccggtaaggcatctcgcgggtctggatagcggcctgggcgctggcggcgcaggcgatgagcagcagggcgcagaacaggcgcatggcatctctccgtga

SEQ ID NO: 2995 - DNA, 264 bp, Pseudomonas aeruginosa
cctggaggcggcgcgccaggtccacgaggcgttgctggaggaggcgaagaacgatccggccgcggccggcagcctgctgctgcgcttcacggagttgcagacgcgggtgatcgccttactgacgcgggtcggcctgctggtcgacgatattctcaagagcgccagcaacctggttacccagggggggcagggcgacggcctgaatcgcttccgcgcggtgttcggcaccctgcgcctgccggaggtcgccgacagcttccgtga

SEQ ID NO: 2996 - DNA, 1092 bp, Pseudomonas aeruginosa
cccttcacgcagttgatcccgcggttgacctcggccttgatgtcgccatgggtggctaccacctggccgtcgcgggtggcgaccatcacgctgcaaccggtgccgcagaagcggcagggggccttgttccaaaccaggctggtgacgtccgcctcggtcaccaggttgctggcgcggaccaggatcggcaggccggccgccgccgcggcgatggcggcggcgttggccttggcgaattcacgacgggtgaggttcatcgattgtctcctcgggcgagcacggtatcgcgcggtcggtcatggccgccgcgtcgttgctatcgtcgtcgtgcaggatctcgtggtagaccagcacggcgttgagcactcctggcaggttctgcaactggcccagggtgtcgagaatctgttcttcgcgttcggcttccagcaccaggatcagcttgccctgcgggctttcctggtagatctccaggccgtcgagcagcgccaggttggccttcaccgccggcagtcgctcgggtcggcaatgcaggatgaggctggcgatctgcagggcttcaggcatgtcgtggagactccttggtggatagcgcgcgcagttggatggcctggctcggacagggcgccaggcaggcgccgcagccgttgcagcgctggctgtccagctcggccagggcgacgccgccgggggccgggcggaagcggatcgcggcgggttcgcaggcgtcctggcaactgcggcagtggatcccggccagggccaggcaggcttcgccgatcgtggcgatccaggggaaggccgggcgcgcgccatcgaacaggccggcctcgcagcggctggcgcattccccgcacagcgtgcagccggcgctggagaggtcgagttcgacgagccgaccggcgccgagcttcagcacgccttccgggcaggcctcgacgcaggcggcgcagcctgtgcagcctgcggcgaagtcggcggcggtccacggcgggcgacgcgtcggcgggtgcccgccgaggcggcggaacagctctcggcgactgctcatacccgacctcaggccggcggcccgggcgggccggccagtag

SEQ ID NO: 2997 - DNA, 753 bp, Pseudomonas aeruginosa
ccgcgcagcgcccgcgagggcatgcttcgatggccgggccggaaggtccggccgcatctcatccggaggaacctcatgaaactgctggtagtggaagacgaggcgctgttgcgccaccacctctatacccgcctgggtgaacaggggcacgtggtggacgcggtaccggatgccgaggaagccctctaccgggtcagcgaataccaccacgacctggcggtgatcgacctcggcctgccgggcatgagcggcctggacctgatccgcgagctgcgttcgcagggcaagtccttcccgatcctgatcctcaccgcccgcggcaactggcaggacaaggtcgaaggcctggccgccggggccgacgactacgtggtcaagccgttccagttcgaggaactggaagcgcgcctgaacgcgttgctgcgacgctcctcggggttcgtccagtcgaccatcgaggccggccccctggtcctcgacctgaaccgcaagcaggcgctggtcgaggagcaaccggtggcgctgaccgcctacgaataccgcatcctcgaatacctcatgcggcatcaccagcaggtggtggccaaggaacgcctgatggaacagctctaccccgacgacgaggagcgcgacgccaacgtcatcgaggtgctggtcggccgcctgcggcgcaagctggaggcctgcggcggcttcaagccgatcgatacggtgcgcggccagggctacctgttcaccgagcgctgccggtga

SEQ ID NO: 2998 - DNA, 2460 bp, Pseudomonas aeruginosa
gcctggacgattccgagctgggcggcgcctgcttccgcatacgtttcgctacagtctgagacttggcggccgttacctacgtctgaggtgtttccgcgctacgctgaagtctgttcggctggcgcagttcctttgacgcaggtaccggggattcgagcggatgttcagtggcaaaaccgacgacaggggcttgtgggcgggcatccaggccggtgtgctgttctttctcgccgccctggcctgcatctacctgtcgcgccagcccgccaccatcgcggcgatctggctgcccaacgcgatcctcaccgccgccctgctgcgcgcgccgctgcgccagtggccggcgatcctgctctgctccgccgtggccaacctggcggccaaccgcctgtatggcgacagcctgtggatgagcgcggcgttcctgccggccaacctgagcgaagcgatcttcgccgcgatgctgttacgcatcaaccgggtgcgcgaggacttcgaattcaacctgcattcggcggttcgcgtgctctgggccggcgcgctgattccgcccttgctcggcgcctcggtgggcgcggtgctggtcagcgtcttcggcatggggcgtttcccggaaatgtgggcgcgctggtacgtgggcgatgcgatgggcatgctcgcgctgctgccgttatgcatggccagcaacctggcggcctggcgtcacgctctgtcggggcgggcgggagtggacaacgcgatgctcctgctggtgaccctggtgatcagcttcgtggccctgacgcgcctgccctacgccttcatctacgtgctcctgccgctgctggtggccgccgccagcaccagcgtgttcggcaccgcgctgatcggttgcctgaacacctgtttcatcgccgtgctgatcgccctcggcgtgttcctccccgagtcgtcccagcagcgtttcggcgagccgctgctgtacctgccgatggccttgaccctcattcccgccttcctggtctcggtgatcatggagcgcagccgccgcgagcagcatcaggtggccatcggcgaggcgcagttccgcggcgccatggaattctcggcgatcggcatggccctggtgtcgctggaggggcggctgttcaaggtcaacgaggcgctgtgccggatgctcggctattccgccgaacgcctgggcgagcagtcgttccaggagatcacctatgtggacgacctggaactggacctcgacctggtgcgcgacctgctcgccgggcgtatcaactcctaccagatggagaagcgctacctgcgccaggacggcgaaaccttctgggcgcgcatcagcgtgtcgctggtgcgcgacgaggagggagtcgcccagtacttcgtcacccaggtggaggatatcgacagtcgcaagcgtgccgagctggagcgcgagcgcctcgccgaacggatcaagctggccaccgacgccgggcagatcggcatctgggagtgggacctggcgcgcaaccgcctgcactgggatttccgcatgttcgacctgtacggcatccgcagcggtcccggggagaccgccgtggagcagtggaaggcgagcctgcatgccgaggatcacgaccgcgtgctgcgcgagctggagcgcgccgtcagcgggttgcagaaattcgactgcgagttccgtatcgtccgccccaaccgcgaggttcgccacctgcgggcgatcgccacgctgacgcgcgacgaggacaaccgtccggtgcggatgatcggcatcaacagcgacatcaccgagatccgcaccctggcggaaaccctgcacgaggaaaaggaacgcctgcaggtgaccctgtattccataggcgatgccgtgttgaccaccgacgccggcggccgcgtgaccttcatgaacccggtggccgaggcgatgaccggctggaccttgcaggacgccatcggcgcgccccacgaactggtcttcaacgtgctcgacagcgacaccggcgaggccctggaaagcccggtgcgacgctgcctgcagaacacccgggtgttctacctggaggacggcgccacgctgatcagccgcaagggcgagcagcacgatatccagaattgcgcggcgccggtgcgcacccgcgatggcgagatcatcggcaccgtgctggtgttccagaacgtcaccaaggcccgggcgatgcagcgcgagctgagctatcacgcctcccacgatgccctcaccgggctgttcaaccgcaccaagttcgaggaggagctgcaacgcgccctggccaacgcccaggagcgggcgacccagcatgcgctgtgcttcatcgacctcgaccgcttcaaggtggtcaacgattccgccgggcacgcggcgggcgacatgctgctgcgcgagctgagccggattctcgccgaccgcacccgcgcctccgacaccctggcgcggctgggcggcgatga

SEQ ID NO: 2999 - DNA, 852 bp, Pseudomonas aeruginosa
ggaagtggagcgccagcaccgcgacatactcctcgccagcgggctgcgcgaggccctggagaacgaccgcttccagttgcaggcgcaggagatcgtcccggtcggcccccgccgcgacggcgaccggcactacgagctgctgctgcgactgtacgatccggatggccagatgactccgccgggcgccttcatcccggccgccgagcgcttcaacctgatggccagcatcgaccgctgggtgatcaacgaggcgctgatcaacttcggcgcgcggatcgccgcggtggagggcctgagcatcggcatcaacctgtccggcaactcgctcaacgacccgctgttcctgccttacctgctggatcgcatcgaacactcgccgctgaggccggagcgcctgtacttcgagctgaccgagacggcgttgatgaaccagttgtcggtggcttcgcggatcgtcgccaagctgcgcgacctcggctgcaaggtggcgctggacgacttcggctccggcctgagttccttcaattacctgaagaatttcgtcgtcgacgtgatcaagatcgacggcagcttcgtccgcaacctggacaagagcccggtggaccaggccatcgtcgactccatcaaccagatcgcccaccgcctgggcgcggtgactgtggccgagttcgtcgagagccgggaaatcctcgatcacctggcgcgcctcggggtggatttcgcccagggctacgcggtcgggcggccgcagccgttcgccacggtgctcgaccaactgcgcagcgggcttcgtcgccaggagttgggctgagcttcaggcttccgcctggtgccggtacgcgccgggggtga

SEQ ID NO: 3000 - DNA, 1461 bp, Pseudomonas aeruginosa
agaaagagcatcctggcacagcctctgcaatgcctgggcaaggttccgccgcggcggttcacgacaaaaaatctccccagcaaggggggtaacgctaccggtgagcgcgttccagggaactggcgaagcgcccccgtgaggactctgcccatgaccaaacaacccttctacaagagcctgtacgtgcaggttctggtcgccatcgccatcggtatcgcgctcggccactggtacccggaaacggcggtggcgatgaagccgttcggcgacggcttcgtcaaactgatcaagatggccatcgcgccgatcatcttctgcaccgtggtcaccggcatcgccggcatgcagagcatgaagtcggtcggcaagaccggcggcatggcgctgctgtacttcgaggtcgtctccaccgtggccctgatcatcggcctggtagtggtcaacgtggtccagccgggcgccggcatgcacgtcgacccgaacaccctcgacaccagcaagatcgctgcctacgccgctgccggcgagaagcagagcactgtcgacttcctgatgaacgtgatccccggcaccgtggtcggcgcgttcgccaacggcgacatcctccaggtcctgttcttctccgtgctcttcggctacgccctgcatcgcctgggcagctacggcaagccggtgttcgagttcatcgagcgcgtctcccacgtgatgttcaacatcatcaacgtgatcatgaaagtcgccccgatcggcgcgttcggcgccatggccttcaccatgggcgcctacggcgtgggttcgctggtgcagctcggccaactgatgctgtgcttctacatcacctgcatcctgttcgtgctcatcgtcctcggcggcatcgcccgcgcccacggcttcagcatcctgcgcttcatcaggtacatccgcgaggaactgctgatcgtgctgggcacctcgtcttccgagtcggccctgccgcggatgatcgacaagatggagaagctcggctgcaacaagtcggtggtcggcctggtgattcccaccggttactccttcaacctcgacggcacctcgatctacctgaccatggccgcggtgttcatcgcccaggccaccgatacaccgatggacatcacccaccagatcaccctgctgctggtgctgctgatcgcttccaagggcgccgccggcgtcaccggcagcggcttcatcgtgctcgccgcgaccctttccgccgtcggccacctgccggtcgccggcctggcgctgatcctcggcatcgaccgcttcatgtccgaagcccgcgcgctgaccaacctggtcggcaacggcgtggccacggtagtggtttccaagtggtgcaagcagctcgacgagggcaccttgcagcgcgaactggccggcgagggcaacgcttcgtcgcctgccagcgatattccggtgggcggccgcgaagcggtctaa

SEQ ID NO: 3001 - DNA, 222 bp, Pseudomonas aeruginosa
acctgctcgccctccggcgtcaggcgcatgccatggctgaagcgctggaacaggacgacgccggtgcgcgcctgcagagccctgagctgctggcttaccgcgccgggagtgacgcccatggccgcggccgcgcgggtgagattgccatggcgggcggtttcgacgaaagcgcgtagcgcgaggagcgggaggacggcacccatgaattcagtttttctataa

SEQ ID NO: 3002 - DNA, 327 bp, Pseudomonas aeruginosa
acaggttgtagaaaggatcgtttttcatccgccgacctgggcttcagcatgtgtggcgaaacgagagactttagcctagctgctttcttcggtgtgcgggaagcggccgaggcggtttccccggtcggcgccgcccccatcgcccaggcgccggatagtccagcgctgctaggatacttgccatgccttccctccagctctacagcgacagttcacccaacggattcaagatcaccatcgccctcgaagaactggggctgccctacgcactgcaccacgttcgcatcgaccatggcgagcaacgccgcccggaattcctgcgcctga

SEQ ID NO: 3003 - DNA, 2592 bp, Pseudomonas aeruginosa
ctttccatgcttccagcatgggccccatcctcggccagcgcgtgcatttcgagatcttcgccgaagagcggtacccgccggccatcgaacgctatcggcggctctccgaggaggttttcgccaccctcgaccagcgcctggccggacggccctggctggccggtgagcaatactccatcgccgatatcgccaccttcggctggacccatacggcgcggatcgtcgacttcgacttcagccattatcgccacctggacgactggcaccggcgcatggccctgcggcctgcggtgcagcgcgggatcctcctgccggaaccggcggtgggtccatgagcgccctgctgcaaggcgcctcggcgccggccttcgtcgggcaccctggctatcggcgcatgttcgccgcagacgcgctgaccctgggcctgttcctgccgttgcgtttctaccagggcgacatgcgggtgctgctgggccaggcgcggttggtcgaagaaatcgatcgactgggattcgccgccgtctgggtacgcgacgtaccgctgttcgacccacgcttcggcgatgccggacaagtgttcgacccgttcacctaccttggctatctggccgcgcggacccgccgtatcgccctggccaccggcagcgcggtgcttgccctgcgccaaccggtcgacctggccaaggccgcggcgagcgtcgaccggttgtccggcggacgcctggtgctgggcctcgcctccggcgaccggccggtggagttccccgcctacgggttggagcatgcgcagcgcggcgagcggttcgcccagggcctggactacctgcgccaactgctgcacggctgccggcacgtcgcctcgccgctcggtacgctggacgacgccgaactgttgccgcgtccgccggccggcgccatcccgctggtcgtcaccggctccgcgcggcagccggcggactggctggcacgccaggcggatggctggctgacctatccggagtcgactgtcgatgcgtccgggccacgtcgcctggccgggaagatccgcgcctggaggatgtccatcgcggacggcgggttccgcccgcacatgaccaacgaatggctggacctggtggacgacccggcgtatccgcgtacgccgttgcacggcggctacgtcctgcgcaccgggcgcaacggcctgatcgagctgctcggcgaatggcgtgcggcgggcgtcaaccatgccgccctgggcatccagttctccgccaggccggcagcggaagtcatccaggaactggccgaggaggtgctgccgctgttcccgtcccacccgggcgtgcagccggcgagcatggactggtagctgaccgattcggtcaaccgagcctgagcgctcgcgtcattgagggcgccggccggcgccgcctaccctgcggaaccactgaccgcagggagtccccgtacatgcaacggcagatcttcgagaccgaacacaacctgttccgcgatgccttccgcgcctttctcgacaaagaggtggtgccgcaccaggacgcctgggaagaggccggggtggtcgaccgcgctgtctggaggaaggcgggggagatgggcttcctgctgccctgggcggacgaggagtacggtggcgccgggctcaaggacttccgctacgagcagatcatgtgcgaggagctggcgcggatcaacgagccgggcttcatgatcccgctgcactcggcgttgtgcgggccgtacatcgccgaatacggtagcgccgagcagaaggcccgcctgttgccggggatcgtccgtggcgagaccatcctcgccgtggccatgaccgagccgtccgccggctccgacctggccggcatgcgcagcaccgcggtggacaagggcgaccactggctgctcaacggctccaaggtgttcatctccaacggcctgctggccgacctggtgatcgtcgcggcgaagaccgatccggcgaacaagcacgccatgggcctgttcctggtggagcgcggcatgcaaggcttcgagcgcgggcgcaacctgaagaagctcggcatgaagagccaggacaccgccgagctgttcttcaacaatgtgcgggtgccgaaggaaaacctgctgggcgacgccaagggcggcttcttctacctgatgaacatgctcgcccaggagcgcctgaccaacgcctgcggcgcggtggccggggccgaggcggcgttgcaggcgaccatcgactacgtgaaggagcgccaggccttcggccggccggtcgcgcacttccagaacacccgcttcaagctcgccgaaatgcgtacccagatcgacgtggcgcaggtcttcaccgaccgctgcgtgatggaccacaaccagaagaagctgtcccccgaggtcgccgccgaagccaagctgttcaccaccgagctgctgggcaaggtggtcgacgaaggcgtgcaactgcatggcggctggggctacatgtgggagtatccgatctgcaggatgtacgccaacgcccgcatccagcggatcttcgccggtacctcggagatcatgaaagagatcatcagccgcggcatgaagctctga

SEQ ID NO: 3004 - DNA, 825 bp, Pseudomonas aeruginosa
catcaactacctggcgttggccggcgtcgccagctacaccgggcgccgcgaacgtggcccgttgccgctgggggtacaactggcggacctcgccggcggttcgctgcatggcgtgatgggcctgctggcggcggtcatccaccggcagcagaccggcgaggggcagttcgtcgacatcagcatgaccgactgcgccttcagcctgaacggcatggccggcgccggctatctcgcggccggggtcgagccggagatggaggcgctggcgctgaacggcggcagcttctacgactactaccgcacccgcgatggccgctggttctcggtgggcagcctggaaccgcagttcatgcagcaattctgcgccgccatcggccgcccggaactggccgcccgcggcctgtcgccgaagccggaagagcagcgggcgctgaagcgcgagatcgagatggagttcgagaaacgcgacttcgccgaatggcaggcggtgttcgccgccctggatgcctgcgtggagccgctgctgccgctctccgaggcgctggaacacccgcagttgcaggcgcgcgggctggtcgcccgggtgccgctggcggacggcggcagccaggcgcagatggcctgtccgatcaagttttccgccggtctgccggcgcctcgccacatcggcgcggcgctcggtgccgacaccgtggcggtgctcgaaggcctgggctactccgccgaacggatcgccgagctgaaggcggccggggccatcgcctgaatcactcgcggagcacttcgccggtgaacaccagggtcgccttgcagcgccggcagtag

SEQ ID NO: 3005 - DNA, 1569 bp, Pseudomonas aeruginosa
gaacggcccgagcccgcgtcgctcgcgggtttagagcaaatcgaagcttcacggccggctgtaatagcgttgcagtatttccatcgccttgttgatcgattgcaggcgcgcggtgctgccgccgcggtcgggatggtgctggctgaccagttgccggtagcgcagcttgatggcgggatagtcgaccgcgccttccagctcgaacagggcgagggcggcggccttctcctcgctgccctgcatgcgcgtccagaaactctgcagcagccgctcgacgtcggcctcgctggtctcccccaggtgacgcaggtcgaggtagtagtcgcgcagcggatcgccctgttccagcgcctgcgtgccatccacgtaaggatgcaggcgcaggctcagcgggctgatctccaggtgcgcctcgcgctcggcccagaggtggtcgcgcaggtggtagagcgcgttgaacaggaggaaatgggtgcggaacagcaccagcttgtcggccagttcgcgatgggggatatgcgtcgaatggcgggccttcagcagctggatcaactggtattcggaaagtccctcgggatgctcgcgcagcaggcagaggatctgcccggcgaggtcgaggcggtggtcgaggtcgggagtcatgggacaagactagcatcgggcgtcgggaggggctggggtcggcgtcgctttgtgcgtaaaatagccagcttttctcctcgaacacccggattccagagcaccatgggcaccctttcggtcaatcagaacaaactgcagaagcgcctgcgccgcctggccggcgaggccatcaccgacttcaacatgatcgaggatggcgacaaggtcatggtctgcctgtccggcggcaaggacagctacaccatgctcgacatcctgctctacctgcagaaggtcgcgccgatccgcttcgagatcgtcgcggtgaacatggaccagaagcagcccggttttcccgagcatgtcctgccggagtacctgaagtcgatcggcgtggagtaccacatcgtcgagaaggacacctactcggtggtcaaggagaagatcccggaaggcaagaccacctgctcgctgtgctcgcgcctgcgccgtggcacgctgtacaccttcgccgacgagatcggcgcgaccaagatggccctcggtcaccatcgcgacgacatcctcgagaccttcttcctcaacatgttctacggcggcaccctgaaggccatgccgccgaagctgctggccgacgacgggcgcaacgtggtgatccggccgctggcctattgcagcgagaaggacatcgaggcctattcccagctcaaggagttcccgatcatcccctgcaacctctgcggttcgcaggagaacctgcagcgccaggtggtcaaggaaatgctgctggaatgggaacgcaaatcgccggggcgtaccgagatcatgttccgcgccctgcagaacgtggtgccgtcgcaactggccgaccgcaacctgttcgacttcgccaacctgcgcatcgacgagaacgccacgccgcgcttcctcgacgtgatgaacctctga

SEQ ID NO: 3006 - DNA, 1110 bp, Pseudomonas aeruginosa
actggcctggttggtggactgcctggcgccgattttcgacggcctgcggcaaccggtcacggtggtcgacccctccggtcgcttcgtctactacaaccgtgccagcggcctgctcgatggtctcgacccgcagcgggcgttgggtatgcacctgttgcagagcgctccctggctggcggccgagcaaagcacgctgttgcgttgcctggccgaagggcggccgtcgatcgatacgctgcaggcctacgtgggggccggcggcgagctgttgcagtatcgccaccgggcgatcccgctgcgcgggcgcgacggttgcctgctcggcgcgatggagctcggcgaagtcgtcgccgagaccgaagaggccgcaggcctggcggattgcccgaacatcctgagcgtggcgccgagcctgctgcggcagttgcagcgcctggacgttttcgccgccaccgacctgccgctgctgatccatggcgagaccggcaccggcaaggaactgttcgcccgtcgcgcccatgccctgagcccgcgacgcagcggtccgatgatcagcctgaactgcgcagcgattcccgagacgctgctggaaagtaccctgttcggcaccacacgcggcgctttcaccggcgccgagaaccgcaagggcatgttcgccctggcgcagggcggcagcttgttcctcgacgagatcaattccatgccgatggccatgcagagcaagctgctgcgggtcctgcaggacggcagctacctgcctctgggcagcctgagcccgcagcgggccgatgtgcgcctgatcgcggcgagcaaccagccgccgcgccaggcgatcgccgagggacgcctgcgcgaggacctgtactaccgtctggacgtgggcagcctgtgcatcccgccgctgcgcgagcgccccggcgatgtggaactgctggcacgggcgttcgtccgtcgcgatgcgcgcagcctcaacccgcgtgtcaccgctcttggcgagcgggcgctggcgcagttgctggcctgcgactggccgggcaacgtccggcaactggaaaacgtgatccggcgcagcctgttgctgcacggggagggcggcgcactgctggatga

SEQ ID NO: 3007 - DNA, 627 bp, Pseudomonas aeruginosa
gacacggtcgtgcccatgcttaaacgcttagcacccctcgtgcccatgagtttcgttctgctgctggccgcttgcgccagccattcgccggagccgcaggtcgccaaagagccgaccgcagccaagagcagcatcgacgtcgaacgcgacgcgatcgcttggcaggatgttgaggacgaaggggcggacaattcatcggctggtacgcctgcgctggcgtccagcatcctcgagcgcgctttcgaactgatcggtacgccgtaccgtttcggcggtacgacggcgaaaggcttcgattgcagcggcttcgtcggctacctgttccgcgaggaggccggcatcaagttgccgcgctccacccgcgaactcatcgatatggacgtaccgctggtctccaaggacgagctgcagcccggtgacctgctgttcttcaacaaccgtggccgtggtcgcgtcagccacgccggcatttacatcggcgatggccagttcatccattccgccagccgtcgcggcggcggggtgcgggtggacagcctggactccagctactggagcctgagctacatggaagccaagcgggtgctcgaacccggctacaaggatgccctgacgagcaagcgctaa

SEQ ID NO: 3008 - DNA, 657 bp, Pseudomonas aeruginosa
ctgcgacggggtgttgtggctgtagccgatgcagggatggcagaggatgtcttcgatgcgttgcagcgggccgtgccgttccaggtattccgggctgcaacacactacccggcggctggtgcccagttggcgggcgatcagcgagctgtcctgcaggcgggtgatgcggatcgccaggtcgtagccttccttctcgaagtcgacgatccggtcgtccagttgcaggaccacttccaggcgcgggttgcgcgccatgaattccatcaccagcggccccagccagagcgtgccgaagctcatcggcgccatcacccgcaattccccgcacaggtcgttctcgcgcagggccacgctttccgcggcgttgttcaggtcctgcagcgaggccttggccgacttgtagaagaagccgccggcctcggtcggctcgacgttgcgcgtcgagcggtagagcaggcgcacgccgaggtggcgctccaggtcgctgacgcgtttgctgatcacggacttggacaggctcatgcgttcggcggcggcgctgatgctgcccagctcgaccacgttgaggaaggcctgtatgtcttcaaggcgcaggctcatggcgaatctcgaaacaatcgggaggcagactgtcgcatgcgggagaactcctggtaa

SEQ ID NO: 3009 - DNA, 810 bp, Pseudomonas aeruginosa
cgcgcccggggaatggcattgttctcgtatcgagaacaccgttttcgcattttaccgggcggtaaatcgctgtcgctgtcactactcttgatgggcggcgtgcgctcccgagaccgcccatgcttgcctcccaggaggcgcttcgtttcacaccgcgcggcgacggacgccgcccgagaccggagaaacaccatgtccttcacctacaagcgactcgacaagaacgatgcggcggtgctgttcgtcgaccaccaggcaggcctgctctccctggtccgcgatttcagcccggacgagttcaagaacaatgtcctggcattggccgacatcgccaggttcttcaacctgccgaccatcctcaccaccagcttcgaggatggccccaacggcccgctggtgccggaactcaaggaaatgtttccgcaggccccgtacatcgcccgccccggcaacatcaacgcctgggacaacgaggacttcgtcaaggcggtcaaggccaccggcaagaagcaactgatcatcgccggcgtggtgaccgatgtctgcgtagccttcccgaccctctcggcgctggaggaggggtttgacgtattcgtcgtcaccgacgcctccggcaccttcaacccggtggtgcgcgacgccgcctgggcgcgcatgaccgccgccggcgcgcaactgatgaactggttcagcgtcggctgcgaactgcaccgcgactggcgcaacgacatcgaaggcttcggtgccatcctcggcggccacctgccggcgtacgccaacctgatccagagcttcggcacgaagaagtaa

SEQ ID NO: 3010 - DNA, 2163 bp, Pseudomonas aeruginosa
cggcgaccgcctgcaccggcgcctgtacctgccgggtctggtggtcgaggacgaagtcgtgctgaaggcgccggacagtgcccactacagcatcaagccgagcgccgaggtggccggcggcagcctcgacatgaccatcgaggagccggagcccggctcgctgttcgtgcgtttcgcctactgcacccgctacctgcagccgctgggcgacgaactgccctacgacgccttcgtcaagcaggcctatatcgccatggatgtggagaccatcgccaccatccgcgaccggttcggcgccagcgccgccagcgggagttgagcgtggaacacggaagcagttttctccagtccggcgtggtcttcctgatcgcggcggtgttcatggtgccgctggccaagcgcctgcaactgggcgcggtgctcggctacctgctggccggcgtgctgatcggtcccagcgtgctgggcctggtggacaacccggaaagcgtcgcgcagatctccgagatgggcgtggtattgctgctgttcatcatcggcctggagctgtcgccgcggcgcctgtgggtgatgcgcaagtcggtgttcggcgtcggcctgctgcaggtgctgctgaccggcgtggtgatcggcaccgtggccctggtcggcttcgaccaaccggtgaacagcgcggtggtgctcggcctgggcctggcgctgtcgtccaccgccttcggcctgcagatcctcgccgagcgcaaggaactgacccagccccatggccgcctggccttcgccatcctgctgttccaggacatcgcggcgatcccgctgatcgccatgatcccgctgctcagcggtgcgcacagcgacgccggcggcagcgaactgacccagaccctcaaggtggtcggtagcatcgccgcggtggtggtcggtggccgctacctgctgcgcccggtgttccgcatcgtcgcccaaaccaagctgcaggacatgtccaccgccactgcgctgctggtggtgatgggtaccgcgctgctgatggagctggccggcgtgtccatggccctcggtgccttcctcgccggcttgctgctggccgactcggagtaccgccacgaactggaggcgcagatcgagccgttcaagggcctgttgcttggcctgttcttcatcagcgtggggatgagcgcggacatcagcctgctgctcaagtcgccgtggatggtgctcggcctgaccgtgctgctgatcgccctgaaggcgccggtgctgtacttcgtcggacgcatttccggcggcctcgacaaggcctcggcgctgcgcctgggcgtggtcctggcggccggcggcgagttcgccttcgtcgtgttcaagatggcccgcgaccagggcctgttccagaacgacctgcacaacctgctggtgctttccatcaccctgtcgatggccctgaccccgttgctggtactcggcctcgcgcgcctgctggcgaaggagccggaggcgacgaagccgccgccggaaatggaacgcatcgacaacgacgacaccccgcgcgtggtgatcgccggggtcggccgcatgggccagatcgtcgctcgcgtgctgcgcgcccagcgcgtgccgttcatcgccctggacacctcggtggagaccatcgagctgacccgtaccctcggcgcgatcccgatcttctacggcgacccgatgcgcccggagatccttcgcgcggcccaggtagagaaggccgagttcttcgtcatcgccaccgatgacccggagaccaacatcgagacggccaagcgcgtgcgcaagctgtatccgcacctgaagatcatcgctcgcgcgcgtaaccgccagcacgtccacctgttgctcgacgccggggtcgagccggtgcgcgagaccttcttctccagcctggagatgagccgcatggtgctctgcggcctgggtctgagcgaggaacaggcggacgcgcggatccgtcgtttccgccggcacgacgaagaggtcctggcctcccagcacctgttctacaacgaccgcgacgcgctgatcaaaagcgctcgcgaggcgcgggtcgagctggagacgctgttccagaccgaccagttggaagaccgtggcgcggtagcggcggagaccccggagaaaccttcccgcgcctcctag

SEQ ID NO: 3011 - DNA, 987 bp, Pseudomonas aeruginosa
cggcgcgaccgccgtgaccctggtgccgtcgctgaccgacaaggccgcccacgtcaccatgctgcagcgctcgccatcctacgtgatcaccctgccgcagaaggacgcgatctccaatttcctccgccgcttccttccggaaacctggatctaccgccaggcgcgggcgcgcaacgtggccatgcagatggtcttcttcatgctcgccaggaccttccccggcctggtccgcaaggccctgctcaagctggccagcctgcaactgggcaaacgcttcgacatgcgtcacttcagcccgcgctacaagccgtgggacgagcgggtctgcgcggtgccggacggcgacctgttcaaggtgctgcgcaagggcaaggcgtcggtggtcaccgagcacatcgaccgcttcgtcgagcggggcattcgcctgaagaccggcgaggtgctggaggcggacatcatcgtcaccgccaccggcctcgacctggtgatgttcggcggcgccgagctggcggtcgacggcaagccgttccaggtcaaccagagcatgggctatcgcggcatcatgctgcgcgacctgccaaacctggcggcggtggtcggctataccaacgccagttggacgctcaaagcggacctctccagcgaatacttctgccgcctgatcaatcacatggatgccaccggcatgcgccaggtgaccgcccgcgacagcaccggcgacgtgcgcgaggagcccttcctcaacctcgactccggctacatccagcgcgccgccgagcgcatacccaagcagggcgaccggatgccctggaagctttaccagaactacgtcctcgacctggcgctgctgcgctacggcaaggtcgaggacggctacctggtgttctcctcgccggcgccgcagcggcaagccggcggcgcggcggtgcaggccctgggctgaacccggtgggcgtcgctcaggcgttcgccacgacctgcccgtag

SEQ ID NO: 3012 - DNA, 828 bp, Pseudomonas aeruginosa
cgccgctgcgtcgagagaggctggggcgcaacgaaagcagcccctcgcccgtgggggcgaggggctgtcgggtcaggccacttccaccagcagcacttcgctgtcttccagggcggtgaccttcagggtcggttcgtcgcgtaccgccaggccatcgcgggcctcggcgcgcacgccgttgacctcgatgctgccggtggccggtaccaggtaggcgcggcgaccgttttccagggcgtactcggcgctctggccggccttcagggtcaccgcggcgacctcggcgtcggcgcggatgtgcagcgcttcgctgtcctgctcgtcgccgctggcgagagtgacgaaacgaccgtcgcgctcggccttcgggaacggtttggagccccagcgcggctggtcgccgcggcggtccgggatgatccagatctggaagatccgggtggtctcggcttccaggttgtactccgaatggacgatgccggtaccggcgctcatcacctgcacgtcgccggcctcggtgcggcccttgttgcccaggctgtcctggtgggtgatcgcgccttcgcggacataggtaatgatctccatgtcgcggtgcgggtgcggcgggaagccgctgccggcggcgatctcgtcatcgttccagacccgcaggcggccccagtcctcgcgctccgggtcatagtagtcggcgaaggaaaaatgatgacgcgcgttcagccagccgtggttggcatggcccagacggtcgaagggacgacgttcgatcatgatcggatctccattgggcccgtcgccgctcgtttgcgcgagggtgcgggcggttga

SEQ ID NO: 3013 - DNA, 1533 bp, Pseudomonas aeruginosa
cgaggctccgtattcctgctgccagagcgacagggtggtgagggtgaacaactggtcgccgggcagcgccgcgacgctcggtgcatccaggccttccaggccgaggtcgtggagcgccggcaggcgttcggcgaggtgccggcgcatttccccgagggcctgcggccaacgttcgaacggcaggcggaaatgccgtttcggctgcgcctgccagcgtttctcgcgctgctccaggagcgccaccagcggtgccttggcggtgtcgccgacgatccgctggaggcgcccggcgcgctgcgccagggcgccatgcaggtagggggtgcgcgcttcgatggtgcgcgacatcagcagatggtcggcgcggcgcagcagcggctccagcgagtagtgcagatcgaactggccgatcgccgcctcgaggccctggccgagggcctcgtgggcgagttcctcgatccgctcggcgacccgtcggcccgccggttccgccagcagcgcggccttgcgccggtactcgccgaaccaggcggcggcgaagcgccgcggttccggtgcgtcgcgccggcgccagagttcgagatggcgcgggtagccccagaacagttcgtcggcgccttcgccgagaagcacgcagtgatagccctgctcgccgataccgtcggccaggcgctggtacatcagcaggctggacatccgtgtcgccccgccgaagttgccgaccgcgcgacgcagcagcggcatgaaggcttcctggcgcagctcgaagcgttgcagccgagggtgtggcagcaggctttcctcgtcgccttccaggcacaggtgaaagcgttgcaactgcgggtccaggtagctgccgagcaggttggaatcgaccccgccgctgaccagcagggcgcaggggcggaaggtctggcggcagcgttcgagggtttcgccgagctgctcgtcgaggctgtccacctcgctggccggggcggtggccagccgctggcgctggcagaggcgcggacgctcctgggagagatcgaagcgcaacacctcgccgggcagcagcagacggacctgctggaacagggtctggccttccagcggcacgccggcggcgaccacctgggcgatcgcctcggcgtcggcgcgggcgccgccgagcaggtgcagcagcgcccgcggctcggaggcgaaggccagcaggccgcgctcgggctggtagctgtagtacagcggcttgatgccgaactcgtcgcgcagcagggtcaattgccgggtctgcgggtcccagctggcgagggcgtacatgccgtccggcagtaccccgcgctgcaagccgtcgagcagcaggcggatctcgccatggatttcgcagccggcctggtagacctcgccgttgtaggcgacccgccgctggccctcctgcggcggcagcggtaccgccgcggcgccggacatcggcaggcgggtcatgccgatggcgccgttcggcaaggccgcgatgccctcgccgaacgggccgcgatgggccagcaggcgtag

SEQ ID NO: 3014 - DNA, 438 bp, Pseudomonas aeruginosa
atggttgctgccgcaagcgcgcccggcgccgtcgatgctggtcggcggtgtcgggcgctcgctggcgttgcgttggccagccgtcccggccgggtgcgtaggcaccggccggaggttttcaggaggcgggcagcggcgcccccttgggccatagcagccagagccggcccggctgcttcatgtgtccggcgagttcgccggcggcgtcgccggtgccccagaacagatcggcgcggacctcgccgacgatggccccgccggtatcctgggccgccaccggacggaccaccgcgctgccgtcgtcagggcgggtggtggacagccacatcaggctgcccagcggaatcaccttgcggtcgatggccacgctgtagccgtcggtcagcggtacgttcagcgagccgcgcggactttcgtcgctgtccgggcgcaggctga

SEQ ID NO: 3015 - DNA, 483 bp, Pseudomonas aeruginosa
cttcggcgggtttgggcgggggctctttcttgccgtcgtcgcatgccgtcagcagggcggcgaaagggagcgcgcagagcagcaggcggcgccagggatggaacggaaacttcacgccaaggacttcctggtggtggatcgaagcccgctagcttgggcaaagcgcgacggtgcgtcaaaccgcggcgacgaccgaagcgtatcgccgcgttacaccgaggcggcgatgagttcgcgcagccagcgatgggccggatcgcggtgcgagcgctcgtgccagagcatggccaggtcgtagccgggcacctccaggggcgcctcgaccacccgcaacctgtcgcgctcgcgtaccagtcgcgacggcagcagcgccaccaggtcggtgctttccagcaccgcgcggaggaacaggaagtgcggcaccgacaacgccacccggcgttccgcgccgagttcggcgagcgcctggtcggtgggacctag

SEQ ID NO: 3016 - DNA, 1083 bp, Pseudomonas aeruginosa
cggctcgcgcagctcctccgcccgcgccgtcgggcgcatcccgcgcgggccgggaagcagcaagggatcgtcgaagatcgcccgcagcttggccaggtgcacgctcaccgagggttgggaaaaattcaggcgttccgccgcgcgcgtcacattgtgttcggtgagcagcacgtcgagggtcaccagcaggttcaggtccagtcgccggagattaatcatccatatacctggaatttcggatattcatttcaactatatccggcgatggccgatcctgcgcccaccttttgccggagacccgccatgaacgtactcatcgtctatgcccatcccgagccgcgctccctcaacggtgcgctcaaggacttcgcggtcgcccgcctcgaggcggccggccatgcggtgcaggtttcggacctctacgcgatgggctggaaggccgtgctcgatgccggcgacagcctcgagcgcgaggccagcgaacgcttcgatccttccgcaacttccctgcgcgccttcgagaacggttggcagagcgtcgacatcgccggtgagcaggacaagctgcgctgggccgatacgctgatcctgcaattcccgctctggtggttcagcatgccggcgatcctcaagggttggatcgatcgcgtctatgcctgcggcttcgcctacggggtcggcgaacattccgacagccactggggcgaccgctacggcgagggccggatgcagggcaagcgggcgatgctggtagtcaccgccggcggctgggagtcgcactacgccgcgcgcggtatcaacggaccgatggacgacctgctgttccccatccaccacggcatcctgcattaccccggcttcgaggtattgccgccgttcgtcgtctatcgcagcggccggatcgacgcggagcgtttcgccgcgctgagcgagcagttgggccggcgcctcgatgacctgcagcgcgctgcgccgatcccgttccgccggcagaacggcggcgactacctgatcccggcgctgaccctgcgcgacgaacttgccccgcagcgggccggtttcgccatgcacctggccgaatga

SEQ ID NO: 3017 - DNA, 249 bp, Pseudomonas aeruginosa
ccgaggatctcggcggtgcgttgcaccgaaacgccggcggacagttgctgcagggcgatgatgatctgcaattgctggcgccactggccgaaggtcatgccggtctcccggcgcaccatccgcgccagggaccgctcgctcatcgccactcgcctggcccattcggccatgctggcgcggtcgccgggggcgcgggtcagttcgtcggcgatgcggcgcaggccgcggttgtccggcagcggcaggtag

SEQ ID NO: 3018 - DNA, 360 bp, Pseudomonas aeruginosa
tcctgcggttgcgcgctcaggtgcaggatcagttcgaggaccagcggcgacagggccagggtgcagcagtcgctcggcaggcgtgccgcccccggctcgacgaagaggaagcagaccttgccgttggcggtgacccggttgctatgggcgatgccgccgggaatccacacaccgaaaccggccggcaccatccacaggccatcgggcaccgtgcaggtgatgccgccgcggcaggccaccaccagctggcccttgcgatgccggtgcaccggcacttcggtgtcgttgtgccgggcctccagctgcagggccagggccggctggccgagcgcgtcgggatcgaagcgttgggcgaggtag

SEQ ID NO: 3019 - DNA, 288 bp, Pseudomonas aeruginosa
gtagtcgatatttgcaaatcgccacgacccgtagcctgtgctcctcaacccgacaggagcggccgaccgctccgcgccctcgataccctggtgccctgcatgctgagcgaagtctccgtttccggcctctacgtgccgccattgttcctctacctgtgcctggcgatgccgctctacctgctgctggagcgcctcgcctggcgctggctggaatgcgcctggcatcccggcctgctgcgtttcttcctgtcgttcatcgtgctgtccgtgctggtgctgaagttctga

SEQ ID NO: 3020 - DNA, 921 bp, Pseudomonas aeruginosa
gccgaggtccccatgtccatcgttcgtctttccaaggtggctgcgaccttcgcctgcggcctgctcgccctgtgcctggcgttgcagttgtggcaagcctacgtgctggcgccctggacccgcgacgggcgggtcagcgcgcaggtgatccgcattgcgccggaagtctccggcagcgtcgaggcggtgttcgtcgcagataaccagcgggtggcccgcggcgatccgctgtaccgcatcgatccgcgcagctatcgcctggccgtgcgccagcgcgaggcggagctggagcaggcgcgggaaaccctgcgccaacgtgacgagcaatggcgccgacgcatgcagttggccggcgcggtttcgcgcgaggaggtcgccaacgccggacgcgccctgcgtatcgcccgcgcccgcgccgaggccgccggggcggcgctcgaccaggcgcggctggacctgcggcgcagcgagttgcgctcgccggtggacggctatgtgacgcagttgcgcgtgcagcccggcgattacgcggcggcgggccggaccaacatcttcatcgtcgatcggcgaagcttctgggtcaccggctatttcgaggaaaccaagctgcgcaatgtacaggtcggcgcgccggcgacgatcaagctgatggggttcgatccgctgctcgacggccatgtcgcgagcatcggtcgcggtgtcgccgacctcaacgaaagccgtgccgacagcggcctgccgcaggtcagcccgaacttcagctggatacgcctggcgcagcgcgtgccggtgcgcatcgaactcgaccgggtaccggcgggcgtggtgcttgccgctggcatgaccggcagtgtcgaggtgctgcaggcggggaccgcgcggcactggcggctgacccgctggttgcaggagtacctttga

SEQ ID NO: 3021 - DNA, 822 bp, Pseudomonas aeruginosa
aaagacagcgcccccactgcccgccaaggcccgcccgatgctgatcgacctgccttccacccggtccggtcttcgcctattgcccaggattatctccacggcgagcgcgtcgagctgcaccggcattcgcgcgcgcaattgatccatgcgctcagcggggtggtcacggtcggcactgccgagggcacctgggtggtgccgccgggacgcggtgtctggttgccggccggtatcgagcatgccctgcgtttcgccggccaggtgcgcatgcgcaccttgttcatcgccccgcaggcgcgccacgacctaccgcgggactgccgggtggtggacgtgccgccgttgctgcggcaattgatcgtcgcggcgatgcggatcgccccggactacccgccgggtggccgcgacgagcgggtgatggagctgatcctcgatgaactgcgggtgctgccgatcctcgccctgcacgtgccacagccggtcgatccgcgactggcggcgctgtgccgcagcctgcgcgccgagccggccgccgactggagcctgggcgatgccgcgcgtcgcctgggcgtcagcccgcggaccctgacccgcgccttccagcgcgaaaccggtctcagcttcgtccagtggctgcggcgcatgcgcctgctcgccagcctcgatgcgctggcggcagggcactcgatcctcgaggtcgcactggacctcggctacgacagccagagcgccttcagcgccatgtttcgccggaccctgggcgtttcgccgagcctctatttcggccgcggcgccgcctacggggtggccgagggcgactga

SEQ ID NO: 3022 - DNA, 1323 bp, Pseudomonas aeruginosa
gcggtggagatccacgagccctcctcgaaggtggctcccagcgcgccttctatctccggcagcgccgcgctggtgacgtgcacgttcatgccggccatgaagcagccgaacaggccgccggtgacggcgacccaggcacgcagcgataccttgtcgtcagcgctcatcggcggaggctccgtccggttcgcgagtgtccacggtggcgatcaccgacatccccggaagcagccggccccgctcggcggcgtcggcgtccaggcggatacgcaccgggaagcgctggacgatcttggtgaagttgccggtggcgttgtccggcggcagcagcgcgaataccgcgccggaggccggcgccacgctgtcgacgcggccgcgccagcggcggccgaacgtgtccacctccagctctaccggttgcccgggacggatgcgttcgagctgggtctccttgtagttggccaccacgtaggcctgctccagcggcaccaccgccagcagcggcagccccggcgtgacgtactggcgcaggcgcaccttgcgctggccgacgcggccggcgaatggggcgcggatttcggtatcgtccagggcgtggcgcgccagttcgcgcgccgccgcggcttcctgcagctccgcctggcgctgggcgagcgccgcctccgcctcgcgtcgccggctcttcagtacgtccttggcggcgcgctggcggccttcctcggcgcttgcccgccgcgccgccgcccgcgctcgctggtgcgccgcgtcggcgttctccaggcgctggcgactggtggcatgctcgtcggccaattgccggtagcgtcgccagtcggtctcggcgcggcgccattcggctcgcgccgcttcgccatcggcgcgggcgcggctgatcgtctgcgcctgctccagcagttgccgatcgagggtctccagcttcgcgcgctgggcttccagcgccgcctgcgccgccgcttcgcgggcctcggcggcgcgcaggcgctggcggaagtcgcgcgggtccaggcgcagcagcaggtcgccggcctggacgtcggcgtcgtcggccaccagaacctcggcgacgtagccggagacctgcgcgctgaccgccacccagtcggcgcgtacataggcatcgtcggtgccctccaggaagcgtccgctgctccaccaccaggccagcagggcggcgagcgcgatggcgccggcgaggccgcccagcagccaggttcggcgccggcgcgtggctgctggcatggtttcgccagtggtgtgttcgatgggttccctgattgcctggttcattgtccgttttcctga

SEQ ID NO: 3023 - DNA, 1833 bp, Pseudomonas aeruginosa
  unsure (36),(37),(40),(41),(42),(43),(44),(49),(58),(61): Identity of nucleotide at the above locations are unknown.
tccccgcccttacccggtgcgtcgtggacaccctcnngannnnntgggntccccgggnccnctctcttaaaggcttcctgttccgggggggtcgcgcgctgccccggccccgggcccggggcttgcgtctcgcgcgacagcgtgccgcctacgtctccccgtggtgacgggcgcagggcgatggcttccgttatggaagtatctgaaatgtcctgcgcatggggtacgcacagctcggaagcggagtgctcgttcggcgcggcgctattcgctcgacggtcttttcccaagaacctagaatccgctgcacgcgcgcctgccaggcgggtgttgcgtcgttttccgctggagtgccccatgcccgtcgatctaccgaacctgttgcttggcctgctggctgccgcgattcccctggccggcctggcatggcagctacagagaagggccagcctggcggagcgcgagatggcgttgctcggcgagcgactggcgaccgcgcaactggcccaggacgggctgaatgcgcagttggagaccagtagggaggcttaccagcaactcggcgagcgccatgccaggctctccggcgaggtcgccgcgctgcgtcgggaagccgagttgatgggggaggagcggcaacgggcgtccctggcggaggcacgttgggccagcgagcgccagggccgggaagaggaagtgcgtcgcctggcttccgaacgggctgcgctggctgcggaacttcgcgagcagcaggaaagccaccagcagcgcctgaccgacctgcagtcggcccgcgacgagttgcgggcacagttcgccgaactggcgggaaagatcttcgacgaacgcgaacagcgtttcgccgagaccagccagcagcgcctggggcagatgctcgatccactgaaggagcgcatccaggcgttcgagaagcgggtggaggaaagctaccagcaggaagcgcgcgagcgtttctccctgagcaaggaactggagcgtctgcagcagctcaacctgcgcctgggcgaggaagcgaccaacctgacccgcgcgctcaagggccagaagacccagggcaactggggcgaactggtgctggagcgggtgctcgagcatgcaggcctggaaaaaggccgggaatacgagacccaggtcagcctgaagggtgccgagggcgaacgcttccagccggacgtgctgatccgcctgcccggcgacaagcaggtggtggtggatgccaaggtcagtctcacggcctaccagcagtacatcgccgctgacgacgatctgctgcgccagcaggcgctgaagcagcacgtaacgtcgttgcgcaaccatgtgaaaggcctctccggcaaggactatcgacgcctggaaggattgcacagcctcgacttcgtcctgctgttcatgccgatcgaggcggctttctcgacggctctgcaggccgagccgaacctgttccaggacgccttcgcgcagaatatcgtgatcgtcagcccgaccaccctgctggccaccctgcgggtaatcgacagcctctggcgccaggagcggcagaaccagaatgcgcgggaaatcgccgaacgtgccggttcgctgtatgacaagttcgtgctcttcgttcaggacctcgatgaggtcggttcgcgcctgcagcaactggacaaggcctatgccgcggcgcgcaacaagctcaccgagggacgtggcaacctgatcagtcgcagcgagcaactcaagctgctcggtgcccgcgccagcaagagcctgccgacggactggctggaccgggcgctggtggcgcccgtggaagaggccggagaggagtga

SEQ ID NO: 3024 - DNA, 708 bp, Pseudomonas aeruginosa
tgctggcgcttttttcggctggggtctttactccctatttgtcggttacaaccgatccacgaggagagttccaatgagcatcacgaggaccgctttacccctgattctggtcagcggcttgctgaccggttgcgcagggttgcagaaaagcgactggccgacctgtgcggcggtcggtggtgtgttaccggcgccggcctgggcgcgatcgaaagcagcagctgggccggctggggcgccctgatcggcggtggcgtcggtgccgcctattgctgggtgcacggtgccggcgaacaggtcgcgccgccgcctccgcagccggtcgaggaagtcgcgccgccgcctcccgtcgtcaaggaagaaaccattgtcgtgcgcgacctgcacttcgccttcgattcgtcgaaggtggacgccgccgacagcgagaagctcaacggcatcgccgaacgcctgaaaggcgaggcggccagtacgcgcctgagtatcaccgggcataccgacagcgtcggttccgatgcctacaaccagaagctgtcggaacggcgcgcgaatgccgttgcgaactatctgattgatgccggggtgccttcgagcatcatcgtcggcgtgcagggattgggcgaaagccagccggtcgccgacaacaagactcgcgaagggcgggccgagaatcgccgggtggaaatcctcatcaagcgcgaatga

SEQ ID NO: 3025 - DNA, 807 bp, Pseudomonas aeruginosa
ccgccctgtcgaaccactgaaaatttatccagctatggcgcgccggcggattcgtcttccgctgcgcgccgggcccaggaattccatgctcagcgccgaactcaagtcccagatccagggtgcctacacccgctttctcgaagccaaggagctgaagcctcgctatggccagcgcctgatgatcgccgaagtggccaaggccctcggcgcgatcaaggaggacgaggaggggcaccgcgagggcgagccggcggtggtcgcggtggaggccggaaccggtaccggcaagaccgtggcctacagcctggcggcgatcgcctgcgccaaggccagtggcaagcgcctggtgatagccaccgcgaccgtcgccctgcaggagcagatcgtccacaaggatcttcccgacctgctgcgcaacagcgggctggccttcagcttcgccctggccaagggccgcgggcgctacctgtgcctgtccaagctcgacgtgctgctgcaggaaggccaggcgcagagcgcgacggcgcaactgttcgccgacgacggtttcaacatcgatgtcgacgagaccagcagcaagctgttcaaccagatgatcgaacgcctggccggcaaccgctgggacggcgaccgcgacagctggccggaggcgatcgacgacgcgcattgggcgcagctcaccaccgatcacagccagtgcaccaaccgacattgcccgaacttccagcagtgcgccttctacaaggcgcgcgaagggatgaccaaggtcgacgtgatcgtcaccaaccacgacctggtcctggctga

SEQ ID NO: 3026 - DNA, 1140 bp, Pseudomonas aeruginosa
tcttttggcgcgcgcccagggcaactgggaactgtggaccgccttcacctgcgaggacccgcaggacagcccgccgatggcgcgctggctgaccctcgccgagagcggcagcttctacgacatcgaagccaacgccagcccgatcctcgccgccgagaccctgcgccgcaacctgtggaacgtcgcctatggcgtgctggtgacctcggcgaccctgaccgcgttgggcaccttcgaccgctaccgcatgcgcgcgggcctgccgcgcaacgcggtcaccgcggtggtgccgagccccttccaccatgccgaggccggggtattgcgggtccccgacctcaaggcggatccgcgcaacgccgccgagcacaccgcggcgatcattcgcgagctgccggaactggtgaagggcgcgcgcggcagcctggtgctgttctcctcgcgcaagcagatgcaggaagtcttcgacggtctcgaccgcgactggcgcaagcgggtgttcatccagggcaacctgtccaagcaggaaaccctgaacaagcacaagtcgcgagtcgacgacggcgaggacagcgtgctcttcggcctcgccagtttcgccgaaggcgtggacctgccgggggcctattgcgaacacgtggtgatcgccaagattcccttcgcggtacccgacgacccggtggaggcggcgctggccgagtggatcgaggcgcgcggcggcaatccgttcatggagatcgccgtgccagacgcttcgctgcggttggtccaggcctgcgggcggctgctgcgcaccgagcaggaccgcggcaccatcaccctgctggatcgccgcgtggtcacccagcgctacggcaaggctatcctcaatgcattgccgccgttccgccgggaaatcgcctgacgcgctggcctgcgcgggagggcgccagccttcacgtccgagccgcatcaggaattcccggcatttgcccaggccgggatggagttaaggaaaacaggcttcatgatccgttcgcgttggcatcttcccctgcttctcggcctgctcgcggtggccacgccgctggcggcgagcgacatccagcaggtactgttcaacttcgtcaagccaatggccgtggtcggcatcacccttga

SEQ ID NO: 3027 - DNA, 768 bp, Pseudomonas aeruginosa
ggatgccgacctgcccagcgcgacggcggaggccaccccggagggcgacattctccgtcgcgtcaccttcagcccggcgcaacggcccaccttgcgcatgagtccggcgctgggccgttgggactggtccgcagcggactacgtgagcctgcgcatccagaacgcgatgagctgggacatgaccctggaggtcgcgatcgagggcgagcagggcgcgccggggctgcaggcatccatcgagctaccggcaggcccgccgcagaccctgctggtgccgttgcgggcggtttcgccagaggctctgggcatgcgtgcggggccgccgatgccacagatggtcgaaggccagcgggtgctgctggcgccacgcgtggagggctcgctggaccgcgccagggtcggagcgctgagcctgtccctgcgctcgccgcaagctccccagagcatcctgctcggacgtttcggcatacgcacagggagggcggtggagcggagcatcctgaccggcctgatcgatcgctatggccagtacagccgcgccgactggccggaaaagattcgttccgacgaacagttgcgcagcgcctatgcggccgaggccgcacagctccgcgactgggaacggcagacaccggcgcgcgaccgtttcggcggcctgctgggtgggccggtgttcgaagccagcggtttcttccgcacggaaaaacgtggcgggcgctggtggctggttactccggaaggacatccgttctggtcgctgggcgttaa

SEQ ID NO: 3028 - DNA, 408 bp, Pseudomonas aeruginosa
cgccccaaggccactgtgacagccgtttcgccccgcttgccgaggccttcgcccggcttttcgacaatccgcaggagcgcggcgcggcgttgtgcctggaggtcggtggcgagacggtggtcgacctctggggcggcgtcgcggacaaggacggcgagcagccctggcagcgcgacaccatcctcaatctgttctcctgcaccaagaccttcaccgccgttgccgtgctgcaactggtggccgagggcaagctcgaactggacgcgccggtggcacactactggcccgagttcgccgcggccggcaaggcagcgatcagcgtgcgccagttgctctgccatcgcgccggcctgccggcgctgcgcgagcagatgccgcccgaggcactctacgactggcaggcgatga

SEQ ID NO: 3029 - DNA, 945 bp, Pseudomonas aeruginosa
ccggcggttgagccgaatgttccatcgggctcgccttctttcacttccaacggaccccgacgtatgaaactgcttaagacctcgacgcttcttctctgcatgaccgcctccggctgcagctatttccagacccaggacgcttcctcgcagccagccaaggctccggccgagcaggcttccagccattcatggtggccgttcggcaaggacgacggacagaccgtcgccaagcaggccacggaacagaaggccgaagccgagcatgtcggctccagccactggtggtggccgttcggcaaggacgaaggcggtcgggacgtagccgccaaggctgcggagcagaaggccgagatcgccgcggcgaagaaagaagtcgccgccgcagccgagccgaaggccgccaacccctggtggtggccgttcggcgccagctcggcgagcaaggcgtcgggcaagccggcactggtccagcagaaggtcaccaaggagtggctggatgcccatgagaaagccctgcgcgaagcgatcgccggtagcgagttcaccctcgaacgccgcgacaacgcattgatcgtcatcgcccccgccgactactcgttcaatcccaagcgccacaccatgctgatgccgatcaccctcaacccgctgggcaaggtcgccaagatggcccaggccgatccgcagagcggtatcctggtactcggccataccgacagcaccggcagcaaggcggtcaacgacaagctgagcttcgagcgtgcccagtcggtggcggcgatcttccgcctcagcggcctgaaaggcgaccaattgcgcctgaagggggtcggttccgacatgccgcgcgcggacaacgccagcgccgccggccgcgcccagaaccgtcgcgtcgaagtgctctatacccagcgcgccagcctgctgtccctggcccagggcaactga

SEQ ID NO: 3030 - DNA, 1473 bp, Pseudomonas aeruginosa
ccttcttctggccggcgctggagcgccaggtgcgcatcgaaggcagcgtcgagaaggtcactcccgaggaatccgacgcctactaccaggtgcgtccgctgggcagtcgcctgggcgcctgggcctcgccgcagagccgggtcatcgccgatcgcgccgagctggaacggctgctcgcggacaccgagcggcgtttcgccgaccagccgccgagctgtcccgagcactggggcggctaccgtctcctgccgcagcgcatcgagttctggcaggggcggccgagccgcctgcacgaccgtctcgactatcgacgccaggacggcggctggctgcgcgaacgcctggcgccctgagtcctccatgttcgaactggattcgacgctggcgcagcacatcgtcgatcgggcgatggcgatcctgccgcacaacatcaatgtgatggatgcccagggcatgatcatcggcagcggcgatccatcgcgcctgcatacccgccacgaaggggcgcaactggtgctggccaaccggcgggtggtggaaatcgacgagcaggccgccgcctgcctgcgcggggtgcggccaggggtgaacctgccgttgctgcacgccgagcggctggtcggcgtgctcggcatcaccggcgcgccggaggtggtccggccctatgccgagctggtgcggatggcagcggaaatgctcatggaacagcgccagatgcaggacgagcgacactggcaacgccagcgtcacgaagcctggctgcgccagttgctcgatcccggccacggcctcggggcgctggcggccgatgccgaacacctggggctggccatgcactggccgcgccaggcggtcttcctggagctgcccgagcatgccgatccgctgccttgccaggctcgcctgctggcggcactcggcggccgggcggagcactggagcgcggcgctgggcgagcgcctggtgttctggtgccggccggtagcccacgcagatacgctcgagcactggctggagcgcgccgacgcgcgcggctggggcgtggcgcgcctgtgtgccggcgacccggcgcatgacctggccgagctgcgcgcctcggcctgcgccgcgcgcgacctgctggactatgcgcgcagccggttgcccggtcggcgggtcgtgaccctggacggacaccgcctcgccagcctgctgttcagccagcgcgacagttggcaggtgcggcagctgctggcgcccttgcagcggttgctcgaccacgatccgcaaggttcgctggccgctaccctggagtcctggtgcgcccatgacgggcacgcccaggcctgtgcccaggcgctggggatccatcgcaacagcctgcgctaccgactggagcgcatcgcttcgatcagcgggctcgatctcgctcgcctggagcaccgccagcaattgttgctggggctgcaattgctcgttccgcgccgcgggtaa

SEQ ID NO: 3031 - DNA, 1014 bp, Pseudomonas aeruginosa
gccgaccctggcgcactggggctggctggacgacgccaccgcagtgatcgaaatggcttccgccagcggcttgcacctggtcccgcgcgaccgccgcgacgccacgcgcagcagcagccgtggcactggcgagctgatccgtgcggcgctggacgccggggcgcggaagattatcctcggcctcggcggcagcgctaccaacgatgccggcgccggcctgctgggcgcgctcggcgtgcgtttcctggctgccgacggcgaggaactggcgcccggcggcgccgcgctggctggcctgcacagtctcgacctgggcgggctggatccgcgcctggtggatgtcgcggtggaagtcgccgcagacgtcgacaacccgctatgcgggccgcgcggcgcttcggcggtgttcggtccgcagaagggcgccagcgccgaacaggtggcgcaactggatgccgccctggcgcacttcgccaaggtggtcgtggcgacccttggcgaggacttcagccgggtgccgggcgtcggcgccgccggcggcctgggtttcgccgcgagggcattcctccgcgcgcgtttccgcccaggcatcgaactggtggcggagctggccgggctggccgatgcgctggtcggtgccgacctggtgctgaccggcgagggccgcctggatgcgcagagcctgcacggcaagaccccggtgggcgtggcgcggatcgcgcgccaggccggcgttcccgtggtagccctggccggcagcctgggcgacggctaccagcgcctgcacgacgccggcatcgatgcggcgttcagcctggcgccgggaccgatcagcctggagcaggcctgtgccggagcggcggcggaactggaggcgcgcgccgagcagatcgcccggctctggcgcctggctcaggcttcgcgggaagggtagtcggcggcggcgcgctccagccaggccggcaggtcgcgccgcttcaccttgctggccttggcctcggccagtcgctgtaa

SEQ ID NO: 3032 - DNA, 450 bp, Pseudomonas aeruginosa
ggaagcccgtaccgtgcagactgtacgcatgggcaccatccaggccttgcgcccggtcaagatcgaaggcaccaagaccccgatcggttccatcgccggtgccggcgtcggcggtgtcgccggcagcgcggtgggcggcggcaagggcagctacgtcgcggccatcatcggcgcggtcgctggcggcctgctgggcgcggctaccgaagaaggcctgacgcgcacccagggcgtcgagatcaccgtgcgcgaagacgacggcagcacccgcgcctatgtccagcaggtcgaccagggccagatcttccgcgtcggcgagcgcgtgcgcatcctgaccgtcaacggcaccagccgcgtcgcccactgattcttcccacgttatcccgcggccggcatttcgccggccgttttcgttgtagcgccgaaccactgccggcgttgtcttgctaa

SEQ ID NO: 3033 - DNA, 237 bp, Pseudomonas aeruginosa
cccggccctacgagagcatcgccggattcttcgtcgagaacagcgtctccgggggcggcggctacaacgtggtcaacgtcatcctggtggacttccgtggtttcgataccctcggcgagatcagcgtgctggcgatcgccggcgtcggcatctacgcgatgctcgccggtttcgccctgcacaagccgacctgcgacccgcagggtcgcaactgggcccacgccaagcacccgctga

SEQ ID NO: 3034 - DNA, 1551 bp, Pseudomonas aeruginosa
cctcggcagcgaccacgtagatggacgcccggacgaggaggagccgcgcccatgagccattggctgatcctgccgatcctgctccccctgtttgccggcagcctgctgctgttgccgctggccgagcgctggcagcgcggcctgtcgttgctcgcggcgctggcactgatccccctgagcctgctgctgatacgtacggccgccagcggcgacctgagcgtctatgccctgggcaactgggccgcgccgttcggcatcgtgctcatgctcgatcgtctcgccgccctgatgctgctggccaccgcggtgctcggcagcgccgcgctgatctacgcgctgcgtggcgacgaccgcctgggcaagcatttccacgcgttgttccagttccagctgctcggtatcaacggcgccttcctgaccggcgacctgttcaacctgttcgtgttcttcgagatactcctgatcgcctcctacgcgttgctcctgcatggcggcggcgcggagcgggtgcgctcgggcttgcactacgtgatcctaaacctggtcggctcggcgttcttcctgatcgccgtgggtaccctgtatggcctcaccggcaccctgaacatgtccgacatggcgcagaagatcgccatggcagatgccgagcgcgcgccgctgctggcggcagccgggctcctgctgctggtggtgttcgccctgaaggcggcgctgttgccgctgtacttctggctgccgcgcgcctatgccgcggccagcgcgccggtggcggcgctgttcgcgatcatgaccaaggtcggcatctactcgatcctgcgggtctacacgctggtcttcggcgatgccgccggcgagctggccaacctggcgcaggcctggctctggccgctggccctggcgacccttggcctgggcgcgatcggtgccttggcggcgcggaccctgcaaagcctgctggcctacctggtggtggtctccgccggaaccctcctggctggcgtggcgttgggcagcgagcgggcgctggcggcgtcgctgtactacctgctgcacagtacctggatcgccggtggcctgttcctgctcgccgacctggtcgcccgccagcgcggcgacaaggccggcgacctggtccagggcccggcgttgcagaatcctcggttgctcggcggggctttcttcatcggcgccatcgccgttgccggtctgccgccattgtcggggttcttcggcaaggtcatgcttttgcagtcggtcgctcccggcagccaggcgctggccctatggagcgtggtactgggcagcggcctggtggcgctggtggcgttgagccgggccggcagcacgctgttctggcgcaccgggcataccgtgctcggtagcgccgaactggaccacggccgcttgttcgcctgcatcctgttgctctccgccggcccgttgctggtgttcgccgcgaagccgctgctggcctacgtccaggccaccgcggcgcagttgcacgacctcgacctgtatcgccagatcatcacccgcggaggtaccgcatga

SEQ ID NO: 3035 - DNA, 627 bp, Pseudomonas aeruginosa
aggagatcttcccatgctcgcttacgtgatcccgctgtgcctggcgctgctcggcctggccctgttgctgaccctggcgcgcctggtcaaggggccgtgcctgccggaccgggcgctggcgctggacaccctctacgtgaacgccatcgccctgctggtgctgtacggcatctggcgcgacagcgacctgttcttcgaggcggcgctgctgatcgcggtgctcggcttcgtcggtacggtggcggtggccaaatacatgctgcgcggagacatcatcgaatgactggcgaacccctgagcctgtggctggaaatcatcgtctcggcgttcctcctgctgggcagcgccttcgtcctgatcggcgcgatcggcctgtaccgcctgccggattttttcatgcgcctgcacgggccgaccaaggccaccaccctgggggtcggcggggtgatcgtcgcctcgctgatctatttctccaaccgccaggcgggcatcagcctgcacgaattgctgatcagcctgttcctcttcatcagcgccccggtcagtgcctacatgctggccaaggccgctgtgctgcagcagttgccgctggagaagaagactcgcggcaagccctgggagcagtga

SEQ ID NO: 3036 - DNA, 753 bp, Pseudomonas aeruginosa
tcggcgccctggtggccgcacggcaaatggtcgcggccggcgagaagggttcgctggtggcgattctctgcgacggcggcgaacgctatgcgaccacctattacgatccggtctggctggccaggcagggctatgcgctggaacccctggtcgaggcgctggctgcctgcatcgagcggggcgtggcgttgcccgacgggctgctggtggctggactttgaaggagtggatatgcaccgtttgcgagctgccgaaaccggcgatatcgaggccatgaccgacctgttgctgcgccacgggccgaatccctggaaccatttgccggaggagggggtgcgtgcgcatctgcgagccatcgccgacggcgaggtacgtgccgtcctggccgagcgcgacgatcggctgctggggttcgccagcttccgtcgcaccgaggatttcgcccattaccagccgcagcgtgccgatgcgccgcgggcctacatctgcgaggcggtagtgcatccggcggcggccggccaggggctcggcagcgcgttgctggaggcggtgctggcccaactggccgacgaaggcatcgaggacgtctatatcgatcgtcacgaagagaacctggcgtcggcgggaatgatgcgcaaggccggcttcgtcgagctggaaacctacgccgatccggcgcggcgaccgaacggctcggggcgctcgacagtgtgccatcgcaatctttccctccagcgcagagccgtgcgatga

SEQ ID NO: 3037 - DNA, 516 bp, Pseudomonas aeruginosa
accagcagacgggcagggcgcatagggaagactccatcgaaaatgcgcccacgttaccgagcgtccgggcctagctcaagtccggatcggacttcatcgcaaccagggagtcgatcaatgatccaatgcaagcgtgtatacgaaccggcgtcgcccgccgatggccggcgcgtactggtggaccggctgtggccgcgcggcatccgcaaggaagccctggccatggacgactggctgaaggacgtggcgccctccaacgaggtgcgcaagcagttctgccacgatccggcactcttcgacagcttccgcgaacactaccgcgccgagttgcaggcgcacccggaacattggtggggcctgctcgacagcgctcgggagggcaccctgacgctgctctacggcgcccacgaccagcagcacaacaatgccgtggtgctggccgagttcctcgaggaggagctggaccgccagcagccgggcagttcgccgacctgctacgccgaccgcctctcctga

SEQ ID NO: 3038 - DNA, 1017 bp, Pseudomonas aeruginosa
ggaaacaatcgtgaaggacctggacgatctcgccgccttcgccgtactccacgacctgggcagtttcacccgcgccgccgagcgtctcggttgcagcaagggccaactgtcgaagcgcattggcgtcctcgagcagaagctcggcgtgaccctcttgcaccgcaccacccgccgtctttcgctgaccgccgccggcgccgcgctgctgcccgaggcgcaggccttgctggtgcaggccgagcgcgcgcggcaggcggtggcgcgcttgcaggagcgagcggaaggacgggtgcgggtgaccctcccggtctcgctgggcgagaccctgttcgatgcactgctggaggacttccaggaacgccatccgctgctgcgcgtcgagctggacctgtacaacggcctgcgcgacctggttggcgagggcttcgacctggcgatccgctctggggtcgagcaggacgcccggctggtggcgcggccgctgttcgtcctgcaggaaatcacctgcgccagtcccgcctacctggcgcgacacggcgagccgcaacgcccggccgagctggccgagcgcgagtgcctgctgaactcgcactacagcggccacgaggagtggctctatcaccgccaccatcggctggagcgggtacgggttgccggctttctcgccagcaaccactacagcctgttgaagaaagccgcgctggccggcaccggcatcgcccggctgccgtcatacatggtccacgacgaactgggcgacggccgcctggcctggttgctgcgcgactaccagacgcgcagcacgccgatgttcctcgtccatccgttccagggcggcctgccgcggcgcacccaggtactcgccgattacctgctcgactggttcgagcgcagccggcgacaattgatcggcctggagggttgaacatttcgccgcgacgcggctctattgcactccgggccgcttccatgcggcctgaagctcatcgcgggcacgtcgttgcacaaggaacgtga

SEQ ID NO: 3039 - DNA, 1917 bp, Pseudomonas aeruginosa
cggaacgtggcagaatcccgcaccggaccgctcgcgtgcgagcggacgccattcatcgaacgcttggatagggacatgcaaagcagctttccgcaatcgaacactccccagatccgtcgcgctggagtcgacctcaacggcgtgatgtcggtgctcagcaagcacctctattccacgcccaccgtggcgttgcgcgagctggtgcagaacgcccacgactcgatcctccgtcgccgcctggagcagcccgactggcaagggccgtcgcgaatcgaggtgatcggcgacagtgccagcaacaccgtgcgcatcgtcgacaccggcgccgggctcaccgagcacgaaatccacgcctacctggccaccgtcggcgtcggctacacccgcggactgcgccagtccggccacgaggacagcgggctgatcggcatgttcggcctgggcttcctctccgctttcgtcctggcccgccgggtcagcgtgcggaccacgtcctaccagcagccggaactgggcttctgctacgtctccagcaacgccgagcaatacagcgtgacgccgatgccggcgcgcccggtaggcaccgagatcaccctcgaactgcaggacgaatacagtgcgctgacccaggccgcgcgcctgcgcgagatcctcgaacgctactgcgtgctgctgcgcgagccgatccacgtcggcggcgacgcccagtcgatcaacccggagccgccgccgtggcggctggccgccgacgccgcgctgcacccgctgcaacggcagcgccgcgacctggagttcgccgcacgcttcgagcacgacttcgagccgatctgctgcctgccggtgcgcccggacgagcgggtcgacgtgcagggcctgctgtggatccaggacggcggcacctatggcaccagcgacaaccgcaatctctcggttttcctccgcggcatgctgctcgacgatgacgcccgcgacctgctgccgtcctgggccgggttcgtcggcggggtgatcgaatcgaaccgcctgacgcccaccgccagccgcgaggacctgcagcgtgacgaccattacgcggcgatccagcatgcgctggccgaggcgctgatcgccgggctcggcgaggtggcgcggcagcagccggaggcctggcggcgggtcctgctgcggcacaacgaggccctgctgggagcggcgttgtgcgacgagcgtctgttcgcgctgatgatggacagcctgcgcgtacccacctcccagggcgacctcccggcttccgaactcctttcgcgcggagcggtgcatgtgctgctggacaacgacagcggcttcgaggaaatgctgttccgtgccatgggcgtaccggtggcccatggcaatcgctatgcggtggtacccttcctccgtcgctgggcgcaggccaaggggatgcgcctggtggagctgggcaccgagcagggcaaccgccagttgttccgcctcgaccgactgcccgagcgcgagaccggctggctggccgaacacctgggcggcgccgaggagcaactggtgatcgcccgcttcagccccgaggaattgccgcttgtgatggtgcccgaccgcgacgccgaactcaagcggcgactggaggacgacgaggccgacaagcgtatttccaccgcggcgttgcgcctggcccggcagttcacccgcaagctcgacaatcgccagccgagccggctctacgtcaacctcgacaatccggcggtgcaggcgctgctcgcggccgtcggcgaggaacgcgacgaagcggcccatgcggcgttgctgctgcgctcgttcaaagtgatcatcgccggacagggacgcggccagcccgcgacctcgctgaaccaggccctggccggactcgccgattcggtgaagcgcctgctggggcaataa

SEQ ID NO: 3040 - DNA, 2310 bp, Pseudomonas aeruginosa
tggagactgaagcatatggatatctggaactgggtggagaagctccgcgccgacctgcgtgaggccggccaggagcagagtgcgcggctgatcgacgaactcaccgcgtacgtctgcgacctcgaggtggagcgcgccgaggcgctgttgccggaggtcaaggcgctgagccggacgttgaacaacccgtggctggaaatcttcgtccgccactgggaaatgcgtaaccgggtcggcaaccaactggagggtgagaccgccctggccgacgccgtttccctgttcgaactggccaatcgcgacgacacccaggcctgcccgcagtcagtctgcgtgacccaggacctggcgtcgtgctacgccaacgtcgacggcccgggctgggtggaggagcgcatcgaggtgtgcgacgagaccctggcgcggatcgacccgacctgggcctgcttccactgcctgagcaacgagaaggccgaggcgctgctcgacgacgggcgcggcgaagatgccctggccttcctggccgaacaggagaagaagatcctcgccgccggcgaggaggtattcgacagcctcctggagatgcgcgtggcgatcctgctgaacctggggcgcgcggaacaggcgctggccctgatcggcgagatggaggagaaggtcgagggagcggagtggaacaacatcagccagccgcggcgtctgtacaaggcccacggcctggcgttgctggggcgcgacgaggaggccctggaggcgctgctgccgttctccgagattgccccgcgctaccgtacgatctggctgcgcgccgtctacctgctgctgcaacggacccctgagcgcaacacctgggacttcggcgggcgcctgcagcagatgctcgaacactactcgcagaagggcgcgcaccgggtggtcatcgatgttgccagccaggccatccgcctcgcgttgcaacgcggttcggtatggagcgccaggcgccacctggcgctggccgaacagcatgctcaacagttgcagcgcgatcggggcgccagccagttgctcgccgggttgagggaggagatcgatgccgcgccgcagcagcaggagctgccggtgccggctgcggagttgctcgactggctggctgcgcagggcagcgaagacgcgccgcgcaacccggagaaagaagtgcagtggctgctccaggcgctggccgagcggcccgacgacaccgccttgcgcgaagtggccgcctcggcgctacaggcctgctccgccgacgacgaggccatcgacctgctctgggagtacgtcgagcgccacaccgacgaggagcagcaactggcctactacctgctcaatgccttgctggcccgcggcgagtacgaccaggtcaagcgcctcggccggctctacgccgacagcgtgccgctgatcgcgctgtggagcgaagtcaagctggccgagaaactcaacgactggccggagctggagcgcgcctgccaatcggtgctggaaatttctcccggctcgctgggagcccacagcctgctgggtaaggcgctgatggagcaggatcgcttcgccgaggcggcgctggcctaccagcgtctggccggcaagctggaggagccgcagtcggtgcagtgggaccagatgaccgccgccagcgccgcgcgcgactggacgatgctgcgcgaggtcgctgccggcatgggcatggagttcgccgccggcgacggaccgatcgaggaagactggggctgggtgatcgtccgttacatcgaggatggcgaagcgctcgactactacgcccggcgcaccggcccggtgaccgcgcgggtcctcgagaacgcgccgggcaatcgcagccagcgggtcggtgactgggtggtgttcgacgccggcctgatctatccggctccggaagacgaggaggagcgcaagcgtttcgttcccacctatgcggtggtgcacgtcctcgagagcggtggttactcgccgagctggctggtggacggcgtctatccgggcgacgaggccttcgacgccttccgcgaaacgctcgacgcgcgcggctggaaggtctgggtgcacagcaaccgcgactaccaggtcaccgatgccagcagcggcgaggaactgcgggcgatctacttcaccgtcgcgacacccgcgcagcaggcgccgcgcgacctgcaccaggcgttgcaggaggccaccgggcaatggccgcaccgcatgtgctggctgcgcctggcggaagcggcggaggtcgacacccagccgcacctggacgctatcgagcgctacggcctgtag

SEQ ID NO: 3041 - DNA, 1284 bp, Pseudomonas aeruginosa
cgtcgtgcagcgcctggatcttgccgtagtaggtggaaaccttgtcgaaactcagcatgctcacgcttcccccagataagccttgatcacgtccgggttgtcgcggatctgctccggcgtcccgtcggccaggggggcgccctggttgatcaccacgatatggtcggaaatgctcatcaccagcttcatgtcgtgctcgatcagcaataccgtcacgttgtgctcgctgcgcagcttggcgatcagcgccttgaggtcgtcggtctccttcgggttgaggccggcggccggctcgtcgagcatgaggatccgcgggcgggtcatcatgcagcgggcaatctccaggcgtcgctgctggccgtaggcgagggtgccggcgctgcggttggcgaactcggtaaggttgacttcctccagccagtgcgcggcgtactccatggcctcgcgctcgctgcggcggaatgccggggtcttgaacaggccggcgaggaagttggtgttgaggtggcggtgctgggcgaccagcaggttctccaccgcggtcatttccttgaacaggcggacgttctggaaggtccgcaccacgcccttgcgagcgatcttgtgaccgggcaggccctggatctcctcgccgtcgaggcggatcaggccgccggtgggctggtagaagccggtcaggcagttgaacacggtggtcttgccggcgccgttcgggccgatcatcgagaccacctgcttttcctcgaccttcaggttgacgccgttgacggccagcaggccgccgaagcgcatggtcaggccgctcacttcgagaatcggtcggctcatggcttcagctccaggtgcgggcgttgcatcggcagcagtccctggggacgccagatcatcatcacgatcatggtcaggccgaagatcagcatgcggtattcgttgaacccgcgcatttcctggagcagcaccatcaccaccgcggcgagtatcacgccgagctgcgaacccatgccgccgagcacgacgatcgcaaggatcatcgccgactcgatgaaggtgaaggactcaggcgtcaccaggccctggcgggcggcgaagaagctgccggcgaaaccggcgaagctggcaccgatggtgaaggcggagagcttgacgatggtcgggttgagaccgagagcgcggcaggccacttcgtcctcgcgcagcgcttcccaggcgcgaccgatcggcatgcgcatcagccggttgatcacgaacagggccagcagcaccagcagcagggccaccacgtag

SEQ ID NO: 3042 - DNA, 912 bp, Pseudomonas aeruginosa
gggactggctcatactttttccacctccggacgaccgaggatgccggtaggtcggaacagcagcaccaggatcagcaggccgaaggccaccacgtccttgtactggtcgccgaacacgtcggcgccgaaggcttcggcgacgcccagcagcaggccgccgagcatggcgccggggatgctgccgatgccgccgagcaccgcggcggtgaacgccttgatcccggcgaggaagccgatcccggggttgatcacgccgtactgcatgcccagcagcaccgcggcgacggcggccagggcggcgccgatgacgaaggtgagggcgatgatgttgttgctgttgatacccagcaggttggtcatcttcaggtcctcggcgcaggcgcggcaggcgcggcccaggcgggagcgggagatgaacagggtgaggccgaacatcaccaggaaggtgacgacgaagatcaggatctgcatataggagatcaccacgccgttcatgctgctttcgccgaacacgaagttgccgggcagcagggtcgggatggccttttccttggagtcctgcgagagcatcacggcgttctgcaggaagatcgacatgccgatcgcggagatcagcgggatcaggcggttgccgccgcgcaacgggcggtaggcgacccgctcgatgctgtagccgaaggcactggtgacgatgatgctggcggcgaatgcggcgagcatcatcagcggaacgctgtccagccccatcatcgccagcagggtgatggcgatgaaggcgatgtacgagccgatcatgtacacctcgccgtgggcgaagttgatcatgccgatgatgccgtagaccatggtgtagccgatcgcgatcagcgcataggtgctgccgacggtcaggccgttaaccaattgttgtag

SEQ ID NO: 3043 - DNA, 432 bp, Pseudomonas aeruginosa
acgtatagaaaaacggcgcggacctgcctcacctccctgggcccggtttcccttcggctgtcgtgggctaccggcgggcgttatcatggcgcccatgcaatccaggtagatcccatgacagaacaaactagcaccctctatgccaagctgctcggcgagaccgcggtcatttcctgggccgagctgcaaccgtttttcgcccgtggcgccttgctccaggtcgatgccgcgctggacctggtggaagtcgccgaggccctggccggggacgaccgcgagaaggtcgccgcctggctttccggcggcggcctgagcaaggtcggggaggatgcggccaaggatttcatcgaacgcgacccgaccctctgggcggtggtggtggcgccctgggtggtcattcaggaacgcgcggaaaaagcgacgttgcactga

SEQ ID NO: 3044 - DNA, 429 bp, Pseudomonas aeruginosa
tccagggcggttttctttcgctcgaccctggctagactgattccgattcccaccaggagattcgtcatgttcgaaccaggccacctccatctggtcagcctgcccggcctcgaccagcaggacatcaatatccatatccgctacgaggtgcggcagaacgccgaatccggcgcctatgtgcacttcgacatggacggcgagatcgacggcaagccgttcagcgactccttcgagctgccgcgcgataccgccttcaacttcgccagcgatgccacgcgggtcgcccagaagcacggcctgcacccgaagttcggcgcgatcacccgggtgcacaaggaatacgatgcgatgttcgaggatattcgcgccaagctgcatgcccatcccggcgaaccggtggatctcgagcggatcattcgccacgagtga

SEQ ID NO: 3045 - DNA, 471 bp, Pseudomonas aeruginosa
tttggcacgggccttgctgaagtgttggcgacgaaagccacaccggcaaacaggttcgcagccatgagcatcagtttcgacagagcactcggtatccaccagcaggccctcagcttccgcgcccagcgcgccgaagtgctggccaacaacctggccaacgccgataccccgaactacaaggctcgcgacctggacttcgccgcggttctcgccgagcagaaggacaaggccgccaagggtaccttcgccatccgcaccaccaacgagcggcatatcgccgccgaaggtttcggcatgggcgagggcagcctgcagtaccgcatcccggtccagccgtcgatcgaccagaacactgtcgacgcccagatcgagcaggccaactacgccgagaacgccatgcacttccaggcgtccttcaccttcctcaacagcaaattcaaagggctggtcagcgccctgcgtggagagtaa

SEQ ID NO: 3046 - DNA, 402 bp, Pseudomonas aeruginosa
acaagagcatggagagcattctctccaactaccagtcgtcgcaggccctgcaagcctcgtcgctggtggggcgcaaggtcatcgtggcgaccgacaagtcggtggtggacaccaaggacaccttcaaggcgtccctcaacctgccggtctccagcagcaacgtatgggtcaacgtctacgacgacaagggcaccgtggtcaatcgcatcaacctcggccagcaggctgccggcagcgtcagcttcatgtgggacggcaaggacagcagcggcaacatcatgccgccgggcacctacaagttcgaggcgcagacctcgatcgacggcaagacctacgggctccagacctacctgccggccaacgtcgacagcgtcaccctggggcagaacggcggcgagctga

SEQ ID NO: 3047 - DNA, 408 bp, Pseudomonas aeruginosa
gcttcaagcaatcccgcgcggagttcgccgacgtctacgccgcctcggtgctgggttcgggcagcaacccgcagggcagcggcgtgctgctctcggacgtctcgcagatgttcaagcagggcaacatcgactcgaccaacagcgtgctggacctggccatcaacggcaacggcttcttcgtcaccagcaacaacggggcgatcagctacacccgcgccggctacttcaataccgacaagcaggatttcatcgtcgacaacaacggctaccgcctgcagggctatgccgtcgggccgaacggccagttgcagaacggcgtggtcaccgacctcaaggtcgagcgcgccaatcaggcgccgcaggccacctcgagcatccagcagtcgtacaacctcaactcgacgctga

SEQ ID NO: 3048 - DNA, 795 bp, Pseudomonas aeruginosa
cctgcaagaaagcccggcggattgtgccggtgcctggaggattcgatggacaagatgctgtacgtctccatgagcggggccagccagaacaccctggcgatgcgtgctcatgccaacaacctggcgaacatctcgaccagcggctttcgtcgcgacttcgagcaggcgcgttcgatgcaggtgttcggcgacagcttcccggcgcgggtattcgccatgagcgagcggcccggtaccgatttcagccatggcagcctccaggaaaccggcaacgagctggacatcgccatcgacggcgacggcttcgtcgcggtccaggcgccggatggcagcgaggcctacgtgcgtaccgccggcatgcatatcgacgccctcggcatgctgcgcaccggcgacggcttgccggtgctcggcaacggtgggccgatcgccgtgccgccggaggaaaaggtggagatcggccaggacggcaccatcagcatccgcgcccttggcgagaaccccaacgtggtcgccgtggtggaccggatcaaactggtcaacccgaacctgaagcagatggagaagggtaccgacggcctgctgcactacaagccgcagccgggcgagcaggcgccgctggccgacgccaacgtgaaggtggtctccggtttcctggaaagcagcaacgtgaacgcggtggaagagatgaccgcgatcctctcgctgtcccgtcaattcgagctgcacgtgaagatgatgcgcaccgccgaggacgattcggcggccatggcgcgggttttgcaaatcagctaa

SEQ ID NO: 3049 - DNA, 1416 bp, Pseudomonas aeruginosa
ccaggcggggcagagcaacagcctgaccggctcgatcaccgtgaccgtggccgaggtgctgcccaacggcatcctctccgtgcgcggcgagaagtggatgaccctgaacaccggcaacgagctggtgcgcatcgccggcctggtccgcgccgacgatatcgccaccgacaacaccgtgtcctcgacccgcgtggccgacgcccggatcacctactccggcaccggcgccttcgccgatgccagtcagccgggctggctggaccgcttcttcctcagcccgctgtggccgttctgaggacgctcgcgatgaccaagttcaagcacctgctggccctcgccgcgctgctcctggccgccggcgcggcccaggccgagcggttgaaggatatcgccagcatccagggcgtgcggaccaaccagttgatcggctatggcctggtggtcggcctgagcggcagcggcgaccagaccacgcagacgccgttcaccctgcagaccttcaacaacatgctggcgcagttcggcatcaaggtgccggccaacgtcggcaacgtgcagttgaagaacgtcgccgcggtatcggtgcatgccgacctgccgccgttcgccaagccgggccagccgatcgacgtcaccgtgtcgtccatcggcaacgccaagagcctgcgcggcggcagcctgctgatgactccgctgaaaggtatcgacggccaggtctacgcggtcgcccagggcaacctggtggtcggcggcttcgacgccgaaggccgcgacggctcgaagatcaccgtcaacgtaccgtccgccggacgtatcccggccggcgccaccgtcgaacgcgcggtgccgagcggcttcgaccagggcaacagcctgacgctgaacctcaaccgcccggacttcaccactgccaagcgcatcgtcgaccgcatcaacgaactgctcggtccgggcgtcgcccatgcggtggacggcggctcggtgcgggtcagcgcgccgctcgacccgaaccagcgggtcgactacctgtcgatcctggagaacctcgacgtgcagccgggcgaggcggtggccaaggtcatcatcaattcgcgcaccggcaccatcgtcatcggccaggacgtcaaggtatcgccggccgccgtcacccacggcagcctgaccgtgagcatcaccgaggacccgatcgtcagccagcccggtgccttctccaacggccagactgcggtggtgccacgctcgcgggtgaacgccgaggaggagaccaagccgatgttcaagttcggtcccggcaccaccctggacgacatcgtccgcgcggtgaaccaggtcggcgccgcgccgagcgacctgatggcgatcctcgaagccctgaagcaggccggcgcgttgcaggccgacttgatcgtgatctga

SEQ ID NO: 3050 - DNA, 1500 bp, Pseudomonas aeruginosa
ggacgacgccatggattcccgtttgctcagcggtatcggcgcaggccccgacagcggctcctataccgatctcaaccgcctcaaccagctcaaggtcggcaaggaccgcgacggcgaggcgaacatccgcaaggtcgcccaggaattcgaatcgctgttcctcaacgagatgctcaaatccatgcgttcggccaacgaagcgctgggcgacggcaatttcatgaacagccagaccaccaagcagtaccaggacatgtacgaccagcaactgtcggtgagcctgtcgaagaatgccggcggcatcggcctggccgacgtgctggtgcgccagttgtcgaagatgaagcaaggctccaggggaaacggcgaaaacccgttcgcccgggtcgccgagaacggcgccggtcgctggccgagcaaccccagcgcgcaggccggcaaggccctgccgatgccggaagccggccgcgacgactcgaagctgctcaaccagaggcgcctggcgctgccgggcaagctggccgagcgcatgctcgccggcatcgttccctccgcctcgccggccgccagccagatgcagagcctgggccaggacagctacctgccggcgcagagctacccggcggcgagccgccgcggtttctccaccgatggcgtcgacagccagggcagccggcgcatcgcccagccgccgctggccaagggcaagtcgatgttcgcctcggccgacgagttcatcgccaccatgctgccgatggcccagaaggccgccgagcggatcggcgtcgatgcccgctacctggtggcccaggccgcgctggagaccggctggggcaaatcgatcatccgccagcaggatggcggcagcagccacaacctgttcggcatcaagaccggcagccgctgggatggtgcctcggcgcgcgctctcaccaccgaatacgaaggcggcaaggcggtcaaggaagtcgcggcgttccgctcctactcgtcgttcgagcagagcttccacgactacgtcagcttcctccagggcaacgaccgctaccagaacgccctggacagcgccgccaaccccgagcgcttcatgcaggaactgcagcgcgccggctacgccaccgatccgcagtacgcccgcaaggtggcgcagatcgccagacagatgcagacctaccaggccgtcgccgccgccggcacgccgcctctgggttgagcaaggaggaactgacccatgtccgacctactctcgataggcctgtccggcctcggcaccagccagacctggctgaccatcaccgggcacaacatcaccaacgtcaagacgccgggctacagtcgccaggatgccatccagcagacccaggtcccgcagttcagcggtgccggctacatgggctcgggcagccagatcgtcgacgtgcgccgcctggccagcgacttcctcaccggccagttgcgcaacgccaccagccagaacagcgagttgagcgcattccgtag

SEQ ID NO: 3051 - DNA, 417 bp, Pseudomonas aeruginosa
ccagatcgagcagctcgacggcctgttgtccaacaccaccaccggcgtcagcccggccatgcagcgcttcttcgccgcactgcaggccgccgccaacaatccctcctcgaccgaagcgcgcgaggcagtgcttgcccaggccgaggggctgggcaagaccttcaataccctctacgaccagttggacaagcagaacagcctgatcaaccagcaactgggcgcgctggcttcgcaggtcaaccatctgtcgcagagcgtggccagctacaacgatgccatcgccaaggccaagtcggcgggcgcggtgcccaacgacctgatggatgcgcgcgacgaagccgtgcgcaagctgtccgagatgatcggggtgaccgcggtcacccaggacgacaacagcgtcagcctgttcatcggtag

SEQ ID NO: 3052 - DNA, 1320 bp, Pseudomonas aeruginosa
gccagcgagaccgccaccatgcgcatttccaccatccaggccttcaacaactcggtcaacgggatttcccgcaactacgcggacctgaaccgtaccttcgagcagatcagcaccggcaagcgcatcctgacaccggcggacgacccggtcggttcggtacgcctgttgcgcctggaccaggagcaggggttgaacgagcagtacaagaccggcatgaccgaggcgaagaacagcctgagccaggaagaaaccatcctccgttcggttggcaacgtcctccagcgcatccgtgagatcgccggccaggccggcgacggcgcactggactccaacgacaagaagtcgctggccagcgagttgcgccagcgcgaggacgagttgctgaacctgctcaacagccgcgacgcgagtggcaaatacctgttttccgggtcccagggctcggtgcagccgttcgtgcgcaacgaggacggcacctacagctacatgggcgacgagagccagcgcgaggtgcagatcgccagcagcacgcggattccggtcagcgacagcggcaaggtactgttcgaggacatcgtcaatgccgctcgtctcgataccaaggcggcggctggcaataccggcgacggtcgcatctcggtcggcctggtcgaggacgagctggccttcgacagccagttcccggcgagcaatccgcctgcggcaaccgacggcttcaacatccacttcgtcagcgacaaggagtatgtggtctacgatccgaagagcctgcctccgggctatgactggaccacctacgatccgaattcgccgccggcctggcaattgtccaagggcgccatcgacgacgacccgaagaccatcgacaaggtgctctacgccggcgtcagcgtgacgatcgacggcacgccgaaggcgggcgacgagttcaacgtcaactacaagccgggcagcgagaagcgcagcctgctgaacgtggtgtcggacctgcgcaaggccctggaaagctccaccgacaaccaggccggcaacgacgccatccgcgatgcgacggcggtggccctgaccaacctctccgccgtggctgccgccgtggatggcggccagggcaagatcggcgcgcgcctgaataccgtggaaagcaccgagaccttcatcgacgatgtgaagctggtgaatgcgtcggtgatgtcgcagatccaggacctggactacgccgaggcgttgtcgcggctgtcgttgcagtccaccatcatggatgccgcgcagcagagctacgtgaagatccaggggttgagcctgttcaactacctgaagtga

SEQ ID NO: 3053 - DNA, 1425 bp, Pseudomonas aeruginosa
cagtccctctgtggaacagggcccatgactccgtcatgggccttttcgttcgcagggactggacctgtgtcgctggagggtctgttccgcaaggtctacggaaacacgggagaatttgtcagaagtttgactgccgattcgcgccgcagcgcctgtggaacagccaggggtcgcgcgaccaggggctttgacctgcatcaggctctttgggtacgggccttgcatagagtggcgtgctcgggtttttcgccctttactcgcctgagtatccattcatcagggccctacatgaacaacaagacgatcccggtcaccagcccgctgctgccgcccctggaagagttcatcccctacctggaaaagatctgggagagccgcttcctgaccaacgggggcgacatgcaccatgcgttggaagaggccctgtgcgaatacctgggggtgaagcacatcgtgctcttcgccaacgccaccctggcgctcatcaccgcgctgcaggcattgcgggtgaccggcgaggtgatcaccacgccgtactccttcgtcgccaccagccacgcgctgctgtggaacgggctcaagccgatcttcgtggacatcgatcaggactccatgaatctcgacccgtcgcggatcgaggcggcgatcaccccgcagaccaccgcgatcctgccggtgcattgctacggcaacccctgcgatgtcgaggcgatccagcggatcgccgatatccaccacctgaaggtcatctacgatgccgcgcatgccttcgccgtgcgcgacgccggcggcagcgtgctgcgccacggcgacctgagcatcctcagcttccatgccaccaaggtgttcaacaccttcgagggcggtgcgatcatctgctcggacgaaaacacccggcaacgcctcaaccaccttaagaatttcggcttcgtcgacgaggtcacggtggtcatgcccggcatcaacggcaagctcaacgaggtcggcgctgccttcgggctgctgcaactcaagcacgtcgaccaggccctggagcagcgcagggagatcgccgagcgctatcggcgcctgctggccggcgtccctggcatccagtgcctccggcctggtacccagaccttcgccaacaacgcctatttcccgatcctggtggaagacgattttccgctttcgcgcgacgagctgtaccagcgcctgcgcgacagggatgtgctggtgcggcgctacttctacccactcatcagcgacttccccatgtaccattcgctgccctcggcggcgcccgccaatcttccggtggcgcggtcgatttcctcgcgggtgctgtgcctgccgatctatcccgggctggccgccgcagacgtcgagttcgtcgccggcctgatcgcttccgccgccatgccgcggcggcgagcatcaagttga

SEQ ID NO: 3054 - DNA, 261 bp, Pseudomonas aeruginosa
cagaatgaacaaccgcctcactcaggtagacaagaaatgagccaagcaaaattcatcgaagacttcctttccgccaccgatttccagaatcccgtcgaggtcagcatggacacccagctcgaagacctgccggaatgggactcgctggccgcgctcggggtcatcgtcatgttcgacatggaatacggcaagaccatcaccggtgaagacctgatcaaggctcgcacggtgggcgacctctaccagatgctcggactctga

SEQ ID NO: 3055 - DNA, 804 bp, Pseudomonas aeruginosa
tcgaatcctgagtgccttgaacgcggaatcagccaagtgaacgacgagacttccttcaatcccttcagcctgtcgggcaggcgcatcctggtcaccggcgccagttccggcctgggcctggccatcgcgcagagctgcgcgcggatgggcgccgaattgatcgtcagcggtcgcgacccacagcgcctgggcgccagcctggaagcgttgcaggcgatttccgatttgtcgcaccaggcgatccaggtcgatctcacggtcgccgagcagcgtgccgccttggtcgcggcgctcgatggcgaaatccatggggtagtgcatagcgcgggaatctcccgtctatgtccggtccgtatgatgagcgaagcgcacctgcgcgaggttcagtcgatcaatgtcgactcgccgatgctgcttacccaggcgctgctgaagcgcaacctgatcgcggccggcggctcgatcctgttcatcgcttccatcgccgcccacatcggggttgccggagtgggcgcatactcgggaaccaaggccgctctgatcgccatgtcccgctgcctggccatggaagtggtgaaacggcggatccgggtcaattgcctgtcgccggcgctggtggaaacaccgctgctggaagctacggcccaggtcgtgggttccatggacaccgagcgcaacaattatccgctgggcttcggcaagcccgaggatatcgccaacgccgctatcttcatgctttccgatgccagccgctgggtgaccggcacgaccctggtgatggacggcggcctgaccatcagttga

SEQ ID NO: 3056 - DNA, 1590 bp, Pseudomonas aeruginosa
ccaactgttcgtcgccgcggtcggcgatccgctcagtcgccagaagcaggtcgcatgcctgctggcgaagggcgccgagttcgtcgctatccgcacccgctgcacccttggcgtgcggaccagctacggcccgaccttcttcggctacgacgtgagcagcggcgtggactgccgtatcggcgcctacggtttcatcgaccagcaaaccatgctcggccacgacgtggtcatcggcgactatgtacacatcggcccgcgctgcctgctggctggctacgtgaaggtgggcgatcgcgcggtgatcaactccggggcgatgatcgcccgcgacgtcagtatcggcgaagacgccgtggtgggcatgggcgcggtggtgttcaaggacgtggcggccggacagaccgtggtcggcaatccggcccgggttattttcagcaagtgaaggttgtggatgtggacatgactcgccatgcgctggacgcagcgcactacaccgagccgcagacgctcgcgctggagcgcgaaaggctgttcggcaggctctggatcttcgtcggcttcagttcgatggtgcgcgagcgcaaccagttcttcacccgcaagatcgccggcgtgccggtcgtggtgcagcgtaccgagtccggcattcgggcctttctcaaccagtgtccgcatcgtctgtcggcgatccagaccgaatgcaccggccagcgaccgctggtctgcccgtaccatgcctggtcgttcggtgccgaggggcagctacagggcattccgaactccagcctgtaccagttcagcgccgaggagcgggcgcggatcggcttgcgcaagctgcacctggaagaggtggggcaactgctgttcgtcaacctggcggacgacccgttgccgctgcgcgagcagttcgacgatggattcctggaaaccttgcgggaggtctcctcgcacctggatacgcggctgatctacagctgccacaaggtgcgctacaactggaagctgaacatggagaacgtgaaggactacaaccacgttcctttcgtccatccgaagaccttcctcccggtgatgaccgctccggtgcgcggtttggcacgcgaggctgcggtgccgtccgaggtgctgcgcctgctgcaggaaggcgaaacgccggagctgcgttcgctgagcttccccaccaaggcgccgatccagccttacaagagctggttctccgacctctgcgagggctacggcgacgagcacgcctactacaactggttcatctacccgaacgtgaacttctgcagcgtccgtggcgagcacttcctgctccagcagtacgatccggtggcacccggcgagaccgactaccacctgtggatgatgactgcccggcgcaaggatccgaagaccgatttcagcgctttgctgagcaccctgattcgcggcgagcgtaacgtgatcggcgaggacaccctggttctggaacgcctccaggaggggctgggcgcacattcgccgccgttcatgcacggcgactacgaggtgcagctggtgcgccagcacctgtggtatcgcgcgcaggtactgggggagagggcatga

SEQ ID NO: 3057 - DNA, 1158 bp, Pseudomonas aeruginosa
acaattgaggggtggtcgatggtggatggtggcagcattgcacaagcggattttctagcgcgttgcgaacagagtggatatctcatgttgctggtgcctagctcctatctcgggcgtatctatcgaccccatatcgcgtccggcctggccaggcgcctgcctgatgtgcgcctggtcgccgtcgatgatgtgctcttcagggaaggcactactgtcgatggcttcgacgaagtgatccccactgctcacctgagcgatccccgtcatgccgggaggccggcggtgaactgcgcctattcgctgtctgcatggctgacgctggaccgtctctcaagcgccgcgaaatgcgccaccctcgacttacctgaactcctctatctgctggatattccgctggtctaccagaccggtgcgctgactcgcgaactggccgtgaaatatcatgccgagttcgtctcgctgcgcgagcgtctggccgacgagccaagccgcaagaccctggatgccatcatgcgcttgcgcctggatggaaaccgttccgctctgctggatgtcgtgtgtccgggagagcaggaatacttttccctataccgcggcgccggacatccgatcgacctgcgaaccgacgagcactacgtggatatcggcgccttcgacggtgatacggtgaagaaattcatgctggcagcccgtcatcgatacgcctcgatccacgccttcgagcccgacccagcgaactaccagcgcatgcacgcggccctaaacggacatgccaggctgaagctgcacaacctggccgtggccgacgatgagggctatcttgcgttcgctgcgcacggcaccatgggcagtcgggtccaggcggatggtgcggttcaagtgcgttgtgtgcgcctggacgacgtcctggaccgtatgagcctgctcaaaatggatgtggagggccacgaagcgcgggtcctccgcggcgcagcgcgcctgatcggcgaatgccggccgcgcatggccattacctgttatcaccacgtggcggacctgctggagattgtcgctgcgatcgatgagatcgccccgggggctcggttgcggctacggcactattcgatgtttttctacgacaccattctgtatgtcgactggccggagtattccgcatga

SEQ ID NO: 3058 - DNA, 822 bp, Pseudomonas aeruginosa
ggtcggttaaatgtcgcggaaaacgcagtttccgcccatcggatgagggactccatgaagtacgccgttgtcattcccgcacgccatgcgtcgacacgcttgccaggcaagcccttgctcgacttatgcggcgtgccgatgatcgtcaggacctacaggcaatgcatccaggcggtggacgccgagcatgtgctggttgccaccgacgacgaacgcatccgcgcagtctgcgaaggcgaggggattcgcacgctcatgacctcgagccgttgcctgaccggaaccgaccgggtcgccgaagtggccggacaggtctcagcggaaatcttcatcaatgtccagggcgatgagccgctgttcaatcctgacgatctgcgcaagctgatcgatgcagcccaggcgagcccggaagcgattatcaatggctactgtggcatcgccgacgaaacgacgtttcgcaacccatcggtccctaaggtggtctttcgtccggatggacgcttgctctacatgtctcgggcagccattccgacgaccaaacaaggcgagtttagtcgggcctggcgtcaggtgtgtgcctacgcctttccgcgtgaggcgctgcgagcgttcgcagccaggccgacgaaaacttcactggaggaggtcgaggacatcgagattctgcgctttctcgaattgggttgggaagtcaagatgatcgaaatgagcgaccagtccatctcagtggataacctcgaggatgtggagcgggtgttggacgcaatcctccagcgcaagccgcgaaccgctagcgttggaggtgaccagcatgccccgtga

SEQ ID NO: 3059 - DNA, 1116 bp, Pseudomonas aeruginosa
gcggagcgactcatgagcgaatctccttacgtccactcggctgcagagggggtagttgaaagcagcatggggctctattccgtgcccgcctatgtcagcttcctgcagcagaaccggacccgggaacaggcgttggcgatctatgagcagcgtatcgccgatgcgttggcgatttacacggagttttctcatgcattcgtggaaaggtgctgtccttgttgcggagcgcaggagcgcgccgacctcgaacctttccagggtatctatcgtgtcgccaaatgcatgcgctgcaccaccgcgtatgtaacgccttgcccgccgccggcggtacttggtcattattacagccagtgccgctgcaacggcatgctcggcgacctgttgaaggcgcgtcagcgctcaggcgaccggataatttccgatcgggtgcgctttctcctcactctgatcgatgagtatctgctgggccgggcgcggatacgcatccttgaggtcggctgcaattcgggcggcttgttatccgagttgaaggctgcccttcacgccagcgatctcctgcaccgatgcgaattgaccggcattgatatcgacgcttcggccatcgctaggaacgaagaccgcgacctcacgctccatgctgccagtgccgaggagtttgctgccggtagtggcggggtcttcgacctgatcatccatttcgagctgatcgagcatctgttcgatcctcacggttttatggtcgccacgaagaagctcatgagcgatggagggctccatcatttccatacacctaacgcgctcggtatggacaaccaggcactgggttacaacagctttcgtgcgctggcccatggtatttttccgccgatgcatttgcaggctttcactccgcaaaatatcgggcatttcgccatgcgttcgggctacagcatcgttcagatggacactcctggaaatttcgatgtcgacatggttgccaactggttgccgaaggacgccatggactctccttttatacacatccaccagttgcccagggagcacctggctatattccaacaatggctgaaagtgctaggtgcgagcagccacatgcgttgcacgctcaggagctga

SEQ ID NO: 3060 - DNA, 1620 bp, Pseudomonas aeruginosa
tggatggtccagccattgtcggcgatcaccagcaaggtgctcgactgtaccctccgtgatggtggctactacaccgcctgggacttccccaccacgatcatcgagcgttatctcgatgcaatgcgtgcggcgcgggtcgacgtcgtggagctgggtttccggtttctgcgcaacgaagggttcaagggagcctgtgcctacaccaccgaccacttcatccgcagccttgctattcccgaagggttggccctggcggtgatgctcaacggcgccgaccttttgggcgagatgggcctggaggcagcgttgcaacaactggttccagagagcgcggaaaccagcgcgctgaagatggtgcgcatcgcctgccacttccacgagttcgagcgtgtattgcccgcgtgcgactggctgaagcgccgaggctatgccgttggcttcaacctgatgcaaatggccggccatacccgtgaggaggtgagtcgccttgcgtcatcggccagtgactggcccgtcgacgtgctgtacttcgccgatagcacgggcagcatgaagcccgcggatgtctgcgagaccgtggcctggctgcgggaaggctggtcgggggcgctgggttttcatgcgcacgacaacatgggcctggcgttacagaacaccctgaccgcgcggaccgagggcgtcgaatggttggatgccaccatcaccggaatgggacgcggccccggcaatgtgcgcatcgaggaactgttgatcgagcttgccgagccgcgggccaacctggtccccttgctggccctgatcggagaatacttcgcccctttgaaggtgcggcatggctgggggaccaacgcgttctactacctttccgggaagcatgccatccacccgacctatgtccaggaaatgctgggcgacccgcgctatggcgaagaggacgtgcttgccgctatcgactatctacgtcggcaaggtggacagagcttccgtcgcgacatgctcgtcagtgcccgtcatctctatgatgaaacgccgaaagggatttggtccccatgcgactggctggaaggcagggaagtattgctgctgggggctggcacaggcgtggtcaggcaccgccaggccctcgagtcctatatccggcgtacccggccagtggtagtcgcgttgaatacccagtcggatctcgacgccagcctgattgatctccgcgtagcctgccatccagtacgcctgcttgcggattgcgaaacccatgcgcgcctgccgcagcctctcataacccctgtctcgagcctgcctaccgaattactgatgtcgttgcacgataagcaacttctggatttcgggttgggagtgaggtccggcaggttcgaagtgttccctcagggctgcgtcgctccgaactcactggtcatcggttatgccttggcggtggccgccagcggcagagcgcgacgaattctcctggccggtttcgatggctatccgccgggagactcgcgcaaccaggatatgcaggaactgttcaatctgttctgtgcgcggcaaagcgtgcccggcatggtttccgtcacggagacggcttatgacattccttgcacgagtatttacggcatgtag

SEQ ID NO: 3061 - DNA, 3621 bp, Pseudomonas aeruginosa
cgacacacgcacccggacagcagcccgcggctatggatgattcccaaaggcaaggcccgtcagagactagcctggcgaatcgatgctcttcaatttcgacaacggtcaatgaatatgggtgaacaggctctcgtcagcatcgtcatgccgacctacaagctggagtacttcgaggatgccctcgacagcgtgctcgggcagacctatccggccctggagctgatcatctgcgacgacagcagcgacgagcggatcgccacgctggtcgagcagaagcgcgcctccgcggcattcccgatccgctacttccgcaacgagacgcgcctcggcgagctgggcagcacggcgaaaggcatccgcctggcggagggcgagtacgtcaagtttctccacgacgacgacgtgttgcttcccgaatgcgtcgaggcgttggtgggagcgatggagcgcgagccgaacgtggtcctggcctcgtcgcggcggttgcgtatcgacgaggaagggcagccgctgccggacatcctggcgacctgcttcccgttcgccggcgacgtcctgatcgacggtcgcgagctggtctcgttcctcgccgaccacaccatcaacttcatcggcgaacccagttgtctgatggcccggcgcgatgcgctgctgcagatctgcgagcgcctgatgatgctcaacggccgggccatcgactggatcggcgacctggccatgtgtgcgcagttgctacagcgtggcgacctggcgttcctgtcgcggccgctgacccgtttccgcgtctcccgccagcagttcagccagatcgggcgcgaccagcccggtatcggcgagcagggccatgccgacttccgcctggctatccgcgaactgggttggtatcgccaggccggcgacaaccgcttcgtccgggtggcaccgatcacccgcctggacgcccgtgtcttcaagccggtcaacctgctcgccgcgctgaggcgggcggcgggcttcggtagcgtcacgctgtcgacctggctggaggcgcggcggccggatgcggtgcagaaggtgctgatcgatcgattcctgcaggagcagggtggtgggccgcgcttcgcggtgctggtgctcgatgcccacggcgataccgaggccgtggagcgtaccctgcagagcctggagcacgtcaatttgtatccacgtgtcgagagccacctgttcgcgccgctgggcacgagtccgcggaacggagcgatgctcttcgatccagaggtggggccggtgccgacgatcaaccaggcgcttgcccggcttgataccgactggttgctcctggtcgaagcgggtgtcgaattcactgtcagcggcctgctggtggcggcgctggacctgctggcggcaccggagagctgccaggcggtgtacgccgacgaactcatgcgcctggatgacggcgagctgggcgcggcgttgcgcccggacctgaatctcgaccttctgctcagtttccccgccgggctgtcccggcactggttgttccgccgcgagccgctgcttgccacgggcggattcgacgagaccgccggcgaggctttcgagctggcctaccagttgcgtctcgtcgagcagcggggcctgggctgtatcggacacatcagcgagccactgctgtctggcccagcgctgcgcctgcagaacagcaccgccgagcgtgcggcgatcgaaggccacctgcgtgcccgtggctacgcgcaggcgacagtcggaagccggctgccggggcgctacgagctggactacggccacgccgggcaaccgccggtcagcatcctggtgctggccggggagcgcctggcgcagctccagcgttgcgtagaaaccgtgctggagaataccgcctatcccaactacgagatccttctgctggaacagggtggcgaagcggccgacgttcgcgaatggctgctcgccgtcgaaggcatgggtgtcgagcaggtgcgggtgctgcgaggcgatgggcagttgtcccgtggggctctgcgcaacctggcggcgtcccgggcgcgcggcgaattcctgctctggctcgatgccggcagcggcatcctcgacaaggactggctgcagcagttactcaaccatggccagcgtccggaagtcggcgcggtaggcgccaagctcctggcggcggacggacgggtctgccacgccggctggctgctcggtttgtgcggaccggccgggcgggccttcgaagggcgttcgcacgaggacgccggttacctgcagcgcctgcaggtggaccagaactactcggcggtggctggcgaatgcctgttgatgcgccgcgagttgttcctcgaattgggcggtttcgacgaggcgctgacgcgctgggacgatgtcgacatctgcctgcgggcggtccaggcgggctacctgaacgtatggacgccgcgtgcgcggctgttgctcgatgcgcctgccacgacggcggcgagcgtcgaggaagaagatgcgctgtacgcgcgctggctaccgttgttggcacgcgatcccgcctataacccgggcttttcgttgcaggccgaaggcggtttcaagctggccgacccgcagctggcctggcgcccgttgcaggggtggcggcccttgcccactgtcctggcgcaccccgccgacctgttcggctgcggccattaccgggtgatccagccgttcagcacgttgcgcgagtcggcatccatcgatggcgcgctgtcgatcggcctgatgcacgtggccgatctggagcgctacgacccggacgtactggtgctgcagcgccaggtcggcgaggagcgtctcgaggccatgcggcggatgcaggcgttctcgcgggccttcaaggtctacgagctggacgactatctgcccaacgtgcccctcaagagcgcccatcgccagcacctgccgaaggacattttgcgcacgctgcgtcgcgggctgggttacgtcgaccgcttcgtggtgtcgacgccggccctggcagaggccttcgccggtctccacccggatatccgggtgatcgagaaccgcctgccggtggggtggtggcaggggctgcgggcgcagcggcggcgcggcgagcggccacgtgtcggttgggcgggcggctcgagccataccggcgatctggaactgatcgccgatgtggtccgggaactggccgacgaagtcgactgggtgttcttcggcatgtgcccgccgtccatccgtcccttcgtcagggaagtgcatgcgggggtgcctatcgaacgctatccgcgggcattggcggctctcgatctcgacctggcgctggcgccggtggagcagaacctgttcaacgagtgcaagagcaatctgcgcctgctggaatacggcgcctgcggtttcccggtggtctgcagcgacgtgcgctgctaccaggacgatctgccggtgacgcgggtgaagaaccgtttccgcgactgggtggaggcgatccgcatgcatacccgcgacctggatgccgcggccagggcaggggataacctgcgcgaacgggtgctggcggattggatgctcgacggcgagcatttgcgcgcctggtatcgtgcctggatgccggactga

SEQ ID NO: 3062 - DNA, 429 bp, Pseudomonas aeruginosa
cagcctgcctggccttgtgaagaaaagctgatgtcgcgtcctatcgatacctaccggcaggtaggcagcgcacaggacgtcccgccctaccaggtggtcaagctgctgctggacggcgcgctcgaacgcatcgccctggcccggcgcgcggtgctggagcgcaacccggcgctgcgcggcgaagcggtaggcaccacgttgtcgatcatcggcgccttgcaggctggcctcgatcaccagcagggcggcgagatagccggcaatctggatgcgttgtacgactacatgacccgccgcctggctggtgtcgcgctggacgacacaccgcgtccgctggacgaggtcgaggcgctgctgggccagatcaagcaggcctgggatgccattggcagcgccgaagcgcagggcgaagacagcgaacggcgctaa

SEQ ID NO: 3063 - DNA, 192 bp, Pseudomonas aeruginosa
gtgcagctgtacagatccttgaagaaaccggtagcgccctgcgcgttgccctggccagccagaactgggaggccatcggtgaactcgaccagcgttgccgccaggccgtcgacgaggcgatgctcgatgtacaggacgaagccaccttgcgggcgcggatggaagagctgctggcgctgtatcgcgagctga

SEQ ID NO: 3064 - DNA, 1437 bp, Pseudomonas aeruginosa
cgacaatctcgatcgcagtcgcgacctggcagtcattctcaacttcctcggcgaagatcagctgacctgcaacagcgaggattggcgagaggtagcggcgggcctgagcaacagtcgcgaagccctgtgcgtgctgctcggcagcgtcgagtcgaagggcggggcggtagagctgctgaagcaactggccagttgggacgagtacctgccgatcctgctgatcggcgagccggccccggccgactggccggaggagctgcgccgccgggtgctcgccagcctggagatgccgcccagctacaacaagctgctcgattccctgcatcgcgcccaggtctaccgcgagatgtacgaccaggcccgcgagcgcggccgctcccgcgagccgaacctgttccgcagcctggtcggcaccagccgggcgatccagcaggtgcggcagatgatgcagcaggtcgccgataccgatgccagcgtgctgatcctcggcgagtccggcaccggcaaggaagtggtggcgcgcaacctgcattaccattccaagcgccgcgaggggcccttcgtcccggtgaactgcggggcgatcccggcggaactgctggaaagcgaactgttcggccacgagaagggcgccttcaccggtgccatcaccagtcgtgccggacgcttcgagctggccaacggcggcaccctgttcctcgacgagatcggcgacatgccgctgccgatgcaggtcaagctgctgcgcgtgctgcaggagcgcaccttcgaaagggtcggcagcaacaagacgcagaacgtcgacgtgcggatcatcgccgcgacccacaagaacctcgagaagatgatcgaggacggcactttccgcgaagacctctactaccgcctcaacgtattccccatcgagatggcgccgctgcgcgagcgggtggaagacatcgcactgctgctcaacgaactgatctcgcggatggagcacgagaagcgcgggtcgatccgcttcaactcggcggccatcatgtcgctctgccgccacgactggccgggcaacgtccgcgaactggcgaacctggtggagcgcctggcgatcatgcatccctacggggtgatcggggtcggcgaactgccgaagaaattccgccatgtcgacgacgaggacgagcaactcgccagcagcctgcgcgaagagctggaagagcgcgcggcgatcaacgccgggctgccgggaatggacgcgccggcgatgctgccggccgaaggcctggacctcaaggactacctggccaacctcgagcagggcctgatccagcaggccctcgacgatgccggcggagtggtcgcgcgggccgccgaacgcctgcgcatccgccgcaccacgctggtggagaagatgcgcaagtacggcatgagccggcgcgacgacgacctgtcggatga

SEQ ID NO: 3065 - DNA, 1461 bp, Pseudomonas aeruginosa
ttccggcggcgcctctttctgcgattcaggagtaaccccatggcagccaaaatcctgctggtcgaagacgaccgcgcagtacgcgaagccctcagcgacaccctgctgctgggcggtcacgagttcgtcgccgtggactcggcggaggcggcgctgccggtcctggcccgcgaagccttcagcctggtgatcagcgacgtgaacatgccgggcatggacgggcaccagttgctcggcctgatccgtacacgctacccgcacctgccggtgttgctgatgaccgcctacggcgcggtcgatcgcgccgtcaaggcgatgcgccagggcgccgccgactacctggtcaagccgttcgaggcgcgggcgctgctcgacctggtggcacgccatgcgctgggccagttgccgggcagcgaggaggatggtccggtggccctggagccggccagccggcagttgctggaactggccgcgcgggtcgcgcgcagcgattccaccgtgctgatctccggcgagtccgggaccggcaaggaagtcctggcgaactatatccaccagcaatcgccgcgtgccggcaagccgttcatcgcgatcaactgcgcggcgatcccggacaacatgctcgaggccaccctgttcggccacgagaaaggttccttcaccggcgccattgccgcccagcccggcaagttcgagctggccgacggcggcaccattcttctcgacgagatatcggaaatgcccctcggcctgcaggccaagctgttgcgcgtattgcaggagcgcgaggtggagcgggtcggtgcgcgcaagccgatcaacctggatatccgcgtgcttgccacgaccaaccgcgacctcgcggcggaagtcgcggcggggcgtttccgcgaggacctctactatcgcctgtcggtcttcccgctggcctggcggccgctgcgcgaacgccctgcggacatcctgccgctggccgagcgtctgctgcgcaagcacagccgcaagatgaacctcggcgcggtggcgctcggccccgaggccgcccagtgcctggtccggcatgcctggccgggcaacgtacgggaactcgacaacgccatccagcgtgcgttgatcctgcaacagggcggcctgatccagcccgccgacctgtgcctcaccgcgccgatcggcatgccgctcgcggccccggtgccggtgcccatgccggcaatgccaccggccaccccgccgagcgtcgagattccgtcgccggccgcaggccaggacgctagcggcgcgctgggcgacgacctgcgccgccgcgaattccaggtgatcatcgataccctgcgcaccgagcgcggccgccgcaaggaggccgccgagcgccttggcatcagcccgcggaccctgcgctacaagctcgcccagatgcgcgacgcggggatggacgtggaggcctatctctacgccatctga

SEQ ID NO: 3066 - DNA, 387 bp, Pseudomonas aeruginosa
ctcctctgcaaagtgccgggcggcgtcaaaaaagccgcggctgttggaggaagagtcatgagtcagggtgtcgagttcaatcgtctgatgctggaaatgcgttccatgcaaatggaagccatggccaaggccaaaccggctcaggcgccggccgaagcgggggcgccgagcttttcggaaatgctctcccaggccgtggacaaggtgaacgagacccagcaggcctccaccgcgatggccaacgccttcgaggtcggccagagcggcgtcgacctgaccgacgtgatgatcgccagccagaaggccagcgtgtcgttccaggccatgacccaggtgcgcaacaaactggtccaggcctaccaagacatcatgcagatgccggtctga

SEQ ID NO: 3067 - DNA, 876 bp, Pseudomonas aeruginosa
ctagttcatggccgatgcactgatcgacagccaggttcccgccaagagcggcggtgccgggatgctgaagaaatccttcccgggactgtcgttcctcgacaacctttccgagatgaccatgctgcgccagatcggcctgctggtcggtctcgccgccagcgtggcgatcggcttcgccgtcgtgctctggtcccagcagccggactacaagccgctctatggcagcctcaacggggtcgacgcgaaccgtgtggtggaagcgctgaccgcggcggacattccctacaaggtcgaacccaactccggcgcgctgctggtcaaggccgacgacctcggccgggcacgcatgaaggtggcctccgccggcgtggcgccgaccgacaacaacgtcggtttcgagatcctcgacaaggaacaggcgctgggcaccagccagttcatggaagccaccaactaccgccgcggcctggaaggcgagctggcgcgcaccgtgtcgagcctgaacaacgtcaaggccgcccgcgtgcacctggcgatcccgaagagttcggtgttcgtccgcgacgaccgcaagcccagcgcctcggtgctggtcgagctgtatccgggtcgcagcctggagccgagccaggtgatggcgatcgtcaacctggtcgccaccagtgtgccggagctggacaagtcgcaggtcaccgtggtcgaccagaagggcaacctgctctccgaccagcaggaactctccgagctgaccatggccggcaagcagttcgacttcacccggcgcatggaaggcctgctcacccagcgcgtgcacaatatcctgcaaccggtgctgggcaacggtcgctacaaggccgaggtgtccgccgacgttga

SEQ ID NO: 3068 - DNA, 732 bp, Pseudomonas aeruginosa
cttcagcgcggtcgagtcgacctcggagatgtacaacccggaccaaccggccctgcgcagcgagcaacgcaacaacgaggaacggcagaattcgtccggcccgcagggcgtgccgggggcgctgtcgaaccagccgccgggcccggccagcgcgccgcagcaggccaccgccagcgcgccggccgactacgtcgcgccgggccagccgctgaaggacgccaacggccagaccatcatcgatccgaagaccggcaagccggagctggcgccgtacccgaccgacaagcgcgaccagaccacccgcaactacgaactggaccgctcgatcagctacaccaagcagcagcagggacgcttgcgccgactgtcggtggcggtggtgctggacgaccagatgaaggtcgacgcgaagaccggcgaggtcagccaccagccctggagcgccgacgaactggcgcgcttcacccgcctggtacaggactcggtgggctacgacgccagccgcggcgacagcgtcagcgtgatcaacgcgccgttcgccccggcccaggccgaagagatcgacagcattccgttctactcgcagccgtggttctgggacatcgtcaagcaggtgctcggcgtgctgttcatcctggtcctggtgttcggcgtactgcgtccggtgctgagcaacatcaccggcggcggcaagggcaagtcgctggccggcggcggcggtcgcgacggtga

SEQ ID NO: 3069 - DNA, 1026 bp, Pseudomonas aeruginosa
gtaagcgccatgagtgagaatcgtctcgccgccaaactgaccaaggtcgacaaggccgccatcctgctcctgtcgctcggcgagaccgacgcggcgcaggtgctgcggcacatgggaccgaaagaggtgcagcgggtcggcgtggccatggcgtcgatgcgcaacgtgcatcgcgaacaggtcgagcaggtgatgggcgagttcgtcgaagtggtcggcgaccagaccagcctcggcgtcggtgccgacggctacatccgcaagatgctcacccaggccctcggcgaggacaaggccaacaacctgatcgaccgcatcctcctcggcggcagcaccagcggcctggacagcctgaagtggatggagccgcgtgccgtggccgacgtgatccgttacgaacacccgcagatccaggccatcgtggtcgcctacctcgatcccgaccaggccgccgaggtgctcagccatttcgaccacaaggtgcgcctggatatcgtcctgcgcgtctcctcgctgaacaccgtgcagccctcggcgctgaaggaactcaacctgatcctggagaagcagttcgccggcaattccaacgccacccgcaccaccatgggcggggtcaagcgcgcggcggacatcatgaactacctcgacagctccatcgaaggccaactgatggattcgatccgcgaggtcgacgaagacctgtccggacagatcgaggacctgatgttcgtcttcgacaacctcgccgacgtcgacgaccgtggcatccaggcgctgctccgggaagtctcctcggacgtactggtgctggcgctcaagggctccgacgaggcgatccgcgagaaggtcttcaagaacatgtccaagcgtgccgccgagctgctgcgcgacgacctggaggccaaggggccggtacgggtcagcgaagtggaaggtgcgcagaaggaaatcctcaccattgcccggcgcatggccgagtccggcgatatcgtgctgggcggcaagggtggcgaggagatgatctga

SEQ ID NO: 3070 - DNA, 447 bp, Pseudomonas aeruginosa
ggcatggagaagcgcgcggcgcggctggcgccggtggtggacatggccagcaaggccgagcgggatgccgcgacccagctgggcaggtgccagcagcaattgctcgcggcacagcagaagctggcggagctggaacgctaccgcaacgactaccagcagcaatggatcagccagggccagaagggcgtcagcggccagtggctgatgaactaccagcgcttcctctcgcaactggagaccgccgtcgcccagcaggccaacagcgtgacctggcaccgcgaggcggtggacaaggcgcggctcaactggcaggagagatacgcccgcctggaagggctgcgcaagctggtcgagcgctacctggaagaggcgcgccaggccgaggacaagcgcgagcagaaacagctcgacgaactcgcccagcgtacccgccgccaggacgactga

SEQ ID NO: 3071 - DNA, 867 bp, Pseudomonas aeruginosa
tggctccggaaaaaagagccaagcctaggccgcctgcgcctggcagaatgctgcggtcaggacggaaaacatcgcgaagaggacaaggtgccgcgctatccctacgaacgggtcgaggatcccgatctcgcccgctgcccggtggtcggcctcgaggtcgacagcaccggccaccgcagcgactggcattgccaccggcgcgcgcagttgctgtacatggcggccggtagcgtcacgctgtatttcgccgagcgcatttgccaattgacgccgctccaggccgcctggctgccggccggcgtgccgcatcgcacggtcctgcacggccgcttcgcctaccgtagcctgtacttcgaaccctcggcgttcgccgagctgccggacagcgtccaggtcctcgaagtcgggccgctaatgcgcgaactgatcctgcgcatgaccggctgggcagccgacttgcaattggaagggccgcacctgacgctgttgcgcgcactgttcgatgaactggcgagcgcgccggcacacgccgcgagcctgccgatgccgcgcgatgcgcgggcgctgaaggtggccgaggcgctgctggcgcaacccgcgctggactggagcatcgaggcgtggggacgtgaggtcggcgccagcgggcggaccctggcgcgtctgttcaccgagcagaccggcctgggtttctcccgctggcgaacccaggcgcgtttgttcgaagcgcggaggcgcctggccgaaggccgctcggtgaccgaggtcgcccacgccctgggctacgccagcgacagcgcgttcatcgccatgtaccggcgggtctgcgggcagtcgccggggcgcgccctgcgtggcctcgaatga

SEQ ID NO: 3072 - DNA, 1182 bp, Pseudomonas aeruginosa
  unsure (696): Identity of nucleotide at the above locations are unknown.
agtggtgtttttcgcttggggaaggagagaacgcatgccgggcctgtctttgaatgccatcctgctgagcgccgtcgcgctgctcgctccgtcggtcgaggcggtggacgccggtcgccacgacagcgagctgggcgccgtcgaggtcaccccggtggttggcggtctggcctatccctgggccgtcgccttcctgccggacaaccagggcatattggtcaccgagcggcccggcagcttgcgtttcgtcagtcccgagggacagttgtcggcgccgctggaaggcgtacccagggtcttcgccagcggccaggggggactgctcgacgtcgccttgtcgccggggttcgccgaggaccggctggtctacctgacctatgccgaggccggcgaggacggccgcgccggaacggcggcgggaagtggccggttatcggcggacaagcgacggctggagggcttccacgtgatcttccggcagttgccgaagctatccagcggccatcacttcggctcgcgcctgtattagacggcaagggccacctgttcatcgccctcggcgagaacaatcagcgcagcacctcgcaggacctggacaagttgcagggcaagatcgtccgcctgtatccggacggcggcgttcccaaggacaatcccttcgtcggccgtgccgacgcgcggccggagatttggagntatggccaccgcaaccagcagggcgccgcgctgaatccctggaccggccggctctggacccacgagcacggcccgcgcggcggcgacgagatcaacataccccaggccggcgggaactacggctggccgctggcgacccatggaatcaactacaccctgctgccgatccccgaagccaggggcaaggccgtcgaaggtaccgaggcgccgcaccatgtctgggagaagtcgccggcgatcagcggcatggcgttctacgatgcgcagcgcttcccggcctggcagcataatttgttcatcggcgcgctggcgacgcaggaactgatccgcctgcaactggatggcgaccggatcgtccacgaagagcgcctgctgggcgatctcggggtgcgcatccgcgacgtgcggcagggcccggacggctatctctacctgctcaccgaccagaaggacgggcaattgctgcgcctggggttggcgcgctag

SEQ ID NO: 3073 - DNA, 477 bp, Pseudomonas aeruginosa
gcgggaggatcgaattgcaggcggtgcgcttcgcctatccgacccgtcccgaacactgggccatcgacgacatcagcctggccgtcgaaccgggggaaaccctggccctggtcggaccttccggcgccggcaagtcgaccctgttcgatctgctcctgcgtttcttcgatccgcagcagggacggctgctgctggacggacagccgatcgtcgaactggacccggccgacttgcgccgcagctttgccctggtgtcgcagaaccccgcgctgttcttcggctgcgtcgaggaaaacatccgctacggccgtccgcatgccagcgccgccgaggtcgaggccgcagcgcgtgccgcgcatgcccacgagttcatcctgggtctgccgcagggctacgccacccacctgggcgagggcggcatcggcctgtccggcggccagcgccagcgcctggcgatcgcccgggcgttgctggtag

SEQ ID NO: 3074 - DNA, 2556 bp, Pseudomonas aeruginosa
cgctcatctcgacgtccttgtcgttcagcgcccggttcgcgcagatggccttttcgtccgctcgctcagccttttcgcaatcgaagctggccgcttcggccaggggcgccagcaggagtccgccgagggcgaggaatgccaggtgcttcatgccgttctccgtttcgcctggttgcttgcgaatcttcgacgcccgcgacggcgctgggttcagcggggagcgcgcggcggccgggcgggccgctccggcgcggtcagtgcgaaaggatcagggccttctgctcggggatgacggtgcgctcccgaggggcgtccgcgcgttccgcttcctcggtttcggggcggttggcgaacaggcttttcagggtgctcagcagcggctgttccttcgccgcttcggcgacctggctgcggctttccacgggttccgggttggccgccgtgaccacgtggaagtcgctgatctcgatgatcccgcggccctcggcgagcaagtggaaggagaaggccttgcgcgcttccgggttgtcgaaggtgaagctcatgtccagcggcttgcctttgagcaggcgcgggatgtccggtaccggtatgggaacgtcgcgttcgaattccttggtcttcagcgtcacccgggcgccgttgcggtccatactgcaaggcgcggatcttcagggtgaccgtggtcctgctgttcttcggcatttccaggtattgcgcgccgatcaggttgtcggtccagtcgttgtgggtttccggcttcaggcggatgcgttcgtgggtggcgaactggaactcctggcccaactggccggcctgttgcacggagtggtcgaggacggcggcgcgctggctgaccaggcgtgcctggcgaccgctgaagcgaccgaggaactcggcttcgtcggcgatgaagccctcgctgcggtagcgccggcagacctgctggaaatcgcattcgacgaaggtgtccttgccgtcgtggtggcgcagcatgccgttggtgtaggacatcatttcgcggccgctggcgtagtcgcggaacagcgagcgcccggaaatccccgccggcacgcggtagccgaaatagtcgaggacggacgcggcgaggtcgacgtggccgtagacgccgctcttgatcggcggcagcgccgcctgttccggtgccagtaccaggttgaagccccaggccgaggcgaggcgcacctggtcgacaccgtgggattcgtcggaagtgagcaccaccagggtgtcgcgcaacacgccctgtttctccaggtcggcgaggaaggcgtcgatcgcgtcgtcgagataggccaccgcggcctgcttggcgctcgggtagcgggccaggtagtcggcaggcgccgagtagggctggtgggtgccgacggtgagcagggtcagcatccagggtttcttctgctggcgcagctgcttcacgtaggtcgcggcgccctcgaagaaggccttgtcgtccatgccccagggaaactccaggtaggacgtgttgcggaaccagtcgcgcccgagggtcttgtcgaagcccatatgcggcatgaccttgtccttggccatgaagcgcaggccggcaccctgcaggaagtgcgtgctgaaaccgtgctggcgcagctgggcgggcaagcactccctggcccgggccgggttgttgagcagctcgacgcccttcggcgtgcccgagtcgagcttgctgtagtcgccgcagagcatggcgtaaaggccgcggatggtctggtggctgtgcagcacgtagtccggggtggtcatcgcccgttcggcccagccactcagtctgggcatcggcgcttcgtggtagctgctgttgatggcggcgcggttggcggcgatatacgcgccggggattccctccatggccacgatcaggacgttgcgcgcgcgccctccgccggccagcagcggcgttccggaaaggtcgagctggttgagcccggcgacgtccggcggggtgtccggacggtcgtcggcgagccagtcttcgaccgccagttggccactgctgagcgcgctggccagcagcttgtgcggcaggttgtactgctgccattggtcggcatcgctcggacgcaggtattgcaggccgacatgcgccgccaggaacgccgccggcagcgcgtaggcatagcgcggcaggcgcggaccgcggcgacgccagagcagcacgcaaagcaatgtcgcgccaccgaggccgagcgccagtggcaggtgggcgaggccgccgccctgggtggagctgctgacgaactgcggatccagcaggtacttgaggtcggaaggttccggcatgcgcccgaccgcgccgaccagttcggcattgccgatcaggaacaggcaccagagcagcatgaccgggagcgcgaaccacagggagcgtcgatgcaggagcagcaccagcaggctgccgagggccaggtccgagagatagccgaacggcgtcgaccagccgagccagtagcggccggcgaggggaacgaccaggaacagcgcggccagcgccagaagcgagccgcaagatga

SEQ ID NO: 3075 - DNA, 609 bp, Pseudomonas aeruginosa
agggcgatgccgatggtcagcgaggtactcaccgtgctgccgtcgctgagccggatcggcgcctgcatgctggcgatgatgttgtcggcgatgcgcagggcgtcggcgccggacgccagcggtgcgagcaggacggcgaattcgtcgccgcccaggcgcgccaccaggtcgctttcgcgcaactgcccacggatgcgcatggcgatgttgaccagcacggtgtcgccggcggcatggccgaggcggtcgttgatctccttgaagcggtcgctgtcgatgaacagcaccgccaattgctcgcgatgctcgttggcatcgcgcagcgcccggctcaggcggccttcgaagaaggcgcggttgggcaggctggtcaggctgtcgtggtgggcctggtgcgccagcgaggcgttctcgtcctgcaggcgcgcctgccaggattcgagttcgtcgagcagggcgttgaagtcctcgcccagttggctcagctcggcgatgccggcttccggtacgcgcttctcgaaatcccgttcgcggcgcacggtatgcgcgaccttcgccagttggtcgagcgggccgacgataccgcgtaccagccgccgcgacaggtag

SEQ ID NO: 3076 - DNA, 558 bp, Pseudomonas aeruginosa
cctttatcagggggcggcatgatccgggaaatcctcaagatgggtgacgagcgcctgttgcgtatcgcgcagccggtgccgtccgaactgttcggcagcgaggagctgcaacggctgatcgacgacatgttcgaaaccatgcatcacgtcggcggggtagggctggccgcgccgcagatcggcgtcgacctgcagctggtgatcttcggtttcgagcgcagcgagcgctatccggacgccccggccgtgccgccgaccatcctgctgaacccgcggatcaccctgctggacgacgagatggaagagggctgggagggctgcctgtcggtgccggggttgcgcggcgcggtatcgcgccatcggcgcatccgctaccagggcctggacccgcagggacagccgatcgaccgcagcgtcgaagggttccatgcgcgggtggtgcagcacgagtgcgaccacctgatcggccgcctgtatccctcgcgaatcaccgacttcagcaagttcggcttcaccgaggtgctgttccccgacctggaccccgccgcggacgattga

SEQ ID NO: 3077 - DNA, 813 bp, Pseudomonas aeruginosa
ccgaccagcatgcccaggacgaataccgcgcgttgtccgcgctgtaagcggaggagcgagatgcgcgctgtcgtcgaactgctcgccggcgcccgccgcctggtgatcttcacgggcgccggggtgtcggcggaaagcgggattcccaccttccgcgatgcccttggcggtctctgggcgcgctacgatccggcggccctggctacgcccgcggccttcgccgacgatcccgcgctggtctggggctggtacgagtggcgccgcctgaaggtgctgggtgtccagccgaatcccgcgcaccgggcgattgccgcattgagcggacggatcgccggcacccggttggtcacccagaacgtcgacgacctgcatgaacgcgccggcagccgcgacgtccttcacctgcatggcagcctgcacgcgccgcgttgcgcgacctgcgcggcagcctaccgggacgccttgcccgattcggtcgagccggaagagggacgacggatcgagccgccgcgttgtccggcctgcggcggacaggtccggccgggtgtggtctggttcggcgaggcgctgcccgaggcggcgctgcgcgaggctttcgccgcggcctgcgagtgcgacctgttgctcagcgtcggcacttccggcgtggtgcagccggcggcgcggatacccggactggcgctggaacacggtgccagcgtcgtgcatgtgaacccgcaaccggtgcgcacccgccatccgcgcgaacactgtctcgtcggtccggccggcgaggtgctgcccgaactgttgcgccgggcgtttcccggctga

SEQ ID NO: 3078 - DNA, 939 bp, Pseudomonas aeruginosa
cctccgagaactgccaggagccctggaatgccggctttcacccgttccgaactcgccgacctgaacgtcttcatgaccatcgtccggcgccgcagcttccgtcactcagcccaggagctgggtgtcagtacctcggcgctgagccacagcatgcgcaacctcgaggcgcggctcggggtgaagctgctcaaccgtaccagccgttcggtggtgccgaccgatgccggcagcgcgctggcggccaagctggaggatggtttccaggtgatcggcgaggcgctcggcgagctcgatgcctatcgcacctcgccggtgggccggctgcgcctgaacgtgccgcgcgatgcctcgcggctgctgctggggccggtcctcaggcgcttcaccgaggcgtatccggacctgcaactggaactttcggtggaggaccgcatggtcgacatcgtcgccgacggctacgacgccggcatccgttacggcggcacggtgccccaggacatggtcgcggtgccattgaccggggagctgcgctgggtggtggccgcgtcgcccgattacctggcgcgccacggcgtgccccagcggccggacgacctgttgcggcacgcctgcatccgcatgcgcctgggcgacaactcgttctacaaatgggaactgggcgacggcgagcggatggtcgaggtcgacgtgcccggccctttcagcgtcaacgaaagcaatacggcggtcgccgcggccctggacggcattggcctggcctactgcctggaagtgggaatcgccgaggagctgcgtagcggccggctgcaactggtattgcccgactggacctcgatgggcgcgccgttctgcctctattatccgagccgacgccagccgcaacccggcttgcgccaactgatggaaatgatccgcggcgactggctggggcgtgcctga

SEQ ID NO: 3079 - DNA, 1236 bp, Pseudomonas aeruginosa
ccctggcgtcgccgacctgccggccagcatcgccttctaccgcgatcttctcggctttcgcctggaagcgcgctgggaccagggcgcctatctcgaactgggttcgctgtggctgtgcctgtcccgggagccgcagtacggtgggccggccgcggactacacgcactacgccttcggcatcgccgccgcggatttcgcccgcttcgccgcgcagctgcgcgcgcatggcgtgcgcgaatggaagcagaaccgcagcgagggcgattcgttctacttcctcgacccggacggccatcgcctggaggcccacgtcggcgacctgcgcagccggctcgcggcgtgccggcaagcgccctatgcgggaatgcgtttcgccgactaggccttggccttgccggaagctacggacgccacggccgggccggcgaggcgcttcagcaggcgcgggcggttggtctccagcgcgccgccgcgtccccgcaggccgtcccacaggccccagcccaggcagcgcagcttgagcagcttgtcgcgttcgagcaggagcaccgcgaggccctgggtcagggtcggcaggttcgccagcagggccagcggcgaggaccgggcgtagcggcgcaggaccagcaggccgttgcgcgccaggtagtagcggcgcagcggggcgtggttcatcgcgctgaggctgagaccgccgaggcggcgggtcttgcgcgtgccgatgcggtgctcgaggaccagccgcgggtcgacgtacaggggcacgtccagcgcctgggcgcgcaggctgtattcggtgtccacgtggtcgatgaacagttcctcgtcgaagtggccgaggcgctggtaggcctcgcgggtcagcaggcagccggaggagatcaggaacgaggtgcgctgcggggtcgtcaggccgtccagagacaattgcctgagcgtcagtccgtcgagatggatggccggcaggaagcgccggtcaccccggtcgaagatccgtgggccgagcaggcaggcctgaccgttgcgcgcctgcaggttgcgccactgggcggcgaggaaggcgccgccgggacgggagtcctggtcgagcagcagcacaccctgcacgccacgccggaacagcgcgtcgagcccctggttgaaggcgccggcgatgccctgccggttgccgtggtgcagcacggcgatgccttgcccgcgcagccgggcattgcgctgcggatcgctgtgcggtga

SEQ ID NO: 3080 - DNA, 468 bp, Pseudomonas aeruginosa
aacttctcgatcacgaagaacggccagaccaccatcaccgcctgcaagccgaggaataccagggcaagcaccgccagcaggagtccgacccccggttgccgagccaggccgctgatcgagcgcaaggcattcatccgcctcgggtccaggcggcggcgtcgcgtcgggggcagggtttcctcgaggaacaggccggcgagcagggcgttgagcaggcacaggccggcggccagcaacagcggcagcgtcgtgccgtgcaccgccagcagcccaccgagggcggggccgaggatcatgcccagagcgaggccggcgtacagccagccgaagtgccgggtgcgctgcccgtgcgtgccgaggtcagccgcgcaggccatcgcggtggccacgctggcgccggtgagcccggccagcgcgcgaccgaggaacagcatccagaggctgtcggccagcgccagcagcagatag

SEQ ID NO: 3081 - DNA, 501 bp, Pseudomonas aeruginosa
acgaggcagacaaggacaagcgcgagccgctgccgccggtacgccagcaggcggtcgacacgaagaaggccggcaagctcatccattcggtatttcgctgaggcgctcgctcaaagagcgccggcgatcgcgcgccaggtgtcggcgtatcgccatcgcagccaggcgaccaggcagcgctcgtgccagcgtcgcagggcgcagctcctttgccgcgccaggcgtcgctcgatggcctcttccagccaggcctcgtcgaaggcggtccataccgccggagcggggctgagcaggttgccgtggcagaccggcgccacttcctcgaagaacaaccgctccagcaacgccgggtcgacgccctttatccgccgggcgatatcctcgggctccaggagagtgtcgacgaaggcgtcggatagcgcgtggcgcagtcgtcggcgttggctcgggtcaagggccatggcaagtatgggtccgcaggctggtgcgcaggcagcataa

SEQ ID NO: 3082 - DNA, 1155 bp, Pseudomonas aeruginosa
agcacgtcgggaccgttgacgccggcggcgcggacttcgaccaggacctcgcgcgggccgggcgtcggcagcggccggctggtcgccaccagtacctcggggccgccgggccgggcgatctcgatggcggtcattcgttcgggaaatcggttcgtactgctcatcgcatgctcctgggaaaatggttcggacctggttcgcatggtaagcagcgcggatgccgtggtcgcgcagcgctttttcattagactgatgcgaaaatgcatcaggaaaaccgccatgaattgggacgacacccgcgtcttcctcgcgctctgccgcgagcacaccctgcgcggcgccgcccgcgcgcttcacgtcgaccaggccacggtgggccggcggctggcgtcgctggaggcggcgctgggctcgaccctgttcctgcgcacctcgtccggctacctgctgaccccggccggcgaggcggccttcgaactggccgagaagatggaacgctcggccctggagttgctgcggcggacccgcgggatggaccaccgactgtccggcgaggtgcggttgtccaccaccgactccctggccgtcgacttcgtgctacccgccctggcccgcctgcaccttgaacacccggatatccgcgtgctgctcgacagcgcttcggccgtggtcgatctgcccaagcgcgagaccgacatcgcgattcgcaccctgcggccggaaaatcccgatttgatcctgagaaaactcgccagttggcccatgggcctgttcgcttccgcggactacctgcggcgcaacggcgtaccggtgcccggcgagcgtttccgcggccacgacctggtgatgtacgaaccctattggcacagccagcgcgaactgaccctgggcggcgagccgatccgcgacggccgggtggtcatcgcggtgaattccaacatgatggtgcgccaggccctggcgcgtggcctggggctctgcgagctgccgctgtacatgggcgagcgcgacggactggtgcgggtctggccgcagcgtgagcgacgccggccatacgaggtgtggatggttacccacaaggacctgcgccacaccgcgcgggtccgcgcggtgatcgagcggctggtggaggcgttcgccgaagcgccggcctga

SEQ ID NO: 3083 - DNA, 939 bp, Pseudomonas aeruginosa
gcctgcaacgccggcgccgggttccggtcgaatgcggcggcgcgccgcggaatcgcgcatcataggcgccatcagatcgaggagatttccatggcaatcccaagcatcccgcgtttggccgtactgacgctcggactggcgctcgcagcggccgccagtgccgccgacgaggcgcaactggtcgaggcgatcaacgcctaccgtggccaggtgcagtcctgcggcgggcaggccagcggcgaactgccgccgctggccgccgatccgcgcctggccttgccggtgaatgccgccggcgacctgcagcaggcgatggcgcaggccgcctacccgatggtcaacgtgcagtcgatcagcctttccgggccgcgcgatgccggcgcggcgatgaaggcgctgcaggaaagcttctgccgcgtggtgctcgacccgcaattcgtcgacgtcggcgtcagccgccaggaccgcgactggcgcatcgtcctcgcccggccattgctgcgcggcggcatgggcgattggcaggcggaagggcagaagctcctggaacggatcaacgccgcccgcgggcaagcccgccagtgcggtggcaaaccttacgcagcggcccagccgctggcctggaacgccacccttggcggcgccgccgaagcgcattcgcgggcgatggccaacggcaacttcttcgaccacctcgaccgcgacggccgcacccccggcgaccgcgccgagctggccggctacagcggcgggctgatcggcgaaaacatcgccgccggccaggacggggtggacaaggtggtcgacggctggctggccagcccgggccactgcgccaacctgatgaaccccggctaccgcgagctgggcgcggcctacgccaccgatccgaagagcgacgcgggaatctactggacggccatgttcggttcgccctga

SEQ ID NO: 3084 - DNA, 591 bp, Pseudomonas aeruginosa
ccgagcagcgtatcgccggcgtcggtcggcaacacgtcgcggttgccgcgctccagcaggcggtgtccggccatttcctccaagcggcgaaccttctggctgacggtcgactgggtcgagtgcaggcgcgcggcggcagtggtgaagctgccgcagtcggccaccgtgacgatggcgcggagcaggtcgaggtcgaacaggcggctattcgatttttcactgtcgctcatggtcgtatcgcattttcgaatgtcgtcgccgcttttagcaggccgtgccgtcagcggcaaccgctcagcgtcgacgcagcgtgcccagcggtcgaccaatgcgctggaagcggcgggaaacccgccaggcggtcatgcatgcgccaggaacaggaccgcggagcgctactcgggcacctcgacgttgacctgcagcgcgtcgtggcgccagtactccaggtcgcagtcgatcaggcggcccgcctggtcgcggttgatccgcacgatctgtagcgccgggctgcccaccgagacccgcagcggtcccgcggcctccgccgggaggatggtcgggaccatttcgaagcgcacccggccgtag

SEQ ID NO: 3085 - DNA, 714 bp, Pseudomonas aeruginosa
tgcttccgggccgccggcggtatagcgcggcgcgccttctcagcgccattccagcactggccagccggcctcgcgggcgtgcccgagcagcgccgggtcggggttcaccgtgtgcggccggtcgacccgcgagagcagcggcaggtcgttgcgcgagtcggaatagaaggtcgcgccggccagcgtctcgccctcctgggccagccaggcttcgaggcgacggaccttgccctcgcggtaggtgagggtgccgcgggtgcgcccggtgtagaggccgtcgcgctcctcgatgtcgatcgccagcacctcgtccacccccagccggcggccgatggcgctgacaaggaagtgcgccgaggcggagatgatcagcaggcggtcgccggcctggcggtggcgttccaggcagcgcagggcgtcggcgtggatgcgcggggctatgatccgcgcgacgaaatcctcgacggcgccggcgatctccgccggggtgcggccggcgatgggcgccaggctgaagtccatgtagtcctccatggccagccggccctcggcatagagttccatgaggcggcgttcctggtgcaggaaggcggtcttctcgacccagcccagttcggtcatgtagcgcccccagagggtcgcgcagtcgccgtcgatcagggtgtcgtcgaggtcgaagagggcaagtggcataggcggttccttgttcgctag

SEQ ID NO: 3086 - DNA, 417 bp, Pseudomonas aeruginosa
gcgccttcagcagggcgccggaatggcttggccggggcgcgttggcggggggcgcggcctcggcctccacgggcggcaggccgacgtcctgcggacggttgcgctggaggaagaagaacagcacggccaccgccagcaccactcccgccgaggacaggaaggccatgcgccagtcatgcgtcaaccggtaggcgcaccagccggcgaacggcgtcgccaccagcccgccgaaggcgtagcaggtactccacaggccgagcacgcggcctcgctcgtaggtggcgaagaaggcgccgatgttcttgcacagccccgaccagccggtggactgcgccaggccctggaccaccatgcaggcggcgaagatcggcagggtggcgaaggtacccatcaccagcgccgccagcgccgaggtga

SEQ ID NO: 3087 - DNA, 1107 bp, Pseudomonas aeruginosa
gtcggccagcgcctgctcgcccacccattgcgcgtcctcgccatccagaccgagggcggcgaggttcgccgggatgccgatgcgcgcgcgcagttcgaggatccacgccagcaggccgtcgaagctcgcttcgtcgagttccaggtagcgcgccaggcgcgcggcgtcggcttctatcgccgggcggttggccagcagaacgtagggcagcagcacggcgttcagcaggccgtggtgcaggtgatggcgagcgcccagcgggtgggccagggcgtggaccccgccaagccccttctggaatgccactgcggcgctggccgaggctaccagcatgccttcccgggcggcgaggtcgttgccgtcgcgcacggcgttttccaggtgctgcctgaccaggcgcacgccttccagggcgatgcccgccgacatcggatggtagagcggcgagaacagcgcctccaggtgatgggtgagggcgtccatgccggtggcggcgctcagcgtcggcggcaacccgcgggtcaggcgcgggtcgaggaatacgcaggcggccagcagctcgcggtggccgacgacccgcttgatgcccagttgcgtgtcggtcagcaccgcctcgcgtcccagttccgagccggtgccggcggtcgtgggaagcgccagcagcggcggcaggccgagcagcgggtagtcggcgagggtcggatagctgcgcagcgtctgtgtccattcgaagcgttcgaggccgtgcggatcgcggctgagcagggcgattcccttggccgcgtcgagggcgctgccgccgccgagagcgatcagcgcgtcatgcccgccagcctcgaagcgcctggcgccgccgtggacttcagcgaggctggggttgctcgacagttcgtggcacaggtcatggtcgaacccggcgcgttacaggcactcgcgcaccaggcgcaggggctacagggcgagcatgccgggatcggtgaccagcaggggccggcgtgcgcccgccagcgcgcaacgcctcggcagttgttccagggcgccgacgccgcagaggatatcggtggggtagttccagtaatgcaggtcgctcatggcgatgctccgtga

SEQ ID NO: 3088 - DNA, 447 bp, Pseudomonas aeruginosa
agcaggccgaacgcggccagcgcggagaacaccacgaccaccgcccagacctggaaccagggcgcgtcgggcggggcgaggctggcccgcggccaggcgacgttgagcgcctcgaacgacagccaggcgactgccaggacgttcaccgccagccccgcgcgtcccaggcgcaaggcgcccttgtccgggtcccagcggccgacgaggcgggcccagagagcgcaggcggcgacgatcaggaagaccacgaagaaaccgccgctgccgaacgcgatcagcgtgccgaccgccgtggcgttcagccccagggccaggccgaggctggccagcagcgtgctgcagaccatcgccgccatcggcaccttgcgccggtcgacccggcgcagcagggcggagccgggcaggatggcgtcgcgcgccatgccgaagatcgcccggccgatgtag

SEQ ID NO: 3089 - DNA, 405 bp, Pseudomonas aeruginosa
tgtcgccgccgtcgccgaggaactccgcgccagtgggatagttgcgctccagcagggcgtcgccgctgtccgccgggcccgcgcattcaccggcggcgaccgggcaggtcaggctcaccacgtcggcgctggccgcgccggcctcgtcgttgcctgtgccctgccggacgaagcgctcgctctcggcggcggccagggtcagggccagacgggcctgctccggctgctcgcggatcgcttcgcccaggtcgccgccgctgccggggctggccagggcgttgcggatcacctggtcgacctggttccacgacagccgcgccgccaggtagagggcgaccagccgctgcaccggatagccgcactgctccagttgttcccagccgcgcggctggcgatgacgggtga

SEQ ID NO: 3090 - DNA, 207 bp, Pseudomonas aeruginosa
cgagctctccacgttggccagcagcccacctctccctactggaaagtcaggtcaataacactggtgccacgtaaggatgggcgttcctactggcccctcatacgccaggctgctacggcagatcgtgtcgctaacctcaagggacacaacccgcaagaacgcgcgtccctgaaaaagcgcctgctgcgcaagtggatgagcaaatga

SEQ ID NO: 3091 - DNA, 3009 bp, Pseudomonas aeruginosa
ggtgcacgcgaaagcggtggtccggcacggtctggccgggccgttcttctcccccggagggaagaaggggattgttcctggccctggcgaggggccttgcgctgccagcgtggcgctggacgagcgaccgtcaggcgccgggcaggccggacccacacgaggagtccggcttgcccggccgcgacacggacgccgttcagcgacgcgcgatcactggcaggcttcgcagtcggggttgtcgatgctgcatgcctgcggcaccggcgccggcttcggctcggcggccggggcggcttgcaggccgtcgttgccaccggccgacacggcgttgagcttgccggtgttgatggtggacttctcggtgctggtggcggccagggcgcggaggtagtaggtggtcttcaggccgcggaaccaggccatgcggtaggtcacgtcgagcttcttgcccgaggcgccggcgatgtacaggttcagcgactgggcctggtcgatccacttctggcgacggctggcggcttcgacgatccagcgggtctcgacttcgaacgcggtggcgtagaggtccttgaggtcctgcgggatgcgctcgatctgctgcacggaaccgtcgtagtacttcaggtcgttgaccatgaccgggtcccacaggccgcgggccttgaggtcgcgcaccaggtaggggttgatcacggtgaactcgccggagaggttcgacttcacgtacaggttctggtaggtcggctcgatcgactgcgagacgccggtgatgttggcgatggtcgcggtcggcgcgatggccatgatgttcgagttgcggatgcctttctgtacgcgctcgcgcagcggcgcccagtcgagggtttccgacaggtcgacttcgatgtacttggcgccgcgctcttcgatcagcttcttctccgagtcgatcggcaggatgccttgcgaccacagcgagccctggaaggtctggtaggcgccgcgctcgtcggccaggtcgcaggaagcctggatcgcgtagtagctgatggcttccatggactggtcggcgaaggcgatggccgcgtccgaaccgtaggggatgtgctgcaggtacagggcgtcctggaagcccatgatgcccaggccgaccggacggtgcttgaagttggagttctgcgcctgcgggaccgagtagtagttgatgtcgatgacgttatcgagcatgcgtaccgcggtcttgacggtcttctccagcttggcggtgtccagcttgccgtcgacgatgtggttgaccaggttgatcgagcccaggttgcagacggcgatctcgtccttgttggtgttcagggtgatctcggtgcagaggttcgagctgtgcaccacgcccacgtgctgctgcgggctgcgcaggttgcacgggtccttgaaggtcagccacgggtggccggtctcgaacagcatggagagcatcttgcgccacaggtccttggcctggacgaccttgtgcagcttcagcttgccgtagctggccagggcctcgtagtactcgtagcgctcctcgaaggccttgccgtagaggtcgtgcaggtcggggacgtcggacggcgagaagagggtccaggagccgtcgtcgaagacgcgcttcatgaacaggtcggggatccagttggcggtgttcatgtcgtgggtacgacgacggtcgtcaccggtgttcttgcgcagctcgaggaattcctcgatgtccaggtgccaggtctccaggtaggcgcagaccgcgcccttgcgcttgccgccctggttgaccgcgaccgcggtgtcgttgaccactttcaggaagggcacgacgccctgggacttgccgttggtgcccttgatgtaggagcccagcgcgcgcaccggggtccagtcgttgcccaggccgccggcgaatttcgacagcatggcgttgtcgtggatggcgccgtagatgcccgacaggtcgtccggcacggtggtcaggtagcagctggagagctgcggacgcagggtgccggcgttgaacagggtgggggtggaactcatgtagtcgaaggacgacagcaggttgtagaactcgatggcacgtgcctcgcggtccttctcctcgatggccaggcccatggccacgcgcatgaagaagatctgcggcagttcgaagcggatgccgtccttgtggatgaagtagcggtcgtacagggtctgcaggccgaggtaagtgaactgctggtcgcgctcgtgatcgatggccttgcccagtttctccaggtcgaattccttcagcttggcatcgaccagctcgaactcggcgcctttctcgatgtaggccggcagggccttggcgtacagctcggccatctcgtgatgggtggcgctctcggccacgccgaggaagcccagggcttcggcgcgcagggtgtccatcagcaggcgggcggtgacgtaggagtagttcggctcgcgctcgaccagggtgcgcgcggtcatcaccagggcggtgttgacgtcctttttcggcgacgccgtcgtagagtttttcaggtctcgcgctcgatcagggcgccgtccacctcgggcaggcctttggcagggttcgctgatgatggtgttcacggcggcctttttcagcggcgacaggctgccgtcggcgcgggtgatgcggatgctcgggtgcggctgggcgacgtcgctggcggcgccggcgttcttgcgctcggcggcgcgggcttcgcggtagatcacgtagtcgcgggcgaccttctgctcgccggcgcgcatcagggccagttcgacctggtcctggatctcttcgatgtggatggtgccgccggacggcatgcggcgcttgaaggtggcggtgacctgctcggtcaggcggcgcacggtgtcatggatacgcgacgaggcggcggcggtgccgccttccacggcgaggaacgccttggtgatggccacggtgatcttgtcatcggtgtaggggactacggtgccgttgcgcttgatcacgcgtag

SEQ ID NO: 3092 - DNA, 945 bp, Pseudomonas aeruginosa
gtcctaggaagcgtccgtaggccgcggcagcgctggagaatgccattcgtcgccctcggaaagcaccggcgcagacctactccccaacctttcggggcgcgcaccctacccacaatatgtagtgtttgcaagatgttcctcgcgtgctgccgcgcggcccccgtattggctacaatgcgggccgctctgagggggccgcacggcggctccgggaccgcgatacgaggaggctgtgtggagcaagaagcctggcgcatcctgatcgtcgaggacgatcgacgcctggccgagctgacccgggaatacctggaaggcaacggcctgaaggtcgacatcgaagccaacggcgcactggcggcggcgcgtatcctcgccgaacgcccggacctggtggtgctcgacctgatgctgccgggcgaggacggcctgtccatctgccgccaggtgcgcccgcagttcgacggtccgatcctgatgctcaccgcgcgcaccgacgatatggacgaggtactcggcctggagatgggcgccgacgactacgtgtgcaagccggtgcgcccgcgtgtgctgctggcgcgcatccgtgccctgttgcggcgcagcgaggcgccggaagcgggcgccccggcggcggacagcaaacgcctggcgttcggtcgcctggtgatcgacaacgcgatgcgcgaggcctggctggacgggaccaccatcgagctgaccagcgccgaattcgacctgctctggctgctggcggcgaacgccgggcggattctctcccgcgaggagatcttcaacgccctgcgcggcatcgagtacgacggccaggaccgctccatcgacgtgcgcatctcgcggatccgcccgaagatcggcgacgacccgatgcacccgcggctgatcaagaccgtgcgcagcaagggctacctgttcgtcggcgagggctga

SEQ ID NO: 3093 - DNA, 351 bp, Pseudomonas aeruginosa
tggaacgccattcgaaatgcccgctccaacggcattttgccggggtcggataacaagaacagcgttgcgcagccgaaccgtcgaagtcttcccggattgggaaggccacttataaaaaattgcaagttggagagtgtggtaatggctgatcgtgaggtcggaaccgtcaagtggttcaatgacgccaaaggttatggattcattcaacgcgatagcggtccggacgtgttcgttcactaccgcgccatccgcggcgagggtcaccgctccctggtggaaggccagaaagtggaattctcggtgatccagggccagaaaggcctgcaagcggaagacgtctccaaggtctga

SEQ ID NO: 3094 - DNA, 423 bp, Pseudomonas aeruginosa
ggaaggcgatggcacccttgtgctccgggtggtcggcgacgaagcgctcgacggcgacgatcatcgacgccaggctgcctttcatgtccgccgcgccgcgcccgcagaagcatgccctggtcgtcgatcagggcgtcgaagggttggtgctgccaggcctgcagcgggccggtggggaccacgtcggtgtgcccggcgaagcacagcaccgggccgtcgccgccgcgccgtgcccagaagttgtccacctcctcgatgcgcatcggctccagggcgaagccggcggcttccaggcggcgcatcatcagggcctggcagtcggcgtcgaggggcgtgacggaggggcggcggatcaactcgcaggcgagttcgagggtcggcgagagactcggcgaagaggcggtcatggggagtgcatcctga

SEQ ID NO: 3095 - DNA, 855 bp, Pseudomonas aeruginosa
tgcgcgcggcaatccgcgattcggtttcagaggtggttggtgatgcaggtggatgaacagcgcttcggcggtatcggccggttgtacggtcgcgaggggctgcaacgcctggccgatagccacgtcgcggtggtcggcatcggcggggtcggttcctgggcggcggaagcgctggcccgcagcggcgtcggcgagatttccctgttcgacctcgacgatgtctgcgtgaccaacaccaaccgccaggtgcatgccatcgaaggctcggtgggcaaggccaaggtcgaggtgatggcggcgcgcatccgggccatcaacccggcctgccgggtccacgcggtggccgatttcgtcacccgcgagaccatggccgagtacatcgtcgacttcgactacctgatcgactgcatcgatagcgtggccgccaaggccgcgctgatcgcctggtgcaagcggcgcaagatcccggtgatcaccaccggcggcgccggtggccaggtcgacccgacgcagatccaggtcgccgacctgaacaagaccttcaacgacccgctggcggccaaggtgcgttccaccctgcgccgcgactacaacttctcgcgcacgccggggcgcacctacagcgtgccctgcgtgttctccagcgaacaactgcgctacccgaagccggacggcacggtgtgccagtcgaagagtttcgtcggcgaaggggtgaagctggactgcgccggcggcttcggcgcggtgatgatggtcaccgccaccttcggcatggtcgccgccgcccgcgccgtcgagcgcctggcggacggccgcgcgctgcggccgtcgcggcgcacgccggggaacgcctga

SEQ ID NO: 3096 - DNA, 684 bp, Pseudomonas aeruginosa
gacaccgtctggatgcctgacctgagtacctggaacctgaccattccccagggccgcccggccatcaccatctccaccagccaattgcagcgcgactaccgcagcgactatttccagcgcaccgccgacggcattcgcttctgggtgccggtgaacggcagccacacgcgcaacagcgagttcccgcgcagcgagttgcgcgagaccctgtccagcggcaggccctacaactggcgttacgccagggccgacaactggctggaggcgaccctgcgcatcgaggcggtgccctcgacccggcgcatgatcatcggccagatccacagcgatggcagcaatagcggccaggccgcgccgctggtgaagctgctctaccagttgcggctcgaccaggggcgggtccaggcgctggtccgcgagcggccggacgacggcgggaccagagcctacacactgatggacgggattcctctcggccagccgttcagctaccgcatcggcgtgtctcgcagcggattgctcagcgtgtcggtgaatggtagcgccctggagcagcaactggacccgcagtgggcctaccagggcctttatttcaaggccggactctacctgcaggacaaccgcggaccgtccagcgagggcgggcgggcgacattcagcgagctgcgcgttagccatcaatga

SEQ ID NO: 3097 - DNA, 2079 bp, Pseudomonas aeruginosa
tgcattgatggagtcgatgatatgaaacgcaggagtgtgctcttgtcgggtgtcgccctgagtggaaccgcactggccaatgactcgatattcttttcacccttgaaatacctcggggcggaacaacagcgatctgtcgatgcctcgcgaagtttgctggacaacctgattccgccgagtttgccgcaatatgacaacctggccggaaagttggcgcggcgtgcggtattgaccagcaagaaactggtatatgtctggaccgagaacttcgctaatgtcaaaggcgtgccgatggcccgctcggtgccgctgggcgagttgccgaatgtcgactggctgttgaagaccgccggggtgatcgtcgagctgatcgtcaatttcgtcgcctcgttgccggcgtcggccgcagcgcagttcgagcggatcgccaccgggctcagcggtgacctggaggcggcgcgccaggtccacgaggcgttgctggaggaggcgaagaacgatccggccgcggccggcagcctgctgctgcgcttcacggagttgcagacgcgggtgatcgccttactgacgcgggtcggcctgctggtcgacgatattctcaagagcgccagcaacctggttacccagggggggcagggcgacggcctgaatcgcttccgcgcggtgttcggcaccctgcgcctgccggaggtcgccgacagcttccgtgacgacgaagcgttcgcctactggcgggtggccgggcctaatccgctgctgatccgtcgcgtcgatgcgctgccggccaactttccgctgggcgaggagcagttccgccgggtgatgggcgccgacgacagcttgctggaggccgccgccagccgccgcctgtatctgctggactacgccgagctgggcaagctggcgccgtcgggagcggtggacaaactgctcaccgggacgggcttcgcctatgcgccgatcgccctgttcgcccttggcaaggatcgggcgaggctattgccggtggccatccagtgtggtcaggaccccgctacccatccgatgttcgtgcgtcccgccgagtcggagagtgatctgtactggggttggcagatggccaagacggtggtccaggtcgccgaggagaactaccacgagatgttcgtccacctggcccagacccacctggtgagcgaggcgttctgcctggccacccagcgcaccctggcgcccagccatccgctgcacgtcctgctcgccccgcacttcgagggcaccctgttcatcaacgagggggcggcgcggatcctgttgcccagcgcgggcttcatcgacgtgatgttcgccgcgccgatccaggacacccaggccaccgccggcggcaatcggctgggtttcgacttctaccgcggcatgttgccggagagcctgaaggcgcggaacgtcgacgacccgctggcgctaccggactacccctatcgcgacgacggcctgctggtatggaatgccatccgccagtgggcggccgactacgtggcggtgtactacgccagcgacggcgacgtcaccgctgacgtcgaactggcggcctgggtcggcgaagtgatcggcagcggcaaggtggccgggttccgcccgatcaccggtcgcagccaactggtcgaggtgctgaccatggtgatcttcactgcctccgcgcagcatgcggcggtcaattttccccagccttcgatgatgacctacgcaccagccatctgtgccatgagcgcggcgccggcaccggactcgccaggcggcaagagcgaggccgattggttgaagatgatgccgccgaccctggtggcgctggagaaggtgaacatctatcacctgctcggttcggtctaccacggtcgcctgggcgactaccggcagaccgggttcccctacgcgccggtgttttcggacaggcgggtgaccgccagcggcggcccgctggagcgcttccaggcacgcctgaaggaggtcgaggcgaccattcgcacgcgcaaccaggcgcgccgcaggccctacgagtacctgttgccgagccggatcccggcgagcaccaatatctga

SEQ ID NO: 3098 - DNA, 561 bp, Pseudomonas aeruginosa
gctggcgcgcatcctccgggtgcatgtagaccagcgcgtcgggcaccgccttgtacagctccgggacccgcgcggtcatgctcccggtgtgccagtgttcgagcacccggccggtggcgagccagaacgggtagtcctggtccggcgcctcggccggcggctcgtagggcagggcgaagacgatcgccttcttgtccggatagccatagaactgcacgccgctgcccttgctcacgtaggggtcgtagccctcgcggtagcgccagcgggtctccttgccgtccaccaccggccagcgcaggccgcgcgcctcgtggtaggcgtcgaagggggcgaggtcgtggccgtggccgcgaccgaaggcggcgtattcctcgaacagacccttctggatatagaagccgaatgcgtcgacctcgtcgttggcgtagcccttggccaggtcgctggccgggaagcggtcgacctggccgttgcggaacagcacgtcgtagagggtcttgcccttcagctcgggggccttcgccagcagttccgcgggccagacttcgtcggtggtga

SEQ ID NO: 3099 - DNA, 1542 bp, Pseudomonas aeruginosa
cgcgcgcagttggatggcctggctcggacagggcgccaggcaggcgccgcagccgttgcagcgctggctgtccagctcggccagggcgacgccgccgggggccgggcggaagcggatcgcggcgggttcgcaggcgtcctggcaactgcggcagtggatcccggccagggccaggcaggcttcgccgatcgtggcgatccaggggaaggccgggcgcgcgccatcgaacaggccggcctcgcagcggctggcgcattccccgcacagcgtgcagccggcgctggagaggtcgagttcgacgagccgaccggcgccgagcttcagcacgccttccgggcaggcctcgacgcaggcggcgcagcctgtgcagcctgcggcgaagtcggcggcggtccacggcgggcgacgcgtcggcgggtgcccgccgaggcggcggaacagctctcggcgactgctcatacccgacctcaggccggcggcccgggcgggccggccagtagctggtacatccagacgcagaaaccgaagccgccgaccagtgcgacggacagcagcgggaacaggcagatcacgagaaacaggaagagcctggcttccatgcccttgacgcgtccctggtcgggttgttcgttcattggcccagcctctatgcaggcgactgtagaaagcctagaccctacttgcagtacgggcaaaaacctcgccgagccggcgcgcggcagcctggaaacagaacgttcgccggcaaacgcgagtcgttcagcccgggttcagcaagcgttcaggggcggttcagtaccctgtccgtactctgcaagccgtgaacgacacgactctcgcagaacggagaaagaccatgaaagcactcaagactctcttcatcgccaccgccctgctgggttccgccgccggcgtccaggccgccgacaacttcgtcggcctgacctggggcgagaccagcaacaacatccagaaatccaagtcgctgaaccgcaacctgaacagcccgaacctcgacaaggtgatcgacaacaccggcacctggggcatccgcgccggccagcagttcgagcagggccgctactacgcgacctacgagaacatctccgacaccagcagcggcaacaagctgcgccagcagaacctgctcggcagctacgacgccttcctgccgatcggcgacaacaacaccaagctgttcggcggtgccaccctcggcctggtcaagctggaacaggacggcaagggcttcaagcgcgacagcgatgtcggctacgctgccgggctgcaggccggtatcctgcaggagctgagcaagaatgcctcgatcgaaggcggctatcgttatctgcgcaccaacgccagcaccgagatgaccccgcatggcggcaacaagctgggctccctggacctgcacagcagctcgcaattctacctgggcgccaactacaagttctaaatgaccgcgcagcgcccgcgagggcatgcttcgatggccgggccggaaggtccggccgcatctcatccggaggaacctcatga

SEQ ID NO: 3100 - DNA, 1575 bp, Pseudomonas aeruginosa
tggaacagctctaccccgacgacgaggagcgcgacgccaacgtcatcgaggtgctggtcggccgcctgcggcgcaagctggaggcctgcggcggcttcaagccgatcgatacggtgcgcggccagggctacctgttcaccgagcgctgccggtgatccgttccctgcgcatccgtctgatgctcggcgccgccgccctggcggtgctgttcatgctggcgctgctgccggccctgcagcgggccttcggcatagccctggagaacaccatcgagcagcgcctggccgccgacgtggcgaccctggtctcggcggcgcgggtggagaagggccgcctggtgatgcccgagcacctgccggtggaggagttcaacctgccggaggccaaggtcctcggctatatctacgaccagaatggcgatctgctctggcgctccacctcggcggccgacgagtcgatcaactacacgccgcgctacgacggccgcggcaacgaattccacaccacccgcgatgcgaagggcgaggagttcttcgtgttcgacgtcgagatcgacctgctgcgcggcaagcaggcggcctacagcatcgtcaccatgcaatcggtcagcgagttcgagagcctgctcaaggggttccgcgagcagctctacctgtggctcggcggcgccctgctggtcttgctcgggctgctctggctgggtctgacctggggcttccgggcgatgcgcgggttgagttccgagctggaccagatcgaatccggcgagcgcgagagcctgagcgaggagcatccgcgcgagctgctgcgcctgacccactcgctgaaccgcctgttgcgcagcgagcacaagcagcgcgagcgctaccgccactccctcggcgacctggcgcacagtctgaagacgccgctggcggtcttgcagggggtcggcgaccagctcgccgaggagcccggcaaccgcgagcaggtgcgggtgctacagggccagatcgagcgcatgagccagcagataggctatcagttgcagcgcgccagcctgcgcaagagcggcctggtacgccatcgcgagcaactggcgccgctggtggagaccctgtgcgacgcgctggacaaggtctatcgcgacaagcgggtaagcctgcagcgggacttctcgccgtccttcagcgtgccggtggagcgcggcgcgctgctggaactgctcggcaacctgctggagaacgcctatcgcctgtgcctgggccgggtccgcgtgggcgcccggctggggccgggttactcggagctgtgggtcgaggacgacggtcccggagtgcctgccgaacagcgcgcacgaatcatccgccgcggcgagcgcgccgatacccagcacccggggcagggcatcggcctggccgtggcgctggacatcatcgagagctacgacggcgaactgagcctggacgattccgagctgggcggcgcctgcttccgcatacgtttcgctacagtctgagacttggcggccgttacctacgtctgaggtgtttccgcgctacgctgaagtctgttcggctggcgcagttcctttga

SEQ ID NO: 3101 - DNA, 3387 bp, Pseudomonas aeruginosa
cgcaggtaccggggattcgagcggatgttcagtggcaaaaccgacgacaggggcttgtgggcgggcatccaggccggtgtgctgttctttctcgccgccctggcctgcatctacctgtcgcgccagcccgccaccatcgcggcgatctggctgcccaacgcgatcctcaccgccgccctgctgcgcgcgccgctgcgccagtggccggcgatcctgctctgctccgccgtggccaacctggcggccaaccgcctgtatggcgacagcctgtggatgagcgcggcgttcctgccggccaacctgagcgaagcgatcttcgccgcgatgctgttacgcatcaaccgggtgcgcgaggacttcgaattcaacctgcattcggcggttcgcgtgctctgggccggcgcgctgattccgcccttgctcggcgcctcggtgggcgcggtgctggtcagcgtcttcggcatggggcgtttcccggaaatgtgggcgcgctggtacgtgggcgatgcgatgggcatgctcgcgctgctgccgttatgcatggccagcaacctggcggcctggcgtcacgctctgtcggggcgggcgggagtggacaacgcgatgctcctgctggtgaccctggtgatcagcttcgtggccctgacgcgcctgccctacgccttcatctacgtgctcctgccgctgctggtggccgccgccagcaccagcgtgttcggcaccgcgctgatcggttgcctgaacacctgtttcatcgccgtgctgatcgccctcggcgtgttcctccccgagtcgtcccagcagcgtttcggcgagccgctgctgtacctgccgatggccttgaccctcattcccgccttcctggtctcggtgatcatggagcgcagccgccgcgagcagcatcaggtggccatcggcgaggcgcagttccgcggcgccatggaattctcggcgatcggcatggccctggtgtcgctggaggggcggctgttcaaggtcaacgaggcgctgtgccggatgctcggctattccgccgaacgcctgggcgagcagtcgttccaggagatcacctatgtggacgacctggaactggacctcgacctggtgcgcgacctgctcgccgggcgtatcaactcctaccagatggagaagcgctacctgcgccaggacggcgaaaccttctgggcgcgcatcagcgtgtcgctggtgcgcgacgaggagggagtcgcccagtacttcgtcacccaggtggaggatatcgacagtcgcaagcgtgccgagctggagcgcgagcgcctcgccgaacggatcaagctggccaccgacgccgggcagatcggcatctgggagtgggacctggcgcgcaaccgcctgcactgggatttccgcatgttcgacctgtacggcatccgcagcggtcccggggagaccgccgtggagcagtggaaggcgagcctgcatgccgaggatcacgaccgcgtgctgcgcgagctggagcgcgccgtcagcgggttgcagaaattcgactgcgagttccgtatcgtccgccccaaccgcgaggttcgccacctgcgggcgatcgccacgctgacgcgcgacgaggacaaccgtccggtgcggatgatcggcatcaacagcgacatcaccgagatccgcaccctggcggaaaccctgcacgaggaaaaggaacgcctgcaggtgaccctgtattccataggcgatgccgtgttgaccaccgacgccggcggccgcgtgaccttcatgaacccggtggccgaggcgatgaccggctggaccttgcaggacgccatcggcgcgccccacgaactggtcttcaacgtgctcgacagcgacaccggcgaggccctggaaagcccggtgcgacgctgcctgcagaacacccgggtgttctacctggaggacggcgccacgctgatcagccgcaagggcgagcagcacgatatccagaattgcgcggcgccggtgcgcacccgcgatggcgagatcatcggcaccgtgctggtgttccagaacgtcaccaaggcccgggcgatgcagcgcgagctgagctatcacgcctcccacgatgccctcaccgggctgttcaaccgcaccaagttcgaggaggagctgcaacgcgccctggccaacgcccaggagcgggcgacccagcatgcgctgtgcttcatcgacctcgaccgcttcaaggtggtcaacgattccgccgggcacgcggcgggcgacatgctgctgcgcgagctgagccggattctcgccgaccgcacccgcgcctccgacaccctggcgcggctgggcggcgatgagttcggcctgctgctgttcgattgcgacctggcggaggcggagcaggtggcgagcaagctcatcgagcagatctgctcggtgcgcttcccctgggaagggcggctctacgacgtgggcgcgagcatcggtatcaccgcccttaccgccacctcgcgcagcaccagcgaactgatgagccaggccgacgtggcctgctacgcggccaagcatgccgggcgcaaccgggtttcggtgtaccagttcggccatgaggaagtggagcgccagcaccgcgacatactcctcgccagcgggctgcgcgaggccctggagaacgaccgcttccagttgcaggcgcaggagatcgtcccggtcggcccccgccgcgacggcgaccggcactacgagctgctgctgcgactgtacgatccggatggccagatgactccgccgggcgccttcatcccggccgccgagcgcttcaacctgatggccagcatcgaccgctgggtgatcaacgaggcgctgatcaacttcggcgcgcggatcgccgcggtggagggcctgagcatcggcatcaacctgtccggcaactcgctcaacgacccgctgttcctgccttacctgctggatcgcatcgaacactcgccgctgaggccggagcgcctgtacttcgagctgaccgagacggcgttgatgaaccagttgtcggtggcttcgcggatcgtcgccaagctgcgcgacctcggctgcaaggtggcgctggacgacttcggctccggcctgagttccttcaattacctgaagaatttcgtcgtcgacgtgatcaagatcgacggcagcttcgtccgcaacctggacaagagcccggtggaccaggccatcgtcgactccatcaaccagatcgcccaccgcctgggcgcggtgactgtggccgagttcgtcgagagccgggaaatcctcgatcacctggcgcgcctcggggtggatttcgcccagggctacgcggtcgggcggccgcagccgttcgccacggtgctcgaccaactgcgcagcgggcttcgtcgccaggagttgggctga

SEQ ID NO: 3102 - DNA, 702 bp, Pseudomonas aeruginosa
tggtttccaagtggtgcaagcagctcgacgagggcaccttgcagcgcgaactggccggcgagggcaacgcttcgtcgcctgccagcgatattccggtgggcggccgcgaagcggtctaagctcaaacctgttcggcagggggaagtgaagagctccctgccgcccttcgaacccgccctcgtggcgggtttttttatgcctcggcggcggcctgctcgcgcagccaggcgaggaacagcgagaggggcgctcgttgcgccgctcctggcaggctcaccgcgtaataggcgaagcggctcggccagggccgctcgagggcgaccgccaggcggccgctggcgatctcggcgcgggcatggatctcccgtaccagcgcgataccctggccggcctcggcggcgcgaaccagcagcaggtcgtcggcgaaagccggacctctctcgctgcgcgggtcgtcctccacccccatcgcccgcagccacatgcgccagtcattgcgctccgactcctgcaacagcgggtatgccaggcaatcgatcgcttcgcggatctcagggccttccgccagcaggcgcgggctggccaccgggatcagcggcggggccatcagcgcctgcacgtcgagtccggggtagtcgccgagcccgtggcggatggcgacgtcgattcgttcccggcgcaggtcggcgagcagtgccgtag

SEQ ID NO: 3103 - DNA, 1185 bp, Pseudomonas aeruginosa
gcaatactccatcgccgatatcgccaccttcggctggacccatacggcgcggatcgtcgacttcgacttcagccattatcgccacctggacgactggcaccggcgcatggccctgcggcctgcggtgcagcgcgggatcctcctgccggaaccggcggtgggtccatgagcgccctgctgcaaggcgcctcggcgccggccttcgtcgggcaccctggctatcggcgcatgttcgccgcagacgcgctgaccctgggcctgttcctgccgttgcgtttctaccagggcgacatgcgggtgctgctgggccaggcgcggttggtcgaagaaatcgatcgactgggattcgccgccgtctgggtacgcgacgtaccgctgttcgacccacgcttcggcgatgccggacaagtgttcgacccgttcacctaccttggctatctggccgcgcggacccgccgtatcgccctggccaccggcagcgcggtgcttgccctgcgccaaccggtcgacctggccaaggccgcggcgagcgtcgaccggttgtccggcggacgcctggtgctgggcctcgcctccggcgaccggccggtggagttccccgcctacgggttggagcatgcgcagcgcggcgagcggttcgcccagggcctggactacctgcgccaactgctgcacggctgccggcacgtcgcctcgccgctcggtacgctggacgacgccgaactgttgccgcgtccgccggccggcgccatcccgctggtcgtcaccggctccgcgcggcagccggcggactggctggcacgccaggcggatggctggctgacctatccggagtcgactgtcgatgcgtccgggccacgtcgcctggccgggaagatccgcgcctggaggatgtccatcgcggacggcgggttccgcccgcacatgaccaacgaatggctggacctggtggacgacccggcgtatccgcgtacgccgttgcacggcggctacgtcctgcgcaccgggcgcaacggcctgatcgagctgctcggcgaatggcgtgcggcgggcgtcaaccatgccgccctgggcatccagttctccgccaggccggcagcggaagtcatccaggaactggccgaggaggtgctgccgctgttcccgtcccacccgggcgtgcagccggcgagcatggactggtag

SEQ ID NO: 3104 - DNA, 1233 bp, Pseudomonas aeruginosa
  unsure (426): Identity of nucleotide at the above locations are unknown.
gctgctcggcaggcgatcccgaccaatgcccggcgacccagaggagggagcatgaaaggcccgttgtcatcgttgaaagtgctggatttctcgaccctgttgccggggccgttcgcctcgctgctgctggccgacatgggggcggacgtgctgcgcgtggagtcgcccgggcgcatggacctggtgcgggtgctgccgccgcacgtcgacggcacctcggccagtcatgcctacctgaaccgcaacaagcgttccatcggcctcgacctgaagcggcagggcgcacgcgaggtggtgctggagctggtacgcgaatacgacatcgtcctcgaacagttccgtccgggggtgatggacaagctcggcgtcggctacgaggcgctgaaggcggcgaacccgcggctgatctacgtggccatcaccggntacggccagaccgggccgtaccgcgagcgcgccgggcatgacatcaactacctggcgttggccggcgtcgccagctacaccgggcgccgcgaacgtggcccgttgccgctgggggtacaactggcggacctcgccggcggttcgctgcatggcgtgatgggcctgctggcggcggtcatccaccggcagcagaccggcgaggggcagttcgtcgacatcagcatgaccgactgcgccttcagcctgaacggcatggccggcgccggctatctcgcggccggggtcgagccggagatggaggcgctggcgctgaacggcggcagcttctacgactactaccgcacccgcgatggccgctggttctcggtgggcagcctggaaccgcagttcatgcagcaattctgcgccgccatcggccgcccggaactggccgcccgcggcctgtcgccgaagccggaagagcagcgggcgctgaagcgcgagatcgagatggagttcgagaaacgcgacttcgccgaatggcaggcggtgttcgccgccctggatgcctgcgtggagccgctgctgccgctctccgaggcgctggaacacccgcagttgcaggcgcgcgggctggtcgcccgggtgccgctggcggacggcggcagccaggcgcagatggcctgtccgatcaagttttccgccggtctgccggcgcctcgccacatcggcgcggcgctcggtgccgacaccgtggcggtgctcgaaggcctgggctactccgccgaacggatcgccgagctgaaggcggccggggccatcgcctga

SEQ ID NO: 3105 - DNA, 924 bp, Pseudomonas aeruginosa
ggtgttcgggcattcgggaagactccagcagcgggcgattatgccggagacaggagggcgggcgcaggcgtcgggacgaccgctcgtccggggtgcaggatcaggcaagcgcggcggcgggcaagaaaaaaccgggcggcggttgcccgcggcccggtcgtacgatgcgttcgctggacgtcagctggtgtattccgggccgaccccgctgccccagaggatcaccgacagggcgatcatcgccaccagcaccaccaggcccaccgccagcaccgagctggagaacaggaagccttcgtccttgtggatgttcatgaaggtgggaatccccacgtagagcaggtagaccgtgtagctgatcgccgccaccccgacgatcattcccagccagaggtgcggatacagcgccgccagcccggcgatgaacagcggcgtggcgttgtaggcggcgaacacgatgcactgggtcaggctcgggttggcgtcgtaggtccgcgccatccagtggatgaacgcgcccatcaccgccaccccggcgagcatcgccaggtaggtgaggaccgtcatctgcaacgcgctggcctgggtcaacttgaccggatcgccgccgccgaccacccagccgacctgggtcgtgccgatataggcggaaatcgccggaatggcagccaggatcaggatgtgggtcaggtacatgtggctgatgctttcttcttcgccacggatttcctgccattcctgatcgggatgggtgaagagcccccatacatgatggatcatgccgtttcctcctcgttcttatgtggtcgccccccagcgaagcgccgggcgcgcatggacagcgccacccggtgctcggccgacctatgcgaccttatgtcgcagtataggaacggcccgagcccgcgtcgctcgcgggtttag

SEQ ID NO: 3106 - DNA, 726 bp, Pseudomonas aeruginosa
acctctgagccgcgccgcgggtcagttcttctctccggtctgcaaggattcccgatgcgcgactacgcctggatgtacgaatactgcctgaaccgcttcggctccagggaggcgctggaagcgcgcctgccgcagccgaagagcgccgccgagctgcgcgcggtgggtgacgaccgctacctgtcgctgatcagcctgcggatcttccgcgccggcctcaagcacagcctggtggacgccaagtggccggccttcgaggaagtgttcttcggcttcgatccgcagaaggtcgtgctcatgagcgccgagcatctcgagcggctgatgcaggacgcccgcctgatccgccacctgggcaagctcaagagcgtgccgcgcaatgcgcagatggtgctcgacctggcccgcgagcatggcagcttcggcaacttcctcgcggattggccggaaaccgacatcgtcggcctgtggaagctgctgagcaagcgcggcaaccagctcggcggcttgtcggcgccgcgtttcctgcggatggccggcaaggacaccttcattcccagcgacgacatggtcgccgcgctgaaggcccaggagatcatcgacaaaccgcccaccagcctcaaggacctggctgccgtgcaggccgccttcaaccagtggcgcgaggagagcggccggccgctgtgccagctgtcggtgatgctggcacatacggtcaatcattga

SEQ ID NO: 3107 - DNA, 1437 bp, Pseudomonas aeruginosa
cgagatttcgacatccgggaaaccgagggggagagcatggcgcttgtcgaggagccgacgatttccacgcgaagcggtgaactggcctggttggtggactgcctggcgccgattttcgacggcctgcggcaaccggtcacggtggtcgacccctccggtcgcttcgtctactacaaccgtgccagcggcctgctcgatggtctcgacccgcagcgggcgttgggtatgcacctgttgcagagcgctccctggctggcggccgagcaaagcacgctgttgcgttgcctggccgaagggcggccgtcgatcgatacgctgcaggcctacgtgggggccggcggcgagctgttgcagtatcgccaccgggcgatcccgctgcgcgggcgcgacggttgcctgctcggcgcgatggagctcggcgaagtcgtcgccgagaccgaagaggccgcaggcctggcggattgcccgaacatcctgagcgtggcgccgagcctgctgcggcagttgcagcgcctggacgttttcgccgccaccgacctgccgctgctgatccatggcgagaccggcaccggcaaggaactgttcgcccgtcgcgcccatgccctgagcccgcgacgcagcggtccgatgatcagcctgaactgcgcagcgattcccgagacgctgctggaaagtaccctgttcggcaccacacgcggcgctttcaccggcgccgagaaccgcaagggcatgttcgccctggcgcagggcggcagcttgttcctcgacgagatcaattccatgccgatggccatgcagagcaagctgctgcgggtcctgcaggacggcagctacctgcctctgggcagcctgagcccgcagcgggccgatgtgcgcctgatcgcggcgagcaaccagccgccgcgccaggcgatcgccgagggacgcctgcgcgaggacctgtactaccgtctggacgtgggcagcctgtgcatcccgccgctgcgcgagcgccccggcgatgtggaactgctggcacgggcgttcgtccgtcgcgatgcgcgcagcctcaacccgcgtgtcaccgctcttggcgagcgggcgctggcgcagttgctggcctgcgactggccgggcaacgtccggcaactggaaaacgtgatccggcgcagcctgttgctgcacggggagggcggcgcactgctggatgaggtggcgttcgccgacgacggcgccgaggccgtgggcggcgaggccgcgctctcgatgaacagcgcggcggtcggaggcctgcgcgaggcgctggcgcaacaggagcgcaacctgatagaagacgccttgcgccaggcgcgcggcaatctctcccgggccgccgcccggttgcggattccgcgcacgaccctgctcgggcgcatgcgccggctcggcttgccggcttccctcgatccgccagcctga

SEQ ID NO: 3108 - DNA, 786 bp, Pseudomonas aeruginosa
caggagccaaccatggacagccacagcccgatcgctaccgtcgcccaggccctgcggcgcgccgaacgcatcctggtcatcaccggcgccggcctctccgcggactccggtatgcccacctatcgcggcctcggcggtctctacaacggtcgcacggaagagggcctgccgatcgaggcggcactttccggaccgatgctgcggcgcgatccggcgctgtgctggaagtacctcgcggaacttggcaaggcttgcctggcggcccgacccaacgccggccacgaagccatcgccgagttgcagaagcacaagccggaatgttgggtgctgacccagaacatcgacggcttccatcgccaggccggctcgccggcccgagcggctgatcgagatccatggcgaactggcgccgctctactgccagtccctgcggtgccgagagcggcggcctggaggagcatctgcacggccagttgccgccgcgttggcgccgcttgcggtggggtgctgcggccgccggtggtgctgttcgaggaaatgttgccggaagaggcgatcgataccctgtaccgcgaattgcgcaaaggcttcgatgcggtgctggtggtgggaaccaccgcgagcttcccctatatcgtcgaaccggtgctgcgcacgcggcaggcgggaggcttcaccgcggaggtgaatcctggcgtgaccgacctcagcgagcgggtcgatgtgaaaatgacaggacgagccttagacatcatgccgcaggtggtaagtcacatttatcgataa

SEQ ID NO: 3109 - DNA, 597 bp, Pseudomonas aeruginosa
gtattgcgtttaactccttgtcgtagcaaagtggaagcattcctcaccaggaaggcttccactatgcatgcactggcccgattctcgatcctcgcctttgctgcgctgcttaccgcctgcgccagcaaagcgccgccccccgcgcccgccaaacaggtcgtattccgtccggcgacgaatttctcgcccgccgccgacgatgtgctgttccgtgccctcggcctggtcggcacgccctaccgctggggcggcaacacgcccgattcgggcttcgattgcagcggcctgatcaacttcgtctaccgcgacatgaccggcatcaagctgccgcgctcgacccgcgagatgatttccatgcgcgcgcccagcgtgccggtgcaggccctgcagaccggcgacctggtgttcttcgccacctccggtggtcgcaccgtgagccatgccggcatctacgtcggcgagggtcgtttcgtgcatgcgccgcgcaccggcggcacggtgcgcctggacagcctgcagaacagctactggcaacgcgcgtacctggacgccaagcgcgtgctggtcgcgccgtcgccgttggcgcgggtgccctga

SEQ ID NO: 3110 - DNA, 426 bp, Pseudomonas aeruginosa
tgggcggcgtgcgctcccgagaccgcccatgcttgcctcccaggaggcgcttcgtttcacaccgcgcggcgacggacgccgcccgagaccggagaaacaccatgtccttcacctacaagcgactcgacaagaacgatgcggcggtgctgttcgtcgaccaccaggcaggcctgctctccctggtccgcgatttcagcccggacgagttcaagaacaatgtcctggcattggccgacatcgccaggttcttcaacctgccgaccatcctcaccaccagcttcgaggatggccccaacggcccgctggtgccggaactcaaggaaatgtttccgcaggccccgtacatcgcccgccccggcaacatcaacgcctgggacaacgaggacttcgtcaaggcggtcaaggccaccggcaagaagcaactga

SEQ ID NO: 3111 - DNA, 2136 bp, Pseudomonas aeruginosa
tccagagcttcggcacgaagaagtaagccggcttcgccgctgtcccggacacaaggcactccgaccatcgggtgccttgtgtcgttttccgtccaggtgttttcatcggaacgccgcttcgccggaacccgaggttccggcacgcccccccatgcacaggagaaaccccatggctacccaggtcgtcaacgcttccctcggcaccaccccttatcgcgtgaccctcggcgacgacagccaccagtggctgagcgacgtgccggccgccctcggcggcgccgacagcggtccctcgccgcacgagatcctgctctcggcgctgggcgcctgcacggcgatcaccgtggcgatgtacgcgcagcgcaaggagtggccgctggagggtatcgacgtgcaactgaacatcgtcgaggaacgcaccaagccggagcccttcacccatatccgccgcgacatccgcctggccggcgatctcgacgccgagcagcgccagcgtctgctggagatcgccaatgcctgcccgatccatcgtgtactctccggagaggtcagcgtcagcagccagctacgcgactgaacccgcacgcacaacgaggagcacggcatgagcgacgacatcaaggtattgggcatttccggcagcctgcgcagcggctcctacaacagcgcggcgctgcaggaggcgattggcctggtcccgccgggcatgagcatcgagctggcggacatctccggcatcccgctatacaacgaggacgtctacgccctcggcttcccgcccgcggtggaacgcttccgcgagcagatccgcgcggcggacgcgctgctgttcgccaccccggaatacaactattcgatggccggggtgctgaagaatgccatcgactgggcctcgcggccgccggagcagccgttctccggcaagccggcggcgatcctcggtgccagcgccgggcgtttcggcaccgcgcgggcgcagtatcacttgcgccagacgctggtgttcctcgacgttcatccgctgaacaagccggaagtgatgatctccagcgcgcagaacgccttcgacgcccagggccggctgctcgacgacaaggcgcgcgagctgatccagcagcagttgcaggccctgcagctatgggtgcgccgcctgcgcggttgaatgcctcgtcaccggagagcctgaacatgagcaataccgaagagcgttgcgacctgtcctcctcgcgggactgtccggaacgccacgaacacctgctgcaacgggtcaccgcgcgtgccgcggaaatcggcggcgggatcaccgtcagtcggctgatgccgtcgcgccagcggcggatgatcggtgcctggtgcttcctcgaccatgccggtcccgccgaattcgaacccggcggcggcctggccgtgggcccgcacccgcacatcggcctgcagaccttcacctggatgatccagggcgaggcgttgcaccgcgacagcctgggcaacgtccaggtgatccgtccgggccaggtcaacctgatgaccgccggccatggcatcgcccacaccgaggagtcgctgcccgacgagcgccacgcccacgccgcgcagttgtggatcgcgctgccctacgagcagcgcgacatcgccccggccttcgaccatcatcccgacctgccgcgctggcaggagcagggggtcaccttcaccctgttggccggcgctctggacgggcggcaggcgccgtgccggctttactcgccgctgctcggcgccgacctggcctgcgacgatgcctcgaccctgcaactggcgctcgacccgcacttcgagtacggcctgctgccgctggaaggcgggttggaagtgggcggcgagcatttcgcggtgaacgaactggcctacctgggcgacggccgcgacggcctgcaactgcaactcgaccctggcgcgcgggtgctattgctgggtggcgcaccgttcggcgcggagatcttcatgtggtggaacttcgtcggccacagcaagggtgagatcgcccgggcgcaaaaggcctgggaggagggggatgctcgcttcggccggctcgacgccctggaagggccgcgcttgagcgctccgccgattccctggaagatcgacgccgagtga

SEQ ID NO: 3112 - DNA, 633 bp, Pseudomonas aeruginosa
ggtcgatgtgccgccgggggccccggcggcgtcctcgaatgcctgtcggcgatcgttgcggacctgcggtctggcgattcgccggcagcgggaaaactttctgcacccatcgccggtcagaactcgcctatcgcatgcaccgaacaggaagtgagccacatgcaattcgaacacctggtccaggtcaacgaccggacgcttgtcgacctgccggtcctcgaccggctgcaactctgggaaggcctggtctgccgtgcgcgcgagccacagtatttcgtcgtcggcctggagcgtttcgagatcctcgtcgatgacggcgaccgcctgcaccggcgcctgtacctgccgggtctggtggtcgaggacgaagtcgtgctgaaggcgccggacagtgcccactacagcatcaagccgagcgccgaggtggccggcggcagcctcgacatgaccatcgaggagccggagcccggctcgctgttcgtgcgtttcgcctactgcacccgctacctgcagccgctgggcgacgaactgccctacgacgccttcgtcaagcaggcctatatcgccatggatgtggagaccatcgccaccatccgcgaccggttcggcgccagcgccgccagcgggagttga

SEQ ID NO: 3113 - DNA, 1632 bp, Pseudomonas aeruginosa
ttcccacgcctgggtccatactttgcggatatcgcagtacgaaggttgggatacccgcgcggcatcccctctgtagggtggagggcatcagcccagcagacggctggacgcttccgccgatcgaggaaccttatgcctgtcgaacacctggacgtactcatcgtcggcgccggattgtccggcgtcggcgccgcctaccacctgatgaagcattgccccggcaagagcttcgccctgctcgaagggcgcgcggcgatgggcggtacctgggacctgttccgctaccccggcatccgttccgactcggacatgttcaccctcggctacaacttcaagccatggagcgatcccaaggccatcgccgacggtccgtcgatccgccgctacatcgaggagaccgcacgggagaacggcatcgaccggaagatccgctaccgccaccgggtgctcagggccgactgggattccgccaatgcgcgctggaacctcgacgtgcagcgcggcgacgagcccgagccgctgcgcatgaccgcgcagttcctgctgatgtgcaccggctactaccgctacgaggccggctataccccggaattcgtcggtcgcgaggacttcgccgggcaggtcgtccatccgcagctgtggcccgaggacctcgactacagcggcaagaaggtggtggtgatcggtagcggcgcgaccgccgtgaccctggtgccgtcgctgaccgacaaggccgcccacgtcaccatgctgcagcgctcgccatcctacgtgatcaccctgccgcagaaggacgcgatctccaatttcctccgccgcttccttccggaaacctggatctaccgccaggcgcgggcgcgcaacgtggccatgcagatggtcttcttcatgctcgccaggaccttccccggcctggtccgcaaggccctgctcaagctggccagcctgcaactgggcaaacgcttcgacatgcgtcacttcagcccgcgctacaagccgtgggacgagcgggtctgcgcggtgccggacggcgacctgttcaaggtgctgcgcaagggcaaggcgtcggtggtcaccgagcacatcgaccgcttcgtcgagcggggcattcgcctgaagaccggcgaggtgctggaggcggacatcatcgtcaccgccaccggcctcgacctggtgatgttcggcggcgccgagctggcggtcgacggcaagccgttccaggtcaaccagagcatgggctatcgcggcatcatgctgcgcgacctgccaaacctggcggcggtggtcggctataccaacgccagttggacgctcaaagcggacctctccagcgaatacttctgccgcctgatcaatcacatggatgccaccggcatgcgccaggtgaccgcccgcgacagcaccggcgacgtgcgcgaggagcccttcctcaacctcgactccggctacatccagcgcgccgccgagcgcatacccaagcagggcgaccggatgccctggaagctttaccagaactacgtcctcgacctggcgctgctgcgctacggcaaggtcgaggacggctacctggtgttctcctcgccggcgccgcagcggcaagccggcggcgcggcggtgcaggccctgggctga

SEQ ID NO: 3114 - DNA, 420 bp, Pseudomonas aeruginosa
agatcacccccagcagcagcgcggaaccggcccagagtgccgagccggcggcgtcgtaggcgaggaagcggcgcaggtgggtgcgggtcatgccggccagggtggtggacaacgcactggcgccgggcaggaacttcgacatcagcagcgccctcggaccgacccgcaggtacatgttctggctctggcggatgcaactgtcctgggacagcgagaccttgcagatgctgcgcaggaggaagccgccgtagcggcgtccggccaggtaccaggcgacgtccgccagcaggcaggcgagcaccaccaccagcaggaccacgcccagcggcgcgccgacgccctgcatggccagcgcgccggcgacgatcagcgccgggtaggcggggatcggcagcccggcctgctcgcagagcacgttga

SEQ ID NO: 3115 - DNA, 792 bp, Pseudomonas aeruginosa
acgcttgatccggctgtgcgcctcgaccagctcggagaccgcgaggacgttcttcaggttgaagcggtcggcggcgaacttggtgtgcagcagggtcagcaactggaaggtgtcggtgatcccggcgcgttcgccgatcccgttgcagctcgccgagtgccactggaccccggcctggatcgccgccagggtattgcccagggccaggccgcggtcgttgtgcacgtggtactcgaagaccacgtcggggaactcgtgacgcagcagcgagagcacgtcgaaggtctcgtccggcagcaggatgccgacgctgtcggcgaagcagatgcgatcggcgccggcgtcgcgcgcggtggcgatcatgctgaccaggtcgctgaccgaggtgcgcgcggcgtcttccaccgtggcccggacccgcaggccgcgttcgcgggcgtagcggatcgcgtcgtggaacagttcgagcacctcctcgcggctcatgcccttgaacttggtttccagcgagatcgcgttgatcgaggcgaacagcccgacccacttgcgcaccggtttccagcaccgcgtcgatatcctcccggcgcgcccgggtgtgggccagcaccggcgtggaaaccgccgccaccacggcgcgtacccgctcgcgttcgtccgcggaaatccgcgggtggccgcactcgatcatatccacccccagcgccgcgatttcccgtgccagctggaccgactgcgcgctgtcgaagctgcactggcgggcctggcacccctcgcgcagggtgcagtcgatga

SEQ ID NO: 3116 - DNA, 1365 bp, Pseudomonas aeruginosa
agaccatcccgcaggaccagggcgacaggtagacgcgcaaggactgcgcggcctcatccggcatcggttggtgccgcaggcggtcgcgctcggagggggacaggcggtgccaatcgccgaccaccaccaggtgctcgcggaaccagtggtagcgcacctccgcggagagaccgacgttcatgccgcgctcctcgacagcaccagcggctgctccggcgtcgccgcccgttccagcagacgctccggcgccaggccgtggctgcgcaggagacggctgaactggtcgaggcgcgagtttgcctgcaagtcggcgagtcccaggtttgctcccgtacccgccgattgacagagggcgaccagttgcagggcgagcaacgagttgccgccgcagaggaagaaatcctggtcggcggcgccgacctcgcaacccagcaattcgctccacagctgcgcgcagccgcgttggtcgggatcgagcgcgctggcgcagcgctccagcggttcttccaggcggcgcagcagggcggcgcggtccagcttgccgtgtgccgtcaagggcaaggcctcgacccggacgcaggcatgcgggcgctgccaggtgggcagttggcggagcagggcctgcgggctggtgtcggcttttcccgtccaggcgcagagcagttgcttgacgccgttgcgctcgcggaccagcagggcgcagtcgaggatgcccggctggcggcggaagcgctgttccagggcggggaggtcgaggcgatagccgttcagcttgacctggccatcgccgcggccgatgaagcgcagccggccctgctcgtcgtagcgagcgcggtcgccggtacggtaggcacgcaggaggcggccgcgatagggcaactcgacgaagctggcgcgggtgcgcgccgcatcgttccgataaccctgcgccaggccggcgccgaaggcgacgatctccccggcccggtcgggctcggcgatctcctgtccttgctcgtcgagcaggagcaccgcggtgccggcgatggccttgccgatggggatgtcgtcttcctcgaggtcgtcgtcggtgacgacatggcagcaggtgaaggtggtgttctccgtcggtccgtagccattcaccaagtgcagtcgcggatgccgcagcagcgcccggcgcacgtgcggcaccgagaggatgtcgccgccggtgagcaactggcgaaagccgccgagacagtcccgggtcgaggttccaccagggtgttgaacagcgaggccggtgagccaaggcgctgtcggctccgcgctcgccgatcaactggcgcagtacgcccgggtcgagggggccgaggtcgttcagcacgcagcagccgccgttga

SEQ ID NO: 3117 - DNA, 1305 bp, Pseudomonas aeruginosa
cagccagagccggcccggctgcttcatgtgtccggcgagttcgccggcggcgtcgccggtgccccagaacagatcggcgcggacctcgccgacgatggccccgccggtatcctgggccgccaccggacggaccaccgcgctgccgtcgtcagggcgggtggtggacagccacatcaggctgcccagcggaatcaccttgcggtcgatggccacgctgtagccgtcggtcagcggtacgttcagcgagccgcgcggactttcgtcgctgtccgggcgcaggctgaagaacacgaagctgggattgctcgccagcagttcggagacccgctgcggattggcctcggcccagtcgcggatgcgcttcatgctgatctcttccttcggcaccaggccctgctcgaccagccagcggccgaccggcttgtacgggtggccattctggtcgccgtagccgatgcgcagttgccggccgtcttccagctggatgcgcccggaaccctggatctgcaggaactgcaggtccatcgggtcgcccagccaggcgagcaccggcgcgctggagccgttgtcgcggatcgtcgcggcgtcgtcgtagggtttcagcacccggccttccaggcgtccgcgcaggcgcttgcccttgagttccgggtagacgctttccagcgcgaccaccaccaggtcgtccggtacgccgtagaccggcaccggggttttttcgccctggctcaggctgccgtggtagaccggttcgtagtagccggtgatcaggccctggtcgccgttgctggaggaacgcaggctatagacctgcatccgctcctggaggaacgcgcgcaccgccgtcggatcggcggcgaccgtcgtggcgctcgcacagggctcgccccataccgggtccttggccagccgcgcgcaggccgagcgccaggcattgaagccggcgagcaggtcggcgtcgctggtggccggcagggcgtcccagggcacgctgttgtaggtggtgacttcggcgggtttgggcgggggctctttcttgccgtcgtcgcatgccgtcagcagggcggcgaaagggagcgcgcagagcagcaggcggcgccagggatggaacggaaacttcacgccaaggacttcctggtggtggatcgaagcccgctagcttgggcaaagcgcgacggtgcgtcaaaccgcggcgacgaccgaagcgtatcgccgcgttacaccgaggcggcgatgagttcgcgcagccagcgatgggccggatcgcggtgcgagcgctcgtgccagagcatggccaggtcgtag

SEQ ID NO: 3118 - DNA, 405 bp, Pseudomonas aeruginosa
tcggtggcggcgacgcgccaggtatgccgtgactgcgtcggatcgaacggcgcggccggcgccaccgcctgctccagggcttccagggccaggcgtaacggctcgcgcagctcctccgcccgcgccgtcgggcgcatcccgcgcgggccgggaagcagcaagggatcgtcgaagatcgcccgcagcttggccaggtgcacgctcaccgagggttgggaaaaattcaggcgttccgccgcgcgcgtcacattgtgttcggtgagcagcacgtcgagggtcaccagcaggttcaggtccagtcgccggagattaatcatccatatacctggaatttcggatattcatttcaactatatccggcgatggccgatcctgcgcccaccttttgccggagacccgccatga

SEQ ID NO: 3119 - DNA, 558 bp, Pseudomonas aeruginosa
gttacttttagtaggttatctatgtcaatgcactccccagacgacccgtcgccacgccgccgcctgtcccgcgacgagcgccagcgccagttgctcgaggtggcctggcggctggtccgcgaagaaggtaccgaggcgctgaccctcggacgcctggccgagcaggccggggtgaccaagccggtggtctatgaccacttcggcacccgcaccggcctgctggcggcgctctaccaggattacgacctgcgccagacggcgctgatggaggctgccctggaagcgagcgaggcgaccctggaggggcgcgccgacgtcatcgcccgcgcctatgtcgactgcgtgatgcaacaaggccgggagattcccggggtggtcgcggccctcgccagctcgccggagctggagcggatcaagcgcgactacgaggttctcttcatggacaagtgccgcgccgtgctggagcccttcgccggcgggggaccgctgaccgtcgccgctctgcgcgcaatgatcggcccccccgaagccctgtcgcacgcggccgccaccgaatag

SEQ ID NO: 3120 - DNA, 666 bp, Pseudomonas aeruginosa
atcgccccggaagaagcccggcgggaactgttcgaggcgatcttgcgatggtcgcgcggaatcgtcggtgaaggaaccgcgtgccctggaggaatatcgccgggcgatagtggcggcctgtccggagctggcggacgccactttcgccatcctggcctcgggctggcattccacggcggtggaggtcggagggcgctgggtgttcaagtttccgcgcggcgcggaggccgaggcggcgctgctgcgcgaggccgccgtgctacgcctggtgcgtccggcggtgagcctgccggtgccggcgccgcaggtgtttgcgggaccgccgctgttttcccgccacgagaaactgcctggcggttacctcctgggcgaggactaccggcgcctggacgaacccgcacggcaggcggtcggcgatgcgttggggcgcttctacgccgagctgcatcgactgccaccggcgcgcatgcgggcggttggagccttgccggtgcgtccctgggagtcgcctgcggcgatgcgcaggcgcgccttgccgctgctgcctgcggcctggcgcgaacgcgcggaacgcttggtgcgggaatatgccaagctgcctgccgatccgctgggttcgatcttcggcttcttcgacggccatggctggaacatggcattcgatag

SEQ ID NO: 3121 - DNA, 1278 bp, Pseudomonas aeruginosa
cctgcaggccgccctgcgggggttcgcccggctcgacggccgggcccgcgccgacgtccgcccagcggccttccatcgacattaccgcgaggccttgcgcaacggcgcgcgagcctggctggcgatgctggtcggcggcgccctgtggttcctcagcgggtgggaccaggggccgaccctgctggcggtgctcggcccctactgcacgctgctggcagcctcgccctttcccgccgagggcacgcgcaatttcattcgcggcacgctctacgtgatacctgccgcattgctctgcaaattccttctgctaccgctgatcaacggttttccattgctgctgctgtgcctcgccttcttctggtcgttcggtatccaggccaccacagtgcccaggcgggcgttgcagggaatcgcctacctgatcgccttcaacaccctggtcgccaccggcaatctcgcccgcttcgatttcggcgacttcgccaaccagtcctgcgcctgggtgctggcgctctgcatcagcctgctggtctaccgcctgctgccgaaggacctggaacggcattcggcgtcgctgctcgaccatctgcgccgcgagaccctcgccttgctgcgtcgtcgcgccggtttcgacgcgcatgcctggcaggcccgccagcagcatcgcatcgcccagttgggcgcgctgcatggcatggaacatccgcgcagcgcgctggccctgcgcctgggcttcgtatccctgcaactcggccgcgagtcgcggcgcctgtggcgcgccctggccgggctcgacccggccgccgcggatgcgcggtggatcgagcgcgcactgcgagccatcgccgtccgccatcgcgatccgccgctcgccgcgcggcacgcacgccgtgccggcgcccgcctggcggccgccggcgagtggcgcctggccgcgatcctcaccgacctcgcctggttgctccgggcctattcgcaaagcgtctcgtccgacggggcgcagcatggagaaaagacctcatgaaaacctcgttcttgctggccttgctgctgtcctgctggtcccaggtccaggcggcggacgacgacgggaaagagttgccgccgatcgagcgctacgactacggcatgccgctggacatcgagcgggtgctttccgtcacgccggtgccggccacctgtggcgtggtgccgctggtgatgctctaccgcgacagcgccggacgcctacatcgcttgcagtaccgaggccttggcgcgggctgttcgcggcactga

SEQ ID NO: 3122 - DNA, 618 bp, Pseudomonas aeruginosa
cccgcgccttccagcgcgaaaccggtctcagcttcgtccagtggctgcggcgcatgcgcctgctcgccagcctcgatgcgctggcggcagggcactcgatcctcgaggtcgcactggacctcggctacgacagccagagcgccttcagcgccatgtttcgccggaccctgggcgtttcgccgagcctctatttcggccgcggcgccgcctacggggtggccgagggcgactgagttcagtccttctggcgcagcatcagcgaggccagggcgcaggccaggagcgccacgcaggaaaggtagaaggcgtcggagtaggccatcaggtaggcctgctggcgcaccccgtggtcgagcagggccagcgcctgctgctgctccggcagttgtatccgcacctggccaccgcccaggcgctgctgcagggcgccgtcgaagatcgtcagggtctcgccgatccgctcggagtggaagcgctcgcgcagcgagaccagttgcgtcagcagcgcggtgccgatcgcgccgccgaggttgcgcagcatcgagatcagcgccgaggccgagccggcctcggccttgtccaggcccttcaccgccagtaccgagagcgcgaccatga

SEQ ID NO: 3123 - DNA, 867 bp, Pseudomonas aeruginosa
aggctggcgaggccatggggtgggggctcctgcgggagtggtcgcgtcgagaggcgctacgttagtgaggagcgcagggctgcgcaagctccgcctgcggtcgtccgcgaggacgtccgcaggccggctcgggactcgctacttcggcggattgatgcgctccaccaaagcataggcgcgttgcgtcgccggacgctggcgaatgctctcgaaccagcgctgcaggtgcgggaagtcggcgagatcctgctcctgccactggtgcgggacgatccacggatagatggccatgtcggcgatgctgtagtcgtcgccggcgacgaaggcgcggtccgccaggcgctggtcgagaacgccgtacaggcgcgcggtttccttgacgtaccggtcgatggcgtagggaatcttctccggggcgaagcggttgaaatggtggttctgccctgccatcggccccagcccgcccatctgccagaacagccactgcagggtttcctggcgcgcgcgcaggtccttggcgaggaagcgtccggtcttttccgcgagatagagcaggatggcgccggactcgaacagcgacaggggagcgccgccgtcggccggttggcgatcgacgatggcgggaatcttgttgttcggcgacaccttcaggaaatccgcctggaactggtcgccctggctgatgttgatcggatggatggcgtagggcaggccggtttcttccaggaaaagagtaatcttgtggccgttcggggtggtccagtagtacaggtcgatcatcggtgcgtctccggctcgtcgatgggctacgaacggaagactctacgccaggaacctaggttcgatgcaaaccgctgtcgcgcatga

SEQ ID NO: 3124 - DNA, 939 bp, Pseudomonas aeruginosa
cgacatgggccaggcacgctccgagccagcggctccggctccggacaccagccacctgcgcctgcaggactgaggcgggcagcggcctgcgacaagccagggcgtggggcggataaccgcgtcgcgaggccgtggcatcggggacaggcgaggggttggaggaacgcgtcggccagggggcaggcgcttgcttcagtggtcgaaatcgtcctggtagacgaacttgggcatttcccagtggaagcggatggccagcaggcggaacaggaagccgctgaacagggtgatcagcatcgcctgctcggaaggcagttccagctccacgcagatcaggtagcaccaggcgctggcgaaggacacgctggcatagagttcgcggcggaatatcaagggtacgtcgttgcacaggatgtcgcggagaatgccgccgaacaccccggtgatcaccccgctgatcgccgcgatcagcaggctgtggcccatttccaggctgacctggcagccgatcagggtgaaggccaccaggccaaccgcgtcgagtaccaggaacagcgagcgcaggtggcgcatcagcggcgcgatgaacactgtcaccagcgcggcgactgcggtcagcgccaggtattccgggtgacggacccaggtcagcgggtaatggcccaacagcatgtcgcgtaccgagccgccgcccagggcggtgacgcaggcgatcagcaccacgccgaacaggtccatgctgcgccggccggccgacagcgcgccggtcatggcttcggcggtgatggcgatgatgtagagcacggtcagcagcatggggatggggcccggatgaaaaggctgcgcattctacccgagcgctcgtcaacgcccaaaccgcgcagcctggcgcagcatctcaggcgtgcatgcgcaaccagaagcgttcctggcaggcgttga

SEQ ID NO: 3125 - DNA, 549 bp, Pseudomonas aeruginosa
ttgatgccggggtgccttcgagcatcatcgtcggcgtgcagggattgggcgaaagccagccggtcgccgacaacaagactcgcgaagggcgggccgagaatcgccgggtggaaatcctcatcaagcgcgaatgacgcaggcggcgcggagcagaacgggggcgtcgaagcccccgttttcgttcatggctggcgccgcggcgggctggcgagtatgttcccccgcacacgatgtcttggggggagttccatgaaagcgtttctcgggctgggcaagctcgtgaccctggtgttctggggcgcggtgctggtcaatctgctgcatccgttcgcctatccgctgaactggctgttgtcgatagccggcggcctgatcctgttgatccacctgatcgagattctcgtcctcggaggacgcctgaaagcgcgcgcgcatccctggctggatcgtctccaggtcttgctgttcggggtcttccacatgcttgcgttgccggcgttgagcccggccagcgagttaccgcaggacaaggaggacgatcatgcgtaa

SEQ ID NO: 3126 - DNA, 3204 bp, Pseudomonas aeruginosa
cggccgcgacctgaccttgcgcctgcaggcggtggaggtggaaagcctgctgctggacgcccgcggtggcgtcggcgctccaggctacgatggcctggacggggcttccggcaaggcctccggctgcctctggggcagcgcgctgaaaggtggcgacggccaatccggaagcgacggcggtccgggcggggcgggcggtcggattcgtctggaagtgccgggcgattttcctctggagcgcttgcaaacccgtctgcaaggcggcgtcggcggcgctggaggcaaggccggcaaaccgggtgcggcggacaacgccaccggttgctggatctactcggtggatgccggtcgtgcggggcgcagcggagaggacggcgcgaacggcaccaacggcagcgacggcagcctggacgtcgtgcgcttctgaggagaggccggcagcacggcttccggcgcatcgccggttcagaggctcgggcgtgccgctaccagggctatcagcaacaggccgaggagcaggttgaagccgacggtgcggcggatcttccccagcgcctgcccgcctgccggccagtcctgggcctgcaccgcgcggcgcagttccggcacttgcagcgcctgcacccgcaggaacagtgccagcatggcgacgtagagccccatcattacctgtacgtagcgcggcgcgccggcgaaaccgttgaagctcaggtgcagcatgccgacgccgctgatcggcagcaggatcaccgcagcccagacccaatggaagaaacggcggaacacctccagccacaggcccaggcgggctggggcctccagcgcggcgacggccgccggacgaagaatcgtccaggcgaagaacatgcctccgacccagaccagggcggccaggacatgcagggcgtagacgagggcgtagggggtcattcggcgatctccgctggcggttgtgacgaagcgcgttatcatagccgccctgtcgaaccactgaaaatttatccagctatggcgcgccggcggattcgtcttccgctgcgcgccgggcccaggaattccatgctcagcgccgaactcaagtcccagatccagggtgcctacacccgctttctcgaagccaaggagctgaagcctcgctatggccagcgcctgatgatcgccgaagtggccaaggccctcggcgcgatcaaggaggacgaggaggggcaccgcgagggcgagccggcggtggtcgcggtggaggccggaaccggtaccggcaagaccgtggcctacagcctggcggcgatcgcctgcgccaaggccagtggcaagcgcctggtgatagccaccgcgaccgtcgccctgcaggagcagatcgtccacaaggatcttcccgacctgctgcgcaacagcgggctggccttcagcttcgccctggccaagggccgcgggcgctacctgtgcctgtccaagctcgacgtgctgctgcaggaaggccaggcgcagagcgcgacggcgcaactgttcgccgacgacggtttcaacatcgatgtcgacgagaccagcagcaagctgttcaaccagatgatcgaacgcctggccggcaaccgctgggacggcgaccgcgacagctggccggaggcgatcgacgacgcgcattgggcgcagctcaccaccgatcacagccagtgcaccaaccgacattgcccgaacttccagcagtgcgccttctacaaggcgcgcgaagggatgaccaaggtcgacgtgatcgtcaccaaccacgacctggtcctggctgacctggccctgggcggcggcgccatcctgcccgatccgcgcgagaccctctacgtgttcgacgagggccatcacctgccggacaaggcgattggccatttcgcccatttcacccgcctgcgcgctaccgccgactggctggagcagatcgccaagaacctcaccaagctgctcgcccagcacccgctgccgggcgacctcggccgcctgatcgaacaggtgccggagctggcccgggagatcaagacccagcagcagttcatgttcaccgcctgcgaagagatcggcgatttccgcgccggcgaggacatggaaggtcgcgagcggccgcgtcaccgtttcgtcggcggggtggtccccgagcatatccgcgagatgggcatcgagctgaagaaaggcttctccaagctgaccgacctgttcacccgcctcaccgatatcctcaaggaggcgatggacggcgaaggcgccggcggcatcgccagccaccaggcggaggagtggtacccgctgttcggtagtcttttggcgcgcgcccagggcaactgggaactgtggaccgccttcacctgcgaggacccgcaggacagcccgccgatggcgcgctggctgaccctcgccgagagcggcagcttctacgacatcgaagccaacgccagcccgatcctcgccgccgagaccctgcgccgcaacctgtggaacgtcgcctatggcgtgctggtgacctcggcgaccctgaccgcgttgggcaccttcgaccgctaccgcatgcgcgcgggcctgccgcgcaacgcggtcaccgcggtggtgccgagccccttccaccatgccgaggccggggtattgcgggtccccgacctcaaggcggatccgcgcaacgccgccgagcacaccgcggcgatcattcgcgagctgccggaactggtgaagggcgcgcgcggcagcctggtgctgttctcctcgcgcaagcagatgcaggaagtcttcgacggtctcgaccgcgactggcgcaagcgggtgttcatccagggcaacctgtccaagcaggaaaccctgaacaagcacaagtcgcgagtcgacgacggcgaggacagcgtgctcttcggcctcgccagtttcgccgaaggcgtggacctgccgggggcctattgcgaacacgtggtgatcgccaagattcccttcgcggtacccgacgacccggtggaggcggcgctggccgagtggatcgaggcgcgcggcggcaatccgttcatggagatcgccgtgccagacgcttcgctgcggttggtccaggcctgcgggcggctgctgcgcaccgagcaggaccgcggcaccatcaccctgctggatcgccgcgtggtcacccagcgctacggcaaggctatcctcaatgcattgccgccgttccgccgggaaatcgcctga

SEQ ID NO: 3127 - DNA, 2352 bp, Pseudomonas aeruginosa
cgcgctggcctgcgcgggagggcgccagccttcacgtccgagccgcatcaggaattcccggcatttgcccaggccgggatggagttaaggaaaacaggcttcatgatccgttcgcgttggcatcttcccctgcttctcggcctgctcgcggtggccacgccgctggcggcgagcgacatccagcaggtactgttcaacttcgtcaagccaatggccgtggtcggcatcacccttgaggatgccgacctgcccagcgcgacggcggaggccaccccggagggcgacattctccgtcgcgtcaccttcagcccggcgcaacggcccaccttgcgcatgagtccggcgctgggccgttgggactggtccgcagcggactacgtgagcctgcgcatccagaacgcgatgagctgggacatgaccctggaggtcgcgatcgagggcgagcagggcgcgccggggctgcaggcatccatcgagctaccggcaggcccgccgcagaccctgctggtgccgttgcgggcggtttcgccagaggctctgggcatgcgtgcggggccgccgatgccacagatggtcgaaggccagcgggtgctgctggcgccacgcgtggagggctcgctggaccgcgccagggtcggagcgctgagcctgtccctgcgctcgccgcaagctccccagagcatcctgctcggacgtttcggcatacgcacagggagggcggtggagcggagcatcctgaccggcctgatcgatcgctatggccagtacagccgcgccgactggccggaaaagattcgttccgacgaacagttgcgcagcgcctatgcggccgaggccgcacagctccgcgactgggaacggcagacaccggcgcgcgaccgtttcggcggcctgctgggtgggccggtgttcgaagccagcggtttcttccgcacggaaaaacgtggcgggcgctggtggctggttactccggaaggacatccgttctggtcgctgggcgttaatgcggtgaccgccgacggcagccggacctacgtcgaaggacgcgagccgatgttcgccgaactgccggcggagggtgagccgctggccgcattcttcggtgagggcgacgaccgccgcggcgtcgccgcgcaggccgggcggcgcttcgggcatggccgctggttcgatttcctcggtgccaatcgccagcgcatcgctccccaggcgagtgccgaccagctcgccggcgaatggcgccagcgcaccctggagcgcctctcggcatggggtttcaacagcctcggcaactggagcgatccggcgctcgccgcacaggcgcggatgccctacagcctgccgctgtcgatcgccggcgactacgccacggtcagcagcggtttcgactggtggggacccatgcccgatcccttcgacccgcgcttcgccatggccgccgagcgcgtcatcgccatcgctgctcgcgaccaccgcgacgatccctggctgctcggctactacgccgacaacgaactggcctgggccgggcgcgacggctcggccctggcgcgctacggcctcgctttcggagccttgacgctgtccatggacagtccggcgaagcgcgccttcgtcaagcaattgaaagccaagtacctgggccatgaggcattggccgaggcctggggcatcgagctggccgcctgggaggccctggaggcgccgggctacgcggctccgctgccgggcgaggggcatccggccatcgccgaggactacagcgccttcctccggctgtatgccgacgcttacttcaagaccctgcgcgacgccctgcaatggcacgcaccgaaccacctcctgctcggcggccgcttcgccgtcagcactcccgaggcgatcacctcctgcgcccggtattgcgacctcctcagtttcaacctctatacgccgttgcccgggcagggcctggacgactccctgctggcgcggctggacaagccggtgctgatcagcgagttccacttcggctcgcgggatcgcggtccgttctggggtggtgtcagcgaggcggccaatgagcgggcgcgcggcgactcctaccgaacgttcctggaggcggcgctgaagagtccgtatatcgtcggcgcccactggttccagtacctagaccaaccggccagcgggcgtctgctggacggcgagaacggccatatcggcctggtcgggatcacgggcttgccgttcgccggcttcgtcgacacggtgcgccgaagcaaccttgccgccctgtcgcgactgtcggcgatggccaggtccatgcctgccgtcgagcctctgccgccgcgcgaggattcagccggttcatga

SEQ ID NO: 3128 - DNA, 663 bp, Pseudomonas aeruginosa
cgatcccttcagcctgttccgccagtggttcgacgacgcggtgaagaccgagcgcctgccggtcgaacccaacgccatgaccctggccaccgtcgacgccgacggctatccgcattgccgtatcctcctgctcaagggcctcgacgagcgcggcttcaccttcttcaccaactacgaaagcgccaagggccggcaactggcggccaatccgcgggcggccatgaccttcttctggccggcgctggagcgccaggtgcgcatcgaaggcagcgtcgagaaggtcactcccgaggaatccgacgcctactaccaggtgcgtccgctgggcagtcgcctgggcgcctgggcctcgccgcagagccgggtcatcgccgatcgcgccgagctggaacggctgctcgcggacaccgagcggcgtttcgccgaccagccgccgagctgtcccgagcactggggcggctaccgtctcctgccgcagcgcatcgagttctggcaggggcggccgagccgcctgcacgaccgtctcgactatcgacgccaggacggcggctggctgcgcgaacgcctggcgccctgagtcctccatgttcgaactggattcgacgctggcgcagcacatcgtcgatcgggcgatggcgatcctgccgcacaacatcaatgtga

SEQ ID NO: 3129 - DNA, 1149 bp, Pseudomonas aeruginosa
ctgatgaaaatcgtgattgctcctgattcgttcaaggaaagcctgtccgcgcccgacgtcgccgaggctatcgcccgcggctggcggcgagtcttcccgcaggccgaggtgttgctgcggccactggcggacggcggcgaaggcacggtcgatgcggtactcgccgccaccgccggcgaacgtcgcgaatgccgggtcgaaggcccgctcggtgagccgaccctggcgcactggggctggctggacgacgccaccgcagtgatcgaaatggcttccgccagcggcttgcacctggtcccgcgcgaccgccgcgacgccacgcgcagcagcagccgtggcactggcgagctgatccgtgcggcgctggacgccggggcgcggaagattatcctcggcctcggcggcagcgctaccaacgatgccggcgccggcctgctgggcgcgctcggcgtgcgtttcctggctgccgacggcgaggaactggcgcccggcggcgccgcgctggctggcctgcacagtctcgacctgggcgggctggatccgcgcctggtggatgtcgcggtggaagtcgccgcagacgtcgacaacccgctatgcgggccgcgcggcgcttcggcggtgttcggtccgcagaagggcgccagcgccgaacaggtggcgcaactggatgccgccctggcgcacttcgccaaggtggtcgtggcgacccttggcgaggacttcagccgggtgccgggcgtcggcgccgccggcggcctgggtttcgccgcgagggcattcctccgcgcgcgtttccgcccaggcatcgaactggtggcggagctggccgggctggccgatgcgctggtcggtgccgacctggtgctgaccggcgagggccgcctggatgcgcagagcctgcacggcaagaccccggtgggcgtggcgcggatcgcgcgccaggccggcgttcccgtggtagccctggccggcagcctgggcgacggctaccagcgcctgcacgacgccggcatcgatgcggcgttcagcctggcgccgggaccgatcagcctggagcaggcctgtgccggagcggcggcggaactggaggcgcgcgccgagcagatcgcccggctctggcgcctggctcaggcttcgcgggaagggtag

SEQ ID NO: 3130 - DNA, 498 bp, Pseudomonas aeruginosa
tattcgtcagttatccctttcggagatgccgttatgcgcaagtctgccttgatcgttgcttccttcaccgccatggccctggctcttggcggctgccaatccagcctcaccggcgatacctacagccgtgaggaagcccgtaccgtgcagactgtacgcatgggcaccatccaggccttgcgcccggtcaagatcgaaggcaccaagaccccgatcggttccatcgccggtgccggcgtcggcggtgtcgccggcagcgcggtgggcggcggcaagggcagctacgtcgcggccatcatcggcgcggtcgctggcggcctgctgggcgcggctaccgaagaaggcctgacgcgcacccagggcgtcgagatcaccgtgcgcgaagacgacggcagcacccgcgcctatgtccagcaggtcgaccagggccagatcttccgcgtcggcgagcgcgtgcgcatcctgaccgtcaacggcaccagccgcgtcgcccactga

SEQ ID NO: 3131 - DNA, 1893 bp, Pseudomonas aeruginosa
cctgaaggggctgctggcctactcgacgatcagccacctgggcctgatcaccctgctgttcggcctcgactccccgctgtcgaacgtcgccgcggtgttccacatcatcaaccacgcgaccttcaaggcctcgctgttcatggccgccgggatcatcgaccacgagaccggcagccgcgacatgcgcctgatcaacgggatgtggaagtacctgccgcataccgcggtgctggccatcgtcgcctccctggcgatggccggggtgccgctgctgaacggcttcctcagcaaggagatgttcttcggcgaaaccctcagccagaacctgctgggcagcttcaactggctggtgccggcggtggcgaccctggccggcgtgttctcggtggcctattcgctgcgtttcatccacgacgtgttcttcaacggcgagccggcccggttgccgaagttcccgccccacgagccgccgcgctacatgaaggtaccggtggagatcctggtgttcctctgcctgttggtcggcatgctgccggtctacaccgtggcgccgctgctggccgccgccgccagtgccagccttggcgggcaactgccggaatacagcctggcgatctggcacggtttcaacctgccattgctgatgagcgtggtggcgctggttggcggtgtgctggtctatgtcctgcgcaagccgctgttcaactggtacgccgggttaccggaggtggacgccaagctggtcttcgagcagcaggtgcaacgtgtggtggccctggccgcgcgcctgaccgcctggctggagaacgggtcgctgcagcgctacctggcctggctgctgggcgcggcgctggtcgtggtggcggtcgagctggcaccgctggcgaggctgaccggctcgcgcgggctgaccccgctggacggtatcaccgccctgggcatgctggtgctggccttcagcggcctggccacggcgctgttccatcgtatgcgcctggtcgcgctattgatcctcagcgtcgccggcctgctggtggccctggccttcgctcgcttctcggccccggacctggcgctgacccagttgtcggtggaagtggtgaccatggtcctgctgatgctggcgctgtatttcctgccctcgcgcactccggcggagtcctccaccctgcgcggcttgcgcgacgtggcgctggccggcggggtcggcatgctggtggcgctgctggcctacgcggtgctgacccggccctacgagagcatcgccggattcttcgtcgagaacagcgtctccgggggcggcggctacaacgtggtcaacgtcatcctggtggacttccgtggtttcgataccctcggcgagatcagcgtgctggcgatcgccggcgtcggcatctacgcgatgctcgccggtttcgccctgcacaagccgacctgcgacccgcagggtcgcaactgggcccacgccaagcacccgctgatcctggaaaccctgtcgcgggtgctgctgccgctggcgttgctgatctcggtgttcatcttcctgcgcggccacaacctgccgggcggaggtttcatcgccggcctggtgactgccatcgccctggtgctgcagtacatcgccagcggctcgcagtgggtcgagcagcgcctgccgctgaactatgcggccatggctggcgccggagtgctgatcgccgggctcaccgggctcggcagctggctgttcggctatccgttcctgacttccgcgttcggccacttcgagttgccgctgatcggcgagatcgagctggccacggcgatgctgttcgacctcggcgtgtacctcaccgtggtcggtgccgcgctgctgatcctgtcctacctcggcaagctcagcctgatgcctga

SEQ ID NO: 3132 - DNA, 366 bp, Pseudomonas aeruginosa
acccgtcgcacaagaggaggcgctctgatggaagccctgttcgccatcaccctcggcctgctcaccgccagcggcgtctacctgctgctgcgggcgaggactttcccggtggtgctcggtctcacgctgatctcctacgcggtcaacctgttcctgttcgccatgggccggctcggcggcagcgtcgcggtgatcggcactcccggggagtatggtgatccgttgccccaggcgctggtgctgaccgccatcgtcatcggcttcgccatgaccgcctttgtcgtggtcctggccctgcgtggcctcggtgacctcggcagcgaccacgtagatggacgcccggacgaggaggagccgcgcccatga

SEQ ID NO: 3133 - DNA, 720 bp, Pseudomonas aeruginosa
tgtcctgctgttgctggtctggttgctgctggtggattccttcgccattggccactggctgctcggcgccttcctcggcgtgtgcattccgctgctgaccaaccgcctgctggtcgggcgcagccaggagtggcatccgttgctgctgctgaagctgctggcgctggtgatgtgggacatactcgtcgccaacatccaggtcgcccgcctgaccctcggaccgatcgagcgcttgcgtccggccttcgtcgaggtgccgatcgagctggagaacgacctcgccatcagcgtgctggtgagcatcgtctcgctgaccccggggtcggtgtcgtcggacctcagcgacgaccgcaagaccttgctggtgcacggcctcgacgtgccggacaaggcggcgctgatcgccgagatcaagcaacgctacgaagcgccgctgaaggagatcttcccatgctcgcttacgtgatcccgctgtgcctggcgctgctcggcctggccctgttgctgaccctggcgcgcctggtcaaggggccgtgcctgccggaccgggcgctggcgctggacaccctctacgtgaacgccatcgccctgctggtgctgtacggcatctggcgcgacagcgacctgttcttcgaggcggcgctgctgatcgcggtgctcggcttcgtcggtacggtggcggtggccaaatacatgctgcgcggagacatcatcgaatga

SEQ ID NO: 3134 - DNA, 1134 bp, Pseudomonas aeruginosa
tcagcctgttcctcttcatcagcgccccggtcagtgcctacatgctggccaaggccgctgtgctgcagcagttgccgctggagaagaagactcgcggcaagccctgggagcagtgaggcccggcgcaacagttttgcccgctttctgtgcctgtcggcgcagctagccggctgcctatactgggagtcctttttccggcgccgcgcggcgcccgtggtggagattcccttgactcggacgcgctggttcgccctggcctgcctgatcctggcgatggcgctgtggggcagttcgtacgtggtgctgaaggtcgctttccgcgaactgccgccgctctgggtgatcttcggccgcatggccctcggcagcctggtgttcctcgttgcctggcgctggcgcggacgcatcgactaccgcccgggcgactggaagtacctgctcggcctggccgtctgcgaaccctgcctgtacttcctctgcgaatccttcgccctgcaatacaccagcgcggcccaggccgggatgatcaccgcgctgctgccgttgctggtggcggtgggggcctggttgctgctgcacgaacggatcggccggatgacctggatcggctttggcctggcggtgctcggttcgatctggctgagcctcgccggcgagcccgacctgcacgcgccgcagccgctgctgggcaacttcttcgaacttctcgcgatgctctgcgccaccggctataccctgttgctgaagcacctttcggcgcgctactcggcattcgccctgaccgccatgcaggccttcgtcggcacgctgttcttcctgccgctggcgctggccagcgccgacctgccgagccagcccagcgcgctggggatccaggcggtggtgtatctcggcgtggtggtcacggtgggcgcctacggcctgtacaacttcggcgtcggtcgactgccggccagccaggcatcgggcttcatcaacctgatcccggtcttcaccctggtattcgccgcgctgttcctcggcgaaaccctcaacggcccgcagatgctcgctgccggcctggtcttcatcggcgtcgccatcagccagtggcgcagcgctccgccgccgcctccggccggcgtcctgaactga

SEQ ID NO: 3135 - DNA, 612 bp, Pseudomonas aeruginosa
cgctgctctacggcgcccacgaccagcagcacaacaatgccgtggtgctggccgagttcctcgaggaggagctggaccgccagcagccgggcagttcgccgacctgctacgccgaccgcctctcctgagaaatatcgcttaccagatgcggtacacctggccggtctgcgcgccttccacgctgcgtgcgtaacccagcgcggcgtccgccgccggaaccggcttgaagccacggaagtagggcgcgtagccgggcagcgcctcgctgaccacggtcgggctgacggcgttgatgcgcaggccgcgcggcaactccagggctgcgccgcggacgaagccctcgacggcgcagttgaccatgctcgccgaactgccgaagcggatcggctgctcggcgagcacgccgctggtgagggtgaaggagcccccgtcgttggcgtactcgcggccgagcagtaccaggttgacctggcccatcagcttgtcgcgcaggccgagctggtattgcgcctcgcccatttcctccagggcgccgaagtgcaccttgccgaccgcggcgaccagcgcgtcgaagcgaccggttttctcgaacagggcgcgaatggagtctga

SEQ ID NO: 3136 - DNA, 957 bp, Pseudomonas aeruginosa
tcctgtcaatcgacaacctaccgttttcatagggaaacaatcgtgaaggacctggacgatctcgccgccttcgccgtactccacgacctgggcagtttcacccgcgccgccgagcgtctcggttgcagcaagggccaactgtcgaagcgcattggcgtcctcgagcagaagctcggcgtgaccctcttgcaccgcaccacccgccgtctttcgctgaccgccgccggcgccgcgctgctgcccgaggcgcaggccttgctggtgcaggccgagcgcgcgcggcaggcggtggcgcgcttgcaggagcgagcggaaggacgggtgcgggtgaccctcccggtctcgctgggcgagaccctgttcgatgcactgctggaggacttccaggaacgccatccgctgctgcgcgtcgagctggacctgtacaacggcctgcgcgacctggttggcgagggcttcgacctggcgatccgctctggggtcgagcaggacgcccggctggtggcgcggccgctgttcgtcctgcaggaaatcacctgcgccagtcccgcctacctggcgcgacacggcgagccgcaacgcccggccgagctggccgagcgcgagtgcctgctgaactcgcactacagcggccacgaggagtggctctatcaccgccaccatcggctggagcgggtacgggttgccggctttctcgccagcaaccactacagcctgttgaagaaagccgcgctggccggcaccggcatcgcccggctgccgtcatacatggtccacgacgaactgggcgacggccgcctggcctggttgctgcgcgactaccagacgcgcagcacgccgatgttcctcgtccatccgttccagggcggcctgccgcggcgcacccaggtactcgccgattacctgctcgactggttcgagcgcagccggcgacaattgatcggcctggagggttga

SEQ ID NO: 3137 - DNA, 363 bp, Pseudomonas aeruginosa
gggaggagatcgatgccgcgccgcagcagcaggagctgccggtgccggctgcggagttgctcgactggctggctgcgcagggcagcgaagacgcgccgcgcaacccggagaaagaagtgcagtggctgctccaggcgctggccgagcggcccgacgacaccgccttgcgcgaagtggccgcctcggcgctacaggcctgctccgccgacgacgaggccatcgacctgctctgggagtacgtcgagcgccacaccgacgaggagcagcaactggcctactacctgctcaatgccttgctggcccgcggcgagtacgaccaggtcaagcgcctcggccggctctacgccgacagcgtgccgctga

SEQ ID NO: 3138 - DNA, 765 bp, Pseudomonas aeruginosa
gggccgttttcgtatgcgctgaagtctccggcgggacggtgctcagccgccgaggtaggcgtcgcgcaccttcgggttggtcagcagggcggcgccggtgtcgtgcatgacgatccggccgttctccagcacgtaggcgcgatcggcgagcttcaacgcctggttggcgttctgctcgacgaggaacacggtgacgccttcgcgacgcaactgctcgatgatctcgaagatctgctggatgatgatcggcgccaggccgagcgaaggttcgtccaacagcaacagctttggcttgctcatcagcgcgcggccgatggcgagcatctgctgttcgccgccggacatggtcccggcgcgctgttcgtagcgttccttcaggcgcgggaagagttccagcaccttgtccatctgcacctggtagtcgtccttgtcggtgaagaagccgcccatcgccaggttttcttccaccgtcaggcgggagaagacccggcggccttccgggaccaccgcgatgctcttgcgcatgatggtggaggagggcaggccgaccagttcctcgccttcgtagcggatgctgccgctggccgcctgcggcgagccgcagagcgtcatcagcagggtcgacttgccggcgccgttggcgccgatcagggtgacgatctcgcccttcttcacttccacgctgacgtcgtgcagcgcctggatcttgccgtagtaggtggaaaccttgtcgaaactcagcatgctcacgcttcccccagataa

SEQ ID NO: 3139 - DNA, 552 bp, Pseudomonas aeruginosa
tctcgccgaagccgagggtcacgatcgccaggtagtcgccgcgcaggcgcagcaccgggaagccgaggaaagaaagccgaacagcgcggccatcatcccggcgatcggcagggcggtccaaaagccgaacccggcgtactcggcgagcagcgcgtatgtgtaggcacctaccgcgtaaaagccgacgtagccgagatcgagcaggccggccaggccgaccacgatgttcaggccgatgccgagcatcacgtagatcaggatcagggtggcgatgtccaccgccccgcgcgaggcgaagaacggccagacgaaagccaccacgaccagggcgaggaccgcccagcgctgggtcgatggcaggctgaggaagttcttcaggccgctgccgttgaccttgtagccgacgccgcgacccagcttgagcgggatgcggtcgcggaacagctgccagacgaacatggccagggcggccgcggcgatggtccagagggtctgcgcatcggcgccgaggacctcgagcttgatgccgacggtgcgcagcttcaggcctag

SEQ ID NO: 3140 - DNA, 528 bp, Pseudomonas aeruginosa
gatcggataggacaccaggatcacgaggagggcgctgaacagcgcgcgcttgagggactggctcatactttttccacctccggacgaccgaggatgccggtaggtcggaacagcagcaccaggatcagcaggccgaaggccaccacgtccttgtactggtcgccgaacacgtcggcgccgaaggcttcggcgacgcccagcagcaggccgccgagcatggcgccggggatgctgccgatgccgccgagcaccgcggcggtgaacgccttgatcccggcgaggaagccgatcccggggttgatcacgccgtactgcatgcccagcagcaccgcggcgacggcggccagggcggcgccgatgacgaaggtgagggcgatgatgttgttgctgttgatacccagcaggttggtcatcttcaggtcctcggcgcaggcgcggcaggcgcggcccaggcgggagcgggagatgaacagggtgaggccgaacatcaccaggaaggtgacgacgaagatcaggatctgcatatag

SEQ ID NO: 3141 - DNA, 645 bp, Pseudomonas aeruginosa
ttccgattcccaccaggagattcgtcatgttcgaaccaggccacctccatctggtcagcctgcccggcctcgaccagcaggacatcaatatccatatccgctacgaggtgcggcagaacgccgaatccggcgcctatgtgcacttcgacatggacggcgagatcgacggcaagccgttcagcgactccttcgagctgccgcgcgataccgccttcaacttcgccagcgatgccacgcgggtcgcccagaagcacggcctgcacccgaagttcggcgcgatcacccgggtgcacaaggaatacgatgcgatgttcgaggatattcgcgccaagctgcatgcccatcccggcgaaccggtggatctcgagcggatcattcgccacgagtgagccgtgtccccggcggccggaagcatgggaaaggcccgatatcgacgatatcgggccttttttcgtttgccggagaggccgttccaggggcttgccacccttgccggcaagcggaaacggcttgccgcttgccgcttccgggttgctcttaaataaactcaagttattgaatataaaggtttttaataatttggcacgggccttgctgaagtgttggcgacgaaagccacaccggcaaacaggttcgcagccatga

SEQ ID NO: 3142 - DNA, 444 bp, Pseudomonas aeruginosa
gcatcagtttcgacagagcactcggtatccaccagcaggccctcagcttccgcgcccagcgcgccgaagtgctggccaacaacctggccaacgccgataccccgaactacaaggctcgcgacctggacttcgccgcggttctcgccgagcagaaggacaaggccgccaagggtaccttcgccatccgcaccaccaacgagcggcatatcgccgccgaaggtttcggcatgggcgagggcagcctgcagtaccgcatcccggtccagccgtcgatcgaccagaacactgtcgacgcccagatcgagcaggccaactacgccgagaacgccatgcacttccaggcgtccttcaccttcctcaacagcaaattcaaagggctggtcagcgccctgcgtggagagtaaccgccatgtccctcgccagtgtcttcaacattgccggtag

SEQ ID NO: 3143 - DNA, 771 bp, Pseudomonas aeruginosa
cgtcagcggcaccagcagcaacaccggcaacgtcaacggcagcaagcgcgccgccggcagcggcgccaccgagaccgggcagagcgtcaagggcagcagcaaccttggcaaggacgaattcctcaagctgctggtggcccagttgaagaaccaggacccgatgtcgccgcagcagaacggcgagttcatcgcccaactggcccagttcagcaccgtggaaggcgtgcagtcgctgaacaagagcatggagagcattctctccaactaccagtcgtcgcaggccctgcaagcctcgtcgctggtggggcgcaaggtcatcgtggcgaccgacaagtcggtggtggacaccaaggacaccttcaaggcgtccctcaacctgccggtctccagcagcaacgtatgggtcaacgtctacgacgacaagggcaccgtggtcaatcgcatcaacctcggccagcaggctgccggcagcgtcagcttcatgtgggacggcaaggacagcagcggcaacatcatgccgccgggcacctacaagttcgaggcgcagacctcgatcgacggcaagacctacgggctccagacctacctgccggccaacgtcgacagcgtcaccctggggcagaacggcggcgagctgatgctcaacctcgcaggcctgggcagcatcgcgctgtccaaagtacagatcatcggccagtaagccggcgtttccggcaaggagctatccatgagtttcaacatcggcctgagcggcatccaggcggcctctag

SEQ ID NO: 3144 - DNA, 810 bp, Pseudomonas aeruginosa
aaccggcacccgaggagcacgacgatgttatcggcactgtgggtcagcaagaccggtctgtccgcccaggacatgaacctgaccaccatttccaacaacctggccaacgtatccaccaccggcttcaagcgcgaccgcgcggagttccaggacctgctgtaccagatccggcgccagccgggcggccagtcgacccaggacagcgagctgccttcgggcctgcaactgggtaccggtgtgcgcgtcgtcggcacccagaagatcttcaccccgggcagcctgcagaccaccgagcagccgctggacatggcggtcaacgggcgcggcttcttccaggtcctgctgccggacggcaccgtgtcctacacccgcgacggcagcttccacctgaactccgacgggcagatcgtcacctccaacggcttcgccctggagccagcgatcgtggtgcccaacgagacccagaccttcaccgtcggccaggacggcaccgtctcggtgaccaccaccggcaacgcccagccgcaggtgatcggcaacatccagaccgccgacttcatcaacccggccggcctgcaggccatcggcaacaacctgttcctggaaaccggctccagcggcgcgccgcaggtcggtacgccgggtctcaacggcctcggcacggttgcccagaacaccctggaaaactccaacgtcaacgtggtcgaggaactggtgaacatgatcaccacccagcgcgcctacgagatgaactccaaggtcatctccaccgccgaccagatgttgtccttcgtcacccagaatctttga

SEQ ID NO: 3145 - DNA, 702 bp, Pseudomonas aeruginosa
cttgatatgaaccggctgatgatcgtctccctgcttggcatcgccaccgccctgggcggttgcgtcaatccaccgccgaagccgaacgatccgtactacgcgccggtgctgccgcgcaccccgctgcccgccgcgcagaacaacggcgcgatctaccaggccggcttcgagcagaacctttacgacgaccgcaaggccttccgcgtgggcgacatcattaccatcaccctcaacgagaagacccaggcgagcaagaaagccaactccgatatccagaaggacagcaagaccaagatggggctgacctcgctgttcggtagcggcatgaccaccaacaacccgatcggcggcggcgacctcagcctcagcgccgaatacggcggctcgcgcgacgccaagggcgatagccaggcggggcagagcaacagcctgaccggctcgatcaccgtgaccgtggccgaggtgctgcccaacggcatcctctccgtgcgcggcgagaagtggatgaccctgaacaccggcaacgagctggtgcgcatcgccggcctggtccgcgccgacgatatcgccaccgacaacaccgtgtcctcgacccgcgtggccgacgcccggatcacctactccggcaccggcgccttcgccgatgccagtcagccgggctggctggaccgcttcttcctcagcccgctgtggccgttctga

SEQ ID NO: 3146 - DNA, 1218 bp, Pseudomonas aeruginosa
tctgaggacgacgccatggattcccgtttgctcagcggtatcggcgcaggccccgacagcggctcctataccgatctcaaccgcctcaaccagctcaaggtcggcaaggaccgcgacggcgaggcgaacatccgcaaggtcgcccaggaattcgaatcgctgttcctcaacgagatgctcaaatccatgcgttcggccaacgaagcgctgggcgacggcaatttcatgaacagccagaccaccaagcagtaccaggacatgtacgaccagcaactgtcggtgagcctgtcgaagaatgccggcggcatcggcctggccgacgtgctggtgcgccagttgtcgaagatgaagcaaggctccaggggaaacggcgaaaacccgttcgcccgggtcgccgagaacggcgccggtcgctggccgagcaaccccagcgcgcaggccggcaaggccctgccgatgccggaagccggccgcgacgactcgaagctgctcaaccagaggcgcctggcgctgccgggcaagctggccgagcgcatgctcgccggcatcgttccctccgcctcgccggccgccagccagatgcagagcctgggccaggacagctacctgccggcgcagagctacccggcggcgagccgccgcggtttctccaccgatggcgtcgacagccagggcagccggcgcatcgcccagccgccgctggccaagggcaagtcgatgttcgcctcggccgacgagttcatcgccaccatgctgccgatggcccagaaggccgccgagcggatcggcgtcgatgcccgctacctggtggcccaggccgcgctggagaccggctggggcaaatcgatcatccgccagcaggatggcggcagcagccacaacctgttcggcatcaagaccggcagccgctgggatggtgcctcggcgcgcgctctcaccaccgaatacgaaggcggcaaggcggtcaaggaagtcgcggcgttccgctcctactcgtcgttcgagcagagcttccacgactacgtcagcttcctccagggcaacgaccgctaccagaacgccctggacagcgccgccaaccccgagcgcttcatgcaggaactgcagcgcgccggctacgccaccgatccgcagtacgcccgcaaggtggcgcagatcgccagacagatgcagacctaccaggccgtcgccgccgccggcacgccgcctctgggttga

SEQ ID NO: 3147 - DNA, 2052 bp, Pseudomonas aeruginosa
cccatgtccgacctactctcgataggcctgtccggcctcggcaccagccagacctggctgaccatcaccgggcacaacatcaccaacgtcaagacgccgggctacagtcgccaggatgccatccagcagacccaggtcccgcagttcagcggtgccggctacatgggctcgggcagccagatcgtcgacgtgcgccgcctggccagcgacttcctcaccggccagttgcgcaacgccaccagccagaacagcgagttgagcgcattccgtagccagatcgagcagctcgacggcctgttgtccaacaccaccaccggcgtcagcccggccatgcagcgcttcttcgccgcactgcaggccgccgccaacaatccctcctcgaccgaagcgcgcgaggcagtgcttgcccaggccgaggggctgggcaagaccttcaataccctctacgaccagttggacaagcagaacagcctgatcaaccagcaactgggcgcgctggcttcgcaggtcaaccatctgtcgcagagcgtggccagctacaacgatgccatcgccaaggccaagtcggcgggcgcggtgcccaacgacctgatggatgcgcgcgacgaagccgtgcgcaagctgtccgagatgatcggggtgaccgcggtcacccaggacgacaacagcgtcagcctgttcatcggtagcggccagccgctggtggtgggcaataccgtgtcgaccctgagcgtggtgcccgggctggatgacccgacccgctaccaggtgcaactgagcaacggcaactccatacagaacgtcaccggcctggtgtccggcggcgagatgggtggcttgctggcctaccgcaacagcgccctggacagcagctacaacaagctcgggcagttggcgatcaccctcgccgataccatcaacaagcagctggggcagggcctcgacctggccggcaaggccggcgccaacctgttcggcgacatcaacgatccggacatcaccgcgctgcgggtcctggcgaagaatggcaacaccggtaatgtccacgccaacctgaacatcaccgataccagcaagctgaattccagcgatttccgcctggacttcgacggcaccagtttcaccgcgcggcgcctgggcgacgacgcaagcatgcaggtcacggtcagcggtaccggtccctacaccctctcgttcaaggatgccaacggcgtcgaccagggcttcaacctgaccctcgaccagctcccggctgccggcgaccgcttcaccctgcagccgacccggcgtggcgcggcggatatcgaggcgacgctgaagaatgcctcgcaactggcgttcgccggtaccgcgcgtaccgagtcgaccaccgaaaaccgcggcaccggcaagatcggcgcgccgaccctcaccagcggtccgtcgccggtggatccgactgtgctacagggcgcgttcgggcccaacgggatcagcctgggcgcgacgctcagcgccgacggcaagacctataccctgtcctcgccgttgccggccggctggagctacgtcgacaaggacggtaacgccctgaccggcagcccgacgctgaccagcggcaataccaataccgtgcgcatagcgttcaccgacccgagcgggcagaaatacagctacgaattcgagctcagcggcgtaccgcagaactccgacagcttcaagctgggcttcaacgacaagggtatttccgacaaccgcaacgctctcaacctgctggccctgcagaccaagccgaccgtcggcggcaccgacaacaccggttccacctataacgaggcctatggtggcctggtcgagcgggtcggcaccctgaccgcccaggtgcgtgccagcagcgaggccagcgccacggtgctgaagcaggcccaggacagccgcgattcgttgtccggggtgagcctcgacgaagaggcggccaacctgatccagttccagcagtactacggtgcctcggcccaggtgattcaagttgcccgcactctgttcgataccctgattggagcgttccgttga

SEQ ID NO: 3148 - DNA, 510 bp, Pseudomonas aeruginosa
acctgctcaacagccgcgacgcgagtggcaaatacctgttttccgggtcccagggctcggtgcagccgttcgtgcgcaacgaggacggcacctacagctacatgggcgacgagagccagcgcgaggtgcagatcgccagcagcacgcggattccggtcagcgacagcggcaaggtactgttcgaggacatcgtcaatgccgctcgtctcgataccaaggcggcggctggcaataccggcgacggtcgcatctcggtcggcctggtcgaggacgagctggccttcgacagccagttcccggcgagcaatccgcctgcggcaaccgacggcttcaacatccacttcgtcagcgacaaggagtatgtggtctacgatccgaagagcctgcctccgggctatgactggaccacctacgatccgaattcgccgccggcctggcaattgtccaagggcgccatcgacgacgacccgaagaccatcgacaaggtgctctacgccggcgtcagcgtga

SEQ ID NO: 3149 - DNA, 567 bp, Pseudomonas aeruginosa
gcatcctcagcttccatgccaccaaggtgttcaacaccttcgagggcggtgcgatcatctgctcggacgaaaacacccggcaacgcctcaaccaccttaagaatttcggcttcgtcgacgaggtcacggtggtcatgcccggcatcaacggcaagctcaacgaggtcggcgctgccttcgggctgctgcaactcaagcacgtcgaccaggccctggagcagcgcagggagatcgccgagcgctatcggcgcctgctggccggcgtccctggcatccagtgcctccggcctggtacccagaccttcgccaacaacgcctatttcccgatcctggtggaagacgattttccgctttcgcgcgacgagctgtaccagcgcctgcgcgacagggatgtgctggtgcggcgctacttctacccactcatcagcgacttccccatgtaccattcgctgccctcggcggcgcccgccaatcttccggtggcgcggtcgatttcctcgcgggtgctgtgcctgccgatctatcccgggctggccgccgcagacgtcgagttcgtcgccggcctga

SEQ ID NO: 3150 - DNA, 1119 bp, Pseudomonas aeruginosa
tcaaggctcgcacggtgggcgacctctaccagatgctcggactctgaccatggccacctccacgctgaagaacgtccgtttcgccgggatggcgacctgcgtccccaagcgcgttatctccaacctgaccgactgcaagccgcagttgcgcgccgagcgcgaacgcctggtgcgcaacatcggcatcgagacgcggcgcatggcgcaggagtggcagtgcttctccgacctggccttcgacgccgccgagcgcctgctggaaagcctggagtggaagcgcgaggaggtcgatgcgctgatcgtcgtgacccagtctcccgactacctggcgccggctaccgcgatcatcctccaggaccgcctggggctgccgcattccaccgtggccttcgacgtcaacctgggttgctcggcctatccgttcgccctcaacctgctgggttcgctgatcgccgccggcggggtgaagaagggccttgtgctggtcggcgaccgcggcgccagtgtcaacgatccgatcttctccgacgcgggcaccgcgacggcgctggagttctgcgaaggcgcgccgccgatgcacttcgacctgaacagcgacggcagcggctacaaggccatcatcctgccggtgggcggccatcgcgaaccggtcggcgtgcagcacctgatgccgttccgcgaggacgagaacgaccattggcaccgtgccatcgacctgcagctcgacggcaccgccgtactcagcttctccacccagcgcgtaccgccggcggtggaaaagctgctcgactatgccggtgcgagcaaggacgaagtggactacttcgttttccaccaggccaaccggatgatcaacgagaccatccgcaagaagctcggcctgccggtagagaaggtgccttcgaccctgcgcgacttcggcaacaccagcggcgcctcgctgccggtgaccatgaccgcgcggatcaaccgggaactcgaggccggccgcaatcgcgtgttgctctgcggcttcggtatcggcctgtcctggggtacctgcctggtggatatcgaaggggcgaagttccccgatctgatcgaatcctgagtgccttgaacgcggaatcagccaagtga

SEQ ID NO: 3151 - DNA, 654 bp, Pseudomonas aeruginosa
ccatcagttgaggacgatgcaatgaagaggatcatcatcctcggcgccggtgggttggggcgtcaggtgttggcccagctgcaggtcgactacagtcacggcatcgactgggtgatcggcgggtttctcgacgaacgcggccccgaagcggtcgcggagtcgctctactatccgtggctcgggtatccggagagcttcgtcgccgagcctgaccaactgttcgtcgccgcggtcggcgatccgctcagtcgccagaagcaggtcgcatgcctgctggcgaagggcgccgagttcgtcgctatccgcacccgctgcacccttggcgtgcggaccagctacggcccgaccttcttcggctacgacgtgagcagcggcgtggactgccgtatcggcgcctacggtttcatcgaccagcaaaccatgctcggccacgacgtggtcatcggcgactatgtacacatcggcccgcgctgcctgctggctggctacgtgaaggtgggcgatcgcgcggtgatcaactccggggcgatgatcgcccgcgacgtcagtatcggcgaagacgccgtggtgggcatgggcgcggtggtgttcaaggacgtggcggccggacagaccgtggtcggcaatccggcccgggttattttcagcaagtga

SEQ ID NO: 3152 - DNA, 1287 bp, Pseudomonas aeruginosa
agagtcttgaacatgtctatcgttaccggaaccttgctgcgcgcacgcctcaagtaccctgacctggacctctccaaggttcgcctagtcggatggggggcggggcagtttttccaggatttctacccgtgtgtgagcgagtacctgaacctgcaatacactatctgtccctatcccgaaaatcaggggaagcgcatccacggcgtggaagttcgggcgccgtctgcactcgaacaggaatcgctggagcacaccttgatcgtggtcatggccaaccacttccccgaagtgatgaaccagatcagtcagtttcatggcaggttccgcacggtacgcgctatcgatttcgatccgggcaacgtggcgctgctcgatgaaatgcaggacgtcgccgagctgctcccaagtctgacgatgaggcgcgatctgccttccagtcggatgggtattttcgtccagggcctggcgttcgacttcacgccgctggtgctggcctggaaccgctcgcatttcccgtccgcctaccagtgcatggtgacctgggaccatcagtccagcgaattgctcgagcgctgtcgcccctggctggatgagttgatattggttccacagccggagaatctcggcttgatgaaccgcaatgtgatcctgcgttcggcacgcttgggtgtacagcgcctggcggacaaggggatcgagttcgctgttcgttgccgcagcgacaacattcttcatggttcgcttcaccaggcgctcaacggactcttctcgcatggccgcaatgccgggaagatcgcggtttcgctgggtgcttcctggcagtacatgccgttccacttctcggagaaagcgatgattgcaagaaccgaggatatgctggcgctctggtccctgcccgaggatccgcgtccggcagactgggccgccgacgagctgtccgatcggctggaactgtcgccggagcggcattaccaggagctgtctcagtacaccttcgaatctgcgctctggcgagattatgcccggcgtctgggctttcctgtggaatccctggccgactcttaccgttttgcacaggcgcgcctcctggcccttgagccgtatatgagctggtactcgttgaagttcaccgcgctgttcaacctggagcgtgacacgttctattcgttttccgctgaaagctggaaccgcctgttttccgatagcgatggagctctgctgcgggcggaggccgccagccgacttgccatgaactcgcgggatttctggcggggtagggtcggttaa

SEQ ID NO: 3153 - DNA, 603 bp, Pseudomonas aeruginosa
gcgaccagtccatctcagtggataacctcgaggatgtggagcgggtgttggacgcaatcctccagcgcaagccgcgaaccgctagcgttggaggtgaccagcatgccccgtgacgactcggcggcctactcgtctcgctgcggtactttcgagtggtgcgatgccgactatgctcggtcctatttgcctcggcgcttctgtgagcaattggcgtcctcgattgctccgaccatacttggcatcgacgcacagcctggcgagtcgttgtggttttccaagcttgttgacctggggtgcagactggattctctcgagtcaggtctcgatagcgttgaggattgcgagtgtctgcgtaacgcccacatcgacatgcacggctacgagtgccaggagatggaggctgtctcccctgggcaagtcgattacatagccatcgaagcgtctctcttcggtttctgcggcaggagtgatatctccgcgaaggccttccagcagatggatgatatcggcttcgcgttgtgggatatcgccaatctatcgaaaagtcccaagaggctgcctaccgattgggacgagttggtctataggcggagcgactcatga

SEQ ID NO: 3154 - DNA, 1254 bp, Pseudomonas aeruginosa
gggtgcctgggcgatgcccacccgaggtcgcaagctcaggcaaacatatcgtccttggagggcatcaagatggccttgaccgtcaacaccaacatcgcttcgctgaacactcagcggaacctgaacaactcttccgcgtcgctgaacacttcgctgcagcgtctgtccaccggttcgcgcatcaacagcgccaaggacgacgccgccggcctgcagatcgccaaccgtctgaccagccaggtcaacggcctgaacgtggctaccaagaacgccaacgacggtatctccctggcgcagaccgctgaaggcgccctgcagcagtcgaccaacatcctgcagcgtatgcgtgacctgtccctgcagtcggccaacggctccaacagcgactccgagcgtaccgctctgaacggcgaagtgaagcaactgcagaaagaactggatcgtatcagcaacaccaccaccttcggtggccgcaagctgctcgacggttccttcggcgtcgccagcttccaggtgggttcggccgccaacgaaatcatcagcgtcggcatcgacgagatgagcgcagagtcgctgaacggcacctacttcaaggctgacggcggcggcgcggtcactgctgcaaccgcttcgggcaccgtcgacatcgcgatcggcatcaccggcggcagcgccgtgaacgtcaaggtcgacatgaagggcaacgaaaccgccgagcaggcggctgccaagatcgccgcagcggtcaacgacgccaacgtcggcatcggtgccttcagcgacggcgataccatcagctatgtttccaaagctggcaaggatggctccggtgcgatcactagcgcggtttccggcgttgtcatcgctgacaccggcagcaccggcgtaggcaccgcggctggcgtaaccccttccgctaccgctttcgccaagaccaacgacaccgtcgccaagatcgacatctccaccgcgaagggcgctcagtccgccgtgctggtgatcgacgaggcgatcaagcagatcgacgcccagcgtgccgacctcggtgcggtgcagaaccgcttcgacaacaccatcaacaacctgaagaacatcggtgagaacgtatcggctgctcgcggccggatcgaagacaccgacttcgcagccgaaaccgccaacctgaccaagaaccaagtgctgcaacaagccggcaccgcgatcctggcccaggccaaccagctgccgcagtcggttctgagcctgctgcgctaa

SEQ ID NO: 3155 - DNA, 1443 bp, Pseudomonas aeruginosa
agcaagatggcgaacagtacgacgatcaacggctacaactcgggccttgatatcaagaacatcgtttccaccctggtggcggccgagaaggcgccgaaggaggcgcagctcaagcgtctggaaagcgacaccaccgccaagttcaccggcatcggccagctcaagagcgcgatctccgacctgcagaccatcctcaaggaactgaacaagcccgagctgttccagaagcgctcggcgagtaccagcgacgagaagttcgccaccgccaccgcgaccaaggacgccctgccgggtatctacaagctcgaagtgacccagctggccagcgtcagcaaggtggccaccgcgtcgtttgccgatggctacaagaccacttccagcggaaccctgaccatcaagcagggtgccgacgatgccggtgtcacggtaaacgtcgcggcgggcgcgaccctcgccgaagtgcgcgactcgctcaacgcgcagctgaaggacaagggcattaccgccaacatcgtcaacaaccctggagacggaacctcgcgactggtcttcaccggcaaggattccggcgccggcaaggacgtgttcgtccagggcagttccggcctggagaacttcaacatcggcagcgtcggcgccgatggcaagctgaccctgtcccagttggacggtacctcttccagcagcagcggctatatcacccaggcgaagaatgccaagttcagcatcgacggcctgaccctggaaagtccgaccaatacggtcgacaaggtcatcaacggcgtcaccttcgagctgaagacggtcaccgacaccaacaagccgatcaccatctcggtcgagcaggaccgtggcggcgtcaaggacaacatcaagaagttcgtcgaggcctacaacaagctggtcggcgtgacttcggaactgaccggcgtgaccaaggtgggcgacgacaaggctcccgtggtcggtgccttggtcggtgacagcagcgtgcgcaacctgctcaccaccatgcgcaacgagatggtccagccggggcaaggtaccgatgttcgcatgctcgccgacatgggtatcaccaccaagaaagacggcaccctggaaatcgacgacaagaaactcgacaaggttctgaaggacaagttcgagtcggtttctgctctgttcaccggcgataccggcctgatgaagcgtctcgacgacaagctcacgccttacacccagaccggcggtgtgctccagcagcgcctggatggattgcaggacaccatcaagtcggtggatacccagcgcgaagcgctcaatcgccgggtcgagcagttgcaggatcgtttgctcaagcagttcaccgccatggaccagttgatcggccagctcaaccagaccagcggacgcatggcccaggctcttagcagcctgcctggccttgtgaagaaaagctga

SEQ ID NO: 3156 - DNA, 426 bp, Pseudomonas aeruginosa
ccgaccgatatagagcgtatcagtcaccgaacaaggcaaccgtcgatgaacgcaatggcagccatgcggcaataccagaatgtcagtacccaggctcaggctatcgatgccagcccgcatcgcctgatccagatgctgatggaaggcggcctgacccggatggcgcaggcccgcggagccctggagcgcggcgaagtggcgctgaagggcgagctgatcggcaaggccatcgccatcgtcggtggcctgcgcgaagggctcgacttcgaggcgggcggcgagctggcagccaacctcgaccgcctttacgcctacatgtcgatgcgactgacggaagccaacttgaagaacgacgcgggcaagctcgaggaagtttccgagctgttgcgcaacatcaaatccggttgggatgcgattgccccctga

SEQ ID NO: 3157 - DNA, 1536 bp, Pseudomonas aeruginosa
gcattagtcccagccctctttcgggtcgagcgagacccattcgatgcaaggcagctgatcaaaatgtggcgcgaaaccaaactcttgctgattgacgacaatctcgatcgcagtcgcgacctggcagtcattctcaacttcctcggcgaagatcagctgacctgcaacagcgaggattggcgagaggtagcggcgggcctgagcaacagtcgcgaagccctgtgcgtgctgctcggcagcgtcgagtcgaagggcggggcggtagagctgctgaagcaactggccagttgggacgagtacctgccgatcctgctgatcggcgagccggccccggccgactggccggaggagctgcgccgccgggtgctcgccagcctggagatgccgcccagctacaacaagctgctcgattccctgcatcgcgcccaggtctaccgcgagatgtacgaccaggcccgcgagcgcggccgctcccgcgagccgaacctgttccgcagcctggtcggcaccagccgggcgatccagcaggtgcggcagatgatgcagcaggtcgccgataccgatgccagcgtgctgatcctcggcgagtccggcaccggcaaggaagtggtggcgcgcaacctgcattaccattccaagcgccgcgaggggcccttcgtcccggtgaactgcggggcgatcccggcggaactgctggaaagcgaactgttcggccacgagaagggcgccttcaccggtgccatcaccagtcgtgccggacgcttcgagctggccaacggcggcaccctgttcctcgacgagatcggcgacatgccgctgccgatgcaggtcaagctgctgcgcgtgctgcaggagcgcaccttcgaaagggtcggcagcaacaagacgcagaacgtcgacgtgcggatcatcgccgcgacccacaagaacctcgagaagatgatcgaggacggcactttccgcgaagacctctactaccgcctcaacgtattccccatcgagatggcgccgctgcgcgagcgggtggaagacatcgcactgctgctcaacgaactgatctcgcggatggagcacgagaagcgcgggtcgatccgcttcaactcggcggccatcatgtcgctctgccgccacgactggccgggcaacgtccgcgaactggcgaacctggtggagcgcctggcgatcatgcatccctacggggtgatcggggtcggcgaactgccgaagaaattccgccatgtcgacgacgaggacgagcaactcgccagcagcctgcgcgaagagctggaagagcgcgcggcgatcaacgccgggctgccgggaatggacgcgccggcgatgctgccggccgaaggcctggacctcaaggactacctggccaacctcgagcagggcctgatccagcaggccctcgacgatgccggcggagtggtcgcgcgggccgccgaacgcctgcgcatccgccgcaccacgctggtggagaagatgcgcaagtacggcatgagccggcgcgacgacgacctgtcggatgattga

SEQ ID NO: 3158 - DNA, 972 bp, Pseudomonas aeruginosa
cggtcacgagatttccctgcgcgacggacgtcgcctgtccatcgccacccgctcgctgaacggcgaaccggggcaactgatcctgctcaacgacctcaccgatacccgccgtctccaggagcaactggcgcgccacgagcgcctgtcggcgctggggcggatggtcgcctcgctggcccaccagatccgcacgccgttgtcggcggcgttgctctatgccgggcacctcagcgagcaggcgctgccgaccgaccagcagcaacgcttcgccgggcgcctgaaggagcgcctgcacgaactggagcatcaggtacgcgacatgctggtgttcgcccgcggcgagctgccactgaccgaccgggtggcgccgaaggcgctgttcgacagcctgcgcgcggcggccgaagtccatgtccaggggctccaggtgcgttggcagtgcgaggcgcgcggcggcgagctgctgtgcaatcgcgacaccctggtgggcaccgtgctcaacctggtggagaacgcgatccaggcttgcgggcccgaactgcgcctgaaggtgcatctctatgcccgcgccgacagcctgcgcctcagcgtcagcgacaacggaccgggtatggacccggcgaccctggcgcgcctgggcgaacccttcttcaccaccaagaccaccggtaccgggctcggcctggcggtggtcaaggccgtggcgcgcgcccaccaggggcaattgcagttgcgctctcggccggggcgcggcacctgcgccaccttgatcctgccgctgattccggcggcgcctctttctgcgattcaggagtaaccccatggcagccaaaatcctgctggtcgaagacgaccgcgcagtacgcgaagccctcagcgacaccctgctgctgggcggtcacgagttcgtcgccgtggactcggcggaggcggcgctgccggtcctggcccgcgaagccttcagcctggtga

SEQ ID NO: 3159 - DNA, 504 bp, Pseudomonas aeruginosa
tctccggcgagtccgggaccggcaaggaagtcctggcgaactatatccaccagcaatcgccgcgtgccggcaagccgttcatcgcgatcaactgcgcggcgatcccggacaacatgctcgaggccaccctgttcggccacgagaaaggttccttcaccggcgccattgccgcccagcccggcaagttcgagctggccgacggcggcaccattcttctcgacgagatatcggaaatgcccctcggcctgcaggccaagctgttgcgcgtattgcaggagcgcgaggtggagcgggtcggtgcgcgcaagccgatcaacctggatatccgcgtgcttgccacgaccaaccgcgacctcgcggcggaagtcgcggcggggcgtttccgcgaggacctctactatcgcctgtcggtcttcccgctggcctggcggccgctgcgcgaacgccctgcggacatcctgccgctggccgagcgtctgctgcgcaagcacagccgcaagatga

SEQ ID NO: 3160 - DNA, 1800 bp, Pseudomonas aeruginosa
ttcatggccgatgcactgatcgacagccaggttcccgccaagagcggcggtgccgggatgctgaagaaatccttcccgggactgtcgttcctcgacaacctttccgagatgaccatgctgcgccagatcggcctgctggtcggtctcgccgccagcgtggcgatcggcttcgccgtcgtgctctggtcccagcagccggactacaagccgctctatggcagcctcaacggggtcgacgcgaaccgtgtggtggaagcgctgaccgcggcggacattccctacaaggtcgaacccaactccggcgcgctgctggtcaaggccgacgacctcggccgggcacgcatgaaggtggcctccgccggcgtggcgccgaccgacaacaacgtcggtttcgagatcctcgacaaggaacaggcgctgggcaccagccagttcatggaagccaccaactaccgccgcggcctggaaggcgagctggcgcgcaccgtgtcgagcctgaacaacgtcaaggccgcccgcgtgcacctggcgatcccgaagagttcggtgttcgtccgcgacgaccgcaagcccagcgcctcggtgctggtcgagctgtatccgggtcgcagcctggagccgagccaggtgatggcgatcgtcaacctggtcgccaccagtgtgccggagctggacaagtcgcaggtcaccgtggtcgaccagaagggcaacctgctctccgaccagcaggaactctccgagctgaccatggccggcaagcagttcgacttcacccggcgcatggaaggcctgctcacccagcgcgtgcacaatatcctgcaaccggtgctgggcaacggtcgctacaaggccgaggtgtccgccgacgttgacttcagcgcggtcgagtcgacctcggagatgtacaacccggaccaaccggccctgcgcagcgagcaacgcaacaacgaggaacggcagaattcgtccggcccgcagggcgtgccgggggcgctgtcgaaccagccgccgggcccggccagcgcgccgcagcaggccaccgccagcgcgccggccgactacgtcgcgccgggccagccgctgaaggacgccaacggccagaccatcatcgatccgaagaccggcaagccggagctggcgccgtacccgaccgacaagcgcgaccagaccacccgcaactacgaactggaccgctcgatcagctacaccaagcagcagcagggacgcttgcgccgactgtcggtggcggtggtgctggacgaccagatgaaggtcgacgcgaagaccggcgaggtcagccaccagccctggagcgccgacgaactggcgcgcttcacccgcctggtacaggactcggtgggctacgacgccagccgcggcgacagcgtcagcgtgatcaacgcgccgttcgccccggcccaggccgaagagatcgacagcattccgttctactcgcagccgtggttctgggacatcgtcaagcaggtgctcggcgtgctgttcatcctggtcctggtgttcggcgtactgcgtccggtgctgagcaacatcaccggcggcggcaagggcaagtcgctggccggcggcggcggtcgcgacggtgacctggcgctgggcgagagtggcctggaaggctcgctggccgacgaccgggtgagcatcggcgggccgtcgagcatcctcctgccgagccccacggaggggtatgatgcgcaattgaacgcgatcaagaacctggtcgcacaggacccgggccgcgtcgcccaggtcgtgaaagagtggatcaacgccgatgagtaa

SEQ ID NO: 3161 - DNA, 297 bp, Pseudomonas aeruginosa
tgttcgtcttcgacaacctcgccgacgtcgacgaccgtggcatccaggcgctgctccgggaagtctcctcggacgtactggtgctggcgctcaagggctccgacgaggcgatccgcgagaaggtcttcaagaacatgtccaagcgtgccgccgagctgctgcgcgacgacctggaggccaaggggccggtacgggtcagcgaagtggaaggtgcgcagaaggaaatcctcaccattgcccggcgcatggccgagtccggcgatatcgtgctgggcggcaagggtggcgaggagatga

SEQ ID NO: 3162 - DNA, 813 bp, Pseudomonas aeruginosa
tctgaggtggtcccccacgacaaggacaaagacaatcccagcgaactgatccgcggcaaggacgtggcggccttcggcctctggtcgttgccgagcttcgacgagccgcgcgacgagccggccgttgccgcgccgcaggtgcccgcggtcgccgaacccgcgccggcgccgccggcggtggaagaggtcgagctggagaccgtcaagccgccgacgctggaggagatcgaggcgatccgccaggacgcctacaacgaaggcttcgccaccggcgagcgcgacggtttccacgccggccagttgaaggcgcggcaggaagccgaggaggcgctgaaggagcgtctgcaaagtctcgagcgtctgatgacgcagcttctggaacccatcgccgagcaggacgccctgatcgagcagggcatggtcaacctggtcaaccacgttgcccgccaagtgatccagcgcgaactgcacatggactccagccatgtccgccaggtcctgcgcgaggctctgaagctgctgccgatgggcgcggcgaacatccgtatccatgtcaacccgcaggacttcgagcgggtcaaggcgctgcgcgagcgccacgaagagagctggcggattctcgaggacgattcgttgctgcccggcggctgccgcatcgagaccgagcacagtcgcatcgacgcgaccatcgagacgcgcctggcgcaggcagtgaagcaactgttcgagcaacagcgcgaacaggcgacccatccgctggccagcgacatccggatcgacctcgacgcccccggagacgtcgatgcgccttga

SEQ ID NO: 3163 - DNA, 1560 bp, Pseudomonas aeruginosa
gcgaaccagtttcgccaggcgcctggagggctacaccgaggctgtctcgctgccggcgcagccggtggtcgagggccgcctgctgcgcatggtcggcctgaccctcgaagccgaaggcttgcaggccgcggtcggcagccgctgcaacgtgatcaacgaaagcggctaccacccggtgcaggtggaggccgaagtgatgggcttttccggcagcaaggtgtacctgatgccggtcggcagcctcgccggcatcgcgcccggcgcgcgggtcgtgccgctgccggacaccgggcgcctgccgatgggcatgtcgatgctcggccgggtgctcgacggcgccggccgcgccctcgacgacaagggcgggatgcgcgccgaagactgggtgccgatggacggcccgacgatcaacccgctcaagcgccacccgatcagcgaacctctcgacgtcggcatccgctcgatcaatggcctgctcacggtcggccgcggccagcgcctcggcctgttcgccggtaccggggtgggcaagtcggtgctgctggggatgatgacccgtttcaccagggccgacatcatcgtcgtcggtctgatcggcgagcggggccgcgaggtgaaggagttcatcgacgagatcctcggcgaggaaggcctcaagcgctctgtggtggtcgcctcgccggccgacgacgcgccgctgatgcgcctgcgtgccgcgcaatactgcacgcggatcgccgagtacttccgcgacaagggcaagaacgtattgctgctgatggactcgctgacccgctacgcccaggcccagcgcgagatcgccctggccatcggcgagccaccggcgaccaaggggtatccgccatcggtgttcgccaagctgccgaagctggtggaacgcgccggcaatgccgaagccggtggcggctcgatcaccgcgttctacaccgtgctctccgagggcgacgaccagcaggacccgatcgccgacgccgctcgcggcgtgctcgacgggcacttcgtattgtcccggcggctggccgaggaaggccactatccggccatcgatatcgaagcttcgatcagccgggtgatgccgcaggtggtcgaggccgagcacctgcgcgacgcccagcgcttcaagcagctctggtcgcgctaccagcagagtcgcgatctgatcagcgtcggtgcctacgtggccggcggcgatcccgagaccgacctggccatcgctcgcttcccggtcatgcgccagttcctgcgccagggcctcgacgaaagcgaaagcctggcggaaagccgtgcgcggctggcgagcctgctctccggcgggcaggcctgaggcgcgctgaggcatggagaagcgcgcggcgcggctggcgccggtggtggacatggccagcaaggccgagcgggatgccgcgacccagctgggcaggtgccagcagcaattgctcgcggcacagcagaagctggcggagctggaacgctaccgcaacgactaccagcagcaatggatcagccagggccagaagggcgtcagcggccagtggctga

SEQ ID NO: 3164 - DNA, 1830 bp, Pseudomonas aeruginosa
cctgcggccctggtaggcgaggccgtggcgcaggcgctcgaggccgccggcggccaggtcgccggcgacctcgaccaggtattcctgctccagccgtgcaccgtcgtccaccagcttgcgcagtacgccgtgctgctggctgaacaccaccagccccgaagcctcgctgtccagcgcaagggtgggacgctggcgggcgaagtgttttttcagcgctcgcaagggactggggtcatcgctccagcgccgccccgcagcgagcaggccttcgaaatcgtcgtggcgccagccggccggcttgtgcaacagcagggtggccggttcaatcgtttccgcgcgggcgcccggcagcagctccacgcgctggtcgagcaccttgaactgtggctcctcgatcacttcgccgtcgacgctgacccagccgccctcgatgtacagctcggcttcgcggcgcgagcaggcggtgagttcggcgaggcgtttggacaggcggatcgggtcggtcatggcgaggctactggaatgaaagaccgccagtttactcgttgtggcgatgggcgccgaggaatgattcggcgcccgctcggtcccaacttaaggaaccggagaggagaccctcatgcagtcacgcctgatcgatggcctggaatgggacctggacgaggatggcagcggcggcctgtgcaacgtccatggcgacaaggtccatctgcgccagggcgacatggacggcgcctgcgggccctactgcctggtcatggcgatgctggtccgcggccaactgcgccggcgccaggccaagggcctggagcgggtcgacagtcgcagtcgctacgggcgcctgatgaaggcgctggaccagcacggcccgctgctgcgcgtcggcaccaccggcgtcgacctgctggagctgctggccgagatcaacgataccgagcatttcgccctcaagggcgaggggcgcaggttggtccggcacacccgcgaatacctggaggccggctttccggtagtgctcggtttccacggccgcaagggcagcgatatccgccactggggcctggccatcggcatgagcgagcgcgccttcctgctcctcgacccggcccacgacctgccgcgcgggcaggcctggaacgcggtgatcaccagcgaggcgcatggttcccggttcggctatcgctatatcaatgccaagggcacctgggcggtgactctcaaggaaatggtcgccttgctttgaggggcgggtttgttacagcccgtgtgcggaccgccaggcgcggcggatctgcgactagagtggtgtttttcgcttggggaaggagagaacgcatgccgggcctgtctttgaatgccatcctgctgagcgccgtcgcgctgctcgctccgtcggtcgaggcggtggacgccggtcgccacgacagcgagctgggcgccgtcgaggtcaccccggtggttggcggtctggcctatccctgggccgtcgccttcctgccggacaaccagggcatattggtcaccgagcggcccggcagcttgcgtttcgtcagtcccgagggacagttgtcggcgccgctggaaggcgtacccagggtcttcgccagcggccaggggggactgctcgacgtcgccttgtcgccggggttcgccgaggaccggctggtctacctgacctatgccgaggccggcgaggacggccgcgccggaacggcggcgggaagtggccggttatcggcggacaagcgacggctggagggcttccacgtgatcttccggcagttgccgaagctatccagcggccatcacttcggctcgcgcctgtattag

SEQ ID NO: 3165 - DNA, 1065 bp, Pseudomonas aeruginosa
aaccctcggtcagatcaagaccgtgcaggcctacaaccaccaggcgcaggatcgccagcgcttcgccggcaccgtcgaacgcgccttcgacaccgcgcgcaagcgcatcgcccagcgcgcctggctgatcaccgtggtgatcgtgctggtgctcggcgcggtcggcgtcatgctctgggtcggcggccgcgacgtgatcgccggcagcatctcggccggcgaactggccgcgttcgtcttctacagcctgatcgtcggcatggccttcggcaccctcagcgaggtgatcggcgaattgcagcgcgccgccggcgccgcagagcgcatcgccgagctgctcagggcgcgcagcgagatccgcccgccagcgcaaccacgcaagctggcggcacgggtgagcgggaggatcgaattgcaggcggtgcgcttcgcctatccgacccgtcccgaacactgggccatcgacgacatcagcctggccgtcgaaccgggggaaaccctggccctggtcggaccttccggcgccggcaagtcgaccctgttcgatctgctcctgcgtttcttcgatccgcagcagggacggctgctgctggacggacagccgatcgtcgaactggacccggccgacttgcgccgcagctttgccctggtgtcgcagaaccccgcgctgttcttcggctgcgtcgaggaaaacatccgctacggccgtccgcatgccagcgccgccgaggtcgaggccgcagcgcgtgccgcgcatgcccacgagttcatcctgggtctgccgcagggctacgccacccacctgggcgagggcggcatcggcctgtccggcggccagcgccagcgcctggcgatcgcccgggcgttgctggtagacgcgccggtgctgctgctcgacgaggcgaccagcgccctggatgcggaaagcgagcacctgatccagcaggccctgccaggcctgatgagcggacgtaccaccctggtgatcgcccatcgcctggccacggtacagagcgccgaccgcatcgcggtgatcgaccaggggcggctggtggccattggtag

SEQ ID NO: 3166 - DNA, 795 bp, Pseudomonas aeruginosa
aacatcgttgtgcttactgccagtagacagtcggcatttgggaaatgtccgcgtggttcaggatgtttcggcgcgaatggccggcaaggcgatgagcggcgtcggcgtaccggcaaaaacttccgcccgcatgcgtggcgcccggtaaaatgccgccccttcgacagggggagacaacatggcggtcatcgggcgtttcaattcactgcaggtggtcaagcacacggagttcgggctctatctcgacggtacccagcacggcgagatcctcctgcccaagcgctatgtgccgaaggaccagcccagcgaagtgggcgactggctcaacgtgttcatctacctggacagcgacgaccgcctgatcgccaccacccagacgcccaaggtccaggtcggcggtttcgccagcctgaaggtcgtggagatcaaccggatcggcctgttcctcgactggggcctgcccaaggacctgctgctgccgcattcggaagagaagcgtccgttgcaggtcggcgactactgcgtggtctacgtctacctggacaagcgcaccaaccgcatcaccgccaccgcacgcctggaccgccagctggacaacctgccgccgcgctacagcgtcggccaggcggtcgacctgctggtggtggagcgtaccgagatgggcttcaaggcgatcatcgagggcaagcactggggcctgatccacaagaacgaggcgttcaagttcctccgcagcggcatgcgcgaacagggctacatcaaggaattgcgcgcggacggcaagatcgcccttag

SEQ ID NO: 3167 - DNA, 789 bp, Pseudomonas aeruginosa
tgccggttcatggcatgcctcccatcgtctgacggcctgttccttgggcgaacaggcaaaggtcgataccccctgtcggtgaatcccggagcacccgcaagcggcaggtcggccgggattgtcggtttcttgcgcagcattcagtctagcatccgcggcagcggcggccggtacgccggtctgctggcttcttccttcaacataggccggaagcggggtagtggcggggccgggcgatggacgggccaggtacgggtgggccgtacgcagcccgcgagcgcaggattactcggcgggaacgatgatggcgacgcggcggttctcgctgcggccggcgcgggtcttgttatcggccacgggcttgctcatgccaaggccgcggacctcgatgttggccgccggcatgccggcttcgcggaataccgcggccaccgattcggcgcgccgttcggagagcttttgattgtagccttcgtcgccgtagttgtcggtgtggccttccaggcggaccttgtcgatgtctaccgcgagcagggcgcgggcgatcttggtcagggtgttgcggctgtcgggattgagacggtcgagattgttgccgaacagcaccttgctcgacatgccgaactcccagccttcgtcgcggagttcgaagccctgctcctggagcacggcgatctgctcggcgctcaggccggtctgcggcggcttggtctggcaaccggccaggcccagcacaaggctgaacagggcgagggcaagcaatctacttgggtggagcctctggggtag

SEQ ID NO: 3168 - DNA, 1503 bp, Pseudomonas aeruginosa
cagggaaacctacggacatgccgggaataccgatctgcaagacatcgtctaccagttggaaagcgaccgcgggcgcatcgtcaattccgccgccgtgcgtcgcttgcagcagaagacccaggtcttcccgctggagcgcaacgcggcggtgcgcagccgcctgacccattccctggaagtgcagcagaccgggcgtttcatcgtccgcacgctgttccgccaactgggcccgcgtgccgcagaggtcggcctggacgggctggaaggcgcgctggaaagcctggtggaaatggcctgcctgatgcacgacgtcggcaatccgccgttcggtcatttcggcgagtacgccatcaacgactggttcgaacgcaacctcgacgccctgttcgagcgccgcataccgccgggccagggcgacggcctgttgcagcagcgcatgctcaccgacctcaagcacttcgaaggcaacgcccaggccatccgcctggtggtgaagctgctgcgcctgaacctcacctacacgcagaccgccggcctgctcaagtacgtgcgcccggcctacgagccgaagccggacaaggcagcggcgaaccactacctgaacaagaagccgggcttctatctttccgaggaagccttcgtcgacgaactgcgccaagtcctcggcatgcgcccgggcactcgccaccctgtggcctacatcatggaagcggccgacgatatctcctattgcctggccgatatcgaagactcggtggaaaaaggcatcctcgacatccgtcaattggcggatctgctggtgaagaagtttgccgtccaccattcgccggacgcaccgattcccggcgacgcggacaacatgagcttccagcggatggtcgactactcgctggaaaaggccgagcgggagccgatcaacaaggtcagcgaattcttcatccgcctgcgggtgaaaatgatccacccgctggtccagcacgccgcccagcagttcatcgacaacctcgaagcggttcatgccggcaccctcggccgcgcgctgatggaggacggcagcctgccgcacgccatcgtccagacgttcaaggacgtggccatggaatgggtgttctgccatccggaggtggaaaccctggaattgcagggctaccgcatcatccagggcctgctggatttctacgcgccgctgctgcgcctgccggccgaggagttccaggccctcgccgaaggtcgccaggccgccgcgccgcatccgcaactgctggttcggcgcctgccgagccagcagatcaaggcttacctggaggccatgaaaggtgtggcggagaacccgttgcagcggcagtgggagttctaccaccgctgccgcatgctccaggatttcgtcagcggcatgaccgaccagcatgcccaggacgaataccgcgcgttgtccgcgctgtaagcggaggagcgagatgcgcgctgtcgtcgaactgctcgccggcgcccgccgcctggtga

SEQ ID NO: 3169 - DNA, 1266 bp, Pseudomonas aeruginosa
acgttttccataactgatccggcagtccttgagaaaaaccgccattttgccttccgccgctccgtcaggccagcggccaggggcgttgccgccccggccgtccgatcaggcgttgcggctgggcggcgccatgaactcgggaccgaccggatcctggatggtctcggcgaggatccgctcgatgcgggccatggcctcgtcgtccaggcgccagccgaaggcgtcggcgatgccgttcaactgctccggcttgcgcgccccccacagcgccaccgtagggccgcgatcgagaatccagcggatggccagggccagcaccgacttgccatagcgctcgcgagccagttcctccagttgcgcgaccgctgccaggtactgggcgaagcggggctgctggaacttcgggtcggacttgcgcaggtcgtcgccatcgaagcgggtctcggcgttcatccgtccggaaagcaggccgcggcacagcgctccgtaggccagcacgacgatgccgttacgctcggcgtagggcagcacgtcggcgtcgatggcgcgctcgaacaggttgtagggtggctgcacgctggccagcggagcgaactggcggaacccgtccatctgttccggcgaatagttgctcacgccgatggcgaggatcttgccgtcgcggcgcaggcgctccagttcgccggcggtttcctcgtgcgccaccagcgggtccggccagtgaatctggtacaggtcgatacgatcggttttcagccgccgcagcgagtcctcgacctcccggcggatgcgtgcggcggaggcgttgcggtggatgcccgcgtcgctccactccagcgccgccttggtggcgatcaccgccttgtcgcgcaggccctgcaaggccttgccgacgacctcctcggaatggccgaagccatagaccggcgcggtgtcgatcaggttgatcccggattccaccgcacgccggatggtttccaccgacgtcgcgtcgtcagcgccgccccacatccagccgccgatggcccaggtgccgaggccgatgcgcgagaccggcgtgtcgataccctcgatgcgaatgctttcaacactcatggaaatactcctgcagatcgggaaaacgcttgccggcaatgcgcccggcggcacggagcgattactctagatcacccgagattgaatgtggctcaatgctgcattgacctccgagaactgccaggagccctggaatgccggctttcacccgttccgaactcgccgacctga

SEQ ID NO: 3170 - DNA, 471 bp, Pseudomonas aeruginosa
tccgcggcgactggctggggcgtgcctgaatcgtcctcccgccaaaccttgcaaggagccccccatgctcaccggtctcaatcacctgaccctggcgtcgccgacctgccggccagcatcgccttctaccgcgatcttctcggctttcgcctggaagcgcgctgggaccagggcgcctatctcgaactgggttcgctgtggctgtgcctgtcccgggagccgcagtacggtgggccggccgcggactacacgcactacgccttcggcatcgccgccgcggatttcgcccgcttcgccgcgcagctgcgcgcgcatggcgtgcgcgaatggaagcagaaccgcagcgagggcgattcgttctacttcctcgacccggacggccatcgcctggaggcccacgtcggcgacctgcgcagccggctcgcggcgtgccggcaagcgccctatgcgggaatgcgtttcgccgactag

SEQ ID NO: 3171 - DNA, 576 bp, Pseudomonas aeruginosa
gtcgaagttgccaggccaggaccagcccggccagaacgagaagggcgccggcgaggaatggcgcgccggccaggggcactggcgcgagcggaccgctgccccagtggaacaggccgctcatcagcggcggaccgacgatcgcggcgaggctcatcaggctgctcagcacgccctgcaactcgccctggcggtcgaccggcacgcgggccgagagcagcccctgcatggccggggtggcgaggctgccgagcgcgaagggcagcagcgcgcagaccagccagaatgacgagtcgaccagggcgaacagcagcaggccgcagccttgcagggcgaggcccaggcgcagcaggcgggcgtcgtccaggcgccgcttgcagaggttcacgccgagggtctgggcgagcaccgcgagcacgccgtagagggccagcgagtagccgatccaggcgctgctccagtgaaacttctcgatcacgaagaacggccagaccaccatcaccgcctgcaagccgaggaataccagggcaagcaccgccagcaggagtccgacccccggttgccgagccaggccgctga

SEQ ID NO: 3172 - DNA, 564 bp, Pseudomonas aeruginosa
gcagccgtttcacctcccggctgtgcggaatgcccgccagcacgccgtggccgccgggaacgaacaccgcggcgtacggcgagtcgtcggcgacggcctgctccaggaggtcggcgagcttccgcggcgctttcagcttgggcaggtacttcgcgtagatgctcttcaccgcctcgtcctcgccgggcatcgcccacatctccagcttcaccgggttgccggagagcgtggcgacatcgaactcgaagccggccttgtccaggtggtacatcggcaggagcatttccaccgggtggttgccggtggagaacatgctgccgttctgcatcaggatgtagcgttcgtcggtaccgatcatcagcaccttcttgccgcccttgtacggggtcgggtagtcggcgccgtcgaagtcggtcttcgccgaggtgtactggctcagggaatagggcgagggaaagaacgcgttgtgctcggcgtggtcgggcgtcggggttctgctggtgtcgcgctcgttgctcatggctcgttcctttctgcgtgatggaggtcgcaccaagacgatag

SEQ ID NO: 3173 - DNA, 489 bp, Pseudomonas aeruginosa
tccgcacgatctgtagcgccgggctgcccaccgagacccgcagcggtcccgcggcctccgccgggaggatggtcgggaccatttcgaagcgcacccggccgtagcggatgccgtagtggttggcgtagagatcggtcagcgagcgagtcaggtcgaagcgctcgatgccgggaaagtaggcgggattcaggtagtgctcgacgtacagcaccagccgcccgtcgacccgccgcgcccggcggatctggaacacccgcgacagcgccggcagctccaggcgctggcagatgtcgacgctggccgggatcatcgccgcgccgagcacctcggtctccggcacccggccctggtcggcgaccatcgcgtggaagtggctgcgcaccagcgggttgtacagcagccgctgcggcgagacgaaccagccgcggcgttcctcgcggtagatcaggccctggtcctccaactggccgagcgcctcgcgcagggtga

SEQ ID NO: 3174 - DNA, 1629 bp, Pseudomonas aeruginosa
cgcccccagagggtcgcgcagtcgccgtcgatcagggtgtcgtcgaggtcgaagagggcaagtggcataggcggttccttgttcgctagggattggcccggcacgcctggcgccgggcggtggttcggcgaggtttcaacgcggcttgccggccgccagcagcggcccgccggcatgcgccttcggttcgacgcggcacgcgcctggccggctgttccagaacggcaccagcagcaggctggcgagcagcgcggtggcggtgaacacgaagaacaccgtgagggtgtcgaagtagcccggcagcaggccgccgaggatcgccccgaccgagccgcagccgttgacgaagccggtggcggtaccggctgcttcgctggtaccgaagtcgatggcggcagcgccgctgatcatcgagtccggcccgtagagggtgacgcccatcatgaacagcaggccgaccaccaggtacaggctgccgctctgcatcgccgggacgaacaacgccaggctcacggtcagcgccgccaggctgagcacgcaggccggcatgcggcgggcgccgaacagcttgtccgaggccaggccgatgaggatcggcccggccagcccggcgacctcgaaggccgaaggcacgatggccgaggcgaccttgccgatctccggcatgcgttcgtagatgatcaccgggccccagagcaggatcgcgtagcgcgccggcttgagcaggaagtaggcgaggccgaggaccagcacgtggggattcctgagcgccttcagcagggcgccggaatggcttggccggggcgcgttggcggggggcgcggcctcggcctccacgggcggcaggccgacgtcctgcggacggttgcgctggaggaagaagaacagcacggccaccgccagcaccactcccgccgaggacaggaaggccatgcgccagtcatgcgtcaaccggtaggcgcaccagccggcgaacggcgtcgccaccagcccgccgaaggcgtagcaggtactccacaggccgagcacgcggcctcgctcgtaggtggcgaagaaggcgccgatgttcttgcacagccccgaccagccggtggactgcgccaggccctggaccaccatgcaggcggcgaagatcggcagggtggcgaaggtacccatcaccagcgccgccagcgccgaggtgagcaaaccgccgagcaccaccacgcgggtgccgaagcggtcggcgaacaccccccacatgaactggcccacggcgtaggcggccaggtagagggcatcgagatcggccatggcgctcttgtcgagctcgaaggaggggtcttcggcgatgccgagcttggccaccgagaaggccttgcgggtgaagtagaaggcggcgtaggccagccaggtgatgacgaagatctggatgcgccagcgctggagcgattgccagccacggtgcagggtaccgttgtggttgttcatgtgggtccctatgggtctagacagtgcggggaggttgttcttgttgtgctgctgcaaagctgtccggatgcatggtctaggccagatgcctttcccatgacttttttcgtgcgcaaggttggctgtcgacgcgctcctgctcggtcctgccgaggctga

SEQ ID NO: 3175 - DNA, 441 bp, Pseudomonas aeruginosa
gcgcctcgaacgacagccaggcgactgccaggacgttcaccgccagccccgcgcgtcccaggcgcaaggcgcccttgtccgggtcccagcggccgacgaggcgggcccagagagcgcaggcggcgacgatcaggaagaccacgaagaaaccgccgctgccgaacgcgatcagcgtgccgaccgccgtggcgttcagccccagggccaggccgaggctggccagcagcgtgctgcagaccatcgccgccatcggcaccttgcgccggtcgacccggcgcagcagggcggagccgggcaggatggcgtcgcgcgccatgccgaagatcgcccggccgatgtaggtctgcaccgacaccacgcaggcgacgaaggcgatcagcaccactgcgacgaatggccgctcggcccaggcgccgaaggcgtccaccaccgccggggtga

SEQ ID NO: 3176 - DNA, 519 bp, Pseudomonas aeruginosa
accaggccaggcggtcgcccaccaggcgccgcacccactggtagcagccgccggccagcggaaactgcgaggacagctcggcgtagaccagcgccacgccgaactgcagcagcaggcacagcggcaccacccagacccaggaggggcccatgctcatggcgccgagggacatcaccgagtagatgcccaccaccggcgagatggtggcgaagccgacggaaaaggacgaccacaggctcagcccgcgctccagttcctggcgatagccgtgggccgccagcaggcgttcgtcgcgggaggtatcgcggagatcagtcatggcggtctccgggcgagcgctgcggggaaggggaaaggcggatgccaccgatgcgatgggtgagcatggagagtcctcgtcggctattggaattgttatggccgcttccgggacgagcgaaagcgtggcagacgcaggttaggcggattacctatcaggatgaattcatattccattgggctggcatcaggaaaacctga

SEQ ID NO: 3177 - DNA, 2001 bp, Pseudomonas aeruginosa
tgtatgggccaggccccgagaaggccggctcctgcgaagggagccggccggtcgcggcagttacttcaggtcctcgcgcggcggtttgccgggctggctggcgtagtccggcagggcgctgatcgcctgttccttgtcggggatgctggacgggtcgaggtcgccgccgacgttgcgcgggtcggtggggatcgccgagggaatcaccacggtgcgctcggccagcggccagccgagaatggtctccaggcgcccgccttcctcctcggggccggtaatggcgtccaggcgcagcggcagcggatggccgatcagccgttcgacctcgcccgccgcctccggcgcggccagggtcaggccggtgcggtagaagcccggcaggctcgagcgcggcacatagacccgcagcagggcaccgttgcggatccggccgcgcgcgtcgggttcctggtcctgggcgtagccgtaggccagcgccggatcgccggcgatatagaaaccgcgccagatcgcgtcgaggtcctggctgcgcgcgcgcaccccgccgaagacgatgctttgcgccgcttcgaggaaggtgccgtggtagccgacgaacacatagccgcgctcctccagttggcggtgcgcctggagcagccgctccaccgtccagttctgcgtgccgcgggtgctgaagctgatgtcgccgccgtcgccgaggaactccgcgccagtgggatagttgcgctccagcagggcgtcgccgctgtccgccgggcccgcgcattcaccggcggcgaccgggcaggtcaggctcaccacgtcggcgctggccgcgccggcctcgtcgttgcctgtgccctgccggacgaagcgctcgctctcggcggcggccagggtcagggccagacgggcctgctccggctgctcgcggatcgcttcgcccaggtcgccgccgctgccggggctggccagggcgttgcggatcacctggtcgacctggttccacgacagccgcgccgccaggtagagggcgaccagccgctgcaccggatagccgcactgctccagttgttcccagccgcgcggctggcgatgacgggtgaaagtctccagcggcaggtggcaggcctggtgcgcggtcagcgcggccaggctgccgccttcggggaagtgcaggcgatgactgatgaccgtgggcttgatgtccaggtcatgcttcgccgggttgccggcgagcacccggtagatcttgccttcccaggtatcgtcgaggttgcagcgctgctgggcgaggtagttgtagaccccgtccagcgggtcgagcaggcacaacaccttgccgctggcccattcgctccagcgcttttcccggcgcggctgggcctgggccatgaccacgctgaccccggcatggctgatggcgagcgtcggctgcatctcgttgctctcgtgcgccctgacgaagaaggtggcatcgcgcgccagcttcgccagcaactcgtcgcccatctcgatggtgtagatcggcgacatgtggctgagctggttgccggcgttcagttcgtggatgaacaccttgatgttcgaaggcttctcgtggccgatcggcaccagccagttcagcgaccaactgccgcgcgcctggcgcgtgtagctgtagcgcaccggcttgttcggctcgacgccgccttcgaggcggatggtcaggccgtcgctggtgatgctgagggcgttgtcgatggccagcttgagcgcgtcgttgccgccctccaggaccatggagtagtgcagcacgccctggccgttggtgtcggcgatggccgggtcgacgctcatgcggctggaacgcacgccgtccttgaggtcgagcacgcaggctttggcgcattcgttccagagatcgaaggcttcctcggcggcggacgcggacgagccgccggcgagcaggccgaggctggcgaccagggggatccaatgggatatcaggtgcatcgcgatggctcctgtgatgggtga

SEQ ID NO: 3178 - DNA, 1866 bp, Pseudomonas aeruginosa
gagatacatatggcacgacccattgctgaccttatccacttcaactctacaactgtcacggcaagcggagacgtttattacggccctgggggaggtaccggcattggccccattgccagacctatagagcacggcttggattcgtccactgaaaatggctggcaagagtttgaaagttatgctgatctgggcgttgaccccagacgctatgttcctcttcaggttaaagaaaaacgcagggagatcgagcttcagttccgagatgccgagaaaaaacttgaggcgtcggtacaagccgagctggataaggctgatgccgctcttggtccggcaaagaatcttgcaccattggacgtcatcaaccgcagtctgaccatcgttggaaacgccctccagcaaaagaatcaaaaactactgctgaatcagaagaagattaccagcctgggtgcaaagaatttccttacccgtacggcggaagagatcggtgaacaagcggtgcgagaaggcaatattaacgggcctgaagcctatatgcgcttcctcgacagggaaatggaaggtctcacggcagcttataacgtaaaactcttcaccgaagcgatcagtagtctccagatccgcatgaatacgttgaccgccgccaaagcaagtattgaggcggccgcagcaaacaaggcgcgtgaacaagcagcggctgaggccaaacgcaaagccgaagagcaggcccgccagcaagcggcgataagagctgccaatacctatgccatgccggccaatggcagcgttgtcgccaccgccgcaggccggggtctgatccaggtcgcacaaggcgccgcatcccttgctcaagcgatctccgatgcgattgccgtcctgggccgggtcctggcttcagcaccctcggtgatggccgtgggctttgccagtctgacctactcctcccggactgccgagcaatggcaggaccaaacgcccgatagcgttcgttacgccctgggcatggatgccgctaaattggggcttcccccaagcgtaaacctgaacgcggttgcaaaagccagcggtaccgtcgatctgccgatgcgcctgaccaacgaggcacgaggcaacacgacgaccctttcggtggtcagcaccgatggtgtgagcgttccgaaagccgttccggtccggatggcggcctacaatgccacgacaggcctgtacgaggttacggttccctctacgaccgcagaagcgccgccactgatcctgacctggacgccggcgagtcctccaggaaaccagaacccttcgagtaccactccggtcgtaccgaagccggtgccggtatatgagggagcgacccttacaccggtgaaggctaccccggaaacctatcctggggtgattacactaccggaagacctgatcatcggcttcccggccgactcggggatcaagccgatctatgtgatgttcagggatccgcgggatgtacctggtgctgcgactggcaagggacagcccgtcagcggtaattggctcggcgccgcctctcaaggtgagggggctccaattccaagccagattgcggataaactacgtggtaagacattcaaaaactggcgggactttcgggaacaattctggatagctgtggctaatgatcctgagttaagtaaacagtttaatcctggtagtttagctgtaatgagagatggaggggctccttatgtcagagagtcagaacaggctggcgggagaataaagatcgaaatccaccacaaggttcgagtagcagatggaggcggcgtttacaatatggggaaccttgttgcagtaacgccaaaacgtcatatagaaatccacaagggagggaagtga

SEQ ID NO: 3179 - DNA, 510 bp, Pseudomonas aeruginosa
gcaaatgagtacatccaacatccaggcattggccagcactgggcacagctcgccaaagaagcgggattccgagccgactatgacagcacatcaacgccagaaacacatctggcctgcggagtaacccaagagtggattcgagaacacatcgttgccaccaacgatatgcgcctgttcggcctgctgcatttgctgggtcaggcatcgttgcgcatggagcaagcgttgtggccggaagattacgagcggatgactcgtaaggtcaagggagtccagcgggaagctgaaggcgacaacgccaaatcgtacatttatgaagaagtcatgcagataaggcaggagcgcttcgataaagcacgacataatttgcaaggggtttgtcataggtatcaaggatccaattattttacagtcctgatactagtattgtggttgttctcaaagaggatggaatgtttttgtcagggtggtatcttgagccaggaagcagacaggaaaaaactattttga

SEQ ID NO: 3180 - DNA, 1707 bp, Pseudomonas aeruginosa
cctaaatcgagaatctcaatcccagctcagtgctccgcccgtctggtactcgataacccgcgtctcgaagaagttcttctccttcttcaggtccatgatctccgacatccacgggaacgggttggtggtccccggatactcttccttcaggccgatctgggtcaggcgccggttggcgatgaacttcaggtagtcctccatcatcgccgcgttcatccccagcaccccgcgcggcatggtgtcgcgcgcgtattcgatctccagctgggtgccctggaggatcatctgggtcgcctcgtccttcatctgggcgtcccacaggtgcgggttctcgatcttgatctggttgatcacgtcgataccgaagttcaggtgcatcgactcgtcgcggaggatgtactggaactgctcggcggtgccggtcatcttgttgcggcggcccatggagaggatctgggtgaagccgcagtagaagaagatgccttccagcacgcagtagtaggcgatcaggttgcgcaggaactggcggtcggtttccggggtgccggtctggaacatcgggtcggagatcgagcgggtgtacttcaggccccaggaggccttcttcgccacgctggggatctcgtggtacatgttgaagatctcgccctcgtccatgcccagcgactcgatgcagtactggtaggcgtgggtgtggatcgcctcttcgaaggcctggcgcaggatgtactggcggcactcggggttggtgatcaggcggtacacggccagcaccaggttgttggcgaccagggagtcggcggtggagaagaagccgaggttgcgcatgacgatgcgccgctcgtgttcgctgaggccgtccttgctcttccacagggcgatgtcggcgttcatgttgacttcctgcggcatccagtggttggcgcaaccatccagatacttctgccaggcccagtcgtacttgaaggggacgagctggttgaggtcagcgcgggcgttgatcatctgcttgtcgccgacctgcacgcgcgcggcggagccttcgaggtcgtccaggccttcctggatgtcgaggtcgttcagggccttcttggcgcgggcgacggcgtcggagtcgtcggcggaaacggcgcgcgcttcttccaccgagccggcggcttcgtcgtccagcttgtcatggccctgggcaacggcctgggcggcggcgggcgcggccttggcttcggtcgggtcttctttgtcgaattcgtcccagctcagcatcttgctctctcctggtctggcggccgtctcggcggcctggatatggggcgtgaggtgcacgcgaaagcggtggtccggcacggtctggccgggccgttcttctcccccggagggaagaaggggattgttcctggccctggcgaggggccttgcgctgccagcgtggcgctggacgagcgaccgtcaggcgccgggcaggccggacccacacgaggagtccggcttgcccggccgcgacacggacgccgttcagcgacgcgcgatcactggcaggcttcgcagtcggggttgtcgatgctgcatgcctgcggcaccggcgccggcttcggctcggcggccggggcggcttgcaggccgtcgttgccaccggccgacacggcgttgagcttgccggtgttgatggtggacttctcggtgctggtggcggccagggcgcggaggtag

SEQ ID NO: 3181 - DNA, 990 bp, Pseudomonas aeruginosa
gctgcggatggacggacgcagccgcgcgcgcttgatgaacggccaggtgctggtgaagcagaccgccgagcacgccgtcaccgtctatacccaggccagcgccgccgagaacctggtgctcagcggcgaggtgcagcaggtcagcgagcaactggcgcgggccacggtgtacctgctgatggacgaactggtgcgctacccggccagcgaacagccttaccaccttgcgcggatcgtccgcgacaagcgcttcggcttcccggtgcacctgctccaggtcaaggagctggacctcgacgacgaccagcgccggcgagtggtggagggcgacacggtgatggcgctgggcaaggacggcgactcgatccgcatcttcgccggcatcctcgacacgccctgggtgctggagctgggcccgctgttccagatgaacccctatccgccgcagctgctgttgctgctcggcgcgctgtgcctgagcttcatcggcctgatcacctacctgctggtgcgtcgtctggagcagcgcctgcgcagcctggaggcggccgccacgcggatcgcccgcggcagcctggatactcgcgtcgaggtgcgcggtggcgactcggtgggacgcctgggcgcggccttcaaccatatggccgagcacatccaccggctgctgacggtgcagcgcgagatggttcgcgcggtgtcccacgagctgcgcacgccggtggcgcggttgcgcttcggcctggagatgatcgagaccgccgagaccgacggcgcccgcctgaagtacctggagggcatggacaacgatatccaggacctcgacaagctggtcgacgagatgctcacctacgcacgcctggaacagggctcgccgccgctgacctaccagcgcctggagctgggcgcgctggtgcgccaggtggtggaggagatcgccccgctgcgccgcgaggtgctggtcagttgcgaggagggcgcgctggtgcctga

SEQ ID NO: 3182 - DNA, 1536 bp, Pseudomonas aeruginosa
acacgctggcgatcagctcgcaactggcgtcggccagcggcagccgggccatgctcgccaccagccaggacaactgcggcgcgcggcggcaggcgcgtttcaccgcctcgcgggagatatccagggcgtagccctcggcgccggccagggcttcgccgagccgggcgctgtagtagccctcgccgcagccgatatccagccagcgtcgcggcgcgcgttcggcggccagttcggccaggcgccgggccagcggcgcgtagtggccggcgccgaggaactggcgacgggcctcgaccatggcggcgttgtcgcccggatcgaggcttttcttgtgctgcaccggcagcaggttcaggtagccctggcgggcgcggtcgaagcggtgcccggcggggcaggcgacgccgttgtcgacatcgcccagggcggcggagcagagcgggcagatcagcatcaggcgagcagcctcaccagggtctggtagtagatttcggtgagcagctccaggtcgctggccaggacccgctcgttgacctggtggatggtggcgttgaccgggccgagttcgaccacctgggtgcccatggtggcgatgaagcgtccgtcggaggtgccgccgctggtcgagggccgggtctcgcggccggtgaccgccctgatgctggcggccaccgcatcgagcagttcgcccggctcggtgaggaacggcaggccggacagcgcccattcgacgtgccagtccaggccgtgcttgtcgaggatcgcctcgacgcgtttctgcaggccttcgacggtggattcggtggagaagcggaagttgaacagcgcggtcagttcgccggggatgacgttggtggcgccggtgccggagttcaggttggaaacctggaagctggtcggcgggaagaaggcattgccgtcgtcccagtgttccgccgccagttcggccagcgccggggcggccaggtggatcgggttcttcgccaggtgcgggtaggccacatggccctgtacgccgcggatggtcagcttggctccaagggagccgcggcggccgttcttcaccacgtcgccgaccaggctggtgctcgacggttcgccgacgatgcaccagtccaggcgctcgccgcgtgcggcgaggcgttcgaccaccgccttggtgccgtggtgggccgggccttcctcgtcgctggtgatgaggaaggcgatggcacccttgtgctccgggtggtcggcgacgaagcgctcgacggcgacgatcatcgacgccaggctgcctttcatgtccgccgcgccgcgcccgcagaagcatgccctggtcgtcgatcagggcgtcgaagggttggtgctgccaggcctgcagcgggccggtggggaccacgtcggtgtgcccggcgaagcacagcaccgggccgtcgccgccgcgccgtgcccagaagttgtccacctcctcgatgcgcatcggctccagggcgaagccggcggcttccaggcggcgcatcatcagggcctggcagtcggcgtcgaggggcgtga

SEQ ID NO: 3183 - DNA, 213 bp, Pseudomonas aeruginosa
gcagcagggcgcagaacaggcgcatggcatctctccgtgaaagggtccccgatcaagatagacgcttgtgcgcgggacgcggggaaaaccctcggtgccggccttgcgccgctcaaacgcgggccattcggccaggcaaagcgtgcgccgctcatctaccctatgggcgagtcccttcccctcgctaggacaccgtctggatgcctgacctga

SEQ ID NO: 3184 - DNA, 504 bp, Pseudomonas aeruginosa
ttattgtggataactattgttccaggcttttcctgtcaactgtgcgaagcgtcagcttattgccggtttttcctctcgctattgctttctccacgttccgaagaagttcgggcgtacaggtttctttgctgttttcagcgagaaccattcgtttcaacaattcgaatatgtggagattcagaaatgaaaaatcaggtgaatgccctggcggttctaagtgtgggtgaaatcgaacaagtttctggcgcagggactttcctgggcgatgccatcatcaacggggtctacgcggccaactccttcctgaactcgccgctgttctccagcatcggcaacgcggccagcgccatcggcctcaaccgtacccacgagctggtcgacctgctggccttccaggtgccttcggtggcggcgatcaccgtcggcaagattctcggcgggaccgacaaccataatgttccgttgcattacaacaaggaaagcggcgaagggctttacagctga

SEQ ID NO: 3185 - DNA, 1308 bp, Pseudomonas aeruginosa
aggaggtcgaggcgaccattcgcacgcgcaaccaggcgcgccgcaggccctacgagtacctgttgccgagccggatcccggcgagcaccaatatctgagccggagaaagaggacggggcgcccccgggcgccccgttgctcttagcggccttcgctttcggcggcgtccgccggcgcggcatgccgctgcttcaactggcggcgcgccaggaggctgccgaggaggatcacgaacagcgcgccgaaggccgccgcgccgtagtgcaggtaggaatcccattgcgcgtagggcgccagccagggcttcagggcgctgtcggtgagcagcatgccgccggcgatccagccgagcaggccgccgccgaagaggatgatcagcgggaagcggtcgatcaggcgcaggatcagctggctgccccagacgatgatcgggatgctgatcagcacgcccagggagaccaggaagaaatccccggccgaggcggcggacagggcgatgacgttgtccaggctcatcaccgcgtcggcgatgatgatggtcttgatcgcgccgagcaggtgggtgctgcccttgatgtcgtcgccgttctcctcctccggcagcagcagcttgatgccgatccacagcagcaggagcgcgccgattaccttgaggtagggcaggtcgagcaggtgcagggcgaagaacagcagcaggatgcggatcaggatggcaccggcgacgccgccgaagatcgcctgcttgcgccggtgcgccggcaggtgccggcaggcgagggcgatgactacggcattgtcgccgcccaggaggatatcgatggcgacgatctgcagcagggctgtccagaacgtcgggtcgctcaaccagtggatcaaggttgtactccgaaacgtgtagtgagggtggaaagcccggggcggtggcgggtggcggccgcccggctttcctgcggtggtctgggaccgtcggggccggctccggcttgtggacggaggcggggaacactgcttggaccggcgaacgcccggccagtgcccggaaaacggacgcgcgggtggcgcagcgcgttcgggcacggatgtgacgcggcggatcggccgcgagacacccggcatgcgtattccgccgccagtctgcccgagcaaggtttcacccgcctttcagggcggagatggcgccgcacccggcgggacggtaggttagtggcccgtgtggctgactcgaccagtcgaacgccgatcaccgagtcaaccgtacaggccgccaggccttcggcgccgggggaagcccgccggtgccatggatga

SEQ ID NO: 3186 - DNA, 1221 bp, Pseudomonas aeruginosa
ccgttcaccgtacaaggaaaccccatgcgcagtcttcttttatcctcggtggccatgatacccgcctggcccgtggcgcaacccgacgcatcgagcttccttccatccttcgccggcctgcagaagaaggcccaggcgcagggcatttccgccgacagttatgagcgcttcaccagcggcctgcaggccgacctcagcgtgctcgacctgctcgacgcgcagccggagttcaccaccccgctgtgggactacctggccggtctggtggacgagcagcgggtcagcgatggcaaggcgatgctcgcccagcacgacaagctgctcgaccaggtggccgcgcgctacggcgtggacaagtacacggtggtggcggtgtggggcgtggaaagcgactacgggcggatcttcggcaagcgtccgctgctgacctcgctgtcgaccctgtcctgctacgggcgccgccagtcgttcttccagggcgagttcctcgccaccctgaagctgttgcaggccggcgacatccgcgacgccggcatcaccggctcctgggccggggccttcggccatacccagttcatgccatcgacctacgcgcggatcgccgtggacttcgacggcgacggtcgccgcgacctggtaggcagcgtgccggatgccctcggttccaccgccaactacctgaagaaggctggctggcgcacgggacagccgtggggctatgaagtgaaggtgccggccgacttccccgccagcctggccgggcgcggcaagcgccagccgctgtcggcctgggtcgcccgtgaggtgaggcgggtcgacggccagccgctgccgggcggcgacgagaaggccgcgatcctcctgccggccggggcccagggcccggccttcctggtctatcgcaactacgatgcgatctattcctacaacgccgcggaaagctacgcgctggccatcgccctgctttccgaccgcctgcgcggcggcagcggcctggtggcgtcctggccgaccgacgacccgggcatcagccggctcgagcgcaagcaattgcagaaggcgttgctggcgcgcggctacgacatcggcgaggccgacgggctgatcggcaccagcacgcgcaaggcgatccaggccgagcagaagcgcctcggcctgaccccggccgacggtcgcgccgggcgcaagatcctcgaggcgctgaagggcgcccagccctga

SEQ ID NO: 3187 - DNA, 2691 bp, Pseudomonas aeruginosa
ccgaggtcggcggcgaaggctgcgggggcgccgagcaggacgaggagcagggcagtcagcagaggtttcatggcgcgctcctcaggccaggttgagcagttcgatgcgaacggcgcacttcttgtagtcggtctgcttggaaatcgggtcggtggcgtccagggtgaccttgttgatcagcttgttggcgtcgaagaacggcacgaacaccagcccctggggcggcttgttgcgcccgcgggtctcgacccgcgcgcggatctcgccgcgccggctcaccaccttgacctcgctgccgcggcgcagcttgagctggcgcgcatcctccgggtgcatgtagaccagcgcgtcgggcaccgccttgtacagctccgggacccgcgcggtcatgctcccggtgtgccagtgttcgagcacccggccggtggcgagccagaacgggtagtcctggtccggcgcctcggccggcggctcgtagggcagggcgaagacgatcgccttcttgtccggatagccatagaactgcacgccgctgcccttgctcacgtaggggtcgtagccctcgcggtagcgccagcgggtctccttgccgtccaccaccggccagcgcaggccgcgcgcctcgtggtaggcgtcgaagggggcgaggtcgtggccgtggccgcgaccgaaggcggcgtattcctcgaacagacccttctggatatagaagccgaatgcgtcgacctcgtcgttggcgtagcccttggccaggtcgctggccgggaagcggtcgacctggccgttgcggaacagcacgtcgtagagggtcttgcccttcagctcgggggccttcgccagcagttccgcgggccagacttcgtcggtggtgaagcgcttggagaattccaccagctgccagaggtcggacttcgcttcgcccggtgccttcaccaactggtgccagaactgcgtgcggcgctcggcattgccgaaggcgccttccttctccacccacatggcgctgggcaggatcaggtcggcggcctgggccgagacggtggggtagacgtcggagacgatcacgaagttgtccgggttgcgccagccgggcagcacttcctgcatcacgttgggaccggcctgcatgttgttgctgacctgggtccagtagacgttgagcacgccgtccttgagcatccggctctgctgcacggcgtggaagccgaccttctcctggatggtgccggccggcaccttccaaatcttctccgcggtttcccggtgcttcgggttggtcaccaccaggtcggcggggagccggtgggagaaggtgccgacctcgcgcgcggtgccgcaggccgagggctggccggtgagcgagaaggggctgttgcccggttcgctgatcttcccggtgagcaggtggatgttgtagatcaggttgttcgcccagaccccgcgggtgtgctggttgaagcccatggtccagaacgacaccaccttgcgcttggggtcggcgtagagttcggcgagggccttcagccgctcggccggcacgccgctttcgcgcgcggtgcgctccagggtatagggcttgacgaactcggcgaaggccttgaagtcgatatcgctccaggtgttggccttgtcggcgttcttcgccttcttctccagcgggtcgtccgggcgcaggccgtagccgatgtcctcggcgccatgggcgaagcgcacgtggcgctcgacgaagtcgcggttcaccgcgccgctctcgatgatgtggttggcgatatagttgaggatgatcaggtcggtctgcggcttgaacaccatgggcaagtcggccagctcgaagctgcggtgctcgaaggtggacagcaccgcgaccttgacctgcggcgcgctgagccggcggtcggtgacccgcgaccagagcaccgggtgcatctcggccatgttcgagccccagaggacgaagctgtcggtggcctcgatgtcgtagtagcagcccatcggctcgtccatgccgaagctgcgcatgaagcccatcaccgccgaggccatgcagtggcgggcgttggggtcgatgttgttgctgcgcaggccggccttgaacagcttgttcgccgcatagccttcccagaccgtccactggccggagccgaacatgccgaccgactccggtcccttggccttgagcgcggccttgaacttctcggccatgatgtcgaaggcctgttcccaactgatcggctggaactcgccctgcttgtcgaacttgccgtccttcatgcgcagcagtgggcgggtcaggcggtcgctgccgtacatgatcttcgacaggaagtagcccttcacgcagttgatcccgcggttgacctcggccttgatgtcgccatgggtggctaccacctggccgtcgcgggtggcgaccatcacgctgcaaccggtgccgcagaagcggcagggggccttgttccaaaccaggctggtgacgtccgcctcggtcaccaggttgctggcgcggaccaggatcggcaggccggccgccgccgcggcgatggcggcggcgttggccttggcgaattcacgacgggtgaggttcatcgattgtctcctcgggcgagcacggtatcgcgcggtcggtcatggccgccgcgtcgttgctatcgtcgtcgtgcaggatctcgtggtagaccagcacggcgttga

SEQ ID NO: 3188 - DNA, 786 bp, Pseudomonas aeruginosa
accctacttgcagtacgggcaaaaacctcgccgagccggcgcgcggcagcctggaaacagaacgttcgccggcaaacgcgagtcgttcagcccgggttcagcaagcgttcaggggcggttcagtaccctgtccgtactctgcaagccgtgaacgacacgactctcgcagaacggagaaagaccatgaaagcactcaagactctcttcatcgccaccgccctgctgggttccgccgccggcgtccaggccgccgacaacttcgtcggcctgacctggggcgagaccagcaacaacatccagaaatccaagtcgctgaaccgcaacctgaacagcccgaacctcgacaaggtgatcgacaacaccggcacctggggcatccgcgccggccagcagttcgagcagggccgctactacgcgacctacgagaacatctccgacaccagcagcggcaacaagctgcgccagcagaacctgctcggcagctacgacgccttcctgccgatcggcgacaacaacaccaagctgttcggcggtgccaccctcggcctggtcaagctggaacaggacggcaagggcttcaagcgcgacagcgatgtcggctacgctgccgggctgcaggccggtatcctgcaggagctgagcaagaatgcctcgatcgaaggcggctatcgttatctgcgcaccaacgccagcaccgagatgaccccgcatggcggcaacaagctgggctccctggacctgcacagcagctcgcaattctacctgggcgccaactacaagttctaa

SEQ ID NO: 3189 - DNA, 1956 bp, Pseudomonas aeruginosa
acaggggcacgtggtggacgcggtaccggatgccgaggaagccctctaccgggtcagcgaataccaccacgacctggcggtgatcgacctcggcctgccgggcatgagcggcctggacctgatccgcgagctgcgttcgcagggcaagtccttcccgatcctgatcctcaccgcccgcggcaactggcaggacaaggtcgaaggcctggccgccggggccgacgactacgtggtcaagccgttccagttcgaggaactggaagcgcgcctgaacgcgttgctgcgacgctcctcggggttcgtccagtcgaccatcgaggccggccccctggtcctcgacctgaaccgcaagcaggcgctggtcgaggagcaaccggtggcgctgaccgcctacgaataccgcatcctcgaatacctcatgcggcatcaccagcaggtggtggccaaggaacgcctgatggaacagctctaccccgacgacgaggagcgcgacgccaacgtcatcgaggtgctggtcggccgcctgcggcgcaagctggaggcctgcggcggcttcaagccgatcgatacggtgcgcggccagggctacctgttcaccgagcgctgccggtgatccgttccctgcgcatccgtctgatgctcggcgccgccgccctggcggtgctgttcatgctggcgctgctgccggccctgcagcgggccttcggcatagccctggagaacaccatcgagcagcgcctggccgccgacgtggcgaccctggtctcggcggcgcgggtggagaagggccgcctggtgatgcccgagcacctgccggtggaggagttcaacctgccggaggccaaggtcctcggctatatctacgaccagaatggcgatctgctctggcgctccacctcggcggccgacgagtcgatcaactacacgccgcgctacgacggccgcggcaacgaattccacaccacccgcgatgcgaagggcgaggagttcttcgtgttcgacgtcgagatcgacctgctgcgcggcaagcaggcggcctacagcatcgtcaccatgcaatcggtcagcgagttcgagagcctgctcaaggggttccgcgagcagctctacctgtggctcggcggcgccctgctggtcttgctcgggctgctctggctgggtctgacctggggcttccgggcgatgcgcgggttgagttccgagctggaccagatcgaatccggcgagcgcgagagcctgagcgaggagcatccgcgcgagctgctgcgcctgacccactcgctgaaccgcctgttgcgcagcgagcacaagcagcgcgagcgctaccgccactccctcggcgacctggcgcacagtctgaagacgccgctggcggtcttgcagggggtcggcgaccagctcgccgaggagcccggcaaccgcgagcaggtgcgggtgctacagggccagatcgagcgcatgagccagcagataggctatcagttgcagcgcgccagcctgcgcaagagcggcctggtacgccatcgcgagcaactggcgccgctggtggagaccctgtgcgacgcgctggacaaggtctatcgcgacaagcgggtaagcctgcagcgggacttctcgccgtccttcagcgtgccggtggagcgcggcgcgctgctggaactgctcggcaacctgctggagaacgcctatcgcctgtgcctgggccgggtccgcgtgggcgcccggctggggccgggttactcggagctgtgggtcgaggacgacggtcccggagtgcctgccgaacagcgcgcacgaatcatccgccgcggcgagcgcgccgatacccagcacccggggcagggcatcggcctggccgtggcgctggacatcatcgagagctacgacggcgaactgagcctggacgattccgagctgggcggcgcctgcttccgcatacgtttcgctacagtctga

SEQ ID NO: 3190 - DNA, 717 bp, Pseudomonas aeruginosa
tcatggagcgcagccgccgcgagcagcatcaggtggccatcggcgaggcgcagttccgcggcgccatggaattctcggcgatcggcatggccctggtgtcgctggaggggcggctgttcaaggtcaacgaggcgctgtgccggatgctcggctattccgccgaacgcctgggcgagcagtcgttccaggagatcacctatgtggacgacctggaactggacctcgacctggtgcgcgacctgctcgccgggcgtatcaactcctaccagatggagaagcgctacctgcgccaggacggcgaaaccttctgggcgcgcatcagcgtgtcgctggtgcgcgacgaggagggagtcgcccagtacttcgtcacccaggtggaggatatcgacagtcgcaagcgtgccgagctggagcgcgagcgcctcgccgaacggatcaagctggccaccgacgccgggcagatcggcatctgggagtgggacctggcgcgcaaccgcctgcactgggatttccgcatgttcgacctgtacggcatccgcagcggtcccggggagaccgccgtggagcagtggaaggcgagcctgcatgccgaggatcacgaccgcgtgctgcgcgagctggagcgcgccgtcagcgggttgcagaaattcgactgcgagttccgtatcgtccgccccaaccgcgaggttcgccacctgcgggcgatcgccacgctga

SEQ ID NO: 3191 - DNA, 1386 bp, Pseudomonas aeruginosa
gcgcgttccagggaactggcgaagcgcccccgtgaggactctgcccatgaccaaacaacccttctacaagagcctgtacgtgcaggttctggtcgccatcgccatcggtatcgcgctcggccactggtacccggaaacggcggtggcgatgaagccgttcggcgacggcttcgtcaaactgatcaagatggccatcgcgccgatcatcttctgcaccgtggtcaccggcatcgccggcatgcagagcatgaagtcggtcggcaagaccggcggcatggcgctgctgtacttcgaggtcgtctccaccgtggccctgatcatcggcctggtagtggtcaacgtggtccagccgggcgccggcatgcacgtcgacccgaacaccctcgacaccagcaagatcgctgcctacgccgctgccggcgagaagcagagcactgtcgacttcctgatgaacgtgatccccggcaccgtggtcggcgcgttcgccaacggcgacatcctccaggtcctgttcttctccgtgctcttcggctacgccctgcatcgcctgggcagctacggcaagccggtgttcgagttcatcgagcgcgtctcccacgtgatgttcaacatcatcaacgtgatcatgaaagtcgccccgatcggcgcgttcggcgccatggccttcaccatgggcgcctacggcgtgggttcgctggtgcagctcggccaactgatgctgtgcttctacatcacctgcatcctgttcgtgctcatcgtcctcggcggcatcgcccgcgcccacggcttcagcatcctgcgcttcatcaggtacatccgcgaggaactgctgatcgtgctgggcacctcgtcttccgagtcggccctgccgcggatgatcgacaagatggagaagctcggctgcaacaagtcggtggtcggcctggtgattcccaccggttactccttcaacctcgacggcacctcgatctacctgaccatggccgcggtgttcatcgcccaggccaccgatacaccgatggacatcacccaccagatcaccctgctgctggtgctgctgatcgcttccaagggcgccgccggcgtcaccggcagcggcttcatcgtgctcgccgcgaccctttccgccgtcggccacctgccggtcgccggcctggcgctgatcctcggcatcgaccgcttcatgtccgaagcccgcgcgctgaccaacctggtcggcaacggcgtggccacggtagtggtttccaagtggtgcaagcagctcgacgagggcaccttgcagcgcgaactggccggcgagggcaacgcttcgtcgcctgccagcgatattccggtgggcggccgcgaagcggtctaagctcaaacctgttcggcagggggaagtga

SEQ ID NO: 3192 - DNA, 654 bp, Pseudomonas aeruginosa
tccagcgctgctaggatacttgccatgccttccctccagctctacagcgacagttcacccaacggattcaagatcaccatcgccctcgaagaactggggctgccctacgcactgcaccacgttcgcatcgaccatggcgagcaacgccgcccggaattcctgcgcctgaatccacatggccggataccggtgctggtagaccgggccgccggcatcaccctgttcgagtcggcggcgatcctgcagtacctggcggagaccagcgggcggttgcttcccgacgccccccgggaacgctgggaggccctgacctggctgactttccatgcttccagcatgggccccatcctcggccagcgcgtgcatttcgagatcttcgccgaagagcggtacccgccggccatcgaacgctatcggcggctctccgaggaggttttcgccaccctcgaccagcgcctggccggacggccctggctggccggtgagcaatactccatcgccgatatcgccaccttcggctggacccatacggcgcggatcgtcgacttcgacttcagccattatcgccacctggacgactggcaccggcgcatggccctgcggcctgcggtgcagcgcgggatcctcctgccggaaccggcggtgggtccatga

SEQ ID NO: 3193 - DNA, 951 bp, Pseudomonas aeruginosa
aatagccagcttttctcctcgaacacccggattccagagcaccatgggcaccctttcggtcaatcagaacaaactgcagaagcgcctgcgccgcctggccggcgaggccatcaccgacttcaacatgatcgaggatggcgacaaggtcatggtctgcctgtccggcggcaaggacagctacaccatgctcgacatcctgctctacctgcagaaggtcgcgccgatccgcttcgagatcgtcgcggtgaacatggaccagaagcagcccggttttcccgagcatgtcctgccggagtacctgaagtcgatcggcgtggagtaccacatcgtcgagaaggacacctactcggtggtcaaggagaagatcccggaaggcaagaccacctgctcgctgtgctcgcgcctgcgccgtggcacgctgtacaccttcgccgacgagatcggcgcgaccaagatggccctcggtcaccatcgcgacgacatcctcgagaccttcttcctcaacatgttctacggcggcaccctgaaggccatgccgccgaagctgctggccgacgacgggcgcaacgtggtgatccggccgctggcctattgcagcgagaaggacatcgaggcctattcccagctcaaggagttcccgatcatcccctgcaacctctgcggttcgcaggagaacctgcagcgccaggtggtcaaggaaatgctgctggaatgggaacgcaaatcgccggggcgtaccgagatcatgttccgcgccctgcagaacgtggtgccgtcgcaactggccgaccgcaacctgttcgacttcgccaacctgcgcatcgacgagaacgccacgccgcgcttcctcgacgtgatgaacctctgagccgcgccgcgggtcagttcttctctccggtctgcaaggattcccgatgcgcgactacgcctggatgtacgaatactgcctga

SEQ ID NO: 3194 - DNA, 1566 bp, Pseudomonas aeruginosa
cgccgccagcgcgaggatcagcaccagcgccgcgacgctgccttcggcgcgattgccgaacgccggcaggccgcgctggcgacgggcatgcaggaagaagcccaggcctggcgcgtagaggatcatcgacagcagcaggtatttcagcccggcggcgtagatcagccagaccccgtagagcgtccccaacagcgccagcgccagcatcgcgcccgagtgcgggcggcgcgccaccagcttcaggcagaagccggcgcagagcaggtaggggatcagcgccatcgaggtggccaactggatcagcgcgttgtagcccgaggcgttgaggaaggccaccagcagcagcgcagagatcagcgtgctggtcagccacagtgccggcgccggggtttccaccgcattggtgcggccgaacagtgccggcgcggtgtgcgttgggccacggctggccaggtagagcatttccaccgcgagcatggtccaggccagcagcgcgccgccgaccgagacgatcaacccgacgttgatcagcgtggcgccccaggggcccaccgccgcggccatcacctgggccatcgaggggttcttcatctgcgccagttcgtgctgcggcaccacgcccagcgacagcaccgagacgcagaccagcaacagcagggtgaccacgaagccgagcagggttgcgcggctgacatcggccgcgtgccgcgcgtggctggcatagaccgtggcgctctcgatgccgaggaatacccagacggtgtagagcatggtggtttccacctggcgggtgacgttgcccagggccgggctgccccagaagtccaggtgaaaggtctcgatgcggaaggccagggctacgcagaggatgaacagggcgatcggcaccaccttggcgagggtcacgatggcgttggtgatcgccgcgttgtgcacgccgtggaggacgaaggcatgcatcagccagagcaccgtcaattcgccgagcagcgccggccaggtggttccgtcgccgaagaaggccagcgcgccgaacgagccgagggcgctgaacagcaccaccaggtagccggcgttgccgacccaggcggaaatccagtagccccaggcggcattgaaccccaggtattcgccgaagccttcgcgggcgtagccgtagacgccgtcgtccagttcggggcgggtggtcgacagccactggaatatccgcgtcagggtcagcatgccgacgaaggtgatcgcccaggcgatcaggatcgcgccggcgcctgcgccttcggccatgttctgcggcaggctgaagatgccgctgccgatgatgccgcccaccaccagcgcggtcagcgccggcagccccagttttcccttgtccgaatcggccatgtggcacctccgaaactgcatccggtatgtcgcgccaggcgcaggcggagcctgcgccggggtgcgacggcgggaggcggcgggtcggtccgccgcggcatggttcagaagcgcagcgacatgcaactgacgccgccgtcgatcttgcgatattcggaggtgtccacctcgatcacccggtag

SEQ ID NO: 3195 - DNA, 213 bp, Pseudomonas aeruginosa
actgcgcagcgattcccgagacgctgctggaaagtaccctgttcggcaccacacgcggcgctttcaccggcgccgagaaccgcaagggcatgttcgccctggcgcagggcggcagcttgttcctcgacgagatcaattccatgccgatggccatgcagagcaagctgctgcgggtcctgcaggacggcagctacctgcctctgggcagcctga

SEQ ID NO: 3196 - DNA, 846 bp, Pseudomonas aeruginosa
gccatgccggcatctacgtcggcgagggtcgtttcgtgcatgcgccgcgcaccggcggcacggtgcgcctggacagcctgcagaacagctactggcaacgcgcgtacctggacgccaagcgcgtgctggtcgcgccgtcgccgttggcgcgggtgccctgaggcggggaggtccggggccatcatgaccacccgcaccctcaatctcgacgacaacctctatcgctacctgctggacgtttcgctgcgggaaaccccgctgatgacccgcctgcgcgaggaaaccgcgaagctgcccaacgcacgctggcagatcgcccccgagcagggccagttcatcgccttgctgctgaccctgatcggcgcgcggcgggcgctggaggtcggcaccttcaccggctacagcgccctgtgcatggctaccgcccttggcgagcaggggcgtcttacctgttgcgacctgcccggcgactaccacctgactgcgcgccgctactggcgcgaagccgctgtcgaggagcgcatcgagctacgcctcgggcccgccctggaaaccctgcgtgcgttgctcgacgaaggcctggccgggcagttcgacctggccttcatcgacgccgacaaggccaactaccccgaatacctggaggccgcgctggcgctggtgcgccacggtgggctggtgcttttcgacaacgtgctgtggagcggccgggtgctcgaagcgcagccgaagagtgcggatacccgcggcatccagcagctcaacctggcgctgaagaacgacgcgcgggtggactactcgctgctgccgatcggcgacgggctgagcgtctgtcgcaagcgctga

SEQ ID NO: 3197 - DNA, 522 bp, Pseudomonas aeruginosa
atcgctgtcgctgtcactactcttgatgggcggcgtgcgctcccgagaccgcccatgcttgcctcccaggaggcgcttcgtttcacaccgcgcggcgacggacgccgcccgagaccggagaaacaccatgtccttcacctacaagcgactcgacaagaacgatgcggcggtgctgttcgtcgaccaccaggcaggcctgctctccctggtccgcgatttcagcccggacgagttcaagaacaatgtcctggcattggccgacatcgccaggttcttcaacctgccgaccatcctcaccaccagcttcgaggatggccccaacggcccgctggtgccggaactcaaggaaatgtttccgcaggccccgtacatcgcccgccccggcaacatcaacgcctgggacaacgaggacttcgtcaaggcggtcaaggccaccggcaagaagcaactgatcatcgccggcgtggtgaccgatgtctgcgtagccttcccgaccctctcggcgctggaggaggggtttga

SEQ ID NO: 3198 - DNA, 774 bp, Pseudomonas aeruginosa
cgtattcgtcgtcaccgacgcctccggcaccttcaacccggtggtgcgcgacgccgcctgggcgcgcatgaccgccgccggcgcgcaactgatgaactggttcagcgtcggctgcgaactgcaccgcgactggcgcaacgacatcgaaggcttcggtgccatcctcggcggccacctgccggcgtacgccaacctgatccagagcttcggcacgaagaagtaagccggcttcgccgctgtcccggacacaaggcactccgaccatcgggtgccttgtgtcgttttccgtccaggtgttttcatcggaacgccgcttcgccggaacccgaggttccggcacgcccccccatgcacaggagaaaccccatggctacccaggtcgtcaacgcttccctcggcaccaccccttatcgcgtgaccctcggcgacgacagccaccagtggctgagcgacgtgccggccgccctcggcggcgccgacagcggtccctcgccgcacgagatcctgctctcggcgctgggcgcctgcacggcgatcaccgtggcgatgtacgcgcagcgcaaggagtggccgctggagggtatcgacgtgcaactgaacatcgtcgaggaacgcaccaagccggagcccttcacccatatccgccgcgacatccgcctggccggcgatctcgacgccgagcagcgccagcgtctgctggagatcgccaatgcctgcccgatccatcgtgtactctccggagaggtcagcgtcagcagccagctacgcgactga

SEQ ID NO: 3199 - DNA, 585 bp, Pseudomonas aeruginosa
acccgcacgcacaacgaggagcacggcatgagcgacgacatcaaggtattgggcatttccggcagcctgcgcagcggctcctacaacagcgcggcgctgcaggaggcgattggcctggtcccgccgggcatgagcatcgagctggcggacatctccggcatcccgctatacaacgaggacgtctacgccctcggcttcccgcccgcggtggaacgcttccgcgagcagatccgcgcggcggacgcgctgctgttcgccaccccggaatacaactattcgatggccggggtgctgaagaatgccatcgactgggcctcgcggccgccggagcagccgttctccggcaagccggcggcgatcctcggtgccagcgccgggcgtttcggcaccgcgcgggcgcagtatcacttgcgccagacgctggtgttcctcgacgttcatccgctgaacaagccggaagtgatgatctccagcgcgcagaacgccttcgacgcccagggccggctgctcgacgacaaggcgcgcgagctgatccagcagcagttgcaggccctgcagctatgggtgcgccgcctgcgcggttga

SEQ ID NO: 3200 - DNA, 765 bp, Pseudomonas aeruginosa
ccatcgaggagccggagcccggctcgctgttcgtgcgtttcgcctactgcacccgctacctgcagccgctgggcgacgaactgccctacgacgccttcgtcaagcaggcctatatcgccatggatgtggagaccatcgccaccatccgcgaccggttcggcgccagcgccgccagcgggagttgagcgtggaacacggaagcagttttctccagtccggcgtggtcttcctgatcgcggcggtgttcatggtgccgctggccaagcgcctgcaactgggcgcggtgctcggctacctgctggccggcgtgctgatcggtcccagcgtgctgggcctggtggacaacccggaaagcgtcgcgcagatctccgagatgggcgtggtattgctgctgttcatcatcggcctggagctgtcgccgcggcgcctgtgggtgatgcgcaagtcggtgttcggcgtcggcctgctgcaggtgctgctgaccggcgtggtgatcggcaccgtggccctggtcggcttcgaccaaccggtgaacagcgcggtggtgctcggcctgggcctggcgctgtcgtccaccgccttcggcctgcagatcctcgccgagcgcaaggaactgacccagccccatggccgcctggccttcgccatcctgctgttccaggacatcgcggcgatcccgctgatcgccatgatcccgctgctcagcggtgcgcacagcgacgccggcggcagcgaactgacccagaccctcaaggtggtcggtag

SEQ ID NO: 3201 - DNA, 321 bp, Pseudomonas aeruginosa
agcattgccccggcaagagcttcgccctgctcgaagggcgcgcggcgatgggcggtacctgggacctgttccgctaccccggcatccgttccgactcggacatgttcaccctcggctacaacttcaagccatggagcgatcccaaggccatcgccgacggtccgtcgatccgccgctacatcgaggagaccgcacgggagaacggcatcgaccggaagatccgctaccgccaccgggtgctcagggccgactgggattccgccaatgcgcgctggaacctcgacgtgcagcgcggcgacgagcccgagccgctgcgcatga

SEQ ID NO: 3202 - DNA, 342 bp, Pseudomonas aeruginosa
tcaccctgccgcagaaggacgcgatctccaatttcctccgccgcttccttccggaaacctggatctaccgccaggcgcgggcgcgcaacgtggccatgcagatggtcttcttcatgctcgccaggaccttccccggcctggtccgcaaggccctgctcaagctggccagcctgcaactgggcaaacgcttcgacatgcgtcacttcagcccgcgctacaagccgtgggacgagcgggtctgcgcggtgccggacggcgacctgttcaaggtgctgcgcaagggcaaggcgtcggtggtcaccgagcacatcgaccgcttcgtcgagcggggcattcgcctga

SEQ ID NO: 3203 - DNA, 1233 bp, Pseudomonas aeruginosa
ccgcccgcgacagcaccggcgacgtgcgcgaggagcccttcctcaacctcgactccggctacatccagcgcgccgccgagcgcatacccaagcagggcgaccggatgccctggaagctttaccagaactacgtcctcgacctggcgctgctgcgctacggcaaggtcgaggacggctacctggtgttctcctcgccggcgccgcagcggcaagccggcggcgcggcggtgcaggccctgggctgaacccggtgggcgtcgctcaggcgttcgccacgacctgcccgtaggccttgcgccaggcgtccaggccgccggccagcgcccaggtgcgggtgaagccggaggcgttgaggcgctgggcgagcatcgcggcggaaagttcgtggggacaggcgcaatagatgacgatgctggcgtccctgaggtcgccggggaggtccttcagcgacacgttcagctccaccgggatggctcccggaatgccgctcggctcgtcttcgtgatgggcgcggacatcgaggatcaccggcaattgcccctgttcgcgaaggttttccagttcctccacgctgattcgcggaatccgccggctgcgcgacagcaggcgctggcgctgccagagcttccaggcgatgaaggcggcgaaggcgccggcgatcagcagcgcgccgatggccgcgtagtcgctgagcagggccagcaggtggtctaccgcatcgctgaagatcacccccagcagcagcgcggaaccggcccagagtgccgagccggcggcgtcgtaggcgaggaagcggcgcaggtgggtgcgggtcatgccggccagggtggtggacaacgcactggcgccgggcaggaacttcgacatcagcagcgccctcggaccgacccgcaggtacatgttctggctctggcggatgcaactgtcctgggacagcgagaccttgcagatgctgcgcaggaggaagccgccgtagcggcgtccggccaggtaccaggcgacgtccgccagcaggcaggcgagcaccaccaccagcaggaccacgcccagcggcgcgccgacgccctgcatggccagcgcgccggcgacgatcagcgccgggtaggcggggatcggcagcccggcctgctcgcagagcacgttgaggaacagcaggagcagcccgtggttctccagcaggggttgcagttcacgcatggcagagcctctcgaattcttctgcgggtagtgtga

SEQ ID NO: 3204 - DNA, 570 bp, Pseudomonas aeruginosa
acaggtacaggtgcgcggcgcgctcgcccaggcgggccgccaggcattgcgccaggtagccgccgaagctgtggccgcagagtatcacccgctcctcgccggccagcgtggcggcggcctggtccagccaatgcgccaggtcgcatccgggcgcgtcgcgcagatggtcgcagcttcgccagccggcgccttccacggaccaggcggagcggcgcaggaaaaatcccgagaccagcagcgcgccggtcatccgccggcccgctcggcctggcgcaggccgaccgcgccgacctgcagcagcatgatcaccccgcacagcgcggccaggccgaggtacagcgcctggctgccggcatggtcgagcatgatcccgccgtacagcggtgccagcgcggtgccgaggctgtagagattggccgcgccgaaatagctgccgcgcaagtcgtcgggggtcagttggtcgacctccacgctgaaggtcgggaacacgatcagttcgccgaggctgagcaccaccgtggccagcgccaggccggcgaacagggtcaccggggtccaggcgaagcctag

SEQ ID NO: 3205 - DNA, 1140 bp, Pseudomonas aeruginosa
ctgggccaggagcatgagcagcatgccgagcatcaggcggccgccggtgccggtgttttccagcaggcggaggaggggaaactgggcgaccactatggtcagcgcgttgatggtcaccagcagggcgatgctgttgaccacgtcgggcagaccgctgcgggtgaggtactgcacgagggtcgaatcgaaggtggcgtagatcagcgcggccagcatgttgcacagcaacagcagggtgaaggcgcgatgccgggccatgctcaggcaggcttcgaggaaccccgtcgaggatcgcggggcaaggctgcgccgcttaagttcgaggtggtgcagcaggcgccagagcagcaggccgtagcagaagtagaccagcgcggtgaccaggaaggtgccggcctgggcggcgacgccgagagtcaggccgatcagcgggccgagggcggcgccgaggttgatcaggaagtaccggcagtagagcgccagttcccgcgagcggcgatcctcgacgcggtcgccgatcagcgccttgcaactggattcgagcagggcgcagccgatgctcaccccggagatcgccagtccgtaggacagcggctggccgctgaagcccagcaacacgaaggaaagcccgctgaggctggtgccgaagaagatcaggcgcttgcgcccgaaacggtccgacagccagccggtgtagatgccgctgagcgcgccgcagacggtcgccagcgccagcagcaggccgatggcgctggcggacagccggaactcgcgccacagcagcaatgccaggaacggccagaccatgaagtaggcgccgcgggtcagcagcgtaccgacgagcatcacgtggatttccgtcggcagggcgcggaagcgttgcacgctgaaggtgttgtcgctcacgggcggggctcctgggcgaggggacggatgccgccgcgcaggctgccggcggctacctggtggaacagcggcaggaagctttccggcagttcgcgggtgaactcgctgctcagccagcagcgcagcaggcagcggcgctgccgctcgtcgtcgctgaactcggtgcgcgcgtgcagggtggtgtggttgttcaccagcaccagcatgcccttgctgaagtccagttcggcatag

SEQ ID NO: 3206 - DNA, 699 bp, Pseudomonas aeruginosa
acaactggtcgccgggcagcgccgcgacgctcggtgcatccaggccttccaggccgaggtcgtggagcgccggcaggcgttcggcgaggtgccggcgcatttccccgagggcctgcggccaacgttcgaacggcaggcggaaatgccgtttcggctgcgcctgccagcgtttctcgcgctgctccaggagcgccaccagcggtgccttggcggtgtcgccgacgatccgctggaggcgcccggcgcgctgcgccagggcgccatgcaggtagggggtgcgcgcttcgatggtgcgcgacatcagcagatggtcggcgcggcgcagcagcggctccagcgagtagtgcagatcgaactggccgatcgccgcctcgaggccctggccgagggcctcgtgggcgagttcctcgatccgctcggcgacccgtcggcccgccggttccgccagcagcgcggccttgcgccggtactcgccgaaccaggcggcggcgaagcgccgcggttccggtgcgtcgcgccggcgccagagttcgagatggcgcgggtagccccagaacagttcgtcggcgccttcgccgagaagcacgcagtgatagccctgctcgccgataccgtcggccaggcgctggtacatcagcaggctggacatccgtgtcgccccgccgaagttgccgaccgcgcgacgcagcagcggcatga

SEQ ID NO: 3207 - DNA, 2298 bp, Pseudomonas aeruginosa
aaccggtgccgacgtaaccgaggatgccgcacatcacgaggcttcccgttgcagcagggcggcgagcgcacggcggtcgtgcttgccggcgccgttcagcggcagggcctggtgcgacagcaccacgcgctgtggcgcgcggagggtgccgagctgctgctggagccagggcaggaaggcgaactcgacctgcggcgcggtgtggatcacggcgacatagttttcgccatagagcgggcagtcgaccttcaggcagcagacgtcgatcacctcgtccaggccgttgagcgccctttcgcattcattcaggtggaacaggttgccgcccttgttgatggtgccgtcgcaacggccgaggacgtgcacgcagcggtcctcgtcgaagtaggcgaggtcctgggtgttcagccagccgtcctcgagcacctgggcggtcaggtcggggcggttgacgtagccggagaacaggctcggcgtgcgcacccacaggcgcccgcgttcgccgctgccctccagcgggcggccgtcggggtcggtcagcttgagttccaggccgacggcaggtcccaccgagttgtcgaacgcatcgccgcgacgcttgccgaagaggaaggcaaagccgcactcgctgaggccgtagatgttcgccagcgccgcgtagtcgcgctggaaggccgcctgcaggtcggcgtccaggcgcgccgagccggcgacgcagagcaggcgctgcaacggcaagcggcgcggcggcggggagccttccttgaccatgtggttgaccaccggcggcaccaggtagaggaaactgatgccgaagcgttccacgcattcccagaagccttcgctgtcggcccagcagtgcagcggcaggagcaccgcgctgccgccgtacagcagcgggaagaggaaattgatgccgaggatgcccaggccgctgatccggtagaagcaaccggagcgcgtgtgctcgccgatgcccaggcagtcgcggccgatgcggtaggcatggagcatggcctgctggctgagttcgatgcctttcggctggccggtggtgcccgaggtgaacaggatcatgtggctgtgcgcggcgcggtcgagccggcgcgtcgcgctgcgctcgaagtccagcgccaggcgcagcccggccagcgcgccctcgagcggatgttcgctggccagcgcgtccaggcgcatctcgtcgacgatggcctgcttcgcggcctccccccactcgggatcgatcagcaccagatgcttgcccgcgcgcatgaccgcatagatcaggcagaggttgcggtagctgttgtcgagcagcacgccgacactgcggcaggcatgcgcggcgatctgctcggcgagggcatcgacctggcggtcggcgtcgccccaggtgtattccagcggtcgctccggctcgcgggcgtcgatcaggaacggccgccgcgggtcggcgctgccgagatggcggagggtgctgtcgagcgatacgggtacggggaggctgctcatgccggctcctcagcgattcagcgcggtgaaggcgtggatgtcgaagttcaccgccacctgcggcgcgctctcgatctcgcgcaccgcggcgatgaagcggtcggcgtagtcttcgccgccttcctgctcgatgtagcgggtcacgtagctggtggagaggaagaacagcgcgacctcctccgggctgaggaagatgatgttggcgaacacttcgcggcggcagtcgcgcaggtgcgggcaactgcccatgatctccagggtgtcgtcatagcgggtcaggcgcggatcacggtgtttggcccacttgttcaccagttcgtgctcgatgaagtcgcgcagcggcccgtaggcgatcgggaagtcgtacttgtaggcgcagaacagcccgccgggggtcagccagtcggccatgcgcgtcagcacctgcttgcggtccatccagtagaaggaggtggcgctggtgaccaggtcgaagcggcgttgcggcgcgaaggtttccgccggcgacacgctgaagcggatctccgggtagttctcgcgggccttggcgatcagcgcctcgcccaggtcgctgccttccacgtagcggaaccagggttgcaggcggacggtcgagacgccgttgccgcagccgatgtccagcgccgcttcgcgtgccggggcgcgttcggcgaggttgcggtagagcgaatccggataggcgatcttgccgcggaccacgttgtaggcgtctgcgtgcttgtcgaactgcttcattgggtaatctccagtaggctctcgtggtaa

SEQ ID NO: 3208 - DNA, 555 bp, Pseudomonas aeruginosa
aatcgatcaccgccgggtcctgcagggccaggtggtgcggacgctcgcaggggaaggtgtcgagccgctcgatcaggtcgcaccagcgttcggcggccgggtcgcggccggcgtcgtcccggcagcgcacccagctggcgcgggcgaggcgatggcggggctgccagcggccgaacagctcgacattgcgcagcaggacctcttcgcgcagttcgccaagctcgctcatcagggcgatccattcgcgcatctcggcgctcagccagcgctggtattgctcgctcggcggcattcgccgcagggccggccagggcaggtggctgtcgatcatcagcaggcggctggccggcaactggcgggccatctcgtagccgaccaggccgccgaaggaatagccgatcagccagtccggttcttccgccaggccgtcgagtacctggctggcgagggcttcgatgctggcgtaggcatccagccggtggtagtcgaccagccggcagtccgttgcgccgaggcgtgccagcagcccgcggaagcagctcgggtggccgatga

SEQ ID NO: 3209 - DNA, 1413 bp, Pseudomonas aeruginosa
cgcctcggccatggccgccgccagcgccagggtccgttcgcggccgaagcggctggccaggctggcgtcccagccgccgtcgtcgcgccggaccagggtcagggtcagcggcaggcggctcttcagtgtcggccggtggatgaacccggcgctgcggaatggctggtcgatgacattgatcatcacctgggcgtcggcatagcgcagcccggcccgttcggcgatggcctccgccggcagcaggctgtgctcgaaggcctcgagcctgtgtcgttcgaaggtgtcctcggcggtcgcggcgtccagcaacagcggcaccaggttcagccagcaaccggaaaccgccgtgcctcggcgactgcgcaggctgaccggggtcagcgccaagaccttgccggtggcgccctggctggccagggcgagagccagggcgcaggcgagccgggtcagcagggcggcttcgccgcctcctggcgtggcagccaagcggaaatcctcgcaatggctggcgcgctccgcccagggcaggttcgccagttcacggaacgcctcgccgcgctcgctccagtagtcttccagcctggtcctgcgctcgcgcagctggcgctccaggcgccattgctgctggaggaagccgaactcgggggccgccgcttcggtcgtggggtcggcgttgagcacggccaggcgggccagcagcacgctggcgaagtcggcgtcggcgaccaggtgatgcagccagacgccccagcgcgcacgtcctccgcagcgcccgtggaacagtcgcagcaggccgcgctcgaacagggaatgcgggcgttgcagcagcgctgcgatgagcgcgttttcgtcggcgaaggggccgacttccagcgccgggctctcctcgggctgcccgtggacgaccagttcgaaaccttccgcgccgctgtccacctggctgtcgagcaacgggaactcttcgcgcaggcgccgtcccaggcgcgtcaggtcggatgccggcacctcggccggagccaggtagcagatgccgaaacgggtcaggtcggcgccgaacagctcgctgaagaccatcccgcaggaccagggcgacaggtagacgcgcaaggactgcgcggcctcatccggcatcggttggtgccgcaggcggtcgcgctcggagggggacaggcggtgccaatcgccgaccaccaccaggtgctcgcggaaccagtggtagcgcacctccgcggagagaccgacgttcatgccgcgctcctcgacagcaccagcggctgctccggcgtcgccgcccgttccagcagacgctccggcgccaggccgtggctgcgcaggagacggctgaactggtcgaggcgcgagtttgcctgcaagtcggcgagtcccaggtttgctcccgtacccgccgattga

SEQ ID NO: 3210 - DNA, 402 bp, Pseudomonas aeruginosa
gcaggacaagctgcgctgggccgatacgctgatcctgcaattcccgctctggtggttcagcatgccggcgatcctcaagggttggatcgatcgcgtctatgcctgcggcttcgcctacggggtcggcgaacattccgacagccactggggcgaccgctacggcgagggccggatgcagggcaagcgggcgatgctggtagtcaccgccggcggctgggagtcgcactacgccgcgcgcggtatcaacggaccgatggacgacctgctgttccccatccaccacggcatcctgcattaccccggcttcgaggtattgccgccgttcgtcgtctatcgcagcggccggatcgacgcggagcgtttcgccgcgctgagcgagcagttgggccggcgcctcgatga

SEQ ID NO: 3211 - DNA, 1002 bp, Pseudomonas aeruginosa
tcggcccccccgaagccctgtcgcacgcggccgccaccgaatagatcgccccggaagaagcccggcgggaactgttcgaggcgatcttgcgatggtcgcgcggaatcgtcggtgaaggaaccgcgtgccctggaggaatatcgccgggcgatagtggcggcctgtccggagctggcggacgccactttcgccatcctggcctcgggctggcattccacggcggtggaggtcggagggcgctgggtgttcaagtttccgcgcggcgcggaggccgaggcggcgctgctgcgcgaggccgccgtgctacgcctggtgcgtccggcggtgagcctgccggtgccggcgccgcaggtgtttgcgggaccgccgctgttttcccgccacgagaaactgcctggcggttacctcctgggcgaggactaccggcgcctggacgaacccgcacggcaggcggtcggcgatgcgttggggcgcttctacgccgagctgcatcgactgccaccggcgcgcatgcgggcggttggagccttgccggtgcgtccctgggagtcgcctgcggcgatgcgcaggcgcgccttgccgctgctgcctgcggcctggcgcgaacgcgcggaacgcttggtgcgggaatatgccaagctgcctgccgatccgctgggttcgatcttcggcttcttcgacggccatggctggaacatggcattcgatagcgaggccgggcggctgaacggtgtgtacgacttcgccgacgcgggcatcggtccgctgcaccaggaattcatctattccgcgttcatcgatgccgacctcaccgagcgcatcgtcgccgcctacgagcgcttcagcggtcggcgcctggagcgtcggcggatcgccttgctgacggcggcgcatcggttgtcggagctggccgagctggccgacgagccgcgccatctgccggagatgctcgccggcgccctcgacggcctggccctggcggaggcgcagggcctggcctga

SEQ ID NO: 3212 - DNA, 1455 bp, Pseudomonas aeruginosa
ccatctgatcctcctggagaaaaaagggcggcattattcccagaagtgtcttcgagtgccagcctcggggggagaacagctgacgaactgcaagacctttccgtcgaccttcgttcagtcggctggccgccgcatgctgtcgcgcacgtagcgggccggggggctgccgagcgccttgcggaacatgccgatgaacgagctgaccgactcgtagccgaggatctcggcggtgcgttgcaccgaaacgccggcggacagttgctgcagggcgatgatgatctgcaattgctggcgccactggccgaaggtcatgccggtctcccggcgcaccatccgcgccagggaccgctcgctcatcgccactcgcctggcccattcggccatgctggcgcggtcgccgggggcgcgggtcagttcgtcggcgatgcggcgcaggccgcggttgtccggcagcggcaggtagagctgttcggtcggcgcctgttccaggagttccagcagcaccccggcgagacgtgcgagcgggccgtcgtgcggatagtcctgcggttgcgcgctcaggtgcaggatcagttcgaggaccagcggcgacagggccagggtgcagcagtcgctcggcaggcgtgccgcccccggctcgacgaagaggaagcagaccttgccgttggcggtgacccggttgctatgggcgatgccgccgggaatccacacaccgaaaccggccggcaccatccacaggccatcgggcaccgtgcaggtgatgccgccgcggcaggccaccaccagctggcccttgcgatgccggtgcaccggcacttcggtgtcgttgtgccgggcctccagctgcagggccagggccggctggccgagcgcgtcgggatcgaagcgttgggcgaggtaggtctgcggttcacggctcacggcaggtcctatggttgtccgaattcgattattttctggctgagtagtcgatatttgcaaatcgccacgacccgtagcctgtgctcctcaacccgacaggagcggccgaccgctccgcgccctcgataccctggtgccctgcatgctgagcgaagtctccgtttccggcctctacgtgccgccattgttcctctacctgtgcctggcgatgccgctctacctgctgctggagcgcctcgcctggcgctggctggaatgcgcctggcatcccggcctgctgcgtttcttcctgtcgttcatcgtgctgtccgtgctggtgctgaagttctgagccgaggtccccatgtccatcgttcgtctttccaaggtggctgcgaccttcgcctgcggcctgctcgccctgtgcctggcgttgcagttgtggcaagcctacgtgctggcgccctggacccgcgacgggcgggtcagcgcgcaggtgatccgcattgcgccggaagtctccggcagcgtcgaggcggtgttcgtcgcagataa

SEQ ID NO: 3213 - DNA, 2640 bp, Pseudomonas aeruginosa
cgagcaatggcgccgacgcatgcagttggccggcgcggtttcgcgcgaggaggtcgccaacgccggacgcgccctgcgtatcgcccgcgcccgcgccgaggccgccggggcggcgctcgaccaggcgcggctggacctgcggcgcagcgagttgcgctcgccggtggacggctatgtgacgcagttgcgcgtgcagcccggcgattacgcggcggcgggccggaccaacatcttcatcgtcgatcggcgaagcttctgggtcaccggctatttcgaggaaaccaagctgcgcaatgtacaggtcggcgcgccggcgacgatcaagctgatggggttcgatccgctgctcgacggccatgtcgcgagcatcggtcgcggtgtcgccgacctcaacgaaagccgtgccgacagcggcctgccgcaggtcagcccgaacttcagctggatacgcctggcgcagcgcgtgccggtgcgcatcgaactcgaccgggtaccggcgggcgtggtgcttgccgctggcatgaccggcagtgtcgaggtgctgcaggcggggaccgcgcggcactggcggctgacccgctggttgcaggagtacctttgatggcggcgtcggcgtccggcgggcgcgattggtacgcggcgttgccgttgccctggcggaccgacagcctggactacgtgctgcgcagcatcggcgctgccgctctggcgctcggcctggggctctacctgcaactggattcgccgttttccgcggcgtccactgtgctgttgctgatcaatccggtgcagggagcggtggtcggcaagggctggtggcgcgccgtgggtaccctggtcggcacgctcgctgccttcgtcctgaccgcgctgttcgcccagaagatgctgctgttcgtcgtcgccctgggtttctggctgggtctctgcgtcggcgtcatgagcctggtccggcacttctacgccaccgccgcggtggtcgccggctacaccgtgtgcctggcgctgggatcggccatggtcgagcccgaggcggccttcgagcacatcgtcacccgcgcctcggcggtaatcgtcggggtctgctgcctgagcctggtgaccgtgctcttcagccgcaggaccgtgtccgggcgggtgcgccagcgtctcgtctcgctctgcgcggcgacgctggcgctggtcgctgcgcggcatgccggtgcggctgacggggaactggagcgccgtcgccggacgctggccggcgaggtctacgcggtagacgacctgctgggtgtcggtcgagccgagtcgcgggcgctgagcgctgcgctcccggcgatccgcggtggcctggcggcgctgttttccacgctgatggagttccgcttcgccggcgagacgcattgggcccggcgcttggcggagcgtggactggcgctgccgatggccgacgacctgtgcctgctgggcggccaactggagcgcggcgagctcgacttcgccggcgccgcgcgacggctcgcgagcttgcgcggtcgcctggcggcgattcggcgcggacttccgacagaccaagcggatgcctgtcgcgaagggctcttcatggagcgtctcgacgagcaactggatgacctgcaggccgccctgcgggggttcgcccggctcgacggccgggcccgcgccgacgtccgcccagcggccttccatcgacattaccgcgaggccttgcgcaacggcgcgcgagcctggctggcgatgctggtcggcggcgccctgtggttcctcagcgggtgggaccaggggccgaccctgctggcggtgctcggcccctactgcacgctgctggcagcctcgccctttcccgccgagggcacgcgcaatttcattcgcggcacgctctacgtgatacctgccgcattgctctgcaaattccttctgctaccgctgatcaacggttttccattgctgctgctgtgcctcgccttcttctggtcgttcggtatccaggccaccacagtgcccaggcgggcgttgcagggaatcgcctacctgatcgccttcaacaccctggtcgccaccggcaatctcgcccgcttcgatttcggcgacttcgccaaccagtcctgcgcctgggtgctggcgctctgcatcagcctgctggtctaccgcctgctgccgaaggacctggaacggcattcggcgtcgctgctcgaccatctgcgccgcgagaccctcgccttgctgcgtcgtcgcgccggtttcgacgcgcatgcctggcaggcccgccagcagcatcgcatcgcccagttgggcgcgctgcatggcatggaacatccgcgcagcgcgctggccctgcgcctgggcttcgtatccctgcaactcggccgcgagtcgcggcgcctgtggcgcgccctggccgggctcgacccggccgccgcggatgcgcggtggatcgagcgcgcactgcgagccatcgccgtccgccatcgcgatccgccgctcgccgcgcggcacgcacgccgtgccggcgcccgcctggcggccgccggcgagtggcgcctggccgcgatcctcaccgacctcgcctggttgctccgggcctattcgcaaagcgtctcgtccgacggggcgcagcatggagaaaagacctcatga

SEQ ID NO: 3214 - DNA, 2031 bp, Pseudomonas aeruginosa
actgcgggtgctgccgatcctcgccctgcacgtgccacagccggtcgatccgcgactggcggcgctgtgccgcagcctgcgcgccgagccggccgccgactggagcctgggcgatgccgcgcgtcgcctgggcgtcagcccgcggaccctgacccgcgccttccagcgcgaaaccggtctcagcttcgtccagtggctgcggcgcatgcgcctgctcgccagcctcgatgcgctggcggcagggcactcgatcctcgaggtcgcactggacctcggctacgacagccagagcgccttcagcgccatgtttcgccggaccctgggcgtttcgccgagcctctatttcggccgcggcgccgcctacggggtggccgagggcgactgagttcagtccttctggcgcagcatcagcgaggccagggcgcaggccaggagcgccacgcaggaaaggtagaaggcgtcggagtaggccatcaggtaggcctgctggcgcaccccgtggtcgagcagggccagcgcctgctgctgctccggcagttgtatccgcacctggccaccgcccaggcgctgctgcagggcgccgtcgaagatcgtcagggtctcgccgatccgctcggagtggaagcgctcgcgcagcgagaccagttgcgtcagcagcgcggtgccgatcgcgccgccgaggttgcgcagcatcgagatcagcgccgaggccgagccggcctcggccttgtccaggcccttcaccgccagtaccgagagcgcgaccatgatcagcggctggccgatgccgcgcacgacgatggaggggatgatcacgttacgtcccgcgtcggcgttcaggtgcgcgcccatccagcagcccagggccatgatcgcgaagccgccggccaccagcagcttggggttcagccagcgcatcaggcgcggcagcagcggcgccaggagcagttgcacgaggccgtagaggatcaggctgtcgccgatctgccgggcgttgaaaccctgcaactgggacaggtagttgggcaccaggaacaccaggccgaaggtcgccgcgccgaacaccgccatcgccaggctggacacgccgaagttgtagctgcccagcaggcgcaggttgatgaacggccgcgcgccccacagttggcgctgtacgaagagcagcagggcgagcacggcgaggacggcgaaggtgcggatgaagccggactcgaaccagtcgcggcggccaccttcctccagcactatctgcagcgcgccgaggccggcgaccatcgcgccgatgccgagccagtcggcctggcgcaggcgttcgcggtcgccgtcgcgggggcggatcgaccaggccaccgcggccagcagggcgatccccggcaacagttgcaggagaaagatccagcgccaggaataggcatccgccagccagccgccgatcgacgggccggcggcctgggccacgctgttggaaaggctgaacagcgccatgccgaggggtatccggctggacggcagctcggtgaggatcagttgcatcgacagcgggatcagcaccgcccccgaagccccctggatcacccggatcaggatcagcgtcgacaggttcggcgccagcgcgcagctcagcgaactgagcaggaacaccagcgagccgaggagcatcacccggcgcaaggagaacacttccaccagccaggcggtaagcgggatcatgctgatttccgcgaccagataggcggtggagatccacgagccctcctcgaaggtggctcccagcgcgccttctatctccggcagcgccgcgctggtgacgtgcacgttcatgccggccatgaagcagccgaacaggccgccggtgacggcgacccaggcacgcagcgataccttgtcgtcagcgctcatcggcggaggctccgtccggttcgcgagtgtccacggtggcgatcaccgacatccccggaagcagccggccccgctcggcggcgtcggcgtccaggcggatacgcaccgggaagcgctggacgatcttggtga

SEQ ID NO: 3215 - DNA, 606 bp, Pseudomonas aeruginosa
cggggttgtctgcgcacagttcccgcggaaaagcaccggcacacttgccgttccctcgcctgccccgaggcgggacggatagcgccgcgcgccattcgccctgtccgcaggaggctcagaacagccgcagcggttcctcgtccagcgccgccagttgttcgcgcagcaccagcacctgctcgccccagtaacgttcgctgccgaaccaggggaagctcggcgggaacgccgggtcgtcccagcgccgcgcgagccaggcgctgtagtgcatcaggcggaggctgcgcaggccttcgagcagcggtagctggcgcgggtcgaagtcgtggaactcgttgtagccgtcgaccagttcggcaatctgcgccaggcgttcgtggcgctcgccggcgagcatcatccacaggtcctggagggccgggcccatgcggcagtcgtcgagatcgaccatgtggtagacatcgtcgcggcacagcaggttgcctggatggcagtcgccgtgcaggcggatcggctggtagggcacctcggcgaacagggcgtcgaggcgtttcagcaggtcgcgggcgaccgactcgtaggccggcagcaggctcctggggatga

SEQ ID NO: 3216 - DNA, 939 bp, Pseudomonas aeruginosa
agtcgacctcaattccgacatgggcgaaggcttcggcccatggaccatcggcgatggcgtggacgcggcgatcatgccgctgatcagcagcgccaacatcgccaccggtttccatgccggcgacccgagcagcatgcgccgcaccgtggagatggccgccgagcatggcgtggccatcggcgcccatccgggcttccgcgacctggtcggcttcgggcgtcggcacatcgccgcgccggccatcgagctggtcaacgacatgctctaccagcttggcgcactgcgcgaattcgcccggctgcagggcctgtcgctgcaacacgtcaagccccacggcgcgctctacatgcacctggcgcgggacgaggtcgccgcgcgcctgttcgtcgagaccctgcaacgcctggaaccggaactgctgctctattgcatgcccggttcggccacctggcgcatcggccgggaactgggccagccgctggtgcgcgagttctacgccgaccgcgactacgaccgcagcggctccatcgtcttcacccggcgggtcgccgccctcgatccgcagcaggtcgccgacaaggtcctgcgcgcctgccgcgagggcaaggtgcgcaccgtcgagggcgaggacctcgacatcgccttcgactcggtgtgcatccacagcgatacccccggtgccctggagctggtcgccagcacccgtgcgcgcctggagggcgccggcatccgcatcaaggcgccgcgttgagcgccgctcgcctcggcgagcctcgcgacaagcttttctgccatttcctacaacgttcgaataatgaggattcgtcatggccgaacataacgtgcagtcccccttgcccggcaccttctatcgcaaggccagccccgacgcgccgccctacgcggaggtcgggcaggcggtcgaggccggcagcgtga

SEQ ID NO: 3217 - DNA, 1551 bp, Pseudomonas aeruginosa
ggtacgcctgatcggccctgcgcgggccgagcggagctacctggatatcgaggcgattctcatggcggcgcgggaaaccggtgccgactcgatccatcccggctacggtttcctctccgagaaccccgccttcgccgaagcggtgcaggcggccggcctggtcttcgtcggtccggaggcgcagaccatccgccgcatgggcgacaaggccgaggcgcggcgtaccgcgatggccgccggggtgccggtggtgccgggctcgcccggcgagctgggcgacctcgacgcggcgctggcttgcgccgaagaggtcggctatccgctgctggtcaaggcctccgccggcggcggcgggcgtggcatccgtatcgcccacgacgccgacgaactacgtcgggaattccccatcgcccagcgcgaggcgcaggccgccttcggttcgccggcggtgtacttggagcgcttcatccgccaggcacggcacatcgaagtgcagatcctcggcgatggcgagcgcgcggtgcatctgttcgaacgcgaatgctcgctgcagcggcggcgccagaaggtcttcgaggaggcaccttcggcggcgctggacggcgcgcagcgccaggccctctgcgagagcgcggtgcgcctggcgcagagtctcggctatcgtggcgcgggcaccctggaatacctgttcgacgcgcacagcggcgagttcttcttcatcgagatgaacacccgtatccaggtcgagcatccggtcagcgagatggtcaccggcatcgacctggtccaggccatgctgcgcatcgccgccggcgaggcgctgccctggcgccaggaggacattcgcctgaacggcgcggcgctggagatgcggatcaacgccgaagacccggcgcgcaatttcttccccagccccggcaccgtggagcgcctggaatggccgcagggcgagggcgtgcgagtggacagccacctgtatcccggctaccgggtgccgccgtactacgattcgttgctggccaagctgatcgtccatggtcgcgaccgcgacgaagcgttcgcccgcgcgcgccaggcgctggagcgcaccgtgctggccggcatggccactaccctgccgctgcaccgctggctgctcgccgatgcgcgggtacaggccgcgcagttcgataccgctaccctggaaacctggctcgccgagcggaccgccgccgcgcaggaggtttgagatgcatgccaacatccgctacagcttcggcggcgacgagcacctgttcgccgaggtcgccgagtccatgtcgctggaagccttcttccgcggcatggcgatcacccgcgccatcgagaccctgcaattgcccggggtgctcgacgtatgcctggccaacgcctcgttccaggtccgcttcgaccccgaccggctggccccgcaggcgctgctggagacggtgcgcggcctggaggtcgaggcggtcgccgcgcgcagcatcgagacgcgtatcgtcgaagtgccggtgttgtacaacgatccctggacccacgagaccctga

SEQ ID NO: 3218 - DNA, 1044 bp, Pseudomonas aeruginosa
gtttcgatctcgacgcgttccttgccgatccgcgaggctgcacgcaacatctgcaggaggtgctgtatgtcgattaaggtgctcaagcccggcctcgccacctcggtgcaggacgccggccgcgaaggccactatcacctgggcatcccgccgtccggcgcgctcgaccagtatgccctgcgcgctgccaacttgctggtgggcaacgcaccgaccgccgccgtgttggagtgcgcgctgctggggccgcagctggagttccagcgcgacgccttggtggccgtgtgcggggcgcgcatgacgcctcgcctggagggcgcggagatgccgctggatacttccttccgggttcgcgccggccaggtcctggggttcgatttcattcgtgccggcgcccgtggctatctcgccatcgacggcggcatcgcggtacccgaggtgctgggcagtcgttcgacctacggtctgggggcgatcggtggcttgcagggacgacggctggcggagggcgacctgctgcctctggggcctgcctcgccctctgccgtggagggcttggcgctgccgcgttcgctgcaggtggaggtcggcggcgaggtgagcttgcgggtggttcccggactctacgtccatcgcctgacccccgacgcggtcgagcgtttcttcgccgagacctggaccgtcggttcggaggcggaccgcaccggctaccgcttcaagggcggcacggcgctccggttcgagccgcgcgaacagccattcggcgcaggctcggacccgtccaacatcgtcgacgcctgctatcccatcggctcgatccaggtaccgggcgggctcgaacccatcgtcctgcatcgtgatgcggtgtccggtgggggatatgccacgctgggcacggtgatcagccccgacctgaaccggctggcgcagatgcaaccgaaccagaaggcgcgtttcgtcgccgtcagcctggaggaaggtctcgaggcgcgtcgccgttacaactggcaagtgcaacgacttcagcacttcttcctgcgctga

SEQ ID NO: 3219 - DNA, 210 bp, Pseudomonas aeruginosa
aacccgtatcgtgttttggaaagtggttggtcggaatggtcgaatatatttttcgttatacttccgctgcgctttgaatggctatatttagggtggttggttgcgttcatggttcaagtctggataacttgttttcgttgcgcaccgctagggtggcaagagattcaatgtttctccatgttagaaacctgccagggaatatataaataa

SEQ ID NO: 3220 - DNA, 1182 bp, Pseudomonas aeruginosa
tcctgtgtcctgggttgggttgacagcgtcatacagccacttatgatgcccttgagcctgacccccggcgtgccggggctccccgacaaaaggcgccatacaagcgtcgaaggaatcttccccatgagtgcaaccgcttccgtcgccacccgtcacgactggtccctcgccgaagtccgtgccctgttcgagcaaccgttcaacgacctgctgttccaggcgcagacggtgcatcgcgcgcacttcgacccgaaccgcgtgcaggtctcgacgctgctgtcgatcaagaccggcgcctgtcccgaggactgcaagtactgcccgcagtccggccactacaacaccggcctggacaaggagaagctgatggaggtgcagaaggtcctcgaggcggcggccgaggccaaggccatcggttcgacccgcttctgcatgggcgctgcctggaagcacccgtcggccaaggacatgccctacgtcctggagatggtcaagggcgtgaagaagctcggcctggagacctgcatgaccctcggtcgcctgacccaggaacagacccaggcgctggcggacgccggcctcgactactacaaccacaacctggatacctcgccggagttctacggcaacatcatcaccacccgcacctacagcgagcgcctgcagaccctggcctacgtgcgcgaggcggggatgaagatctgctccggcggcatcctcggcatgggcgagtcggtggacgaccgcgccggcctgctgatccaactggcgaacctgccggagcacccggagtcggtgccgatcaacatgctggtgaaggtcaagggcacgcccctggcggaagagagggacgtcgatcccttcgacttcatccgcaccctggcggtggcccggatcatgatgccgaagtcccacgtgcgcctgtccgccggccgcgagcagatgaacgagcagatgcaggcgctggccttcatggccggggccaactcgatcttctacggcgaaaagctgctgaccacgaagaacccgcaggccgaaaaggacatgcagttgttcgcccgtctcggcatcaagccggaagagcgcgaagagcacgccgacgaagtgcaccaggccgccatcgagcaggcgttggtggaacaacgcgaatcgaagctgttctataacgccgcttccgcctga

SEQ ID NO: 3221 - DNA, 1311 bp, Pseudomonas aeruginosa
ccatactggaagggagggcgccgccgtcccttcgttgcagccgctgatgtcggccctgcgtggacgggtgcgcctgcgtccgtccagcaacacgagcgacctgccatgtccttcgatctcgcttcccgcctcgccagccggcgcgcggaagacctctaccgccagcggccgctgctggagtcggcccagggcccggacgtcgtggtcgacggccagccgctgctggccttctgttccaacgactacctcggcctggccaaccatcccgaggtgatcgccgcgctgcgcgccggcgccgagcgctggggcgtgggcggtggcgcctcgcacctggtggtcggccacagcggcccgcaccacgaactggagctggccctcgccgaattcaccgggcggccccgtgcgctgctgttctccaccggctacatggccaatctcggcgcggtgaccgcgctggtcggcaagggcgacacggtgctggaggaccgcctcaaccacgcttcgctgctggatgccggattgctctccggcgcgcgtttctcgcgctacctgcacaacgacccggcaagcctcgccgcgcgcctggacaaggccgagggcaataccctggtggtcaccgacggggtcttcagcatggacggcaatctcgccgacctgccggccctggccgccgtcgcgcaggcccgcggcgcctggctgatggtcgacgacgcgcatggcttcggcccgctgggcgccagcggcggcgggatcgtcgaacatttcggcctcggccaggagcaggtgccggtgctgatcggcaccctcggcaagggtttcggtaccgccggcgccttcgtagcgggcagcgaggaactgatcgagaccctgattcagtacgcccggccctacatctacaccaccagccagccgccagcggtggcctgcgccaccctgaagagcctggagctgctgcgccgcgaaagctggcggcggcaacacctggcggcgctgatcgcccgtttccgccatggcgccgaggcgcttggcctgaccctgatggacagcttcacgccgatccagccgatcctggtcggcggcagccgccaggccgtggccctggccggcatgcttcgagcccgtggcatcatggtcggcgcgatccgcccgccaaccgtgccggccaacagcgcgcggctgcgcgtcacgctgtccgccgcgcacagcgaagcgcaggtcgaccgcttgctcgaagccctcggcgaaagctggcgacagctgtcgtctagccttctggcagagatcgaagccgaggagggagacgatgcgtga

SEQ ID NO: 3222 - DNA, 603 bp, Pseudomonas aeruginosa
cgatgcctgacgattcctcgccgctgctggcgccccatggcgttgccgcgctgcccgacaagcgccaggtcgccgcgtcgttttcccgcgcggcggccagatacgacgcggtggccgaactccagcgcggcgtcggtgagagcctgctgtcggcattgccggaaggcttctcgccgcgccgctgggtcgatctcggctgcggcaccggttatttcagccgggccctggaacgacgcttcggtgcggccgagggcctggccgtggatatcgccgaaggcatgctgcggcatgcccgcgcgcgcggcggcgccagccatttcattggcggcgacgccgagaggctgccgttgcgcgacggcagttgcgacctgctgttctccagcctggctatccagtggtgcgccgacctcccggcggtcctggccgaggcgcggcgggtcctgcggccgggcggcgtgctggcgttcagcagcctgtgcgtcggtaccctgggcgagttgcgcgacagttggcgggtggtggacggcttcgtccacgtcaatcgcttccgcgccttcgccgactacctgcaacacgcggccggcagcggcctgctgccgctga

SEQ ID NO: 3223 - DNA, 306 bp, Pseudomonas aeruginosa
ccgagccgcactgcggcaccgacctgggcatgctgcgcaccaaggccgagccgcaggccgacggtagctacaaggtcaccggcaccaagatcttcatctccgccggcgagcacgacatggccgacaacatcgtccatatcgtcctggcccgcctgcccgacgccccgcagggcaccaagggcatctcgctgttcatcgtgccgaagttcctgcccaacgccgaaggcaacgccggcgagcgcaacgcggtttcctgcggttccatcgagcacaagatgggcatccacggcaacgccacctgcgtga

SEQ ID NO: 3224 - DNA, 1200 bp, Pseudomonas aeruginosa
cgtgggcgcgcgcaatgcggtctcctgtggctccatcgagcacaagatggggatcaaggcctcggccacctgtgtgatgaacttcgacggcgccaccggctacctgatcggcgagccgaacaagggcctgcactgcatgttcaccatgatgaaccacgcccgcctgggcaccggcatgcagggcctgtgccttggcgagaccagttaccagggcgccgtgcgctacgcccgggagcgcttgcagatgcgctcgctgaccgggccgaaggcgccggacaagccggccgacccgatcatcgtgcaccccgacgtacggcgcatgctgctgaccatgaaggcgttcaacgaaggcaaccgcgcgctggcctacttcaccgcccagttgctcgacaccgagcacctgtcgcaggacgccgccgagcgcgagcgggccgccgacctgctggccttcctgacaccgatctgcaaggccttcatgaccgagaccgggcaggaggtgaccaacctcggcatgcaggtctacggcggccacggctacatccgcgagtggggcatggagcagttggtccgcgattgccgcatcgcacagatctacgaaggcaccaacggcatccaggccctcgacctgcttggccgcaaggtactgggcagccagggcaagctgttgcgcggtttcaccaaactggtccaccagttgtgccaggcccaggccgagcatccgcaactgaagggacaggtcgcgcaactggcggcgctgaacgcgcagtggggcgaactgacccagcaggtgggcctggcggcgatgaagaatgccgacgaagtgggcgccgcctcggtggactacctgatgttctccggctacgtgaccctggcctatttctggttgcgcatcgccctggtggcgcgcgagaagctggatgccggcagcggcgaggccgcgttctacgaagccaagctggccaccgccgacttctacttcagtcgcctgctgccgcgcaccgcggcgcacgccgcggcgatccaggccggcgcggcgggcctgatgagcctgtcggcggagcagttttcgctctagcggctgccggggcaggggcgcggcgcttcttcccccggtttctcccgcacccgccgggcccgtcggactcccggcgaactcgctcgagcccgcgaaaagcgggctttctcatgcctgtcgcatag

SEQ ID NO: 3225 - DNA, 1863 bp, Pseudomonas aeruginosa
actcggccgcggcacgcctttcgtgcctccattttgttgccgctggcccccggccggcgatcggtacgatcgaggattccccacatggctgattacaaagctccgctgcgcgacatgcgcttcgtcctcaatgaggtgttcgaggtctcccggctctgggcgcaactgccggcgctggccgaagtggtcgacgccgagaccgccgcggcgatcctcgaagaggccggcaaggtcaccgccggtaccatcgccccgctgaaccgtccgggcgacgaggaaggctgccagtggaacgctggcgcggtgagcaccccggccggcttccccgaggcctaccggacctacgccgaaggcggctgggtcggcgtcggcggtgatccgacctacggcggcatgggtatgcccaaggtgatctcggcgcaggtcgaggaattggtcaactcggccaacctgtcgttcggcctgtatccgatgctgaccgccggcgcctgcctggcgctcaatgcccatgccagcgacgaactgaaggacaagtacctgccgaacatgtacgccggtatctgggccggttccatgtgcctgaccgagccgcatgccggcaccgacctgggcatcatccgcaccagggccgagccgcaggccgacggctcctacaagatcagcgggaccaagatcttcatcaccggcggcgagcatgacctgaccgagaacatcatccacctggtgctggccaagctgcccgacgccccggccgggccgaagggcatctcgctgttcctggtaccgaaggtgctggtcaacgccgatggctcgctgggcgagaagaacagcctgggttgcggctccatcgagcacaagatggggatcaaggcctcggccacctgcgtgatgaacttcgacggcgctaccggttggctggtgggcgaggtcaacaagggcctggcggcgatgttcaccatgatgaactacgagcgccttggcgtcggcatccagggcctggccactggcgagcgctcctaccagagcgccatcgaatatgcccgcgagcgtatccagagccgcgcgccgaccggcccggtggccaaggacaaggccgccgacccgatcatcgtgcaccccgacgtgcgtcgcatgctgctcaccatgaaggcgctgaacgaaggcggccgcgccttctccagctacgtcgcgatgcagctggacaccgccaagtacagcgaagacgcggtcacccgcaagcgcgcggaagagctggtggcgctgctgaccccggtggccaaggcattcctcaccgacatggggctggaaaccaccatccatggccagcagatcttcggtggccacggcttcatccgcgaatggggccaggagcaactggtgcgcgactgtcgcatcacgcagatctacgaaggcaccaatggcattcaggcgctcgacctggtggggcgcaaggtgatcggcagcggcggcgccttctcccgtcacttcaccgacgagatcaaggccttcgtcgcttccgccgacgaggccctgggcgagttcagcaagccgctggcggccgccgtggagaacctggaagagctgaccgcctggctgctcgaccgcgccaagggcaatcccaacgagatcggcgcggcgtcggtcgaatacctgcatgtgttcggctacaccgcctatgcctacatgtgggcattgatggcgcgcaccgcgctggccaagcagggcgaggacgacttctacgccagcaagctgggtaccgcgcgcttctacttcgcccgcctgctgccgcgcatccattccctgagcgcctccgtgcgcgccggcagcgagtcgctgtacctgctggacgccgagcagttctga

SEQ ID NO: 3226 - DNA, 1623 bp, Pseudomonas aeruginosa
tggcgtctcgcccgagcctcagtgcgaggttccctccgcatagccgatcttgttgccgacgttgtacttgcccgacggcttgttcatcggcagtcgcttcacttcctccaggctgtgcgcgtcgtagaccaccagcgcgccgtcgcggtcccagacgctgagcagggcgtagcggccgtcgcgggtgaactcgacgtggccggcgaccttgcccgggctggggcgcaggcgatgggcgatttccagggtctgcttgtcgatcagcaggatctcgtcgtgtttcttgccaaggaaggtatcggtccaggcgtagggcgagtcggcatggctgcgcatgaagaagccggggccgtcggtgacgatttccttcaacggcttccagttttgcaggtcgatcaccgagatcaccccgcggctgatgttcggcgtggcgaatacccagcgcccgtcgcgcttccagtagatgcccgagccgaggtgcggcatgcccgacagcgggatcgaggcgacccgcgcgccgctgtccagctcgatcacctcgccgcccctggcctgccgcgagctgcccagcaggtagcggtagtcggggctgaaggagaagtcgtcgaggtagtcggccaccgccaaccgtttcggcgcgaccggcttgccgttggcatagggcagctcccacagctcgtggacgtccttcagggcgaccacgaagctgtgtcgcggcggtgccgtgtataccgcgctgacccgcgaggcctggccctgggcgtcggccgccgggatgacctgcaccagggacaggtcgcgggcgtccagcagcaccaggttgccgggcaggtagttgcccaccaggacccagcgcccgtcgtcgctgaccgccaggttgcgcgtgttgaggccggcgcggacctcggcgaccaccttcaggttgtacaggtcgtagagggttacccagccgtcgcgcgaggcgaagaacaccaggcgcccgtccggggagaacttcggacctccgtgcagggcgtagcgcgaggggaagcgggcgatgggctcgaagcgatcgccgtcgaggatggtcacgtggtggtcgccggactccaccaccacgaacaggttcagcgggtcggcctcgaagcggggcctggacggcagggtggcgaggggatgcggctgaacctggctggcccggatgtcctcggcgctccactgcggttcgcgcggcggcgcctggtagagataggcgaccagggcgtccgccgcggcgtcgtccaattgaccggcaaagccggccatctgggttgccgggcgaccgtgcaggatcacttcgcgggcctgcgccggcttcagccgcgaaaggctttccgggagcagggtcgggccgctgccgccgagccgcccggcgccgtggcaggcctggcagtgctggcggtagagcgcttcccccggcgcttcgccggcctgtgcgagggcgccgaggagcaggccgagggcgaggccgatcaggcgcatgcgacggcctcgcggctgaccggcgagccggcgcccaggtatgaaggatgcgccatcgcgcgctcggcgaagagcgccaccacctggccgacgacgatcagcgtcggcggcttcaactggtag

SEQ ID NO: 3227 - DNA, 909 bp, Pseudomonas aeruginosa
acagccagcggtgcggtgtctggcgcagggcgtggcgctccagcagggcctcgatctggcgttccacttcgccgcgctcgcggccgtggatcatgcaaaacaggttgtatggccacatcggcaggcgacgcgggcggcggtaacagagcgagacgatcgtttcgtgggcgagggcgcggccgacggcgtcgacctccgcgtggccgacgtccagcaccagcttggcgttggcggtatagcccagggcgcggtggtggaggatcactccgaagcggcggaacaggccgtcttcgtcccagcggcggacctgttccagcacttcgtcttcgccggcgccgatgcgttcggcgagcacccggtagggccggctggccagcggcaggccctgttccagcaggtagcgcaggtgttgccgctgcggcgcggcgaggggttcgacggggttcatcggctggcctccaggggaaacgcgaggtcgatgcagtaggcttcctgcatcggcaggtcgaggggttgcaggccggtgtcggcggcgatctccgccagtacccggtcgagttgcgcgcggtcgccggcggtgagcacgaaccacaggttgtagcggtgttcgcgctggtagttgtggttgacctcggcgtactggctgatgcgctcggcgacccgttgcagacgctcctcgggcaccgccagggcagccagggtgctggccccggcgcgttggtggcggagcaccgggccgacccgcgacaacgcgccgtcggcttccaggcgacgcagccgttcgagcacctcggcttcgctgcaacccagggtctcggccatccgccgatagggttccgcgcagatcggcaggcctttctggtagcgggcgaggaggcggcgggagaggtcgtccatggtgcctcctag

SEQ ID NO: 3228 - DNA, 912 bp, Pseudomonas aeruginosa
gatcgaagtcttcgagcgcgcctggcggcacggcctgccggtattgctcaagggccccaccggttgcggcaagacccgcttcgtccagtacatggcgcggcgcctggaactgccgctgtacagcgtcgcctgccacgacgacctgggcgccgccgacctgctcggccgccatctgatcggcgccgacggcacctggtggcaggacggcccgctgacccgcgcggtgcgcgaaggcggtatctgctacctggacgaagtggtggaggcgcgccaggacaccacggtcgccatccacccgctggccgacgaccgccgcgagctgtacctggagcgcaccggcgagacgttgcaggcgccgccttcgttcatgctggtggtgtcctacaaccccggctaccagaacctgctcaagggcctgaagcccagcacccggcagcgtttcgtcgcgttgcgcttcgactacccggcggcgcagcaggaggcacgcatcctggtcggcgagagcggttgtgccgaggccctggcgcagcgcctggtgcagttgggccaggcgctgcggcggctggagcagcacgacctggaggaagtcgcctcgacccgcctgctgatcttcgccgcgcgcctcatcggcgacggcatggacccgcgcgaggcgtgccgggtggcgctggccgaaccgctctcggacgacccggcgacggtggcggcgctgatggacatcgtcgatctccatgtcgcctgataccgtcgagcggcgcctgcccggcgacctggcgatgtggttcttcatcctcgccgaactcagcgtgttcagcctgctgctgctggcgttcgccggcgcccaggcctggcagccggagctgttccgtgccggccgggagcaactggatagccgctggggcctgttgctga

SEQ ID NO: 3229 - DNA, 405 bp, Pseudomonas aeruginosa
tcctcggctggctggcgcaggcctgctggcgccggtgttatacgccgcaggcttgctcgggactggagtcgggagtgctctactggcacatggtcgacctggtctgggtgctgctgttcccgctggtctacgtcctgcaatgaggtgccgatgcgaaccctgaccctctgctggctggcgttgctggcgctggccgtgaccggtgtgctgctgggtggcgccggcgactctccctggctgctggcggcggtgctggccctgcgcggtggccaagggttggctgatcggcgagcgcttcatggagctggcccatgccccggcgctatggcgccgcctgctgctggcctggccgctgctgatggccctggcggtgggcgctgcgctgtacctggcgcggatgaataa

SEQ ID NO: 3230 - DNA, 534 bp, Pseudomonas aeruginosa
ctgagtaaatcgttcgggaatcttgattgccatcaagcgggttcgccgccgccgcttcctagaatcgccgcaccacccattccaggaggccgcatgtccgagacctttaccaaaggcatggccaggaacatctatttcggcgggagtgtgttcttcatcctgctgttcctggccctgacctaccacaccgagaagaccctgcccgagcgcaccaacgaggccgcgatgagcgccgcggtggtgcgcggcaagctggtctgggaacagaacaactgcgtcggctgccacaccctgctcggcgagggcgcctacttcgcgccggagctgggcaacgtggtcggacgccgtggcggcgaggagggcttcaacaccttcctccaggcctggatgaatatccagccgctgaacgtgccgggccgccgcgccatgccgcagttccatctcagcgagggccaggtcgacgacctggccgagttcctcaagtggagctcgaagatcgataccaaccaatggccgccgaacaaggagggttga

SEQ ID NO: 3231 - DNA, 1869 bp, Pseudomonas aeruginosa
gcttccggcgcggcaaggcggccgcctgagatggccttcgccgtcgagctggaggaatgggtcggcgcccactggcaccgcttcatcacccgccatgccagcggcgagttcgaggcggcgcgggtgaccctggagagcatgcggcgtccgctcggcatgctcttccgggcgctcggcggcgcaccgggggtagccctcgaggcgaccccggcgcgccgcctgctgctacgccgcacctggttgcagcgggtcgccgggacctgcgagcaggccccggtgtcctggttcaacggcgacagcctgcgcctgccggaatccctcgcggtctatccgcaggccgagctgaaccgcgaactgtatcgctggctggcgctgctggcggccagcgccgggccgctgcggcactgggcccaggacaaccagcgctgggcgcggcagttgctcgatgcctatccggcgctgcgcccgcgctacgcccggctggtcgccgcgcatctgcgccagcgcccgtcgctggacgattgcccggcggcagacgccgaactggaaatcgccctgcgccgcgcgcttgccgagccgggcagcgtcgagcgcttcccgcgagtcgagcgggcgccctggccggtgccgctgtggctgtatcccggcgagcgctggacgccttccgccagtgcggaggacggcgaggaagcggccgccggcgccggcaagcgccaggtcgcccgcagcggagcgcgcaagcgcgccgagcgcattgaggaacgcaacagcgaacgcaacctgctgctgttccgcctggaaagcctgctcagttggtcggagcacctggccctggaccgctgtagcgacgacgaggacgacccggacggcgcgcgcgtcgccgaagacctcgactacctgtcgctgtcgcgccagcgcacgcagaagggcggcggcctgcgcctggatctcgacctgccggccgccgactacgatgacctgccgctcggccccgggctgaagctgcccgagtgggactatcggcagcagcgcctgctgagcgaccacgtgctgctgcaaccgatgcggccgcgcggcgcgaccagcgccagcctgccggcgcacctggagaagaccgcgctgcatctgcgccgccagttcgcctgcctgcgcgacggccgccaacgcctgcgccagcagccgcaaggcgacgagatcgacctcgatgcctggctcgacttccaggtcgagcggcggcgcggcggttccacccagccaggcctgttcctcgaacagcggccgcgccggcgcgacctcgcctgcctgttgctggcggacctgtcgatgtccaccgaagcctacctcgacgaccagcggcgagtgatcgacagcatcgtcgacagcctgctgctgttcggcgaggcgttgcaggcactgggcgaccccttcgcgctgtacgggttttcctcggtgcgccggcagcaggtgcgctggcaggtgctgaaggacttcgacgaaggctacggcggcgaggtccgcggtcgcgtgctggcgctctcgccgggctactacacgcggatgggcgcggcgatccgccgggccagccaggtgctcggcgggcagccgcagaagcgtcgcctgctgttgctgttgagcgacggcaagcccaacgacctggaccgctacgagggccgctacggcatcgaggacacccgccaggcggtgatcgaggcgcgcagccagggactggtgccgttctgcatcaccatcgacaaggaggcggcggactacctgccctacctgttcggcgccgacggcttcgcgctggtcgagcgcgccgggcagttgcccgagcgcctgctccagctctatcggcgcctgcgccgctga

SEQ ID NO: 3232 - DNA, 741 bp, Pseudomonas aeruginosa
tctagctgcattggcggtacatcgggtggtcgcggagcaatggagcagatagtcgtaaacggtgttttcataggtaaagtcgaagaaacctggggcggattggtcagcgcgatcgacaagctgccggtcgagcaggagttctggctgggccacgatggcctgcccggcgacgaacaggccgacatccgccaccacggcggcctcgagcgcgctcttcatcactatcccgccgagcactaccgctactggcgcaagcgccacccgctgaaccgctggcaactgccggcgttcggcgagaacatctcgacctacggcatcaccgaagccgaggtctgcatcggcgaccagttccattggggcgatgccctgctggaagtcagccagccgcgttcgccctgctatcgccagggccagcgctggaatcttcccgagctgcccgacgaattgcagagcggcggccgctgcggctggttctatcgggtcctgcgcagcggcatggtgactcccggggacgagctgaagctggtccagcggcattaccctgaactgaccgtcgcccgcctgttgcagtggtatttcggcgatcccctggagcctctcgggttgcgccagatgatggcctgcgacgcgctatcccagcgttggcgcaagacagcggcgaaacgcctgtccagcggcgtgatggaagactgggggccgcgcctgcgcggaccgtcggattaccgggagcatgcctcttga

SEQ ID NO: 3233 - DNA, 1173 bp, Pseudomonas aeruginosa
aagatggctgatgcgctggatagcctgcgcctgatgcgcacccaggaacggcccgaacaggtgttcgtccgtggccagggctcgtggctgtgggacagcgacggacgcgccttcctcgacttcacccagggcctggcggtgaactgccttggccacagtcccagcgtgctggtccaggccctggcccggcaggcgcgggagctggtcagcgccggccccggcctgctcaaccggccggtgctggcattggcgcagcgcctgtgcctggcgaccggcagcgaccaggcctacttcctcaccagcggcgccgaggccaacgaagcggccatcgccctggcgcgcaagtggggccgcctgcatcgcggcggcgcgcaacggatcgtcagcactgtcaacagcatccatggacgcaccccgggcaccctgacggcttgtggcaagccggcgcagcatggcctggagggattggccagggtgccgttcaacgacctcgacgccatggccgcggccatcgacgaagagacggtggcggtgatgctggagccggtgcagggcgatgccggggtgatcccggcgaccctcgactacctgcgtggcatcgagcggctgtgccggcagcgtggcgtcctgttgatcctcgacgaggtgcagaccggcatcggccgctgcggcgcgctgctggcggaggaactgtacggggtacgcgccgacatcgttaccctcggcaagggcctcggcgccggggtgccgctgtcggcgctgctggcgcgtggcaacgcctgctgcttcgaaccgggcgaccagcttggcacccaccacggcaacgcgttgatgaccgctgccgggctggcggtactgaataccgtgctggagccgggtttcctggagcaggtgcgcgagcagggcacccacctacgcgatggcctggcccgtgtcgcgcgtcgctatgggcatggtccgctgcgcggccagggactgttctgggggccgccgctgatcggccagcgcgcgccggcggtggttcgcgcggcgttcggcgaagggctgctgatcaacgcgccgcagccgcattgcctgcgtttttccccggcgctgacggtgagccgggccaacgtcgacgaaatgctgcggcgactggagcgggccctggcccgggtcgccaaccgacactag

SEQ ID NO: 3234 - DNA, 1965 bp, Pseudomonas aeruginosa
cctcccggccggcgcggcgtctgggcttcccgcccggacattgcttcctgtatcgccagggtaggggtgcctccgctatcgtttcgcgatgcaaatgcactagcaccgctagtgcaatcgtcacgcgtgcgcggtcagggcgggcgggcatccttgctgcccccggaaaatcgctccatccaagaggaacagcatgaacgaccaggtactgcgtacccagaccgaccgccgccagttgcagcagatcatcgccggccttaccgaaggggtgatcctgatcgagccggaccagcgcatcctctgggccaacgaggcggccctggcgatgcacggcgtccattcgctggaatgcctgggcgccgataccggcgagtatcgcgaacgctttcgcctgcgctaccgcaacaatcatccgctgcaggaggggcagtacccggccgagcgcctggtggctggcgagtgcttcagcgacgtggtggtggaagtgtttcccgccgccgacgaggacacccgctgggtgcaccgcgtgcgcgggttggtgctgacgacccccgaggacaagcccgactgcctggtgctgatcctccacgacgccaccgagtgggccagcgccgagcagcgcttcgagaagaccttcaatgccaacccggcgccggcggtgatctgccggctcagcgactaccgctacgtgaaggtcaatgtcggtttcctggaaatgaccggctatgcccgcgaccaggtgatcggccgttcggtgtacgagctggacgtactcgaccaggccgagcgccgcgaactggcggtggagcgtctgggcgccggcgagaccatcccgcagatggaggcgagcctgcgggtggcggagggcggacgcaagtgcgtggtggtcgccgggcagccgatagaggtcggcgaggaggcctgcatgctcttcaccttcaccgatctcgaaccgcggaagaaggccgaggaggccctgcgcaagagcgaggagcgcttcgccaaggccttccgcatggcaccggtgccgagcctggtgctgtacggcgacgacctgcaggcgctggacatcaaccaggccttcagcgaaaccttcggctaccaggccgaggaactgctcggcgagtccaccgtcgcctgcgggctgtggcaggacggcggcgccgagcgcctgggcgagctgctggcgcagagcggcagcgtgcgcaacgtccagctgcgcctgcagcacaaggatcgcaacggcctggactgcctggtctcggccgaggcggtgagcctcaacgagcaggactgcgtgctggtggccttgctggacatcagcgaccggcggcgcaccgaaatggagctggtgcacgccatcgagacggtgatgcaggacgcttcctggttcagccgcaccctgatcgaaaagctcgccaacgtgcgccgcgccaacgcgccgggcaccggcgccgaactggccgacctgaccgcgcgcgagcgcgaggtgttcgacctcatctgccagggcctggcggacaaggagatcgccaaggaactgggcctggcgccgaacaccgtgcgcaaccacgtggcgaccatctacgccaagctcgatgtccacagccgtggcgaggccatcgtctgggcacgcgaacgcggattcgcgccggagccgcgcaacggcaacgggcgcaaataaacgaagagggtacgaatgcaccagggcggctggtgcattcgtacctgtcgcccgctcccgtcggcgccgacactggcgcagcacgcccggcatgcccccgcccgtggtcgtgcaccttttctccgcggcgcgagccgcgccgtccgcacgtctgttcccctcgccagtttcgctctggcggggggcttcccgcctcctttcgaatatttgcccctctgcctctgctggtgcgcgacggcatcctgccggccgtttgcgaatgctcgggactggtgtcgtga

SEQ ID NO: 3235 - DNA, 1047 bp, Pseudomonas aeruginosa
aaaaagcccgaggcacaggcctcgggcttttcgtcaccagcgtccggaggcgccgccgccgccgctggagccgccgccaccgcggaagatgccgccaccgccgctgccgcctcccccaccgccgccgcgactattgaggatggcgctgagaatggccatcagcacttcgccgggaagcaggaacagggcgtagatgaacagggtcggggccagtacgccgagactgtcgtccgccgcgcggtcgacgttctgccacaggcccatgctcaacagccaggccaggccggcgaccgccgcgctgcaaagcaggaagcggccgatgctgcgccgccgcatccactgcaacggcagcaggcgtccgagcagggccacggcgagcaggaccgccacatagacaccgaggtagaccggattgccccagagctgtccgctcaggccgctcttcttcttcggctccggcggggcgctgtcatacacctcaccctcgtcgaccggtgccggcagggcccgcggcggcgtggcctcgggaaccgccggcaaggcgtcgacgggagcgctggcggtagcgctgtccgggttcttctcggcatcgatcagttgcaccaggctgtccacgccggcctggatgccgccatagaagttgccctggcggaactgcggcgtgatctgctcgctgatgatccgcccggcctggacgtcggtgatggccccttccaggccgtagccgacctcgatgcgcagggtgcggtcgttcttcgccaccagcagcaggacgccgtcgtcgaccttcttctggcccagcttccatttctcgaaggtacgcaccgcgtactcctcgatggaatcgtcgccggtggtcgggaccagcagcacagcgagttgcgcgccgctcttggcttccagggcggcgagctgttgcttcagttgctggcgctggtcgccggaaagcgtcgcggtgaggtcggtgacccgcgccgtcagcgcgggtatcggaggcacatcggccctggtgaccaggctggcgagcagcagcccggcgcccagtag

SEQ ID NO: 3236 - DNA, 474 bp, Pseudomonas aeruginosa
aaaaagagccttgccatgaagctgaagtccctgctcgtcgtgctgctggccggcgtcgccctgagcggctgtcaccgtatggatcccaattcgcccgaggccaagcgccaggcgatcttcaaggaaatgctacggaccagcgaggacatgggcgggatgctccgcggacgcctgcccttcgacgcggagaagttccgtgccggatcggcgaagttgcaccaactggccgaccagccctggcagtacttccccagtcccaaggccggcgaggagggcgaggacacccgcgccaaggacgaggtttggcagcgccagcaggagttcaaggccgccacccaggtcttcatcgacgcgatgaaccgtctccaggacaacacccgccaggccacgccgaccccggatggcgtgcgcaaggacttcgccgcggtggaagacgcctgcgaagcctgccacaagaaattccgcgcgctctga

SEQ ID NO: 3237 - DNA, 474 bp, Pseudomonas aeruginosa
aggtcgcgggcctgcgccggcattacctgctctacgtgccgccgggcgtgtccgagggagcgccgttgctggtggtgctgcacggctcacggggcgacggcgcgcagatgcgccgcatcagcggctacggcttcgaccggctggcggcgcaagaaggtttcctggtggcctacccggacggcttcgagggccactggaacgattgccgcaaggccgccagctattcggcgcggctgcgtgacgtcgatgacgtggctttcctccgcgcgctggtggcgcggctggcccaggaataccgcgtcgattcgcagcgggtatatgtcgccggctactccaatggcggccagatggctttccgcctggccgccgaagcgccggggttgccggcggcgatcgcagcggtggcggcgagcctgccgaccacggggaacgatgcctgtcggccggtcgagcggccgaccgcggcgttgctga

SEQ ID NO: 3238 - DNA, 255 bp, Pseudomonas aeruginosa
cccgtcccggcccggtctggaccgagcgacagcgctggcaggaagacggccatccgccggtggagctgctcagcgtgcatggcggcggccacgtgctggcgcagccggactatcgcttcccgcggattctcggcaagagcgacccggaactggacgcgccagtggaaatctggcgcttcttcagccagttgccgcgctgaggctcagacctcgaagacgaattccggacggaacccgcctctctcgtggggatag

SEQ ID NO: 3239 - DNA, 1470 bp, Pseudomonas aeruginosa
agagcgccgaaggacgctggccgagcgtctggttctgcggtccgcaggggctggccgacagcctgcgccgcgatctgcgccggcagggcatgccgctgcggctgttccaccaggaagccttccgcatgcgctgagcctgccggaaacgaaaaagccccgccgaagcggggctttttatcgcgcggtcgctcagaggccggcggcgtcgcgcaggagagcggccttgtcggtcttctcccaggtgaacgcggtgaaggtatcgccgtccacggtcagctcgaacggatgacgaccgaagtggccgtaggccgcggtcggctggtacatcgggtggagcaggtcgagcatcttggtgatcgcgtacgggcgcaggtcgaagtgctcgcggaccagttgcacgatcttctcgtcgctgaccttgccggtgccgaaggtgttgatcgagatcgaggtcggctgggccacgccgatggcgtaggaaacctggatctcgcaacgctcggcgaggccggcggcgacgatgttcttcgccacgtagcggccggcgtaggcggcggagcggtcgaccttggacgggtccttgccggagaacgcgccgccgccgtggcgggccatgccgccgtaggagtcgacgatgatcttgcgtccggtcaggccgcagtcgccgaccgggccgccgatcacgaagttgccggtcgggttgatgtggaactgggtgtccttgtgcagcagctcggccggcagcacctgcttgatgatcagctccatcacgccgtcgcgcaggtcgttataggagacttccgggttgtgctgggtggacagcaccaccgcatcgatgccgaccaccttgccgccttcgtagcggcaggtcacctgggacttggcgtccgggcgcagccatggcagcaggccggacttgcgcgcctcggcctggcgctcgaccaggcggtgggagaagcagatcggcgccggcatcagcacgtcggtctcgttgctggcgtagccgaacatcaggccctggtcgccggcgccctggtcttccggcttggcccggtcgacgccctggttgatgtccaccgactgcttgccgatgatgttcagcacgccgcaggtggcaccatcgaagccgacgtcggagctgtcgtagccgatgtcgatgatgaccttgcgcaccagctcttccaggtcgacccaggcggaggtggtgacttcaccggcgatgatcgccacgccggtcttgaccagggtttcgcatgccacgcgagcgtacttgtccttggcgatgatggcgtccagcaccgcgtcggagatctggtccgcgatcttgtccggatggccttcggacacggactcggaggtgaaaacggaatattcgctcatcaatcggttcctacattaccggtgggtgaggcggctttcggatgcatccctggcgaagtgccggacctggatctggaagccattgcgtaa

SEQ ID NO: 3240 - DNA, 2229 bp, Pseudomonas aeruginosa
taccgggtccgaaccccggcaatgcctgtatcaaaaatttttgatattgatgacgggtggccgtcgcgcaattgcaatccggctgcgccaggcttctggcaaaaccggtcggcagcgacatactgtccccctgccgatctgtcattgccccttgggccttcggtgggcgaaaatggcgccctttttttcactcctggtcttccgaccagcaacccccgtaggagaattgcgatgcccagccgtcgtgagcgagccaatgccatccgtgcactgagcatggatgccgtgcagaaagccaacagcggccacccgggcgccccgatgggcatggccgatatcgccgaggtcctctggcgcgactacatgcagcacaacccgagcaacccgcagtgggccaaccgcgaccgcttcgtgctgtccaacggccacggctcgatgctgatctactccctgctgcacctcaccgggtacgacctcggcatcgaggacctgaagaacttccgccagctcaactcgcgcaccccgggccacccggagtacggctacaccgccggcgtcgagaccaccaccggtccgctcggccagggcatcgccaatgcggtgggcatggcgctggcggagaaggtcctggccgcccagttcaaccgcgacggccacgcggtggtcgaccactacacctacgccttcctcggcgacggctgcatgatggaaggcatttcccatgaggtcgcctcgctggccggcaccctgcgcctgaacaagctgatcgccttctacgacgacaacggcatttccatcgacggcgaggtccacggctggttcaccgacgacaccccgaagcgcttcgaggcctatggctggcaagtgatccgcaacgtcgacgggcatgacgccgacgaaatcaagaccgccatcgataccgcgcgcaagagcgaccagccgaccctgatctgctgcaagaccgtgatcggtttcggctcgccgaacaagcagggcaaggaagagtgccacggcgcgccgctgggcgccgacgagatcgccgcgacccgcgccgcgctgggctgggagcacgctccgttcgagatcccggcgcagatctacgccgagtgggacgccaaggaaaccggcgccgcccaggaagccgagtggaacaagcgtttcgccgcctaccaggctgcccatccggaactggccgccgaattgctgcgccgcctgaagggcgagctgccggccgacttcgccgagaaggccgcggcctacgtcgccgatgttgccaacaagggtgagaccatcgccagccgcaaggccagccagaacgcgctgaacgccttcggcccgctgctgccggagctgctcggcggttccgccgacctggccggctccaacctgaccttgtggaagggctgcaagggcgtcagcgccgacgacgccgccggcaactacgtgttctacggcgtgcgcgaattcggcatgagcgcgatcatgaatggcgtcgccctgcacggcggtttcattccctacggtgcgaccttcctgatcttcatggaatacgcgcgcaacgccgtgcgcatgtccgcactgatgaagcagcgcgtgctctacgtgttcacccacgactccatcggcctcggcgaggacggcccgacccaccagccgatcgaacaactggccagcctgcgcctgaccccgaacctggacacctggcgcccggccgacgcggtcgagtcggcggtggcctggaagcatgccatcgagcgtaccgacggtccgtccgcgctgatcttctcccgccagaacctgccgcaccaggcgcgcgacgtcgcccaggtggccgacatcgcccgcggcggctacgtgctgaaggactgcgaaggcgagccggaactgatcctgatcgccaccggttcggaagtcggcctggccgtgcaggcctacgacaagctcagcgagcagggccgcaaggtccgcgtggtatcgatgccatgcaccagcgtctacgagcagcaggacgagtcctacaagcagtccgtgctgccggtggaagtcggcgcgcgcatcgccatcgaggccgcccatgccgactactggtacaagtacgtcggtctcgacgggcgcatcatcggcatgaccagcttcggcgagtcggcgccggccccggcgctgttcgagcacttcggcttcaccctggacaacgtcctggcggtagccgaggagctgctggaagactga

SEQ ID NO: 3241 - DNA, 759 bp, Pseudomonas aeruginosa
ctcgaacaggtaggggtagttcacttcgttgtcgtcatccggctcgtggcggtcgggtaccccggcgatctggacgtggccgatattgccgatgtcgcgacgcagggtggtggccaggtcgccctcgacgatctggcagtggtagcagtcgaactgtacctgcaggttgtccgcgccgacctcgcggcagatggcctgggcgtcgtcctggcgggtgaggaagaagcccggcatgtcgcggttgttgatcggctctatgagcaccgtcagcccggcgccggcggcttcgcgggcggcatgggcgaggttgtcgaggtaggtctcgcggtggcggatgcggtcggcgccggccggcagcagtccggccatgacatggatgtggcggttgccgaggacctgggcatagtcgatggcctgggcgatggcgcggcggaattcggcctcgcgccccggcaggctggccaggccgcgctcgcccttgtcccagtcgccgggtgcggcattgaacagcatctggcgcaggccgtggtcgtccagccgggccttcagttcggccgcagggtaggcataggggaacaggtactccacgccctcgaagccgtccgccgcggcggcggcgaagcgttcgaggaagtcgtggcgggggtagagcatgctgaggttggcggcgaagcggggcatctggcgctcctggcggtcggtggatgcgggcgagccttgcacaacggaacgcggtcgcgccagccaggtgtcgcatga

SEQ ID NO: 3242 - DNA, 1191 bp, Pseudomonas aeruginosa
tcaacaagtacccaaggactgattgtcatgaccgtgttgaagatgactgacctcgacctcaaaggtaagcgcgtgctgatccgcgaggacctcaacgtgcccgtgaaggacggccaggtgcagagcgatgcacggatcaaggccgccctgccgaccctcaagctggccctggagaagggcgcggcggtgatggtctgctcgcacctgggccgtccgaccgagggcgagttctccgccgagaacagcctgaagccggtggccgagtacctgtccaaggccctgggccgcgaagtgccgctgctggccgactacctcgacggcgtcaaggtcaaggcgggcgacctggtgctgttcgagaacgtgcgcttcaacaagggcgagaagaagaacgctgacgagctggcgcagaagtacgccgcgctgtgcgacgtgttcgtgatggatgccttcggtaccgcccaccgcgccgaggggtcgacccacggcgtggccaggttcgccaaggtcgccgccgccggcccgctgctggccgccgaactggacgcgctgggcaaggcgctgggcaacccggcgcggccgatggcggcgatcgtcgccggctccaaggtttccaccaagctcgacgtgctgaacagcctggccggcatctgcgaccaactgatcgtcggcggcggcatcgccaacaccttcctcgccgcggccggacacaaggtcggcaagtcactgtacgaggccgacctggtcgagaccgccaaggccatcgccgccaaggtcaaggtgccgctgccggtggacgtggtggtggccaaggaattcgccgagagcgccgtggcgaccgtcaaggccatcgccgaggtcgccgatgacgacatgatcctcgacatcggcccgcagaccgccgcgcagttcgccgagctgctgaagacctcgaagaccatcctgtggaacggtccggtcggggtgttcgagttcgaccagttcggcgagggcacccgtaccctggccaatgccatcgccgatagcgcggcgttctccatcgccggcggcggcgataccctggcggcgatcgacaagtacggcatcgccgagcggatctcctatatttccaccggtggcggcgcgttcctcgagttcgtcgagggcaaggtcctgccggccgtggaaatcctggagcagcgcgccaagggctga

SEQ ID NO: 3243 - DNA, 273 bp, Pseudomonas aeruginosa
cgcagacggggcaaaccattcgccgtcctcgggggtcacacctttgaggacgacgaaaaaaggaggtgccccatgcgttccgtaaccttgccactcctgatgttctgcctgggcctggccgcctgtagcggcgatggcggtcgacgcccgagcacctgcgaggtgatcagtccgccggacgtgatggtgccgaccgagcagaaccgccagcgggtcgagcagcagagcagcggcgatccgaccgccggacaaaagccggtggaatgcccgtag

SEQ ID NO: 3244 - DNA, 426 bp, Pseudomonas aeruginosa
caggcaaggccagccggccgccgcgcgggccgcttgcggcccggcgaggtgcggcggagcgttccgcacggatggaggatggacatgaactactcgcgtatcgccctgttcggcggcttcgccgccgcggcgctgctggccggctgctccgcttcctccggcaagccgggcggcaaggactggacccgctggacctgcgacagcaaggcggtgatcgaatggcgctatatcgacggcagcaagaacatcgtcgacctgcgcctgaaggacgaggacgacgtggtccaccatctggagcaggaacctgcggccgtcggcgctttctatagcgacggacgcctgggcttccacctggagaacgacgaaggcctggtgtactgggtcgaaaccgacgacctcatcggtcgcggttgcaaggcgcgctga

SEQ ID NO: 3245 - DNA, 888 bp, Pseudomonas aeruginosa
acatcgacaccgacctgcgcctggcctccaccggtgccatccgccgcttcctggcgcagaacccgagcgagttcgacccgcgcaagtacttctccaagaccgtcgaggccatgcgcgacatctgcatcgctcgctacgaagccttcggcaccgccggcaacgcttccaagatcaagccgatctccctggaaggcatgttccagcgctacgctcgcggcgagctggatccgaaggtcaactaagcgccttcgttcgaacgggagccccgctggtcggggctcttgcacatccgccccggggaaatccgatgcgccgctggctccttaccctgccgttcctgctgctggccggttgcgctggcctgcacgcgccgtcccgcgacgtcgaggaggccgcgtcgccgagcgtagcgcgcgatcccgccgacccgcaggattgcctggcgcgcagcgactgcacgaccaagacttcgcgcaccctgctgttcgtcttcgactatgcagaggccggcggcgaactggtggtgcgcgacgggcgccaactggaaaccccgccggcgccgcaacgctccacctggccggcgttgcgcatccaactggccgagccggtcaacggtcgcttcgagttcgagagcccctgcctgcgcaagagcggcaagggctgccgctacagccaggctacgctgctgaaggtctaccgcagctacctggtcggcaagccctgctcgctgctcagccctcgcgcagtgaaacgctgcgtcgacccggcggcgaccgccgcgcggcgctgagtcagggctgcaggtcgaacagcgccttgccgtccatgtcgaacggcgccgagaaatgctcgtggatcaccttccagccgtcgccgtgcttgcggtag

SEQ ID NO: 3246 - DNA, 909 bp, Pseudomonas aeruginosa
cctcttccccgagaggtccacgaagcccctgaccaatggctgcgagccacgctgcgcaaggctttgaaccgttcgtctggaattcggaggaaaaccgctgtgctatacctcgggctttccctgccgcccaggaggtccctcatgtcgtccgtacacagcgccgcccagcaaggtttcagcgccgaggcccagcgttacgcccagggccggcccgagtacccggaagcgctctccgactggttgcgcgatgcccttggcctgcgtccgcagaccgtcgtggtggacctcggcgccggcaccggcaagttcacccgcctgctggcccgtaccggcgcgcgagtggtcgcggtggaaccggtggatgcgatgcgcgcccagcttgccgaagccttgccgcaggtccaggcgctggccggtagcgcccagtcgattccgctggccaacggcttcgccgacgccctggtgtgcgcacaggccttccattggttcgccaccgtggaggcgctggaggaaatgcgccgcgtgctgacggcggaaggcaggctggggctggtgtggaacgtgcgtgacgagtcgctggattgggtcgccgagatcactcgcatcatcaccccctacgaaggcgacgcgccgcgcttctacaagggcgactggcgtcggccgttcgagcgcgcgcccttcggaccgctgcgcttgtccaccttcgcctacgagcatgtcggcccgccggagcaggtgatcgtctcgcgcttcctttcggtgagcttcatcgccgccttgccggagacggaaaagaacgccgtggcggcgcaattgcgcgagctggtcgccagccatccggcgctcaaggggagggagcaggtagcgctgccctatcgcaccgaggcctatctggccgaggcgcgctag

SEQ ID NO: 3247 - DNA, 828 bp, Pseudomonas aeruginosa
cgggccagcgccgacttgcagaagtgcggattgcgcgaaaggaagttggccggctcggtgtacaggttggtgaaattgcagcgcccgccgccggacatgaggatcttcttgccggccttgttggcgtggtcgagcacccgcacgcggcgcccgcgtccggccgccgtcatcgcacacatcagcccggccgccccggcgccaacgatcagcacatctgtacttgccactgtcccactccgctcatcggaaacggcgcgcatcttacccgaagcggcggtcggccgccggagctcccgacgcggtacactgggcgttttccgcgaaccgccggacccgtgcatgatccccctcaagtacctccaggcctatcccgcatcgctgcaggaccaggtccgccagctgatcgccgagaaccgcctgggcgagtacctcgagcgccgctacccggggcgtcacgatgtgcagagtgacaaggcgctgtacgcctacaccatgaacctcaagcaggaacacctgcgcaacgcgccgggcctggacaaggtgctctacgacaacaagctcgacgtggtccagcgtgccctcggcctgcacaccgcgatctcgcgggtgcagggcggcaagctcaaggcgaagaaggaaatccgcgtggcttccctgttcaaggacgccgccccggagttcctgcggatgatcgtcgtccacgaactcgcccacctgaaggaaagcgagcacaacaaggcgttctaccagctctgccagtacatgctgccggactatcaccagctggagttcgacctgcgggtgtacctgacctggaagagtctctag

SEQ ID NO: 3248 - DNA, 456 bp, Pseudomonas aeruginosa
cagcggatcgccgaaatgtgcgccggtagcgctttcagcgagcggagtcggcctggcggcggaaacggcccggcgatacgccgaaggcctggcggaaattgcgggaaaacgccgcctccgactggtagccggtctcggcggcgatatccagcaggctcttctgcgtttgtcgcagcaggccgcgagccttctccatgcggatgcgggtcagcaggttccacggcgaggttccgccgagggcggagaaggcgcggacgaaactggcccgcgacatcgccgcctgctgggcaagctgttccagggtccaggcatgctccgggcgttccagcatggcccgcagggctcgtcccaggcgggcgtcgcccagcaggccgaacaggccgtcgcccagcggttggcggtccaggtaggcgcgcagggccagggcgaacagcgcggtggccagcgcgtcgatga

SEQ ID NO: 3249 - DNA, 222 bp, Pseudomonas aeruginosa
cgcgaaaaaacgccggctcacgcgccggacaccgtatcgaccctggaccaaggagttccgttcatggacctgatccgcatcctcatcgccatcctcctgccgccgctgggcgtgttcctgcaagtcggcttcggcggcgccttctggctgaacatcctgctcaccctgctcggctacatcccgggcatcgtccacgcggtgtacatcatcgccaagcgttga

SEQ ID NO: 3250 - DNA, 1395 bp, Pseudomonas aeruginosa
ggcccctgctcaggcgtagttccatggttccttcacggtgaagtcccgccacgggtcttcgccgtggaaggggccgacgtagagcacctcgccgccccggacgatccattccataccgtgttcgcggtcccattcgcagttcagcgacaggtggatcaccgcttcgtcgccctgttccgggtcgggcacgatcagctcgcccggctcgatccgttccagcaccccgcgcgccggcgcgacttcctccgcagactcgcccagccgccccaggcgcgcggcgcggtagcgcaggctggcggcacaaagccgctcgatcacggcgtcatccagttcgtcgagggctcgggcgcagcgccaggcgtaggcgtcgtcggcctcgttctcgatgaacaggctgatgtagcgccggtacaggcgccaatacacttcgcccatgttcgcatcgtccaggttgcggatcagttccatgcgtggtctccctgttcagcagcgttcggtgagggcgatgccacggccgtcgccgaagccatcgtgtacgtgcagccacagcgggatcggccaggcccagccgccggccttccaccagcactcggcgaaccaggcttgcagcgtatcggcgagcaggtcgacgccgccgaagccgtcggcgaagtaggcttcgtcgaaatccggggcatgtcccaggccgagcgccaggtccagcgccttgccgggaaacaggcgcgggtcgctggcgtcgacccggttgttggcgccattcaggtacaaccacgcttccgctgcgtcgcgtccgtcctcgccgaggaacagttggatctcgccgtcgcgcagtccttcctccaagggttgccggagcagctcgcgcaggcgctggatcacgcccggcgcggcgcgttgcaggtcgcggcggtagcgctcgcggaatttttcggggctgaggccgaaaggaatcatgggcgtttctccgtcattcgggcaggcagggcccggcttccagccaggcctccaggctgggtgccaggggttcgaagcagtccggcgtcatcgcgccatggtcgaccaggaacagcgcctgccggtgatcgtccagggccatcaccacggcgcggccgccgctgtcgtcgcctatggccaggtagccggggcagtagagagaggtttcgaaggcccggttgcgttccagcaactcgtcggcggcgtagagcagcaggcccggctcgacgaggcggccgccgtgctgctccagagcggcgacgaaggcagccggcagcggtcgtccgagccaggcctctagggcatccaattcaggcttcatcgggctcgtccagggcgaacaatgcatggtggcgggcatgggccagcaggcgttcgcccagcgcgtcggccagggcgtag

SEQ ID NO: 3251 - DNA, 1893 bp, Pseudomonas aeruginosa
cgcgaaggttggccgctggtcgcgctgggtcagccaggacaggccgagcaacaggttgtcgttgccgtccgtgctgctggcatcgccgctgtttcccgggcgctgggcgtaggtgccgtagccgagggcagccttgttggcgtcccagtcggacttgtccacctggcgctggtgcaggtagagcagggtccagatgtcccaaccctgcagcggatcgttcttcaggtcggcccagtagtgcacccactgggtatagaaggccatccgctcgccgttcagcgcgtaggtgcccgggtcttcccacaggcgcttgtatacgcctgccagcggatcggcctcggcgcgtccggcgacgatcaggttgtaggcgttgcggtagttgacccgcgtatcgtcgaggttctgcccgaactcgcggagcacgcgccagtccttgtgcaacgggaatatctggttggagatctcgcccgagcgcccgccgtaaaccttcagtcgattcacttgcaggttgtggcccagctcatggctttcgccccagccacgcgggttcaggccccaggtctggtcgtaggggttgccgctgcaaccgccgccgcactgggcgtactggtcgacgttgatgtgctgggtgccgggcagcttgtgcagggtctcgctgtcgcagtcccagccgcgcgccgcgcattcctgctggattgccggagtcttcgcctggttgggaatggcgaagccggccagggtgtaggcgtcgtcgatgaacacctcgttcaactcacggatgaagcgctggacgtcgccgccatagtccttgtcgatcgagccacggaccttctccaccttggcgtggacctccaccgagccgctgcggatctccagccagtcggccttgtcggcgtccagcgcctggatgaagtcggcaatcgcctggctgctgtcctcgcccggctggatgtcgaggaacggctggctggccgcgccggttaccttgacggttaccgtctgacccggcgtggcgccgctgtagaccagttgcaacaggccgccgtagggcgataccagcgccaccgactggtttgcctggagcttgatgtccgggctcttgaggaagcgcggacggtcatactggcgggtattccacagccgcgtcgagccgatgcgctgggtgttcaggccgaccgccaggctggcctggccagcgtcttcgatgcggatgctcaggcgcttgcccggcgccgccatgcggccgatggcggtgaagccctgggccgacggcaaggtgagggtcagggtttcctccgagcccgataccggcatcgactgttggcgctggccggcgtagctgcccagttccttctgcgccgcgccggcttcgcgcacgtagccgacgatggcgtcggcgacgaaggtttcctggaagcgcgccgtgtcggcggccttgtccatcgggtagcggatgttctgccgcaccgcgtcggcccacagcagccagagccgcagcgaggtggtgccgggcagggcgaagaggttctgcgccttctggttgtaggcgtcgagggcgcctttcaatacatcgacgcgcttgctgaagtcgctcagtcccggcacgtcgtcgcaggtggtgcgaccgacgtaggaggtgcatttcgaccagtcgtagtccgtgcgccagctaccgtcgacgatctgctgcaccagcgccgggtcctggccataggcgccgcccagctcgaccgaacgcgtccgggtgcggctggatggcaccctgtccttgtcccagtagttaccgccgtaggggccttcctgcaggcccaggccggcgaggatctgctggccggtgctgctctggttccagccattggtgtgcacgaagaggatcggcagcccggcctgtag

SEQ ID NO: 3252 - DNA, 663 bp, Pseudomonas aeruginosa
ccgtgcgcgcaccgtggcgctcaggctagcggcgctggcgccgttgcccagtaccagcaatttgctggtgctggcgcaactggcgtcggtcagcgcgttgcaggcggcgtccgccggttgcaggccggcgctcttcaggccgttgagggcggcggtcttgtccaccccgaccacgctgaccttgaagtccttcgcagtggccgcgcccgggtcgccgttcaccagccactgcaccgcccgcttcagcaacggcgcgtgggcggcattggtcccgctcaactgggtgagcacgttggtgccataggccagcccgcggccgccggcctccaggctcaggctggcgagcacgcgccccttgtcgccgatgaggaagggcagggtattgtccgggttggccggcaggacccacatgctggcggcgccaggatcataggcttggctgaggttctggtagagaccgtcgagcaactgggtgcgggtctggcggatgcgctcgacctgctgctgcaggcgcagggcgaccaggtggctgtcggtcagttgcgaggaatccccgctgaccagtgccgcatcgaggatttcttcctgggtggcagcctgggcggacagcgcgccagccaggcagaaaccgaccagcaacgctcggtggcgagggatgggtga

SEQ ID NO: 3253 - DNA, 204 bp, Pseudomonas aeruginosa
atggtgttcgcctatgtgatggtactgactaatccgaacattgctagatggcaaggtttcgatcagtacgccccggctagcaacctgacacatgagagcttgttgcaatcggaggtagtctgtcggcgccaagaattgtgcttcctttgcaaccaactcatgagctcggatgagtactgcctcatggctaagccattcccatag

SEQ ID NO: 3254 - DNA, 774 bp, Pseudomonas aeruginosa
  unsure (52),(56),(57),(59),(64),(65),(66),(68),(69),(70),(740): Identity of nucleotide at the above locations are unknown.
gtcctctgctctaaccgactgagctataggcccccagagtcgggtggggatntgtnntngcttnnncnnncgggctctctctttttttttcttctcgtttggtgtctgttctggcccctttctgtcttttttcttcccgttgccccactgtctcttcttcctccctgttttttcgtttccgcctttttgtccttcttgtctcttcctctctttgtctgtctgtcgttgttcttcttgtcttcttgctgttcctctctcctttgccttgttgtgtgtctttttgtccttttccctctttgtttggccttctcccggttgtttgtcctttctcctctcttctgtctcttcgtctgctctcttttccggctccctgtgcctttctgccggttctctggttgcttcctgcgcctgtcgtcttgtccttgtttcccttgttttggttgtctctctcgtgctctctgcctttgttgcttcggtcttcgccttcgtttccgctgtttctccttgtgcattgtggtcgagctctttcttggtttgtggttcggtcggttctctgcattcccattctttctacgcctccttcctccgtatccttcgcctctggctcttccctctcgcctttccttctgtctttggcttcttgctacgttttgtgccttctcctattgcgctgcactcctcatttgtgtttcagctctgcctctgcttcgccttctcgctctctatttcttgctcagtcngcgcgctgtgcttctattttctctcgctatccgt

SEQ ID NO: 3255 - DNA, 831 bp, Pseudomonas aeruginosa
caggaccagcgtcggtgccaggtattgcaggaagcccagagtggcgtagggcaggtgccttgccgcagcgttgaagcagaccagcggaaccagcgtcaccgggcccgcggcgaccacccacagggcttccggggtgctccagaaagccgtttcgctggtcggcccgtcggcgaaaaacagcaaccagaccagcgccagcggcagcagcagccaggtttccaccaccagtccgggcagcgcggcgaccggtgcctttttgcggatcaggccgtacaagccgaaggtcagggccagcaccagcgacacccagggcaggctgccgagttgccagacctgctgcgccacgcccagcgaagccagggccaccgccagccattgcaggggacgcaggcgttccttgagcagcaacatgccgagcatcacgttgatcagcggattgatgtagtagcccaggctggcttccagcatgtggccgttgttcaccgcccagacataggtcatccagttgctggcgatcagcagtccgctggcggccagcacgacgaagcgctgcggattctggcgcagctcgcgccaccagcccgggtgtttccagaacagcagcaggacggcgccgaacagggccgaccagaccgcgcgctggacgatgatttccaccgcgggaatgcgttcgagcagtttgaagtagagcgggaacagcccccagatcacataagccgtcaggccgaggacatagccccgacggaggttggcggtcgccatggagaatccttgaaacgtcaggcaggtaagaatggccgtgcacggcatgcacgagcggatgacctgtga

SEQ ID NO: 3256 - DNA, 1134 bp, Pseudomonas aeruginosa
ccgaggctttccacggcatccaggacgaggtcgggggtcagttggtcgaagggatgggacatgacggggcatccaaggctcgaaagacccctagtgtacgcaagccggcgcgggccggcaggttcacagcggcgtgccgagcaggacctgggccggatcgaaggaggcgatcaccttctgacccttcttcagccccaggctggccaggcgttcgccggacaacagcgcgcagagggtaagaccgctgcccagggcgatgcgcacctcgctgggaccggccttggccgcgaggatttcctccagggtgccgtgcaactggttcggctggtcctcgcgcggttccagcccgacgtccagccagccggccttgatcagcgccagtaccgggcggccgcgaccgagttcgagttgctcggtgctggcgcgggtgatcagcgcctcgatgcgttgctggcctggcagctcgatggcgatgcggtcgtggaagccttcgccatggatcgacaggacccgcccgtgcaattggttgcgtgcgctggtgcggagcatcaggcggccgatcaggttgaggtcctcggcgtcttccgcggcctgcaacacctgcgcttgcaaggcttccaggcgccggtagagagccagcaggcgttcgccctcggcggtcagccgggcgccgccgccgcccttgccgccgacgcttcgctcgaccagcggacgctcggccaggttgttcagttcgtcgatggcgtcccaggcgcccttgtagctgatgcccacggccttcgccgcacgggtgatggagcccagttcggcgatctgcgcgagcagggcgatgcgttgcgggcgacgggtgacgtgctgggcgagagtggagagtgcggacatggaggcttcgctatgagcggacgtatacggcgaaggctccaacagccatgggcaaaacgcaagggcgtcactcggcggcctggtacagaccgtacccggcggcggcgccggccaggtcccaggcgaggtccttccaggctccagccgctgccggcggaacggctgtcgtacaactccttgccgacgccgaaggcgagggagaagctcaggccgaagcgtgcctggcgagcgccgcgcacgccgcggtcgtga

SEQ ID NO: 3257 - DNA, 771 bp, Pseudomonas aeruginosa
ggcctgcgggcaatgactgaagtcgacctcaattccgacatgggcgaaggcttcggcccatggaccatcggcgatggcgtggacgcggcgatcatgccgctgatcagcagcgccaacatcgccaccggtttccatgccggcgacccgagcagcatgcgccgcaccgtggagatggccgccgagcatggcgtggccatcggcgcccatccgggcttccgcgacctggtcggcttcgggcgtcggcacatcgccgcgccggccatcgagctggtcaacgacatgctctaccagcttggcgcactgcgcgaattcgcccggctgcagggcctgtcgctgcaacacgtcaagccccacggcgcgctctacatgcacctggcgcgggacgaggtcgccgcgcgcctgttcgtcgagaccctgcaacgcctggaaccggaactgctgctctattgcatgcccggttcggccacctggcgcatcggccgggaactgggccagccgctggtgcgcgagttctacgccgaccgcgactacgaccgcagcggctccatcgtcttcacccggcgggtcgccgccctcgatccgcagcaggtcgccgacaaggtcctgcgcgcctgccgcgagggcaaggtgcgcaccgtcgagggcgaggacctcgacatcgccttcgactcggtgtgcatccacagcgatacccccggtgccctggagctggtcgccagcacccgtgcgcgcctggagggcgccggcatccgcatcaaggcgccgcgttga

SEQ ID NO: 3258 - DNA, 1362 bp, Pseudomonas aeruginosa
acaagctgctggtggccaatcgcggcgagatcgccgtgcgcatcatccgcgcccgcgcaggcactgggcattcccacggtagcggtgtgcagcgaggcggatcgcgattcgctggccgcgcggctggccgatgaggtacgcctgatcggccctgcgcgggccgagcggagctacctggatatcgaggcgattctcatggcggcgcgggaaaccggtgccgactcgatccatcccggctacggtttcctctccgagaaccccgccttcgccgaagcggtgcaggcggccggcctggtcttcgtcggtccggaggcgcagaccatccgccgcatgggcgacaaggccgaggcgcggcgtaccgcgatggccgccggggtgccggtggtgccgggctcgcccggcgagctgggcgacctcgacgcggcgctggcttgcgccgaagaggtcggctatccgctgctggtcaaggcctccgccggcggcggcgggcgtggcatccgtatcgcccacgacgccgacgaactacgtcgggaattccccatcgcccagcgcgaggcgcaggccgccttcggttcgccggcggtgtacttggagcgcttcatccgccaggcacggcacatcgaagtgcagatcctcggcgatggcgagcgcgcggtgcatctgttcgaacgcgaatgctcgctgcagcggcggcgccagaaggtcttcgaggaggcaccttcggcggcgctggacggcgcgcagcgccaggccctctgcgagagcgcggtgcgcctggcgcagagtctcggctatcgtggcgcgggcaccctggaatacctgttcgacgcgcacagcggcgagttcttcttcatcgagatgaacacccgtatccaggtcgagcatccggtcagcgagatggtcaccggcatcgacctggtccaggccatgctgcgcatcgccgccggcgaggcgctgccctggcgccaggaggacattcgcctgaacggcgcggcgctggagatgcggatcaacgccgaagacccggcgcgcaatttcttccccagccccggcaccgtggagcgcctggaatggccgcagggcgagggcgtgcgagtggacagccacctgtatcccggctaccgggtgccgccgtactacgattcgttgctggccaagctgatcgtccatggtcgcgaccgcgacgaagcgttcgcccgcgcgcgccaggcgctggagcgcaccgtgctggccggcatggccactaccctgccgctgcaccgctggctgctcgccgatgcgcgggtacaggccgcgcagttcgataccgctaccctggaaacctggctcgccgagcggaccgccgccgcgcaggaggtttga

SEQ ID NO: 3259 - DNA, 987 bp, Pseudomonas aeruginosa
tggacagcttcacgccgatccagccgatcctggtcggcggcagccgccaggccgtggccctggccggcatgcttcgagcccgtggcatcatggtcggcgcgatccgcccgccaaccgtgccggccaacagcgcgcggctgcgcgtcacgctgtccgccgcgcacagcgaagcgcaggtcgaccgcttgctcgaagccctcggcgaaagctggcgacagctgtcgtctagccttctggcagagatcgaagccgaggagggagacgatgcgtgaccacttgatcctgttgccgggctggggcctgggcagcgcaccgctggaaccgctgcgcgacgcgctgcacgagcgcgagccgcacctgaacgtgttgatcgagccgctgccgtcgctggacgacgccgccgactggctcgacgaactcgacgataacctgccgcgcgatagctggctggccggctggtcgctgggaggcatgctcgccggcgaactggcggcgcgccgcggcgacgattgccggggactgctgaccctggccagcaatccgtgcttccgcgtgcgcgaggactggccgaacgcgatgccggcggaaaccttcgaggacttcttcgaggctttcctgctcgaaccgcacctgacccgcaagcgtttcaccctgctggtcagccagggtgcgcgcgaccctcggaccctggcgcggcaactgcaggtggcgctgccgcagctggagcgcgaggcgctggtcgccggcctgcagttgctcggccaactggatacccgggccgccctggaaaacttccgcgggccgcaattgcacctgttcgccgaagccgatgcgctggtgccgctggccgccgccgaggccctgctcgagtggctgccggacgtcgaggtctcgaccctggcggccagtcacggcctgccgctggaatgcccggacgaggtggccggcgcaatcctgagattccttcgcgagggtgacgatgcctga

SEQ ID NO: 3260 - DNA, 1434 bp, Pseudomonas aeruginosa
gagcctgctgtcggcattgccggaaggcttctcgccgcgccgctgggtcgatctcggctgcggcaccggttatttcagccgggccctggaacgacgcttcggtgcggccgagggcctggccgtggatatcgccgaaggcatgctgcggcatgcccgcgcgcgcggcggcgccagccatttcattggcggcgacgccgagaggctgccgttgcgcgacggcagttgcgacctgctgttctccagcctggctatccagtggtgcgccgacctcccggcggtcctggccgaggcgcggcgggtcctgcggccgggcggcgtgctggcgttcagcagcctgtgcgtcggtaccctgggcgagttgcgcgacagttggcgggtggtggacggcttcgtccacgtcaatcgcttccgcgccttcgccgactacctgcaacacgcggccggcagcggcctgctgccgctgaccctgcgccacgaggaccggctcctgcatttccccgacctgcgcagcctgacccacgaactcaaggcgctgggcgcgcacaacctcaaccccgggcggcccgacggcctgaccgggcgccagcgcatccgcgcgctggtcgccgcctacgagcgtttccgccagcccgaggggctgcccgctacctaccgcgtcgtcttcggcgtgctgcgcaaggattcctgaaccatgccggcgttcttcgtcaccggtaccgacaccgagatcggcaagaccaccatcgccgccggcctgctccacgcggcccggagtgccggcctgagcaccgccgcggcgaagccggtggcctccggctgcgagcccacggcgcaaggcctgcgcaatggcgacgcgttggtgttgctcggccagtgctcgctggcgctggcctacgagcaggtcaacccgctggccttcgcaccggccatcgccccgcacctggcggcgcgcgaggctggcgtcgaactgagcgccgcacgcttgcacgaggcggtgcgcgaggtgctggcgctacaggccgacttcaccctggtggagggcgccggcggatggcgcgtgccgttgctgggccgcgagaacctgtccgacctggcgcgcctgctggcgctgccggtggtgctggtggtcggcgtgcgcctgggctgtatcaaccatgcgctgctcagcgccgaggcgatcctgggcgacggcctggcgctggccggctgggtggccaacgtcgtcgacccggctacctcgcgcctggaagagaacctggcgaccctcgccgaacgcctgccggcgccctgcctgggtcgggtaccgcgcctggaggaagccactcccgcggccgtggccgcacacctcgacctgcggcccctgggtatcgggctataaacagcgggccgtccataaccaacgggcggtacccagcgccggccaagtctgcttga

SEQ ID NO: 3261 - DNA, 423 bp, Pseudomonas aeruginosa
  unsure (288): Identity of nucleotide at the above locations are unknown.
atagaagccacttgctatcgcagtggcgcatgcgcgtccccaggagtagagggtggaaatttccggcaacgctttcgtcagtggcctcaacgcggtgcagtcgggcagcgcccgcgtcgcccaggccggcagcgagatcgcccgcaataccgtggaggcccgttcgccccaggccgagcagatggtcgaactgacccgcgccaagctcgaggcgcagagcggcgcccgggtcatcgaggtagccgacgagaccctcggtaccctgatcgatacccacgcctgatttcntggcggccggcagcggccgccccgacccttccttttccgactgtcacccggcggcccctgaagcctgccgggcgcttcgccatgggctttactgagagagacgaaagtgctttggaaggacgtggctgccagtga

SEQ ID NO: 3262 - DNA, 1845 bp, Pseudomonas aeruginosa
cttcgagggattcgcgcctgtggggcgcccctgccgaggagaacagagatgccggaatacaaggctccgctgcgcgacatgcgcttcctgatcgatgaggtattcgacttccatgggcgctaccaggcgctcggcgccagcgacgcgaccccggacatggtggcggcgatcctcgatgaagggtcgaaattctgcgaacaggttctggcgccgctgaaccgctccggcgacgaagagggctgccacttcgacaacggcgtggtgaccacgcccaagggtttcaaggaagcctatgcacagtacgtcgagggtggctggaacggtgtcgccagcgatcccgcgtacggcggccagggcctgccgcactcgctgggtctgctgctcagcgagatgatcggcgccagcaatgtctcctggggcatgtacccgggcctgacccgcggcgccatgtcggcgatccacgcccacggcagccaggcgcagaaggacctctacctggcgcggatgaccgccggcacctggaccggcaccatgtgcctgaccgagccgcactgcggcaccgacctgggcatcatcaagacccgcgcggtgccgaacgccgacggcagccatgcgatcagcgggacgaagatcttcatctccgccggcgagcacgacctgagcgagaacatcgtccacctggtgctggccaagcttcccgatgcgccggccgggaccaagggtatctcgctgttcatcgtgccgaagttcctacccgacgccgaaggtaacgtgggcgcgcgcaatgcggtctcctgtggctccatcgagcacaagatggggatcaaggcctcggccacctgtgtgatgaacttcgacggcgccaccggctacctgatcggcgagccgaacaagggcctgcactgcatgttcaccatgatgaaccacgcccgcctgggcaccggcatgcagggcctgtgccttggcgagaccagttaccagggcgccgtgcgctacgcccgggagcgcttgcagatgcgctcgctgaccgggccgaaggcgccggacaagccggccgacccgatcatcgtgcaccccgacgtacggcgcatgctgctgaccatgaaggcgttcaacgaaggcaaccgcgcgctggcctacttcaccgcccagttgctcgacaccgagcacctgtcgcaggacgccgccgagcgcgagcgggccgccgacctgctggccttcctgacaccgatctgcaaggccttcatgaccgagaccgggcaggaggtgaccaacctcggcatgcaggtctacggcggccacggctacatccgcgagtggggcatggagcagttggtccgcgattgccgcatcgcacagatctacgaaggcaccaacggcatccaggccctcgacctgcttggccgcaaggtactgggcagccagggcaagctgttgcgcggtttcaccaaactggtccaccagttgtgccaggcccaggccgagcatccgcaactgaagggacaggtcgcgcaactggcggcgctgaacgcgcagtggggcgaactgacccagcaggtgggcctggcggcgatgaagaatgccgacgaagtgggcgccgcctcggtggactacctgatgttctccggctacgtgaccctggcctatttctggttgcgcatcgccctggtggcgcgcgagaagctggatgccggcagcggcgaggccgcgttctacgaagccaagctggccaccgccgacttctacttcagtcgcctgctgccgcgcaccgcggcgcacgccgcggcgatccaggccggcgcggcgggcctgatgagcctgtcggcggagcagttttcgctctag

SEQ ID NO: 3263 - DNA, 846 bp, Pseudomonas aeruginosa
tcgctccgccgatgctgttgccgccctggatcaggcgcttgtcgatgcgctgggccagcaggtcgagcttggtcaggccgccgtcgcgaccgaatacgtaggcgtagcgctggtcgcgggagaacaccagggaggcgtgggacaggtcgccgaggccttcgacccgcgccagcgaggtcttcgccgtgccgtcgaggatctgcacgctgccgtcggcgcgttcgatcagcacgccgaggtcgccgctgccgcgcaagggcggctgctggctacagccggcgagcagggcgaggaaaagcggcgcgaggggacgcaggttcatggggcgatctctccttcgatcaggcggtccaccagccagccggcgtcgtcttcgctgagcaggccggcccaggggggcatcggggtttgcggacggcccatgagcacggtggcgaccagcgattcgcgcggcttgccgcgcagggcctcgggggtcagcgccgggccgaggccgccggtcaggcgcaggccgtggcaggatccgcagtcctgcaacagcaggtgacgcaactgggcctggcgacgggcatcgggatgctcgtcggccaggcccggaagaggacaggcgaacgtcagcgcgagggccagccacaaggcgtggctggcggcgcgccggaagtccggaggggcgttcatttctgcgacaggacccacttcgccagggtctgcgcctcgtcgtcgctgaccgcgttcggcggcatcgggatcgggccccagacgccctggctgccgttcttgatccgctgcgcgagttccgcttcggcgccggcctggccggcgaacttggcggcgacgtccttgtag

SEQ ID NO: 3264 - DNA, 786 bp, Pseudomonas aeruginosa
gacatgcgggacgcgacacccttctacgaggccaccggccatgagatcgaagtcttcgagcgcgcctggcggcacggcctgccggtattgctcaagggccccaccggttgcggcaagacccgcttcgtccagtacatggcgcggcgcctggaactgccgctgtacagcgtcgcctgccacgacgacctgggcgccgccgacctgctcggccgccatctgatcggcgccgacggcacctggtggcaggacggcccgctgacccgcgcggtgcgcgaaggcggtatctgctacctggacgaagtggtggaggcgcgccaggacaccacggtcgccatccacccgctggccgacgaccgccgcgagctgtacctggagcgcaccggcgagacgttgcaggcgccgccttcgttcatgctggtggtgtcctacaaccccggctaccagaacctgctcaagggcctgaagcccagcacccggcagcgtttcgtcgcgttgcgcttcgactacccggcggcgcagcaggaggcacgcatcctggtcggcgagagcggttgtgccgaggccctggcgcagcgcctggtgcagttgggccaggcgctgcggcggctggagcagcacgacctggaggaagtcgcctcgacccgcctgctgatcttcgccgcgcgcctcatcggcgacggcatggacccgcgcgaggcgtgccgggtggcgctggccgaaccgctctcggacgacccggcgacggtggcggcgctgatggacatcgtcgatctccatgtcgcctga

SEQ ID NO: 3265 - DNA, 210 bp, Pseudomonas aeruginosa
ccggtgtgctgctgggtggcgccggcgactctccctggctgctggcggcggtgctggccctgcgcggtggccaagggttggctgatcggcgagcgcttcatggagctggcccatgccccggcgctatggcgccgcctgctgctggcctggccgctgctgatggccctggcggtgggcgctgcgctgtacctggcgcggatgaataactga

SEQ ID NO: 3266 - DNA, 1626 bp, Pseudomonas aeruginosa
acgtgccgggccgccgcgccatgccgcagttccatctcagcgagggccaggtcgacgacctggccgagttcctcaagtggagctcgaagatcgataccaaccaatggccgccgaacaaggagggttgatgatgtcgcccaatggctccctgaaattcgcctcgcaggcggtcgccaaaccctacttcgtgttcgccctgatcctcttcgtcgggcagatcctgttcggcctgatcatgggcctgcagtacgtggtcggcgacttcctgttcccggcgatccccttcaacgtcgcgcgcatggtgcacaccaacctgctgatcgtctggctgctgttcggcttcatgggcgctgcctactacctggtgccggaggagagcgactgcgagctgtacagcccgaagctggcctggatcctgttctgggtattcgccgccgccggcgtgctgaccatcctcggctacctgctggtgccctacgccggcctggccaggctcaccggcaacgaactgtggccgaccatgggccgcgagttcctcgaacagccgaccatcagcaaggcgggcatcgtgatcgtcgccctgggcttcctgttcaacgtcggcatgaccgtgctgcgcgggcgcaagaccgccatcagcatggtcctgatgaccggcctgatcggcctcgccctgctgttcctgttctccttctacaacccggaaaacctcacccgcgacaagttctactggtggtgggtggtgcacctgtgggtggaaggcgtgtgggaactgatcatgggtgcgatcctcgccttcgtgctggtgaagatcaccggggtcgaccgcgaggtgatcgagaagtggctctacgtgatcatcgccatggcgctgatcagcggcatcatcggcaccggccaccactacttctggatcggcgtgcccggctactggctgtggctcggctcggtattctcggcgctggagccgctgccgttcttcgccatggtgctgttcgccttcaacaccatcaaccgccgccgccgccgcgactatccgaaccgcgcggtcgcgctgtgggccatgggcaccacagtgatggccttcctcggcgcgggagtgtggggcttcatgcataccctggcgccggtcaactactacacccacggcacccagctcaccgccgcccacggccacatggccttctatggcgcctacgcgatgatcgtgatgaccatcatctcctacgccatgccgcgcctgcgcgggatcggcgaggcgatggacaaccgctcgcaggtcctggagatgtggggcttctggctgatgaccgtggcgatggtgttcatcaccctgttcctctccgcggccggggtgctgcaggtctggctgcaacggatgccggcggacggcgcggcgatgaccttcatggccacccaggaccagctggcgatcttctactggctgcgcgaaggcgccggggtggtgttcctcatcggcctggtcgcctacctgctgagcttccggcgcggcaaggcggccgcctgagatggccttcgccgtcgagctggaggaatgggtcggcgcccactggcaccgcttcatcacccgccatgccagcggcgagttcgaggcggcgcgggtga

SEQ ID NO: 3267 - DNA, 654 bp, Pseudomonas aeruginosa
accgcgaactgtatcgctggctggcgctgctggcggccagcgccgggccgctgcggcactgggcccaggacaaccagcgctgggcgcggcagttgctcgatgcctatccggcgctgcgcccgcgctacgcccggctggtcgccgcgcatctgcgccagcgcccgtcgctggacgattgcccggcggcagacgccgaactggaaatcgccctgcgccgcgcgcttgccgagccgggcagcgtcgagcgcttcccgcgagtcgagcgggcgccctggccggtgccgctgtggctgtatcccggcgagcgctggacgccttccgccagtgcggaggacggcgaggaagcggccgccggcgccggcaagcgccaggtcgcccgcagcggagcgcgcaagcgcgccgagcgcattgaggaacgcaacagcgaacgcaacctgctgctgttccgcctggaaagcctgctcagttggtcggagcacctggccctggaccgctgtagcgacgacgaggacgacccggacggcgcgcgcgtcgccgaagacctcgactacctgtcgctgtcgcgccagcgcacgcagaagggcggcggcctgcgcctggatctcgacctgccggccgccgactacgatgacctgccgctcggccccgggctga

SEQ ID NO: 3268 - DNA, 771 bp, Pseudomonas aeruginosa
aacggtggcgaagcgggtctgcggcaggctgtcgagaatcccgctcatgtggttcagttccgcctgcacccgcggccgccggccgatcgcggcgagttgctcctgccagatctggcgcgcgcggaactcttcgccgagcagcagcatcggcaactccgcggcctgggccagggacacctttctgaactccttcaacgggtgttcctcggggatcaccagctgcaattcgtcctcgtacagctcgacgctgtgcaagcccggctggcgcggcggcaggaagccgatgccgatatccaggttgccggtgagcaggcgccgctcgatgtcgattcccgacagttcgtagatctgcacccgcaggtgcggctgcgcggcgtgcaggcgttcgaccatgtacggcaccaggctggcgttgaccgtctgcagcacgccgatcgccaggctgcgcggggtctgcccgcggaatacgcgcatcgcctcgcgggccctttccaatccctccagcagcggtaccgcatggttgtacagggtgtgggcggcgacggtcggcagcaggcgcttgccgctgcgctggaacagcgagacgtcgaggttctgctccaactggcggatctgctgcgagagggccggttgcgacagggccaggcgttcggcggcgcggccgacgtggccttcctcgtagagcgcgacgaaatagcggagttggcgaaaatccataagctgttcttatcgatgaaactggaaaatcgaaatggagtgggtcccgcgtga

SEQ ID NO: 3269 - DNA, 222 bp, Pseudomonas aeruginosa
cgccgggaggatccgccagggtgtcgcgcattgccgcgaggtggcgccggtgctgttcctgttgctcgattacctggcgcatcggccggcggagatcgcacgccgggcctgatcgccagaaagattcctctgtcctcgcatgcgcctccggacgtcgttttggtcctgtggggcgctttttttattctaggctgcgtgctttcccaaccagggctccagtag

SEQ ID NO: 3270 - DNA, 1572 bp, Pseudomonas aeruginosa
tgcaatcgtcacgcgtgcgcggtcagggcgggcgggcatccttgctgcccccggaaaatcgctccatccaagaggaacagcatgaacgaccaggtactgcgtacccagaccgaccgccgccagttgcagcagatcatcgccggccttaccgaaggggtgatcctgatcgagccggaccagcgcatcctctgggccaacgaggcggccctggcgatgcacggcgtccattcgctggaatgcctgggcgccgataccggcgagtatcgcgaacgctttcgcctgcgctaccgcaacaatcatccgctgcaggaggggcagtacccggccgagcgcctggtggctggcgagtgcttcagcgacgtggtggtggaagtgtttcccgccgccgacgaggacacccgctgggtgcaccgcgtgcgcgggttggtgctgacgacccccgaggacaagcccgactgcctggtgctgatcctccacgacgccaccgagtgggccagcgccgagcagcgcttcgagaagaccttcaatgccaacccggcgccggcggtgatctgccggctcagcgactaccgctacgtgaaggtcaatgtcggtttcctggaaatgaccggctatgcccgcgaccaggtgatcggccgttcggtgtacgagctggacgtactcgaccaggccgagcgccgcgaactggcggtggagcgtctgggcgccggcgagaccatcccgcagatggaggcgagcctgcgggtggcggagggcggacgcaagtgcgtggtggtcgccgggcagccgatagaggtcggcgaggaggcctgcatgctcttcaccttcaccgatctcgaaccgcggaagaaggccgaggaggccctgcgcaagagcgaggagcgcttcgccaaggccttccgcatggcaccggtgccgagcctggtgctgtacggcgacgacctgcaggcgctggacatcaaccaggccttcagcgaaaccttcggctaccaggccgaggaactgctcggcgagtccaccgtcgcctgcgggctgtggcaggacggcggcgccgagcgcctgggcgagctgctggcgcagagcggcagcgtgcgcaacgtccagctgcgcctgcagcacaaggatcgcaacggcctggactgcctggtctcggccgaggcggtgagcctcaacgagcaggactgcgtgctggtggccttgctggacatcagcgaccggcggcgcaccgaaatggagctggtgcacgccatcgagacggtgatgcaggacgcttcctggttcagccgcaccctgatcgaaaagctcgccaacgtgcgccgcgccaacgcgccgggcaccggcgccgaactggccgacctgaccgcgcgcgagcgcgaggtgttcgacctcatctgccagggcctggcggacaaggagatcgccaaggaactgggcctggcgccgaacaccgtgcgcaaccacgtggcgaccatctacgccaagctcgatgtccacagccgtggcgaggccatcgtctgggcacgcgaacgcggattcgcgccggagccgcgcaacggcaacgggcgcaaataa

SEQ ID NO: 3271 - DNA, 1062 bp, Pseudomonas aeruginosa
gccgctcggcgaggaacgggcgaagtcgttgctgccgcgcaactgctgcgtgaccgacaaccagttcgtcctcgactacttccgcctgaccccggactaccgcctgctgttcggcggcggctgcacctacctgggcggcatgcccagcgacatccgcgccgccacccggccctatctcgaaagggtgttcccgcagttgcgcggggtggcgctggagtacgcctggggcgggcatatcgactgcagcatgcggcgtaccccggacctcggccggcagggcaaccgctactggctgcaaggctactccggccacggcgtgctgccgagtctggcggcggccagggcggtcagcgacgcgctgctcggcgacgacgagaccctggcgctctaccagcgcctgcgcaatccgaagtttcccggcggccagcgcttcgccgcgccgctggaagccctgggcaaagcgtattaccgtttgcgcgacctgttctgagagggcctggagccgagatgagcgaagtagccgacgacctggcggagatcgccagcctggtgcgcgaattgcgcaagcgcaagggcatcaccctgcaggcgctggccgacggcattcgccgttcggtgggcttcgtctcccaggtcgagcgcggcctttcgcggccggcggtggacgacctggtcgccatcagccaggtgctcggggtgccggcgacctacttcttctgctcgccgaagatccaggcctcgccctgggtgacccgcccgggcgagcgtcggaccctggcctacgctcgtggcgccagcgacaacctggtatcgccgcgtctcggcggcgccttcttcatgctcgaaacctgccttgaagcgggtgccgacagcggcgagcgcgacctgctggacagctcggagcagggcggctacgtgctcgaaggcgagctgaccctgtggctggaggacgaggagctgcgcctgcaggccggcgacggtttccagattcccagccatatgcgcagccgctatgccaaccgcagccaggcgccggtcagggtgctctgggtatacgcctga

SEQ ID NO: 3272 - DNA, 543 bp, Pseudomonas aeruginosa
actatcctggtctataccaataaggcccgtcatgctagccaccagcctggtgctatgcgccgccgttctccacgccacctggaacaccctggtcaagttcagcagcgaccgcttgctggtggtcgcctgcatggacgtggtcggcgtgctctgcgccatcctgctgttgcccttcgtcagcctgccgccggccgaagtctggccctggctgctcggcgccaccgtcctgcaactgctctaccgggtactgttgatcgaggcctacaaggtcggcgacctgggcctggtctatccgctgatgcgcgggctgtcgccgctggtggtgctgggcctgaccctggcgttcggcggcgagcagctcagcggccggcagatcctcggcatcctgttgatccccttcggcatgctttgcctgctctggggcggcggcggttcgcggctgccctggcggaccctgccggtggtgctgctgatcggcctgtgcatcggcggctacacctggagcgacggcaacgccttgaagcgctggccgttggcgcttga

SEQ ID NO: 3273 - DNA, 819 bp, Pseudomonas aeruginosa
cgtggctttcctccgcgcgctggtggcgcggctggcccaggaataccgcgtcgattcgcagcgggtatatgtcgccggctactccaatggcggccagatggctttccgcctggccgccgaagcgccggggttgccggcggcgatcgcagcggtggcggcgagcctgccgaccacggggaacgatgcctgtcggccggtcgagcggccgaccgcggcgttgctgatcaacggcacgcgcgatccgatcaatccctatctcggcggcaaggtcagcctgttcggcttcggcgaccggggcgcggtacgctcgaccctggactcggcacgctggtgggccggcctgaacggcatcgcagcgccgccggacgtggcgccgctgacccgtcccggcccggtctggaccgagcgacagcgctggcaggaagacggccatccgccggtggagctgctcagcgtgcatggcggcggccacgtgctggcgcagccggactatcgcttcccgcggattctcggcaagagcgacccggaactggacgcgccagtggaaatctggcgcttcttcagccagttgccgcgctgaggctcagacctcgaagacgaattccggacggaacccgcctctctcgtggggatagccgcccggattggccagcacccgtgcccggccgatgcggtagtcgagggcgtcgtggacgtgaccgtgcagccagtagtcggcctgcgccaccagttcgtcgaggttggaagcgaaggctggcgacagtgggttgccgacgaactgcggcgggatcgacagcgcactgggcgcgtggtggctga

SEQ ID NO: 3274 - DNA, 681 bp, Pseudomonas aeruginosa
agactctcgccgggcgtgagccctgcggcgtcggcccactgggccaggtcctcctgttcgaaacccaaccagaggtcgccgcaggcctccctggcccagccctggttgtgccggcacaagtccgtcaccagcaggctgccgcccggatggaccaggcgggccaactgtttcagcgcctccgccggcgcggcgaagtggtgcaggaccatgttcagcaccacgcaatcggccggttcggcggcgtcctgcagggcatcggccaattccaggcggacgttgcccaatccttcttccttgcagcgctggcgcgccagttccagcatcgccgcgctgttgtccagcgccgtgacctggcggaaacgcctggcgagttccggcaggaatccgccgtcccccgggccgacctccagcgccgtggcgccgggggcgaaggccagtgcgtcgagcaaggccaacacgctctcacggtattgcggcagtcctgcgatcaggtcctgctgggcctggaacttgtccgccgcgcgggcgaagaagtcctggctgaccgccgcgcgctgggcgtgcacggcatcgatccgcgcccgcacgtcgtcgggtagcgcccgttcgtccacttcctccagcagcgccgcgtgcagcgcgccgccggtgcgttcggccaggggcagcgaacgtcggtag

SEQ ID NO: 3275 - DNA, 1104 bp, Pseudomonas aeruginosa
ttggcgcctttcactggccccttgccggagctatccctgccgatgtccaccccgccttttcgcgtcgcgctcaatggctatggccgtatcggccgctgcgtcctgcgcgcgctgcacgagcgcccggagcaactgggcttcgagatcgtcgcgctgaacgacctggccgaccaggccagcgtcgagtacctgacccgcttcgactccacccatggccgctttcccggcgaagtgaaggtcgacggcgactgcctgcacatcaacggcgattgcgtgaaggtgctgcgtagcccgactccggaggccatcgactggcaggcgctgcgggtcgacctggtgctggagtgctccggccagtacaccaaccgcgcccaggccgagcgtttcctccgcgccggcgcgccgcgggtgctgttctcgcagccgatggcgagcgaggcggacatcgacgccaccatcgtctatggggtcaaccagcaggacctcagcggccgcgaaacgctggtctccaacgcctcctgcacgaccaattgcggggtgccgctgctcaagctgctgaacgaggcgatcggcctggaatacgtgtcgatcaccaccatccactcggcgatgaacgaccagccggtgatcgacgcctaccaccatgaggacctgcgccgtacccgttcggcgttccagtcggtgatcccggtgtccaccggtctggcgcgcggcatcgaacgcctgttgccggaacttgccgggcgcatccaggccaaagccatacgcgtgcccacggtgaacgtctcggcgctggacatcaccctgcagacttcccgcgacacctccgccgccgagatcaaccgggtgcttcgcgaggctgccgaaagcggcccgctgcgcggactgctggcttataccgagctgccgcacgccagttgcgatttcaaccacgacccccattcggccatcgtcgatggcagccagacccgcgtttccgggcctcgcctggtcaacttgctggcctggttcgacaacgaatggggattcgccaaccgtatgctcgacgtcgccggacactacctgcgcgccgccgtgcctgatcaacaagtacccaaggactga

SEQ ID NO: 3276 - DNA, 1284 bp, Pseudomonas aeruginosa
agacggcaagacccctgccgactacgactacaacgtccgcgtgacccagcagaccgtggcgttcgcccatgcctgcggcgtgtccgtggaaggcgagctgggctgcctgggttccctggaaaccggcatggccggcgaggaagacggcgtcggcgcggaaggcgtgctggaccacagccagttgctgaccgatccggaagaagccgccgacttcgtgaagaagaccaaggtcgacgccctggccatcgccatcggcaccagccacggcgcctacaagttcaccaagccgccgaccggggacaccctgtcgatccagcgcatcaaggaaatccacgcgcgcatcccggacacccacctggtgatgcacggctcttcctcggtaccgcaggactggctggcgatcatcaacgagtacggcggcgagatcaaagagacctacggcgtgccggtcgaggaaatcgtcgagggcatcaagtacggcgtgcgcaaggtgaacatcgacaccgacctgcgcctggcctccaccggtgccatccgccgcttcctggcgcagaacccgagcgagttcgacccgcgcaagtacttctccaagaccgtcgaggccatgcgcgacatctgcatcgctcgctacgaagccttcggcaccgccggcaacgcttccaagatcaagccgatctccctggaaggcatgttccagcgctacgctcgcggcgagctggatccgaaggtcaactaagcgccttcgttcgaacgggagccccgctggtcggggctcttgcacatccgccccggggaaatccgatgcgccgctggctccttaccctgccgttcctgctgctggccggttgcgctggcctgcacgcgccgtcccgcgacgtcgaggaggccgcgtcgccgagcgtagcgcgcgatcccgccgacccgcaggattgcctggcgcgcagcgactgcacgaccaagacttcgcgcaccctgctgttcgtcttcgactatgcagaggccggcggcgaactggtggtgcgcgacgggcgccaactggaaaccccgccggcgccgcaacgctccacctggccggcgttgcgcatccaactggccgagccggtcaacggtcgcttcgagttcgagagcccctgcctgcgcaagagcggcaagggctgccgctacagccaggctacgctgctgaaggtctaccgcagctacctggtcggcaagccctgctcgctgctcagccctcgcgcagtgaaacgctgcgtcgacccggcggcgaccgccgcgcggcgctga

SEQ ID NO: 3277 - DNA, 1197 bp, Pseudomonas aeruginosa
cctggaagagtctctagcggctgttacaaggatgaattctcgatgggaagcgcttcgcaacgttcggtgcaggatctttatgaggacgtgggagatcactaccggatctttatccgggcgccattctttcaattgctgaaacacagggactactgggttcccctgctgtatttcttcttcgtgttgatcacgatgttctgggacttgtattgccactccggacagtacctctacgaagccaggagtctgctccctttctatctgttcccgtttctgatcgctgcgctacggataggcgatatcgtcgtcgatacgcgctgtcgcaatgtggagaacctgggaggcttcgagcgctccgccgagagcagtcgctacgtccagctttccctctacgaacggcaatggttccggctgcggtaccgggcctatggcggtaacctccgctgcctggcgggcgatctggtggagaactggcgcctctggaaggaggtgaattcgaaggccgcgaaggatatcgacggcgcagtgatgctgcgattctttctgcctccccgggaccttgctcgtctggtcacgctgttggctgcgctcattgcggtcatcgccactctcatcattaccctgggggctgacaggcagggctatttcgagtttgtcgacaacctgcccgcctatctgaaactgtattggggcgtcgttttcatcattgccttcagcggtccatacatgatcttcctggggatgcaggcgcgcctggtactgcgcgcaatgatcgacgcattgtccatttcccaaccaagcgacaagctgttctatcaattcatccagcggctcatctgggcggacggagtgaaaccggcgaaccccagtgccaacagcagggtgctacgggcggtcgactccatggtcgacttcttctacgaggagtggagaagcgccatcggcaagcttgtgctgtggctcgttgccctgcttgtgctgcttctttgcacgcttttgcattgcctgctccgagtcttttcctcggcgagaacgttgggagaggcgctgatgcggattctcttggctgttctggggggcgtttgctggatagtcgcggcgatccagcgcttgaatcttgccgtgcccttccactggaccttcttcgtgctgacgggaacgggagccttgttcgcaaccctctgcgggcagccctga

SEQ ID NO: 3278 - DNA, 1566 bp, Pseudomonas aeruginosa
cctcgctgtcgaccaggacgccgtcgcagtcggaaatcagtgcgtcgatggggtggggcatgggctacctcgctgcgggcgttggcgcagggcgccggagtgggagcgaggcattctaaccccggtcaggggcgggaagggaaacagggagagggagaacgccgggccgtgcggcccggcgggaaggaatcaggcgatgcccttcgggttctggccgtactggttctggccggcgtcgctgtccttggccagcaggtagatcaggtacaggccgacgatcgggatcagcgcgatcagcatccaccagccgctcttgttgatgtcgtgcagacgccgggcggtgacgcccagggccggcagcagcacggcgagcgagtagagattggcgatcggcaggagcttttcactgatcaggccgagcacgacgctcagcgcaacggagatgatgatgttcaccagggtgaacatccagtattccttgcgacgggcacgcccgttgaagtcgaagtagtgttccttcacgcatttcagaaaccattccatgtttgcctcctgggcgtactggtaaagcgggagagtgggtgccgcgacaagtacccccgcgcctccttgccgggaaagcacagtgtagccgtactgtcagtgaattcgtacaggatgttgcgaaaatcattcacattgcatagcagcggatcgccgaaatgtgcgccggtagcgctttcagcgagcggagtcggcctggcggcggaaacggcccggcgatacgccgaaggcctggcggaaattgcgggaaaacgccgcctccgactggtagccggtctcggcggcgatatccagcaggctcttctgcgtttgtcgcagcaggccgcgagccttctccatgcggatgcgggtcagcaggttccacggcgaggttccgccgagggcggagaaggcgcggacgaaactggcccgcgacatcgccgcctgctgggcaagctgttccagggtccaggcatgctccgggcgttccagcatggcccgcagggctcgtcccaggcgggcgtcgcccagcaggccgaacaggccgtcgcccagcggttggcggtccaggtaggcgcgcagggccagggcgaacagcgcggtggccagcgcgtcgatgatcgagcgggcgccgctgcgggtgctctcggcttcctcgcgcatcaacccgatcagcgcgcgcaggggctgctgggtcgactcgtccatatgcaccagcaggcgctcggggagcgcgccgaacaggctggcaccggcgtgatagcggtagctgccgcaaagcatgtcgagggcctcgccagggccgttcaactggtacagcgggatgctgccgcggtgctctacggtgggttcgcagggttgcgccgggctgtcgctgcgcaggaggtgcggggtgccgcgtggcaacagaatcaggtcgccgggatgcaggtcgaggcgaccgccatcgaggaattcgcaatagcaggtgccggccatgacgatatggaaggtcgcctcgccgggcaccgcttgcgggtgctccagcgcccagctgccctgtag

SEQ ID NO: 3279 - DNA, 429 bp, Pseudomonas aeruginosa
agacgcatgggcaggcggcgcggtccagactggtcgagactggtaacccgacgcgccactcccggcgcgaaagcaacggagaatatcaccatgctgaacaactggaccgagttcgtccccgccgtgaaaaaagccttcggtgccctgggcaagcaacacccgaagatgctcgccgcctatggcgcgctggaggaagccagcgccgagggcgccctggatgccaagacccgcgaactgatctccatcgccgtggccattaccacccgttgcgacggttgcatcggcgtgcacaccgaggccgcgctgaaggccggcgccagcgaggcggaaatcgcccagaccctggctaccgccatctccctgaatgccggcgccgcctatgtctattcgctgcgcgcgctggaagcctacgaccagttcaaaaagtga

SEQ ID NO: 3280 - DNA, 363 bp, Pseudomonas aeruginosa
cctgcagcacggctcgccggtgcaacggtagagacctatcggcaggtgccggaaacctgccgccagcactgctgcgaattgcgcctggcaccggcctacgacatcgtcaacaccacggcttatatcccgcaagatgtactggcgctggatgtcgtaggcaacaagtctctctttgcctcgcgacaggggctgctggagttcgcccaggtctgctatgtagctcggccaaaagaagtgatccgcgagcagttgcaggcactggagcgggtgttggcccgctcaactgagctgagcgagcaggccccgcatgtggtcgcggcaatcaggcaatgtgccgttccgtttatgcagacgtttggctag

SEQ ID NO: 3281 - DNA, 1515 bp, Pseudomonas aeruginosa
cccagctcagccgggcttcggcgtgcgcgccaggcagtagacgtcgacccgcgcggcgcccgcccggcgcaacaggcgggaaaggcgctcggcggtggccccggtggtgagcacgtcgtccaccagtgccaggtgcagcccgcgaacatcgctggcgggcgccagggcgaaggcgtggcgcaggttgcgccgccgcaccgtcgcgtccagtccctgctgggccggagtatccagcactcgccgcaggctgtgcggatcgcagcgcatgtccagctcgccagccagtcgctcggcgagctgttgcgcctggttgaagccgcgacgacgttcgcgccgtggcgccagcgggaccggcagcaggcgtgccgggcgcggcaggccttcggcgtagcgttgccgcaggtgttccgccagcaactcgccgagcagccgccccagcggccaggccgcctggtgcttgaagcggttgatcaggctgtcgagcggaaaggcgtagcgccagggcgcgatcgcctgttcataggccggcgggcggcgcaggcactcgccgcacacctggccgtccagcggcaggggcagggcgcagcgccggcactgctggcgcgaccagggcaggtcggcggcacaggcgcggcacagtgggcggggcggctggtcgctgcgggcggcgcagagcaggcaggccggcggcggcaaaagccagcgagtgagaggacgaagcgggaacgacatggcgggacttcctggcggatgtcgcaccatgcaaccgcaggcgcgcgccgccgaccagccgttgccagcgggttcggaactcgcctgtggataaccgaaaccttccttcgctccttgcggaaacggccgacgcgtggatcagtggatgagccagctcatgacgatcaggccgagcaccgtccagatcaccccgccgactatcgagcggcgcatgaaggcgcgtataccgctgtagagcagcaacaggccgagcaccaggaagacgaagctgaacagcgatgcgtccatgccgatggccctggccaggccgtggaggaagtcgtccatggcgtcccagatgccgcccagcaggccggagagcaggtccaccacgaagcggatcgccctgcccagcatctcgcccagtccgtcgaaaaagccttctgtacccatgagtgtcctgtcctgagtgttcccagcgttggatcagagattagccgccgggttcagcgccggctgctgctttgctgcggagcgaggaacgactggcggaagtattcgcggaacgcgcgcatcccggcgctcgcttcggtgtcgcggcgccaggccaggccgacgctcatcgacggcaccgggtcgaccagcgatagcgtctcgatgcgtttgccttccagcgaccagggccggtacaccaggtcggagaggatggccacgccggagccgttggcgaccatgctgcgcaccgcttccaccgaactggtatggaggatcacctgtggccggtggccgctctgttgccagtag

SEQ ID NO: 3282 - DNA, 732 bp, Pseudomonas aeruginosa
tcagcagcgccaacatcgccaccggtttccatgccggcgacccgagcagcatgcgccgcaccgtggagatggccgccgagcatggcgtggccatcggcgcccatccgggcttccgcgacctggtcggcttcgggcgtcggcacatcgccgcgccggccatcgagctggtcaacgacatgctctaccagcttggcgcactgcgcgaattcgcccggctgcagggcctgtcgctgcaacacgtcaagccccacggcgcgctctacatgcacctggcgcgggacgaggtcgccgcgcgcctgttcgtcgagaccctgcaacgcctggaaccggaactgctgctctattgcatgcccggttcggccacctggcgcatcggccgggaactgggccagccgctggtgcgcgagttctacgccgaccgcgactacgaccgcagcggctccatcgtcttcacccggcgggtcgccgccctcgatccgcagcaggtcgccgacaaggtcctgcgcgcctgccgcgagggcaaggtgcgcaccgtcgagggcgaggacctcgacatcgccttcgactcggtgtgcatccacagcgatacccccggtgccctggagctggtcgccagcacccgtgcgcgcctggagggcgccggcatccgcatcaaggcgccgcgttgagcgccgctcgcctcggcgagcctcgcgacaagcttttctgccatttcctacaacgttcgaataa

SEQ ID NO: 3283 - DNA, 258 bp, Pseudomonas aeruginosa
ggattcgtcatggccgaacataacgtgcagtcccccttgcccggcaccttctatcgcaaggccagccccgacgcgccgccctacgcggaggtcgggcaggcggtcgaggccggcagcgtgatcgggctgatcgaggtgatgaagcagttttccgaagtgcaggccgggcaggccggcatactccaggcgttccacgtggaagatggcgaggccatcgagccgggccaggtgctggcggtgatcgccagcgctacctga

SEQ ID NO: 3284 - DNA, 1080 bp, Pseudomonas aeruginosa
tcgtccatggtcgcgaccgcgacgaagcgttcgcccgcgcgcgccaggcgctggagcgcaccgtgctggccggcatggccactaccctgccgctgcaccgctggctgctcgccgatgcgcgggtacaggccgcgcagttcgataccgctaccctggaaacctggctcgccgagcggaccgccgccgcgcaggaggtttgagatgcatgccaacatccgctacagcttcggcggcgacgagcacctgttcgccgaggtcgccgagtccatgtcgctggaagccttcttccgcggcatggcgatcacccgcgccatcgagaccctgcaattgcccggggtgctcgacgtatgcctggccaacgcctcgttccaggtccgcttcgaccccgaccggctggccccgcaggcgctgctggagacggtgcgcggcctggaggtcgaggcggtcgccgcgcgcagcatcgagacgcgtatcgtcgaagtgccggtgttgtacaacgatccctggacccacgagaccctgatgcgcttccgcgaccggcaccaggacccggactccaccgacctcgagtacgctgcgcggatcaacggctacgccgacgtgcaggcgttcatccaggcgcacagcggcacgccgtggttcgtctcgatggtcggtttcgtcgccggcctgccgttcatgtaccagatggtcgagcgcgagcggcagttgcaggtgcccaagtacctgcgtccgcgcatcgacacgccgaagctgaccctcggccacggcggttgcttcggctgcatctattcggtgcgcggtgccggcggctatcagatgttcggcgtgactccggcgccgatcttcgatccccgccagggcctgccctatctcgaggaatcgatggtgttcttccgcgctggcgacatcgtccagttccgccccatcgagcggaccgagtacgagcgcatggcggccgaagtcgaagcgggcacattcgacctgcgcatccgtccggtgagtttcgatctcgacgcgttccttgccgatccgcgaggctgcacgcaacatctgcaggaggtgctgtatgtcgattaa

SEQ ID NO: 3285 - DNA, 783 bp, Pseudomonas aeruginosa
ggtgctcaagcccggcctcgccacctcggtgcaggacgccggccgcgaaggccactatcacctgggcatcccgccgtccggcgcgctcgaccagtatgccctgcgcgctgccaacttgctggtgggcaacgcaccgaccgccgccgtgttggagtgcgcgctgctggggccgcagctggagttccagcgcgacgccttggtggccgtgtgcggggcgcgcatgacgcctcgcctggagggcgcggagatgccgctggatacttccttccgggttcgcgccggccaggtcctggggttcgatttcattcgtgccggcgcccgtggctatctcgccatcgacggcggcatcgcggtacccgaggtgctgggcagtcgttcgacctacggtctgggggcgatcggtggcttgcagggacgacggctggcggagggcgacctgctgcctctggggcctgcctcgccctctgccgtggagggcttggcgctgccgcgttcgctgcaggtggaggtcggcggcgaggtgagcttgcgggtggttcccggactctacgtccatcgcctgacccccgacgcggtcgagcgtttcttcgccgagacctggaccgtcggttcggaggcggaccgcaccggctaccgcttcaagggcggcacggcgctccggttcgagccgcgcgaacagccattcggcgcaggctcggacccgtccaacatcgtcgacgcctgctatcccatcggctcgatccaggtaccgggcgggctcgaacccatcgtcctgcatcgtga

SEQ ID NO: 3286 - DNA, 1221 bp, Pseudomonas aeruginosa
tgtcggccctgcgtggacgggtgcgcctgcgtccgtccagcaacacgagcgacctgccatgtccttcgatctcgcttcccgcctcgccagccggcgcgcggaagacctctaccgccagcggccgctgctggagtcggcccagggcccggacgtcgtggtcgacggccagccgctgctggccttctgttccaacgactacctcggcctggccaaccatcccgaggtgatcgccgcgctgcgcgccggcgccgagcgctggggcgtgggcggtggcgcctcgcacctggtggtcggccacagcggcccgcaccacgaactggagctggccctcgccgaattcaccgggcggccccgtgcgctgctgttctccaccggctacatggccaatctcggcgcggtgaccgcgctggtcggcaagggcgacacggtgctggaggaccgcctcaaccacgcttcgctgctggatgccggattgctctccggcgcgcgtttctcgcgctacctgcacaacgacccggcaagcctcgccgcgcgcctggacaaggccgagggcaataccctggtggtcaccgacggggtcttcagcatggacggcaatctcgccgacctgccggccctggccgccgtcgcgcaggcccgcggcgcctggctgatggtcgacgacgcgcatggcttcggcccgctgggcgccagcggcggcgggatcgtcgaacatttcggcctcggccaggagcaggtgccggtgctgatcggcaccctcggcaagggtttcggtaccgccggcgccttcgtagcgggcagcgaggaactgatcgagaccctgattcagtacgcccggccctacatctacaccaccagccagccgccagcggtggcctgcgccaccctgaagagcctggagctgctgcgccgcgaaagctggcggcggcaacacctggcggcgctgatcgcccgtttccgccatggcgccgaggcgcttggcctgaccctgatggacagcttcacgccgatccagccgatcctggtcggcggcagccgccaggccgtggccctggccggcatgcttcgagcccgtggcatcatggtcggcgcgatccgcccgccaaccgtgccggccaacagcgcgcggctgcgcgtcacgctgtccgccgcgcacagcgaagcgcaggtcgaccgcttgctcgaagccctcggcgaaagctggcgacagctgtcgtctag

SEQ ID NO: 3287 - DNA, 846 bp, Pseudomonas aeruginosa
gattccttcgcgagggtgacgatgcctgacgattcctcgccgctgctggcgccccatggcgttgccgcgctgcccgacaagcgccaggtcgccgcgtcgttttcccgcgcggcggccagatacgacgcggtggccgaactccagcgcggcgtcggtgagagcctgctgtcggcattgccggaaggcttctcgccgcgccgctgggtcgatctcggctgcggcaccggttatttcagccgggccctggaacgacgcttcggtgcggccgagggcctggccgtggatatcgccgaaggcatgctgcggcatgcccgcgcgcgcggcggcgccagccatttcattggcggcgacgccgagaggctgccgttgcgcgacggcagttgcgacctgctgttctccagcctggctatccagtggtgcgccgacctcccggcggtcctggccgaggcgcggcgggtcctgcggccgggcggcgtgctggcgttcagcagcctgtgcgtcggtaccctgggcgagttgcgcgacagttggcgggtggtggacggcttcgtccacgtcaatcgcttccgcgccttcgccgactacctgcaacacgcggccggcagcggcctgctgccgctgaccctgcgccacgaggaccggctcctgcatttccccgacctgcgcagcctgacccacgaactcaaggcgctgggcgcgcacaacctcaaccccgggcggcccgacggcctgaccgggcgccagcgcatccgcgcgctggtcgccgcctacgagcgtttccgccagcccgaggggctgcccgctacctaccgcgtcgtcttcggcgtgctgcgcaaggattcctga

SEQ ID NO: 3288 - DNA, 690 bp, Pseudomonas aeruginosa
accatgccggcgttcttcgtcaccggtaccgacaccgagatcggcaagaccaccatcgccgccggcctgctccacgcggcccggagtgccggcctgagcaccgccgcggcgaagccggtggcctccggctgcgagcccacggcgcaaggcctgcgcaatggcgacgcgttggtgttgctcggccagtgctcgctggcgctggcctacgagcaggtcaacccgctggccttcgcaccggccatcgccccgcacctggcggcgcgcgaggctggcgtcgaactgagcgccgcacgcttgcacgaggcggtgcgcgaggtgctggcgctacaggccgacttcaccctggtggagggcgccggcggatggcgcgtgccgttgctgggccgcgagaacctgtccgacctggcgcgcctgctggcgctgccggtggtgctggtggtcggcgtgcgcctgggctgtatcaaccatgcgctgctcagcgccgaggcgatcctgggcgacggcctggcgctggccggctgggtggccaacgtcgtcgacccggctacctcgcgcctggaagagaacctggcgaccctcgccgaacgcctgccggcgccctgcctgggtcgggtaccgcgcctggaggaagccactcccgcggccgtggccgcacacctcgacctgcggcccctgggtatcgggctataa

SEQ ID NO: 3289 - DNA, 234 bp, Pseudomonas aeruginosa
agggtggaaatttccggcaacgctttcgtcagtggcctcaacgcggtgcagtcgggcagcgcccgcgtcgcccaggccggcagcgagatcgcccgcaataccgtggaggcccgttcgccccaggccgagcagatggtcgaactgacccgcgccaagctcgaggcgcagagcggcgcccgggtcatcgaggtagccgacgagaccctcggtaccctgatcgatacccacgcctga

SEQ ID NO: 3290 - DNA, 1818 bp, Pseudomonas aeruginosa
aggttgactgctatgcctgattacaaggcccccttgcgtgatatccgtttcgttcgcgacgagctgctgggctacgaagcgcactaccagagcctgccgggcgccgaagacgcgactcccgacatggtcaacgccatcctcgaggaaggtgcgaagttctgcgaacaggtgatcgctccgctgaaccgcgtcggcgacctggaaggctgcacctggagcgccgacggcgtgaagaccccgaccggcttcaaggaggcctaccagcagttcgtcgaaggcggctggccgagcctggcccatgacgtcgagcacggcggccagggtctgccggaatccctcggcctggccatcagcgagatggtcggccaggccaactggtcctggggcatgtacccgggcctgtcccacggcgccatgaacaccctgcatgcccacggcaccgccgagcagcaggcaacctacctgaccaagctggtctccggcgagtggaccggcaccatgtgcctgaccgagccgcactgcggcaccgacctgggcatgctgcgcaccaaggccgagccgcaggccgacggtagctacaaggtcaccggcaccaagatcttcatctccgccggcgagcacgacatggccgacaacatcgtccatatcgtcctggcccgcctgcccgacgccccgcagggcaccaagggcatctcgctgttcatcgtgccgaagttcctgcccaacgccgaaggcaacgccggcgagcgcaacgcggtttcctgcggttccatcgagcacaagatgggcatccacggcaacgccacctgcgtgatgaacttcgacgccgccactggcttcctgatcggcccgccgaacaagggcctgaactgcatgttcaccttcatgaacaccgctcgcctgggtaccgcgctgcaaggcctggcccatgccgaagtcgttttccagggcggcatcgcctatgctcgcgagcgtctgcagatgcgctcgctgaccggtccgaaggcgcccgagaagcccgccgacccgatcatcgtgcatcctgacgtgcgccgcatgctgctgaccatgaaggcattcgccgaaggcaaccgcgcgatgctgtacttcgccgccaagcaggtcgacatcgtccagcgcagccaggacgaagagcagaagaaagccgccgactcgatgctggccttcctcacgccgatcgccaaggcgttcatgaccgaagtcggcttcgagtccgccaaccacggcgtgcagatcttcggcggccacggtttcatcgccgagcacggcatggagcagaacgtccgcgacagccgcatctcgatgctgtacgaaggcactaccggcgttcaggccctcgacctgctgggtcgcaaggtgctgatgacccagggcgaggcgctgaagggcttcaccaagatcgtgcacaagttctgccaggccaacgaagccaacgaagccgtcaaggaattcgtcgctccgctggcacagctgaacaaggagtggggcgacctgaccatgaaggtcggcatggccgccatgaaggatcgcgaggaagtcggcgccgcttcggtggactacctgatgtactccggctacgcctgcctggcctacttctgggccgacatggcgcgcctggccgccgagaagctggccgccggcaccggcgaggaagccttctacaaggccaagctgcagaccgcgcgcttctacttccagcgcatcctgccgcgtacccgcgcccacgtcgccgccatgctgtccggcgccaacagcctgatggagatggccgaggaagatttcgccctcggttactga

SEQ ID NO: 3291 - DNA, 654 bp, Pseudomonas aeruginosa
ggccggcgcggacctcggcgaccaccttcaggttgtacaggtcgtagagggttacccagccgtcgcgcgaggcgaagaacaccaggcgcccgtccggggagaacttcggacctccgtgcagggcgtagcgcgaggggaagcgggcgatgggctcgaagcgatcgccgtcgaggatggtcacgtggtggtcgccggactccaccaccacgaacaggttcagcgggtcggcctcgaagcggggcctggacggcagggtggcgaggggatgcggctgaacctggctggcccggatgtcctcggcgctccactgcggttcgcgcggcggcgcctggtagagataggcgaccagggcgtccgccgcggcgtcgtccaattgaccggcaaagccggccatctgggttgccgggcgaccgtgcaggatcacttcgcgggcctgcgccggcttcagccgcgaaaggctttccgggagcagggtcgggccgctgccgccgagccgcccggcgccgtggcaggcctggcagtgctggcggtagagcgcttcccccggcgcttcgccggcctgtgcgagggcgccgaggagcaggccgagggcgaggccgatcaggcgcatgcgacggcctcgcggctgaccggcgagccggcgcccaggtatga

SEQ ID NO: 3292 - DNA, 846 bp, Pseudomonas aeruginosa
aggatgcgccatcgcgcgctcggcgaagagcgccaccacctggccgacgacgatcagcgtcggcggcttcaactggtagcgtcgcgccagcgccggcagctcggcaagggcgccgcgggtcacctgctggcccgcctgggtgccctggctgaccagcgccgccggggtgtcgctggcgaggccgtgctcgaccaggcgcgcggcgatctcggcgaggttgcccaggcccatgtagaacaccagggtctgcttgccacgcgccaggccggcccagtcgaggtcgaggcggccgtcgttctgcaggtggccggtgacgaaggtgcaggactgggcgaggtcgcggtgggtcagcgggatgccggcgtaggtactgcaaccggaggcggcggtgacgccggggaccacctggcagtcgacgccggcttcgagcaggcgctccagctcctcggcgccgcgaccgaagatgaacgggtcgccgcctttcaggcggaccacccggcgttgctgccgggccaggcgcaccagcagctcgttgatttcttcctgcggcaggctgtggtggccgcagcgcttgccgacgtagatgcgctggcagctttccggcagaagggcgatcagctcgcgggcgaccaggcggtcgtagaccaccacctcggcctgttgcagcagggcccatgcgcgcagggtgagcatgcccggatcgccggggccggcgccgaccagggcgacgctgccggcagggaaatcgacatcgaggaaggacggcggaatccccgtagtgttcatgaggctttccttataacgggtgcagcgcgatgcgctcgaggccgatttcctgatctctga

SEQ ID NO: 3293 - DNA, 1662 bp, Pseudomonas aeruginosa
tgcgctcggcgacccgttgcagacgctcctcgggcaccgccagggcagccagggtgctggccccggcgcgttggtggcggagcaccgggccgacccgcgacaacgcgccgtcggcttccaggcgacgcagccgttcgagcacctcggcttcgctgcaacccagggtctcggccatccgccgatagggttccgcgcagatcggcaggcctttctggtagcgggcgaggaggcggcgggagaggtcgtccatggtgcctcctagagtccgatgtgctgggcgcggtggctgaagaatatgccgctcgggctgcgggccggaaggctgccgatgcgcttcaggcggtacgggtcccagacctgcaactggtcggcgtcgcgcaccgagatccatacctggtcgccgcgcccgctgaattccatgtgcagtacgccggggccagggcgcagggtttcgatcacttcgtgggtctcgctgtcgatgacctgcaccttgtcgttgtccgggtaggcgaagttgacccacatctgccggtcgtccggtcgagtcatgacgaacaccggctggccggcgacgtcgatggcgtcggtctgcttccagtcgcgcgcgtcgagcaccagcacctggtgatggccgaccgccgggacgaaggcctggtcgctggcgatggtccagccctccaggtgcggcatcttgtacaccggcagcttgcgttggccgcggccgtagtcgccgagtacgcgcctgacgccgcgctccgggtgccagaggtcgagctgggccatgccgtcctcgccgaacagcccggccatgtagtagcgcccgtcggggctgatgagggcgtcgtagggttgcttgccgatatcgcggaagcgggtcaggtgcggcgtgtcgccctggctgaagtcggcgatccagatctcgccgctgtcgaacaggctgaacacgaagcgctgcccgggcgcgtcgaccaggccgaccacccgggagttcctgtcctggccggggaggcgggtggcgggaatctcggcgaccagctccagggtgcggctgtcgaacaccttgaccccgcccggctcgtagctggataccgcgaccagccgaccgtcctggctgatcgctccgccgatgctgttgccgccctggatcaggcgcttgtcgatgcgctgggccagcaggtcgagcttggtcaggccgccgtcgcgaccgaatacgtaggcgtagcgctggtcgcgggagaacaccagggaggcgtgggacaggtcgccgaggccttcgacccgcgccagcgaggtcttcgccgtgccgtcgaggatctgcacgctgccgtcggcgcgttcgatcagcacgccgaggtcgccgctgccgcgcaagggcggctgctggctacagccggcgagcagggcgaggaaaagcggcgcgaggggacgcaggttcatggggcgatctctccttcgatcaggcggtccaccagccagccggcgtcgtcttcgctgagcaggccggcccaggggggcatcggggtttgcggacggcccatgagcacggtggcgaccagcgattcgcgcggcttgccgcgcagggcctcgggggtcagcgccgggccgaggccgccggtcaggcgcaggccgtggcaggatccgcagtcctgcaacagcaggtga

SEQ ID NO: 3294 - DNA, 1359 bp, Pseudomonas aeruginosa
ttcggcgactttcttccaggcgtactgcggatggttcttcggatcggtgccgatcagcgagatgctgccgtcgcccaggtggctggtgctccacaccgggccgtacttgggatgcacgaagttggcgccacgccccgggtgcggggtcttgccgacgtcgaccagggccgacaggcgacggtccttggagtcgatcacggcaaccttgttggagttgttggcggcggtcatgaagtagcggtggctgctgtcccagccgccgtcgtggaggaacggcgccgcaccgatgctggtgacggtgaggttgtcgatatccttgtagttgaccagcaggaccttgccggtctccttcacgttgacgatgaactcggggtgctcgtgggaggcgatgatcgccgccacgcgcggttccgggtggtaggtctgggtgtctacggtcatgccgcgggtggagacgatctgcttcggctccagggtctcgccgtccatgatcgcgaactgcggcggccagtaggcgccggcgatggtgtagcggtcctcgtagcccttgaacttggagctttccaccgagcgcgcctcgatgccgatcttgatctcggcgaccttggtcggctccttggcccacaggtcgatcatgtcgatccgcgcgtcgcggccgatcaccagcaggtagcggccggaagcggacatccgcgagatatgcacggcatagccggtatcgatgaccttgacgatcttcttgctgtcgccgtcgaccagggcgatctgcccggcgtcgcgcagggtcaccgagaacaggttgggcaggtcgaggtcgttgagctgtttcttcggccggtcctccggcttcaccagcaccttccacgattcgcgcatctccggcatgccccactccggcggttgcggcggggtgtgctggatgtacttggccatcagggtgatctgttccttgctcagctcgccggagctgccccagttcggcatgcccagcggggtgccgtaggtgatcagcgcttccaggtattgctggccgcgttgctgggtgatgtccggggtcagcggcttgccggtggcgcccttgcgcaggacgccgtggcaaccggcgcagcgttggaagtagatctgcttggcctcgttgaactcgctttcactcatgtcgggggcaccgttggtgcgcaccacgtgagcgggatcgacggcggaagcggcaccctggtattgctcggcggctttcatgtcgtccttggcgtgagcggtggccaggcccagcagcgtcagcgaggcgagcaaggtgcccgccagtggcttgccaaatggcatggtctatctcctcaggagccctgcgaggcgctcccttag

SEQ ID NO: 3295 - DNA, 591 bp, Pseudomonas aeruginosa
tggacatcgtcgatctccatgtcgcctgataccgtcgagcggcgcctgcccggcgacctggcgatgtggttcttcatcctcgccgaactcagcgtgttcagcctgctgctgctggcgttcgccggcgcccaggcctggcagccggagctgttccgtgccggccgggagcaactggatagccgctggggcctgttgctgaccgtggccctgctcagctccggctggctcgccgcgctggcggtgcatgcggtgcgccgcggacggccgcgccaggcgagcggctggttgctggcggcgctgctgctggcgctggtctacgtcggcctgaagctgcacgagtacgggcggctcgccgatctcggcctggacatcgagcacgacactttcttcaccctctactggtgcctgaccggcttccatttcctccacgtcctgctcggcctgctgatcctcggctggctggcgcaggcctgctggcgccggtgttatacgccgcaggcttgctcgggactggagtcgggagtgctctactggcacatggtcgacctggtctgggtgctgctgttcccgctggtctacgtcctgcaatga

SEQ ID NO: 3296 - DNA, 1872 bp, Pseudomonas aeruginosa
aatcgccgcaccacccattccaggaggccgcatgtccgagacctttaccaaaggcatggccaggaacatctatttcggcgggagtgtgttcttcatcctgctgttcctggccctgacctaccacaccgagaagaccctgcccgagcgcaccaacgaggccgcgatgagcgccgcggtggtgcgcggcaagctggtctgggaacagaacaactgcgtcggctgccacaccctgctcggcgagggcgcctacttcgcgccggagctgggcaacgtggtcggacgccgtggcggcgaggagggcttcaacaccttcctccaggcctggatgaatatccagccgctgaacgtgccgggccgccgcgccatgccgcagttccatctcagcgagggccaggtcgacgacctggccgagttcctcaagtggagctcgaagatcgataccaaccaatggccgccgaacaaggagggttgatgatgtcgcccaatggctccctgaaattcgcctcgcaggcggtcgccaaaccctacttcgtgttcgccctgatcctcttcgtcgggcagatcctgttcggcctgatcatgggcctgcagtacgtggtcggcgacttcctgttcccggcgatccccttcaacgtcgcgcgcatggtgcacaccaacctgctgatcgtctggctgctgttcggcttcatgggcgctgcctactacctggtgccggaggagagcgactgcgagctgtacagcccgaagctggcctggatcctgttctgggtattcgccgccgccggcgtgctgaccatcctcggctacctgctggtgccctacgccggcctggccaggctcaccggcaacgaactgtggccgaccatgggccgcgagttcctcgaacagccgaccatcagcaaggcgggcatcgtgatcgtcgccctgggcttcctgttcaacgtcggcatgaccgtgctgcgcgggcgcaagaccgccatcagcatggtcctgatgaccggcctgatcggcctcgccctgctgttcctgttctccttctacaacccggaaaacctcacccgcgacaagttctactggtggtgggtggtgcacctgtgggtggaaggcgtgtgggaactgatcatgggtgcgatcctcgccttcgtgctggtgaagatcaccggggtcgaccgcgaggtgatcgagaagtggctctacgtgatcatcgccatggcgctgatcagcggcatcatcggcaccggccaccactacttctggatcggcgtgcccggctactggctgtggctcggctcggtattctcggcgctggagccgctgccgttcttcgccatggtgctgttcgccttcaacaccatcaaccgccgccgccgccgcgactatccgaaccgcgcggtcgcgctgtgggccatgggcaccacagtgatggccttcctcggcgcgggagtgtggggcttcatgcataccctggcgccggtcaactactacacccacggcacccagctcaccgccgcccacggccacatggccttctatggcgcctacgcgatgatcgtgatgaccatcatctcctacgccatgccgcgcctgcgcgggatcggcgaggcgatggacaaccgctcgcaggtcctggagatgtggggcttctggctgatgaccgtggcgatggtgttcatcaccctgttcctctccgcggccggggtgctgcaggtctggctgcaacggatgccggcggacggcgcggcgatgaccttcatggccacccaggaccagctggcgatcttctactggctgcgcgaaggcgccggggtggtgttcctcatcggcctggtcgcctacctgctgagcttccggcgcggcaaggcggccgcctga

SEQ ID NO: 3297 - DNA, 729 bp, Pseudomonas aeruginosa
gatggccttcgccgtcgagctggaggaatgggtcggcgcccactggcaccgcttcatcacccgccatgccagcggcgagttcgaggcggcgcgggtgaccctggagagcatgcggcgtccgctcggcatgctcttccgggcgctcggcggcgcaccgggggtagccctcgaggcgaccccggcgcgccgcctgctgctacgccgcacctggttgcagcgggtcgccgggacctgcgagcaggccccggtgtcctggttcaacggcgacagcctgcgcctgccggaatccctcgcggtctatccgcaggccgagctgaaccgcgaactgtatcgctggctggcgctgctggcggccagcgccgggccgctgcggcactgggcccaggacaaccagcgctgggcgcggcagttgctcgatgcctatccggcgctgcgcccgcgctacgcccggctggtcgccgcgcatctgcgccagcgcccgtcgctggacgattgcccggcggcagacgccgaactggaaatcgccctgcgccgcgcgcttgccgagccgggcagcgtcgagcgcttcccgcgagtcgagcgggcgccctggccggtgccgctgtggctgtatcccggcgagcgctggacgccttccgccagtgcggaggacggcgaggaagcggccgccggcgccggcaagcgccaggtcgcccgcagcggagcgcgcaagcgcgccgagcgcattga

SEQ ID NO: 3298 - DNA, 2283 bp, Pseudomonas aeruginosa
cctgccgctcggccccgggctgaagctgcccgagtgggactatcggcagcagcgcctgctgagcgaccacgtgctgctgcaaccgatgcggccgcgcggcgcgaccagcgccagcctgccggcgcacctggagaagaccgcgctgcatctgcgccgccagttcgcctgcctgcgcgacggccgccaacgcctgcgccagcagccgcaaggcgacgagatcgacctcgatgcctggctcgacttccaggtcgagcggcggcgcggcggttccacccagccaggcctgttcctcgaacagcggccgcgccggcgcgacctcgcctgcctgttgctggcggacctgtcgatgtccaccgaagcctacctcgacgaccagcggcgagtgatcgacagcatcgtcgacagcctgctgctgttcggcgaggcgttgcaggcactgggcgaccccttcgcgctgtacgggttttcctcggtgcgccggcagcaggtgcgctggcaggtgctgaaggacttcgacgaaggctacggcggcgaggtccgcggtcgcgtgctggcgctctcgccgggctactacacgcggatgggcgcggcgatccgccgggccagccaggtgctcggcgggcagccgcagaagcgtcgcctgctgttgctgttgagcgacggcaagcccaacgacctggaccgctacgagggccgctacggcatcgaggacacccgccaggcggtgatcgaggcgcgcagccagggactggtgccgttctgcatcaccatcgacaaggaggcggcggactacctgccctacctgttcggcgccgacggcttcgcgctggtcgagcgcgccgggcagttgcccgagcgcctgctccagctctatcggcgcctgcgccgctgagatgcctcagggagcatcgcgcggcaaccagagcatcatgcccaggcagaacagcgccagcccgacgcagaaccaggcgaagcgccgctgccggcgaccctggagctggcgctgggaagcgctgggcagtggcatgccgcactgttcgcaggcgctttccgcgccttcggtttcatggaggcaatacaggcattggcgcatgggcgttctcgcgggctcgaccccgccagcttgccggtggacaggccgtggcgcgcttgaccgcgatcaagcggcggggctgttcactcgaagcactccaggcgttcgcggtcgaggatgctgatttcgcggccgtcgaggcggatgatgccctcgtcgccgaggcggtgcatgatccgcgagaaggtttccggctggatcgacaggtgaccggccaccaattgcttggccaccgggatttccacccggcagttctcccccggcgcgtgggcggcgagggtcagcaggtagcgcaccacgcggtgggtggcgttcttcagggaaagcgtctcgatctcgtcgatgcgctggtgcaggcgggtgctgagcttggccagcagggccagggccaacggggtgttgtcctgcaactggcgcaggtaggccttgttggagaaacggaacagctggctgggcaccacggcctgggcggtggccacgtagttcggggtgtccatgaacatcatcgcctcggcgaaggtgttgcgttcgttggtcacttcgagaatcttctcctggccttccggggtcagccggtagatcttcacgcagccggaaatcaggtagtagaaggcgtgcgccggctcgccctggcggaacacgtaggcgcccttgtcgaggttgaccaggtcgctgctggcgagcagttcctggagctggacgggagaaagcggttcgaacaggtggtggctttgcagcaactgctggtggacgcgctggaattccatgctgggaaggctcgcgatgatgaggggactgcccactgtagcgggcccggcgcaggtcatcttgatgcacggcaagctcgcggcgggtgggcgctgccgtcggtccggcgagcggaactattacagcgtgtaagccaaggcttacaaacggcggtggttttggctgctttctccccctcgcggagatgcgtaatcttcaaaccgtcaggacattgcgcaggaagcgccaaagacaatacggaaactcagggaatccaccatggatggtggcgtagcacggatgtcaggatagaggtctgcaaaaccccgcccaaaaggcggggttttttattgcccgcgaaaaaccgcgtcgctcagaccacgccttccagcagcgagcgcagcagctcgacgctggcgtgctggcgctgcgcgtcgcggtag

SEQ ID NO: 3299 - DNA, 429 bp, Pseudomonas aeruginosa
actgaccgtcgcccgcctgttgcagtggtatttcggcgatcccctggagcctctcgggttgcgccagatgatggcctgcgacgcgctatcccagcgttggcgcaagacagcggcgaaacgcctgtccagcggcgtgatggaagactgggggccgcgcctgcgcggaccgtcggattaccgggagcatgcctcttgagcgactacctgatcaccctgagccagtccggccggctgttggccagcatgacggtgagcgccgcgcgctttgccgaggtgcgcgagctgatgcgccagcgcttccccgccggcgacggcttcgaactgcgcatcgaaacgcgccgggaaagccgccggctgctggaacaggggccgcagggcgtgcgcttgctggcggtggagtacatgaccgaggaactgaaagatggctga

SEQ ID NO: 3300 - DNA, 1878 bp, Pseudomonas aeruginosa
cctgcgcctgatgcgcacccaggaacggcccgaacaggtgttcgtccgtggccagggctcgtggctgtgggacagcgacggacgcgccttcctcgacttcacccagggcctggcggtgaactgccttggccacagtcccagcgtgctggtccaggccctggcccggcaggcgcgggagctggtcagcgccggccccggcctgctcaaccggccggtgctggcattggcgcagcgcctgtgcctggcgaccggcagcgaccaggcctacttcctcaccagcggcgccgaggccaacgaagcggccatcgccctggcgcgcaagtggggccgcctgcatcgcggcggcgcgcaacggatcgtcagcactgtcaacagcatccatggacgcaccccgggcaccctgacggcttgtggcaagccggcgcagcatggcctggagggattggccagggtgccgttcaacgacctcgacgccatggccgcggccatcgacgaagagacggtggcggtgatgctggagccggtgcagggcgatgccggggtgatcccggcgaccctcgactacctgcgtggcatcgagcggctgtgccggcagcgtggcgtcctgttgatcctcgacgaggtgcagaccggcatcggccgctgcggcgcgctgctggcggaggaactgtacggggtacgcgccgacatcgttaccctcggcaagggcctcggcgccggggtgccgctgtcggcgctgctggcgcgtggcaacgcctgctgcttcgaaccgggcgaccagcttggcacccaccacggcaacgcgttgatgaccgctgccgggctggcggtactgaataccgtgctggagccgggtttcctggagcaggtgcgcgagcagggcacccacctacgcgatggcctggcccgtgtcgcgcgtcgctatgggcatggtccgctgcgcggccagggactgttctgggggccgccgctgatcggccagcgcgcgccggcggtggttcgcgcggcgttcggcgaagggctgctgatcaacgcgccgcagccgcattgcctgcgtttttccccggcgctgacggtgagccgggccaacgtcgacgaaatgctgcggcgactggagcgggccctggcccgggtcgccaaccgacactaggaggtggcctgatgcgcgccctggtattgcaacacgttcccttcgaaggcagcgcgcggatcggcgactggatcggccgccactgcgagcacgagcacgtctgctacctctacgccgacgcccacctgcctgcgctggacagcttcgacctgctggtggtgatgggcgggccgatgagcgtccacgacgaagcgcaatatccctggctggtggcggagaaccgtttgatccgcgcggcgctggatgccggcaagaaggtcctcggcatctgcctcggcgcgcagctgctggcccaggcgctgggggctgcggtacgcccgggacgccaggcggagatcggctggtggccgctgcacaggtacagccaggcgctgggctcgccgctgggcgagcgcctgccggaacggctgatggcgttccactggcacggcgagaccttcgacctgccagccggcagcatgccgctctatggttcggctgcctgcgccaaccagggcttcatctggaacgagcaggctatcggcctgcaatgtcacctggaaagcaccgcggagagcatcgaggcgctgctcgatgcctgcccgcaggacctgcaacgggaaggggcggtgcatagcgccgggaggatccgccagggtgtcgcgcattgccgcgaggtggcgccggtgctgttcctgttgctcgattacctggcgcatcggccggcggagatcgcacgccgggcctga

SEQ ID NO: 3301 - DNA, 501 bp, Pseudomonas aeruginosa
ccgcgcgcgagcgcgaggtgttcgacctcatctgccagggcctggcggacaaggagatcgccaaggaactgggcctggcgccgaacaccgtgcgcaaccacgtggcgaccatctacgccaagctcgatgtccacagccgtggcgaggccatcgtctgggcacgcgaacgcggattcgcgccggagccgcgcaacggcaacgggcgcaaataaacgaagagggtacgaatgcaccagggcggctggtgcattcgtacctgtcgcccgctcccgtcggcgccgacactggcgcagcacgcccggcatgcccccgcccgtggtcgtgcaccttttctccgcggcgcgagccgcgccgtccgcacgtctgttcccctcgccagtttcgctctggcggggggcttcccgcctcctttcgaatatttgcccctctgcctctgctggtgcgcgacggcatcctgccggccgtttgcgaatgctcgggactggtgtcgtgaaattttaa

SEQ ID NO: 3302 - DNA, 1338 bp, Pseudomonas aeruginosa
gtgttatttttcatgaaaaataaccaatataatttcacggaggtcgcgatgttcctgcaatccaacgagcatgtcggcacttactacgccgccgtcaatcccgaactgatccagccgcgccaggccctggagggcgacctcgactgcgaggtgctggtggtcggcgccggtttcagcggcttgcacacggcgctgcggctggtcgaaggcggacgccaggtatgcgtcatcgaagccagccggatcgcctgggcggcctccgggcgcaacggcgggcaggcgctgcccggctggtccagcgatctgccgccgcttgaggccgacctcggctacgaaggcgcacgccgtctctgggacggcatgctctgggcggccggcgagatgcgcgagttgccgcagcgacatggcttcgactgcgactaccgggtcggccacctatggacggcgatcctgccgcgccgggtcggcctgctttacgactggcaggccgaggccaaccgtcgctggggctacgaggggctacgcttcgtggcgaaggacgagttgcccgaatggatcgccagcgagcgctaccttgccggtctctacgatccccacgccgcacacctgaatccgctcaagctggcgttcggcctggccgccgccatcgagcgcgccggcgggcgtatccacgagcggacccgggccctgaactatcgcgaggagggcgacggctaccgggtccgtaccgagcacggcgagatccgctgcgcggcgctggtgctggcctgcaacgcctacatcgacgggctggacagcgagctgtcgcaacggatgctgccggtgggcacctatcaggtcgccactgagccgctcggcgaggaacgggcgaagtcgttgctgccgcgcaactgctgcgtgaccgacaaccagttcgtcctcgactacttccgcctgaccccggactaccgcctgctgttcggcggcggctgcacctacctgggcggcatgcccagcgacatccgcgccgccacccggccctatctcgaaagggtgttcccgcagttgcgcggggtggcgctggagtacgcctggggcgggcatatcgactgcagcatgcggcgtaccccggacctcggccggcagggcaaccgctactggctgcaaggctactccggccacggcgtgctgccgagtctggcggcggccagggcggtcagcgacgcgctgctcggcgacgacgagaccctggcgctctaccagcgcctgcgcaatccgaagtttcccggcggccagcgcttcgccgcgccgctggaagccctgggcaaagcgtattaccgtttgcgcgacctgttctga

SEQ ID NO: 3303 - DNA, 1635 bp, Pseudomonas aeruginosa
gaaagctcgattgtagaccagccaatggccagcacgttccttgtgccggcacggatatcggcgctgtcaggcggtgcggcggccgaacgccagcttggccgccagggccagcaggcagaacacgaacagcgccagcgaccagaccgccatggactggccgagcagggtccagaccacttcgccgcacagcccctcgggctggaagacctgcggcagccaggtgtccagcggtatccattcggggaagcccatgaacatcttgcaactgcccatgccctgggcagccagtttctcttccgcgaccagcgaccaggcgtggtagatcccgcccaggctggcggcgagcatgcccagcgcggcgatgccgccggcgatccgcgaacgcggggcgaggctgccgacgatcccggcgagcaccaggccgagcacgtccaggcgaatgaagatgcacagcgagcagggcgcgaagccgcgcacgtgctggaggtagaggacgaaagcgaggatcagcaggccgccgatggcgaccgcgggccagaacaagcggttgtcgaggggcttgaggagagcgctcaaggcagggattcctgtgtcgttgataagggaggccgggccggcactgtgcggcgctggccgatggtagtccatcaggattgtccgaagattaagccgtttgacgtaacgatgtctgctgcatgtttctccgctttcgtaggagctttcagggaaaaacgccgcaacgaggcgagcatttggagcctccgccgggatagactatcctggtctataccaataaggcccgtcatgctagccaccagcctggtgctatgcgccgccgttctccacgccacctggaacaccctggtcaagttcagcagcgaccgcttgctggtggtcgcctgcatggacgtggtcggcgtgctctgcgccatcctgctgttgcccttcgtcagcctgccgccggccgaagtctggccctggctgctcggcgccaccgtcctgcaactgctctaccgggtactgttgatcgaggcctacaaggtcggcgacctgggcctggtctatccgctgatgcgcgggctgtcgccgctggtggtgctgggcctgaccctggcgttcggcggcgagcagctcagcggccggcagatcctcggcatcctgttgatccccttcggcatgctttgcctgctctggggcggcggcggttcgcggctgccctggcggaccctgccggtggtgctgctgatcggcctgtgcatcggcggctacacctggagcgacggcaacgccttgaagcgctggccgttggcgcttgactacctggtctggctgacgctgctttccggcctgccgttcccgctgatcgccgttggcgcgcgaacccgcgccttcgcccgcttctgggcgctggagtggaagctcggcctggcggtcggggtctgcgtgttggccagctacggcctggtgctgtgggccatgcagctggggtcgatcgccgaagcggcagcgttgcgcgagaccagcgtgctgctggcggtgctgttcggcatgcgcttcctcaacgagccgttcggactgccacgcctgctggcgtgcggcctggtgctggccggaatgctgctgatgaagctctga

SEQ ID NO: 3304 - DNA, 417 bp, Pseudomonas aeruginosa
gttgcagttccacaactacaaggaactgccatgaccatcgctttctggtgcgtgctgatcgcgatcttcctgccttacgtctgtacctccatcgccaagttcggcggggagggctacggcggtcgggccaacgccgacccgcgggcgttcctcggttcgctcgaaggctttcgccggcgtgccaacaacgcccagttgaacgctttcgaagtgaccccggcgttcgccgcggcggtgatcatcgcccatctggtcggcaacgcttcgcaggcgaccctggatagcctggccattgcctggatcaccagtcgcctgctctacgtcatctgctacctcgccgactgggggccgttgcgctcgctggtctggttcgtcggcatgctgctcatcgccgcgttcttcgtggtttccgcctga

SEQ ID NO: 3305 - DNA, 1122 bp, Pseudomonas aeruginosa
caaaggcgcaagtgtgccagcaaacggcacggttgtggttgtccgggagcaaagtacgccgccccggggtctctggagaagggccatggttcgggcattccggcacaacccggcctaacgttgtccgaagacaccgagaacgggagaaccgcgatgcgtacgctgatccgcctggttcgcacgcttatcctgctgctggtcctggcgctgctcgccggcgcctggtggtggttgcaggacgaggccctgcgcccccccgcgctggccggccacagcgaggactcgagtctgaaggtcgcgggcctgcgccggcattacctgctctacgtgccgccgggcgtgtccgagggagcgccgttgctggtggtgctgcacggctcacggggcgacggcgcgcagatgcgccgcatcagcggctacggcttcgaccggctggcggcgcaagaaggtttcctggtggcctacccggacggcttcgagggccactggaacgattgccgcaaggccgccagctattcggcgcggctgcgtgacgtcgatgacgtggctttcctccgcgcgctggtggcgcggctggcccaggaataccgcgtcgattcgcagcgggtatatgtcgccggctactccaatggcggccagatggctttccgcctggccgccgaagcgccggggttgccggcggcgatcgcagcggtggcggcgagcctgccgaccacggggaacgatgcctgtcggccggtcgagcggccgaccgcggcgttgctgatcaacggcacgcgcgatccgatcaatccctatctcggcggcaaggtcagcctgttcggcttcggcgaccggggcgcggtacgctcgaccctggactcggcacgctggtgggccggcctgaacggcatcgcagcgccgccggacgtggcgccgctgacccgtcccggcccggtctggaccgagcgacagcgctggcaggaagacggccatccgccggtggagctgctcagcgtgcatggcggcggccacgtgctggcgcagccggactatcgcttcccgcggattctcggcaagagcgacccggaactggacgcgccagtggaaatctggcgcttcttcagccagttgccgcgctga

SEQ ID NO: 3306 - DNA, 1374 bp, Pseudomonas aeruginosa
gggacaattaagactggacgcgcagggttcattccagcgattcgcgcgttctgtctgggagtggtgccaatgaaactgttatggggagttctcgccgccgcgctggcggcctggggcctgacgctggccgtcgatccgccggcgagcctggacatctgggtggtgcgcaagcaggcgatcctgcttaccggggtagcgtccttcgccctgatgtcgttgatcatgctgctggcggtgcgtccggtctggctggagaagccgctggacgggctcgaccgcatgtaccgcctgcacaagtgggcgggcatcctgaccatcgtcctcggcctgttgcactacctgctggagttggccggcccctggctggcgggtatcgtcggcaaaccggtgaaaggcccgcgggtggaaaccttcctcgatgtcttccgtggctcggccaaggagttgggtgaatggtcggcgtggattctcggcgggatgctgctggtcactctctggcagcgcttcccgtatcacctctggcgttatgtgcacaaggcgttggccctggtctacctggtactggccttccattccgtggtgctcgccccggccagctactggagccagccggccggttggctggtggcggcctgcgcactgctcggttcggcctgcgcactgttgtctctgagcgggcggatcggtcgcacgcgtcgccatgcgggcgtggtcaccgccgtcgagcggcacggcgaaagcctgctcgaggtgacctgccggctgcagggcgactggtcgcacagggccgggcagttcgcctttctcacctgcgaccgcctggagggtgcccatccgttcaccatcgccagcgccgaccgcggctgcggcgaggtgcgcttcagcatcaaggcgttgggcgactacacccggcgcctgcaggacaacctggaggtcggcgccagggtcgaggtggaggggccatacggctgcttcgacttccgccgtggcctggccgggcggcaggtctgggtcgccgccgggatcggcgtgacgccgttcatcgcctggctggagtcgctgcaggccgcgccggaaagcgcgccatcggtggagctgcactattgcgtgcgcaattcccaggaagcgctgttcgccgggcgcttgcgcgagctttgcgaacacctgcccagcgtgaccctgcacatccgctatagcgacgagcagggcaagccgcaggcggcgcaactgggcgtgctgaagagcgccgaaggacgctggccgagcgtctggttctgcggtccgcaggggctggccgacagcctgcgccgcgatctgcgccggcagggcatgccgctgcggctgttccaccaggaagccttccgcatgcgctga

SEQ ID NO: 3307 - DNA, 330 bp, Pseudomonas aeruginosa
gccctgcggcgtcggcccactgggccaggtcctcctgttcgaaacccaaccagaggtcgccgcaggcctccctggcccagccctggttgtgccggcacaagtccgtcaccagcaggctgccgcccggatggaccaggcgggccaactgtttcagcgcctccgccggcgcggcgaagtggtgcaggaccatgttcagcaccacgcaatcggccggttcggcggcgtcctgcagggcatcggccaattccaggcggacgttgcccaatccttcttccttgcagcgctggcgcgccagttccagcatcgccgcgctgttgtccagcgccgtga

SEQ ID NO: 3308 - DNA, 2007 bp, Pseudomonas aeruginosa
gaccatcgccagccgcaaggccagccagaacgcgctgaacgccttcggcccgctgctgccggagctgctcggcggttccgccgacctggccggctccaacctgaccttgtggaagggctgcaagggcgtcagcgccgacgacgccgccggcaactacgtgttctacggcgtgcgcgaattcggcatgagcgcgatcatgaatggcgtcgccctgcacggcggtttcattccctacggtgcgaccttcctgatcttcatggaatacgcgcgcaacgccgtgcgcatgtccgcactgatgaagcagcgcgtgctctacgtgttcacccacgactccatcggcctcggcgaggacggcccgacccaccagccgatcgaacaactggccagcctgcgcctgaccccgaacctggacacctggcgcccggccgacgcggtcgagtcggcggtggcctggaagcatgccatcgagcgtaccgacggtccgtccgcgctgatcttctcccgccagaacctgccgcaccaggcgcgcgacgtcgcccaggtggccgacatcgcccgcggcggctacgtgctgaaggactgcgaaggcgagccggaactgatcctgatcgccaccggttcggaagtcggcctggccgtgcaggcctacgacaagctcagcgagcagggccgcaaggtccgcgtggtatcgatgccatgcaccagcgtctacgagcagcaggacgagtcctacaagcagtccgtgctgccggtggaagtcggcgcgcgcatcgccatcgaggccgcccatgccgactactggtacaagtacgtcggtctcgacgggcgcatcatcggcatgaccagcttcggcgagtcggcgccggccccggcgctgttcgagcacttcggcttcaccctggacaacgtcctggcggtagccgaggagctgctggaagactgatgcacacgctctactggcgggacctcgaaagccccgccaatggcgaatggctgggcctcgcggtccaggtggagggcgcccatcgggcgccctctttccttcatctgcaatccggcggccaggcccgcattcgcctgatgcgtggcgatcagccgctgctctgggccacccagttgccgtaccacgatggcatctggctggtgaagagcctggtcgcggcgagcccggcgcaggccagcgtgccgcccatcgactcgccgaccctggaagcgttgcgcggcctgcgcggcgaggcccgctacaaggcctggagccgctatttcgtcgagaccctgcgtaccagcccgggcagttgcctggaggccgggcgctggttgctgcgcctgtcgctcgccgagcaggtgcccgcctggcagccaccgcagagccacgatccgcgcgaacgggtgctggaacgctggcgctaccgcagcgtcgggcgcgacgcactgttgccggactggcgcttctacagcctggagaaggtcctcggcgacgactgggtgcagtggctcgactggtgggggcgcgacaacgacgccctgatcgccctgcgccgggtcgaggatgacgaggggcgggtcaagtggtggcgcaagaaggcccgcgaaggcgagctgccgccggtgctggcgctgcgcctgaactgcctggatgcctgcgtgatcctcgatggccactgccggctgcgcgccggcctgctggagaacgtcgcgccggagatcctggtgctctgtgcctacgacgagcagccgatgccggtggatacggcgcagcgcgaacgggtgctgcaatcgctggcgcagcgggtcgacgcgccggtgcgccgtggacgccggccgctggatagcgaacagctcaaccaggtgctgctgcgcctgttcgacgaccgtccctggccgcgagtgctgacccgtgcccgcgcggtgctgaaggaagaacagtggtgcgcggaagtgcgcgactggctggccgcccgcgagcgtctggacgcgctggagccgatcatccgtcgcgtcgagtag

SEQ ID NO: 3309 - DNA, 471 bp, Pseudomonas aeruginosa
cgagctggcgcagaagtacgccgcgctgtgcgacgtgttcgtgatggatgccttcggtaccgcccaccgcgccgaggggtcgacccacggcgtggccaggttcgccaaggtcgccgccgccggcccgctgctggccgccgaactggacgcgctgggcaaggcgctgggcaacccggcgcggccgatggcggcgatcgtcgccggctccaaggtttccaccaagctcgacgtgctgaacagcctggccggcatctgcgaccaactgatcgtcggcggcggcatcgccaacaccttcctcgccgcggccggacacaaggtcggcaagtcactgtacgaggccgacctggtcgagaccgccaaggccatcgccgccaaggtcaaggtgccgctgccggtggacgtggtggtggccaaggaattcgccgagagcgccgtggcgaccgtcaaggccatcgccgaggtcgccgatga

SEQ ID NO: 3310 - DNA, 1095 bp, Pseudomonas aeruginosa
acgaccccgcgattgggagatacgagaaccatggcactcatcagcatgcgccagatgctggatcacgccgccgaattcggctacggcgtgccggccttcaacgtcaacaacctcgagcagatgcgcgccatcatggaagcggccgacaagaccgattcgcccgtgatcgtccaggcttccgccggtgctcgcaaatacgccggcgcgcccttcctgcgccacctgatcctcgccgcgatcgaagaattcccgcacatcccggtggtcatgcaccaggatcacggcaccagtcccgacgtctgccagcgttccatccagctgggcttcagctcggtgatgatggacggctccctgcgtgaagacggcaagacccctgccgactacgactacaacgtccgcgtgacccagcagaccgtggcgttcgcccatgcctgcggcgtgtccgtggaaggcgagctgggctgcctgggttccctggaaaccggcatggccggcgaggaagacggcgtcggcgcggaaggcgtgctggaccacagccagttgctgaccgatccggaagaagccgccgacttcgtgaagaagaccaaggtcgacgccctggccatcgccatcggcaccagccacggcgcctacaagttcaccaagccgccgaccggggacaccctgtcgatccagcgcatcaaggaaatccacgcgcgcatcccggacacccacctggtgatgcacggctcttcctcggtaccgcaggactggctggcgatcatcaacgagtacggcggcgagatcaaagagacctacggcgtgccggtcgaggaaatcgtcgagggcatcaagtacggcgtgcgcaaggtgaacatcgacaccgacctgcgcctggcctccaccggtgccatccgccgcttcctggcgcagaacccgagcgagttcgacccgcgcaagtacttctccaagaccgtcgaggccatgcgcgacatctgcatcgctcgctacgaagccttcggcaccgccggcaacgcttccaagatcaagccgatctccctggaaggcatgttccagcgctacgctcgcggcgagctggatccgaaggtcaactaa

SEQ ID NO: 3311 - DNA, 1758 bp, Pseudomonas aeruginosa
cgagtcgctggattgggtcgccgagatcactcgcatcatcaccccctacgaaggcgacgcgccgcgcttctacaagggcgactggcgtcggccgttcgagcgcgcgcccttcggaccgctgcgcttgtccaccttcgcctacgagcatgtcggcccgccggagcaggtgatcgtctcgcgcttcctttcggtgagcttcatcgccgccttgccggagacggaaaagaacgccgtggcggcgcaattgcgcgagctggtcgccagccatccggcgctcaaggggagggagcaggtagcgctgccctatcgcaccgaggcctatctggccgaggcgcgctaggcgtactgccccgccgcataacccgaggcccaggcccactggaagttgaagccgccgaggtggccgctgacgtccagtacttcgccgacgaaatacagccccggcgagcgctgcgactccatggtcttcgacgacacttcgtcggtgctcaccccgcccagggtcacttccgcggtgcggtagccctcggtgcccgagggcgtgacccgccaggccgaaagctgcccggcgatacccgccagttcggtcggggtgtactgcttcatcggcttggagacgaaccagcggtcggccagcagtccggcgagcttcttggtgagcagctcggcgagcagggtcttcagctcgctgttgggacgctcgcgctgttgctgcgccagccattcgctggcgtcgtggtccggcagcaggtcgatttccagggtatcgcccggttgccagtaggaggaaatctgcaacatcgccgggccgctgaggccgcgatgggtgaacagcaggttctcgcggaacacttggccgttgcagctcacccggcaatccacggaggtgccggaaagctcggcacacagctccttcaactggtcggtgatggtgaacggcaccagcccggcgcgggtcggcagcacctcgtggccgaactggcgcgccacctggtagccgaaaccgctggcgccgagggtcgggatcgacaggccgccgctggcgatcaccagcgactcgcagcgcatctcgccggcgctggtacgcaggtggtagccggcgtcgtcgcgggcgatctcttcgatcgaggtgtccagcaggatttccgctccggcctcggcgcattcgcgcagcagcatctcgaggatgtcgctggacttgttgtcgcagaacagctggccgagtttcttctcgtggtacggcacctggtgcttggccaccaggccgatgaagtcccactgggtgtagcgggccagcgccgacttgcagaagtgcggattgcgcgaaaggaagttggccggctcggtgtacaggttggtgaaattgcagcgcccgccgccggacatgaggatcttcttgccggccttgttggcgtggtcgagcacccgcacgcggcgcccgcgtccggccgccgtcatcgcacacatcagcccggccgccccggcgccaacgatcagcacatctgtacttgccactgtcccactccgctcatcggaaacggcgcgcatcttacccgaagcggcggtcggccgccggagctcccgacgcggtacactgggcgttttccgcgaaccgccggacccgtgcatgatccccctcaagtacctccaggcctatcccgcatcgctgcaggaccaggtccgccagctgatcgccgagaaccgcctgggcgagtacctcgagcgccgctacccggggcgtcacgatgtgcagagtga

SEQ ID NO: 3312 - DNA, 405 bp, Pseudomonas aeruginosa
atgccggcgccgcctatgtctattcgctgcgcgcgctggaagcctacgaccagttcaaaaagtgaggccgtacaggcgctgcaggtagaacagcaaccccagccaggccaccagggccagccagcccagccccagcaggcccttgcgcagcagcgtcgagggcctgccgtggagcaggtcgaccaggctaagcacgccgccgagcagcagcaggccgagcagcgcctgggtgtactgggcgaaactcggcgacaacgcctcgtcgccgtgggcggcatagttgtacaggttccaggcgcagatcagcgtcgccggcagcagcgccagcagcgcgccgagccagcgcccgcggacatgcaggaggaagcccgcgagcaggccgaccagcccggtacccagcggtag

SEQ ID NO: 3313 - DNA, 1452 bp, Pseudomonas aeruginosa
agcagcaggcccggctcgacgaggcggccgccgtgctgctccagagcggcgacgaaggcagccggcagcggtcgtccgagccaggcctctagggcatccaattcaggcttcatcgggctcgtccagggcgaacaatgcatggtggcgggcatgggccagcaggcgttcgcccagcgcgtcggccagggcgtagaagcgcgtgtccagcgcatccagggccgcttcgcagtcgcggtcgggttcatcggcccaggtcggcatgcgcaattggcgttcggcctgggagactggcaccggaccgtcgccgaacagcagggcggcggctcgctccagcagggccagggcgtcctccgcctccaattcgcgaagacccgcgcgcgccgcctggtactggtcgccggaggagttgccgaagtactggtcgaagccgccgttgtgcacttcgccgctgagcacgctcactgcgtagtagctccgttcggccggcgacagcccggcgaatccctcgcggccatcgtagacgcgattcaccagcgcgctccagtacagcgcctgcggactcgccaggtagcgccgtcgctccgcgtggaagcgcttgccatcctcgatgttctgccggtagccgcccttgcagggcatgcacagtccgtcgttcctcgccgccgtggttggaaggatgagatggccgcaggcgcggcagggaaggcggtcggtcatgagcggtccttgctggtggaaggggctcattattgcgcaggatcgttcagcttgaacgacagtttggcttgccagcctggcacggcattgcccgctggcatggccgaccctctctcccttcggggagaggggcatgaggaccggcgcggagcgagaagcatcaccccgcgccagccccctcagctacgactcacggaaacggccacgccggcgacccctggctcatgtccagaagcttcaccgtgctgtattcgttggtccggttgttggcatagaagaacgccggctgctcggcgaaaccgtaggccgccacctgcgcctgggccgctgccgaggtacggatgccccatagcgcgaaggttggccgctggtcgcgctgggtcagccaggacaggccgagcaacaggttgtcgttgccgtccgtgctgctggcatcgccgctgtttcccgggcgctgggcgtaggtgccgtagccgagggcagccttgttggcgtcccagtcggacttgtccacctggcgctggtgcaggtagagcagggtccagatgtcccaaccctgcagcggatcgttcttcaggtcggcccagtagtgcacccactgggtatagaaggccatccgctcgccgttcagcgcgtaggtgcccgggtcttcccacaggcgcttgtatacgcctgccagcggatcggcctcggcgcgtccggcgacgatcaggttgtaggcgttgcggtagttga

SEQ ID NO: 3314 - DNA, 576 bp, Pseudomonas aeruginosa
  unsure (501),(502),(503),(505),(506),(507),(512),(514),(515),(519): Identity of nucleotide at the above locations are unknown.
aaagaatgggaatgcagagaaccgaccgaaccacaaaccaagaaagagctcgaccacaatgcacaaggagaaacagcggaaacgaaggcgaagaccgaagcaacaaaggcagagagcacgagagagacaaccaaaacaagggaaacaaggacaagacgacaggcgcaggaagcaaccagagaaccggcagaaaggcacagggagccggaaaagagagcagacgaagagacagaagagaggagaaaggacaaacaaccgggagaaggccaaacaaagagggaaaaggacaaaaagacacacaacaaggcaaaggagagaggaacagcaagaagacaagaagaacaacgacagacagacaaagagaggaagagacaagaaggacaaaaaggcggaaacgaaaaaacagggaggaagaagagacagtggggcaacgggaagaaaaaagacagaaaggggccagaacagacaccaaacgagaagaaaaaaaaagagagagcccgnnngnnnaagcnannacanatccccacccgactctgggggcctatagctcagtcggttagagcagaggactcataa

SEQ ID NO: 3315 - DNA, 2532 bp, Pseudomonas aeruginosa
caggcaatgagtgcgcaagccgcctccattgattcgttgctttcgatattgttgctggcagaccatcgagtcttggagctgtcgtggagcaccccctttaacgagcctctggaatggtccaattggcgggagcctgtgtaccttgcctatcagccttgggcagcccgctatcccgatcacgtgttctcgtcggcctggcgttttttaagtgaacgtcaacctgctcatggggcgctgctcaccgcactgtctgcgcttgccattgagtttgtcgagcttcggcatggcgtaacacgtattcggcgtgacttgttcggagcctggcagcaggggctcgccagtcggctttcaaccctacctatccaagctgccgcaaaggtaagtctcggttcacctctgctaagcctgactcctacgtcctttactgaagaagagtcatctaataaaaggactgcggcatggcgaagacaagtcgtgccattgctgcaccctgaggaggctccagtagctgactacattacgcgtgagggcttgcatgaatcgcacctacatctaaatggcagtacccattccgagatttgctggctgcgcgctctacgaaacatacgggctgaaactcgggaattcgtaacaacctggaaacacgagaaaggcgtactctctgttcgtgatttaatcggccagataaacccaagattgactccacaggtatttcatcagcacctgctggccgcgagccgacttcgcacatggttggttggcgccgccactggccagattggggctggcgctcagctacccttttcatgtgaaagtatgtgcgctgccggtgaagatgattggtctgaaggactggctctgccaatgccgtcatggcgtagtgagcccgacatccaagacgagctttcctggatggaagctctcatcggccagctcatgcaacaacccagcacgcagatcagccgaatgttccatacctacttgctgctgctaaaccagtatttccgattgctcgtacaaagcgagacccagtacggattcgatcagtttcagaaactcacactgacaaagcttcgtgacccgtcagagcgagactttcgaacacgctttaattctatgcatgggctcaactcgaccataagcacaatcgggtacctagaaggtcgcttttcgcctaaagtagatctgcgaaaagctgaacacctttaccaagcagttctgggcggttaccacggctatctacgcgacaccactggcgccagtgaattgtccagcaccacacctagatccctctcacgcttactgacagagttggattctttttttgcaaggcaggctttaccacatcgcaggattcatcgtttgacacttgtcgcgcatttcatcaagcgtgactggtctcccaaagcaaatggcaaggccggcccctttagacattatccgcttgatgtagacctacgccataccgttaacgtactgcttttatcactagaccgctggccccggcttcgtacctgggtaaggggtatcgacgctgctgctaacgagcttcacgcaccaccagatgttttcgcgccggccttccgcgtttgttatcgggctggccttagtagacgcagctaccacgcaggcgaagactttcgtcacctgctatctggcattgcaaccatgtgggaggcgctagaatttctacagcttcgcgacggtgatcgtatcggtcatggtacagcgatgggtattcgcccaagcctctggctggatcgcatgccgagaaaaatatctctaccgagaggtgaatggttccaaggggtgctagctgcatggcagctgctccgcgatgagcctgagatgcagggatgcgctaaccgcctacagcgtgagctggagggcgtagcgcatgagatttttgggcgcacgctatctgctttggacattgagcgcgccatggcactacgcggtttgagtcgccttgacgtaatgcgacagctcaccagttgcggggcattccaccacgaaactttaaacgacctgtggcgagaagaaacggagcaggtcaaagtcgcatatcataaccagcggtcggcactcgaactgctatgggaatggcttagccatgaggcagtactcatccgagctcatgagttggttgcaaaggaagcacaattcttggcgccgacagactacctccgattgcaacaagctctcatgtgtcaggttgctagccggggcgtactgatcgaaaccttgccatctagcaatgttcggattagtcagtaccatcacataggcgaacaccattcattgcgctggatgcgggttccgggttttgtcgagcatggcgacccagaaatcatggtttgcctaggctcggacgatccgggcatcttcgctaacgacttagagacagagttttatctgatgtacgccacactccgacaagcgggcctgagtgactctgacgcactcaatcgactgagcacactgaacgaacgaggccgaacctatcgtttccaccatccgctcctgtcgtaa

SEQ ID NO: 3316 - DNA, 234 bp, Pseudomonas aeruginosa
gcgtgggaaggcacttatcaggcacttccgaaggcactaccggacgatatcgattccatcgccaacgcggtaacttcgaagtacttaaaccttcatgaaactgcaacttccaactcgatcgacagctctggaaatacatcctcggtattttccaagaccctaaccaaagtctggatcgtttcgtcacaggaaacgctggagcgcctattccagagcgcttcgaacaatcggtaa

SEQ ID NO: 3317 - DNA, 2808 bp, Pseudomonas aeruginosa
caatatgccgccctccacgggccgatagcgccagttgtgagcctgtccaccactgcatttccctcactgcaaggagagaacatgagtcgctcacccatccctcgccaccgagcgttgctggtcggtttctgcctggctggcgcgctgtccgcccaggctgccacccaggaagaaatcctcgatgcggcactggtcagcggggattcctcgcaactgaccgacagccacctggtcgccctgcgcctgcagcagcaggtcgagcgcatccgccagacccgcacccagttgctcgacggtctctaccagaacctcagccaagcctatgatcctggcgccgccagcatgtgggtcctgccggccaacccggacaataccctgcccttcctcatcggcgacaaggggcgcgtgctcgccagcctgagcctggaggccggcggccgcgggctggcctatggcaccaacgtgctcacccagttgagcgggaccaatgccgcccacgcgccgttgctgaagcgggcggtgcagtggctggtgaacggcgacccgggcgcggccactgcgaaggacttcaaggtcagcgtggtcggggtggacaagaccgccgccctcaacggcctgaagagcgccggcctgcaaccggcggacgccgcctgcaacgcgctgaccgacgccagttgcgccagcaccagcaaattgctggtactgggcaacggcgccagcgccgctagcctgagcgccacggtgcgcgcacggctacaggccgggctgccgatcctcttcgtgcacaccaatggctggaaccagagcagcaccggccagcagatcctcgccggcctgggcctgcaggaaggcccctacggcggtaactactgggacaaggacagggtgccatccagccgcacccggacgcgttcggtcgagctgggcggcgcctatggccaggacccggcgctggtgcagcagatcgtcgacggtagctggcgcacggactacgactggtcgaaatgcacctcctacgtcggtcgcaccacctgcgacgacgtgccgggactgagcgacttcagcaagcgcgtcgatgtattgaaaggcgccctcgacgcctacaaccagaaggcgcagaacctcttcgccctgcccggcaccacctcgctgcggctctggctgctgtgggccgacgcggtgcggcagaacatccgctacccgatggacaaggccgccgacacggcgcgcttccaggaaaccttcgtcgccgacgccatcgtcggctacgtgcgcgaagccggcgcggcgcagaaggaactgggcagctacgccggccagcgccaacagtcgatgccggtatcgggctcggaggaaaccctgaccctcaccttgccgtcggcccagggcttcaccgccatcggccgcatggcggcgccgggcaagcgcctgagcatccgcatcgaagacgctggccaggccagcctggcggtcggcctgaacacccagcgcatcggctcgacgcggctgtggaatacccgccagtatgaccgtccgcgcttcctcaagagcccggacatcaagctccaggcaaaccagtcggtggcgctggtatcgccctacggcggcctgttgcaactggtctacagcggcgccacgccgggtcagacggtaaccgtcaaggtaaccggcgcggccagccagccgttcctcgacatccagccgggcgaggacagcagccaggcgattgccgacttcatccaggcgctggacgccgacaaggccgactggctggagatccgcagcggctcggtggaggtccacgccaaggtggagaaggtccgtggctcgatcgacaaggactatggcggcgacgtccagcgcttcatccgtgagttgaacgaggtgttcatcgacgacgcctacaccctggccggcttcgccattcccaaccaggcgaagactccggcaatccagcaggaatgcgcggcgcgcggctgggactgcgacagcgagaccctgcacaagctgcccggcacccagcacatcaacgtcgaccagtacgcccagtgcggcggcggttgcagcggcaacccctacgaccagacctggggcctgaacccgcgtggctggggcgaaagccatgagctgggccacaacctgcaagtgaatcgactgaaggtttacggcgggcgctcgggcgagatctccaaccagatattcccgttgcacaaggactggcgcgtgctccgcgagttcgggcagaacctcgacgatacgcgggtcaactaccgcaacgcctacaacctgatcgtcgccggacgcgccgaggccgatccgctggcaggcgtatacaagcgcctgtgggaagacccgggcacctacgcgctgaacggcgagcggatggccttctatacccagtgggtgcactactgggccgacctgaagaacgatccgctgcagggttgggacatctggaccctgctctacctgcaccagcgccaggtggacaagtccgactgggacgccaacaaggctgccctcggctacggcacctacgcccagcgcccgggaaacagcggcgatgccagcagcacggacggcaacgacaacctgttgctcggcctgtcctggctgacccagcgcgaccagcggccaaccttcgcgctatggggcatccgtacctcggcagcggcccaggcgcaggtggcggcctacggtttcgccgagcagccggcgttcttctatgccaacaaccggaccaacgaatacagcacggtgaagcttctggacatgagccaggggtcgccggcgtggccgtttccgtga

SEQ ID NO: 3318 - DNA, 558 bp, Pseudomonas aeruginosa
cgccggactgcttcgaacccctggcacccagcctggaggcctggctggaagccgggccctgcctgcccgaatgacggagaaacgcccatgattcctttcggcctcagccccgaaaaattccgcgagcgctaccgccgcgacctgcaacgcgccgcgccgggcgtgatccagcgcctgcgcgagctgctccggcaacccttggaggaaggactgcgcgacggcgagatccaactgttcctcggcgaggacggacgcgacgcagcggaagcgtggttgtacctgaatggcgccaacaaccgggtcgacgccagcgacccgcgcctgtttcccggcaaggcgctggacctggcgctcggcctgggacatgccccggatttcgacgaagcctacttcgccgacggcttcggcggcgtcgacctgctcgccgatacgctgcaagcctggttcgccgagtgctggtggaaggccggcggctgggcctggccgatcccgctgtggctgcacgtacacgatggcttcggcgacggccgtggcatcgccctcaccgaacgctgctga

SEQ ID NO: 3319 - DNA, 474 bp, Pseudomonas aeruginosa
acagggagaccacgcatggaactgatccgcaacctggacgatgcgaacatgggcgaagtgtattggcgcctgtaccggcgctacatcagcctgttcatcgagaacgaggccgacgacgcctacgcctggcgctgcgcccgagccctcgacgaactggatgacgccgtgatcgagcggctttgtgccgccagcctgcgctaccgcgccgcgcgcctggggcggctgggcgagtctgcggaggaagtcgcgccggcgcgcggggtgctggaacggatcgagccgggcgagctgatcgtgcccgacccggaacagggcgacgaagcggtgatccacctgtcgctgaactgcgaatgggaccgcgaacacggtatggaatggatcgtccggggcggcgaggtgctctacgtcggccccttccacggcgaagacccgtggcgggacttcaccgtgaaggaaccatggaactacgcctga

SEQ ID NO: 3320 - DNA, 1020 bp, Pseudomonas aeruginosa
ccggggttagaatgcctcgctcccactccggcgccctgcgccaacgcccgcagcgaggtagcccatgccccaccccatcgacgcactgatttccgactgcgacggcgtcctggtcgacagcgaggtcattgccgagcgcgtgatgtacgaggcgctcagcgcctacgcgccgctggaggagctgcagcgcctgctggaaggcaccttcggcctgaccagccgcgacatcctcgatcgcgtcgagaagcacttcggcctgcgcatccccgacagcttcaaccgcgaggtgcgccagcgcagcgaggagatggtcgcccaggtccaacccattcccggcgcacgcgaggcgctgctggccctggacctgcctgtcgcggtggcctccaacagccgccgccacagcctggagcgctcgctggcgcgcgccgggctcagcgaactgatcggcgaacgcctggccagcgccgatatggtcgccctgcccaagcccgcacccgacgtctacctgcacgccgccagcctgctcggcgtcgcccccgagcgttgcctggtggtggaagacagcagcaccggcacccgcgccgccctcgccgcggggatgcgggtgatcggcttcgtcggcgccgggcacattcccgccgggcacgccgaggtactgcgcgagctgggcgccatcgccatcgtcgagcacatgcgcgaactgccggagaccgtggcgcgcctgcgccggacagtctgagtcagggctgcccgcagagggttgcgaacaaggctcccgttcccgtcagcacgaagaaggtccagtggaagggcacggcaagattcaagcgctggatcgccgcgactatccagcaaacgccccccagaacagccaagagaatccgcatcagcgcctctcccaacgttctcgccgaggaaaagactcggagcaggcaatgcaaaagcgtgcaaagaagcagcacaagcagggcaacgagccacagcacaagcttgccgatggcgcttctccactcctcgtag

SEQ ID NO: 3321 - DNA, 573 bp, Pseudomonas aeruginosa
cagccgctagagactcttccaggtcaggtacacccgcaggtcgaactccagctggtgatagtccggcagcatgtactggcagagctggtagaacgccttgttgtgctcgctttccttcaggtgggcgagttcgtggacgacgatcatccgcaggaactccggggcggcgtccttgaacagggaagccacgcggatttccttcttcgccttgagcttgccgccctgcacccgcgagatcgcggtgtgcaggccgagggcacgctggaccacgtcgagcttgttgtcgtagagcaccttgtccaggcccggcgcgttgcgcaggtgttcctgcttgaggttcatggtgtaggcgtacagcgccttgtcactctgcacatcgtgacgccccgggtagcggcgctcgaggtactcgcccaggcggttctcggcgatcagctggcggacctggtcctgcagcgatgcgggataggcctggaggtacttgagggggatcatgcacgggtccggcggttcgcggaaaacgcccagtgtaccgcgtcgggagctccggcggccgaccgccgcttcgggtaa

SEQ ID NO: 3322 - DNA, 1995 bp, Pseudomonas aeruginosa
gcggagtgggacagtggcaagtacagatgtgctgatcgttggcgccggggcggccgggctgatgtgtgcgatgacggcggccggacgcgggcgccgcgtgcgggtgctcgaccacgccaacaaggccggcaagaagatcctcatgtccggcggcgggcgctgcaatttcaccaacctgtacaccgagccggccaacttcctttcgcgcaatccgcacttctgcaagtcggcgctggcccgctacacccagtgggacttcatcggcctggtggccaagcaccaggtgccgtaccacgagaagaaactcggccagctgttctgcgacaacaagtccagcgacatcctcgagatgctgctgcgcgaatgcgccgaggccggagcggaaatcctgctggacacctcgatcgaagagatcgcccgcgacgacgccggctaccacctgcgtaccagcgccggcgagatgcgctgcgagtcgctggtgatcgccagcggcggcctgtcgatcccgaccctcggcgccagcggtttcggctaccaggtggcgcgccagttcggccacgaggtgctgccgacccgcgccgggctggtgccgttcaccatcaccgaccagttgaaggagctgtgtgccgagctttccggcacctccgtggattgccgggtgagctgcaacggccaagtgttccgcgagaacctgctgttcacccatcgcggcctcagcggcccggcgatgttgcagatttcctcctactggcaaccgggcgataccctggaaatcgacctgctgccggaccacgacgccagcgaatggctggcgcagcaacagcgcgagcgtcccaacagcgagctgaagaccctgctcgccgagctgctcaccaagaagctcgccggactgctggccgaccgctggttcgtctccaagccgatgaagcagtacaccccgaccgaactggcgggtatcgccgggcagctttcggcctggcgggtcacgccctcgggcaccgagggctaccgcaccgcggaagtgaccctgggcggggtgagcaccgacgaagtgtcgtcgaagaccatggagtcgcagcgctcgccggggctgtatttcgtcggcgaagtactggacgtcagcggccacctcggcggcttcaacttccagtgggcctgggcctcgggttatgcggcggggcagtacgcctagcgcgcctcggccagataggcctcggtgcgatagggcagcgctacctgctccctccccttgagcgccggatggctggcgaccagctcgcgcaattgcgccgccacggcgttcttttccgtctccggcaaggcggcgatgaagctcaccgaaaggaagcgcgagacgatcacctgctccggcgggccgacatgctcgtaggcgaaggtggacaagcgcagcggtccgaagggcgcgcgctcgaacggccgacgccagtcgcccttgtagaagcgcggcgcgtcgccttcgtagggggtgatgatgcgagtgatctcggcgacccaatccagcgactcgtcacgcacgttccacaccagccccagcctgccttccgccgtcagcacgcggcgcatttcctccagcgcctccacggtggcgaaccaatggaaggcctgtgcgcacaccagggcgtcggcgaagccgttggccagcggaatcgactgggcgctaccggccagcgcctggacctgcggcaaggcttcggcaagctgggcgcgcatcgcatccaccggttccaccgcgaccactcgcgcgccggtacgggccagcaggcgggtgaacttgccggtgccggcgccgaggtccaccacgacggtctgcggacgcaggccaagggcatcgcgcaaccagtcggagagcgcttccgggtactcgggccggccctgggcgtaacgctgggcctcggcgctgaaaccttgctgggcggcgctgtgtacggacgacatgagggacctcctgggcggcagggaaagcccgaggtatag

SEQ ID NO: 3323 - DNA, 1371 bp, Pseudomonas aeruginosa
gtgccatggttctcgtatctcccaatcgcggggtcgttcagtgattcagaagcctgccgcaggggcaggcccggttcaagttccttgcgaggagcggtcgcggcgccgcgcccctgccggcgcgactcagcgcgccttgcaaccgcgaccgatgaggtcgtcggtttcgacccagtacaccaggccttcgtcgttctccaggtggaagcccaggcgtccgtcgctatagaaagcgccgacggccgcaggttcctgctccagatggtggaccacgtcgtcctcgtccttcaggcgcaggtcgacgatgttcttgctgccgtcgatatagcgccattcgatcaccgccttgctgtcgcaggtccagcgggtccagtccttgccgcccggcttgccggaggaagcggagcagccggccagcagcgccgcggcggcgaagccgccgaacagggcgatacgcgagtagttcatgtccatcctccatccgtgcggaacgctccgccgcacctcgccgggccgcaagcggcccgcgcggcggccggctggccttgcctgtcacaggaaaggcgcaatgctactgcgtacgctggcgaatccccagccctttccgtagaaactggcagaaaagcactacgggcattccaccggcttttgtccggcggtcggatcgccgctgctctgctgctcgacccgctggcggttctgctcggtcggcaccatcacgtccggcggactgatcacctcgcaggtgctcgggcgtcgaccgccatcgccgctacaggcggccaggcccaggcagaacatcaggagtggcaaggttacggaacgcatggggcacctccttttttcgtcgtcctcaaaggtgtgacccccgaggacggcgaatggtttgccccgtctgcgtcagcccttggcgcgctgctccaggatttccacggccggcaggaccttgccctcgacgaactcgaggaacgcgccgccaccggtggaaatataggagatccgctcggcgatgccgtacttgtcgatcgccgccagggtatcgccgccgccggcgatggagaacgccgcgctatcggcgatggcattggccagggtacgggtgccctcgccgaactggtcgaactcgaacaccccgaccggaccgttccacaggatggtcttcgaggtcttcagcagctcggcgaactgcgcggcggtctgcgggccgatgtcgaggatcatgtcgtcatcggcgacctcggcgatggccttgacggtcgccacggcgctctcggcgaattccttggccaccaccacgtccaccggcagcggcaccttgaccttggcggcgatggccttggcggtctcgaccaggtcggcctcgtacagtga

SEQ ID NO: 3324 - DNA, 720 bp, Pseudomonas aeruginosa
cttgccgaccttgtgtccggccgcggcgaggaaggtgttggcgatgccgccgccgacgatcagttggtcgcagatgccggccaggctgttcagcacgtcgagcttggtggaaaccttggagccggcgacgatcgccgccatcggccgcgccgggttgcccagcgccttgcccagcgcgtccagttcggcggccagcagcgggccggcggcggcgaccttggcgaacctggccacgccgtgggtcgacccctcggcgcggtgggcggtaccgaaggcatccatcacgaacacgtcgcacagcgcggcgtacttctgcgccagctcgtcagcgttcttcttctcgcccttgttgaagcgcacgttctcgaacagcaccaggtcgcccgccttgaccttgacgccgtcgaggtagtcggccagcagcggcacttcgcggcccagggccttggacaggtactcggccaccggcttcaggctgttctcggcggagaactcgccctcggtcggacggcccaggtgcgagcagaccatcaccgccgcgcccttctccagggccagcttgagggtcggcagggcggccttgatccgtgcatcgctctgcacctggccgtccttcacgggcacgttgaggtcctcgcggatcagcacgcgcttacctttgaggtcgaggtcagtcatcttcaacacggtcatgacaatcagtccttgggtacttgttga

SEQ ID NO: 3325 - DNA, 882 bp, Pseudomonas aeruginosa
aacgattcatgcgacacctggctggcgcgaccgcgttccgttgtgcaaggctcgcccgcatccaccgaccgccaggagcgccagatgccccgcttcgccgccaacctcagcatgctctacccccgccacgacttcctcgaacgcttcgccgccgccgcggcggacggcttcgagggcgtggagtacctgttcccctatgcctaccctgcggccgaactgaaggcccggctggacgaccacggcctgcgccagatgctgttcaatgccgcacccggcgactgggacaagggcgagcgcggcctggccagcctgccggggcgcgaggccgaattccgccgcgccatcgcccaggccatcgactatgcccaggtcctcggcaaccgccacatccatgtcatggccggactgctgccggccggcgccgaccgcatccgccaccgcgagacctacctcgacaacctcgcccatgccgcccgcgaagccgccggcgccgggctgacggtgctcatagagccgatcaacaaccgcgacatgccgggcttcttcctcacccgccaggacgacgcccaggccatctgccgcgaggtcggcgcggacaacctgcaggtacagttcgactgctaccactgccagatcgtcgagggcgacctggccaccaccctgcgtcgcgacatcggcaatatcggccacgtccagatcgccggggtacccgaccgccacgagccggatgacgacaacgaagtgaactacccctacctgttcgagctactcgaccggctcggctaccagggctggatcggctgcgagtaccgtccgcgcggcgacacctcggcaggcctggaatggctgcggcgctggcgcgctactcgacgcgacggatga

SEQ ID NO: 3326 - DNA, 2709 bp, Pseudomonas aeruginosa
cccgcccctcgtcatcctcgacccggcgcagggcgatcagggcgtcgttgtcgcgcccccaccagtcgagccactgcacccagtcgtcgccgaggaccttctccaggctgtagaagcgccagtccggcaacagtgcgtcgcgcccgacgctgcggtagcgccagcgttccagcacccgttcgcgcggatcgtggctctgcggtggctgccaggcgggcacctgctcggcgagcgacaggcgcagcaaccagcgcccggcctccaggcaactgcccgggctggtacgcagggtctcgacgaaatagcggctccaggccttgtagcgggcctcgccgcgcaggccgcgcaacgcttccagggtcggcgagtcgatgggcggcacgctggcctgcgccgggctcgccgcgaccaggctcttcaccagccagatgccatcgtggtacggcaactgggtggcccagagcagcggctgatcgccacgcatcaggcgaatgcgggcctggccgccggattgcagatgaaggaaagagggcgcccgatgggcgccctccacctggaccgcgaggcccagccattcgccattggcggggctttcgaggtcccgccagtagagcgtgtgcatcagtcttccagcagctcctcggctaccgccaggacgttgtccagggtgaagccgaagtgctcgaacagcgccggggccggcgccgactcgccgaagctggtcatgccgatgatgcgcccgtcgagaccgacgtacttgtaccagtagtcggcatgggcggcctcgatggcgatgcgcgcgccgacttccaccggcagcacggactgcttgtaggactcgtcctgctgctcgtagacgctggtgcatggcatcgataccacgcggaccttgcggccctgctcgctgagcttgtcgtaggcctgcacggccaggccgacttccgaaccggtggcgatcaggatcagttccggctcgccttcgcagtccttcagcacgtagccgccgcgggcgatgtcggccacctgggcgacgtcgcgcgcctggtgcggcaggttctggcgggagaagatcagcgcggacggaccgtcggtacgctcgatggcatgcttccaggccaccgccgactcgaccgcgtcggccgggcgccaggtgtccaggttcggggtcaggcgcaggctggccagttgttcgatcggctggtgggtcgggccgtcctcgccgaggccgatggagtcgtgggtgaacacgtagagcacgcgctgcttcatcagtgcggacatgcgcacggcgttgcgcgcgtattccatgaagatcaggaaggtcgcaccgtagggaatgaaaccgccgtgcagggcgacgccattcatgatcgcgctcatgccgaattcgcgcacgccgtagaacacgtagttgccggcggcgtcgtcggcgctgacgcccttgcagcccttccacaaggtcaggttggagccggccaggtcggcggaaccgccgagcagctccggcagcagcgggccgaaggcgttcagcgcgttctggctggccttgcggctggcgatggtctcacccttgttggcaacatcggcgacgtaggccgcggccttctcggcgaagtcggccggcagctcgcccttcaggcggcgcagcaattcggcggccagttccggatgggcagcctggtaggcggcgaaacgcttgttccactcggcttcctgggcggcgccggtttccttggcgtcccactcggcgtagatctgcgccgggatctcgaacggagcgtgctcccagcccagcgcggcgcgggtcgcggcgatctcgtcggcgcccagcggcgcgccgtggcactcttccttgccctgcttgttcggcgagccgaaaccgatcacggtcttgcagcagatcagggtcggctggtcgctcttgcgcgcggtatcgatggcggtcttgatttcgtcggcgtcatgcccgtcgacgttgcggatcacttgccagccataggcctcgaagcgcttcggggtgtcgtcggtgaaccagccgtggacctcgccgtcgatggaaatgccgttgtcgtcgtagaaggcgatcagcttgttcaggcgcagggtgccggccagcgaggcgacctcatgggaaatgccttccatcatgcagccgtcgccgaggaaggcgtaggtgtagtggtcgaccaccgcgtggccgtcgcggttgaactgggcggccaggaccttctccgccagcgccatgcccaccgcattggcgatgccctggccgagcggaccggtggtggtctcgacgccggcggtgtagccgtactccgggtggcccggggtgcgcgagttgagctggcggaagttcttcaggtcctcgatgccgaggtcgtacccggtgaggtgcagcagggagtagatcagcatcgagccgtggccgttggacagcacgaagcggtcgcggttggcccactgcgggttgctcgggttgtgctgcatgtagtcgcgccagaggacctcggcgatatcggccatgcccatcggggcgcccgggtggccgctgttggctttctgcacggcatccatgctcagtgcacggatggcattggctcgctcacgacggctgggcatcgcaattctcctacgggggttgctggtcggaagaccaggagtgaaaaaaagggcgccattttcgcccaccgaaggcccaaggggcaatga

SEQ ID NO: 3327 - DNA, 1047 bp, Pseudomonas aeruginosa
tacaggcattgccggggttcggacccggtactagactgcgcctccatgagccttcgcgtgccttcgatacgaccagacgactacgacccgctcgccgcgctgtgcaaggcggctggcgactcgctgcgactgaatgtgttgcgcgccctggccaacgattcgttcggcgtgctggaactggcgcagatcttcgccatcggccagtcgggcatgagccaccacctcaaggtgctggcccaggccgggctggtggcgacgcgccgcgagggcaacgcgatcttctaccgacgttcgctgcccctggccgaacgcaccggcggcgcgctgcacgcggcgctgctggaggaagtggacgaacgggcgctacccgacgacgtgcgggcgcggatcgatgccgtgcacgcccagcgcgcggcggtcagccaggacttcttcgcccgcgcggcggacaagttccaggcccagcaggacctgatcgcaggactgccgcaataccgtgagagcgtgttggccttgctcgacgcactggccttcgcccccggcgccacggcgctggaggtcggcccgggggacggcggattcctgccggaactcgccaggcgtttccgccaggtcacggcgctggacaacagcgcggcgatgctggaactggcgcgccagcgctgcaaggaagaaggattgggcaacgtccgcctggaattggccgatgccctgcaggacgccgccgaaccggccgattgcgtggtgctgaacatggtcctgcaccacttcgccgcgccggcggaggcgctgaaacagttggcccgcctggtccatccgggcggcagcctgctggtgacggacttgtgccggcacaaccagggctgggccagggaggcctgcggcgacctctggttgggtttcgaacaggaggacctggcccagtgggccgacgccgcagggctcacgcccggcgagagtctttacattggtttacgcaatggcttccagatccaggtccggcacttcgccagggatgcatccgaaagccgcctcacccaccggtaa

SEQ ID NO: 3328 - DNA, 1206 bp, Pseudomonas aeruginosa
tgtaggaaccgattgatgagcgaatattccgttttcacctccgagtccgtgtccgaaggccatccggacaagatcgcggaccagatctccgacgcggtgctggacgccatcatcgccaaggacaagtacgctcgcgtggcatgcgaaaccctggtcaagaccggcgtggcgatcatcgccggtgaagtcaccacctccgcctgggtcgacctggaagagctggtgcgcaaggtcatcatcgacatcggctacgacagctccgacgtcggcttcgatggtgccacctgcggcgtgctgaacatcatcggcaagcagtcggtggacatcaaccagggcgtcgaccgggccaagccggaagaccagggcgccggcgaccagggcctgatgttcggctacgccagcaacgagaccgacgtgctgatgccggcgccgatctgcttctcccaccgcctggtcgagcgccaggccgaggcgcgcaagtccggcctgctgccatggctgcgcccggacgccaagtcccaggtgacctgccgctacgaaggcggcaaggtggtcggcatcgatgcggtggtgctgtccacccagcacaacccggaagtctcctataacgacctgcgcgacggcgtgatggagctgatcatcaagcaggtgctgccggccgagctgctgcacaaggacacccagttccacatcaacccgaccggcaacttcgtgatcggcggcccggtcggcgactgcggcctgaccggacgcaagatcatcgtcgactcctacggcggcatggcccgccacggcggcggcgcgttctccggcaaggacccgtccaaggtcgaccgctccgccgcctacgccggccgctacgtggcgaagaacatcgtcgccgccggcctcgccgagcgttgcgagatccaggtttcctacgccatcggcgtggcccagccgacctcgatctcgatcaacaccttcggcaccggcaaggtcagcgacgagaagatcgtgcaactggtccgcgagcacttcgacctgcgcccgtacgcgatcaccaagatgctcgacctgctccacccgatgtaccagccgaccgcggcctacggccacttcggtcgtcatccgttcgagctgaccgtggacggcgataccttcaccgcgttcacctgggagaagaccgacaaggccgctctcctgcgcgacgccgccggcctctga

SEQ ID NO: 3329 - DNA, 642 bp, Pseudomonas aeruginosa
gcgtgcgaaccaggcggatcagcgtacgcatcgcggttctcccgttctcggtgtcttcggacaacgttaggccgggttgtgccggaatgcccgaaccatggcccttctccagagaccccggggcggcgtactttgctcccggacaaccacaaccgtgccgtttgctggcacacttgcgcctttgtcacgccggctgccgcctgcctcatccgcctgccaggacgctcggccgagccgtcgtccggcaaccgcaccggccgttcgatcaaggagccaaccgatgtccattcgtccttcactgccgctggccgggctgctgctcgccgtcgccctgccgctctctgccgcccagccgggcgccgccaaaggcgccccactcagcggttgcgccgccaagcaggccgccatcgaggcgaagctggaaacggcccgctcgttcgccaacgaaggccaggtggccggcttggaaaaggccctctccgaggtcaaggaacactgcaccgaagccggcctgctgagggagaacaagcagaaggtgatcgacagcgagcgcgaggtcagcgaacgcgagaaggatttgcgcaaggccatgggcaagggcgatccggagaagatcgagaaacgcaaggccaagctggctga

SEQ ID NO: 3330 - DNA, 426 bp, Pseudomonas aeruginosa
ggaagcgcatgccgaacagcaccgccagcagcacgctggtctcgcgcaacgctgccgcttcggcgatcgaccccagctgcatggcccacagcaccaggccgtagctggccaacacgcagaccccgaccgccaggccgagcttccactccagcgcccagaagcgggcgaaggcgcgggttcgcgcgccaacggcgatcagcgggaacggcaggccggaaagcagcgtcagccagaccaggtagtcaagcgccaacggccagcgcttcaaggcgttgccgtcgctccaggtgtagccgccgatgcacaggccgatcagcagcaccaccggcagggtccgccagggcagccgcgaaccgccgccgccccagagcaggcaaagcatgccgaaggggatcaacaggatgccgaggatctgccggccgctga

SEQ ID NO: 3331 - DNA, 513 bp, Pseudomonas aeruginosa
aagcccgcttggtcggaagtgctcaaccagtaccagcggcgcgccgacttggtgcccaacttggtcagcacggtgaagggctatgcttcccatgaggcgtcggtcctgacccaggtcaccgaggcccgggccaaggtcggcagcgtgcagctgaacgccgaccaactggacgacgagcaggccgtgcagcgcttccaaaaggcccagggagaactgagctcggcgctttcgcgcctgctggtagtcaccgagaactacccgcaactgaaggccgacggcctgttcaaggacctgctgacccaactggaaggcaccgagaaccgcatcgccgtcgctcgcggccgatacgtcaagtcggtacaggaatacaacgtgctgctgcgccagttccccggcgtgatcaccgccaagctgttcggctacaagcccaaggcgaacttcagcgtggaaaacgaagcggccatctccaccgcgccgaaagtcgatttcggcaacccgcaaccggcgcagtaa

SEQ ID NO: 3332 - DNA, 1029 bp, Pseudomonas aeruginosa
gccatgcgccggctgctactgggcgccgggctgctgctcgccagcctggtcaccagggccgatgtgcctccgatacccgcgctgacggcgcgggtcaccgacctcaccgcgacgctttccggcgaccagcgccagcaactgaagcaacagctcgccgccctggaagccaagagcggcgcgcaactcgctgtgctgctggtcccgaccaccggcgacgattccatcgaggagtacgcggtgcgtaccttcgagaaatggaagctgggccagaagaaggtcgacgacggcgtcctgctgctggtggcgaagaacgaccgcaccctgcgcatcgaggtcggctacggcctggaaggggccatcaccgacgtccaggccgggcggatcatcagcgagcagatcacgccgcagttccgccagggcaacttctatggcggcatccaggccggcgtggacagcctggtgcaactgatcgatgccgagaagaacccggacagcgctaccgccagcgctcccgtcgacgccttgccggcggttcccgaggccacgccgccgcgggccctgccggcaccggtcgacgagggtgaggtgtatgacagcgccccgccggagccgaagaagaagagcggcctgagcggacagctctggggcaatccggtctacctcggtgtctatgtggcggtcctgctcgccgtggccctgctcggacgcctgctgccgttgcagtggatgcggcggcgcagcatcggccgcttcctgctttgcagcgcggcggtcgccggcctggcctggctgttgagcatgggcctgtggcagaacgtcgaccgcgcggcggacgacagtctcggcgtactggccccgaccctgttcatctacgccctgttcctgcttcccggcgaagtgctgatggccattctcagcgccatcctcaatagtcgcggcggcggtgggggaggcggcagcggcggtggcggcatcttccgcggtggcggcggctccagcggcggcggcggcgcctccggacgctggtga

SEQ ID NO: 3333 - DNA, 579 bp, Pseudomonas aeruginosa
ccgccctggccgccgccagactcggcagcacgccgtggccggagtagccttgcagccagtagcggttgccctgccggccgaggtccggggtacgccgcatgctgcagtcgatatgcccgccccaggcgtactccagcgccaccccgcgcaactgcgggaacaccctttcgagatagggccgggtggcggcgcggatgtcgctgggcatgccgcccaggtaggtgcagccgccgccgaacagcaggcggtagtccggggtcaggcggaagtagtcgaggacgaactggttgtcggtcacgcagcagttgcgcggcagcaacgacttcgcccgttcctcgccgagcggctcagtggcgacctgataggtgcccaccggcagcatccgttgcgacagctcgctgtccagcccgtcgatgtaggcgttgcaggccagcaccagcgccgcgcagcggatctcgccgtgctcggtacggacccggtagccgtcgccctcctcgcgatagttcagggcccgggtccgctcgtggatacgcccgccggcgcgctcgatggcggcggccaggccgaacgccagcttga

SEQ ID NO: 3334 - DNA, 759 bp, Pseudomonas aeruginosa
agccctggttggcgcaggcagccgaaccatagagcggcatgctgccggctggcaggtcgaaggtctcgccgtgccagtggaacgccatcagccgttccggcaggcgctcgcccagcggcgagcccagcgcctggctgtacctgtgcagcggccaccagccgatctccgcctggcgtcccgggcgtaccgcagcccccagcgcctgggccagcagctgcgcgccgaggcagatgccgaggaccttcttgccggcatccagcgccgcgcggatcaaacggttctccgccaccagccagggatattgcgcttcgtcgtggacgctcatcggcccgcccatcaccaccagcaggtcgaagctgtccagcgcaggcaggtgggcgtcggcgtagaggtagcagacgtgctcgtgctcgcagtggcggccgatccagtcgccgatccgcgcgctgccttcgaagggaacgtgttgcaataccagggcgcgcatcaggccacctcctagtgtcggttggcgacccgggccagggcccgctccagtcgccgcagcatttcgtcgacgttggcccggctcaccgtcagcgccggggaaaaacgcaggcaatgcggctgcggcgcgttgatcagcagcccttcgccgaacgccgcgcgaaccaccgccggcgcgcgctggccgatcagcggcggcccccagaacagtccctggccgcgcagcggaccatgcccatagcgacgcgcgacacgggccaggccatcgcgtag

SEQ ID NO: 3335 - DNA, 1122 bp, Pseudomonas aeruginosa
gtgggtgccctgctcgcgcacctgctccaggaaacccggctccagcacggtattcagtaccgccagcccggcagcggtcatcaacgcgttgccgtggtgggtgccaagctggtcgcccggttcgaagcagcaggcgttgccacgcgccagcagcgccgacagcggcaccccggcgccgaggcccttgccgagggtaacgatgtcggcgcgtaccccgtacagttcctccgccagcagcgcgccgcagcggccgatgccggtctgcacctcgtcgaggatcaacaggacgccacgctgccggcacagccgctcgatgccacgcaggtagtcgagggtcgccgggatcaccccggcatcgccctgcaccggctccagcatcaccgccaccgtctcttcgtcgatggccgcggccatggcgtcgaggtcgttgaacggcaccctggccaatccctccaggccatgctgcgccggcttgccacaagccgtcagggtgcccggggtgcgtccatggatgctgttgacagtgctgacgatccgttgcgcgccgccgcgatgcaggcggccccacttgcgcgccagggcgatggccgcttcgttggcctcggcgccgctggtgaggaagtaggcctggtcgctgccggtcgccaggcacaggcgctgcgccaatgccagcaccggccggttgagcaggccggggccggcgctgaccagctcccgcgcctgccgggccagggcctggaccagcacgctgggactgtggccaaggcagttcaccgccaggccctgggtgaagtcgaggaaggcgcgtccgtcgctgtcccacagccacgagccctggccacggacgaacacctgttcgggccgttcctgggtgcgcatcaggcgcaggctatccagcgcatcagccatctttcagttcctcggtcatgtactccaccgccagcaagcgcacgccctgcggcccctgttccagcagccggcggctttcccggcgcgtttcgatgcgcagttcgaagccgtcgccggcggggaagcgctggcgcatcagctcgcgcacctcggcaaagcgcgcggcgctcaccgtcatgctggccaacagccggccggactggctcagggtga

SEQ ID NO: 3336 - DNA, 1197 bp, Pseudomonas aeruginosa
cgcgtcgcaggccatcatctggcgcaacccgagaggctccaggggatcgccgaaataccactgcaacaggcgggcgacggtcagttcagggtaatgccgctggaccagcttcagctcgtccccgggagtcaccatgccgctgcgcaggacccgatagaaccagccgcagcggccgccgctctgcaattcgtcgggcagctcgggaagattccagcgctggccctggcgatagcagggcgaacgcggctggctgacttccagcagggcatcgccccaatggaactggtcgccgatgcagacctcggcttcggtgatgccgtaggtcgagatgttctcgccgaacgccggcagttgccagcggttcagcgggtggcgcttgcgccagtagcggtagtgctcggcgggatagtgatgaagagcgcgctcgaggccgccgtggtggcggatgtcggcctgttcgtcgccgggcaggccatcgtggcccagccagaactcctgctcgaccggcagcttgtcgatcgcgctgaccaatccgccccaggtttcttcgactttacctatgaaaacaccgtttacgactatctgctccattgctccgcgaccacccgatgtaccgccaatgcagctagactattgcctcacgcgggacccactccatttcgattttccagtttcatcgataagaacagcttatggattttcgccaactccgctatttcgtcgcgctctacgaggaaggccacgtcggccgcgccgccgaacgcctggccctgtcgcaaccggccctctcgcagcagatccgccagttggagcagaacctcgacgtctcgctgttccagcgcagcggcaagcgcctgctgccgaccgtcgccgcccacaccctgtacaaccatgcggtaccgctgctggagggattggaaagggcccgcgaggcgatgcgcgtattccgcgggcagaccccgcgcagcctggcgatcggcgtgctgcagacggtcaacgccagcctggtgccgtacatggtcgaacgcctgcacgccgcgcagccgcacctgcgggtgcagatctacgaactgtcgggaatcgacatcgagcggcgcctgctcaccggcaacctggatatcggcatcggcttcctgccgccgcgccagccgggcttgcacagcgtcgagctgtacgaggacgaattgcagctggtga

SEQ ID NO: 3337 - DNA, 897 bp, Pseudomonas aeruginosa
agattacgcatctccgcgagggggagaaagcagccaaaaccaccgccgtttgtaagccttggcttacacgctgtaatagttccgctcgccggaccgacggcagcgcccacccgccgcgagcttgccgtgcatcaagatgacctgcgccgggcccgctacagtgggcagtcccctcatcatcgcgagccttcccagcatggaattccagcgcgtccaccagcagttgctgcaaagccaccacctgttcgaaccgctttctcccgtccagctccaggaactgctcgccagcagcgacctggtcaacctcgacaagggcgcctacgtgttccgccagggcgagccggcgcacgccttctactacctgatttccggctgcgtgaagatctaccggctgaccccggaaggccaggagaagattctcgaagtgaccaacgaacgcaacaccttcgccgaggcgatgatgttcatggacaccccgaactacgtggccaccgcccaggccgtggtgcccagccagctgttccgtttctccaacaaggcctacctgcgccagttgcaggacaacaccccgttggccctggccctgctggccaagctcagcacccgcctgcaccagcgcatcgacgagatcgagacgctttccctgaagaacgccacccaccgcgtggtgcgctacctgctgaccctcgccgcccacgcgccgggggagaactgccgggtggaaatcccggtggccaagcaattggtggccggtcacctgtcgatccagccggaaaccttctcgcggatcatgcaccgcctcggcgacgagggcatcatccgcctcgacggccgcgaaatcagcatcctcgaccgcgaacgcctggagtgcttcgagtgaacagccccgccgcttga

SEQ ID NO: 3338 - DNA, 1650 bp, Pseudomonas aeruginosa
ggcatctcagcggcgcaggcgccgatagagctggagcaggcgctcgggcaactgcccggcgcgctcgaccagcgcgaagccgtcggcgccgaacaggtagggcaggtagtccgccgcctccttgtcgatggtgatgcagaacggcaccagtccctggctgcgcgcctcgatcaccgcctggcgggtgtcctcgatgccgtagcggccctcgtagcggtccaggtcgttgggcttgccgtcgctcaacagcaacagcaggcgacgcttctgcggctgcccgccgagcacctggctggcccggcggatcgccgcgcccatccgcgtgtagtagcccggcgagagcgccagcacgcgaccgcggacctcgccgccgtagccttcgtcgaagtccttcagcacctgccagcgcacctgctgccggcgcaccgaggaaaacccgtacagcgcgaaggggtcgcccagtgcctgcaacgcctcgccgaacagcagcaggctgtcgacgatgctgtcgatcactcgccgctggtcgtcgaggtaggcttcggtggacatcgacaggtccgccagcaacaggcaggcgaggtcgcgccggcgcggccgctgttcgaggaacaggcctggctgggtggaaccgccgcgccgccgctcgacctggaagtcgagccaggcatcgaggtcgatctcgtcgccttgcggctgctggcgcaggcgttggcggccgtcgcgcaggcaggcgaactggcggcgcagatgcagcgcggtcttctccaggtgcgccggcaggctggcgctggtcgcgccgcgcggccgcatcggttgcagcagcacgtggtcgctcagcaggcgctgctgccgatagtcccactcgggcagcttcagcccggggccgagcggcaggtcatcgtagtcggcggccggcaggtcgagatccaggcgcaggccgccgcccttctgcgtgcgctggcgcgacagcgacaggtagtcgaggtcttcggcgacgcgcgcgccgtccgggtcgtcctcgtcgtcgctacagcggtccagggccaggtgctccgaccaactgagcaggctttccaggcggaacagcagcaggttgcgttcgctgttgcgttcctcaatgcgctcggcgcgcttgcgcgctccgctgcgggcgacctggcgcttgccggcgccggcggccgcttcctcgccgtcctccgcactggcggaaggcgtccagcgctcgccgggatacagccacagcggcaccggccagggcgcccgctcgactcgcgggaagcgctcgacgctgcccggctcggcaagcgcgcggcgcagggcgatttccagttcggcgtctgccgccgggcaatcgtccagcgacgggcgctggcgcagatgcgcggcgaccagccgggcgtagcgcgggcgcagcgccggataggcatcgagcaactgccgcgcccagcgctggttgtcctgggcccagtgccgcagcggcccggcgctggccgccagcagcgccagccagcgatacagttcgcggttcagctcggcctgcggatagaccgcgagggattccggcaggcgcaggctgtcgccgttgaaccaggacaccggggcctgctcgcaggtcccggcgacccgctgcaaccaggtgcggcgtag

SEQ ID NO: 3339 - DNA, 1104 bp, Pseudomonas aeruginosa
tcaggccgaacaggatctgcccgacgaagaggatcagggcgaacacgaagtagggtttggcgaccgcctgcgaggcgaatttcagggagccattgggcgacatcatcaaccctccttgttcggcggccattggttggtatcgatcttcgagctccacttgaggaactcggccaggtcgtcgacctggccctcgctgagatggaactgcggcatggcgcggcggcccggcacgttcagcggctggatattcatccaggcctggaggaaggtgttgaagccctcctcgccgccacggcgtccgaccacgttgcccagctccggcgcgaagtaggcgccctcgccgagcagggtgtggcagccgacgcagttgttctgttcccagaccagcttgccgcgcaccaccgcggcgctcatcgcggcctcgttggtgcgctcgggcagggtcttctcggtgtggtaggtcagggccaggaacagcaggatgaagaacacactcccgccgaaatagatgttcctggccatgcctttggtaaaggtctcggacatgcggcctcctggaatgggtggtgcggcgattctaggaagcggcggcggcgaacccgcttgatggcaatcaagattcccgaacgatttactcagttattcatccgcgccaggtacagcgcagcgcccaccgccagggccatcagcagcggccaggccagcagcaggcggcgccatagcgccggggcatgggccagctccatgaagcgctcgccgatcagccaacccttggccaccgcgcagggccagcaccgccgccagcagccagggagagtcgccggcgccacccagcagcacaccggtcacggccagcgccagcaacgccagccagcagagggtcagggttcgcatcggcacctcattgcaggacgtagaccagcgggaacagcagcacccagaccaggtcgaccatgtgccagtagagcactcccgactccagtcccgagcaagcctgcggcgtataacaccggcgccagcaggcctgcgccagccagccgaggatcagcaggccgagcaggacgtggaggaaatggaagccggtcaggcaccagtagagggtga

SEQ ID NO: 3340 - DNA, 1377 bp, Pseudomonas aeruginosa
aagcgagttcaacgaggccaagcagatctacttccaacgctgcgccggttgccacggcgtcctgcgcaagggcgccaccggcaagccgctgaccccggacatcacccagcaacgcggccagcaatacctggaagcgctgatcacctacggcaccccgctgggcatgccgaactggggcagctccggcgagctgagcaaggaacagatcaccctgatggccaagtacatccagcacaccccgccgcaaccgccggagtggggcatgccggagatgcgcgaatcgtggaaggtgctggtgaagccggaggaccggccgaagaaacagctcaacgacctcgacctgcccaacctgttctcggtgaccctgcgcgacgccgggcagatcgccctggtcgacggcgacagcaagaagatcgtcaaggtcatcgataccggctatgccgtgcatatctcgcggatgtccgcttccggccgctacctgctggtgatcggccgcgacgcgcggatcgacatgatcgacctgtgggccaaggagccgaccaaggtcgccgagatcaagatcggcatcgaggcgcgctcggtggaaagctccaagttcaagggctacgaggaccgctacaccatcgccggcgcctactggccgccgcagttcgcgatcatggacggcgagaccctggagccgaagcagatcgtctccacccgcggcatgaccgtagacacccagacctaccacccggaaccgcgcgtggcggcgatcatcgcctcccacgagcaccccgagttcatcgtcaacgtgaaggagaccggcaaggtcctgctggtcaactacaaggatatcgacaacctcaccgtcaccagcatcggtgcggcgccgttcctccacgacggcggctgggacagcagccaccgctacttcatgaccgccgccaacaactccaacaaggttgccgtgatcgactccaaggaccgtcgcctgtcggccctggtcgacgtcggcaagaccccgcacccggggcgtggcgccaacttcgtgcatcccaagtacggcccggtgtggagcaccagccacctgggcgacggcagcatctcgctgatcggcaccgatccgaagaaccatccgcagtacgcctggaagaaagtcgccgaactacagggccagggcggcggctcgctgttcatcaagacccatccgaagtcctcgcacctctacgtcgacaccaccttcaaccccgacgccaggatcagccagagcgtcgcggtgttcgacctgaagaacctcgacgccaagtaccaggtgctgccgatcgccgaatgggccgatctcggcgaaggcgccaagcgggtggtgcagcccgagtacaacaagcgcggcgatga

SEQ ID NO: 3341 - DNA, 402 bp, Pseudomonas aeruginosa
gttcaacgtctacaacacccagcacgacgtgtactgagacccgcgtgcggggcacgccccgcacgctcccccctacgaggaaccgtgatgaaaccgtacgcactgctttcgctgctcgccaccggcaccctgctcgcccagggcgcctgggccgaagaccccgaagtgctgttcaagaacaagggctgcgtggcctgccatgccatcgacaccaagatggtcggcccggcctacaaggacgtcgccgccaagttcgccggccaggccggcgccgaagcggaactcgcgcagcggatcaagaacggcagccagggcgtctggggcccgatcccgatgccgccgaacgcggtcagcgacgacgaggcgcagaccctggcgaagtgggtcctgtcgcagaaatga

SEQ ID NO: 3342 - DNA, 1587 bp, Pseudomonas aeruginosa
ccagcagccgcccttgcgcggcagcggcgacctcggcgtgctgatcgaacgcgccgacggcagcgtgcagatcctcgacggcacggcgaagacctcgctggcgcgggtcgaaggcctcggcgacctgtcccacgcctccctggtgttctcccgcgaccagcgctacgcctacgtattcggtcgcgacggcggcctgaccaagctcgacctgctggcccagcgcatcgacaagcgcctgatccagggcggcaacagcatcggcggagcgatcagccaggacggtcggctggtcgcggtatccagctacgagccgggcggggtcaaggtgttcgacagccgcaccctggagctggtcgccgagattcccgccacccgcctccccggccaggacaggaactcccgggtggtcggcctggtcgacgcgcccgggcagcgcttcgtgttcagcctgttcgacagcggcgagatctggatcgccgacttcagccagggcgacacgccgcacctgacccgcttccgcgatatcggcaagcaaccctacgacgccctcatcagccccgacgggcgctactacatggccgggctgttcggcgaggacggcatggcccagctcgacctctggcacccggagcgcggcgtcaggcgcgtactcggcgactacggccgcggccaacgcaagctgccggtgtacaagatgccgcacctggagggctggaccatcgccagcgaccaggccttcgtcccggcggtcggccatcaccaggtgctggtgctcgacgcgcgcgactggaagcagaccgacgccatcgacgtcgccggccagccggtgttcgtcatgactcgaccggacgaccggcagatgtgggtcaacttcgcctacccggacaacgacaaggtgcaggtcatcgacagcgagacccacgaagtgatcgaaaccctgcgccctggccccggcgtactgcacatggaattcagcgggcgcggcgaccaggtatggatctcggtgcgcgacgccgaccagttgcaggtctgggacccgtaccgcctgaagcgcatcggcagccttccggcccgcagcccgagcggcatattcttcagccaccgcgcccagcacatcggactctaggaggcaccatggacgacctctcccgccgcctcctcgcccgctaccagaaaggcctgccgatctgcgcggaaccctatcggcggatggccgagaccctgggttgcagcgaagccgaggtgctcgaacggctgcgtcgcctggaagccgacggcgcgttgtcgcgggtcggcccggtgctccgccaccaacgcgccggggccagcaccctggctgccctggcggtgcccgaggagcgtctgcaacgggtcgccgagcgcatcagccagtacgccgaggtcaaccacaactaccagcgcgaacaccgctacaacctgtggttcgtgctcaccgccggcgaccgcgcgcaactcgaccgggtactggcggagatcgccgccgacaccggcctgcaacccctcgacctgccgatgcaggaagcctactgcatcgacctcgcgtttcccctggaggccagccgatga

SEQ ID NO: 3343 - DNA, 603 bp, Pseudomonas aeruginosa
tccacggccgcgagcgcggcgaagtggaacgccagatcgaggccctgctggagcgccacgccctgcgccagacaccgcaccgctggctgttcagcctgcgcgcctacaagcagtgcggcggccgctacaccgcgccgccggccgacctggagcgccgccatggatgagttcgaccggcgcctgctgaaccgcctgcaacacggcctgccgctggagccgcatccctacgcgctgctcgccgccgagctggattgccgcgagggagacatcctgcgccgcctggacgacctgctcgacgacggcaccctgacccgcttcggtccgctgttcgatatcgagcccctcggcggtgccttcaccctggccgccatgagcgtgccggaggcgcgtttcgaagagatcgccgcgctgctcgccggctggccgcaggtcgcccacaactaccgtcgcgagcacgccctgaacatgtggctggtggtcgcctgcgacagcccggcggaggtcgccgagaccctcgcacggctggagcgcgagagcgggctggcggtactcgacctgcccaaggaggcgacctaccatgtcggcctgcatttccccctctga

SEQ ID NO: 3344 - DNA, 1647 bp, Pseudomonas aeruginosa
cgccctgctcgcccgccgcctgatcgagctgacccaggccggcctgccgctggtcgccgacccttgggcgtggatcgccgcgcaactgcggctgagcgaggcggagaccctggcgctgctgaagcgcctgcgcgacgccggggtgatccggcgcatcgccgcggtgcccaaccactatcgccttggctaccggcacaacggcatgaccgtctgggacgtcgccgacgaacgcatcgaacgcctcggccggctggtcggcgggctgtccttcgtcagccattgctaccggcgcccgcgccatctgccgcagtggcgctacaacctgttcgccatggttcacggccgcagcgaagcggagatcgaaggctatcgccagcagatccgcctgctgctcggcgaggactgtcgcgccgacgagatgctggtgagcagccgcatcctgaagaagaccggcctgcgcctggcgcagaaggaggaacgtccatgctgaggatcagccattacctgcgcagcctcgccgaggacgcgccgacgccgcgccgcgccggcggcaggcgcgccccggtggtgatctggaacctgctgcggcgctgcaacctgacctgcaagcactgttactccacctccgccgacagcgacttccgtggcgagctggagaccgcggaaatccttcgcggcatcgacgacctgcgcgccgccggagtgcgcgtgctgatcctctccggcggcgagccgctgatgcacccggacctcttcgagatcgccgcccatgcgcgccaggccgggatgttcgtggcgctgtcgagcaacggtacgctgatcgacgaaggcaacatccagcgcgtcgccgaggcccgcttcgactacgtcggcatcagcctcgacggcctgcgcgagacccacgaccgcttccgccagaagcagggcagcttcgacgccgcgctggcggccatgcgcctgtgccgcgaggcggatatccgcgtcggcatgcgcaccaccctgaccgaggagaacgccgcgcaactaccggcactgctcgacctgatgcgcgaactcgacgtgcagaagttctacctctcgcacctcaactacagtggccgcggccgccgcagccgcgccctcgacgcccaccaccggcgcacccgcgaggccctcgcgctgctcttcgaacgggccgacgaggacatccggcaggggcgcgacagcgacttcgtcaccggcaacaacgacgccgacgcgatccttctcctcgactggctcaagcgccgccgcccgcagcaactggcgcgtctctgcgagctgctgctggactggggcggcaacgcctcgggcgagggcatcgccaacatcgacaacaccggcgaggtgcatccggacagctactggtggcaccacagcgtcggcaacatccgccatcagcgcttcgccgacttctggttcgagcgccccgacccgctgctcctgcaactgcgccagcgcccgcgaccggtggtcgggcgctgcagccaatgccgctggctggacatctgcaacggcaacacccgcacccgcgcctgggccggcggagaactttggggcgaagaccccggctgctacctcagagatcaggaaatcggcctcgagcgcatcgcgctgcacccgttataa

SEQ ID NO: 3345 - DNA, 2322 bp, Pseudomonas aeruginosa
ggaaagcctcatgaacactacggggattccgccgtccttcctcgatgtcgatttccctgccggcagcgtcgccctggtcggcgccggccccggcgatccgggcatgctcaccctgcgcgcatgggccctgctgcaacaggccgaggtggtggtctacgaccgcctggtcgcccgcgagctgatcgcccttctgccggaaagctgccagcgcatctacgtcggcaagcgctgcggccaccacagcctgccgcaggaagaaatcaacgagctgctggtgcgcctggcccggcagcaacgccgggtggtccgcctgaaaggcggcgacccgttcatcttcggtcgcggcgccgaggagctggagcgcctgctcgaagccggcgtcgactgccaggtggtccccggcgtcaccgccgcctccggttgcagtacctacgccggcatcccgctgacccaccgcgacctcgcccagtcctgcaccttcgtcaccggccacctgcagaacgacggccgcctcgacctcgactgggccggcctggcgcgtggcaagcagaccctggtgttctacatgggcctgggcaacctcgccgagatcgccgcgcgcctggtcgagcacggcctcgccagcgacaccccggcggcgctggtcagccagggcacccaggcgggccagcaggtgacccgcggcgcccttgccgagctgccggcgctggcgcgacgctaccagttgaagccgccgacgctgatcgtcgtcggccaggtggtggcgctcttcgccgagcgcgcgatggcgcatccttcatacctgggcgccggctcgccggtcagccgcgaggccgtcgcatgcgcctgatcggcctcgccctcggcctgctcctcggcgccctcgcacaggccggcgaagcgccgggggaagcgctctaccgccagcactgccaggcctgccacggcgccgggcggctcggcggcagcggcccgaccctgctcccggaaagcctttcgcggctgaagccggcgcaggcccgcgaagtgatcctgcacggtcgcccggcaacccagatggccggctttgccggtcaattggacgacgccgcggcggacgccctggtcgcctatctctaccaggcgccgccgcgcgaaccgcagtggagcgccgaggacatccgggccagccaggttcagccgcatcccctcgccaccctgccgtccaggccccgcttcgaggccgacccgctgaacctgttcgtggtggtggagtccggcgaccaccacgtgaccatcctcgacggcgatcgcttcgagcccatcgcccgcttcccctcgcgctacgccctgcacggaggtccgaagttctccccggacgggcgcctggtgttcttcgcctcgcgcgacggctgggtaaccctctacgacctgtacaacctgaaggtggtcgccgaggtccgcgccggcctcaacacgcgcaacctggcggtcagcgacgacgggcgctgggtcctggtgggcaactacctgcccggcaacctggtgctgctggacgcccgcgacctgtccctggtgcaggtcatcccggcggccgacgcccagggccaggcctcgcgggtcagcgcggtatacacggcaccgccgcgacacagcttcgtggtcgccctgaaggacgtccacgagctgtgggagctgccctatgccaacggcaagccggtcgcgccgaaacggttggcggtggccgactacctcgacgacttctccttcagccccgactaccgctacctgctgggcagctcgcggcaggccaggggcggcgaggtgatcgagctggacagcggcgcgcgggtcgcctcgatcccgctgtcgggcatgccgcacctcggctcgggcatctactggaagcgcgacgggcgctgggtattcgccacgccgaacatcagccgcggggtgatctcggtgatcgacctgcaaaactggaagccgttgaaggaaatcgtcaccgacggccccggcttcttcatgcgcagccatgccgactcgccctacgcctggaccgataccttccttggcaagaaacacgacgagatcctgctgatcgacaagcagaccctggaaatcgcccatcgcctgcgccccagcccgggcaaggtcgccggccacgtcgagttcacccgcgacggccgctacgccctgctcagcgtctgggaccgcgacggcgcgctggtggtctacgacgcgcacagcctggaggaagtgaagcgactgccgatgaacaagccgtcgggcaagtacaacgtcggcaacaagatcggctatgcggagggaacctcgcactga

SEQ ID NO: 3346 - DNA, 2154 bp, Pseudomonas aeruginosa
ccgcaagcggatatcccccccacccgtcccgcgcgccgagcccccggcgcccagaaaaaagccccgcatcgcggggctttccgtctcaggcgccaggcctcagaactgctcggcgtccagcaggtacagcgactcgctgccggcgcgcacggaggcgctcagggaatggatgcgcggcagcaggcgggcgaagtagaagcgcgcggtacccagcttgctggcgtagaagtcgtcctcgccctgcttggccagcgcggtgcgcgccatcaatgcccacatgtaggcataggcggtgtagccgaacacatgcaggtattcgaccgacgccgcgccgatctcgttgggattgcccttggcgcggtcgagcagccaggcggtcagctcttccaggttctccacggcggccgccagcggcttgctgaactcgcccagggcctcgtcggcggaagcgacgaaggccttgatctcgtcggtgaagtgacgggagaaggcgccgccgctgccgatcaccttgcgccccaccaggtcgagcgcctgaatgccattggtgccttcgtagatctgcgtgatgcgacagtcgcgcaccagttgctcctggccccattcgcggatgaagccgtggccaccgaagatctgctggccatggatggtggtttccagccccatgtcggtgaggaatgccttggccaccggggtcagcagcgccaccagctcttccgcgcgcttgcgggtgaccgcgtcttcgctgtacttggcggtgtccagctgcatcgcgacgtagctggagaaggcgcggccgccttcgttcagcgccttcatggtgagcagcatgcgacgcacgtcggggtgcacgatgatcgggtcggcggccttgtccttggccaccgggccggtcggcgcgcggctctggatacgctcgcgggcatattcgatggcgctctggtaggagcgctcgccagtggccaggccctggatgccgacgccaaggcgctcgtagttcatcatggtgaacatcgccgccaggcccttgttgacctcgcccaccagccaaccggtagcgccgtcgaagttcatcacgcaggtggccgaggccttgatccccatcttgtgctcgatggagccgcaacccaggctgttcttctcgcccagcgagccatcggcgttgaccagcaccttcggtaccaggaacagcgagatgcccttcggcccggccggggcgtcgggcagcttggccagcaccaggtggatgatgttctcggtcaggtcatgctcgccgccggtgatgaagatcttggtcccgctgatcttgtaggagccgtcggcctgcggctcggccctggtgcggatgatgcccaggtcggtgccggcatgcggctcggtcaggcacatggaaccggcccagataccggcgtacatgttcggcaggtacttgtccttcagttcgtcgctggcatgggcattgagcgccaggcaggcgccggcggtcagcatcggatacaggccgaacgacaggttggccgagttgaccaattcctcgacctgcgccgagatcaccttgggcatacccatgccgccgtaggtcggatcaccgccgacgccgacccagccgccttcggcgtaggtccggtaggcctcggggaagccggccggggtgctcaccgcgccagcgttccactggcagccttcctcgtcgcccggacggttcagcggggcgatggtaccggcggtgaccttgccggcctcttcgaggatcgccgcggcggtctcggcgtcgaccacttcggccagcgccggcagttgcgcccagagccgggagacctcgaacacctcattgaggacgaagcgcatgtcgcgcagcggagctttgtaatcagccatgtggggaatcctcgatcgtaccgatcgccggccgggggccagcggcaacaaaatggaggcacgaaaggcgtgccgcggccgagtctacaccaccaacatttcggacttgtagcgtcacgtcgtgacctgaaagtctatatcggtcttctatgcgacaggcatgagaaagcccgcttttcgcgggctcgagcgagttcgccgggagtccgacgggcccggcgggtgcgggagaaaccgggggaagaagcgccgcgcccctgccccggcagccgctag

SEQ ID NO: 3347 - DNA, 462 bp, Pseudomonas aeruginosa
ccccgaggtcggaaggccaggatgcagcggatcgcaggcatgaaaaagcccgccgaagggcgggctctttctcacctggggaacgggccgccagcggcccgtgccatcagtaaccgagggcgaaatcttcctcggccatctccatcaggctgttggcgccggacagcatggcggcgacgtgggcgcgggtacgcggcaggatgcgctggaagtagaagcgcgcggtctgcagcttggccttgtagaaggcttcctcgccggtgccggcggccagcttctcggcggccaggcgcgccatgtcggcccagaagtaggccaggcaggcgtagccggagtacatcaggtagtccaccgaagcggcgccgacttcctcgcgatccttcatggcggccatgccgaccttcatggtcaggtcgccccactccttgttcagctgtgccagcggagcgacgaattccttga

SEQ ID NO: 3348 - DNA, 3150 bp, Pseudomonas aeruginosa
ctggccgccagggtcgagacctcgacgtccggcagccactcgagcagggcctcggcggcggccagcggcaccagcgcatcggcttcggcgaacaggtgcaattgcggcccgcggaagttttccagggcggcccgggtatccagttggccgagcaactgcaggccggcgaccagcgcctcgcgctccagctgcggcagcgccacctgcagttgccgcgccagggtccgagggtcgcgcgcaccctggctgaccagcagggtgaaacgcttgcgggtcaggtgcggttcgagcaggaaagcctcgaagaagtcctcgaaggtttccgccggcatcgcgttcggccagtcctcgcgcacgcggaagcacggattgctggccagggtcagcagtccccggcaatcgtcgccgcggcgcgccgccagttcgccggcgagcatgcctcccagcgaccagccggccagccagctatcgcgcggcaggttatcgtcgagttcgtcgagccagtcggcggcgtcgtccagcgacggcagcggctcgatcaacacgttcaggtgcggctcgcgctcgtgcagcgcgtcgcgcagcggttccagcggtgcgctgcccaggccccagcccggcaacaggatcaagtggtcacgcatcgtctccctcctcggcttcgatctctgccagaaggctagacgacagctgtcgccagctttcgccgagggcttcgagcaagcggtcgacctgcgcttcgctgtgcgcggcggacagcgtgacgcgcagccgcgcgctgttggccggcacggttggcgggcggatcgcgccgaccatgatgccacgggctcgaagcatgccggccagggccacggcctggcggctgccgccgaccaggatcggctggatcggcgtgaagctgtccatcagggtcaggccaagcgcctcggcgccatggcggaaacgggcgatcagcgccgccaggtgttgccgccgccagctttcgcggcgcagcagctccaggctcttcagggtggcgcaggccaccgctggcggctggctggtggtgtagatgtagggccgggcgtactgaatcagggtctcgatcagttcctcgctgcccgctacgaaggcgccggcggtaccgaaacccttgccgagggtgccgatcagcaccggcacctgctcctggccgaggccgaaatgttcgacgatcccgccgccgctggcgcccagcgggccgaagccatgcgcgtcgtcgaccatcagccaggcgccgcgggcctgcgcgacggcggccagggccggcaggtcggcgagattgccgtccatgctgaagaccccgtcggtgaccaccagggtattgccctcggccttgtccaggcgcgcggcgaggcttgccgggtcgttgtgcaggtagcgcgagaaacgcgcgccggagagcaatccggcatccagcagcgaagcgtggttgaggcggtcctccagcaccgtgtcgcccttgccgaccagcgcggtcaccgcgccgagattggccatgtagccggtggagaacagcagcgcacggggccgcccggtgaattcggcgagggccagctccagttcgtggtgcgggccgctgtggccgaccaccaggtgcgaggcgccaccgcccacgccccagcgctcggcgccggcgcgcagcgcggcgatcacctcgggatggttggccaggccgaggtagtcgttggaacagaaggccagcagcggctggccgtcgaccacgacgtccgggccctgggccgactccagcagcggccgctggcggtagaggtcttccgcgcgccggctggcgaggcgggaagcgagatcgaaggacatggcaggtcgctcgtgttgctggacggacgcaggcgcacccgtccacgcagggccgacatcagcggctgcaacgaagggacggcggcgccctcccttccagtatggtcaggcggaagcggcgttatagaacagcttcgattcgcgttgttccaccaacgcctgctcgatggcggcctggtgcacttcgtcggcgtgctcttcgcgctcttccggcttgatgccgagacgggcgaacaactgcatgtccttttcggcctgcgggttcttcgtggtcagcagcttttcgccgtagaagatcgagttggccccggccatgaaggccagcgcctgcatctgctcgttcatctgctcgcggccggcggacaggcgcacgtgggacttcggcatcatgatccgggccaccgccagggtgcggatgaagtcgaagggatcgacgtccctctcttccgccaggggcgtgcccttgaccttcaccagcatgttgatcggcaccgactccgggtgctccggcaggttcgccagttggatcagcaggccggcgcggtcgtccaccgactcgcccatgccgaggatgccgccggagcagatcttcatccccgcctcgcgcacgtaggccagggtctgcaggcgctcgctgtaggtgcgggtggtgatgatgttgccgtagaactccggcgaggtatccaggttgtggttgtagtagtcgaggccggcgtccgccagcgcctgggtctgttcctgggtcaggcgaccgagggtcatgcaggtctccaggccgagcttcttcacgcccttgaccatctccaggacgtagggcatgtccttggccgacgggtgcttccaggcagcgcccatgcagaagcgggtcgaaccgatggccttggcctcggccgccgcctcgaggaccttctgcacctccatcagcttctccttgtccaggccggtgttgtagtggccggactgcgggcagtacttgcagtcctcgggacaggcgccggtcttgatcgacagcagcgtcgagacctgcacgcggttcgggtcgaagtgcgcgcgatgcaccgtctgcgcctggaacagcaggtcgttgaacggttgctcgaacagggcacggacttcggcgagggaccagtcgtgacgggtggcgacggaagcggttgcactcatggggaagattccttcgacgcttgtatggcgccttttgtcggggagccccggcacgccgggggtcaggctcaagggcatcataagtggctgtatgacgctgtcaacccaacccaggacacaggactacatctgatcaatatttga

SEQ ID NO: 3349 - DNA, 1092 bp, Pseudomonas aeruginosa
ccattcaaagcgcagcggaagtataacgaaaaatatattcgaccattccgaccaaccactttccaaaacacgatacgggtttcattcgggcacattcaggaatatgaatggaaagcgcctcttccaggtccgaagttggcttcggatggttcttgcatcgatattcgcctggctgtgcatgtccgcccatgccgatctctctttcgacggccagaaccgtttcgtgatgaaaggcaagcgcctgccgatcacgctggtcaacgagggcaaggagccggccctggcggaaatctccctggattggggtaccgacggcaaggggcaggcgctgcccttcgccgtgtccaggccgctgctccgcctgggcgccggccagcgggccaaggtggaggtgctctaccagggccagggcctgcccaccgaccgcgagacctacctgctgttgagcgtgctggacgtgccgcacgcgcccagtactcccgagaccctgcagatcgccctacgccatcgcttcaagctgttctatcggccgcccctggaagccaccgtcgagcaggcgaacgagggcgtgacgtggacgctcggcaccagcggcaatccgaaggcacacaatccttcgccctaccacatcaccttcagccagttggagttcctcgacgcatcggagcggagctgcggcgaagccatcgaacacctgatgctggcgcccttctccaatcaccagttcgacatcgccgcctgccatcccgacaaagtgcgttacgcgatcgtcagcgacggagggaacctccacccttatcacggcgcattgaaatcaggcgtagagaccaacgccaaacacccatgaggcccggaatacaccatgaatgcaattacccgaacactacttgtgggaatgctggttgcgttggcgcagaaaggttatgcgctgacctgcgaaagagcggacaacaaggcaacgatcgactatgtcaacatcgacacgagcatcgccgtgccttcggctctgcccaaggacaccgtgctctggcgctctccaacctacgatttctccgtcaggtgttaccaggagcgcgaaaacaccggacctga

SEQ ID NO: 3350 - DNA, 774 bp, Pseudomonas aeruginosa
ggagttcgagttcattccctacgccccaacccagacgacggtgacgaagaactttctcgcccaactgaggtggatgacgagcagacccattctaggcccgttcaacgccaccgccgcgatagaggtctattacaagtgaccgctaggccgcacctgcaacaggcgcggcatgctctgcaaaaacaagaatcgattaacaacctgcagaagaaccccatgaatgccttcatccgttacatgcttgtcgcaatgctgctcgtcctgtcgcagaaaagcttcgccttgatgtgctggaaatcggacaacaagcaaaccgaagattatgtctacatcgatacgagcatcgctgttccatcggtcctccccaaggacaccgtactctggcggtctccgaactactccatatcgatcacttgcttccaggatcgcgactgggggccagagcaggtctatttctacctgagtccaaccggtcagggcgcgctgggttcggacctggaggtgggcatcaacctgaacggcgaagacctgcgctgctcgacactcgacaagtgccgaaaggagatcggcatgcacttcgatggttgctggacgggacgaggttgcgaaggcagggcgaagaagatgaccgtcaacttcaacttctttctctccaagcgggcaggtcccagtaccggtaaggaaggtcctatcacaggggtaaacgcctacccgattttccagttcgatggcgagagcgctatcaataacatagggggtacaacttccgcatga

SEQ ID NO: 3351 - DNA, 1434 bp, Pseudomonas aeruginosa
aggtctactacaagtgaccgcccggggccgcttcgcagaccgaagcggcccggtatcgacgactcagcgcaggaagaagtgctgaagtcgttgcacttgccagttgtaacggcgacgcgcctcgagaccttcctccaggctgacggcgacgaaacgcgccttctggttcggttgcatctgcgccagccggttcaggtcggggctgatcaccgtgcccagcgtggcatatcccccaccggacaccgcatcacgatgcaggacgatgggttcgagcccgcccggtacctggatcgagccgatgggatagcaggcgtcgacgatgttggacgggtccgagcctgcgccgaatggctgttcgcgcggctcgaaccggagcgccgtgccgcccttgaagcggtagccggtgcggtccgcctccgaaccgacggtccaggtctcggcgaagaaacgctcgaccgcgtcgggggtcaggcgatggacgtagagtccgggaaccacccgcaagctcacctcgccgccgacctccacctgcagcgaacgcggcagcgccaagccctccacggcagagggcgaggcaggccccagaggcagcaggtcgccctccgccagccgtcgtccctgcaagccaccgatcgcccccagaccgtaggtcgaacgactgcccagcacctcgggtaccgcgatgccgccgtcgatggcgagatagccacgggcgccggcacgaatgaaatcgaaccccaggacctggccggcgcgaacccggaaggaagtatccagcggcatctccgcgccctccaggcgaggcgtcatgcgcgccccgcacacggccaccaaggcgtcgcgctggaactccagctgcggccccagcagcgcgcactccaacacggcggcggtcggtgcgttgcccaccagcaagttggcagcgcgcagggcatactggtcgagcgcgccggacggcgggatgcccaggtgatagtggccttcgcggccggcgtcctgcaccgaggtggcgaggccgggcttgagcaccttaatcgacatacagcacctcctgcagatgttgcgtgcagcctcgcggatcggcaaggaacgcgtcgagatcgaaactcaccggacggatgcgcaggtcgaatgtgcccgcttcgacttcggccgccatgcgctcgtactcggtccgctcgatggggcggaactggacgatgtcgccagcgcggaagaacaccatcgattcctcgagatagggcaggccctggcggggatcgaagatcggcgccggagtcacgccgaacatctgatagccgccggcaccgcgcaccgaatagatgcagccgaagcaaccgccgtggccgagggtcagcttcggcgtgtcgatgcgcggacgcaggtacttgggcacctgcaactgccgctcgcgctcgaccatctggtacatga

SEQ ID NO: 3352 - DNA, 1095 bp, Pseudomonas aeruginosa
  unsure (662): Identity of nucleotide at the above locations are unknown.
acaggcgatcgcgccctggcgctacgcctttccgctcgacagcctgatcaaccgcttcaagcaccaggcggcctggccgctggggcggctgctcggcgagttgctggcggaacacctgcggcaacgctacgccgaaggcctgccgcgcccggcacgcctgctgccggtcccgctggcgccacggcgcgaacgtcgtcgcggcttcaaccaggcgcaacagctcgccgagcgactggctggcgagctggacatgcgctgcgatccgcacagcctgcggcgagtgctggatactccggcccagcagggactggacgcgacggtgcggcggcgcaacctgcgccacgccttcgccctggcgcccgccagcgatgttcgcgggctgcacctggcactggtggacgacgtgctcaccaccggggccaccgccgagcgcctttcccgcctgttgcgccgggcgggcgccgcgcgggtcgacgtctactgcctggcgcgcacgccgaagcccggctgagctgggctaaactgccgcgcaaccgatacgggagaggatccatgcgcgcactgctggtcgcggcctgcctgttgctcggcggttgcagccatttcgccgaagacgactggctgggcgaagacaaagccctgcatttcgccagttccgcggnccttgccgcggcgggcatgcagatggctcacgaccgcggcgtgcgcggcgctcgccaggcacgcttcggcctgagcttctccctcgccttcggcgtcggcaaggagttgtacgacagccgttccgccggcagcggctggagcctggaaggacctcgcctgggacctggccggcgccgccgccgggtacggtctgtaccaggccgccgagtgacgcccttgcgttttgcccatggctgttggagccttcgccgtatacgtccgctcatagcgaagcctccatgtccgcactctccactctcgcccagcacgtcacccgtcgcccgcaacgcatcgccctgctcgcgcagatcgccgaactgggctccatcacccgtgcggcgaaggccgtgggcatcagctacaagggcgcctgggacgccatcgacgaactga

SEQ ID NO: 3353 - DNA, 648 bp, Pseudomonas aeruginosa
tcgcctccttcgatccggcccaggtcctgctcggcacgccgctgtgaacctgccggcccgcgccggcttgcgtacactaggggtctttcgagccttggatgccccgtcatgtcccatcccttcgaccaactgacccccgacctcgtcctggatgccgtggaaagcctcggctatctcagcgacgcacgggtgctggcgctcaacagctacgaaaaccgcgtgtaccaggtcggcatcgaagacggcgagccgctgatcgccaagttctaccgaccggaccgctggagcgacgcggcgatccgcgaggagcacgctttatccgcccgagctgggcggaatgcgaggtgccggtggtggcgccgctgtcgcgcgacggcgaaagcctgttcgcattctccggcttccgcttcgccctgttcccccggcgcggcgggcgcgcgcccgagccgggcaatctcgaccagctctaccgcctcggccagttgctcggccgcctgcacgcggtcggcgccacgcggccgttcgagcaccgcgaggcgctcgctgtggataacttcggccacgcctcgctggccaccctgctggaaggcaatttcatccccaggagcctgctgccggcctacgagtcggtcgcccgcgacctgctga

SEQ ID NO: 3354 - DNA, 639 bp, Pseudomonas aeruginosa
  unsure (593),(594),(595),(597),(598),(599),(604),(606),(607),(611): Identity of nucleotide at the above locations are unknown.
gagaaggcacaaaacgtagcaagaagccaaagacagaaggaaaggcgagagggaagagccagaggcgaaggatacggaggaaggaggcgtagaaagaatgggaatgcagagaaccgaccgaaccacaaaccaagaaagagctcgaccacaatgcacaaggagaaacagcggaaacgaaggcgaagaccgaagcaacaaaggcagagagcacgagagagacaaccaaaacaagggaaacaaggacaagacgacaggcgcaggaagcaaccagagaaccggcagaaaggcacagggagccggaaaagagagcagacgaagagacagaagagaggagaaaggacaaacaaccgggagaaggccaaacaaagagggaaaaggacaaaaagacacacaacaaggcaaaggagagaggaacagcaagaagacaagaagaacaacgacagacagacaaagagaggaagagacaagaaggacaaaaaggcggaaacgaaaaaacagggaggaagaagagacagtggggcaacgggaagaaaaaagacagaaaggggccagaacagacaccaaacgagaagaaaaaaaaagagagagcccgnnngnnnaagcnannacanatccccacccgactctgggggcctatag

SEQ ID NO: 3355 - DNA, 246 bp, Pseudomonas aeruginosa
tggcctcataaacggctccatggccaaaaggtacaaaatcggtacagtactggttcgccagtctgcctttggagtccttatctgatggcaacaatcgcccccccttcccgtggtccgcaaaacggattggccgaccaacgaaaaaccttccgcaccaagcgcgacgccgaagactgggcacgccgcaccgaagacgagatggtacgcggcgtgtacatccagcactgcggctccgagcgcatgtga

SEQ ID NO: 3356 - DNA, 1131 bp, Pseudomonas aeruginosa
atatcccttatgaacgacccactctggatctggcagcagcccgactggccgcagttcaactggcaagccgaagcgcttgcaccactgctgcgctcctgtagccaggctcagggtcgtttgttaggaatgctcggtgccgtggggagtgacaccgaagtgcagagcagcctggatgccatgctgcagaacatcgtcacctcttcagccattgagggagagcaactgaatgtcggttcggtgcgctcatcactggcacggcgactgggattgcaagaagaaggtcgaaccacctctcgctccgaaggcctggcggaactgctgctcgatgccacccacgcacatcaagagccgctagacgaacagcgactgttcacctggcacagttggttattccccaccgatgaccaactgctggctcgaccactacacatcggcgcactgcgcggcgaagagcccatgcaggtagtttcgggtcggatagaccgccctaccgtacatttcgaagcccctccctgcgcagggttggaagcgcaactggcggactttctcgcctggttcgaaagcagccgcagcgatgccaacctcgacccgtttctgcgcgccggtatcgcacatttctggttcgtgaccctgcaccccttcgacgacggcaacggtcgcctcacccgcgctatcaccgatctggcattggctcagggcgagcagcaagccattcgcttctacgctatgtctgcgagcatcctcgacgaccgcgccggttactaccgcattctcgaagcaagtcagaaaagcacgctggatatcaccaactggctgcaatggtttctcgcgacgttgctcaacagcctggagcaggctcttgctcgtatcgaccgcgtgctggtcaaggcgcgcttctggcaggcacaccgcagccaaaccctatcggcggagcaagtcaaagtgcttaaccgcctgcttgatggcggcgaaaggggtttcgaggacggaatcagtgccgctcaataccaagccgtggccaaggtatccaaagccaccgcgacccgtcacttgagcgacctgctggaaaagggctgcatcgagcgactgcccggcggagggcgtagcacccgttaccagatagcacgctga

SEQ ID NO: 3357 - DNA, 864 bp, Pseudomonas aeruginosa
aatcaattagccattatccgaatcagtgccaggcaactggatttcggcacatctgctcgcccagccatcaagcagctctgctcaaggaagaaaatggattacagcccgatagtcgcccaggcctggggcatgctgacctggtttatcccggcggccctgctgatcagcctgctcaaatcgccttgggccaaggggcagatcggcgaactgctggtgcgcctttttgcccattggcagctggacaagcaaacctaccgccgcctacacaacgtcaccctgaacacgccggacggcacgacacagatcgaccacgtattcctctcgccctacggcatcttcgtgctggaaacgaagaacatgagcggctggattttcggcagcgagaagcaggcgcagtggacgcagaagctctacaagcgcacgttcaaattccagaacccgctacgacagaactacaaacacctcaaagtcctggaagccacctttggcgttaaccccgagcacctgcactcggtgatcacctttatcggcggcagcaccttcaaaaccgaattgccgaccaacgtcacccagggcattggctttattcgctatatccagtcattccagcaggcggtattcagcgaagctgaagtcgaagccatgctgcaagccctgcaaaccggccgccgcgcaccaacactcgccactcaccgcgagcacgtgcaaaacctcaaacgccgaagcgatccgacagccgaacggcaatgcccgaaatgcggaagtgcgctgttggttcgcacggtgaaatcagggccaaaggcggggcagcagttttggggatgctctgcgtttcccaagtgcagaaccatgcagagtctttga

SEQ ID NO: 3358 - DNA, 2736 bp, Pseudomonas aeruginosa
ctcaaacacactccccttatacagaaaataaatctttccccatttcttataccgactgctcaccaccggagaaaaaaattgaacagcgtagtacccatagtaaataacgtggaggttctcatcgacctgaatcagggagacagtgccaaggcgctagaagcccgcgagatggttcagcgtagtcactacgaccatctccaccaacaaattagtaagcatctccactcaccggacgctttgtcgctagagcaaaacttgccgacagggagcggctggactcattttatcgacggatctcggggagcaggcaaatcgactttcttgcaatcggtaaggcgagccctgaatgacgacagcgacttaagaacaaagctggcattcatcgccgtaattgaccccagtcgaattgagcaaagcgagattatcctactcgtcatgctccagcgccttagccagcgggttgaagaggttcttaaagtgatgcgtagcactgaacaggaggagcttcgtatccggtggcgcaaggcattcaagagtgtggcaggagggttgagcctattcacacaggggtatcatcctcttaacgatctagaccctgaactattcctagactggggcatggagcgcactagtgacagcaccagcctgagagagaaactccactacctttttgaaactgcgtgcaagattcttggcgttaaattgctgatgtttggctttgacgatgcagatacagatgccactcatgcgattaatctgctggagtgtattcgtaagtacctagacaccccccggctcatggtgctggtcacaggcgacatggaactctactcactactagtaaaccaacacttcgccaaaacagtcgcaggaaaacgagatgcggcttttgagcttgtgcgcgactcaaaacctggagatcgctcgggccagtatttacgtatgatcgaccaccttgaagaacagtacctgctcaagctctttccagttaaccggcgcttgcagttacagcctttatggaatatcgccaagggcaacgaaaagtgtgaagctgaatttatagattggggcaccaagaagatccctgtcgaaagattgatgcggaatatcgtgcaacgcggcctacgcattaagtccgagcctgacgtcactctatatacagagtttctactcaagcaacccttgcgctcggcgctacaaattctaagcaattgtgcaccctatctagataagaggtccatcgagaatacatcggataactggtctaaagaattaagtgaggcactcaatcgcgccctgcaagccttggcactgaccagcttctacaagcactctattaacaccgacgctctcgcagcgaaggatctagatgttttaacccaaactgtttttgatctgtcactggaagacggagacctcgacaccgcaccatacctgcgtcctatgtccgcaaggcaagacatcaaagccggttttaccgcattagcagcagaagttccctgtctttgcgcccagcagccgggaacagcacttcgctatttattgcgagcccccggcagcgtttcgctctataatctcgcgagcccacacttaatcaataaagatggcgataagggctcggagaattcgcaagcatctgtataccatttcaaatcttacatgggtattggacgccaggaagatagcctcgactgggcacggcgtgccaccgccgttattgccctgccttacagcggaggacagcaacaacgcgttgtgcttcccggcgtaatcgggatcatgaatcaaaaagggaaaaagggagagatcagcgctcagacagcgatcggacgcgcgatagcgagccaatcggttcaagcactgccagttcttgccttaggtatgatcaccgttgtgaaccagccgaactctcgtacctatgcgtccatttttactctccttggcctaatcgaaaagctactttcagctggttctaatagcacgctgaacgcaaagaccgttttttatcgggcctaccctactcttaccatctccggccccaactggatgcgaaaaggtgtcgattcaacagacgaattcaacaacgataggctacccgacgaagaagataaaaaatataaggagaaacaagaagccctttggagccaaattcaaagatggctagaaagcctaagtgatctgactccggaaaccacaccttcgggagtttttttgggaaaggtttggacacgcctgttcttcagcctccaaaacgccgccgatgatctgaggtccaacgcaacgctggacacagtgatggagatttttgcgctctgcgccatcaatgcgttttgggtcgaagaatctgaacagcacctcccggcctcatcacctaaatcagagagccgcgcaacagtagacagaaaaaatccaaaaaattcggcaggatggtttgttgacaaacttacttcttcacaactacaacggaagaatcttccttatacagccatcatggcaacctgcccgcttcttctaggtttactagacagcaagctaagctatgccgaagctctgaaaccattttttccagaaggtacacaactggatgacatccgagtattactgtgcccatctgatttaaaaaaacttatgagcaatgtatctgttacgggcaagtctcgtcgcagagcccagaactctgcaggggagacgaaaaatggtacagaggatgctgggcctggagatgacaggcaatga

SEQ ID NO: 3359 - DNA, 798 bp, Pseudomonas aeruginosa
ctgagggggctggcgcggggtgatgcttctcgctccgcgccggtcctcatgcccctctccccgaagggagagagggtcggccatgccagcgggcaatgccgtgccaggctggcaagccaaactgtcgttcaagctgaacgatcctgcgcaataatgagccccttccaccagcaaggaccgctcatgaccgaccgccttccctgccgcgcctgcggccatctcatccttccaaccacggcggcgaggaacgacggactgtgcatgccctgcaagggcggctaccggcagaacatcgaggatggcaagcgcttccacgcggagcgacggcgctacctggcgagtccgcaggcgctgtactggagcgcgctggtgaatcgcgtctacgatggccgcgagggattcgccgggctgtcgccggccgaacggagctactacgcagtgagcgtgctcagcggcgaagtgcacaacggcggcttcgaccagtacttcggcaactcctccggcgaccagtaccaggcggcgcgcgcgggtcttcgcgaattggaggcggaggacgccctggccctgctggagcgagccgccgccctgctgttcggcgacggtccggtgccagtctcccaggccgaacgccaattgcgcatgccgacctgggccgatgaacccgaccgcgactgcgaagcggccctggatgcgctggacacgcgcttctacgccctggccgacgcgctgggcgaacgcctgctggcccatgcccgccaccatgcattgttcgccctggacgagcccgatgaagcctga

SEQ ID NO: 3360 - DNA, 657 bp, Pseudomonas aeruginosa
gccggcgttttttcgcgtcaccctatgactgactcccgccattcgcggagggttcaaccgcaacggtactcgccgcctgtcacgcgcagcggtacgcttgagcctacgctcatgcgagcggacaacccgcaaggaacatccatgtccgacctgcccccgcgtcccgccttctggccgtacctgccgggctacgccctgttgctgctttcggtgctgctctgcgccagcggcagctaccgtttcgtcaccccgatggcgctcgccgacggcgtcgacctggtctacctcagccagggcctggcgctgctaccgctgggtaccgggctggtcggcctgctcgcgggcttcctcctgcatgtccgcgggcgctggctcggcgcgctgctggcgctgctgccggcgacgctgatctgcgcctggaacctgtacaactatgccgcccacggcgacgaggcgttgtcgccgagtttcgcccagtacacccaggcgctgctcggcctgctgctgctcggcggcgtgcttagcctggtcgacctgctccacggcaggccctcgacgctgctgcgcaagggcctgctggggctgggctggctggccctggtggcctggctggggttgctgttctacctgcagcgcctgtacggcctcactttttga

SEQ ID NO: 3361 - DNA, 1071 bp, Pseudomonas aeruginosa
tattctccgttgctttcgcgccgggagtggcgcgtcgggttaccagtctcgaccagtctggaccgcgccgcctgcccatgcgtctctactttcgacctgatcggctcatcccatggacccactcgaccggctcatccagctcgccaacctgcagggccgcctcgaccagcgctgccagctacagggcagctgggcgctggagcacccgcaagcggtgcccggcgaggcgaccttccatatcgtcatggccggcacctgctattgcgaattcctcgatggcggtcgcctcgacctgcatcccggcgacctgattctgttgccacgcggcaccccgcacctcctgcgcagcgacagcccggcgcaaccctgcgaacccaccgtagagcaccgcggcagcatcccgctgtaccagttgaacggccctggcgaggccctcgacatgctttgcggcagctaccgctatcacgccggtgccagcctgttcggcgcgctccccgagcgcctgctggtgcatatggacgagtcgacccagcagcccctgcgcgcgctgatcgggttgatgcgcgaggaagccgagagcacccgcagcggcgcccgctcgatcatcgacgcgctggccaccgcgctgttcgccctggccctgcgcgcctacctggaccgccaaccgctgggcgacggcctgttcggcctgctgggcgacgcccgcctgggacgagccctgcgggccatgctggaacgcccggagcatgcctggaccctggaacagcttgcccagcaggcggcgatgtcgcgggccagtttcgtccgcgccttctccgccctcggcggaacctcgccgtggaacctgctgacccgcatccgcatggagaaggctcgcggcctgctgcgacaaacgcagaagagcctgctggatatcgccgccgagaccggctaccagtcggaggcggcgttttcccgcaatttccgccaggccttcggcgtatcgccgggccgtttccgccgccaggccgactccgctcgctgaaagcgctaccggcgcacatttcggcgatccgctgctatgcaatgtga

SEQ ID NO: 3362 - DNA, 678 bp, Pseudomonas aeruginosa
cccatgccccaccccatcgacgcactgatttccgactgcgacggcgtcctggtcgacagcgaggtcattgccgagcgcgtgatgtacgaggcgctcagcgcctacgcgccgctggaggagctgcagcgcctgctggaaggcaccttcggcctgaccagccgcgacatcctcgatcgcgtcgagaagcacttcggcctgcgcatccccgacagcttcaaccgcgaggtgcgccagcgcagcgaggagatggtcgcccaggtccaacccattcccggcgcacgcgaggcgctgctggccctggacctgcctgtcgcggtggcctccaacagccgccgccacagcctggagcgctcgctggcgcgcgccgggctcagcgaactgatcggcgaacgcctggccagcgccgatatggtcgccctgcccaagcccgcacccgacgtctacctgcacgccgccagcctgctcggcgtcgcccccgagcgttgcctggtggtggaagacagcagcaccggcacccgcgccgccctcgccgcggggatgcgggtgatcggcttcgtcggcgccgggcacattcccgccgggcacgccgaggtactgcgcgagctgggcgccatcgccatcgtcgagcacatgcgcgaactgccggagaccgtggcgcgcctgcgccggacagtctga

SEQ ID NO: 3363 - DNA, 1317 bp, Pseudomonas aeruginosa
gcctggaggtacttgagggggatcatgcacgggtccggcggttcgcggaaaacgcccagtgtaccgcgtcgggagctccggcggccgaccgccgcttcgggtaagatgcgcgccgtttccgatgagcggagtgggacagtggcaagtacagatgtgctgatcgttggcgccggggcggccgggctgatgtgtgcgatgacggcggccggacgcgggcgccgcgtgcgggtgctcgaccacgccaacaaggccggcaagaagatcctcatgtccggcggcgggcgctgcaatttcaccaacctgtacaccgagccggccaacttcctttcgcgcaatccgcacttctgcaagtcggcgctggcccgctacacccagtgggacttcatcggcctggtggccaagcaccaggtgccgtaccacgagaagaaactcggccagctgttctgcgacaacaagtccagcgacatcctcgagatgctgctgcgcgaatgcgccgaggccggagcggaaatcctgctggacacctcgatcgaagagatcgcccgcgacgacgccggctaccacctgcgtaccagcgccggcgagatgcgctgcgagtcgctggtgatcgccagcggcggcctgtcgatcccgaccctcggcgccagcggtttcggctaccaggtggcgcgccagttcggccacgaggtgctgccgacccgcgccgggctggtgccgttcaccatcaccgaccagttgaaggagctgtgtgccgagctttccggcacctccgtggattgccgggtgagctgcaacggccaagtgttccgcgagaacctgctgttcacccatcgcggcctcagcggcccggcgatgttgcagatttcctcctactggcaaccgggcgataccctggaaatcgacctgctgccggaccacgacgccagcgaatggctggcgcagcaacagcgcgagcgtcccaacagcgagctgaagaccctgctcgccgagctgctcaccaagaagctcgccggactgctggccgaccgctggttcgtctccaagccgatgaagcagtacaccccgaccgaactggcgggtatcgccgggcagctttcggcctggcgggtcacgccctcgggcaccgagggctaccgcaccgcggaagtgaccctgggcggggtgagcaccgacgaagtgtcgtcgaagaccatggagtcgcagcgctcgccggggctgtatttcgtcggcgaagtactggacgtcagcggccacctcggcggcttcaacttccagtgggcctgggcctcgggttatgcggcggggcagtacgcctag

SEQ ID NO: 3364 - DNA, 708 bp, Pseudomonas aeruginosa
cgctgggcctcggcgctgaaaccttgctgggcggcgctgtgtacggacgacatgagggacctcctgggcggcagggaaagcccgaggtatagcacagcggttttcctccgaattccagacgaacggttcaaagccttgcgcagcgtggctcgcagccattggtcaggggcttcgtggacctctcggggaagaggctattgtcgatccgaaggcccacccgacgaccagggtaaaagcatcccggcacacgccggcgtcccccgccacaaccaggagtcagccatgagcagcgaagtcagcgccatccgccaattgatcgaagactggcgagccgccgtccgcgccagcgacgttccgcgcatcgtctcgtactacgcggaggacatcgtcgccttcgacgccatcctgcaattgcaattcaaggggcgcgacgcctaccagaagcactggcaggcctgcaccgagatgtgcaaaggaccgatgaccttcgatatcgccgaactgcagatccatgccgacccgcaggtcgccttcgcccactacctctgccactgcggcggcaccggcccggacggccagccgcactcctcgtggatgcgggtcagcgccggctaccgcaagcacggcgacggctggaaggtgatccacgagcatttctcggcgccgttcgacatggacggcaaggcgctgttcgacctgcagccctga

SEQ ID NO: 3365 - DNA, 1368 bp, Pseudomonas aeruginosa
ggagccagcggcgcatcggatttccccggggcggatgtgcaagagccccgaccagcggggctcccgttcgaacgaaggcgcttagttgaccttcggatccagctcgccgcgagcgtagcgctggaacatgccttccagggagatcggcttgatcttggaagcgttgccggcggtgccgaaggcttcgtagcgagcgatgcagatgtcgcgcatggcctcgacggtcttggagaagtacttgcgcgggtcgaactcgctcgggttctgcgccaggaagcggcggatggcaccggtggaggccaggcgcaggtcggtgtcgatgttcaccttgcgcacgccgtacttgatgccctcgacgatttcctcgaccggcacgccgtaggtctctttgatctcgccgccgtactcgttgatgatcgccagccagtcctgcggtaccgaggaagagccgtgcatcaccaggtgggtgtccgggatgcgcgcgtggatttccttgatgcgctggatcgacagggtgtccccggtcggcggcttggtgaacttgtaggcgccgtggctggtgccgatggcgatggccagggcgtcgaccttggtcttcttcacgaagtcggcggcttcttccggatcggtcagcaactggctgtggtccagcacgccttccgcgccgacgccgtcttcctcgccggccatgccggtttccagggaacccaggcagcccagctcgccttccacggacacgccgcaggcatgggcgaacgccacggtctgctgggtcacgcggacgttgtagtcgtagtcggcaggggtcttgccgtcttcacgcagggagccgtccatcatcaccgagctgaagcccagctggatggaacgctggcagacgtcgggactggtgccgtgatcctggtgcatgaccaccgggatgtgcgggaattcttcgatcgcggcgaggatcaggtggcgcaggaagggcgcgccggcgtatttgcgagcaccggcggaagcctggacgatcacgggcgaatcggtcttgtcggccgcttccatgatggcgcgcatctgctcgaggttgttgacgttgaaggccggcacgccgtagccgaattcggcggcgtgatccagcatctggcgcatgctgatgagtgccatggttctcgtatctcccaatcgcggggtcgttcagtgattcagaagcctgccgcaggggcaggcccggttcaagttccttgcgaggagcggtcgcggcgccgcgcccctgccggcgcgactcagcgcgccttgcaaccgcgaccgatgaggtcgtcggtttcgacccagtacaccaggccttcgtcgttctccaggtggaagcccaggcgtccgtcgctatag

SEQ ID NO: 3366 - DNA, 789 bp, Pseudomonas aeruginosa
gagatccgctcggcgatgccgtacttgtcgatcgccgccagggtatcgccgccgccggcgatggagaacgccgcgctatcggcgatggcattggccagggtacgggtgccctcgccgaactggtcgaactcgaacaccccgaccggaccgttccacaggatggtcttcgaggtcttcagcagctcggcgaactgcgcggcggtctgcgggccgatgtcgaggatcatgtcgtcatcggcgacctcggcgatggccttgacggtcgccacggcgctctcggcgaattccttggccaccaccacgtccaccggcagcggcaccttgaccttggcggcgatggccttggcggtctcgaccaggtcggcctcgtacagtgacttgccgaccttgtgtccggccgcggcgaggaaggtgttggcgatgccgccgccgacgatcagttggtcgcagatgccggccaggctgttcagcacgtcgagcttggtggaaaccttggagccggcgacgatcgccgccatcggccgcgccgggttgcccagcgccttgcccagcgcgtccagttcggcggccagcagcgggccggcggcggcgaccttggcgaacctggccacgccgtgggtcgacccctcggcgcggtgggcggtaccgaaggcatccatcacgaacacgtcgcacagcgcggcgtacttctgcgccagctcgtcagcgttcttcttctcgcccttgttgaagcgcacgttctcgaacagcaccaggtcgcccgccttgaccttgacgccgtcgaggtag

SEQ ID NO: 3367 - DNA, 1329 bp, Pseudomonas aeruginosa
actacccctacctgttcgagctactcgaccggctcggctaccagggctggatcggctgcgagtaccgtccgcgcggcgacacctcggcaggcctggaatggctgcggcgctggcgcgctactcgacgcgacggatgatcggctccagcgcgtccagacgctcgcgggcggccagccagtcgcgcacttccgcgcaccactgttcttccttcagcaccgcgcgggcacgggtcagcactcgcggccagggacggtcgtcgaacaggcgcagcagcacctggttgagctgttcgctatccagcggccggcgtccacggcgcaccggcgcgtcgacccgctgcgccagcgattgcagcacccgttcgcgctgcgccgtatccaccggcatcggctgctcgtcgtaggcacagagcaccaggatctccggcgcgacgttctccagcaggccggcgcgcagccggcagtggccatcgaggatcacgcaggcatccaggcagttcaggcgcagcgccagcaccggcggcagctcgccttcgcgggccttcttgcgccaccacttgacccgcccctcgtcatcctcgacccggcgcagggcgatcagggcgtcgttgtcgcgcccccaccagtcgagccactgcacccagtcgtcgccgaggaccttctccaggctgtagaagcgccagtccggcaacagtgcgtcgcgcccgacgctgcggtagcgccagcgttccagcacccgttcgcgcggatcgtggctctgcggtggctgccaggcgggcacctgctcggcgagcgacaggcgcagcaaccagcgcccggcctccaggcaactgcccgggctggtacgcagggtctcgacgaaatagcggctccaggccttgtagcgggcctcgccgcgcaggccgcgcaacgcttccagggtcggcgagtcgatgggcggcacgctggcctgcgccgggctcgccgcgaccaggctcttcaccagccagatgccatcgtggtacggcaactgggtggcccagagcagcggctgatcgccacgcatcaggcgaatgcgggcctggccgccggattgcagatgaaggaaagagggcgcccgatgggcgccctccacctggaccgcgaggcccagccattcgccattggcggggctttcgaggtcccgccagtagagcgtgtgcatcagtcttccagcagctcctcggctaccgccaggacgttgtccagggtgaagccgaagtgctcgaacagcgccggggccggcgccgactcgccgaagctggtcatgccgatgatgcgcccgtcgagaccgacgtacttgtaccagtag

SEQ ID NO: 3368 - DNA, 363 bp, Pseudomonas aeruginosa
tcgcgccagaggacctcggcgatatcggccatgcccatcggggcgcccgggtggccgctgttggctttctgcacggcatccatgctcagtgcacggatggcattggctcgctcacgacggctgggcatcgcaattctcctacgggggttgctggtcggaagaccaggagtgaaaaaaagggcgccattttcgcccaccgaaggcccaaggggcaatgacagatcggcagggggacagtatgtcgctgccgaccggttttgccagaagcctggcgcagccggattgcaattgcgcgacggccacccgtcatcaatatcaaaaatttttgatacaggcattgccggggttcggacccggtactag

SEQ ID NO: 3369 - DNA, 1434 bp, Pseudomonas aeruginosa
ccgtggacggcgataccttcaccgcgttcacctgggagaagaccgacaaggccgctctcctgcgcgacgccgccggcctctgagcgaccgcgcgataaaaagccccgcttcggcggggctttttcgtttccggcaggctcagcgcatgcggaaggcttcctggtggaacagccgcagcggcatgccctgccggcgcagatcgcggcgcaggctgtcggccagcccctgcggaccgcagaaccagacgctcggccagcgtccttcggcgctcttcagcacgcccagttgcgccgcctgcggcttgccctgctcgtcgctatagcggatgtgcagggtcacgctgggcaggtgttcgcaaagctcgcgcaagcgcccggcgaacagcgcttcctgggaattgcgcacgcaatagtgcagctccaccgatggcgcgctttccggcgcggcctgcagcgactccagccaggcgatgaacggcgtcacgccgatcccggcggcgacccagacctgccgcccggccaggccacggcggaagtcgaagcagccgtatggcccctccacctcgaccctggcgccgacctccaggttgtcctgcaggcgccgggtgtagtcgcccaacgccttgatgctgaagcgcacctcgccgcagccgcggtcggcgctggcgatggtgaacggatgggcaccctccaggcggtcgcaggtgagaaaggcgaactgcccggccctgtgcgaccagtcgccctgcagccggcaggtcacctcgagcaggctttcgccgtgccgctcgacggcggtgaccacgcccgcatggcgacgcgtgcgaccgatccgcccgctcagagacaacagtgcgcaggccgaaccgagcagtgcgcaggccgccaccagccaaccggccggctggctccagtagctggccggggcgagcaccacggaatggaaggccagtaccaggtagaccagggccaacgccttgtgcacataacgccagaggtgatacgggaagcgctgccagagagtgaccagcagcatcccgccgagaatccacgccgaccattcacccaactccttggccgagccacggaagacatcgaggaaggtttccacccgcgggcctttcaccggtttgccgacgatacccgccagccaggggccggccaactccagcaggtagtgcaacaggccgaggacgatggtcaggatgcccgcccacttgtgcaggcggtacatgcggtcgagcccgtccagcggcttctccagccagaccggacgcaccgccagcagcatgatcaacgacatcagggcgaaggacgctaccccggtaagcaggatcgcctgcttgcgcaccacccagatgtccaggctcgccggcggatcgacggccagcgtcaggccccaggccgccagcgcggcggcgagaactccccataa

SEQ ID NO: 3370 - DNA, 825 bp, Pseudomonas aeruginosa
cctgcgtcaatcgttgtcggccttcaaccccggggtgggcggagctatgctggtccgccgcgcctaccgccgagccgtgccatgaagatccgcctgctgtccgacctccaccacgaacatttcgacgggcgacgccaactgccagaggtcgaggccgacgtggtggtgctggccggcgatatccacagccacctggaaggcctgcactgggcccgcgagaccttcgccgacagcgagatcgtctacgtcgccggcaaccatgagttctactcctcggaaatgaccgacttgacccaggcgatgcgcaatatcgcccgggcgctggagatccacttcctggaaaacgacgaagcgcggatcggcccggcgcgcttcctcggcgccaccctgtggaccgacttccagctctatggcgcggacggctatgcacccgcccatgagctggccctacaatcgatgccggacttcagctgcatcgactggttcggtggcgacttcacccccgagcagagcatcgccctgcaccaggcctcgcgcgactggctcgccgaacagctggcgcggccccacgacggcccgacgctggtggtcagccaccacgcgcccagtgcgctgtcgatcccgccgcagttcgtcggcaacccactgtcgccagccttcgcttccaacctcgacgaactggtggcgcaggccgactactggctgcacggtcacgtccacgacgccctcgactaccgcatcggccgggcacgggtgctggccaatccgggcggctatccccacgagagaggcgggttccgtccggaattcgtcttcgaggtctga

SEQ ID NO: 3371 - DNA, 747 bp, Pseudomonas aeruginosa
gcctcagcgcggcaactggctgaagaagcgccagatttccactggcgcgtccagttccgggtcgctcttgccgagaatccgcgggaagcgatagtccggctgcgccagcacgtggccgccgccatgcacgctgagcagctccaccggcggatggccgtcttcctgccagcgctgtcgctcggtccagaccgggccgggacgggtcagcggcgccacgtccggcggcgctgcgatgccgttcaggccggcccaccagcgtgccgagtccagggtcgagcgtaccgcgccccggtcgccgaagccgaacaggctgaccttgccgccgagatagggattgatcggatcgcgcgtgccgttgatcagcaacgccgcggtcggccgctcgaccggccgacaggcatcgttccccgtggtcggcaggctcgccgccaccgctgcgatcgccgccggcaaccccggcgcttcggcggccaggcggaaagccatctggccgccattggagtagccggcgacatatacccgctgcgaatcgacgcggtattcctgggccagccgcgccaccagcgcgcggaggaaagccacgtcatcgacgtcacgcagccgcgccgaatagctggcggccttgcggcaatcgttccagtggccctcgaagccgtccgggtaggccaccaggaaaccttcttgcgccgccagccggtcgaagccgtagccgctgatgcggcgcatctgcgcgccgtcgccccgtga

SEQ ID NO: 3372 - DNA, 630 bp, Pseudomonas aeruginosa
gccgggttgtgccggaatgcccgaaccatggcccttctccagagaccccggggcggcgtactttgctcccggacaaccacaaccgtgccgtttgctggcacacttgcgcctttgtcacgccggctgccgcctgcctcatccgcctgccaggacgctcggccgagccgtcgtccggcaaccgcaccggccgttcgatcaaggagccaaccgatgtccattcgtccttcactgccgctggccgggctgctgctcgccgtcgccctgccgctctctgccgcccagccgggcgccgccaaaggcgccccactcagcggttgcgccgccaagcaggccgccatcgaggcgaagctggaaacggcccgctcgttcgccaacgaaggccaggtggccggcttggaaaaggccctctccgaggtcaaggaacactgcaccgaagccggcctgctgagggagaacaagcagaaggtgatcgacagcgagcgcgaggtcagcgaacgcgagaaggatttgcgcaaggccatgggcaagggcgatccggagaagatcgagaaacgcaaggccaagctggctgaggcccgcgccgaactggaagaggccaagaaaggcctggaacaggcccaggcgcagtag

SEQ ID NO: 3373 - DNA, 864 bp, Pseudomonas aeruginosa
ttgtggaactgcaactcaagctggcgccgctcgttctgtaaaggcacagccccttcagagcttcatcagcagcattccggccagcaccaggccgcacgccagcaggcgtggcagtccgaacggctcgttgaggaagcgcatgccgaacagcaccgccagcagcacgctggtctcgcgcaacgctgccgcttcggcgatcgaccccagctgcatggcccacagcaccaggccgtagctggccaacacgcagaccccgaccgccaggccgagcttccactccagcgcccagaagcgggcgaaggcgcgggttcgcgcgccaacggcgatcagcgggaacggcaggccggaaagcagcgtcagccagaccaggtagtcaagcgccaacggccagcgcttcaaggcgttgccgtcgctccaggtgtagccgccgatgcacaggccgatcagcagcaccaccggcagggtccgccagggcagccgcgaaccgccgccgccccagagcaggcaaagcatgccgaaggggatcaacaggatgccgaggatctgccggccgctgagctgctcgccgccgaacgccagggtcaggcccagcaccaccagcggcgacagcccgcgcatcagcggatagaccaggcccaggtcgccgaccttgtaggcctcgatcaacagtacccggtagagcagttgcaggacggtggcgccgagcagccagggccagacttcggccggcggcaggctgacgaagggcaacagcaggatggcgcagagcacgccgaccacgtccatgcaggcgaccaccagcaagcggtcgctgctgaacttgaccagggtgttccaggtggcgtggagaacggcggcgcatag

SEQ ID NO: 3374 - DNA, 708 bp, Pseudomonas aeruginosa
tctatcccggcggaggctccaaatgctcgcctcgttgcggcgtttttccctgaaagctcctacgaaagcggagaaacatgcagcagacatcgttacgtcaaacggcttaatcttcggacaatcctgatggactaccatcggccagcgccgcacagtgccggcccggcctcccttatcaacgacacaggaatccctgccttgagcgctctcctcaagcccctcgacaaccgcttgttctggcccgcggtcgccatcggcggcctgctgatcctcgctttcgtcctctacctccagcacgtgcgcggcttcgcgccctgctcgctgtgcatcttcattcgcctggacgtgctcggcctggtgctcgccgggatcgtcggcagcctcgccccgcgttcgcggatcgccggcggcatcgccgcgctgggcatgctcgccgccagcctgggcgggatctaccacgcctggtcgctggtcgcggaagagaaactggctgcccagggcatgggcagttgcaagatgttcatgggcttccccgaatggataccgctggacacctggctgccgcaggtcttccagcccgaggggctgtgcggcgaagtggtctggaccctgctcggccagtccatggcggtctggtcgctggcgctgttcgtgttctgcctgctggccctggcggccaagctggcgttcggccgccgcaccgcctga

SEQ ID NO: 3375 - DNA, 906 bp, Pseudomonas aeruginosa
tgcccttgcgcttgcgcaattcgcgcaccaggctggcgatctccgccaggtcgtcggctacttcgctcatctcggctccaggccctctcagaacaggtcgcgcaaacggtaatacgctttgcccagggcttccagcggcgcggcgaagcgctggccgccgggaaacttcggattgcgcaggcgctggtagagcgccagggtctcgtcgtcgccgagcagcgcgtcgctgaccgccctggccgccgccagactcggcagcacgccgtggccggagtagccttgcagccagtagcggttgccctgccggccgaggtccggggtacgccgcatgctgcagtcgatatgcccgccccaggcgtactccagcgccaccccgcgcaactgcgggaacaccctttcgagatagggccgggtggcggcgcggatgtcgctgggcatgccgcccaggtaggtgcagccgccgccgaacagcaggcggtagtccggggtcaggcggaagtagtcgaggacgaactggttgtcggtcacgcagcagttgcgcggcagcaacgacttcgcccgttcctcgccgagcggctcagtggcgacctgataggtgcccaccggcagcatccgttgcgacagctcgctgtccagcccgtcgatgtaggcgttgcaggccagcaccagcgccgcgcagcggatctcgccgtgctcggtacggacccggtagccgtcgccctcctcgcgatagttcagggcccgggtccgctcgtggatacgcccgccggcgcgctcgatggcggcggccaggccgaacgccagcttgagcggattcaggtgtgcggcgtggggatcgtagagaccggcaaggtagcgctcgctggcgatccattcgggcaactcgtccttcgccacgaagcgtag

SEQ ID NO: 3376 - DNA, 432 bp, Pseudomonas aeruginosa
gtggccgacccggtagtcgcagtcgaagccatgtcgctgcggcaactcgcgcatctcgccggccgcccagagcatgccgtcccagagacggcgtgcgccttcgtagccgaggtcggcctcaagcggcggcagatcgctggaccagccgggcagcgcctgcccgccgttgcgcccggaggccgcccaggcgatccggctggcttcgatgacgcatacctggcgtccgccttcgaccagccgcagcgccgtgtgcaagccgctgaaaccggcgccgaccaccagcacctcgcagtcgaggtcgccctccagggcctggcgcggctggatcagttcgggattgacggcggcgtagtaagtgccgacatgctcgttggattgcaggaacatcgcgacctccgtgaaattatattggttatttttcatgaaaaataa

SEQ ID NO: 3377 - DNA, 360 bp, Pseudomonas aeruginosa
cgacgcgcgacacgggccaggccatcgcgtaggtgggtgccctgctcgcgcacctgctccaggaaacccggctccagcacggtattcagtaccgccagcccggcagcggtcatcaacgcgttgccgtggtgggtgccaagctggtcgcccggttcgaagcagcaggcgttgccacgcgccagcagcgccgacagcggcaccccggcgccgaggcccttgccgagggtaacgatgtcggcgcgtaccccgtacagttcctccgccagcagcgcgccgcagcggccgatgccggtctgcacctcgtcgaggatcaacaggacgccacgctgccggcacagccgctcgatgccacgcaggtag

SEQ ID NO: 3378 - DNA, 801 bp, Pseudomonas aeruginosa
ttccgctcgccggaccgacggcagcgcccacccgccgcgagcttgccgtgcatcaagatgacctgcgccgggcccgctacagtgggcagtcccctcatcatcgcgagccttcccagcatggaattccagcgcgtccaccagcagttgctgcaaagccaccacctgttcgaaccgctttctcccgtccagctccaggaactgctcgccagcagcgacctggtcaacctcgacaagggcgcctacgtgttccgccagggcgagccggcgcacgccttctactacctgatttccggctgcgtgaagatctaccggctgaccccggaaggccaggagaagattctcgaagtgaccaacgaacgcaacaccttcgccgaggcgatgatgttcatggacaccccgaactacgtggccaccgcccaggccgtggtgcccagccagctgttccgtttctccaacaaggcctacctgcgccagttgcaggacaacaccccgttggccctggccctgctggccaagctcagcacccgcctgcaccagcgcatcgacgagatcgagacgctttccctgaagaacgccacccaccgcgtggtgcgctacctgctgaccctcgccgcccacgcgccgggggagaactgccgggtggaaatcccggtggccaagcaattggtggccggtcacctgtcgatccagccggaaaccttctcgcggatcatgcaccgcctcggcgacgagggcatcatccgcctcgacggccgcgaaatcagcatcctcgaccgcgaacgcctggagtgcttcgagtga

SEQ ID NO: 3379 - DNA, 423 bp, Pseudomonas aeruginosa
tcgaggtcttcggcgacgcgcgcgccgtccgggtcgtcctcgtcgtcgctacagcggtccagggccaggtgctccgaccaactgagcaggctttccaggcggaacagcagcaggttgcgttcgctgttgcgttcctcaatgcgctcggcgcgcttgcgcgctccgctgcgggcgacctggcgcttgccggcgccggcggccgcttcctcgccgtcctccgcactggcggaaggcgtccagcgctcgccgggatacagccacagcggcaccggccagggcgcccgctcgactcgcgggaagcgctcgacgctgcccggctcggcaagcgcgcggcgcagggcgatttccagttcggcgtctgccgccgggcaatcgtccagcgacgggcgctggcgcagatgcgcggcgaccagccgggcgtag

SEQ ID NO: 3380 - DNA, 1923 bp, Pseudomonas aeruginosa
accgcgagggattccggcaggcgcaggctgtcgccgttgaaccaggacaccggggcctgctcgcaggtcccggcgacccgctgcaaccaggtgcggcgtagcagcaggcggcgcgccggggtcgcctcgagggctacccccggtgcgccgccgagcgcccggaagagcatgccgagcggacgccgcatgctctccagggtcacccgcgccgcctcgaactcgccgctggcatggcgggtgatgaagcggtgccagtgggcgccgacccattcctccagctcgacggcgaaggccatctcaggcggccgccttgccgcgccggaagctcagcaggtaggcgaccaggccgatgaggaacaccaccccggcgccttcgcgcagccagtagaagatcgccagctggtcctgggtggccatgaaggtcatcgccgcgccgtccgccggcatccgttgcagccagacctgcagcaccccggccgcggagaggaacagggtgatgaacaccatcgccacggtcatcagccagaagccccacatctccaggacctgcgagcggttgtccatcgcctcgccgatcccgcgcaggcgcggcatggcgtaggagatgatggtcatcacgatcatcgcgtaggcgccatagaaggccatgtggccgtgggcggcggtgagctgggtgccgtgggtgtagtagttgaccggcgccagggtatgcatgaagccccacactcccgcgccgaggaaggccatcactgtggtgcccatggcccacagcgcgaccgcgcggttcggatagtcgcggcggcggcggcggttgatggtgttgaaggcgaacagcaccatggcgaagaacggcagcggctccagcgccgagaataccgagccgagccacagccagtagccgggcacgccgatccagaagtagtggtggccggtgccgatgatgccgctgatcagcgccatggcgatgatcacgtagagccacttctcgatcacctcgcggtcgaccccggtgatcttcaccagcacgaaggcgaggatcgcacccatgatcagttcccacacgccttccacccacaggtgcaccacccaccaccagtagaacttgtcgcgggtgaggttttccgggttgtagaaggagaacaggaacagcagggcgaggccgatcaggccggtcatcaggaccatgctgatggcggtcttgcgcccgcgcagcacggtcatgccgacgttgaacaggaagcccagggcgacgatcacgatgcccgccttgctgatggtcggctgttcgaggaactcgcggcccatggtcggccacagttcgttgccggtgagcctggccaggccggcgtagggcaccagcaggtagccgaggatggtcagcacgccggcggcggcgaatacccagaacaggatccaggccagcttcgggctgtacagctcgcagtcgctctcctccggcaccaggtagtaggcagcgcccatgaagccgaacagcagccagacgatcagcaggttggtgtgcaccatgcgcgcgacgttgaaggggatcgccgggaacaggaagtcgccgaccacgtactgcaggcccatgatcaggccgaacaggatctgcccgacgaagaggatcagggcgaacacgaagtagggtttggcgaccgcctgcgaggcgaatttcagggagccattgggcgacatcatcaaccctccttgttcggcggccattggttggtatcgatcttcgagctccacttgaggaactcggccaggtcgtcgacctggccctcgctgagatggaactgcggcatggcgcggcggcccggcacgttcagcggctggatattcatccaggcctggaggaaggtgttgaagccctcctcgccgccacggcgtccgaccacgttgcccagctccggcgcgaagtag

SEQ ID NO: 3381 - DNA, 834 bp, Pseudomonas aeruginosa
agcgctcgccgatcagccaacccttggccaccgcgcagggccagcaccgccgccagcagccagggagagtcgccggcgccacccagcagcacaccggtcacggccagcgccagcaacgccagccagcagagggtcagggttcgcatcggcacctcattgcaggacgtagaccagcgggaacagcagcacccagaccaggtcgaccatgtgccagtagagcactcccgactccagtcccgagcaagcctgcggcgtataacaccggcgccagcaggcctgcgccagccagccgaggatcagcaggccgagcaggacgtggaggaaatggaagccggtcaggcaccagtagagggtgaagaaagtgtcgtgctcgatgtccaggccgagatcggcgagccgcccgtactcgtgcagcttcaggccgacgtagaccagcgccagcagcagcgccgccagcaaccagccgctcgcctggcgcggccgtccgcggcgcaccgcatgcaccgccagcgcggcgagccagccggagctgagcagggccacggtcagcaacaggccccagcggctatccagttgctcccggccggcacggaacagctccggctgccaggcctgggcgccggcgaacgccagcagcagcaggctgaacacgctgagttcggcgaggatgaagaaccacatcgccaggtcgccgggcaggcgccgctcgacggtatcaggcgacatggagatcgacgatgtccatcagcgccgccaccgtcgccgggtcgtccgagagcggttcggccagcgccacccggcacgcctcgcgcgggtccatgccgtcgccgatga

SEQ ID NO: 3382 - DNA, 300 bp, Pseudomonas aeruginosa
gcaataccggcaggccgtgccgccaggcgcgctcgaagacttcgatctcatggccggtggcctcgtagaagggtgtcgcgtcccgcatgtcctactcctgcgctagggattaggaccgcacgctattcacagttggaaggtgccacaagcgcaaagcaacgcaatcttgattccggtcaagcaagggtaaagaccctgctttctatgatcctttcgcgccatgaattcccgggagttcccgacgcagccacccccaaaacactgctaagggagcgcctcgcagggctcctgaggagatag

SEQ ID NO: 3383 - DNA, 1710 bp, Pseudomonas aeruginosa
accatgccatttggcaagccactggcgggcaccttgctcgcctcgctgacgctgctgggcctggccaccgctcacgccaaggacgacatgaaagccgccgagcaataccagggtgccgcttccgccgtcgatcccgctcacgtggtgcgcaccaacggtgcccccgacatgagtgaaagcgagttcaacgaggccaagcagatctacttccaacgctgcgccggttgccacggcgtcctgcgcaagggcgccaccggcaagccgctgaccccggacatcacccagcaacgcggccagcaatacctggaagcgctgatcacctacggcaccccgctgggcatgccgaactggggcagctccggcgagctgagcaaggaacagatcaccctgatggccaagtacatccagcacaccccgccgcaaccgccggagtggggcatgccggagatgcgcgaatcgtggaaggtgctggtgaagccggaggaccggccgaagaaacagctcaacgacctcgacctgcccaacctgttctcggtgaccctgcgcgacgccgggcagatcgccctggtcgacggcgacagcaagaagatcgtcaaggtcatcgataccggctatgccgtgcatatctcgcggatgtccgcttccggccgctacctgctggtgatcggccgcgacgcgcggatcgacatgatcgacctgtgggccaaggagccgaccaaggtcgccgagatcaagatcggcatcgaggcgcgctcggtggaaagctccaagttcaagggctacgaggaccgctacaccatcgccggcgcctactggccgccgcagttcgcgatcatggacggcgagaccctggagccgaagcagatcgtctccacccgcggcatgaccgtagacacccagacctaccacccggaaccgcgcgtggcggcgatcatcgcctcccacgagcaccccgagttcatcgtcaacgtgaaggagaccggcaaggtcctgctggtcaactacaaggatatcgacaacctcaccgtcaccagcatcggtgcggcgccgttcctccacgacggcggctgggacagcagccaccgctacttcatgaccgccgccaacaactccaacaaggttgccgtgatcgactccaaggaccgtcgcctgtcggccctggtcgacgtcggcaagaccccgcacccggggcgtggcgccaacttcgtgcatcccaagtacggcccggtgtggagcaccagccacctgggcgacggcagcatctcgctgatcggcaccgatccgaagaaccatccgcagtacgcctggaagaaagtcgccgaactacagggccagggcggcggctcgctgttcatcaagacccatccgaagtcctcgcacctctacgtcgacaccaccttcaaccccgacgccaggatcagccagagcgtcgcggtgttcgacctgaagaacctcgacgccaagtaccaggtgctgccgatcgccgaatgggccgatctcggcgaaggcgccaagcgggtggtgcagcccgagtacaacaagcgcggcgatgaagtctggttctcggtgtggaacggcaagaacgacagctccgcgctggtggtggtggacgacaagaccctgaagctcaaggccgtggtcaaggacccgcggctgatcaccccgaccggtaagttcaacgtctacaacacccagcacgacgtgtactga

SEQ ID NO: 3384 - DNA, 1842 bp, Pseudomonas aeruginosa
aaccgtacgcactgctttcgctgctcgccaccggcaccctgctcgcccagggcgcctgggccgaagaccccgaagtgctgttcaagaacaagggctgcgtggcctgccatgccatcgacaccaagatggtcggcccggcctacaaggacgtcgccgccaagttcgccggccaggccggcgccgaagcggaactcgcgcagcggatcaagaacggcagccagggcgtctggggcccgatcccgatgccgccgaacgcggtcagcgacgacgaggcgcagaccctggcgaagtgggtcctgtcgcagaaatgaacgcccctccggacttccggcgcgccgccagccacgccttgtggctggccctcgcgctgacgttcgcctgtcctcttccgggcctggccgacgagcatcccgatgcccgtcgccaggcccagttgcgtcacctgctgttgcaggactgcggatcctgccacggcctgcgcctgaccggcggcctcggcccggcgctgacccccgaggccctgcgcggcaagccgcgcgaatcgctggtcgccaccgtgctcatgggccgtccgcaaaccccgatgcccccctgggccggcctgctcagcgaagacgacgccggctggctggtggaccgcctgatcgaaggagagatcgccccatgaacctgcgtcccctcgcgccgcttttcctcgccctgctcgccggctgtagccagcagccgcccttgcgcggcagcggcgacctcggcgtgctgatcgaacgcgccgacggcagcgtgcagatcctcgacggcacggcgaagacctcgctggcgcgggtcgaaggcctcggcgacctgtcccacgcctccctggtgttctcccgcgaccagcgctacgcctacgtattcggtcgcgacggcggcctgaccaagctcgacctgctggcccagcgcatcgacaagcgcctgatccagggcggcaacagcatcggcggagcgatcagccaggacggtcggctggtcgcggtatccagctacgagccgggcggggtcaaggtgttcgacagccgcaccctggagctggtcgccgagattcccgccacccgcctccccggccaggacaggaactcccgggtggtcggcctggtcgacgcgcccgggcagcgcttcgtgttcagcctgttcgacagcggcgagatctggatcgccgacttcagccagggcgacacgccgcacctgacccgcttccgcgatatcggcaagcaaccctacgacgccctcatcagccccgacgggcgctactacatggccgggctgttcggcgaggacggcatggcccagctcgacctctggcacccggagcgcggcgtcaggcgcgtactcggcgactacggccgcggccaacgcaagctgccggtgtacaagatgccgcacctggagggctggaccatcgccagcgaccaggccttcgtcccggcggtcggccatcaccaggtgctggtgctcgacgcgcgcgactggaagcagaccgacgccatcgacgtcgccggccagccggtgttcgtcatgactcgaccggacgaccggcagatgtgggtcaacttcgcctacccggacaacgacaaggtgcaggtcatcgacagcgagacccacgaagtgatcgaaaccctgcgccctggccccggcgtactgcacatggaattcagcgggcgcggcgaccaggtatggatctcggtgcgcgacgccgaccagttgcaggtctgggacccgtaccgcctgaagcgcatcggcagccttccggcccgcagcccgagcggcatattcttcagccaccgcgcccagcacatcggactctag

SEQ ID NO: 3385 - DNA, 1002 bp, Pseudomonas aeruginosa
gaggcaccatggacgacctctcccgccgcctcctcgcccgctaccagaaaggcctgccgatctgcgcggaaccctatcggcggatggccgagaccctgggttgcagcgaagccgaggtgctcgaacggctgcgtcgcctggaagccgacggcgcgttgtcgcgggtcggcccggtgctccgccaccaacgcgccggggccagcaccctggctgccctggcggtgcccgaggagcgtctgcaacgggtcgccgagcgcatcagccagtacgccgaggtcaaccacaactaccagcgcgaacaccgctacaacctgtggttcgtgctcaccgccggcgaccgcgcgcaactcgaccgggtactggcggagatcgccgccgacaccggcctgcaacccctcgacctgccgatgcaggaagcctactgcatcgacctcgcgtttcccctggaggccagccgatgaaccccgtcgaacccctcgccgcgccgcagcggcaacacctgcgctacctgctggaacagggcctgccgctggccagccggccctaccgggtgctcgccgaacgcatcggcgccggcgaagacgaagtgctggaacaggtccgccgctgggacgaagacggcctgttccgccgcttcggagtgatcctccaccaccgcgccctgggctataccgccaacgccaagctggtgctggacgtcggccacgcggaggtcgacgccgtcggccgcgccctcgcccacgaaacgatcgtctcgctctgttaccgccgcccgcgtcgcctgccgatgtggccatacaacctgttttgcatgatccacggccgcgagcgcggcgaagtggaacgccagatcgaggccctgctggagcgccacgccctgcgccagacaccgcaccgctggctgttcagcctgcgcgcctacaagcagtgcggcggccgctacaccgcgccgccggccgacctggagcgccgccatggatgagttcgaccggcgcctgctga

SEQ ID NO: 3386 - DNA, 630 bp, Pseudomonas aeruginosa
acatgtggctggtggtcgcctgcgacagcccggcggaggtcgccgagaccctcgcacggctggagcgcgagagcgggctggcggtactcgacctgcccaaggaggcgacctaccatgtcggcctgcatttccccctctgacgccctgctcgcccgccgcctgatcgagctgacccaggccggcctgccgctggtcgccgacccttgggcgtggatcgccgcgcaactgcggctgagcgaggcggagaccctggcgctgctgaagcgcctgcgcgacgccggggtgatccggcgcatcgccgcggtgcccaaccactatcgccttggctaccggcacaacggcatgaccgtctgggacgtcgccgacgaacgcatcgaacgcctcggccggctggtcggcgggctgtccttcgtcagccattgctaccggcgcccgcgccatctgccgcagtggcgctacaacctgttcgccatggttcacggccgcagcgaagcggagatcgaaggctatcgccagcagatccgcctgctgctcggcgaggactgtcgcgccgacgagatgctggtgagcagccgcatcctgaagaagaccggcctgcgcctggcgcagaaggaggaacgtccatgctga

SEQ ID NO: 3387 - DNA, 1452 bp, Pseudomonas aeruginosa
tgcgcgaactcgacgtgcagaagttctacctctcgcacctcaactacagtggccgcggccgccgcagccgcgccctcgacgcccaccaccggcgcacccgcgaggccctcgcgctgctcttcgaacgggccgacgaggacatccggcaggggcgcgacagcgacttcgtcaccggcaacaacgacgccgacgcgatccttctcctcgactggctcaagcgccgccgcccgcagcaactggcgcgtctctgcgagctgctgctggactggggcggcaacgcctcgggcgagggcatcgccaacatcgacaacaccggcgaggtgcatccggacagctactggtggcaccacagcgtcggcaacatccgccatcagcgcttcgccgacttctggttcgagcgccccgacccgctgctcctgcaactgcgccagcgcccgcgaccggtggtcgggcgctgcagccaatgccgctggctggacatctgcaacggcaacacccgcacccgcgcctgggccggcggagaactttggggcgaagaccccggctgctacctcagagatcaggaaatcggcctcgagcgcatcgcgctgcacccgttataaggaaagcctcatgaacactacggggattccgccgtccttcctcgatgtcgatttccctgccggcagcgtcgccctggtcggcgccggccccggcgatccgggcatgctcaccctgcgcgcatgggccctgctgcaacaggccgaggtggtggtctacgaccgcctggtcgcccgcgagctgatcgcccttctgccggaaagctgccagcgcatctacgtcggcaagcgctgcggccaccacagcctgccgcaggaagaaatcaacgagctgctggtgcgcctggcccggcagcaacgccgggtggtccgcctgaaaggcggcgacccgttcatcttcggtcgcggcgccgaggagctggagcgcctgctcgaagccggcgtcgactgccaggtggtccccggcgtcaccgccgcctccggttgcagtacctacgccggcatcccgctgacccaccgcgacctcgcccagtcctgcaccttcgtcaccggccacctgcagaacgacggccgcctcgacctcgactgggccggcctggcgcgtggcaagcagaccctggtgttctacatgggcctgggcaacctcgccgagatcgccgcgcgcctggtcgagcacggcctcgccagcgacaccccggcggcgctggtcagccagggcacccaggcgggccagcaggtgacccgcggcgcccttgccgagctgccggcgctggcgcgacgctaccagttgaagccgccgacgctgatcgtcgtcggccaggtggtggcgctcttcgccgagcgcgcgatggcgcatccttcatacctgggcgccggctcgccggtcagccgcgaggccgtcgcatgcgcctga

SEQ ID NO: 3388 - DNA, 2115 bp, Pseudomonas aeruginosa
aaaagcccgccgaagggcgggctctttctcacctggggaacgggccgccagcggcccgtgccatcagtaaccgagggcgaaatcttcctcggccatctccatcaggctgttggcgccggacagcatggcggcgacgtgggcgcgggtacgcggcaggatgcgctggaagtagaagcgcgcggtctgcagcttggccttgtagaaggcttcctcgccggtgccggcggccagcttctcggcggccaggcgcgccatgtcggcccagaagtaggccaggcaggcgtagccggagtacatcaggtagtccaccgaagcggcgccgacttcctcgcgatccttcatggcggccatgccgaccttcatggtcaggtcgccccactccttgttcagctgtgccagcggagcgacgaattccttgacggcttcgttggcttcgttggcctggcagaacttgtgcacgatcttggtgaagcccttcagcgcctcgccctgggtcatcagcaccttgcgacccagcaggtcgagggcctgaacgccggtagtgccttcgtacagcatcgagatgcggctgtcgcggacgttctgctccatgccgtgctcggcgatgaaaccgtggccgccgaagatctgcacgccgtggttggcggactcgaagccgacttcggtcatgaacgccttggcgatcggcgtgaggaaggccagcatcgagtcggcggctttcttctgctcttcgtcctggctgcgctggacgatgtcgacctgcttggcggcgaagtacagcatcgcgcggttgccttcggcgaatgccttcatggtcagcagcatgcggcgcacgtcaggatgcacgatgatcgggtcggcgggcttctcgggcgccttcggaccggtcagcgagcgcatctgcagacgctcgcgagcataggcgatgccgccctggaaaacgacttcggcatgggccaggccttgcagcgcggtacccaggcgagcggtgttcatgaaggtgaacatgcagttcaggcccttgttcggcgggccgatcaggaagccagtggcggcgtcgaagttcatcacgcaggtggcgttgccgtggatgcccatcttgtgctcgatggaaccgcaggaaaccgcgttgcgctcgccggcgttgccttcggcgttgggcaggaacttcggcacgatgaacagcgagatgcccttggtgccctgcggggcgtcgggcaggcgggccaggacgatatggacgatgttgtcggccatgtcgtgctcgccggcggagatgaagatcttggtgccggtgaccttgtagctaccgtcggcctgcggctcggccttggtgcgcagcatgcccaggtcggtgccgcagtgcggctcggtcaggcacatggtgccggtccactcgccggagaccagcttggtcaggtaggttgcctgctgctcggcggtgccgtgggcatgcagggtgttcatggcgccgtgggacaggcccgggtacatgccccaggaccagttggcctggccgaccatctcgctgatggccaggccgagggattccggcagaccctggccgccgtgctcgacgtcatgggccaggctcggccagccgccttcgacgaactgctggtaggcctccttgaagccggtcggggtcttcacgccgtcggcgctccaggtgcagccttccaggtcgccgacgcggttcagcggagcgatcacctgttcgcagaacttcgcaccttcctcgaggatggcgttgaccatgtcgggagtcgcgtcttcggcgcccggcaggctctggtagtgcgcttcgtagcccagcagctcgtcgcgaacgaaacggatatcacgcaagggggccttgtaatcaggcatagcagtcaacctctacgaagggttctggttaatcggcgaccggacggatgtccagagtctgcggtcgcagtgcgggatcgctcccggtcgccttgccggacgcactcatgcgtcccggctctcaaacaggcgtttgaaacatacgtttacgccaatcccttgtcaagcatccgaaccgaccgctcggtcatgcccgaaatcactggcagccacgtccttccaaagcactttcgtctctctcagtaa

SEQ ID NO: 3389 - DNA, 1470 bp, Pseudomonas aeruginosa
cgccagcacctcgcgcaccgcctcgtgcaagcgtgcggcgctcagttcgacgccagcctcgcgcgccgccaggtgcggggcgatggccggtgcgaaggccagcgggttgacctgctcgtaggccagcgccagcgagcactggccgagcaacaccaacgcgtcgccattgcgcaggccttgcgccgtgggctcgcagccggaggccaccggcttcgccgcggcggtgctcaggccggcactccgggccgcgtggagcaggccggcggcgatggtggtcttgccgatctcggtgtcggtaccggtgacgaagaacgccggcatggttcaggaatccttgcgcagcacgccgaagacgacgcggtaggtagcgggcagcccctcgggctggcggaaacgctcgtaggcggcgaccagcgcgcggatgcgctggcgcccggtcaggccgtcgggccgcccggggttgaggttgtgcgcgcccagcgccttgagttcgtgggtcaggctgcgcaggtcggggaaatgcaggagccggtcctcgtggcgcagggtcagcggcagcaggccgctgccggccgcgtgttgcaggtagtcggcgaaggcgcggaagcgattgacgtggacgaagccgtccaccacccgccaactgtcgcgcaactcgcccagggtaccgacgcacaggctgctgaacgccagcacgccgcccggccgcaggacccgccgcgcctcggccaggaccgccgggaggtcggcgcaccactggatagccaggctggagaacagcaggtcgcaactgccgtcgcgcaacggcagcctctcggcgtcgccgccaatgaaatggctggcgccgccgcgcgcgcgggcatgccgcagcatgccttcggcgatatccacggccaggccctcggccgcaccgaagcgtcgttccagggcccggctgaaataaccggtgccgcagccgagatcgacccagcggcgcggcgagaagccttccggcaatgccgacagcaggctctcaccgacgccgcgctggagttcggccaccgcgtcgtatctggccgccgcgcgggaaaacgacgcggcgacctggcgcttgtcgggcagcgcggcaacgccatggggcgccagcagcggcgaggaatcgtcaggcatcgtcaccctcgcgaaggaatctcaggattgcgccggccacctcgtccgggcattccagcggcaggccgtgactggccgccagggtcgagacctcgacgtccggcagccactcgagcagggcctcggcggcggccagcggcaccagcgcatcggcttcggcgaacaggtgcaattgcggcccgcggaagttttccagggcggcccgggtatccagttggccgagcaactgcaggccggcgaccagcgcctcgcgctccagctgcggcagcgccacctgcagttgccgcgccagggtccgagggtcgcgcgcaccctggctga

SEQ ID NO: 3390 - DNA, 792 bp, Pseudomonas aeruginosa
aacgcttgcgggtcaggtgcggttcgagcaggaaagcctcgaagaagtcctcgaaggtttccgccggcatcgcgttcggccagtcctcgcgcacgcggaagcacggattgctggccagggtcagcagtccccggcaatcgtcgccgcggcgcgccgccagttcgccggcgagcatgcctcccagcgaccagccggccagccagctatcgcgcggcaggttatcgtcgagttcgtcgagccagtcggcggcgtcgtccagcgacggcagcggctcgatcaacacgttcaggtgcggctcgcgctcgtgcagcgcgtcgcgcagcggttccagcggtgcgctgcccaggccccagcccggcaacaggatcaagtggtcacgcatcgtctccctcctcggcttcgatctctgccagaaggctagacgacagctgtcgccagctttcgccgagggcttcgagcaagcggtcgacctgcgcttcgctgtgcgcggcggacagcgtgacgcgcagccgcgcgctgttggccggcacggttggcgggcggatcgcgccgaccatgatgccacgggctcgaagcatgccggccagggccacggcctggcggctgccgccgaccaggatcggctggatcggcgtgaagctgtccatcagggtcaggccaagcgcctcggcgccatggcggaaacgggcgatcagcgccgccaggtgttgccgccgccagctttcgcggcgcagcagctccaggctcttcagggtggcgcaggccaccgctggcggctggctggtggtgtag

SEQ ID NO: 3391 - DNA, 879 bp, Pseudomonas aeruginosa
accatgaacgcaaccaaccaccctaaatatagccattcaaagcgcagcggaagtataacgaaaaatatattcgaccattccgaccaaccactttccaaaacacgatacgggtttcattcgggcacattcaggaatatgaatggaaagcgcctcttccaggtccgaagttggcttcggatggttcttgcatcgatattcgcctggctgtgcatgtccgcccatgccgatctctctttcgacggccagaaccgtttcgtgatgaaaggcaagcgcctgccgatcacgctggtcaacgagggcaaggagccggccctggcggaaatctccctggattggggtaccgacggcaaggggcaggcgctgcccttcgccgtgtccaggccgctgctccgcctgggcgccggccagcgggccaaggtggaggtgctctaccagggccagggcctgcccaccgaccgcgagacctacctgctgttgagcgtgctggacgtgccgcacgcgcccagtactcccgagaccctgcagatcgccctacgccatcgcttcaagctgttctatcggccgcccctggaagccaccgtcgagcaggcgaacgagggcgtgacgtggacgctcggcaccagcggcaatccgaaggcacacaatccttcgccctaccacatcaccttcagccagttggagttcctcgacgcatcggagcggagctgcggcgaagccatcgaacacctgatgctggcgcccttctccaatcaccagttcgacatcgccgcctgccatcccgacaaagtgcgttacgcgatcgtcagcgacggagggaacctccacccttatcacggcgcattgaaatcaggcgtagagaccaacgccaaacacccatga

SEQ ID NO: 3392 - DNA, 1023 bp, Pseudomonas aeruginosa
ggcccggaatacaccatgaatgcaattacccgaacactacttgtgggaatgctggttgcgttggcgcagaaaggttatgcgctgacctgcgaaagagcggacaacaaggcaacgatcgactatgtcaacatcgacacgagcatcgccgtgccttcggctctgcccaaggacaccgtgctctggcgctctccaacctacgatttctccgtcaggtgttaccaggagcgcgaaaacaccggacctgaggacgtctatttctatctcagtccggacggccagggcgcattgggctcggacctggaggtgggcatcaacctgaacggcgaggacctccgttgttcctcgctccccggctgccggcagaagataggcatgcatttcgatggttgctggacaggaggacgggggggatgcgaaggcatggctcagaccaagcaggtccgtttccagatcttcctctccaaactcgccgcccccactcccggcaaggaaggtcccatcacgggcgtaaactcctacgcactgttccagttcgatggagtgggaggcatcaacaacctggggggccggaacctacgtatgtatgcccttggcatgaacaacctccgctacgtcgcctgcacctccacgctaagcatttctccaaagaccctcaacttccagatactgcaatcgcaatttgccgcacagaatctggtcatcaaagaacttcccttcagcatcaccgccaataagagctgcaacagcgcctatggcctgaacgctatgttcattcccgccagcaataccaccctgtcgagcacggatacgttgctggccaaggacaatccaacagtgggcatcaggctcctcaatgaggatcgcagcgtcatcagtatcggtaaggagttcgagttcattccctacgccccaacccagacgacggtgacgaagaactttctcgcccaactgaggtggatgacgagcagacccattctaggcccgttcaacgccaccgccgcgatagaggtctattacaagtga

SEQ ID NO: 3393 - DNA, 1080 bp, Pseudomonas aeruginosa
ggtcgacttcagtcattgcccgcaggcctcatctgtcttgttgttggatggagccacggtaaaagccggaaaaggtattgggtagatttattattcgatagactggtttctgaaaaacagatacctcctccggatgctccccatggccctgaccctccgccaggttcgctacttcatcgccaccgccgagttcggccagatatcccaggccgccatccacctgaacatctcgcagtcggcggtgaccagcgcgatccaggaactggagggcatgctcggcgtcgccctgttcacccgcacggcccagggcatgaacctgaccgacagcggccggcacttcctcaaccacgcctattcgatccagcgcagcgtcgacgacgcgctcaacagcccgcaaccggacacccgggtcgaaggcaccctgaaggtcgccgccagctataccgtgatgggctatttcctcccccaccacctgcaacgcctggcgcagtggtacccggaactggagctgcaactgttcgaggacgagcgcgccagcatcgagcgcggcctcctcgacggtcgctacgacatcgccgtgctgctcaccggcaatctcaccgagcccgggatcgccgccgaaaccctgttcaactccgagcgccggttgtggctgcccagccgccatccgctgggcgagaaggccgacctgggccttgccgacgtggccggcgagccctacatcatgctcaccgtcgacgaggccgggcagagcgcgctgcgctactggcaacagagcggccaccggccacaggtgatcctccataccagttcggtggaagcggtgcgcagcatggtcgccaacggctccggcgtggccatcctctccgacctggtgtaccggccctggtcgctggaaggcaaacgcatcgagacgctatcgctggtcgacccggtgccgtcgatgagcgtcggcctggcctggcgccgcgacaccgaagcgagcgccgggatgcgcgcgttccgcgaatacttccgccagtcgttcctcgctccgcagcaaagcagcagccggcgctgaacccggcggctaatctctga

SEQ ID NO: 3394 - DNA, 327 bp, Pseudomonas aeruginosa
tccaacgctgggaacactcaggacaggacactcatgggtacagaaggctttttcgacggactgggcgagatgctgggcagggcgatccgcttcgtggtggacctgctctccggcctgctgggcggcatctgggacgccatggacgacttcctccacggcctggccagggccatcggcatggacgcatcgctgttcagcttcgtcttcctggtgctcggcctgttgctgctctacagcggtatacgcgccttcatgcgccgctcgatagtcggcggggtgatctggacggtgctcggcctgatcgtcatgagctggctcatccactga

SEQ ID NO: 3395 - DNA, 864 bp, Pseudomonas aeruginosa
tccacgcgtcggccgtttccgcaaggagcgaaggaaggtttcggttatccacaggcgagttccgaacccgctggcaacggctggtcggcggcgcgcgcctgcggttgcatggtgcgacatccgccaggaagtcccgccatgtcgttcccgcttcgtcctctcactcgctggcttttgccgccgccggcctgcctgctctgcgccgcccgcagcgaccagccgccccgcccactgtgccgcgcctgtgccgccgacctgccctggtcgcgccagcagtgccggcgctgcgccctgcccctgccgctggacggccaggtgtgcggcgagtgcctgcgccgcccgccggcctatgaacaggcgatcgcgccctggcgctacgcctttccgctcgacagcctgatcaaccgcttcaagcaccaggcggcctggccgctggggcggctgctcggcgagttgctggcggaacacctgcggcaacgctacgccgaaggcctgccgcgcccggcacgcctgctgccggtcccgctggcgccacggcgcgaacgtcgtcgcggcttcaaccaggcgcaacagctcgccgagcgactggctggcgagctggacatgcgctgcgatccgcacagcctgcggcgagtgctggatactccggcccagcagggactggacgcgacggtgcggcggcgcaacctgcgccacgccttcgccctggcgcccgccagcgatgttcgcgggctgcacctggcactggtggacgacgtgctcaccaccggggccaccgccgagcgcctttcccgcctgttgcgccgggcgggcgccgcgcgggtcgacgtctactgcctggcgcgcacgccgaagcccggctga

SEQ ID NO: 3396 - DNA, 855 bp, Pseudomonas aeruginosa
cgaagcctccatgtccgcactctccactctcgcccagcacgtcacccgtcgcccgcaacgcatcgccctgctcgcgcagatcgccgaactgggctccatcacccgtgcggcgaaggccgtgggcatcagctacaagggcgcctgggacgccatcgacgaactgaacaacctggccgagcgtccgctggtcgagcgaagcgtcggcggcaagggcggcggcggcgcccggctgaccgccgagggcgaacgcctgctggctctctaccggcgcctggaagccttgcaagcgcaggtgttgcaggccgcggaagacgccgaggacctcaacctgatcggccgcctgatgctccgcaccagcgcacgcaaccaattgcacgggcgggtcctgtcgatccatggcgaaggcttccacgaccgcatcgccatcgagctgccaggccagcaacgcatcgaggcgctgatcacccgcgccagcaccgagcaactcgaactcggtcgcggccgcccggtactggcgctgatcaaggccggctggctggacgtcgggctggaaccgcgcgaggaccagccgaaccagttgcacggcaccctggaggaaatcctcgcggccaaggccggtcccagcgaggtgcgcatcgccctgggcagcggtcttaccctctgcgcgctgttgtccggcgaacgcctggccagcctggggctgaagaagggtcagaaggtgatcgcctccttcgatccggcccaggtcctgctcggcacgccgctgtgaacctgccggcccgcgccggcttgcgtacactaggggtctttcgagccttggatgccccgtcatgtcccatcccttcgaccaactga

SEQ ID NO: 3397 - DNA, 1707 bp, Pseudomonas aeruginosa
cttcggccacgcctcgctggccaccctgctggaaggcaatttcatccccaggagcctgctgccggcctacgagtcggtcgcccgcgacctgctgaaacgcctcgacgccctgttcgccgaggtgccctaccagccgatccgcctgcacggcgactgccatccaggcaacctgctgtgccgcgacgatgtctaccacatggtcgatctcgacgactgccgcatgggcccggccctccaggacctgtggatgatgctcgccggcgagcgccacgaacgcctggcgcagattgccgaactggtcgacggctacaacgagttccacgacttcgacccgcgccagctaccgctgctcgaaggcctgcgcagcctccgcctgatgcactacagcgcctggctcgcgcggcgctgggacgacccggcgttcccgccgagcttcccctggttcggcagcgaacgttactggggcgagcaggtgctggtgctgcgcgaacaactggcggcgctggacgaggaaccgctgcggctgttctgagcctcctgcggacagggcgaatggcgcgcggcgctatccgtcccgcctcggggcaggcgagggaacggcaagtgtgccggtgcttttccgcgggaactgtgcgcagacaaccccgtcaccccctactagaattcacaggtcatccgctcgtgcatgccgtgcacggccattcttacctgcctgacgtttcaaggattctccatggcgaccgccaacctccgtcggggctatgtcctcggcctgacggcttatgtgatctgggggctgttcccgctctacttcaaactgctcgaacgcattcccgcggtggaaatcatcgtccagcgcgcggtctggtcggccctgttcggcgccgtcctgctgctgttctggaaacacccgggctggtggcgcgagctgcgccagaatccgcagcgcttcgtcgtgctggccgccagcggactgctgatcgccagcaactggatgacctatgtctgggcggtgaacaacggccacatgctggaagccagcctgggctactacatcaatccgctgatcaacgtgatgctcggcatgttgctgctcaaggaacgcctgcgtcccctgcaatggctggcggtggccctggcttcgctgggcgtggcgcagcaggtctggcaactcggcagcctgccctgggtgtcgctggtgctggccctgaccttcggcttgtacggcctgatccgcaaaaaggcaccggtcgccgcgctgcccggactggtggtggaaacctggctgctgctgccgctggcgctggtctggttgctgtttttcgccgacgggccgaccagcgaaacggctttctggagcaccccggaagccctgtgggtggtcgccgcgggcccggtgacgctggttccgctggtctgcttcaacgctgcggcaaggcacctgccctacgccactctgggcttcctgcaatacctggcaccgacgctggtcctgctacaggcgatcctgctgttcggcgagcacctggactccagccgcctgaccgccttcgctttcatctggctcgccctggccgtttacagcttcgacgcctggcgcagcctgcgccgcctgccgcaaccgggctgacgttatccccaggcttgcggaactccgcaagcctggcgaaaaaacgcgcaatccttcctagcccctgtcaatactga

SEQ ID NO: 3398 - DNA, 633 bp, Pseudomonas aeruginosa
  unsure (574),(575),(576),(578),(579),(580),(585),(587),(588),(592): Identity of nucleotide at the above locations are unknown.
caagaagccaaagacagaaggaaaggcgagagggaagagccagaggcgaaggatacggaggaaggaggcgtagaaagaatgggaatgcagagaaccgaccgaaccacaaaccaagaaagagctcgaccacaatgcacaaggagaaacagcggaaacgaaggcgaagaccgaagcaacaaaggcagagagcacgagagagacaaccaaaacaagggaaacaaggacaagacgacaggcgcaggaagcaaccagagaaccggcagaaaggcacagggagccggaaaagagagcagacgaagagacagaagagaggagaaaggacaaacaaccgggagaaggccaaacaaagagggaaaaggacaaaaagacacacaacaaggcaaaggagagaggaacagcaagaagacaagaagaacaacgacagacagacaaagagaggaagagacaagaaggacaaaaaggcggaaacgaaaaaacagggaggaagaagagacagtggggcaacgggaagaaaaaagacagaaaggggccagaacagacaccaaacgagaagaaaaaaaaagagagagcccgnnngnnnaagcnannacanatccccacccgactctgggggcctatagctcagtcggttag

SEQ ID NO: 3399 - DNA, 693 bp, Pseudomonas aeruginosa
gcgtgctcagcggcgaagtgcacaacggcggcttcgaccagtacttcggcaactcctccggcgaccagtaccaggcggcgcgcgcgggtcttcgcgaattggaggcggaggacgccctggccctgctggagcgagccgccgccctgctgttcggcgacggtccggtgccagtctcccaggccgaacgccaattgcgcatgccgacctgggccgatgaacccgaccgcgactgcgaagcggccctggatgcgctggacacgcgcttctacgccctggccgacgcgctgggcgaacgcctgctggcccatgcccgccaccatgcattgttcgccctggacgagcccgatgaagcctgaattggatgccctagaggcctggctcggacgaccgctgccggctgccttcgtcgccgctctggagcagcacggcggccgcctcgtcgagccgggcctgctgctctacgccgccgacgagttgctggaacgcaaccgggccttcgaaacctctctctactgccccggctacctggccataggcgacgacagcggcggccgcgccgtggtgatggccctggacgatcaccggcaggcgctgttcctggtcgaccatggcgcgatgacgccggactgcttcgaacccctggcacccagcctggaggcctggctggaagccgggccctgcctgcccgaatga

SEQ ID NO: 3400 - DNA, 681 bp, Pseudomonas aeruginosa
tctgcgcctggaacctgtacaactatgccgcccacggcgacgaggcgttgtcgccgagtttcgcccagtacacccaggcgctgctcggcctgctgctgctcggcggcgtgcttagcctggtcgacctgctccacggcaggccctcgacgctgctgcgcaagggcctgctggggctgggctggctggccctggtggcctggctggggttgctgttctacctgcagcgcctgtacggcctcactttttgaactggtcgtaggcttccagcgcgcgcagcgaatagacataggcggcgccggcattcagggagatggcggtagccagggtctgggcgatttccgcctcgctggcgccggccttcagcgcggcctcggtgtgcacgccgatgcaaccgtcgcaacgggtggtaatggccacggcgatggagatcagttcgcgggtcttggcatccagggcgccctcggcgctggcttcctccagcgcgccataggcggcgagcatcttcgggtgttgcttgcccagggcaccgaaggcttttttcacggcggggacgaactcggtccagttgttcagcatggtgatattctccgttgctttcgcgccgggagtggcgcgtcgggttaccagtctcgaccagtctggaccgcgccgcctgcccatgcgtctctactttcgacctga

SEQ ID NO: 3401 - DNA, 924 bp, Pseudomonas aeruginosa
tcggctcatcccatggacccactcgaccggctcatccagctcgccaacctgcagggccgcctcgaccagcgctgccagctacagggcagctgggcgctggagcacccgcaagcggtgcccggcgaggcgaccttccatatcgtcatggccggcacctgctattgcgaattcctcgatggcggtcgcctcgacctgcatcccggcgacctgattctgttgccacgcggcaccccgcacctcctgcgcagcgacagcccggcgcaaccctgcgaacccaccgtagagcaccgcggcagcatcccgctgtaccagttgaacggccctggcgaggccctcgacatgctttgcggcagctaccgctatcacgccggtgccagcctgttcggcgcgctccccgagcgcctgctggtgcatatggacgagtcgacccagcagcccctgcgcgcgctgatcgggttgatgcgcgaggaagccgagagcacccgcagcggcgcccgctcgatcatcgacgcgctggccaccgcgctgttcgccctggccctgcgcgcctacctggaccgccaaccgctgggcgacggcctgttcggcctgctgggcgacgcccgcctgggacgagccctgcgggccatgctggaacgcccggagcatgcctggaccctggaacagcttgcccagcaggcggcgatgtcgcgggccagtttcgtccgcgccttctccgccctcggcggaacctcgccgtggaacctgctgacccgcatccgcatggagaaggctcgcggcctgctgcgacaaacgcagaagagcctgctggatatcgccgccgagaccggctaccagtcggaggcggcgttttcccgcaatttccgccaggccttcggcgtatcgccgggccgtttccgccgccaggccgactccgctcgctga

SEQ ID NO: 3402 - DNA, 450 bp, Pseudomonas aeruginosa
cagtacggctacactgtgctttcccggcaaggaggcgcgggggtacttgtcgcggcacccactctcccgctttaccagtacgcccaggaggcaaacatggaatggtttctgaaatgcgtgaaggaacactacttcgacttcaacgggcgtgcccgtcgcaaggaatactggatgttcaccctggtgaacatcatcatctccgttgcgctgagcgtcgtgctcggcctgatcagtgaaaagctcctgccgatcgccaatctctactcgctcgccgtgctgctgccggccctgggcgtcaccgcccggcgtctgcacgacatcaacaagagcggctggtggatgctgatcgcgctgatcccgatcgtcggcctgtacctgatctacctgctggccaaggacagcgacgccggccagaaccagtacggccagaacccgaagggcatcgcctga

SEQ ID NO: 3403 - DNA, 408 bp, Pseudomonas aeruginosa
cggcggccggacgcgggcgccgcgtgcgggtgctcgaccacgccaacaaggccggcaagaagatcctcatgtccggcggcgggcgctgcaatttcaccaacctgtacaccgagccggccaacttcctttcgcgcaatccgcacttctgcaagtcggcgctggcccgctacacccagtgggacttcatcggcctggtggccaagcaccaggtgccgtaccacgagaagaaactcggccagctgttctgcgacaacaagtccagcgacatcctcgagatgctgctgcgcgaatgcgccgaggccggagcggaaatcctgctggacacctcgatcgaagagatcgcccgcgacgacgccggctaccacctgcgtaccagcgccggcgagatgcgctgcgagtcgctggtga

SEQ ID NO: 3404 - DNA, 288 bp, Pseudomonas aeruginosa
tctcggcgacccaatccagcgactcgtcacgcacgttccacaccagccccagcctgccttccgccgtcagcacgcggcgcatttcctccagcgcctccacggtggcgaaccaatggaaggcctgtgcgcacaccagggcgtcggcgaagccgttggccagcggaatcgactgggcgctaccggccagcgcctggacctgcggcaaggcttcggcaagctgggcgcgcatcgcatccaccggttccaccgcgaccactcgcgcgccggtacgggccagcaggcgggtga

SEQ ID NO: 3405 - DNA, 519 bp, Pseudomonas aeruginosa
tcacctcgcaggtgctcgggcgtcgaccgccatcgccgctacaggcggccaggcccaggcagaacatcaggagtggcaaggttacggaacgcatggggcacctccttttttcgtcgtcctcaaaggtgtgacccccgaggacggcgaatggtttgccccgtctgcgtcagcccttggcgcgctgctccaggatttccacggccggcaggaccttgccctcgacgaactcgaggaacgcgccgccaccggtggaaatataggagatccgctcggcgatgccgtacttgtcgatcgccgccagggtatcgccgccgccggcgatggagaacgccgcgctatcggcgatggcattggccagggtacgggtgccctcgccgaactggtcgaactcgaacaccccgaccggaccgttccacaggatggtcttcgaggtcttcagcagctcggcgaactgcgcggcggtctgcgggccgatgtcgaggatcatgtcgtcatcggcgacctcggcgatggccttga

SEQ ID NO: 3406 - DNA, 1077 bp, Pseudomonas aeruginosa
caatcagtccttgggtacttgttgatcaggcacggcggcgcgcaggtagtgtccggcgacgtcgagcatacggttggcgaatccccattcgttgtcgaaccaggccagcaagttgaccaggcgaggcccggaaacgcgggtctggctgccatcgacgatggccgaatgggggtcgtggttgaaatcgcaactggcgtgcggcagctcggtataagccagcagtccgcgcagcgggccgctttcggcagcctcgcgaagcacccggttgatctcggcggcggaggtgtcgcgggaagtctgcagggtgatgtccagcgccgagacgttcaccgtgggcacgcgtatggctttggcctggatgcgcccggcaagttccggcaacaggcgttcgatgccgcgcgccagaccggtggacaccgggatcaccgactggaacgccgaacgggtacggcgcaggtcctcatggtggtaggcgtcgatcaccggctggtcgttcatcgccgagtggatggtggtgatcgacacgtattccaggccgatcgcctcgttcagcagcttgagcagcggcaccccgcaattggtcgtgcaggaggcgttggagaccagcgtttcgcggccgctgaggtcctgctggttgaccccatagacgatggtggcgtcgatgtccgcctcgctcgccatcggctgcgagaacagcacccgcggcgcgccggcgcggaggaaacgctcggcctgggcgcggttggtgtactggccggagcactccagcaccaggtcgacccgcagcgcctgccagtcgatggcctccggagtcgggctacgcagcaccttcacgcaatcgccgttgatgtgcaggcagtcgccgtcgaccttcacttcgccgggaaagcggccatgggtggagtcgaagcgggtcaggtactcgacgctggcctggtcggccaggtcgttcagcgcgacgatctcgaagcccagttgctccgggcgctcgtgcagcgcgcgcaggacgcagcggccgatacggccatagccattgagcgcgacgcgaaaaggcggggtggacatcggcagggatag

SEQ ID NO: 3407 - DNA, 849 bp, Pseudomonas aeruginosa
ctccggcaaggggccagtgaaaggcgccaattatgcgggggatgggcccgcctgggaaccgtccgcgacccgcgcggcgcggcgtgcgccgcggcgacggctcgcgtgcaggcgctgaaacgattcatgcgacacctggctggcgcgaccgcgttccgttgtgcaaggctcgcccgcatccaccgaccgccaggagcgccagatgccccgcttcgccgccaacctcagcatgctctacccccgccacgacttcctcgaacgcttcgccgccgccgcggcggacggcttcgagggcgtggagtacctgttcccctatgcctaccctgcggccgaactgaaggcccggctggacgaccacggcctgcgccagatgctgttcaatgccgcacccggcgactgggacaagggcgagcgcggcctggccagcctgccggggcgcgaggccgaattccgccgcgccatcgcccaggccatcgactatgcccaggtcctcggcaaccgccacatccatgtcatggccggactgctgccggccggcgccgaccgcatccgccaccgcgagacctacctcgacaacctcgcccatgccgcccgcgaagccgccggcgccgggctgacggtgctcatagagccgatcaacaaccgcgacatgccgggcttcttcctcacccgccaggacgacgcccaggccatctgccgcgaggtcggcgcggacaacctgcaggtacagttcgactgctaccactgccagatcgtcgagggcgacctggccaccaccctgcgtcgcgacatcggcaatatcggccacgtccagatcgccggggtacccgaccgccacgagccggatga

SEQ ID NO: 3408 - DNA, 417 bp, Pseudomonas aeruginosa
cgacaacgaagtgaactacccctacctgttcgagctactcgaccggctcggctaccagggctggatcggctgcgagtaccgtccgcgcggcgacacctcggcaggcctggaatggctgcggcgctggcgcgctactcgacgcgacggatgatcggctccagcgcgtccagacgctcgcgggcggccagccagtcgcgcacttccgcgcaccactgttcttccttcagcaccgcgcgggcacgggtcagcactcgcggccagggacggtcgtcgaacaggcgcagcagcacctggttgagctgttcgctatccagcggccggcgtccacggcgcaccggcgcgtcgacccgctgcgccagcgattgcagcacccgttcgcgctgcgccgtatccaccggcatcggctgctcgtcgtag

SEQ ID NO: 3409 - DNA, 513 bp, Pseudomonas aeruginosa
cgcccttgcagcccttccacaaggtcaggttggagccggccaggtcggcggaaccgccgagcagctccggcagcagcgggccgaaggcgttcagcgcgttctggctggccttgcggctggcgatggtctcacccttgttggcaacatcggcgacgtaggccgcggccttctcggcgaagtcggccggcagctcgcccttcaggcggcgcagcaattcggcggccagttccggatgggcagcctggtaggcggcgaaacgcttgttccactcggcttcctgggcggcgccggtttccttggcgtcccactcggcgtagatctgcgccgggatctcgaacggagcgtgctcccagcccagcgcggcgcgggtcgcggcgatctcgtcggcgcccagcggcgcgccgtggcactcttccttgccctgcttgttcggcgagccgaaaccgatcacggtcttgcagcagatcagggtcggctggtcgctcttgcgcgcggtatcgatggcggtcttga

SEQ ID NO: 3410 - DNA, 552 bp, Pseudomonas aeruginosa
gagcgtgttggccttgctcgacgcactggccttcgcccccggcgccacggcgctggaggtcggcccgggggacggcggattcctgccggaactcgccaggcgtttccgccaggtcacggcgctggacaacagcgcggcgatgctggaactggcgcgccagcgctgcaaggaagaaggattgggcaacgtccgcctggaattggccgatgccctgcaggacgccgccgaaccggccgattgcgtggtgctgaacatggtcctgcaccacttcgccgcgccggcggaggcgctgaaacagttggcccgcctggtccatccgggcggcagcctgctggtgacggacttgtgccggcacaaccagggctgggccagggaggcctgcggcgacctctggttgggtttcgaacaggaggacctggcccagtgggccgacgccgcagggctcacgcccggcgagagtctttacattggtttacgcaatggcttccagatccaggtccggcacttcgccagggatgcatccgaaagccgcctcacccaccggtaatgtag

SEQ ID NO: 3411 - DNA, 627 bp, Pseudomonas aeruginosa
cccaggcgatgcgcaatatcgcccgggcgctggagatccacttcctggaaaacgacgaagcgcggatcggcccggcgcgcttcctcggcgccaccctgtggaccgacttccagctctatggcgcggacggctatgcacccgcccatgagctggccctacaatcgatgccggacttcagctgcatcgactggttcggtggcgacttcacccccgagcagagcatcgccctgcaccaggcctcgcgcgactggctcgccgaacagctggcgcggccccacgacggcccgacgctggtggtcagccaccacgcgcccagtgcgctgtcgatcccgccgcagttcgtcggcaacccactgtcgccagccttcgcttccaacctcgacgaactggtggcgcaggccgactactggctgcacggtcacgtccacgacgccctcgactaccgcatcggccgggcacgggtgctggccaatccgggcggctatccccacgagagaggcgggttccgtccggaattcgtcttcgaggtctgagcctcagcgcggcaactggctgaagaagcgccagatttccactggcgcgtccagttccgggtcgctcttgccgagaatccgcgggaagcgatag

SEQ ID NO: 3412 - DNA, 237 bp, Pseudomonas aeruginosa
tccggctgcgccagcacgtggccgccgccatgcacgctgagcagctccaccggcggatggccgtcttcctgccagcgctgtcgctcggtccagaccgggccgggacgggtcagcggcgccacgtccggcggcgctgcgatgccgttcaggccggcccaccagcgtgccgagtccagggtcgagcgtaccgcgccccggtcgccgaagccgaacaggctgaccttgccgccgagatag

SEQ ID NO: 3413 - DNA, 2325 bp, Pseudomonas aeruginosa
aatttcacgacaccagtcccgagcattcgcaaacggccggcaggatgccgtcgcgcaccagcagaggcagaggggcaaatattcgaaaggaggcgggaagccccccgccagagcgaaactggcgaggggaacagacgtgcggacggcgcggctcgcgccgcggagaaaaggtgcacgaccacgggcgggggcatgccgggcgtgctgcgccagtgtcggcgccgacgggagcgggcgacaggtacgaatgcaccagccgccctggtgcattcgtaccctcttcgtttatttgcgcccgttgccgttgcgcggctccggcgcgaatccgcgttcgcgtgcccagacgatggcctcgccacggctgtggacatcgagcttggcgtagatggtcgccacgtggttgcgcacggtgttcggcgccaggcccagttccttggcgatctccttgtccgccaggccctggcagatgaggtcgaacacctcgcgctcgcgcgcggtcaggtcggccagttcggcgccggtgcccggcgcgttggcgcggcgcacgttggcgagcttttcgatcagggtgcggctgaaccaggaagcgtcctgcatcaccgtctcgatggcgtgcaccagctccatttcggtgcgccgccggtcgctgatgtccagcaaggccaccagcacgcagtcctgctcgttgaggctcaccgcctcggccgagaccaggcagtccaggccgttgcgatccttgtgctgcaggcgcagctggacgttgcgcacgctgccgctctgcgccagcagctcgcccaggcgctcggcgccgccgtcctgccacagcccgcaggcgacggtggactcgccgagcagttcctcggcctggtagccgaaggtttcgctgaaggcctggttgatgtccagcgcctgcaggtcgtcgccgtacagcaccaggctcggcaccggtgccatgcggaaggccttggcgaagcgctcctcgctcttgcgcagggcctcctcggccttcttccgcggttcgagatcggtgaaggtgaagagcatgcaggcctcctcgccgacctctatcggctgcccggcgaccaccacgcacttgcgtccgccctccgccacccgcaggctcgcctccatctgcgggatggtctcgccggcgcccagacgctccaccgccagttcgcggcgctcggcctggtcgagtacgtccagctcgtacaccgaacggccgatcacctggtcgcgggcatagccggtcatttccaggaaaccgacattgaccttcacgtagcggtagtcgctgagccggcagatcaccgccggcgccgggttggcattgaaggtcttctcgaagcgctgctcggcgctggcccactcggtggcgtcgtggaggatcagcaccaggcagtcgggcttgtcctcgggggtcgtcagcaccaacccgcgcacgcggtgcacccagcgggtgtcctcgtcggcggcgggaaacacttccaccaccacgtcgctgaagcactcgccagccaccaggcgctcggccgggtactgcccctcctgcagcggatgattgttgcggtagcgcaggcgaaagcgttcgcgatactcgccggtatcggcgcccaggcattccagcgaatggacgccgtgcatcgccagggccgcctcgttggcccagaggatgcgctggtccggctcgatcaggatcaccccttcggtaaggccggcgatgatctgctgcaactggcggcggtcggtctgggtacgcagtacctggtcgttcatgctgttcctcttggatggagcgattttccgggggcagcaaggatgcccgcccgccctgaccgcgcacgcgtgacgattgcactagcggtgctagtgcatttgcatcgcgaaacgatagcggaggcacccctaccctggcgatacaggaagcaatgtccgggcgggaagcccagacgccgcgccggccgggaggctacgccgcccctcggtcccgaggtcgtcgacgcatccacccgactcgccctgcacgagaagaaagccccatccccttgcatgagcgacgcgatgagcaagaacaagcaccccgatctcggcgagatccagcgcagcctgaaccaggcgctggaaggctacgactgccagtgccggatgcactacgacggcaccgtcagtatcaatgtcgccgcccgagagcacgacgaaaccttcaccttcgtcggcatccagcccggcgagctggacaaccccacccgcctgcacctgttcgcggaaagcctgcgtcgcgacctggcactactggagccctggttgggaaagcacgcagcctag

SEQ ID NO: 3414 - DNA, 888 bp, Pseudomonas aeruginosa
gaacagcttatggattttcgccaactccgctatttcgtcgcgctctacgaggaaggccacgtcggccgcgccgccgaacgcctggccctgtcgcaaccggccctctcgcagcagatccgccagttggagcagaacctcgacgtctcgctgttccagcgcagcggcaagcgcctgctgccgaccgtcgccgcccacaccctgtacaaccatgcggtaccgctgctggagggattggaaagggcccgcgaggcgatgcgcgtattccgcgggcagaccccgcgcagcctggcgatcggcgtgctgcagacggtcaacgccagcctggtgccgtacatggtcgaacgcctgcacgccgcgcagccgcacctgcgggtgcagatctacgaactgtcgggaatcgacatcgagcggcgcctgctcaccggcaacctggatatcggcatcggcttcctgccgccgcgccagccgggcttgcacagcgtcgagctgtacgaggacgaattgcagctggtgatccccgaggaacacccgttgaaggagttcagaaaggtgtccctggcccaggccgcggagttgccgatgctgctgctcggcgaagagttccgcgcgcgccagatctggcaggagcaactcgccgcgatcggccggcggccgcgggtgcaggcggaactgaaccacatgagcgggattctcgacagcctgccgcagacccgcttcgccaccgttctaccgggcaaggcacggcagatgcactcgaaccagcggctgctgtggaaaccgctcagcgaaccgcgcatcccgctgaaggtcggcctggtctaccgcgacgcgcagcgccagcacgccagcgtcgagctgctgcgctcgctgctggaaggcgtggtctga

SEQ ID NO: 3415 - DNA, 933 bp, Pseudomonas aeruginosa
tgcagaacggcaccagtccctggctgcgcgcctcgatcaccgcctggcgggtgtcctcgatgccgtagcggccctcgtagcggtccaggtcgttgggcttgccgtcgctcaacagcaacagcaggcgacgcttctgcggctgcccgccgagcacctggctggcccggcggatcgccgcgcccatccgcgtgtagtagcccggcgagagcgccagcacgcgaccgcggacctcgccgccgtagccttcgtcgaagtccttcagcacctgccagcgcacctgctgccggcgcaccgaggaaaacccgtacagcgcgaaggggtcgcccagtgcctgcaacgcctcgccgaacagcagcaggctgtcgacgatgctgtcgatcactcgccgctggtcgtcgaggtaggcttcggtggacatcgacaggtccgccagcaacaggcaggcgaggtcgcgccggcgcggccgctgttcgaggaacaggcctggctgggtggaaccgccgcgccgccgctcgacctggaagtcgagccaggcatcgaggtcgatctcgtcgccttgcggctgctggcgcaggcgttggcggccgtcgcgcaggcaggcgaactggcggcgcagatgcagcgcggtcttctccaggtgcgccggcaggctggcgctggtcgcgccgcgcggccgcatcggttgcagcagcacgtggtcgctcagcaggcgctgctgccgatagtcccactcgggcagcttcagcccggggccgagcggcaggtcatcgtagtcggcggccggcaggtcgagatccaggcgcaggccgccgcccttctgcgtgcgctggcgcgacagcgacaggtagtcgaggtcttcggcgacgcgcgcgccgtccgggtcgtcctcgtcgtcgctacagcggtccagggccaggtgctccgaccaactga

SEQ ID NO: 3416 - DNA, 522 bp, Pseudomonas aeruginosa
gcaggctttccaggcggaacagcagcaggttgcgttcgctgttgcgttcctcaatgcgctcggcgcgcttgcgcgctccgctgcgggcgacctggcgcttgccggcgccggcggccgcttcctcgccgtcctccgcactggcggaaggcgtccagcgctcgccgggatacagccacagcggcaccggccagggcgcccgctcgactcgcgggaagcgctcgacgctgcccggctcggcaagcgcgcggcgcagggcgatttccagttcggcgtctgccgccgggcaatcgtccagcgacgggcgctggcgcagatgcgcggcgaccagccgggcgtagcgcgggcgcagcgccggataggcatcgagcaactgccgcgcccagcgctggttgtcctgggcccagtgccgcagcggcccggcgctggccgccagcagcgccagccagcgatacagttcgcggttcagctcggcctgcggatagaccgcgagggattccggcaggcgcaggctgtcgccgttga

SEQ ID NO: 3417 - DNA, 774 bp, Pseudomonas aeruginosa
tcaccccgaccggtaagttcaacgtctacaacacccagcacgacgtgtactgagacccgcgtgcggggcacgccccgcacgctcccccctacgaggaaccgtgatgaaaccgtacgcactgctttcgctgctcgccaccggcaccctgctcgcccagggcgcctgggccgaagaccccgaagtgctgttcaagaacaagggctgcgtggcctgccatgccatcgacaccaagatggtcggcccggcctacaaggacgtcgccgccaagttcgccggccaggccggcgccgaagcggaactcgcgcagcggatcaagaacggcagccagggcgtctggggcccgatcccgatgccgccgaacgcggtcagcgacgacgaggcgcagaccctggcgaagtgggtcctgtcgcagaaatgaacgcccctccggacttccggcgcgccgccagccacgccttgtggctggccctcgcgctgacgttcgcctgtcctcttccgggcctggccgacgagcatcccgatgcccgtcgccaggcccagttgcgtcacctgctgttgcaggactgcggatcctgccacggcctgcgcctgaccggcggcctcggcccggcgctgacccccgaggccctgcgcggcaagccgcgcgaatcgctggtcgccaccgtgctcatgggccgtccgcaaaccccgatgcccccctgggccggcctgctcagcgaagacgacgccggctggctggtggaccgcctgatcgaaggagagatcgccccatga

SEQ ID NO: 3418 - DNA, 1059 bp, Pseudomonas aeruginosa
agcgcatcggcagccttccggcccgcagcccgagcggcatattcttcagccaccgcgcccagcacatcggactctaggaggcaccatggacgacctctcccgccgcctcctcgcccgctaccagaaaggcctgccgatctgcgcggaaccctatcggcggatggccgagaccctgggttgcagcgaagccgaggtgctcgaacggctgcgtcgcctggaagccgacggcgcgttgtcgcgggtcggcccggtgctccgccaccaacgcgccggggccagcaccctggctgccctggcggtgcccgaggagcgtctgcaacgggtcgccgagcgcatcagccagtacgccgaggtcaaccacaactaccagcgcgaacaccgctacaacctgtggttcgtgctcaccgccggcgaccgcgcgcaactcgaccgggtactggcggagatcgccgccgacaccggcctgcaacccctcgacctgccgatgcaggaagcctactgcatcgacctcgcgtttcccctggaggccagccgatgaaccccgtcgaacccctcgccgcgccgcagcggcaacacctgcgctacctgctggaacagggcctgccgctggccagccggccctaccgggtgctcgccgaacgcatcggcgccggcgaagacgaagtgctggaacaggtccgccgctgggacgaagacggcctgttccgccgcttcggagtgatcctccaccaccgcgccctgggctataccgccaacgccaagctggtgctggacgtcggccacgcggaggtcgacgccgtcggccgcgccctcgcccacgaaacgatcgtctcgctctgttaccgccgcccgcgtcgcctgccgatgtggccatacaacctgttttgcatgatccacggccgcgagcgcggcgaagtggaacgccagatcgaggccctgctggagcgccacgccctgcgccagacaccgcaccgctggctgttcagcctgcgcgcctacaagcagtgcggcggccgctacaccgcgccgccggccgacctggagcgccgccatggatga

SEQ ID NO: 3419 - DNA, 1218 bp, Pseudomonas aeruginosa
agaagaccggcctgcgcctggcgcagaaggaggaacgtccatgctgaggatcagccattacctgcgcagcctcgccgaggacgcgccgacgccgcgccgcgccggcggcaggcgcgccccggtggtgatctggaacctgctgcggcgctgcaacctgacctgcaagcactgttactccacctccgccgacagcgacttccgtggcgagctggagaccgcggaaatccttcgcggcatcgacgacctgcgcgccgccggagtgcgcgtgctgatcctctccggcggcgagccgctgatgcacccggacctcttcgagatcgccgcccatgcgcgccaggccgggatgttcgtggcgctgtcgagcaacggtacgctgatcgacgaaggcaacatccagcgcgtcgccgaggcccgcttcgactacgtcggcatcagcctcgacggcctgcgcgagacccacgaccgcttccgccagaagcagggcagcttcgacgccgcgctggcggccatgcgcctgtgccgcgaggcggatatccgcgtcggcatgcgcaccaccctgaccgaggagaacgccgcgcaactaccggcactgctcgacctgatgcgcgaactcgacgtgcagaagttctacctctcgcacctcaactacagtggccgcggccgccgcagccgcgccctcgacgcccaccaccggcgcacccgcgaggccctcgcgctgctcttcgaacgggccgacgaggacatccggcaggggcgcgacagcgacttcgtcaccggcaacaacgacgccgacgcgatccttctcctcgactggctcaagcgccgccgcccgcagcaactggcgcgtctctgcgagctgctgctggactggggcggcaacgcctcgggcgagggcatcgccaacatcgacaacaccggcgaggtgcatccggacagctactggtggcaccacagcgtcggcaacatccgccatcagcgcttcgccgacttctggttcgagcgccccgacccgctgctcctgcaactgcgccagcgcccgcgaccggtggtcgggcgctgcagccaatgccgctggctggacatctgcaacggcaacacccgcacccgcgcctgggccggcggagaactttggggcgaagaccccggctgctacctcagagatcaggaaatcggcctcgagcgcatcgcgctgcacccgttataaggaaagcctcatga

SEQ ID NO: 3420 - DNA, 2364 bp, Pseudomonas aeruginosa
tcgtcgtcggccaggtggtggcgctcttcgccgagcgcgcgatggcgcatccttcatacctgggcgccggctcgccggtcagccgcgaggccgtcgcatgcgcctgatcggcctcgccctcggcctgctcctcggcgccctcgcacaggccggcgaagcgccgggggaagcgctctaccgccagcactgccaggcctgccacggcgccgggcggctcggcggcagcggcccgaccctgctcccggaaagcctttcgcggctgaagccggcgcaggcccgcgaagtgatcctgcacggtcgcccggcaacccagatggccggctttgccggtcaattggacgacgccgcggcggacgccctggtcgcctatctctaccaggcgccgccgcgcgaaccgcagtggagcgccgaggacatccgggccagccaggttcagccgcatcccctcgccaccctgccgtccaggccccgcttcgaggccgacccgctgaacctgttcgtggtggtggagtccggcgaccaccacgtgaccatcctcgacggcgatcgcttcgagcccatcgcccgcttcccctcgcgctacgccctgcacggaggtccgaagttctccccggacgggcgcctggtgttcttcgcctcgcgcgacggctgggtaaccctctacgacctgtacaacctgaaggtggtcgccgaggtccgcgccggcctcaacacgcgcaacctggcggtcagcgacgacgggcgctgggtcctggtgggcaactacctgcccggcaacctggtgctgctggacgcccgcgacctgtccctggtgcaggtcatcccggcggccgacgcccagggccaggcctcgcgggtcagcgcggtatacacggcaccgccgcgacacagcttcgtggtcgccctgaaggacgtccacgagctgtgggagctgccctatgccaacggcaagccggtcgcgccgaaacggttggcggtggccgactacctcgacgacttctccttcagccccgactaccgctacctgctgggcagctcgcggcaggccaggggcggcgaggtgatcgagctggacagcggcgcgcgggtcgcctcgatcccgctgtcgggcatgccgcacctcggctcgggcatctactggaagcgcgacgggcgctgggtattcgccacgccgaacatcagccgcggggtgatctcggtgatcgacctgcaaaactggaagccgttgaaggaaatcgtcaccgacggccccggcttcttcatgcgcagccatgccgactcgccctacgcctggaccgataccttccttggcaagaaacacgacgagatcctgctgatcgacaagcagaccctggaaatcgcccatcgcctgcgccccagcccgggcaaggtcgccggccacgtcgagttcacccgcgacggccgctacgccctgctcagcgtctgggaccgcgacggcgcgctggtggtctacgacgcgcacagcctggaggaagtgaagcgactgccgatgaacaagccgtcgggcaagtacaacgtcggcaacaagatcggctatgcggagggaacctcgcactgaggctcgggcgagacgccatcaacggatatccccgtatcctccgcgacggaccgcgacaaccctgtcccatcacggcacgagaaaaaccaggggaatggcggataaccgcaagcggttattcgccctaccgcccaccctgcgcgaggagccgcagggcgcataacgccaacggcgttatccgccgatcaccctgtcccatcacggccccgagaaaaccacgggaatggcggataaccgcaagcggttattcgccctaccgcccaccctgcgcgaggagccgtagggcgcataacgccaacggcgttatccgccgatcaccctgtcccatcacggccccgagaaaaccctgggaatggcggatagccgcaagcggatatcccccccacccgtcccgcgcgccgagcccccggcgcccagaaaaaagccccgcatcgcggggctttccgtctcaggcgccaggcctcagaactgctcggcgtccagcaggtacagcgactcgctgccggcgcgcacggaggcgctcagggaatggatgcgcggcagcaggcgggcgaagtagaagcgcgcggtacccagcttgctggcgtagaagtcgtcctcgccctgcttggccagcgcggtgcgcgccatcaatgcccacatgtaggcataggcggtgtagccgaacacatgcaggtattcgaccgacgccgcgccgatctcgttgggattgcccttggcgcggtcgagcagccaggcggtcagctcttccaggttctccacggcggccgccagcggcttgctga

SEQ ID NO: 3421 - DNA, 1203 bp, Pseudomonas aeruginosa
gaaagcccgcttttcgcgggctcgagcgagttcgccgggagtccgacgggcccggcgggtgcgggagaaaccgggggaagaagcgccgcgcccctgccccggcagccgctagagcgaaaactgctccgccgacaggctcatcaggcccgccgcgccggcctggatcgccgcggcgtgcgccgcggtgcgcggcagcaggcgactgaagtagaagtcggcggtggccagcttggcttcgtagaacgcggcctcgccgctgccggcatccagcttctcgcgcgccaccagggcgatgcgcaaccagaaataggccagggtcacgtagccggagaacatcaggtagtccaccgaggcggcgcccacttcgtcggcattcttcatcgccgccaggcccacctgctgggtcagttcgccccactgcgcgttcagcgccgccagttgcgcgacctgtcccttcagttgcggatgctcggcctgggcctggcacaactggtggaccagtttggtgaaaccgcgcaacagcttgccctggctgcccagtaccttgcggccaagcaggtcgagggcctggatgccgttggtgccttcgtagatctgtgcgatgcggcaatcgcggaccaactgctccatgccccactcgcggatgtagccgtggccgccgtagacctgcatgccgaggttggtcacctcctgcccggtctcggtcatgaaggccttgcagatcggtgtcaggaaggccagcaggtcggcggcccgctcgcgctcggcggcgtcctgcgacaggtgctcggtgtcgagcaactgggcggtgaagtaggccagcgcgcggttgccttcgttgaacgccttcatggtcagcagcatgcgccgtacgtcggggtgcacgatgatcgggtcggccggcttgtccggcgccttcggcccggtcagcgagcgcatctgcaagcgctcccgggcgtagcgcacggcgccctggtaactggtctcgccaaggcacaggccctgcatgccggtgcccaggcgggcgtggttcatcatggtgaacatgcagtgcaggcccttgttcggctcgccgatcaggtagccggtggcgccgtcgaagttcatcacacaggtggccgaggccttgatccccatcttgtgctcgatggagccacaggagaccgcattgcgcgcgcccacgttaccttcggcgtcgggtag

SEQ ID NO: 3422 - DNA, 1173 bp, Pseudomonas aeruginosa
  unsure (343): Identity of nucleotide at the above locations are unknown.
tcaggcatagcagtcaacctctacgaagggttctggttaatcggcgaccggacggatgtccagagtctgcggtcgcagtgcgggatcgctcccggtcgccttgccggacgcactcatgcgtcccggctctcaaacaggcgtttgaaacatacgtttacgccaatcccttgtcaagcatccgaaccgaccgctcggtcatgcccgaaatcactggcagccacgtccttccaaagcactttcgtctctctcagtaaagcccatggcgaagcgcccggcaggcttcaggggccgccgggtgacagtcggaaaaggaagggtcggggcggccgctgccggccgccangaaatcaggcgtgggtatcgatcagggtaccgagggtctcgtcggctacctcgatgacccgggcgccgctctgcgcctcgagcttggcgcgggtcagttcgaccatctgctcggcctggggcgaacgggcctccacggtattgcgggcgatctcgctgccggcctgggcgacgcgggcgctgcccgactgcaccgcgttgaggccactgacgaaagcgttgccggaaatttccaccctctactcctggggacgcgcatgcgccactgcgatagcaagtggcttctattcaagcagacttggccggcgctgggtaccgcccgttggttatggacggcccgctgtttatagcccgatacccaggggccgcaggtcgaggtgtgcggccacggccgcgggagtggcttcctccaggcgcggtacccgacccaggcagggcgccggcaggcgttcggcgagggtcgccaggttctcttccaggcgcgaggtagccgggtcgacgacgttggccacccagccggccagcgccaggccgtcgcccaggatcgcctcggcgctgagcagcgcatggttgatacagcccaggcgcacgccgaccaccagcaccaccggcagcgccagcaggcgcgccaggtcggacaggttctcgcggcccagcaacggcacgcgccatccgccggcgccctccaccagggtgaagtcggcctgtagcgccagcacctcgcgcaccgcctcgtgcaagcgtgcggcgctcagttcgacgccagcctcgcgcgccgccaggtgcggggcgatggccggtgcgaaggccagcgggttgacctgctcgtag

SEQ ID NO: 3423 - DNA, 420 bp, Pseudomonas aeruginosa
agctgtccatcagggtcaggccaagcgcctcggcgccatggcggaaacgggcgatcagcgccgccaggtgttgccgccgccagctttcgcggcgcagcagctccaggctcttcagggtggcgcaggccaccgctggcggctggctggtggtgtagatgtagggccgggcgtactgaatcagggtctcgatcagttcctcgctgcccgctacgaaggcgccggcggtaccgaaacccttgccgagggtgccgatcagcaccggcacctgctcctggccgaggccgaaatgttcgacgatcccgccgccgctggcgcccagcgggccgaagccatgcgcgtcgtcgaccatcagccaggcgccgcgggcctgcgcgacggcggccagggccggcaggtcggcgagattgccgtccatgctga

SEQ ID NO: 3424 - DNA, 468 bp, Pseudomonas aeruginosa
catagggggtacaacttccgcatgaccctccacggcttgaataaccttcgctacgtcgcctgcgcgtccacaatcagcctttctccgaaaaccgtcgacttccaaagcctgcaggcctatttcgccagccgggaccagatactcaaggaacttccgttcagcgtcaccgccaataagaactgcagcagcgcctatggcctgaacgcgatgttcctcccctccggcaacacctccctgtggggttcggacactcttttggataacaacaacaagtccgtgggaatccgacttctcaagcaggaagaccgcagcatcatcgatatcggcaaggagttcgtactggtgcccaatagccagaaccaattggtggtcataagaaacttcctcgcccaggtgaggtggatgacgggcactccaacgccaggccccttcaacgccaccgccgcgatagaggtctactacaagtga

SEQ ID NO: 3425 - DNA, 858 bp, Pseudomonas aeruginosa
cggatgttggcatgcatctcaaacctcctgcgcggcggcggtccgctcggcgagccaggtttccagggtagcggtatcgaactgcgcggcctgtacccgcgcatcggcgagcagccagcggtgcagcggcagggtagtggccatgccggccagcacggtgcgctccagcgcctggcgcgcgcgggcgaacgcttcgtcgcggtcgcgaccatggacgatcagcttggccagcaacgaatcgtagtacggcggcacccggtagccgggatacaggtggctgtccactcgcacgccctcgccctgcggccattccaggcgctccacggtgccggggctggggaagaaattgcgcgccgggtcttcggcgttgatccgcatctccagcgccgcgccgttcaggcgaatgtcctcctggcgccagggcagcgcctcgccggcggcgatgcgcagcatggcctggaccaggtcgatgccggtgaccatctcgctgaccggatgctcgacctggatacgggtgttcatctcgatgaagaagaactcgccgctgtgcgcgtcgaacaggtattccagggtgcccgcgccacgatagccgagactctgcgccaggcgcaccgcgctctcgcagagggcctggcgctgcgcgccgtccagcgccgccgaaggtgcctcctcgaagaccttctggcgccgccgctgcagcgagcattcgcgttcgaacagatgcaccgcgcgctcgccatcgccgaggatctgcacttcgatgtgccgtgcctggcggatgaagcgctccaagtacaccgccggcgaaccgaaggcggcctgcgcctcgcgctgggcgatggggaattcccgacgtag

SEQ ID NO: 3426 - DNA, 480 bp, Pseudomonas aeruginosa
ttcgtcggcgtcgtgggcgatacggatgccacgcccgccgccgccggcggaggccttgaccagcagcggatagccgacctcttcggcgcaagccagcgccgcgtcgaggtcgcccagctcgccgggcgagcccggcaccaccggcaccccggcggccatcgcggtacgccgcgcctcggccttgtcgcccatgcggcggatggtctgcgcctccggaccgacgaagaccaggccggccgcctgcaccgcttcggcgaaggcggggttctcggagaggaaaccgtagccgggatggatcgagtcggcaccggtttcccgcgccgccatgagaatcgcctcgatatccaggtagctccgctcggcccgcgcagggccgatcaggcgtacctcatcggccagccgcgcggccagcgaatcgcgatccgcctcgctgcacaccgctaccgtgggaatgcccagtgcctgcgcgggcgcggatga

SEQ ID NO: 3427 - DNA, 945 bp, Pseudomonas aeruginosa
aaggtgccgggcaagggggactgcacgttatgttcggccatgacgaatcctcattattcgaacgttgtaggaaatggcagaaaagcttgtcgcgaggctcgccgaggcgagcggcgctcaacgcggcgccttgatgcggatgccggcgccctccaggcgcgcacgggtgctggcgaccagctccagggcaccgggggtatcgctgtggatgcacaccgagtcgaaggcgatgtcgaggtcctcgccctcgacggtgcgcaccttgccctcgcggcaggcgcgcaggaccttgtcggcgacctgctgcggatcgagggcggcgacccgccgggtgaagacgatggagccgctgcggtcgtagtcgcggtcggcgtagaactcgcgcaccagcggctggcccagttcccggccgatgcgccaggtggccgaaccgggcatgcaatagagcagcagttccggttccaggcgttgcagggtctcgacgaacaggcgcgcggcgacctcgtcccgcgccaggtgcatgtagagcgcgccgtggggcttgacgtgttgcagcgacaggccctgcagccgggcgaattcgcgcagtgcgccaagctggtagagcatgtcgttgaccagctcgatggccggcgcggcgatgtgccgacgcccgaagccgaccaggtcgcggaagcccggatgggcgccgatggccacgccatgctcggcggccatctccacggtgcggcgcatgctgctcgggtcgccggcatggaaaccggtggcgatgttggcgctgctgatcagcggcatgatcgccgcgtccacgccatcgccgatggtccatgggccgaagccttcgcccatgtcggaattgaggtcgacttcagtcattgcccgcaggcctcatctgtcttgttgttggatggagccacggtaaaagccggaaaaggtattgggtag

SEQ ID NO: 3428 - DNA, 975 bp, Pseudomonas aeruginosa
atttattattcgatagactggtttctgaaaaacagatacctcctccggatgctccccatggccctgaccctccgccaggttcgctacttcatcgccaccgccgagttcggccagatatcccaggccgccatccacctgaacatctcgcagtcggcggtgaccagcgcgatccaggaactggagggcatgctcggcgtcgccctgttcacccgcacggcccagggcatgaacctgaccgacagcggccggcacttcctcaaccacgcctattcgatccagcgcagcgtcgacgacgcgctcaacagcccgcaaccggacacccgggtcgaaggcaccctgaaggtcgccgccagctataccgtgatgggctatttcctcccccaccacctgcaacgcctggcgcagtggtacccggaactggagctgcaactgttcgaggacgagcgcgccagcatcgagcgcggcctcctcgacggtcgctacgacatcgccgtgctgctcaccggcaatctcaccgagcccgggatcgccgccgaaaccctgttcaactccgagcgccggttgtggctgcccagccgccatccgctgggcgagaaggccgacctgggccttgccgacgtggccggcgagccctacatcatgctcaccgtcgacgaggccgggcagagcgcgctgcgctactggcaacagagcggccaccggccacaggtgatcctccataccagttcggtggaagcggtgcgcagcatggtcgccaacggctccggcgtggccatcctctccgacctggtgtaccggccctggtcgctggaaggcaaacgcatcgagacgctatcgctggtcgacccggtgccgtcgatgagcgtcggcctggcctggcgccgcgacaccgaagcgagcgccgggatgcgcgcgttccgcgaatacttccgccagtcgttcctcgctccgcagcaaagcagcagccggcgctga

SEQ ID NO: 3429 - DNA, 417 bp, Pseudomonas aeruginosa
gctggctcatccactgatccacgcgtcggccgtttccgcaaggagcgaaggaaggtttcggttatccacaggcgagttccgaacccgctggcaacggctggtcggcggcgcgcgcctgcggttgcatggtgcgacatccgccaggaagtcccgccatgtcgttcccgcttcgtcctctcactcgctggcttttgccgccgccggcctgcctgctctgcgccgcccgcagcgaccagccgccccgcccactgtgccgcgcctgtgccgccgacctgccctggtcgcgccagcagtgccggcgctgcgccctgcccctgccgctggacggccaggtgtgcggcgagtgcctgcgccgcccgccggcctatgaacaggcgatcgcgccctggcgctacgcctttccgctcgacagcctga

SEQ ID NO: 3430 - DNA, 1179 bp, Pseudomonas aeruginosa
  unsure (141): Identity of nucleotide at the above locations are unknown.
actgccgcgcaaccgatacgggagaggatccatgcgcgcactgctggtcgcggcctgcctgttgctcggcggttgcagccatttcgccgaagacgactggctgggcgaagacaaagccctgcatttcgccagttccgcggnccttgccgcggcgggcatgcagatggctcacgaccgcggcgtgcgcggcgctcgccaggcacgcttcggcctgagcttctccctcgccttcggcgtcggcaaggagttgtacgacagccgttccgccggcagcggctggagcctggaaggacctcgcctgggacctggccggcgccgccgccgggtacggtctgtaccaggccgccgagtgacgcccttgcgttttgcccatggctgttggagccttcgccgtatacgtccgctcatagcgaagcctccatgtccgcactctccactctcgcccagcacgtcacccgtcgcccgcaacgcatcgccctgctcgcgcagatcgccgaactgggctccatcacccgtgcggcgaaggccgtgggcatcagctacaagggcgcctgggacgccatcgacgaactgaacaacctggccgagcgtccgctggtcgagcgaagcgtcggcggcaagggcggcggcggcgcccggctgaccgccgagggcgaacgcctgctggctctctaccggcgcctggaagccttgcaagcgcaggtgttgcaggccgcggaagacgccgaggacctcaacctgatcggccgcctgatgctccgcaccagcgcacgcaaccaattgcacgggcgggtcctgtcgatccatggcgaaggcttccacgaccgcatcgccatcgagctgccaggccagcaacgcatcgaggcgctgatcacccgcgccagcaccgagcaactcgaactcggtcgcggccgcccggtactggcgctgatcaaggccggctggctggacgtcgggctggaaccgcgcgaggaccagccgaaccagttgcacggcaccctggaggaaatcctcgcggccaaggccggtcccagcgaggtgcgcatcgccctgggcagcggtcttaccctctgcgcgctgttgtccggcgaacgcctggccagcctggggctgaagaagggtcagaaggtgatcgcctccttcgatccggcccaggtcctgctcggcacgccgctgtga

SEQ ID NO: 3431 - DNA, 1005 bp, Pseudomonas aeruginosa
gggtctttcgagccttggatgccccgtcatgtcccatcccttcgaccaactgacccccgacctcgtcctggatgccgtggaaagcctcggctatctcagcgacgcacgggtgctggcgctcaacagctacgaaaaccgcgtgtaccaggtcggcatcgaagacggcgagccgctgatcgccaagttctaccgaccggaccgctggagcgacgcggcgatccgcgaggagcacgctttatccgcccgagctgggcggaatgcgaggtgccggtggtggcgccgctgtcgcgcgacggcgaaagcctgttcgcattctccggcttccgcttcgccctgttcccccggcgcggcgggcgcgcgcccgagccgggcaatctcgaccagctctaccgcctcggccagttgctcggccgcctgcacgcggtcggcgccacgcggccgttcgagcaccgcgaggcgctcgctgtggataacttcggccacgcctcgctggccaccctgctggaaggcaatttcatccccaggagcctgctgccggcctacgagtcggtcgcccgcgacctgctgaaacgcctcgacgccctgttcgccgaggtgccctaccagccgatccgcctgcacggcgactgccatccaggcaacctgctgtgccgcgacgatgtctaccacatggtcgatctcgacgactgccgcatgggcccggccctccaggacctgtggatgatgctcgccggcgagcgccacgaacgcctggcgcagattgccgaactggtcgacggctacaacgagttccacgacttcgacccgcgccagctaccgctgctcgaaggcctgcgcagcctccgcctgatgcactacagcgcctggctcgcgcggcgctgggacgacccggcgttcccgccgagcttcccctggttcggcagcgaacgttactggggcgagcaggtgctggtgctgcgcgaacaactggcggcgctggacgaggaaccgctgcggctgttctga

SEQ ID NO: 3432 - DNA, 969 bp, Pseudomonas aeruginosa
aattcacaggtcatccgctcgtgcatgccgtgcacggccattcttacctgcctgacgtttcaaggattctccatggcgaccgccaacctccgtcggggctatgtcctcggcctgacggcttatgtgatctgggggctgttcccgctctacttcaaactgctcgaacgcattcccgcggtggaaatcatcgtccagcgcgcggtctggtcggccctgttcggcgccgtcctgctgctgttctggaaacacccgggctggtggcgcgagctgcgccagaatccgcagcgcttcgtcgtgctggccgccagcggactgctgatcgccagcaactggatgacctatgtctgggcggtgaacaacggccacatgctggaagccagcctgggctactacatcaatccgctgatcaacgtgatgctcggcatgttgctgctcaaggaacgcctgcgtcccctgcaatggctggcggtggccctggcttcgctgggcgtggcgcagcaggtctggcaactcggcagcctgccctgggtgtcgctggtgctggccctgaccttcggcttgtacggcctgatccgcaaaaaggcaccggtcgccgcgctgcccggactggtggtggaaacctggctgctgctgccgctggcgctggtctggttgctgtttttcgccgacgggccgaccagcgaaacggctttctggagcaccccggaagccctgtgggtggtcgccgcgggcccggtgacgctggttccgctggtctgcttcaacgctgcggcaaggcacctgccctacgccactctgggcttcctgcaatacctggcaccgacgctggtcctgctacaggcgatcctgctgttcggcgagcacctggactccagccgcctgaccgccttcgctttcatctggctcgccctggccgtttacagcttcgacgcctggcgcagcctgcgccgcctgccgcaaccgggctga

SEQ ID NO: 3433 - DNA, 342 bp, Pseudomonas aeruginosa
caatccattttctcacgccagctcctgacaagcttcctcgcctatgtgctcgggcagatcctcgacatccaggtattcgaccgcctccgtcgttcccggcactggtggaccgcgccagtcgcctcgaccatcctcggcaacctgctggacaccttcaccttcttcttcgtggcgttctggcgtagcgacaatccgttcatggcgcagcactgggtggaaatcgccacggtggactacggagtgaagctgagtatcagccttctgctgttcgtgccgctctacggcatgctactcaacggcatcctgaagatgctgccggggcggccgcagagcaacgcttga

SEQ ID NO: 3434 - DNA, 243 bp, Pseudomonas aeruginosa
gtctgtctgcgtctttcttgcttctatcccttactatcctcatcttactgtctgcaatgctcgctctcttttctctctccttacgtctgtgatgtcacctctcctcacctcttgtcgtttggtctgtccaactgtggtcgctctgtacagttcctgtcagcgctcttgctcttctctctctctccctcctcgttttctaggcacccgtttctcctccgcagtgtctcctgctccatctcctga

SEQ ID NO: 3435 - DNA, 216 bp, Pseudomonas aeruginosa
caagcttcctcgcctatgtgctcgggcagatcctcgacatccaggtattcgaccgcctccgtcgttcccggcactggtggaccgcgccagtcgcctcgaccatcctcggcaacctgctggacaccttcaccttcttcttcgtggcgttctggcgtagcgacaatccgttcatggcgcagcactgggtggaaatcgccacggtggactacggagtga

SEQ ID NO: 3436 - DNA, 243 bp, Pseudomonas aeruginosa
cacatcaggaaaggctaccataaggagataaagcgaatggccgaacaggggaggatagcccgtcggcaggctgacaacgacgaccgacgaagaaccgtgactaatagggaaagaaaagagggcagcaagggaggagggagaaaagagagcaatgaagaagagacgcccttcctccagattgcatcgataagcctcaagcgttgctctgcggccgccccggcagcatcttcaggatgccgttga

SEQ ID NO: 3437 - DNA, 1116 bp, Pseudomonas aeruginosa
gggtacggtaggagaagcgctcaggagacaggcgtgagagggagaaggccgcgcagagaacgggcaggcggagcgagaggccaacacacgcagggcgtcggggccgactgccagggagagacgcaggcgccgacacagcagactccgccagagcggcggcgcgacgcggggctcagcgcggcggcgacaacgcagcacgcgacgcccgcgacgaacgcgcgcgacggctggcggcgcggcggggcgcggcgccgccacgggcggcgacgggcaccgggcggcgcgaggggggccggggcaggcgcagcggcccgcgggcgaggaagccaggcaccaccgaaaggggagcgcgccgcgcgggccgcgggtttcggaaattcattttccgcccacgtgctcggggacgatcagcttgccggcggtcttcgccacgatctccacgacgctgaccccgggggcgcgctcgcggaggatgaaggcgccgtcctcgatctccaggtaggccaggtcggtgagcaccttgcgaatgcagccgcaaccggtcagcggcagggtgcagtacggcagcagcttggactcgccgtccttggaggcgtgggtcatggtgacgatgatgttctcggcgccggccaccaggtccatggcgccgcccatgcccttgaccagcttgccggggatcatccaggaggcgatgttgccgcgcacgtccacctcgaaggcaccgagcacggtgaggtcgacgtggccgccacggatcatggcgaaggactgcgccgagtcgaagatcgacgcgccgacgcgggcggtcacggtctgcttgccggcgttgatcatgtcggcgtcgacttccgcctcgctggggaacgcgcccatgccgagcaggccgttctccgactggagcatgacgtcgatgccttccggcacgtagttggccaccagggtcgggatgccgatgccgaggttgacgtagtagccgtccttcaattcgcgcgccacgcgctgcgccatctgttcgcgggtaagtgccatctggggaaacctcttgtcgttgtagcggccgccgtcaggcgcgcagcgtgcgtttctcgatgcgtttctcgaagcgaccctggatga

SEQ ID NO: 3438 - DNA, 921 bp, Pseudomonas aeruginosa
atgaccgtcaagcagttgcgcgccttcctcgccgtggcgcagagcctcagcttcgcccaggccggcgaacgcctgcacctctcccagccggccctgagcctggcgatcaagagcctggaggaaagcctcggcggtccgctgctggaacgtaccacccgcagcgtcagcctcacccccgagggcgagaccctgctgccgctggcgctgcgcctgctggccgactgggacaataccgaggaattgctgcgccagcacttcaccctgcaactgggcaaggtctccatcgccgccatgccctccttcgccggcaacctgctgccgctggtcttgaagacctttcgcgaacgccacccgcgggtcaacgtggcggtgcacgacgtgatcaacgagcaggtgctggagatggtccgcaaccgacgcgtcgagctgggcatcgccttcgagccggagtccctggaaaacctcgagttcaccccgttctacagcgaccgcttcgtcgccgtggtgccggccggctcgccgctgtccgggcaggagcgggtcagttggcgcgaactgctcggcgagcccttcattaccctgcaacgcccctcggcggtgcgcctgctcctggaagaaagcgtggccgccgagcacggccgcttgccggtggcgttcgagagccaccaactggtcacggtcgggcggatggtcgcccagggactcggtgtcagcgccgtgccgaccctgtgcatccagcagatgcaggaactcggcgcgcgctgcctgccgctctacgcgccgcaggtgcagcgacgggtcggcctgctgcggctgagcgagcacaagctgtccaccgccgcccaggccctcagcgacgtgctgctgcatggcaccgactggcgctcgctggcgctgccgcaggaccagtccacggagtga

SEQ ID NO: 3439 - DNA, 1713 bp, Pseudomonas aeruginosa
tgccccggcgctgatcgcggtgagcgaagacggtcgccgcgaggtgctcagccacgccgaactggcccgtcacgtggcgggcctgcagaagcgcctcgccgccctgggcataggccccggcgaccgggtcgccgcgctgatgccgaacacctggcagaccgtggtcggcatgctcgccaccgccagcctcggcgcgacctggtcgagctgctcgccggacttcggtacccagggcgtgatcgaccgcttcggccagatcgaaccgcgcgtgctgatcgcctgtgccggctaccgctacgccggcaagtcgctggacctgaccgccaagctcaacgaggtgctcgccggcctgcccggcctggagcaactgctggtggtgccctacgaccgtccgcaggcgcagccgcaggactaccgctgccaggcgcaggtcgcgctgtgggacgggttctaccaggccgagggcgagccggtcttcaccccggtgcccttcgagcagccgctgtacatcctctattcgtcgggcaccaccggagtccccaagtgcatcgtccatgccaccggcggcgtgctcctgcaacatctcaaggagcacggcctgcacaccgacctgggcgacggcgaccggctgttctactacaccacctgcggctggatgatgtggaactggctggcctccggtctggcggtgggcgccagcctggtgctctacgacggctcgccgttccaccccggccccgagcgcctgctggacctcatcgacgccgaggacatcgccgtgttcggcgccagcgccaagtacctggcggcgctcgagaaggccggcatgcgcccgcgccacagccaccgcctggacagcctgaggacactgctctccaccggttcgccgctggcccacgaaagcttcgactacgtctaccgcgagctgaagagcgacctctgcctgtcgtcgatctccggcggcaccgacatcgtttcctgcttcgccatcggcaacccggtgctgccggtgtggcgcggcgaactgcaatgcaaggcgctgggcatggccgtggaaatctgggacgacaacggccgccgcctcgccagcggcaagggcgagctggtctgcacccggcatttcccgtcgatcccgctgggcttctggaacgacccggatggcaccaggttccacgacgcctacttcgccagctttcccggcgtctgggcccatggcgactacgccgaggaaaccgtccacggcgggctggtcatccacggccgctccgacgcggtgctcaatcccggcggcgtgcgcatcggcaccgcggaaatctaccgccaggtggaaaaggtcgaggaagtcctcgagtccatcgccatcggccaggactggcagggcgatgtgcgtgtgctgctgttcgtccgcctgcgcgacggcgtgcgactcgacgagccgctgcgcgaacgcatccgccagaccatccgcgccaacgccacgccgcgccacgtaccggcgaagatcatccaggtcgccgatatcccgcgcaccctgagcggcaagatcgtcgagcttgcggtgcgcaacgtgatccacggccgcccggtgaagaacaccgacgcactggccaacccgcaggcgctggagctttatcgcgacctcgccgaactgcgcgactgaagccgcggcgagcctgggctagaatgcgcgttccgtcctaccgcaaaaggtaa

SEQ ID NO: 3440 - DNA, 1218 bp, Pseudomonas aeruginosa
ttccatgcccgtcgccatggcccgccacatcctggtcaagaccgaagccgaggccgcgcaactgaagcagcgcctggccaagggcgaggacttcgccacgctggcgaagaagcattcgacctgcccgtccggcaagcgcggcggcgacctcggcgaggtgcgcccggggcagatggtcaggtccatcgacaatgccatcttcaggaaacccgtgggcgtgctccagggtccgctgaagagccagttcggctaccatctcctggaagtgtatttccgcgactgaaccgccaccggagcgtccatgaccgccgaccagatcgccgccttctgcctgcaactgcccggcgcccgggaagacctcaagtggggttcgaaccgggtgttctcggtggccggcaacaagatgttcgccatcctcgacttcgtcgacaaggacggcggcctggccttcaaggtcggcagcgagctgttcctcggctatgtcgaccgccccggcatccgtccggcgccctacctggcgcgcgcgcactggatcgtcatggcccgcccctacccgatgaaggcggcggagttgcgcgaggccctggtccgttcccatcaactggtggtggcgcgcctgcccaagcgccagcgcctcggcctggtactcgacgcatgagtcgcgaccgtctgtacacctgggccggcctgtggcgctcgccgtcgtccagttgggaggccctgcgcctggaggacgaccaggcggaaagccagttgcgcgcgccggacgaacgcagcggcctgccctaccaattggactaccggctgcgctgggacgccgactggcatctacgtgaggcggtgttccacgtcgaaagcgaaaccggggtgcgcaagctgcacctgctcgccgatggccgcggccactggcaggacggcgacggcgaagcgctaccggcattcgacggttgcctggacatcgatatttggccaagccccttcaccaacaccttcccgatccgccgcctgggcctggccgatggccagcgcgcggaaatccgcgcgctctacatcgaggccccggccctggagccgcgtagcatgcgccaggcatacacccgcctggacgccagccactacctctacgagaacctcgaaggcagcgcgttcaaagcggtactgctggtggacgaacagggcctggtgatcgattacccgggtctcttccagcgtctctga

SEQ ID NO: 3441 - DNA, 948 bp, Pseudomonas aeruginosa
cgccgggcaccgcgcgtcgccgatagcccggcgaatccgttagcctgctttcattcgtcatctgcaacggtcatcatggcggaccgcgacaacccactgcgaccgcgtttcccacatgtccgtcgatatccgccccaccccgccggcgcaggacagcgcccggcagaacgtcaccctgcagatcgtctcggtggtgatgttcaccttcatcggctacctgaccatcggcatcccgctggcggtgctgcccggctacgtgcacgacgacctcggctacggctcggtgctggccggcctggtgatcagcctgcagtacctcgccaccctgctcgcccggccgtacgccgggcgcgtcatcgacggcctcgggccgaagcgcgcggtgctctacggcatggccggcagcgccgcgagcgggctgttcatgctgctctcggtggcgatccagggctggccggcgctgagcctggccagcctgctggtcggccgcctggtactcggcgcggcggaaagcctggtcggctcggcggcgatcggctggggcatcggccgggtcggcgcgccgcacaccgccaaggtgatttcctggaacggcatcgccagctacggcgccatcgccctcggggcgccgctaggggtgctgctggtgcagtggctggggctgtggagcatgggcgcgtccatcgtcctgctcggggcgctcggcttcgccctggcctggccgaagttgccggcgccgctggtgcacggcgagcgactgccgttccaccatgtgctcggccgggtcaccccgcacggtatgggcctggcgctgggggcgatcggcttcggcaccatcgccaccttcatcaccctttactacgccagccgtggctgggccaacgcactgctctgcctgagtgccttcggcggttgcttcatcggcgcccggctgttgttcgccaataa

SEQ ID NO: 3442 - DNA, 438 bp, Pseudomonas aeruginosa
tcgtccaggtccggacggatcgcgctctggtcgagccgggcgatttccagcaggtcggtgagcaaggtctcggcaccttccagggccaggtgggtgcgctccaccagttgcagttcggcggccggcaggccccgttcgcgcagggtgtcgaccagcagccgcgccgcgttgagcggttgcagcaggtcgtggctggcggcggcgaggtacttgtccttgctgtggttggcggcttcggcggcgtcgcgcgcctggcgcaactggcggttgagctcttccagctcgtgggtgcgctcggctacccgccgctccagctcctcgttcatggtctgcaggcgctgctgggcctggacccgctcggtgatgtcggcgacgaaaccttcgaccaattcttcctcgtcgtgcctgagcagcaggttcatcaatacctcgatgtga

SEQ ID NO: 3443 - DNA, 1656 bp, Pseudomonas aeruginosa
tggctcttgcgcgcggagtggctgcccaggccgagtaacccggccagggcctcctgctgctgctcagagggcctcgccatagaccacctcgacatcgcgctggctcgactcgcgcgggttggtaaggatgcacgggtcctgcatcgcgtggcgcgagaggaaaggaatgtcggagctgccgaccccgtgcagggcgaggctctcgtggaaacccacggcgtgcttgaaggcgatcaggtggtccaccaggcgctggcggacctgcccctgggtcagaccgcggcaatcgatgccgaaggtctcggcgatcaccttgaagcgttccggcgcggcgctgtagttgaacgccaccacgtgttcgaccagcgccgcgttgcacaggccgtggggcaggtcgagatagccgccgaggctgtgcgacatggcatgcaccgcgccgaggatggcgttggagaaggccagcccggcctgcatgctcccgagcatgatcttctcgcgcagggcgatgtcgccgggattggcgatcatctgtaccagattgccatcgatcaggcgcatcgcttccagcgcgtggggatcggtcagcggcccgtggccggtggagacgaacgcctcgatggcgtgtaccagtgcatcgatgccggtacaggccgaaaggaagggatccatggtcaacgtggtttccgggtcgatcagcgagacgtcaggcacaaccgccttgctcaccacggagaacttcatgcgctcgtcctggttggaaatgatcacgaactgcgagacgtccgccgaagtcccggcggtggtcgggatcaggatcagcggcggactcggcacccgcagccggtcgacgccttcgaactcgaggatgctgcggccatgggcggcgacgatgccgatgcccttggcgcaatccatcgggctgccgccgcccaccgcgacgatcacattgcagccctcgctgcgatagaactcggcgccgagcatcacctcgtcgacccgggggttgggcgaaacgtcggtatacaggcagtagtcgatgccctgcccctccaggcttgcctggatgtcggcgacccagccggcggcgagcacgccggggtcggagaccagcaggaccttgcgcgcaccgaaggtcttcacgtagttggcgacgctgtgccggcagccggcgccgaagatgatctcgggcgagacgaatttacgcagttggctgaggtcgtggctcatctgacagaccattcttattgttatcggacattgccggcagcctactgcattcgtcggttattgcaatgcgaccttggcggccctttcaatcctccagcaggcccaggtagaagcgccattccgccagcagcgcatgggcgcgattggccggctggcggaaaccgtggcgctcctgcggatagcggtggcactccacgcgcacgccgctgcgccgcaggccggcgaccatcgcctcggtctgctccggcaccaccaccgcgtcgagcccgccctggaagaacactaccggcgcgcggatacgcccgacctgaagcaccgggctgcgcaccaggtagcgacggcgctggcgcagcgggtcgccaatcagccagtcgaggtagtcaccctcgaacttgtgggtgcaacgcgccagtgccaacggatcgctga

SEQ ID NO: 3444 - DNA, 675 bp, Pseudomonas aeruginosa
ccccatagagactggcgccgccgcgcaggccatcgaggcaagccagggcgcgcaacgcgctgtagcctccggcgctggcgccacggacgaagacccgggcgcggtcgatccgtccctccgcgtccagctgcgccagcgcggcctcgatatcgcgcaactccaggcgcccccactggccgcgcaagcgctgccgataggcgcggccgtagccgctgctgccccggtagttcagcgcggccacggcgaaaccgcgctgggtccagaactgcaggccggcatcgaacgccggcgaatgcatcgaggtcggtccgccatgcagccacactagcagcggcggtggtcgtcggggatcgacgcggcggcgggcattgcgcggcggatagaagaaaccgtggccgttttcgccgttgcccagcccatagacgaaggcctgcggatgcgacaggtcgtcctccgccagcggtcgctcgccgccacgcagcacctcgacacgcagctcgtcgcgatggatcgccagcagcgccggcaggcgcccggccgccgccgcgatgcagtagaacgcccgggcatccgcggccagtccggcgaaccggttccagtccgcggccaggcgccgctcgctgccgtccgcttcgcgcaggaacagttgcccgccgccggcctcgacgcgactga

SEQ ID NO: 3445 - DNA, 741 bp, Pseudomonas aeruginosa
gcagcagccttccctctcccagcggcaggtggctgcaagcgcccaattgccagggcgcgccagcgtggtcggcatcggcgaagcggccggccaacgctacctcggcgcagggacgccaccagccgtcgcggtcgctcagccagtgaaggcggccggcgggatcgaagcgtggttgctggatcgactcgccgcctccggctccggccaggcagcgcgtacgcccattctccgccaggcccaggcgggtctcggtccagggctggtgcggacggtcccattcgatccaggccagccgccgcccctggccggcggcacgcggcgcggcgtagaaatcggcaccctcgaccagcacccggcgcgcgccatcggcgtccaggcgcacgatgcgatgcacgaccccggtcggcccatggctctcttccaccgccagcagggcatcccaggcatcgacgtaggccaggtcgccgtagcgacactgcgccccgccgcccagcacttgggctgcgcggcccgctcgccagcggcgtacctgctggtcggtttcgtcgacccaggccagcccgtcgagcgtcacgcagcaggcgccgccgccgtactcgtagacccggctgcgcaccgagccgtccggcgcggtgggctcctccagcacgccgtcgcgccacaggtacaggcgcgagcgcgcactggccggatcgaattccacccaggccagcccgccatgggccgccttcagctcgctga

SEQ ID NO: 3446 - DNA, 693 bp, Pseudomonas aeruginosa
aacagggtaccggcgctatcgaggtcctcgaccacccaggccgatgttgtcgcccggatgggggtcgccgcgatgcggggaatacggcggcgcgctgctgcgcagggggatcgcggtgaagcgcaggcgcggacaggccggaatggcgaaaggctcgccatcgagggcgatcggccgatggcgcaggccgccgttccagtgggaaagcatagggaacagcgggaagccttcgctgaggtcctggtggaccatctgcgtgcaccagacttcgtgcgggcagccttcgcgcaggctgagcaggccggtggtgtggtcgatctggctgtcgagcaggacgatcgcgccgatcgccgtatcgcgcggccgacgcgccggctggagggccgggaaggcggcgatctgggcacggatgtcgggcgaggcgttgcagaggatccagcgctcgccgtcgtcggacagggcgatggaggattgcgtgcgtggctgggccgctacgctgccgtcgcggaccccgcgacagttgcggcagttgcagttccactgggggaagccgccgccggcggccgaaccgagaatacggatgtgcatgggtctgccccgcgggctggagggaggccccggaagaccggggccgaacggatcagcggttggcgaagtagagggtcacttcgaaaccgagacgcaggtcggtga

SEQ ID NO: 3447 - DNA, 465 bp, Pseudomonas aeruginosa
gagggagaaggccgcgcagagaacgggcaggcggagcgagaggccaacacacgcagggcgtcggggccgactgccagggagagacgcaggcgccgacacagcagactccgccagagcggcggcgcgacgcggggctcagcgcggcggcgacaacgcagcacgcgacgcccgcgacgaacgcgcgcgacggctggcggcgcggcggggcgcggcgccgccacgggcggcgacgggcaccgggcggcgcgaggggggccggggcaggcgcagcggcccgcgggcgaggaagccaggcaccaccgaaaggggagcgcgccgcgcgggccgcgggtttcggaaattcattttccgcccacgtgctcggggacgatcagcttgccggcggtcttcgccacgatctccacgacgctgaccccgggggcgcgctcgcggaggatgaaggcgccgtcctcgatctccaggtag

SEQ ID NO: 3448 - DNA, 426 bp, Pseudomonas aeruginosa
gccaggtcggtgagcaccttgcgaatgcagccgcaaccggtcagcggcagggtgcagtacggcagcagcttggactcgccgtccttggaggcgtgggtcatggtgacgatgatgttctcggcgccggccaccaggtccatggcgccgcccatgcccttgaccagcttgccggggatcatccaggaggcgatgttgccgcgcacgtccacctcgaaggcaccgagcacggtgaggtcgacgtggccgccacggatcatggcgaaggactgcgccgagtcgaagatcgacgcgccgacgcgggcggtcacggtctgcttgccggcgttgatcatgtcggcgtcgacttccgcctcgctggggaacgcgcccatgccgagcaggccgttctccgactggagcatgacgtcgatgccttccggcacgtag

SEQ ID NO: 3449 - DNA, 756 bp, Pseudomonas aeruginosa
cggccgccgtcaggcgcgcagcgtgcgtttctcgatgcgtttctcgaagcgaccctggatgatccggtcgacgtagatgccgggggtgtggatctgcgtcgggtccagttcgccgggctcgacgatctcctccacctcgaccaccgtgatgcgcccggcggtggcgaccagcgggttgaagttctgcgcggtgtggcgatagacgacgttgccgaaatggtcggccttccagcccttgacgatggcgaagtcgccggtgatggccggttcgaggatgtagtggcggccattgaactcgcgcgcctccttgccctcggcgaccggggtgccgtagccggtggcggtgaagaaggccgggatgccggcgccgccggcgcggatcttctcggccagcgagccttgcggggtcagttcgacttccagctcgccactgagcagttgttgctcgaacagggcgttctcgccgacataggaggcgatcatcttgcggatctgccggtcttccagcagcacgccgaggccgaaaccgtcgacgccgcagttgttcgagaccaccgtgaggtccctgaccccgcgccggcggatttccgcgatcaggttctcgggaatcccgcagaggccgaagcccccggcgaggacggtcatgccgtcggtcaggccttcgagggcctcttcgtaagtgcctactcgcttgtcgagtccgctcatgctgctgtgcctcttccggctcttgtgattgtgcgtgcggcagtctga

SEQ ID NO: 3450 - DNA, 2127 bp, Pseudomonas aeruginosa
gcgagcacaagctgtccaccgccgcccaggccctcagcgacgtgctgctgcatggcaccgactggcgctcgctggcgctgccgcaggaccagtccacggagtgaggcaggcagcggcgggtccggttatgcttcctgcatgtcccggaacaacaacaaggacggacacgccatgcccgcaccgctctggagcccttccgccgaacgcatcgccgccagtcgcatggaggccttccgacgcttcgtcaaccagcggcacgccctcggcctggtcgactacccggcgctgcatgcctggagcgtgcagcggcgcgaggcgttctggcaggccatcatcaacttcttcgaggtgcgcttccagcaaccgccgcgtgcggtcctcgaggaaggcgcgcagatgccctcggcgcgctggttccccggcgccacgctgaatttcgccgaacacctgctgcgccgccgcgatgatgccccggcgctgatcgcggtgagcgaagacggtcgccgcgaggtgctcagccacgccgaactggcccgtcacgtggcgggcctgcagaagcgcctcgccgccctgggcataggccccggcgaccgggtcgccgcgctgatgccgaacacctggcagaccgtggtcggcatgctcgccaccgccagcctcggcgcgacctggtcgagctgctcgccggacttcggtacccagggcgtgatcgaccgcttcggccagatcgaaccgcgcgtgctgatcgcctgtgccggctaccgctacgccggcaagtcgctggacctgaccgccaagctcaacgaggtgctcgccggcctgcccggcctggagcaactgctggtggtgccctacgaccgtccgcaggcgcagccgcaggactaccgctgccaggcgcaggtcgcgctgtgggacgggttctaccaggccgagggcgagccggtcttcaccccggtgcccttcgagcagccgctgtacatcctctattcgtcgggcaccaccggagtccccaagtgcatcgtccatgccaccggcggcgtgctcctgcaacatctcaaggagcacggcctgcacaccgacctgggcgacggcgaccggctgttctactacaccacctgcggctggatgatgtggaactggctggcctccggtctggcggtgggcgccagcctggtgctctacgacggctcgccgttccaccccggccccgagcgcctgctggacctcatcgacgccgaggacatcgccgtgttcggcgccagcgccaagtacctggcggcgctcgagaaggccggcatgcgcccgcgccacagccaccgcctggacagcctgaggacactgctctccaccggttcgccgctggcccacgaaagcttcgactacgtctaccgcgagctgaagagcgacctctgcctgtcgtcgatctccggcggcaccgacatcgtttcctgcttcgccatcggcaacccggtgctgccggtgtggcgcggcgaactgcaatgcaaggcgctgggcatggccgtggaaatctgggacgacaacggccgccgcctcgccagcggcaagggcgagctggtctgcacccggcatttcccgtcgatcccgctgggcttctggaacgacccggatggcaccaggttccacgacgcctacttcgccagctttcccggcgtctgggcccatggcgactacgccgaggaaaccgtccacggcgggctggtcatccacggccgctccgacgcggtgctcaatcccggcggcgtgcgcatcggcaccgcggaaatctaccgccaggtggaaaaggtcgaggaagtcctcgagtccatcgccatcggccaggactggcagggcgatgtgcgtgtgctgctgttcgtccgcctgcgcgacggcgtgcgactcgacgagccgctgcgcgaacgcatccgccagaccatccgcgccaacgccacgccgcgccacgtaccggcgaagatcatccaggtcgccgatatcccgcgcaccctgagcggcaagatcgtcgagcttgcggtgcgcaacgtgatccacggccgcccggtgaagaacaccgacgcactggccaacccgcaggcgctggagctttatcgcgacctcgccgaactgcgcgactga

SEQ ID NO: 3451 - DNA, 336 bp, Pseudomonas aeruginosa
agccgcggcgagcctgggctagaatgcgcgttccgtcctaccgcaaaaggtaattccatgcccgtcgccatggcccgccacatcctggtcaagaccgaagccgaggccgcgcaactgaagcagcgcctggccaagggcgaggacttcgccacgctggcgaagaagcattcgacctgcccgtccggcaagcgcggcggcgacctcggcgaggtgcgcccggggcagatggtcaggtccatcgacaatgccatcttcaggaaacccgtgggcgtgctccagggtccgctgaagagccagttcggctaccatctcctggaagtgtatttccgcgactga

SEQ ID NO: 3452 - DNA, 375 bp, Pseudomonas aeruginosa
accgccaccggagcgtccatgaccgccgaccagatcgccgccttctgcctgcaactgcccggcgcccgggaagacctcaagtggggttcgaaccgggtgttctcggtggccggcaacaagatgttcgccatcctcgacttcgtcgacaaggacggcggcctggccttcaaggtcggcagcgagctgttcctcggctatgtcgaccgccccggcatccgtccggcgccctacctggcgcgcgcgcactggatcgtcatggcccgcccctacccgatgaaggcggcggagttgcgcgaggccctggtccgttcccatcaactggtggtggcgcgcctgcccaagcgccagcgcctcggcctggtactcgacgcatga

SEQ ID NO: 3453 - DNA, 528 bp, Pseudomonas aeruginosa
gtcgcgaccgtctgtacacctgggccggcctgtggcgctcgccgtcgtccagttgggaggccctgcgcctggaggacgaccaggcggaaagccagttgcgcgcgccggacgaacgcagcggcctgccctaccaattggactaccggctgcgctgggacgccgactggcatctacgtgaggcggtgttccacgtcgaaagcgaaaccggggtgcgcaagctgcacctgctcgccgatggccgcggccactggcaggacggcgacggcgaagcgctaccggcattcgacggttgcctggacatcgatatttggccaagccccttcaccaacaccttcccgatccgccgcctgggcctggccgatggccagcgcgcggaaatccgcgcgctctacatcgaggccccggccctggagccgcgtagcatgcgccaggcatacacccgcctggacgccagccactacctctacgagaacctcgaaggcagcgcgttcaaagcggtactgctggtggacgaacagggcctggtga

SEQ ID NO: 3454 - DNA, 1281 bp, Pseudomonas aeruginosa
cctgctttcattcgtcatctgcaacggtcatcatggcggaccgcgacaacccactgcgaccgcgtttcccacatgtccgtcgatatccgccccaccccgccggcgcaggacagcgcccggcagaacgtcaccctgcagatcgtctcggtggtgatgttcaccttcatcggctacctgaccatcggcatcccgctggcggtgctgcccggctacgtgcacgacgacctcggctacggctcggtgctggccggcctggtgatcagcctgcagtacctcgccaccctgctcgcccggccgtacgccgggcgcgtcatcgacggcctcgggccgaagcgcgcggtgctctacggcatggccggcagcgccgcgagcgggctgttcatgctgctctcggtggcgatccagggctggccggcgctgagcctggccagcctgctggtcggccgcctggtactcggcgcggcggaaagcctggtcggctcggcggcgatcggctggggcatcggccgggtcggcgcgccgcacaccgccaaggtgatttcctggaacggcatcgccagctacggcgccatcgccctcggggcgccgctaggggtgctgctggtgcagtggctggggctgtggagcatgggcgcgtccatcgtcctgctcggggcgctcggcttcgccctggcctggccgaagttgccggcgccgctggtgcacggcgagcgactgccgttccaccatgtgctcggccgggtcaccccgcacggtatgggcctggcgctgggggcgatcggcttcggcaccatcgccaccttcatcaccctttactacgccagccgtggctgggccaacgcactgctctgcctgagtgccttcggcggttgcttcatcggcgcccggctgttgttcgccaataacatcaaccggctcggcggcttccgcgtggcgatcatctgcctcggcgtcgaaagcctcggcctgctgttgctgtggagcgcgccgaatccctgggtcggcctggccggcgcggccctcaccggcttcggcttctccctggtgttcccggcgttcggcgtggaaacggtgaacctggtaccggcttccaaccgtggcgcggcgctgggcgcctactcgctgttcgtcgacctgtcgctgggcatcaccgggccgctggtgggcttcgtcgccaacctgttcggcttccgctcgatgttcctcttcgcctgcctggcctcgctcggcgggctggccctggccgtcgcactgcaccggcgcagccgccggcctggctag

SEQ ID NO: 3455 - DNA, 417 bp, Pseudomonas aeruginosa
gcagcaggttcatcaatacctcgatgtgactgccgtccctgcgccagaggcgcgtctcgtagccgaacaggccgccgcgctcgcgcagcagcgcgcggatccgtcgcatctcggcctcgccgccgacgaacagttgcccggccatgtcctccagcgaccagagcacctgttgcggatcgtcgtagccgagcatctgcgccagcgccggattggcggcgcgcagcccctggccgaggctggcctggaagatgccgtgcaccgcgtgctcgaacagccatttgtagcggttgcgctcggcctccagctcctccaggcgcgccagcagctccgggtagtggctcttgcgcgcggagtggctgcccaggccgagtaacccggccagggcctcctgctgctgctcagagggcctcgccatag

SEQ ID NO: 3456 - DNA, 564 bp, Pseudomonas aeruginosa
ccgccgaggctgtgcgacatggcatgcaccgcgccgaggatggcgttggagaaggccagcccggcctgcatgctcccgagcatgatcttctcgcgcagggcgatgtcgccgggattggcgatcatctgtaccagattgccatcgatcaggcgcatcgcttccagcgcgtggggatcggtcagcggcccgtggccggtggagacgaacgcctcgatggcgtgtaccagtgcatcgatgccggtacaggccgaaaggaagggatccatggtcaacgtggtttccgggtcgatcagcgagacgtcaggcacaaccgccttgctcaccacggagaacttcatgcgctcgtcctggttggaaatgatcacgaactgcgagacgtccgccgaagtcccggcggtggtcgggatcaggatcagcggcggactcggcacccgcagccggtcgacgccttcgaactcgaggatgctgcggccatgggcggcgacgatgccgatgcccttggcgcaatccatcgggctgccgccgcccaccgcgacgatcacattgcagccctcgctgcgatag

SEQ ID NO: 3457 - DNA, 1317 bp, Pseudomonas aeruginosa
cagcggcggtggtcgtcggggatcgacgcggcggcgggcattgcgcggcggatagaagaaaccgtggccgttttcgccgttgcccagcccatagacgaaggcctgcggatgcgacaggtcgtcctccgccagcggtcgctcgccgccacgcagcacctcgacacgcagctcgtcgcgatggatcgccagcagcgccggcaggcgcccggccgccgccgcgatgcagtagaacgcccgggcatccgcggccagtccggcgaaccggttccagtccgcggccaggcgccgctcgctgccgtccgcttcgcgcaggaacagttgcccgccgccggcctcgacgcgactgagcagcagccttccctctcccagcggcaggtggctgcaagcgcccaattgccagggcgcgccagcgtggtcggcatcggcgaagcggccggccaacgctacctcggcgcagggacgccaccagccgtcgcggtcgctcagccagtgaaggcggccggcgggatcgaagcgtggttgctggatcgactcgccgcctccggctccggccaggcagcgcgtacgcccattctccgccaggcccaggcgggtctcggtccagggctggtgcggacggtcccattcgatccaggccagccgccgcccctggccggcggcacgcggcgcggcgtagaaatcggcaccctcgaccagcacccggcgcgcgccatcggcgtccaggcgcacgatgcgatgcacgaccccggtcggcccatggctctcttccaccgccagcagggcatcccaggcatcgacgtaggccaggtcgccgtagcgacactgcgccccgccgcccagcacttgggctgcgcggcccgctcgccagcggcgtacctgctggtcggtttcgtcgacccaggccagcccgtcgagcgtcacgcagcaggcgccgccgccgtactcgtagacccggctgcgcaccgagccgtccggcgcggtgggctcctccagcacgccgtcgcgccacaggtacaggcgcgagcgcgcactggccggatcgaattccacccaggccagcccgccatgggccgccttcagctcgctgaaatcgcgcccggcggccaccgcgcgctcggcgctccagtcgctcggccagtcgccgtagtcgaccattgcctcaggccttgcagatcaggcgtgacgcgcgctggttgcgccaggtcagcgcgtccaggccaagcggcgcctcctcggcctggcgacgggccgcgaggatcaggtcgtgccgtgccgacttggcgcagaccgggtcggtggcgtcggcatcgccggtga

SEQ ID NO: 3458 - DNA, 447 bp, Pseudomonas aeruginosa
tcaggttggtgtagaagcccaggccgcgccctgcctcgatcagttcggcgaggtcctggcgcagcaccggctcgccgccggagaaaccgagctgtgcggcgcccagctcgcgggcctggcggaacacctcgatccattccgcggtactcagctcggcgccctcgcgggcgaattccagcgggttcgagcagtacgggcactgcaacggacagcgataggtcagctcggccagcagccagagcggcggccccacgctttcactgcagctcgatccagaattgcgcatgggccacctcgaggaacgccaggatgtcttcgtctatgccggggacttcggggaaacgctcgcgcagcgccgcgacgatggccgccacgtcgcggcggccatcgaccagcttgaggatttccccggcgctgtcgttgagcttgaccatgccttcggggtag

SEQ ID NO: 3459 - DNA, 1029 bp, Pseudomonas aeruginosa
gcaccttgcgcgcggccggcaccttcgccagcacctcgagcatgccgcccggcccgctctgcgccaggtgccccatctgccggccgagcttgtcgccgacctcgcagaccagcatctcgtcatcgcgccagagcgtaccgtccaccagcaggcagtcggcgcggcgcatccattcgagcagcgcctcgtccacctcgccgaggcccggcgcatagaacagggtaccggcgctatcgaggtcctcgaccacccaggccgatgttgtcgcccggatgggggtcgccgcgatgcggggaatacggcggcgcgctgctgcgcagggggatcgcggtgaagcgcaggcgcggacaggccggaatggcgaaaggctcgccatcgagggcgatcggccgatggcgcaggccgccgttccagtgggaaagcatagggaacagcgggaagccttcgctgaggtcctggtggaccatctgcgtgcaccagacttcgtgcgggcagccttcgcgcaggctgagcaggccggtggtgtggtcgatctggctgtcgagcaggacgatcgcgccgatcgccgtatcgcgcggccgacgcgccggctggagggccgggaaggcggcgatctgggcacggatgtcgggcgaggcgttgcagaggatccagcgctcgccgtcgtcggacagggcgatggaggattgcgtgcgtggctgggccgctacgctgccgtcgcggaccccgcgacagttgcggcagttgcagttccactgggggaagccgccgccggcggccgaaccgagaatacggatgtgcatgggtctgccccgcgggctggagggaggccccggaagaccggggccgaacggatcagcggttggcgaagtagagggtcacttcgaaaccgagacgcaggtcggtgaagctgggcttggtccacatggggtcgatcctctctggtggggccgggcgattccggcaggtcgagttaaacatcagcggggctcgctccgaatgagactttcgaaggagttttccccctga

SEQ ID NO: 3460 - DNA, 594 bp, Pseudomonas aeruginosa
  unsure (566): Identity of nucleotide at the above locations are unknown.
tccatgcaggggcggcggcgaggcgaaaaaaaagacgcggccagggccgcgtcgcgccagaacccgccatggggaaagccgcgtcgggacgcgggacgagcgcacccgcaggtgccttggcggaaaggccgcgggtcggagcgatccgcggcggctgaggaccgctcagaagaagcccagcgggttgatgtcgtagctcaccagcaggttcttggtctgctggtagtggtcgagcatcatcttgtgcgtctcgcgaccgacgccggacttcttgtagccgccgaacgcggcgtgggccgggtacaggtggtagcagttggtccacacgcgaccggccttgatcccgcggcccatgcggtaggcgcggttgatgtcgcgggtccagaggccggcgccgaggccgtactcggtgtcgttggcgatggccagggcctcggcttcgtccttgaaggtggtgacgccgaccaccgggccgaagatttcctcctggaacacgcgcatgccgttgtgccccttgagcagggtcggctggatctagtagccgctggtcagatgcgtccgagttnttgtatatgcggccgcggagcagctcaa

SEQ ID NO: 3461 - DNA, 438 bp, Pseudomonas aeruginosa
gagaagcgctcaggagacaggcgtgagagggagaaggccgcgcagagaacgggcaggcggagcgagaggccaacacacgcagggcgtcggggccgactgccagggagagacgcaggcgccgacacagcagactccgccagagcggcggcgcgacgcggggctcagcgcggcggcgacaacgcagcacgcgacgcccgcgacgaacgcgcgcgacggctggcggcgcggcggggcgcggcgccgccacgggcggcgacgggcaccgggcggcgcgaggggggccggggcaggcgcagcggcccgcgggcgaggaagccaggcaccaccgaaaggggagcgcgccgcgcgggccgcgggtttcggaaattcattttccgcccacgtgctcggggacgatcagcttgccggcggtcttcgccacgatctccacgacgctga

SEQ ID NO: 3462 - DNA, 1263 bp, Pseudomonas aeruginosa
gaaaaacaaataaatgaccgtcaagcagttgcgcgccttcctcgccgtggcgcagagcctcagcttcgcccaggccggcgaacgcctgcacctctcccagccggccctgagcctggcgatcaagagcctggaggaaagcctcggcggtccgctgctggaacgtaccacccgcagcgtcagcctcacccccgagggcgagaccctgctgccgctggcgctgcgcctgctggccgactgggacaataccgaggaattgctgcgccagcacttcaccctgcaactgggcaaggtctccatcgccgccatgccctccttcgccggcaacctgctgccgctggtcttgaagacctttcgcgaacgccacccgcgggtcaacgtggcggtgcacgacgtgatcaacgagcaggtgctggagatggtccgcaaccgacgcgtcgagctgggcatcgccttcgagccggagtccctggaaaacctcgagttcaccccgttctacagcgaccgcttcgtcgccgtggtgccggccggctcgccgctgtccgggcaggagcgggtcagttggcgcgaactgctcggcgagcccttcattaccctgcaacgcccctcggcggtgcgcctgctcctggaagaaagcgtggccgccgagcacggccgcttgccggtggcgttcgagagccaccaactggtcacggtcgggcggatggtcgcccagggactcggtgtcagcgccgtgccgaccctgtgcatccagcagatgcaggaactcggcgcgcgctgcctgccgctctacgcgccgcaggtgcagcgacgggtcggcctgctgcggctgagcgagcacaagctgtccaccgccgcccaggccctcagcgacgtgctgctgcatggcaccgactggcgctcgctggcgctgccgcaggaccagtccacggagtgaggcaggcagcggcgggtccggttatgcttcctgcatgtcccggaacaacaacaaggacggacacgccatgcccgcaccgctctggagcccttccgccgaacgcatcgccgccagtcgcatggaggccttccgacgcttcgtcaaccagcggcacgccctcggcctggtcgactacccggcgctgcatgcctggagcgtgcagcggcgcgaggcgttctggcaggccatcatcaacttcttcgaggtgcgcttccagcaaccgccgcgtgcggtcctcgaggaaggcgcgcagatgccctcggcgcgctggttccccggcgccacgctga

SEQ ID NO: 3463 - DNA, 606 bp, Pseudomonas aeruginosa
agagcgacctctgcctgtcgtcgatctccggcggcaccgacatcgtttcctgcttcgccatcggcaacccggtgctgccggtgtggcgcggcgaactgcaatgcaaggcgctgggcatggccgtggaaatctgggacgacaacggccgccgcctcgccagcggcaagggcgagctggtctgcacccggcatttcccgtcgatcccgctgggcttctggaacgacccggatggcaccaggttccacgacgcctacttcgccagctttcccggcgtctgggcccatggcgactacgccgaggaaaccgtccacggcgggctggtcatccacggccgctccgacgcggtgctcaatcccggcggcgtgcgcatcggcaccgcggaaatctaccgccaggtggaaaaggtcgaggaagtcctcgagtccatcgccatcggccaggactggcagggcgatgtgcgtgtgctgctgttcgtccgcctgcgcgacggcgtgcgactcgacgagccgctgcgcgaacgcatccgccagaccatccgcgccaacgccacgccgcgccacgtaccggcgaagatcatccaggtcgccgatatcccgcgcaccctga

SEQ ID NO: 3464 - DNA, 1332 bp, Pseudomonas aeruginosa
agagaatctcggtctcgttgtccaccaccagcagccggcccgtcccggcagcggatcaccagccgaaacccgcgcaatcgcctcgccgggtgctggccgcgccggcttgcggaccagcggcacctcgatggcgaacagcgagcctcggcctggagtcgaatgcacctcgatgcggtagccgaggatgccggcgatacggtcgacgatggccagcccgagtccgacgccacggcgctcggaagcgcgcccggcgtccagttggttgaactcgaggaagatcgcctgcaactggtcggcggggatgccccggccagtgtcccacacctccaggcgtaccttgccgccacgccggcgcgcccccagcagcacgctgccgcgctcggtgtagcggcaggcgttgctgagcaagttgcgcaggatccgcgacagcaggcgcgcatcggtgcgcactgccagtcgcgggatccgcgcacgcagggccaggccggcggcacgcgcgacttcctcgaactccgaggccagcggagcgagcagttcgtcgagggaatagtcgtccaggtccggacggatcgcgctctggtcgagccgggcgatttccagcaggtcggtgagcaaggtctcggcaccttccagggccaggtgggtgcgctccaccagttgcagttcggcggccggcaggccccgttcgcgcagggtgtcgaccagcagccgcgccgcgttgagcggttgcagcaggtcgtggctggcggcggcgaggtacttgtccttgctgtggttggcggcttcggcggcgtcgcgcgcctggcgcaactggcggttgagctcttccagctcgtgggtgcgctcggctacccgccgctccagctcctcgttcatggtctgcaggcgctgctgggcctggacccgctcggtgatgtcggcgacgaaaccttcgaccaattcttcctcgtcgtgcctgagcagcaggttcatcaatacctcgatgtgactgccgtccctgcgccagaggcgcgtctcgtagccgaacaggccgccgcgctcgcgcagcagcgcgcggatccgtcgcatctcggcctcgccgccgacgaacagttgcccggccatgtcctccagcgaccagagcacctgttgcggatcgtcgtagccgagcatctgcgccagcgccggattggcggcgcgcagcccctggccgaggctggcctggaagatgccgtgcaccgcgtgctcgaacagccatttgtagcggttgcgctcggcctccagctcctccaggcgcgccagcagctccgggtagtggctcttgcgcgcggagtggctgcccaggccgagtaa

SEQ ID NO: 3465 - DNA, 417 bp, Pseudomonas aeruginosa
tcacgaactgcgagacgtccgccgaagtcccggcggtggtcgggatcaggatcagcggcggactcggcacccgcagccggtcgacgccttcgaactcgaggatgctgcggccatgggcggcgacgatgccgatgcccttggcgcaatccatcgggctgccgccgcccaccgcgacgatcacattgcagccctcgctgcgatagaactcggcgccgagcatcacctcgtcgacccgggggttgggcgaaacgtcggtatacaggcagtagtcgatgccctgcccctccaggcttgcctggatgtcggcgacccagccggcggcgagcacgccggggtcggagaccagcaggaccttgcgcgcaccgaaggtcttcacgtagttggcgacgctgtgccggcagccggcgccgaagatga

SEQ ID NO: 3466 - DNA, 717 bp, Pseudomonas aeruginosa
cgcgcgctggttgcgccaggtcagcgcgtccaggccaagcggcgcctcctcggcctggcgacgggccgcgaggatcaggtcgtgccgtgccgacttggcgcagaccgggtcggtggcgtcggcatcgccggtgaggaggaacgcctggcagcggcagccgccgtggtccctctccttctcctcgcaggaacggcagggttcgggcatccaggcgtcgccgcggtaacggttgaagccgaacgattcgtaccagatgtggcgcaggctgtgctcgcgcacgttgggaaactgcaccggcaattgccgcgcgctgtgacacggcagcgcggtgccgtcgggggtgatgtcgaggaatacgctggcccagccgcccatgcaggccttcggccgttcctcgtagtagtcgggggtgacgaagatcagcttgcacgggttgccttcggcggccagccgctggcggtattcggcggtgatccgctcggcgcgctccagttgggcgcgggtcggcagcagcccggcacggttcagcgcggcccagccgtagaactggcaagtggcgagttcgacgtaatcggcttccagctcgatgcacagctggatgatccgctcgatgttgtcgatgttgtgccggtgggtgacgaagttgagcaccatcggatagccgtgcgccttcaccgcgcgggccatcgccagtttctgggcgaaggccttgcgtga

SEQ ID NO: 3467 - DNA, 519 bp, Pseudomonas aeruginosa
gccggcgagcaggttgttcacttcttcgtcggcggcctggaagctgatctgcacgtggtccagcccggcctcggcgaagcgcgccaggcgtgcctcgtcgaggccgatgccggaggtgatcaggttggtgtagaagcccaggccgcgccctgcctcgatcagttcggcgaggtcctggcgcagcaccggctcgccgccggagaaaccgagctgtgcggcgcccagctcgcgggcctggcggaacacctcgatccattccgcggtactcagctcggcgccctcgcgggcgaattccagcgggttcgagcagtacgggcactgcaacggacagcgataggtcagctcggccagcagccagagcggcggccccacgctttcactgcagctcgatccagaattgcgcatgggccacctcgaggaacgccaggatgtcttcgtctatgccggggacttcggggaaacgctcgcgcagcgccgcgacgatggccgccacgtcgcggcggccatcgaccagcttga

SEQ ID NO: 3468 - DNA, 1203 bp, Pseudomonas aeruginosa
tgccagcccccgatgccagacccgctcgcgggtcaccgtgtggtacggcgggcgttcgagttcgtaggccatgctcatcgcgtcgagcatgctccacaacacgtccagcttgaattgcaggatatccagcatgcgttcctgtgcctcgcgggtccgatagtgctccagggtgatccgcaggccgtgctcgacgtcgcgccgggcctgggccaggcgactgcggaaatactcgtagccggccgcctcgatccacggatagtggcgcggccagctgtccagccgcgactggtggatctgcggggcgaagagttcggtcagcgaactgctcgccgcctcctgccaactggcgcgacgggcgaagttgacgtaggcgtcgacggcgaagcgcacgccgggcagcacccgctcctcggacagcacctgctcgcgctccaggcccaccgcttccgccagacgcagccaggcctcgatgccgcccgcctcgccgggggcgccgtcgtggtcgaggatacgctggatccactcgcggcggacctcgcggtcgggacagttggccaggatcgccgcgtccttcagcgggatgttgacctggtagtagaaacggttcgccacccagccctggatctgttcgcgactggcacggccctcgtacatcgcgacatggaacggatggtggatatggtagtagcgtcccttgtcgcgcagcgcccgttcgaattcggcgcgatccatggcggcacggctcatgttggccccctacagctggatgtgcatgccatcccaggccacttcgatgccactggcatccagttcggcgcgttcggccgaagcggtgtcgaggatgggattggtgttgttgatgtggatgagcaccttgcgcgcggccggcaccttcgccagcacctcgagcatgccgcccggcccgctctgcgccaggtgccccatctgccggccgagcttgtcgccgacctcgcagaccagcatctcgtcatcgcgccagagcgtaccgtccaccagcaggcagtcggcgcggcgcatccattcgagcagcgcctcgtccacctcgccgaggcccggcgcatagaacagggtaccggcgctatcgaggtcctcgaccacccaggccgatgttgtcgcccggatgggggtcgccgcgatgcggggaatacggcggcgcgctgctgcgcagggggatcgcggtga

SEQ ID NO: 3469 - DNA, 648 bp, Pseudomonas aeruginosa
ccctctacttcgccaaccgctgatccgttcggccccggtcttccggggcctccctccagcccgcggggcagacccatgcacatccgtattctcggttcggccgccggcggcggcttcccccagtggaactgcaactgccgcaactgtcgcggggtccgcgacggcagcgtagcggcccagccacgcacgcaatcctccatcgccctgtccgacgacggcgagcgctggatcctctgcaacgcctcgcccgacatccgtgcccagatcgccgccttcccggccctccagccggcgcgtcggccgcgcgatacggcgatcggcgcgatcgtcctgctcgacagccagatcgaccacaccaccggcctgctcagcctgcgcgaaggctgcccgcacgaagtctggtgcacgcagatggtccaccaggacctcagcgaaggcttcccgctgttccctatgctttcccactggaacggcggcctgcgccatcggccgatcgccctcgatggcgagcctttcgccattccggcctgtccgcgcctgcgcttcaccgcgatccccctgcgcagcagcgcgccgccgtattccccgcatcgcggcgacccccatccgggcgacaacatcggcctgggtggtcgaggacctcgatag

SEQ ID NO: 3470 - DNA, 1269 bp, Pseudomonas aeruginosa
cgagatgctggtctgcgaggtcggcgacaagctcggccggcagatggggcacctggcgcagagcgggccgggcggcatgctcgaggtgctggcgaaggtgccggccgcgcgcaaggtgctcatccacatcaacaacaccaatcccatcctcgacaccgcttcggccgaacgcgccgaactggatgccagtggcatcgaagtggcctgggatggcatgcacatccagctgtagggggccaacatgagccgtgccgccatggatcgcgccgaattcgaacgggcgctgcgcgacaagggacgctactaccatatccaccatccgttccatgtcgcgatgtacgagggccgtgccagtcgcgaacagatccagggctgggtggcgaaccgtttctactaccaggtcaacatcccgctgaaggacgcggcgatcctggccaactgtcccgaccgcgaggtccgccgcgagtggatccagcgtatcctcgaccacgacggcgcccccggcgaggcgggcggcatcgaggcctggctgcgtctggcggaagcggtgggcctggagcgcgagcaggtgctgtccgaggagcgggtgctgcccggcgtgcgcttcgccgtcgacgcctacgtcaacttcgcccgtcgcgccagttggcaggaggcggcgagcagttcgctgaccgaactcttcgccccgcagatccaccagtcgcggctggacagctggccgcgccactatccgtggatcgaggcggccggctacgagtatttccgcagtcgcctggcccaggcccggcgcgacgtcgagcacggcctgcggatcaccctggagcactatcggacccgcgaggcacaggaacgcatgctggatatcctgcaattcaagctggacgtgttgtggagcatgctcgacgcgatgagcatggcctacgaactcgaacgcccgccgtaccacacggtgacccgcgagcgggtctggcatcgggggctggcatcatgagcctgccgtcgctcgacagcgtgccgatgctgcgccggggcttccgcttccagttcgaaccggcccaggactgccatgtgctgctctaccccgaaggcatggtcaagctcaacgacagcgccggggaaatcctcaagctggtcgatggccgccgcgacgtggcggccatcgtcgcggcgctgcgcgagcgtttccccgaagtccccggcatagacgaagacatcctggcgttcctcgaggtggcccatgcgcaattctggatcgagctgcagtga

SEQ ID NO: 3471 - DNA, 1200 bp, Pseudomonas aeruginosa
aagcgtggggccgccgctctggctgctggccgagctgacctatcgctgtccgttgcagtgcccgtactgctcgaacccgctggaattcgcccgcgagggcgccgagctgagtaccgcggaatggatcgaggtgttccgccaggcccgcgagctgggcgccgcacagctcggtttctccggcggcgagccggtgctgcgccaggacctcgccgaactgatcgaggcagggcgcggcctgggcttctacaccaacctgatcacctccggcatcggcctcgacgaggcacgcctggcgcgcttcgccgaggccgggctggaccacgtgcagatcagcttccaggccgccgacgaagaagtgaacaacctgctcgccggctcacgcaaggccttcgcccagaaactggcgatggcccgcgcggtgaaggcgcacggctatccgatggtgctcaacttcgtcacccaccggcacaacatcgacaacatcgagcggatcatccagctgtgcatcgagctggaagccgattacgtcgaactcgccacttgccagttctacggctgggccgcgctgaaccgtgccgggctgctgccgacccgcgcccaactggagcgcgccgagcggatcaccgccgaataccgccagcggctggccgccgaaggcaacccgtgcaagctgatcttcgtcacccccgactactacgaggaacggccgaaggcctgcatgggcggctgggccagcgtattcctcgacatcacccccgacggcaccgcgctgccgtgtcacagcgcgcggcaattgccggtgcagtttcccaacgtgcgcgagcacagcctgcgccacatctggtacgaatcgttcggcttcaaccgttaccgcggcgacgcctggatgcccgaaccctgccgttcctgcgaggagaaggagagggaccacggcggctgccgctgccaggcgttcctcctcaccggcgatgccgacgccaccgacccggtctgcgccaagtcggcacggcacgacctgatcctcgcggcccgtcgccaggccgaggaggcgccgcttggcctggacgcgctgacctggcgcaaccagcgcgcgtcacgcctgatctgcaaggcctgaggcaatggtcgactacggcgactggccgagcgactggagcgccgagcgcgcggtggccgccgggcgcgatttcagcgagctga

SEQ ID NO: 3472 - DNA, 1221 bp, Pseudomonas aeruginosa
ccgacgaatgcagtaggctgccggcaatgtccgataacaataagaatggtctgtcagatgagccacgacctcagccaactgcgtaaattcgtctcgcccgagatcatcttcggcgccggctgccggcacagcgtcgccaactacgtgaagaccttcggtgcgcgcaaggtcctgctggtctccgaccccggcgtgctcgccgccggctgggtcgccgacatccaggcaagcctggaggggcagggcatcgactactgcctgtataccgacgtttcgcccaacccccgggtcgacgaggtgatgctcggcgccgagttctatcgcagcgagggctgcaatgtgatcgtcgcggtgggcggcggcagcccgatggattgcgccaagggcatcggcatcgtcgccgcccatggccgcagcatcctcgagttcgaaggcgtcgaccggctgcgggtgccgagtccgccgctgatcctgatcccgaccaccgccgggacttcggcggacgtctcgcagttcgtgatcatttccaaccaggacgagcgcatgaagttctccgtggtgagcaaggcggttgtgcctgacgtctcgctgatcgacccggaaaccacgttgaccatggatcccttcctttcggcctgtaccggcatcgatgcactggtacacgccatcgaggcgttcgtctccaccggccacgggccgctgaccgatccccacgcgctggaagcgatgcgcctgatcgatggcaatctggtacagatgatcgccaatcccggcgacatcgccctgcgcgagaagatcatgctcgggagcatgcaggccgggctggccttctccaacgccatcctcggcgcggtgcatgccatgtcgcacagcctcggcggctatctcgacctgccccacggcctgtgcaacgcggcgctggtcgaacacgtggtggcgttcaactacagcgccgcgccggaacgcttcaaggtgatcgccgagaccttcggcatcgattgccgcggtctgacccaggggcaggtccgccagcgcctggtggaccacctgatcgccttcaagcacgccgtgggtttccacgagagcctcgccctgcacggggtcggcagctccgacattcctttcctctcgcgccacgcgatgcaggacccgtgcatccttaccaacccgcgcgagtcgagccagcgcgatgtcgaggtggtctatggcgaggccctctga

SEQ ID NO: 3473 - DNA, 1302 bp, Pseudomonas aeruginosa
gcagcagcaggaggccctggccgggttactcggcctgggcagccactccgcgcgcaagagccactacccggagctgctggcgcgcctggaggagctggaggccgagcgcaaccgctacaaatggctgttcgagcacgcggtgcacggcatcttccaggccagcctcggccaggggctgcgcgccgccaatccggcgctggcgcagatgctcggctacgacgatccgcaacaggtgctctggtcgctggaggacatggccgggcaactgttcgtcggcggcgaggccgagatgcgacggatccgcgcgctgctgcgcgagcgcggcggcctgttcggctacgagacgcgcctctggcgcagggacggcagtcacatcgaggtattgatgaacctgctgctcaggcacgacgaggaagaattggtcgaaggtttcgtcgccgacatcaccgagcgggtccaggcccagcagcgcctgcagaccatgaacgaggagctggagcggcgggtagccgagcgcacccacgagctggaagagctcaaccgccagttgcgccaggcgcgcgacgccgccgaagccgccaaccacagcaaggacaagtacctcgccgccgccagccacgacctgctgcaaccgctcaacgcggcgcggctgctggtcgacaccctgcgcgaacggggcctgccggccgccgaactgcaactggtggagcgcacccacctggccctggaaggtgccgagaccttgctcaccgacctgctggaaatcgcccggctcgaccagagcgcgatccgtccggacctggacgactattccctcgacgaactgctcgctccgctggcctcggagttcgaggaagtcgcgcgtgccgccggcctggccctgcgtgcgcggatcccgcgactggcagtgcgcaccgatgcgcgcctgctgtcgcggatcctgcgcaacttgctcagcaacgcctgccgctacaccgagcgcggcagcgtgctgctgggggcgcgccggcgtggcggcaaggtacgcctggaggtgtgggacactggccggggcatccccgccgaccagttgcaggcgatcttcctcgagttcaaccaactggacgccgggcgcgcttccgagcgccgtggcgtcggactcgggctggccatcgtcgaccgtatcgccggcatcctcggctaccgcatcgaggtgcattcgactccaggccgaggctcgctgttcgccatcgaggtgccgctggtccgcaagccggcgcggccagcacccggcgaggcgattgcgcgggtttcggctggtga

SEQ ID NO: 3474 - DNA, 378 bp, Pseudomonas aeruginosa
tccgctgccgggacgggccggctgctggtggtggacaacgagaccgagattctcttcagcatgtccgcgctgctcggccagtggggctgcgaggtgcttaccgccaccgacctggaaggcgcgcgcaaggcgctcgatggccgcgcgccggatgcgatcctggtcgactaccacctggaccacggcgctaccggttgccagttgctgggcgccttgcgcgaggactacggcgcggagatcgccgcggtgatgatcaccgccgaccgcagcgacgattgccgccgcgcgctggcccgcctgggcgtgccgctgctcaacaagccgctgaagcccggcaagctgcgcgcggccctgagcgccttgctcggcgagctctag

SEQ ID NO: 3475 - DNA, 300 bp, Pseudomonas aeruginosa
gcgcccagcgccgcgccacggttggaagccggtaccaggttcaccgtttccacgccgaacgccgggaacaccagggagaagccgaagccggtgagggccgcgccggccaggccgacccagggattcggcgcgctccacagcaacagcaggccgaggctttcgacgccgaggcagatgatcgccacgcggaagccgccgagccggttgatgttattggcgaacaacagccgggcgccgatgaagcaaccgccgaaggcactcaggcagagcagtgcgttggcccagccacggctggcgtag

SEQ ID NO: 3476 - DNA, 216 bp, Pseudomonas aeruginosa
ctggcgatgccgttccaggaaatcaccttggcggtgtgcggcgcgccgacccggccgatgccccagccgatcgccgccgagccgaccaggctttccgccgcgccgagtaccaggcggccgaccagcaggctggccaggctcagcgccggccagccctggatcgccaccgagagcagcatgaacagcccgctcgcggcgctgccggccatgccgtag

SEQ ID NO: 3477 - DNA, 984 bp, Pseudomonas aeruginosa
ccggacccgccgctgcctgcctcactccgtggactggtcctgcggcagcgccagcgagcgccagtcggtgccatgcagcagcacgtcgctgagggcctgggcggcggtggacagcttgtgctcgctcagccgcagcaggccgacccgtcgctgcacctgcggcgcgtagagcggcaggcagcgcgcgccgagttcctgcatctgctggatgcacagggtcggcacggcgctgacaccgagtccctgggcgaccatccgcccgaccgtgaccagttggtggctctcgaacgccaccggcaagcggccgtgctcggcggccacgctttcttccaggagcaggcgcaccgccgaggggcgttgcagggtaatgaagggctcgccgagcagttcgcgccaactgacccgctcctgcccggacagcggcgagccggccggcaccacggcgacgaagcggtcgctgtagaacggggtgaactcgaggttttccagggactccggctcgaaggcgatgcccagctcgacgcgtcggttgcggaccatctccagcacctgctcgttgatcacgtcgtgcaccgccacgttgacccgcgggtggcgttcgcgaaaggtcttcaagaccagcggcagcaggttgccggcgaaggagggcatggcggcgatggagaccttgcccagttgcagggtgaagtgctggcgcagcaattcctcggtattgtcccagtcggccagcaggcgcagcgccagcggcagcagggtctcgccctcgggggtgaggctgacgctgcgggtggtacgttccagcagcggaccgccgaggctttcctccaggctcttgatcgccaggctcagggccggctgggagaggtgcaggcgttcgccggcctgggcgaagctgaggctctgcgccacggcgaggaaggcgcgcaactgcttgacggtcatttatttgtttttctcatcaatgaattggaaaaacaaacttaa

SEQ ID NO: 3478 - DNA, 1083 bp, Pseudomonas aeruginosa
ccccgcaaggctcgctggccgagaagatccgcgccggcggcgccggcatcccggccttcttcaccgccaccggctacggcaccccggtcgccgagggcaaggaggcgcgcgagttcaatggccgccactacatcctcgaaccggccatcaccggcgacttcgccatcgtcaagggctggaaggccgaccatttcggcaacgtcgtctatcgccacaccgcgcagaacttcaacccgctggtcgccaccgccgggcgcatcacggtggtcgaggtggaggagatcgtcgagcccggcgaactggacccgacgcagatccacacccccggcatctacgtcgaccggatcatccagggtcgcttcgagaaacgcatcgagaaacgcacgctgcgcgcctgacggcggccgctacaacgacaagaggtttccccagatggcacttacccgcgaacagatggcgcagcgcgtggcgcgcgaattgaaggacggctactacgtcaacctcggcatcggcatcccgaccctggtggccaactacgtgccggaaggcatcgacgtcatgctccagtcggagaacggcctgctcggcatgggcgcgttccccagcgaggcggaagtcgacgccgacatgatcaacgccggcaagcagaccgtgaccgcccgcgtcggcgcgtcgatcttcgactcggcgcagtccttcgccatgatccgtggcggccacgtcgacctcaccgtgctcggtgccttcgaggtggacgtgcgcggcaacatcgcctcctggatgatccccggcaagctggtcaagggcatgggcggcgccatggacctggtggccggcgccgagaacatcatcgtcaccatgacccacgcctccaaggacggcgagtccaagctgctgccgtactgcaccctgccgctgaccggttgcggctgcattcgcaaggtgctcaccgacctggcctacctggagatcgaggacggcgccttcatcctccgcgagcgcgcccccggggtcagcgtcgtggagatcgtggcgaagaccgccggcaagctgatcgtccccgagcacgtgggcggaaaatga

SEQ ID NO: 3479 - DNA, 741 bp, Pseudomonas aeruginosa
  unsure (30): Identity of nucleotide at the above locations are unknown.
attgagctgctccgcggccgcatatacaanaactcggacgcatctgaccagcggctactagatccagccgaccctgctcaaggggcacaacggcatgcgcgtgttccaggaggaaatcttcggcccggtggtcggcgtcaccaccttcaaggacgaagccgaggccctggccatcgccaacgacaccgagtacggcctcggcgccggcctctggacccgcgacatcaaccgcgcctaccgcatgggccgcgggatcaaggccggtcgcgtgtggaccaactgctaccacctgtacccggcccacgccgcgttcggcggctacaagaagtccggcgtcggtcgcgagacgcacaagatgatgctcgaccactaccagcagaccaagaacctgctggtgagctacgacatcaacccgctgggcttcttctgagcggtcctcagccgccgcggatcgctccgacccgcggcctttccgccaaggcacctgcgggtgcgctcgtcccgcgtcccgacgcggctttccccatggcgggttctggcgcgacgcggccctggccgcgtcttttttttcgcctcgccgccgcccctgcatggactaggcttctgccctgcaccagggcgaaccaggggggcgcaacggcgttctcccggcgaaccttgggcgggacaggcagtccctaccaaatcagggggaaaactccttcgaaagtctcattcggagcgagccccgctgatgtttaa

SEQ ID NO: 3480 - DNA, 819 bp, Pseudomonas aeruginosa
cggcccagccacgcacgcaatcctccatcgccctgtccgacgacggcgagcgctggatcctctgcaacgcctcgcccgacatccgtgcccagatcgccgccttcccggccctccagccggcgcgtcggccgcgcgatacggcgatcggcgcgatcgtcctgctcgacagccagatcgaccacaccaccggcctgctcagcctgcgcgaaggctgcccgcacgaagtctggtgcacgcagatggtccaccaggacctcagcgaaggcttcccgctgttccctatgctttcccactggaacggcggcctgcgccatcggccgatcgccctcgatggcgagcctttcgccattccggcctgtccgcgcctgcgcttcaccgcgatccccctgcgcagcagcgcgccgccgtattccccgcatcgcggcgacccccatccgggcgacaacatcggcctgggtggtcgaggacctcgatagcgccggtaccctgttctatgcgccgggcctcggcgaggtggacgaggcgctgctcgaatggatgcgccgcgccgactgcctgctggtggacggtacgctctggcgcgatgacgagatgctggtctgcgaggtcggcgacaagctcggccggcagatggggcacctggcgcagagcgggccgggcggcatgctcgaggtgctggcgaaggtgccggccgcgcgcaaggtgctcatccacatcaacaacaccaatcccatcctcgacaccgcttcggccgaacgcgccgaactggatgccagtggcatcgaagtggcctgggatggcatgcacatccagctgtag

SEQ ID NO: 3481 - DNA, 762 bp, Pseudomonas aeruginosa
ggggccaacatgagccgtgccgccatggatcgcgccgaattcgaacgggcgctgcgcgacaagggacgctactaccatatccaccatccgttccatgtcgcgatgtacgagggccgtgccagtcgcgaacagatccagggctgggtggcgaaccgtttctactaccaggtcaacatcccgctgaaggacgcggcgatcctggccaactgtcccgaccgcgaggtccgccgcgagtggatccagcgtatcctcgaccacgacggcgcccccggcgaggcgggcggcatcgaggcctggctgcgtctggcggaagcggtgggcctggagcgcgagcaggtgctgtccgaggagcgggtgctgcccggcgtgcgcttcgccgtcgacgcctacgtcaacttcgcccgtcgcgccagttggcaggaggcggcgagcagttcgctgaccgaactcttcgccccgcagatccaccagtcgcggctggacagctggccgcgccactatccgtggatcgaggcggccggctacgagtatttccgcagtcgcctggcccaggcccggcgcgacgtcgagcacggcctgcggatcaccctggagcactatcggacccgcgaggcacaggaacgcatgctggatatcctgcaattcaagctggacgtgttgtggagcatgctcgacgcgatgagcatggcctacgaactcgaacgcccgccgtaccacacggtgacccgcgagcgggtctggcatcgggggctggcatcatga

SEQ ID NO: 3482 - DNA, 1179 bp, Pseudomonas aeruginosa
acgaagacatcctggcgttcctcgaggtggcccatgcgcaattctggatcgagctgcagtgaaagcgtggggccgccgctctggctgctggccgagctgacctatcgctgtccgttgcagtgcccgtactgctcgaacccgctggaattcgcccgcgagggcgccgagctgagtaccgcggaatggatcgaggtgttccgccaggcccgcgagctgggcgccgcacagctcggtttctccggcggcgagccggtgctgcgccaggacctcgccgaactgatcgaggcagggcgcggcctgggcttctacaccaacctgatcacctccggcatcggcctcgacgaggcacgcctggcgcgcttcgccgaggccgggctggaccacgtgcagatcagcttccaggccgccgacgaagaagtgaacaacctgctcgccggctcacgcaaggccttcgcccagaaactggcgatggcccgcgcggtgaaggcgcacggctatccgatggtgctcaacttcgtcacccaccggcacaacatcgacaacatcgagcggatcatccagctgtgcatcgagctggaagccgattacgtcgaactcgccacttgccagttctacggctgggccgcgctgaaccgtgccgggctgctgccgacccgcgcccaactggagcgcgccgagcggatcaccgccgaataccgccagcggctggccgccgaaggcaacccgtgcaagctgatcttcgtcacccccgactactacgaggaacggccgaaggcctgcatgggcggctgggccagcgtattcctcgacatcacccccgacggcaccgcgctgccgtgtcacagcgcgcggcaattgccggtgcagtttcccaacgtgcgcgagcacagcctgcgccacatctggtacgaatcgttcggcttcaaccgttaccgcggcgacgcctggatgcccgaaccctgccgttcctgcgaggagaaggagagggaccacggcggctgccgctgccaggcgttcctcctcaccggcgatgccgacgccaccgacccggtctgcgccaagtcggcacggcacgacctgatcctcgcggcccgtcgccaggccgaggaggcgccgcttggcctggacgcgctgacctggcgcaaccagcgcgcgtcacgcctgatctgcaaggcctga

SEQ ID NO: 3483 - DNA, 1536 bp, Pseudomonas aeruginosa
ggcaatggtcgactacggcgactggccgagcgactggagcgccgagcgcgcggtggccgccgggcgcgatttcagcgagctgaaggcggcccatggcgggctggcctgggtggaattcgatccggccagtgcgcgctcgcgcctgtacctgtggcgcgacggcgtgctggaggagcccaccgcgccggacggctcggtgcgcagccgggtctacgagtacggcggcggcgcctgctgcgtgacgctcgacgggctggcctgggtcgacgaaaccgaccagcaggtacgccgctggcgagcgggccgcgcagcccaagtgctgggcggcggggcgcagtgtcgctacggcgacctggcctacgtcgatgcctgggatgccctgctggcggtggaagagagccatgggccgaccggggtcgtgcatcgcatcgtgcgcctggacgccgatggcgcgcgccgggtgctggtcgagggtgccgatttctacgccgcgccgcgtgccgccggccaggggcggcggctggcctggatcgaatgggaccgtccgcaccagccctggaccgagacccgcctgggcctggcggagaatgggcgtacgcgctgcctggccggagccggaggcggcgagtcgatccagcaaccacgcttcgatcccgccggccgccttcactggctgagcgaccgcgacggctggtggcgtccctgcgccgaggtagcgttggccggccgcttcgccgatgccgaccacgctggcgcgccctggcaattgggcgcttgcagccacctgccgctgggagagggaaggctgctgctcagtcgcgtcgaggccggcggcgggcaactgttcctgcgcgaagcggacggcagcgagcggcgcctggccgcggactggaaccggttcgccggactggccgcggatgcccgggcgttctactgcatcgcggcggcggccgggcgcctgccggcgctgctggcgatccatcgcgacgagctgcgtgtcgaggtgctgcgtggcggcgagcgaccgctggcggaggacgacctgtcgcatccgcaggccttcgtctatgggctgggcaacggcgaaaacggccacggtttcttctatccgccgcgcaatgcccgccgccgcgtcgatccccgacgaccaccgccgctgctagtgtggctgcatggcggaccgacctcgatgcattcgccggcgttcgatgccggcctgcagttctggacccagcgcggtttcgccgtggccgcgctgaactaccggggcagcagcggctacggccgcgcctatcggcagcgcttgcgcggccagtgggggcgcctggagttgcgcgatatcgaggccgcgctggcgcagctggacgcggagggacggatcgaccgcgcccgggtcttcgtccgtggcgccagcgccggaggctacagcgcgttgcgcgccctggcttgcctcgatggcctgcgcggcggcgccagtctctatggggtcagcgatccgttggcactggcgcgttgcacccacaagttcgagggtga

SEQ ID NO: 3484 - DNA, 216 bp, Pseudomonas aeruginosa
tcgccaatcccggcgacatcgccctgcgcgagaagatcatgctcgggagcatgcaggccgggctggccttctccaacgccatcctcggcgcggtgcatgccatgtcgcacagcctcggcggctatctcgacctgccccacggcctgtgcaacgcggcgctggtcgaacacgtggtggcgttcaactacagcgccgcgccggaacgcttcaaggtga

SEQ ID NO: 3485 - DNA, 1722 bp, Pseudomonas aeruginosa
tcgccttcaagcacgccgtgggtttccacgagagcctcgccctgcacggggtcggcagctccgacattcctttcctctcgcgccacgcgatgcaggacccgtgcatccttaccaacccgcgcgagtcgagccagcgcgatgtcgaggtggtctatggcgaggccctctgagcagcagcaggaggccctggccgggttactcggcctgggcagccactccgcgcgcaagagccactacccggagctgctggcgcgcctggaggagctggaggccgagcgcaaccgctacaaatggctgttcgagcacgcggtgcacggcatcttccaggccagcctcggccaggggctgcgcgccgccaatccggcgctggcgcagatgctcggctacgacgatccgcaacaggtgctctggtcgctggaggacatggccgggcaactgttcgtcggcggcgaggccgagatgcgacggatccgcgcgctgctgcgcgagcgcggcggcctgttcggctacgagacgcgcctctggcgcagggacggcagtcacatcgaggtattgatgaacctgctgctcaggcacgacgaggaagaattggtcgaaggtttcgtcgccgacatcaccgagcgggtccaggcccagcagcgcctgcagaccatgaacgaggagctggagcggcgggtagccgagcgcacccacgagctggaagagctcaaccgccagttgcgccaggcgcgcgacgccgccgaagccgccaaccacagcaaggacaagtacctcgccgccgccagccacgacctgctgcaaccgctcaacgcggcgcggctgctggtcgacaccctgcgcgaacggggcctgccggccgccgaactgcaactggtggagcgcacccacctggccctggaaggtgccgagaccttgctcaccgacctgctggaaatcgcccggctcgaccagagcgcgatccgtccggacctggacgactattccctcgacgaactgctcgctccgctggcctcggagttcgaggaagtcgcgcgtgccgccggcctggccctgcgtgcgcggatcccgcgactggcagtgcgcaccgatgcgcgcctgctgtcgcggatcctgcgcaacttgctcagcaacgcctgccgctacaccgagcgcggcagcgtgctgctgggggcgcgccggcgtggcggcaaggtacgcctggaggtgtgggacactggccggggcatccccgccgaccagttgcaggcgatcttcctcgagttcaaccaactggacgccgggcgcgcttccgagcgccgtggcgtcggactcgggctggccatcgtcgaccgtatcgccggcatcctcggctaccgcatcgaggtgcattcgactccaggccgaggctcgctgttcgccatcgaggtgccgctggtccgcaagccggcgcggccagcacccggcgaggcgattgcgcgggtttcggctggtgatccgctgccgggacgggccggctgctggtggtggacaacgagaccgagattctcttcagcatgtccgcgctgctcggccagtggggctgcgaggtgcttaccgccaccgacctggaaggcgcgcgcaaggcgctcgatggccgcgcgccggatgcgatcctggtcgactaccacctggaccacggcgctaccggttgccagttgctgggcgccttgcgcgaggactacggcgcggagatcgccgcggtga

SEQ ID NO: 3486 - DNA, 1392 bp, Pseudomonas aeruginosa
aacggggtgaactcgaggttttccagggactccggctcgaaggcgatgcccagctcgacgcgtcggttgcggaccatctccagcacctgctcgttgatcacgtcgtgcaccgccacgttgacccgcgggtggcgttcgcgaaaggtcttcaagaccagcggcagcaggttgccggcgaaggagggcatggcggcgatggagaccttgcccagttgcagggtgaagtgctggcgcagcaattcctcggtattgtcccagtcggccagcaggcgcagcgccagcggcagcagggtctcgccctcgggggtgaggctgacgctgcgggtggtacgttccagcagcggaccgccgaggctttcctccaggctcttgatcgccaggctcagggccggctgggagaggtgcaggcgttcgccggcctgggcgaagctgaggctctgcgccacggcgaggaaggcgcgcaactgcttgacggtcatttatttgtttttctcatcaatgaattggaaaaacaaacttaacaaatcagtccgcagcggagaagctctgtgcgacccggcagtcagactgccgcacgcacaatcacaagagccggaagaggcacagcagcatgagcggactcgacaagcgagtaggcacttacgaagaggccctcgaaggcctgaccgacggcatgaccgtcctcgccgggggcttcggcctctgcgggattcccgagaacctgatcgcggaaatccgccggcgcggggtcagggacctcacggtggtctcgaacaactgcggcgtcgacggtttcggcctcggcgtgctgctggaagaccggcagatccgcaagatgatcgcctcctatgtcggcgagaacgccctgttcgagcaacaactgctcagtggcgagctggaagtcgaactgaccccgcaaggctcgctggccgagaagatccgcgccggcggcgccggcatcccggccttcttcaccgccaccggctacggcaccccggtcgccgagggcaaggaggcgcgcgagttcaatggccgccactacatcctcgaaccggccatcaccggcgacttcgccatcgtcaagggctggaaggccgaccatttcggcaacgtcgtctatcgccacaccgcgcagaacttcaacccgctggtcgccaccgccgggcgcatcacggtggtcgaggtggaggagatcgtcgagcccggcgaactggacccgacgcagatccacacccccggcatctacgtcgaccggatcatccagggtcgcttcgagaaacgcatcgagaaacgcacgctgcgcgcctgacggcggccgctacaacgacaagaggtttccccagatggcacttacccgcgaacagatggcgcagcgcgtggcgcgcgaattga

SEQ ID NO: 3487 - DNA, 369 bp, Pseudomonas aeruginosa
atccagccgaccctgctcaaggggcacaacggcatgcgcgtgttccaggaggaaatcttcggcccggtggtcggcgtcaccaccttcaaggacgaagccgaggccctggccatcgccaacgacaccgagtacggcctcggcgccggcctctggacccgcgacatcaaccgcgcctaccgcatgggccgcgggatcaaggccggtcgcgtgtggaccaactgctaccacctgtacccggcccacgccgcgttcggcggctacaagaagtccggcgtcggtcgcgagacgcacaagatgatgctcgaccactaccagcagaccaagaacctgctggtgagctacgacatcaacccgctgggcttcttctga

SEQ ID NO: 3488 - DNA, 429 bp, Pseudomonas aeruginosa
gcggtcctcagccgccgcggatcgctccgacccgcggcctttccgccaaggcacctgcgggtgcgctcgtcccgcgtcccgacgcggctttccccatggcgggttctggcgcgacgcggccctggccgcgtcttttttttcgcctcgccgccgcccctgcatggactaggcttctgccctgcaccagggcgaaccaggggggcgcaacggcgttctcccggcgaaccttgggcgggacaggcagtccctaccaaatcagggggaaaactccttcgaaagtctcattcggagcgagccccgctgatgtttaactcgacctgccggaatcgcccggccccaccagagaggatcgaccccatgtggaccaagcccagcttcaccgacctgcgtctcggtttcgaagtgaccctctacttcgccaaccgctga

SEQ ID NO: 3489 - DNA, 1845 bp, Pseudomonas aeruginosa
tctgcaaggcctgaggcaatggtcgactacggcgactggccgagcgactggagcgccgagcgcgcggtggccgccgggcgcgatttcagcgagctgaaggcggcccatggcgggctggcctgggtggaattcgatccggccagtgcgcgctcgcgcctgtacctgtggcgcgacggcgtgctggaggagcccaccgcgccggacggctcggtgcgcagccgggtctacgagtacggcggcggcgcctgctgcgtgacgctcgacgggctggcctgggtcgacgaaaccgaccagcaggtacgccgctggcgagcgggccgcgcagcccaagtgctgggcggcggggcgcagtgtcgctacggcgacctggcctacgtcgatgcctgggatgccctgctggcggtggaagagagccatgggccgaccggggtcgtgcatcgcatcgtgcgcctggacgccgatggcgcgcgccgggtgctggtcgagggtgccgatttctacgccgcgccgcgtgccgccggccaggggcggcggctggcctggatcgaatgggaccgtccgcaccagccctggaccgagacccgcctgggcctggcggagaatgggcgtacgcgctgcctggccggagccggaggcggcgagtcgatccagcaaccacgcttcgatcccgccggccgccttcactggctgagcgaccgcgacggctggtggcgtccctgcgccgaggtagcgttggccggccgcttcgccgatgccgaccacgctggcgcgccctggcaattgggcgcttgcagccacctgccgctgggagagggaaggctgctgctcagtcgcgtcgaggccggcggcgggcaactgttcctgcgcgaagcggacggcagcgagcggcgcctggccgcggactggaaccggttcgccggactggccgcggatgcccgggcgttctactgcatcgcggcggcggccgggcgcctgccggcgctgctggcgatccatcgcgacgagctgcgtgtcgaggtgctgcgtggcggcgagcgaccgctggcggaggacgacctgtcgcatccgcaggccttcgtctatgggctgggcaacggcgaaaacggccacggtttcttctatccgccgcgcaatgcccgccgccgcgtcgatccccgacgaccaccgccgctgctagtgtggctgcatggcggaccgacctcgatgcattcgccggcgttcgatgccggcctgcagttctggacccagcgcggtttcgccgtggccgcgctgaactaccggggcagcagcggctacggccgcgcctatcggcagcgcttgcgcggccagtgggggcgcctggagttgcgcgatatcgaggccgcgctggcgcagctggacgcggagggacggatcgaccgcgcccgggtcttcgtccgtggcgccagcgccggaggctacagcgcgttgcgcgccctggcttgcctcgatggcctgcgcggcggcgccagtctctatggggtcagcgatccgttggcactggcgcgttgcacccacaagttcgagggtgactacctcgactggctgattggcgacccgctgcgccagcgccgtcgctacctggtgcgcagcccggtgcttcaggtcgggcgtatccgcgcgccggtagtgttcttccagggcgggctcgacgcggtggtggtgccggagcagaccgaggcgatggtcgccggcctgcggcgcagcggcgtgcgcgtggagtgccaccgctatccgcaggagcgccacggtttccgccagccggccaatcgcgcccatgcgctgctggcggaatggcgcttctacctgggcctgctggaggattga

SEQ ID NO: 3490 - DNA, 495 bp, Pseudomonas aeruginosa
attcgtctcgcccgagatcatcttcggcgccggctgccggcacagcgtcgccaactacgtgaagaccttcggtgcgcgcaaggtcctgctggtctccgaccccggcgtgctcgccgccggctgggtcgccgacatccaggcaagcctggaggggcagggcatcgactactgcctgtataccgacgtttcgcccaacccccgggtcgacgaggtgatgctcggcgccgagttctatcgcagcgagggctgcaatgtgatcgtcgcggtgggcggcggcagcccgatggattgcgccaagggcatcggcatcgtcgccgcccatggccgcagcatcctcgagttcgaaggcgtcgaccggctgcgggtgccgagtccgccgctgatcctgatcccgaccaccgccgggacttcggcggacgtctcgcagttcgtgatcatttccaaccaggacgagcgcatgaagttctccgtggtgagcaaggcggttgtgcctga

SEQ ID NO: 3491 - DNA, 1026 bp, Pseudomonas aeruginosa
cgtctcgctgatcgacccggaaaccacgttgaccatggatcccttcctttcggcctgtaccggcatcgatgcactggtacacgccatcgaggcgttcgtctccaccggccacgggccgctgaccgatccccacgcgctggaagcgatgcgcctgatcgatggcaatctggtacagatgatcgccaatcccggcgacatcgccctgcgcgagaagatcatgctcgggagcatgcaggccgggctggccttctccaacgccatcctcggcgcggtgcatgccatgtcgcacagcctcggcggctatctcgacctgccccacggcctgtgcaacgcggcgctggtcgaacacgtggtggcgttcaactacagcgccgcgccggaacgcttcaaggtgatcgccgagaccttcggcatcgattgccgcggtctgacccaggggcaggtccgccagcgcctggtggaccacctgatcgccttcaagcacgccgtgggtttccacgagagcctcgccctgcacggggtcggcagctccgacattcctttcctctcgcgccacgcgatgcaggacccgtgcatccttaccaacccgcgcgagtcgagccagcgcgatgtcgaggtggtctatggcgaggccctctgagcagcagcaggaggccctggccgggttactcggcctgggcagccactccgcgcgcaagagccactacccggagctgctggcgcgcctggaggagctggaggccgagcgcaaccgctacaaatggctgttcgagcacgcggtgcacggcatcttccaggccagcctcggccaggggctgcgcgccgccaatccggcgctggcgcagatgctcggctacgacgatccgcaacaggtgctctggtcgctggaggacatggccgggcaactgttcgtcggcggcgaggccgagatgcgacggatccgcgcgctgctgcgcgagcgcggcggcctgttcggctacgagacgcgcctctggcgcagggacggcagtcacatcgaggtattga

SEQ ID NO: 3492 - DNA, 1896 bp, Pseudomonas aeruginosa
ccgagcgcacccacgagctggaagagctcaaccgccagttgcgccaggcgcgcgacgccgccgaagccgccaaccacagcaaggacaagtacctcgccgccgccagccacgacctgctgcaaccgctcaacgcggcgcggctgctggtcgacaccctgcgcgaacggggcctgccggccgccgaactgcaactggtggagcgcacccacctggccctggaaggtgccgagaccttgctcaccgacctgctggaaatcgcccggctcgaccagagcgcgatccgtccggacctggacgactattccctcgacgaactgctcgctccgctggcctcggagttcgaggaagtcgcgcgtgccgccggcctggccctgcgtgcgcggatcccgcgactggcagtgcgcaccgatgcgcgcctgctgtcgcggatcctgcgcaacttgctcagcaacgcctgccgctacaccgagcgcggcagcgtgctgctgggggcgcgccggcgtggcggcaaggtacgcctggaggtgtgggacactggccggggcatccccgccgaccagttgcaggcgatcttcctcgagttcaaccaactggacgccgggcgcgcttccgagcgccgtggcgtcggactcgggctggccatcgtcgaccgtatcgccggcatcctcggctaccgcatcgaggtgcattcgactccaggccgaggctcgctgttcgccatcgaggtgccgctggtccgcaagccggcgcggccagcacccggcgaggcgattgcgcgggtttcggctggtgatccgctgccgggacgggccggctgctggtggtggacaacgagaccgagattctcttcagcatgtccgcgctgctcggccagtggggctgcgaggtgcttaccgccaccgacctggaaggcgcgcgcaaggcgctcgatggccgcgcgccggatgcgatcctggtcgactaccacctggaccacggcgctaccggttgccagttgctgggcgccttgcgcgaggactacggcgcggagatcgccgcggtgatgatcaccgccgaccgcagcgacgattgccgccgcgcgctggcccgcctgggcgtgccgctgctcaacaagccgctgaagcccggcaagctgcgcgcggccctgagcgccttgctcggcgagctctagaacgcgtaccgccgcctgggacggtgcacgccctagccaggccggcggctgcgccggtgcagtgcgacggccagggccagcccgccgagcgaggccaggcaggcgaagaggaacatcgagcggaagccgaacaggttggcgacgaagcccaccagcggcccggtgatgcccagcgacaggtcgacgaacagcgagtaggcgcccagcgccgcgccacggttggaagccggtaccaggttcaccgtttccacgccgaacgccgggaacaccagggagaagccgaagccggtgagggccgcgccggccaggccgacccagggattcggcgcgctccacagcaacagcaggccgaggctttcgacgccgaggcagatgatcgccacgcggaagccgccgagccggttgatgttattggcgaacaacagccgggcgccgatgaagcaaccgccgaaggcactcaggcagagcagtgcgttggcccagccacggctggcgtagtaaagggtgatgaaggtggcgatggtgccgaagccgatcgcccccagcgccaggcccataccgtgcggggtgacccggccgagcacatggtggaacggcagtcgctcgccgtgcaccagcggcgccggcaacttcggccaggccagggcgaagccgagcgccccgagcaggacgatggacgcgcccatgctccacagccccagccactgcaccagcagcacccctag

SEQ ID NO: 3493 - DNA, 558 bp, Pseudomonas aeruginosa
cggcgccccgagggcgatggcgccgtagctggcgatgccgttccaggaaatcaccttggcggtgtgcggcgcgccgacccggccgatgccccagccgatcgccgccgagccgaccaggctttccgccgcgccgagtaccaggcggccgaccagcaggctggccaggctcagcgccggccagccctggatcgccaccgagagcagcatgaacagcccgctcgcggcgctgccggccatgccgtagagcaccgcgcgcttcggcccgaggccgtcgatgacgcgcccggcgtacggccgggcgagcagggtggcgaggtactgcaggctgatcaccaggccggccagcaccgagccgtagccgaggtcgtcgtgcacgtagccgggcagcaccgccagcgggatgccgatggtcaggtagccgatgaaggtgaacatcaccaccgagacgatctgcagggtgacgttctgccgggcgctgtcctgcgccggcggggtggggcggatatcgacggacatgtgggaaacgcggtcgcagtgggttgtcgcggtccgccatga

SEQ ID NO: 3494 - DNA, 2112 bp, Pseudomonas aeruginosa
cccaggctcgccgcggcttcagtcgcgcagttcggcgaggtcgcgataaagctccagcgcctgcgggttggccagtgcgtcggtgttcttcaccgggcggccgtggatcacgttgcgcaccgcaagctcgacgatcttgccgctcagggtgcgcgggatatcggcgacctggatgatcttcgccggtacgtggcgcggcgtggcgttggcgcggatggtctggcggatgcgttcgcgcagcggctcgtcgagtcgcacgccgtcgcgcaggcggacgaacagcagcacacgcacatcgccctgccagtcctggccgatggcgatggactcgaggacttcctcgaccttttccacctggcggtagatttccgcggtgccgatgcgcacgccgccgggattgagcaccgcgtcggagcggccgtggatgaccagcccgccgtggacggtttcctcggcgtagtcgccatgggcccagacgccgggaaagctggcgaagtaggcgtcgtggaacctggtgccatccgggtcgttccagaagcccagcgggatcgacgggaaatgccgggtgcagaccagctcgcccttgccgctggcgaggcggcggccgttgtcgtcccagatttccacggccatgcccagcgccttgcattgcagttcgccgcgccacaccggcagcaccgggttgccgatggcgaagcaggaaacgatgtcggtgccgccggagatcgacgacaggcagaggtcgctcttcagctcgcggtagacgtagtcgaagctttcgtgggccagcggcgaaccggtggagagcagtgtcctcaggctgtccaggcggtggctgtggcgcgggcgcatgccggccttctcgagcgccgccaggtacttggcgctggcgccgaacacggcgatgtcctcggcgtcgatgaggtccagcaggcgctcggggccggggtggaacggcgagccgtcgtagagcaccaggctggcgcccaccgccagaccggaggccagccagttccacatcatccagccgcaggtggtgtagtagaacagccggtcgccgtcgcccaggtcggtgtgcaggccgtgctccttgagatgttgcaggagcacgccgccggtggcatggacgatgcacttggggactccggtggtgcccgacgaatagaggatgtacagcggctgctcgaagggcaccggggtgaagaccggctcgccctcggcctggtagaacccgtcccacagcgcgacctgcgcctggcagcggtagtcctgcggctgcgcctgcggacggtcgtagggcaccaccagcagttgctccaggccgggcaggccggcgagcacctcgttgagcttggcggtcaggtccagcgacttgccggcgtagcggtagccggcacaggcgatcagcacgcgcggttcgatctggccgaagcggtcgatcacgccctgggtaccgaagtccggcgagcagctcgaccaggtcgcgccgaggctggcggtggcgagcatgccgaccacggtctgccaggtgttcggcatcagcgcggcgacccggtcgccggggcctatgcccagggcggcgaggcgcttctgcaggcccgccacgtgacgggccagttcggcgtggctgagcacctcgcggcgaccgtcttcgctcaccgcgatcagcgccggggcatcatcgcggcggcgcagcaggtgttcggcgaaattcagcgtggcgccggggaaccagcgcgccgagggcatctgcgcgccttcctcgaggaccgcacgcggcggttgctggaagcgcacctcgaagaagttgatgatggcctgccagaacgcctcgcgccgctgcacgctccaggcatgcagcgccgggtagtcgaccaggccgagggcgtgccgctggttgacgaagcgtcggaaggcctccatgcgactggcggcgatgcgttcggcggaagggctccagagcggtgcgggcatggcgtgtccgtccttgttgttgttccgggacatgcaggaagcataaccggacccgccgctgcctgcctcactccgtggactggtcctgcggcagcgccagcgagcgccagtcggtgccatgcagcagcacgtcgctga

SEQ ID NO: 3495 - DNA, 807 bp, Pseudomonas aeruginosa
attggaaaaacaaacttaacaaatcagtccgcagcggagaagctctgtgcgacccggcagtcagactgccgcacgcacaatcacaagagccggaagaggcacagcagcatgagcggactcgacaagcgagtaggcacttacgaagaggccctcgaaggcctgaccgacggcatgaccgtcctcgccgggggcttcggcctctgcgggattcccgagaacctgatcgcggaaatccgccggcgcggggtcagggacctcacggtggtctcgaacaactgcggcgtcgacggtttcggcctcggcgtgctgctggaagaccggcagatccgcaagatgatcgcctcctatgtcggcgagaacgccctgttcgagcaacaactgctcagtggcgagctggaagtcgaactgaccccgcaaggctcgctggccgagaagatccgcgccggcggcgccggcatcccggccttcttcaccgccaccggctacggcaccccggtcgccgagggcaaggaggcgcgcgagttcaatggccgccactacatcctcgaaccggccatcaccggcgacttcgccatcgtcaagggctggaaggccgaccatttcggcaacgtcgtctatcgccacaccgcgcagaacttcaacccgctggtcgccaccgccgggcgcatcacggtggtcgaggtggaggagatcgtcgagcccggcgaactggacccgacgcagatccacacccccggcatctacgtcgaccggatcatccagggtcgcttcgagaaacgcatcgagaaacgcacgctgcgcgcctga

SEQ ID NO: 3496 - DNA, 891 bp, Pseudomonas aeruginosa
cggcggccgctacaacgacaagaggtttccccagatggcacttacccgcgaacagatggcgcagcgcgtggcgcgcgaattgaaggacggctactacgtcaacctcggcatcggcatcccgaccctggtggccaactacgtgccggaaggcatcgacgtcatgctccagtcggagaacggcctgctcggcatgggcgcgttccccagcgaggcggaagtcgacgccgacatgatcaacgccggcaagcagaccgtgaccgcccgcgtcggcgcgtcgatcttcgactcggcgcagtccttcgccatgatccgtggcggccacgtcgacctcaccgtgctcggtgccttcgaggtggacgtgcgcggcaacatcgcctcctggatgatccccggcaagctggtcaagggcatgggcggcgccatggacctggtggccggcgccgagaacatcatcgtcaccatgacccacgcctccaaggacggcgagtccaagctgctgccgtactgcaccctgccgctgaccggttgcggctgcattcgcaaggtgctcaccgacctggcctacctggagatcgaggacggcgccttcatcctccgcgagcgcgcccccggggtcagcgtcgtggagatcgtggcgaagaccgccggcaagctgatcgtccccgagcacgtgggcggaaaatgaatttccgaaacccgcggcccgcgcggcgcgctcccctttcggtggtgcctggcttcctcgcccgcgggccgctgcgcctgccccggcccccctcgcgccgcccggtgcccgtcgccgcccgtggcggcgccgcgccccgccgcgccgccagccgtcgcgcgcgttcgtcgcgggcgtcgcgtgctgcgttgtcgccgccgcgctga

SEQ ID NO: 3497 - DNA, 381 bp, Pseudomonas aeruginosa
gaacaatcagagggctggaacatgacgtacctgcagcagcacgcccgctcgatcgccgagccggccgcgttctgggccgaacaggcccgttccctggcctggtaccaagcgcccgcgaacatcctcgaaagcctgcccgacggcacccatcgctggttcgccgatggccgtctgaacagcgcctacctggccctcgaccggcagatcgaagaagggcgccgcgaaaagaccgcgctgatctaccactcgccggtgaccggcacccaggaccgcctacgctaccttgcggctgcgccaccaaattgggccccctggccggcgcccttgcggccctccggggtccgcaaagggctaccgggtgaatctctaccttcccgatgg

SEQ ID NO: 3498 - DNA, 330 bp, Pseudomonas aeruginosa
gtcggtgcgcacaaaataggcctcgacccggcggtgaagtccgaggtgatgaagcagagttccggcggcaactgggcgctgaacctctacaacccctggcccggggtgatgccgcaggcgccggcgagcaacggctatgccggcggtttccaggtgcgcctgatgaacaaggacctcggcctggcgctggccaacgcccaggcggtgcaggcctcgacgccgctcggcgcgctggcgcgcaacctgttcagcctgcacgcccaggccgatgccgagcacgaggggctggacttctccagcatccagaagctctaccgcggcaaggactga

SEQ ID NO: 3499 - DNA, 273 bp, Pseudomonas aeruginosa
agaccggcactgccgccaacgaagaaacttccatccaaggccgttcgggcagttgcgccttacctgcaaagccagtaccgggagttcttccagctttcccccaaggcgcagaagaagacccgccgcctgaccggcccctactcctggggctggtgggccatggaggtgtcggcgctgggcgtgctctacggctgggacgatggcgtcctgcgcgcctcgccgcattacctcggcgacctggtcgactacgcgcgggcgcgcggcgacgcctga

SEQ ID NO: 3500 - DNA, 852 bp, Pseudomonas aeruginosa
  unsure (651): Identity of nucleotide at the above locations are unknown.
gccaccggccgccgctcatgcccgccggcggcgggcgatgaacgcggcggccaggtcgaggctggtgcagagcacgaagtagagcagggcgacgaacacgaagatctccgtcgggtggaccatcacccggttgctcacctgggtggcgacgaaggacagctcgccgacgccgatcacgtaggccagggaagtgtccttgatcagcgacacccactggttgaggaaggatggcagcatcaccggcagcgcctgcggcaggatcaccaggcgcaatacctgccacggccgcagtccgagcgcgcgggcggccgcccactgcccggcggggaggctgtggatgccggcgtacaccgagtgggcgaggtaggcgccgccgatcagcgacagcgcgcagaccacggtggccagcgccggtacgtcgacatggaagacgatcggcagcaggaagtatgtccagaaaatcagcatcagcaccgggatcgcgcggaagaaaccgagcagcgccaccagcagcaggcgcggcttgccgggcagcaccgcgagggccacgccgaggaccacgccgagcaccgccgaagccagtccggagagcgacgccagcagcagggtcagcgccgctccgccgaccgggccgtccgggtatgcgcccancaacaagtacgacaggttgtcccacatgaccgacaaatccatctcaggcacctccctggcggtaacggcgggtctgctgccacccctggccgaaagctaccatcacggccatggcgcccatgtacaaaaagggtggccaatccaaacgccctggaaggtcttcaaaggtctcggtttcccccttgcccccaaaacctatga

SEQ ID NO: 3501 - DNA, 594 bp, Pseudomonas aeruginosa
  unsure (284): Identity of nucleotide at the above locations are unknown.
gcgccgccgatcagcgacagcgcgcagaccacggtggccagcgccggtacgtcgacatggaagacgatcggcagcaggaagtatgtccagaaaatcagcatcagcaccgggatcgcgcggaagaaaccgagcagcgccaccagcagcaggcgcggcttgccgggcagcaccgcgagggccacgccgaggaccacgccgagcaccgccgaagccagtccggagagcgacgccagcagcagggtcagcgccgctccgccgaccgggccgtccgggtatgcgcccancaacaagtacgacaggttgtcccacatgaccgacaaatccatctcaggcacctccctggcggtaacggcgggtctgctgccacccctggccgaaagctaccatcacggccatggcgcccatgtacaaaaagggtggccaatccaaacgccctggaaggtcttcaaaggtctcggtttcccccttgcccccaaaacctatgaacaaccccgcccaggcccgatgggccaccccccagccaaggaaattcttcccccccctttcctttttctgcccccaagcccgcgggggaagaaacccttgcgccagggc

SEQ ID NO: 3502 - DNA, 459 bp, Pseudomonas aeruginosa
  unsure (430): Identity of nucleotide at the above locations are unknown.
ggaaggatggcagcatcaccggcagcgcctgcggcaggatcaccaggcgcaatacctgccacggccgcagtccgagcgcgcgggcggccgcccactgcccggcggggaggctgtggatgccggcgtacaccgagtgggcgaggtaggcgccgccgatcagcgacagcgcgcagaccacggtggccagcgccggtacgtcgacatggaagacgatcggcagcaggaagtatgtccagaaaatcagcatcagcaccgggatcgcgcggaagaaaccgagcagcgccaccagcagcaggcgcggcttgccgggcagcaccgcgagggccacgccgaggaccacgccgagcaccgccgaagccagtccggagagcgacgccagcagcagggtcagcgccgctccgccgaccgggccgtccgggtatgcgcccancaacaagtacgacaggttgtcccacatga

SEQ ID NO: 3503 - DNA, 732 bp, Pseudomonas aeruginosa
  unsure (97): Identity of nucleotide at the above locations are unknown.
ctttcggccaggggtggcagcagacccgccgttaccgccagggaggtgcctgagatggatttgtcggtcatgtgggacaacctgtcgtacttgttgntgggcgcatacccggacggcccggtcggcggagcggcgctgaccctgctgctggcgtcgctctccggactggcttcggcggtgctcggcgtggtcctcggcgtggccctcgcggtgctgcccggcaagccgcgcctgctgctggtggcgctgctcggtttcttccgcgcgatcccggtgctgatgctgattttctggacatacttcctgctgccgatcgtcttccatgtcgacgtaccggcgctggccaccgtggtctgcgcgctgtcgctgatcggcggcgcctacctcgcccactcggtgtacgccggcatccacagcctccccgccgggcagtgggcggccgcccgcgcgctcggactgcggccgtggcaggtattgcgcctggtgatcctgccgcaggcgctgccggtgatgctgccatccttcctcaaccagtgggtgtcgctgatcaaggacacttccctggcctacgtgatcggcgtcggcgagctgtccttcgtcgccacccaggtgagcaaccgggtgatggtccacccgacggagatcttcgtgttcgtcgccctgctctacttcgtgctctgcaccagcctcgacctggccgccgcgttcatcgcccgccgccggcgggcatga

SEQ ID NO: 3504 - DNA, 978 bp, Pseudomonas aeruginosa
  unsure (44): Identity of nucleotide at the above locations are unknown.
gatggatttgtcggtcatgtgggacaacctgtcgtacttgttgntgggcgcatacccggacggcccggtcggcggagcggcgctgaccctgctgctggcgtcgctctccggactggcttcggcggtgctcggcgtggtcctcggcgtggccctcgcggtgctgcccggcaagccgcgcctgctgctggtggcgctgctcggtttcttccgcgcgatcccggtgctgatgctgattttctggacatacttcctgctgccgatcgtcttccatgtcgacgtaccggcgctggccaccgtggtctgcgcgctgtcgctgatcggcggcgcctacctcgcccactcggtgtacgccggcatccacagcctccccgccgggcagtgggcggccgcccgcgcgctcggactgcggccgtggcaggtattgcgcctggtgatcctgccgcaggcgctgccggtgatgctgccatccttcctcaaccagtgggtgtcgctgatcaaggacacttccctggcctacgtgatcggcgtcggcgagctgtccttcgtcgccacccaggtgagcaaccgggtgatggtccacccgacggagatcttcgtgttcgtcgccctgctctacttcgtgctctgcaccagcctcgacctggccgccgcgttcatcgcccgccgccggcgggcatgagcggcggccggtggctcaggcgtcgccgcgcgcccgcgcgtagtcgaccaggtcgccgaggtaatgcggcgaggcgcgcaggacgccatcgtcccagccgtagagcacgcccagcgccgacacctccatggcccaccagccccaggagtaggggccggtcaggcggcgggtcttcttctgcgccttgggggaaagctggaagaactcccggtactggctttgcaggtaaggcgcaactgcccgaacggccttggatggaagtttcttcgttggcggcagtgccggtcttcaaccacgaa

SEQ ID NO: 3505 - DNA, 963 bp, Pseudomonas aeruginosa
  unsure (28): Identity of nucleotide at the above locations are unknown.
cggggtgttacaatgtcttttcccaaancctttctcccccccccccccccaggaaaccccccattttttttcccccccccccctttttttattttttcccccccttttttggggggggcccccccccaaaaaaaaaaacccccccccccgagaaaaaaaaacaccccccctcttttttggggaggtggagagaaaaaaaaactacctccgcgagcagtaaaaccaaaggtacagcgaaatggtcgccgccaacccccgcgtcgatacctggttgccgggcgtctgcaccgaagtgataatccctacccgcttcgtgctgccgcctggcccgcgcgaaagcgtggtgatcaacctggccgagtaccgcctgtactactacccgaaagggcagaacgtggtgcacacctatccgctgggcatcggccgcgagggctggggttcgccgatcgcgaacacccgcatcaccgccaagaccaaggacccggcctggtatccgccggcctcgatccgcgccgagcacgccgccgatggcgatccgctgccgaccgtggtgccgccgggcccggacaatccgctgggaccgtacaagctgaccctgggtgtgccgggctacctgatccatggttcgaacaagaagttcggcatcggcacccgcaccagccatggctgcttccgcatgtacaacgccgacgtgacccacctgttctctatgatcagcgtcggcaccagcgtgcgtatcatcaacgagccctacaagttcggcgtgagcaacggcaaggtctacctggaggcgcatacgccgctgaacgaccatggcgacccgtcggtggtggacaagcacactgcggtgatcaacaccctgctcaagcgcgacgacctggccaagcgtatccagttgaactgggacgtggtccgcgaagtggtggcctcggaggatggcgtgccggtggaaatcgcccagga

SEQ ID NO: 3506 - DNA, 744 bp, Pseudomonas aeruginosa
aaccaaaggtacagcgaaatggtcgccgccaacccccgcgtcgatacctggttgccgggcgtctgcaccgaagtgataatccctacccgcttcgtgctgccgcctggcccgcgcgaaagcgtggtgatcaacctggccgagtaccgcctgtactactacccgaaagggcagaacgtggtgcacacctatccgctgggcatcggccgcgagggctggggttcgccgatcgcgaacacccgcatcaccgccaagaccaaggacccggcctggtatccgccggcctcgatccgcgccgagcacgccgccgatggcgatccgctgccgaccgtggtgccgccgggcccggacaatccgctgggaccgtacaagctgaccctgggtgtgccgggctacctgatccatggttcgaacaagaagttcggcatcggcacccgcaccagccatggctgcttccgcatgtacaacgccgacgtgacccacctgttctctatgatcagcgtcggcaccagcgtgcgtatcatcaacgagccctacaagttcggcgtgagcaacggcaaggtctacctggaggcgcatacgccgctgaacgaccatggcgacccgtcggtggtggacaagcacactgcggtgatcaacaccctgctcaagcgcgacgacctggccaagcgtatccagttgaactgggacgtggtccgcgaagtggtggcctcggaggatggcgtgccggtggaaatcgcccaggaa

SEQ ID NO: 3507 - DNA, 504 bp, Pseudomonas aeruginosa
  unsure (275): Identity of nucleotide at the above locations are unknown.
ggattatcacttcggtgcagacgcccggcaaccaggtatcgacgcgggggttggcggcgaccatttcgctgtacctttggttttactgctcgcggaggtagtttttttttctctccacctccccaaaaaagagggggggtgtttttttttctcgggggggggggtttttttttttgggggggggccccccccaaaaaagggggggaaaaaataaaaaaaggggggggggggaaaaaaaatggggggtttcctgggggggggggggggagaaaggntttgggaaaagacattgtaacaccccgtcaggtttcaccgggagggctcagaccaaccaggacaggcgctccccgcgcttttcggcttccagttgtttccgtcaatcgggacacagcagccggtcgcgcagacgcgcccgttccagcggctgccagcgcggctgggccggcagcagcttgccccacagcgtgcgtctcgcctaagtggccgtcttcaccaagtatatgg

SEQ ID NO: 3508 - DNA, 1089 bp, Pseudomonas aeruginosa
  unsure (111),(376),(451): Identity of nucleotide at the above locations are unknown.
tacgttgcccttggacttggacatcttctggccctgaccgtcgcgcaccaggccgtggacatagacggtcttgaacgggatctgcggggtgccgtcggggttcttcaccangtgcatggtgagcatgatcatccgcgcgacccagaagaagatgatgtcgaagccggtgaccagtacgtcggtggggtggaaggtcttgaggaactcggtctgctgcggccagccgagggtggagaaggtccacaggccggagctgaaccaggtgtcgagaacgtcttcgtcctggcgcaactcgacctcgttgccgagcttgtgcttggtgcgcacctcgacctcgtcgcggccgacgtaaacgttgccggcctcgtcgtaccangccgggagcggggtgtcgcgcatggcgaaataggcgaatacggctacgcccacggcgacgatggccggcacgtanaaggccgagcgccagtcgccgaacagcgccaggccgagcaggaacagcgggccgatcaggccgccgccgacgttgtgggcgacgttccacaccgagaccacgctgccgcgctccttctgcgaccaccagtggaccatggtccgtccgctcggcggccagcccatgccctgggcccagccgttgatgaagagcaggacgaacatgatggcgacgctggaggtagcccagtgcgcgaatccgaaaatgaacatcaccgccgccgacaccaacaggccgaacggcaggaagacccgtgggttggaacgatccgagaccaggcccatgatgaatttcgacaggccgtaggcgatggcgatggccgacatcgcgacgcccagttgaccgcggctgtagccgtcctcgatgaggtagggcatggccagggagaagttcttgcgcagcaggtagtaacccgcgtagccgatgaagataccggcgaagatctgccagcgcaggcgccggtaggtgctgtccacctcggcatcgggcagtggcgcctggtgtggcgcgggacgaaagattccgaacatcgcgagctccgcttgttgttgtgtcgcgcctttttacgcggttgcgaacactacatttttcgtaaatga

SEQ ID NO: 3509 - DNA, 1143 bp, Pseudomonas aeruginosa
  unsure (655),(730),(995): Identity of nucleotide at the above locations are unknown.
catttccgctattttttcatttacgaaaaatgtagtgttcgcaaccgcgtaaaaaggcgcgacacaacaacaagcggagctcgcgatgttcggaatctttcgtcccgcgccacaccaggcgccactgcccgatgccgaggtggacagcacctaccggcgcctgcgctggcagatcttcgccggtatcttcatcggctacgcgggttactacctgctgcgcaagaacttctccctggccatgccctacctcatcgaggacggctacagccgcggtcaactgggcgtcgcgatgtcggccatcgccatcgcctacggcctgtcgaaattcatcatgggcctggtctcggatcgttccaacccacgggtcttcctgccgttcggcctgttggtgtcggcggcggtgatgttcattttcggattcgcgcactgggctacctccagcgtcgccatcatgttcgtcctgctcttcatcaacggctgggcccagggcatgggctggccgccgagcggacggaccatggtccactggtggtcgcagaaggagcgcggcagcgtggtctcggtgtggaacgtcgcccacaacgtcggcggcggcctgatcggcccgctgttcctgctcggcctggcgctgttcggcgactggcgctcggccttntacgtgccggccatcgtcgccgtgggcgtagccgtattcgcctatttcgccatgcgcgacaccccgctcccggcntggtacgacgaggccggcaacgtttacgtcggccgcgacgaggtcgaggtgcgcaccaagcacaagctcggcaacgaggtcgagttgcgccaggacgaagacgttctcgacacctggttcagctccggcctgtggaccttctccaccctcggctggccgcagcagaccgagttcctcaagaccttccaccccaccgacgtactggtcaccggcttcgacatcatcttcttctgggtcgcgcggatgatcatgctcaccatgcacntggtgaagaaccccgacggcaccccgcagatcccgttcaagaccgtctatgtccacggcctggtgcgcgacggtcagggccagaagatgtccaagtccaagggcaacgtactagacccgctggacatcgtcgagggcatcgaccttga

SEQ ID NO: 3510 - DNA, 1116 bp, Pseudomonas aeruginosa
  unsure (603),(678),(943): Identity of nucleotide at the above locations are unknown.
aaaggcgcgacacaacaacaagcggagctcgcgatgttcggaatctttcgtcccgcgccacaccaggcgccactgcccgatgccgaggtggacagcacctaccggcgcctgcgctggcagatcttcgccggtatcttcatcggctacgcgggttactacctgctgcgcaagaacttctccctggccatgccctacctcatcgaggacggctacagccgcggtcaactgggcgtcgcgatgtcggccatcgccatcgcctacggcctgtcgaaattcatcatgggcctggtctcggatcgttccaacccacgggtcttcctgccgttcggcctgttggtgtcggcggcggtgatgttcattttcggattcgcgcactgggctacctccagcgtcgccatcatgttcgtcctgctcttcatcaacggctgggcccagggcatgggctggccgccgagcggacggaccatggtccactggtggtcgcagaaggagcgcggcagcgtggtctcggtgtggaacgtcgcccacaacgtcggcggcggcctgatcggcccgctgttcctgctcggcctggcgctgttcggcgactggcgctcggccttntacgtgccggccatcgtcgccgtgggcgtagccgtattcgcctatttcgccatgcgcgacaccccgctcccggcntggtacgacgaggccggcaacgtttacgtcggccgcgacgaggtcgaggtgcgcaccaagcacaagctcggcaacgaggtcgagttgcgccaggacgaagacgttctcgacacctggttcagctccggcctgtggaccttctccaccctcggctggccgcagcagaccgagttcctcaagaccttccaccccaccgacgtactggtcaccggcttcgacatcatcttcttctgggtcgcgcggatgatcatgctcaccatgcacntggtgaagaaccccgacggcaccccgcagatcccgttcaagaccgtctatgtccacggcctggtgcgcgacggtcagggccagaagatgtccaagtccaagggcaacgtactagacccgctggacatcgtcgagggcatcgaccttgataccatgcgcaaaggcgcaatctag

SEQ ID NO: 3511 - DNA, 255 bp, Pseudomonas aeruginosa
  unsure (140): Identity of nucleotide at the above locations are unknown.
acgccctcggcccagcgcagggccggtcggcaaggttgtgggtggaggttcgctgacccacgaaggcggggagtatggcttcccgcccgtgcggagaaaggcatggcgggcggaagcgatacaccggccgaggcccacgntgtcagaagtttttcccatatgaaggccccggtttccgaccggggcttttttatttccgaccaatgcactcaacctgtaacatttccgctattttttcatttacgaaaaatgtag

SEQ ID NO: 3512 - DNA, 660 bp, Pseudomonas aeruginosa
  unsure (517): Identity of nucleotide at the above locations are unknown.
ccacgtcgaacggcaggccggccggaacgacctggaacagcagatctgcgagcccatgtggaaatgcagcaggcgcacgccctggtcgagaccggcctggcggaagcgctcgaccaccgacagcagctgggcggcggaaaggccgaacttggccttctcgccaccggtgtctgcccacttcgacgaagccagcgaggacagccgcacgcgcaggccgacctggggctgcacgccgacgttggcggcctcctcgatcaccagctgcacctcggattccttctcgatcacgatgaacacgttgtgcccgagcttctgccccatcagcgccagcttgatgaactcgcggtccttgtagccgttgcagacgatggtgccgcccttcggggccagcgccagcaccgccatgagttccggcttggagcctgcctccaggccgatggagacgttctcggtggcgatgatgttctccaccaccgcttcctgctggttgaccttgatcggatacagcgcggtgtancggttctggtattcgaggcgctcgatgttcgcgtcgaaggcgccggtgagcttgcgcacgcggtcctgcaggatatccgggaagcgcaccagcagcggcaggctcaggcccgcctcgcgcagttggccgaccagctcgtatag

SEQ ID NO: 3513 - DNA, 501 bp, Pseudomonas aeruginosa
ccgcgccgcattcgcgtggtgaagacgataggcgaaaccggtgtacatcagctggtcggcgaagatgacggtgtccttcagacccaccacgcgatagcagtggttgatcagcttggagatcgccttcttcttcatcgactggttgaccacgtcgaacggcaggccggccggaacgacctggaacagcagatctgcgagcccatgtggaaatgcagcaggcgcacgccctggtcgagaccggcctggcggaagcgctcgaccaccgacagcagctgggcggcggaaaggccgaacttggccttctcgccaccggtgtctgcccacttcgacgaagccagcgaggacagccgcacgcgcaggccgacctggggctgcacgccgacgttggcggcctcctcgatcaccagctgcacctcggattccttctcgatcacgatgaacacgttgtgcccgagcttctgccccatcagcgccagcttgatgaactcgcggtccttgtag

SEQ ID NO: 3514 - DNA, 216 bp, Pseudomonas aeruginosa
  unsure (20),(41): Identity of nucleotide at the above locations are unknown.
aaggaggtggcccagcgcgntggaacgggcgatgcggcacngggcggcattttcaaaggacggcgtggtggagatccagggcgagcaagtcggactggtgatggacgaactctcaaggggcggtttcaaggcgaagaagtccgcgggctgacggcgttctcccctgcagagagcgggcagtcccggcaccgggaggccgcgccagccctttcctag

SEQ ID NO: 3515 - DNA, 1125 bp, Pseudomonas aeruginosa
  unsure (23),(71),(463): Identity of nucleotide at the above locations are unknown.
gcggatttcctcggctttcctanactaccgcccagtgtggcggtcaacacggcaacgtcacatcctccggntagcctccaccacaggcgtgccggcccagggccatccggagatcccggcgcccgcccgaccccgaacattgaggagatcaccgcgcatggccgctcgacggactcgcaaagacgatggcagcaactggaccgtggccgacagccgcggcgtatacggcatccgccactggggtgcgggttatttcgccatcaacgatggcggcaatgtcgaagtgcgtccgcagggtgccgactcgacgcccatcgatctatacgagctggtcggccaactgcgcgaggcgggcctgagcctgccgctgctggtgcgcttcccggatatcctgcaggaccgcgtgcgcaagctcaccggcgccttcgacgcgaacatcgagcgcctcgaataccagaaccgntacaccgcgctgtatccgatcaaggtcaaccagcaggaagcggtggtggagaacatcatcgccaccgagaacgtctccatcggcctggaggcaggctccaagccggaactcatggcggtgctggcgctggccccgaagggcggcaccatcgtctgcaacggctacaaggaccgcgagttcatcaagctggcgctgatggggcagaagctcgggcacaacgtgttcatcgtgatcgagaaggaatccgaggtgcagctggtgatcgaggaggccgccaacgtcggcgtgcagccccaggtcggcctgcgcgtgcggctgtcctcgctggcttcgtcgaagtgggcagacaccggtggcgagaaggccaagttcggcctttccgccgcccagctgctgtcggtggtcgagcgcttccgccaggccggtctcgaccagggcgtgcgcctgctgcatttccacatgggctcgcagatctgctgttccaggtcgttccggccggcctgccgttcgacgtggtcaaccagtcgatgaagaagaaggcgatctccaagctgatcaaccactgctatcgcgtggtgggtctgaaggacaccgtcatcttcgccgaccagctgatgtacaccggtttcgcctatcgtcttcaccacgcgaatgcggcgcgg

SEQ ID NO: 3516 - DNA, 1086 bp, Pseudomonas aeruginosa
  unsure (115),(163),(555): Identity of nucleotide at the above locations are unknown.
cggcgttctcccctgcagagagcgggcagtcccggcaccgggaggccgcgccagccctttcctaggatgggagactgcggatacccgcatgagcggatttcctcggctttcctanactaccgcccagtgtggcggtcaacacggcaacgtcacatcctccggntagcctccaccacaggcgtgccggcccagggccatccggagatcccggcgcccgcccgaccccgaacattgaggagatcaccgcgcatggccgctcgacggactcgcaaagacgatggcagcaactggaccgtggccgacagccgcggcgtatacggcatccgccactggggtgcgggttatttcgccatcaacgatggcggcaatgtcgaagtgcgtccgcagggtgccgactcgacgcccatcgatctatacgagctggtcggccaactgcgcgaggcgggcctgagcctgccgctgctggtgcgcttcccggatatcctgcaggaccgcgtgcgcaagctcaccggcgccttcgacgcgaacatcgagcgcctcgaataccagaaccgntacaccgcgctgtatccgatcaaggtcaaccagcaggaagcggtggtggagaacatcatcgccaccgagaacgtctccatcggcctggaggcaggctccaagccggaactcatggcggtgctggcgctggccccgaagggcggcaccatcgtctgcaacggctacaaggaccgcgagttcatcaagctggcgctgatggggcagaagctcgggcacaacgtgttcatcgtgatcgagaaggaatccgaggtgcagctggtgatcgaggaggccgccaacgtcggcgtgcagccccaggtcggcctgcgcgtgcggctgtcctcgctggcttcgtcgaagtgggcagacaccggtggcgagaaggccaagttcggcctttccgccgcccagctgctgtcggtggtcgagcgcttccgccaggccggtctcgaccagggcgtgcgcctgctgcatttccacatgggctcgcagatctgctgttccaggtcgttccggccggcctgccgttcgacgtggtcaaccagtcgatga

SEQ ID NO: 3517 - DNA, 450 bp, Pseudomonas aeruginosa
ggccatcccgtggcgatggcagtgaaagagactgactttgcggcagcttggataggtagggttgaaagccgactggcgagcccctgctgccaggctccgaacaagtcacgccgaatacgtgttacgccatgccgaagctcgacaaactcaatggcaagcgcagactgccgagaattaaatcggctgctacaggttctggaacacagactcaacgttgtcgaagaagtgtcgtcgctggacatgatgctaacgctcgtcggcgcaggctatgggattggtttcatgacggcgaccaagattcccatcagccagaggccggacgtggtgattcgccctctggcgcaggacacggcggtaatcacaacctatctgcttcggccagaaagcagcaactcatcggtttcgctggatcgcttcatcgaacgtctgcgaggacctccggatgactaa

SEQ ID NO: 3518 - DNA, 258 bp, Pseudomonas aeruginosa
ttcctgggggacggcctcgtcggacagttcgcttctccatgcttggaagcgtcgaacagtccaaacaatttaaccacgttacgtttaactcaaactagctatcatgaagactttccatccttgtcttatcgcttcttggggcctctcatgcacgacgccaccagcccacgcccacagctcaggctcgccatagcgcctggtgtggcctcttcgtacctagctgcattgcttgccctgcagcgcgcggaggagcccgaa

SEQ ID NO: 3519 - DNA, 360 bp, Pseudomonas aeruginosa
tttgagttaaacgtaacgtggttaaattgtttggactgttcgacgcttccaagcatggagaagcgaactgtccgacgaggccgtcccccaggaactaccactttcgacgccgagccagcgttggcattcggagcggccgttcgtgtcgcccgcctgacgcaaggtgttgctcaggaagaactggctgcgaaagcagggatcgagcgatcgcacatgggcaaaatagagcgtggggagcacatgcccactctcgctctgatcttaagaatcgccgccggactcaagctcagtgctgcggaactcgtcagcgcagccgaacgcaatcttcgtgccgcggcgcacgattcagataggcattga

SEQ ID NO: 3520 - DNA, 336 bp, Pseudomonas aeruginosa
gccagcgactcggcactggtcaggtcgccgatcagcggaccggcgagcagttcgaccatcgccgccagggccgagcccttgtgcccgccgaaagtgagcatggcgcctcgcaacgcggcgctggcatcggtggtcggctcgccctgctcgtccaccccccagcccagcgggattggcttgccggcgcgttcgtgcaactggatctcgccacgcgccacggcgctggtggcgaagtcgaagacgaacggcgggccgtccggacgcggccagccaaaggcgatcgggttggtgccgaagatcggcttgcgtccgcccgccggcgccacccaggcatga

SEQ ID NO: 3521 - DNA, 519 bp, Pseudomonas aeruginosa
caatcatgtaaggcaattccaaatagccccgcagcccctcaagaaacccttccgcgccccgctacaggaccaagcaccttcccacagcccggtcggagaccaccccatgcttcttcgtcgtatcgccatcaccccacgcgccgtcatcggcttcgccatcctcgcctcgctgctggtggcgctcggcctcttcgcgcacaaccgcatgggttcgctgaaccgcgccgccaaggatatcggcgaggtctggctgcccagcgtcgaagcctcggcccagctcagcggcctgatgagcgaactgcgcctcggcgagatgaaccacgtgctgctgcacgacgccacgcgcatgcgccagcaggaacaacggatggacgaggtcatcgctaccctcgccagggtggaaagggaataccgccccttgctggtcctggacgaggagcgcgcgttgctcgaccagttcgtccagcgccagcaggagtacctcgaaggacacgccgccctgctcgcgctgtcccgtga

SEQ ID NO: 3522 - DNA, 495 bp, Pseudomonas aeruginosa
gatcgaaggcatgatcgccagcgtccgcgagggcaccgacaccgcggtgtccgcgatgcgcgagaacgaccagcgcgcccggcagatgctcgacgaggccgaggccgccgaccacgccctgggcgagatcgccgagcacgccacgcggatcaacgagcgcaccctggtgatcgccagcgctgccgaggagcaggcccacgtcgcccgcgaggtcgatcgcaacctggtgaacatccgcgacgttgccgtgcagaccacccagggcgccgagcagacccgcggcgccagccacgagctgtcgcgcctggccaacgacctcaagggcatgatcggtcgcttcgtggtctgacccgcaagcgagctagggcgtcgcgcggcgcagcaccaactgcccgccgtcgcccttctgcacccggtagtcgccctcgccctggcgaccgaggagcatcagggtcaggccgccgcgttcgagcagcgcgatcccggccggggtag

SEQ ID NO: 3523 - DNA, 2832 bp, Pseudomonas aeruginosa
ccgctcgacgttccggttgacccggccatggcgaatgacgccggtggcgtcgttcgcccctacgccaagtctccatcgcggtctcgggcaccgcgtacgaaatcatcgccagactccgcctggcaacgcgccgagcgtctggagcgccccggtgcgccatcccgcccagccggattgaacgcaagcgcacccaccgccctcctatattccatgcaacccaccacctcaaccggaaccgagcaagactccgcagacatggcacagcctttcaccatcgaaccggacccgaacaccctcgaccatccaccggccttcctggccaacggaggagcggtcgggaaactgttgctcagcctcgacgcggccggttcgcccctcggcccgccggacgcctggtcggcgagcctgaagacgacgatggccacgctgctgccggccaaggcgcagatcgtgctgttctggggcgcggaattcgtcgccctgtacaacgatgcctacgcgccgagcatcggcgacaagcatccgcgcgccctcggtcggccggcgatagagaactggcgggagctgtgggatgacctcgaaccgctgctgcgcggggtgtacgagaccggcgagaccttcgcggcaaaggatcggcccttctacatcgaacgccacgggcgcggcgagacggtctatttcgacgtgtcctattcggcggtgcgggaaaccgacggttccgtcggcggcgtgctgtgcatcgtcaccgagaccaccgagcgggtgcgttttgaacgccgccaggcgttcctcctggaactgggccagaccctgccgtccctggccgatcccctggaaatcgaagccaccgccctgcgccggctcggcgaggagctgggcgcgtcgcggatattcttcggcgaggacaacggcgacggcatgaccttccaggtccatcgcgactatctccacgacggccgctcggcggtcggtcggcatcgctacctggcgttcggcgccaccctgtccggcgaactgcataccggacgcagcgtggcgcgggaagacctcgccggggagcgcggcatgagtctcgacgaggcggcgagccgcgcgcgcctggggctgggcgccacgctgcacgtcccggtgctgcgccacggccggctggaggcgctgctggcgatccacttcgcccatccgcaggcgctcggcgaagattcgcgccgcctggcggaggaagccgccaagctggcctggacctcgctcacccatgcccgcgcggagctggcgctgcgcaccagttccgcgcaactggcggcgatgttcgaccaggccagcgcgggcatcgcggtatgcgaccggaactggcgcttcacccgggtcaacgatcgctactgcgagatcgccggccgttcgcgcgagaccctgctcggcctgcgcatgcaggacatcctcgaccccgccgacttcgccctccccgcggcgccaggcggagcgaccggcgcggcgttcgagatgagcggccgatacgttcgccccgacggcgatacggtgtgggtgcagaaccaggtcacgccgctggtggacgagcagcatgccgccagcggcctgctctgcgtgtgcatggacatcagcgcgcgggtacgcgccgagaacgagctgcgcgaactcaacgaaagcctggaagaacgtgtcgcgaccatgctcgcccagcgcgaaagcgccctggcgcagcttcacgaggcacgcaagatggagatggtcggccagttgaccggcggcattgcccatgacttcaacaacctgctgacgccgatcatggcctcgctggaactgatccgccggcggctcgacgacgcccgctccgccgacctcatcgacggcgcgctacagtccgccgaacgggcgcggaatctcgtcggtcgcctgctcaccttcgcccgccggcaaaccctcaaaccgcaggcggtggccctgcgcgagctggtcgaaggcatgcacgacctgatcgagcgctcgctcggcccgaccatcgaggtccgcatcgagatcccggaacgcctacctgcggtggtggtggatccgcaccagttcgaactggccatcctcaacctcgcggtgaacgcccgcgacgccatgggcgaaggcggccgcctggaaataggcgcgcggaccgacctggtgatcgacggcgcagtggacggtctcggcgccggccgctacgtgtgcctggaagtcgccgacaacggcggaggcatgcccgccgaggtgctggcccgctgcatggagccgttcttttccaccaagggcgtgggcaagggcaccggcctcggcctgtcgatggtccagggcctggtcgcccagtccggcggcggcctgggcatccactcggagatcggcaaggggacccgggtgagcatctggctgccgatcaccgcggagcagacgcaatccaccgcagaaagctgcccggacgcaccggaggcgttgcggccgacccacgtgctgctggtcgacgacgacaggatggtgcgctacaccaccgcgctgctgctcggcgatctcggctaccaggtcagcgaggcggcgtcggcggaggaagccctgggcgaggtcgagcgcggcctggcgcccgacctgctggtcaccgaccatctcatggccgacaagaccggcgtgcagcttgccgaggaactgcgccagcgcttcccgcaattgccggtgctggtcatcaccggctacgccaacctcaggcccgagcaactcaacggcttcgaggtgttgaccaagccgttccgccacaacgaactcgccgaacgcctcgcccggctgctggaagcctcgccgtga

SEQ ID NO: 3524 - DNA, 1227 bp, Pseudomonas aeruginosa
gttcgatgccgacgaagccctgcgcatgcgcctgctcaccgaggtggtggaacccggcgaggaactggcacgggccctcgaatacgccgagcggatcgcccgggccgcgccgctggcggtgcgcgccgcgctgcaatcggcgttccaggggcgcgacgagggggacgatgcggcgctgtcgcgggtcaacgagtcgctggccgcgttaatcggcagcgaggacgtccgcgagggcgtgctggcgatggtgcaaaagcgcgcgccggcgttcaaaggccgctagctcccctgcgggtcgacccccggtcgctccgctccatctctcctgcggaaaccgacatgacttcgttgactcaacattccgcagcgccggtgcggatggaacgcctggccctgcccgcgaccgacggctatccgctgtccgcctaccgctaccacgcgccgggccacgcccatggcaacctgctggtggccggcgcgacgggcgtcgcccagcgcttctaccggcgtttcgccgaacacgccgcgcgccagggcttcgacgtactcaccctggactatcgcggcatcggcgaatccgcgccggcaagcctgaagggcttcgccatgtcctacctggactgggcctaccgggacctcgccgccgccgtcgagctgctcggccgggaggagcggccgctgtactggatcggccactccttcggcggccacgccatcggcctgctgcccgaccatgggcggctcgccgcctgctacagcttcggcagcggcgccggctggagcggctggatgtcgcgccgcgaagcgctcaaggtgcgccatgcctgtggaccctggtgctgccgccgctggtggcctggaaaaggctacatggcctggagcctgctgggcatgggcgacgacctgccgctgggggtctaccgcgactggaagcgctggtgccgccatccccgctactatttcgacgacccggcgatgcgccacctccaccagcgctacgccgcagtgcgcacgccctgtctgttcgccaccgccctggacgatccctgggcaccgccgcgctcgcgggacgccttcgtcgaggcctaccgcaacgcaccgctggaaaccctcgacctgcgacccgacggtggaccgctcggacacatgggctacttccgcgccggtgcagaggcgctgtgggacgacgccctgcgctggctgagacggcatccggagaacgcctga

SEQ ID NO: 3525 - DNA, 1833 bp, Pseudomonas aeruginosa
aagaccagcgagagcgcgccatgcacccgttgccgttgtcccttcgcctgttcgccgtcgcattctggctgggcgtggtcgccgtggagttccttctcgaacgcagccgcgccgaaagccgcgaccggggtttcgccgggagaccgccaccaaggccgacagctttgccgggatgaaccgctgctcccggcagatccaccgcatctccctgctggccatcccggccgggctgctggcccagggctgcggcccgtacctgatgcggcaacgctgaaaaatccgccgactgtccatttcgcgacgatgactggcgcttttgccggcgcaggccgcctgcgcctgccttaccgttccccgctctttcagacacgggagcaaggcaatgccgcttgccagtcatctgcgttgcgtggcgctggcgctggggatctccaccgcgctgggctgcgcgaaccgcaaccaacccgcgccacgcgcggaaagcctcgaccctggcctgtcgagggtggcgggaacccgcggcgacgcgctgcccgcccagtggtggacgctctaccaggaccctgggctgaaccacctggtggccgccgcgctgcgccacaaccgcgacctggccgcagccgatgcccatgcccgcgcgctcctcggccatctgcgcggcgcacagggcgaacgctggccacggaccgaggtcggctatggctaccagtatgggcgcgacggcgacgaccagaccctcgccgaagccaccgacgaggacctgcacagccagtggaaacacaccgtccgcctcgacctgtcctaccagttggacctgtggggcgaagtccgcgcccgcatcgccgcggcgaaggcggatgccgaagcggcgcaagcggcgcgcgacctgctcagggtcagcgtggccagccagaccaccctcgcctacgtccgcgcctgcgccctggcgcgacgggcagaggtacaacgccgatcggtcggtctgctcgacgcgagcctggcgctgagcgaacgccagctcgccgccggcctttccagcgagctgcagcgacgccggctgctggccttgcgcgagcggacccgcgccgcgctgccgatgctcgaggcgcggcggcgcgcggcactctacgaactggcgctgctcagcgggcgctcgccgcgccagttggacgctcctgccgcgacctgcgccggcataccgcaactgcgccgtgccctgcccaccggcgacaggtggagcctgctggcgcgccgcccggacgtccgcgcgggcgaacgcccggtcgccgccgccgacgcccggcgcgcgctggccgaagccgagctgttaccgcgcatcaatttccccggtcggcgccgaaacataccgcagagaccatcgccggcatcggcggcagcggcgcgatggcatatgcggccggcccgatgatgagctggcgcttccccaaccgggaaagcgcgcgaggccgcttggacagcgcagcggcagagcgcgacgccgccctggcgcgattcgacggagcggtgctcggcgccctgcgcgaggtcgagcgtgccctggcgctgaatgccggcgagcgccagcggcgtgccgacctccagcgtgccctcgacgagcagcgccacgcataccggttggcgcgcagcaactatcgcgccggcgccctcgatgccctcgagctgctcgacagccaacgcagcctggtcgccgaccgggcgcgcctggtcgacgccgagatgcgcgtcgccgagcgccaggtcgaactgttccgggctatcggcggcggatggcaagccgctcccagcccctcccatcaggaaaacggacaatga

SEQ ID NO: 3526 - DNA, 1836 bp, Pseudomonas aeruginosa
ggtggcctgccgcgacagccttctcttgacctcaatcgacccggagcatgccgaaaacggcacaaccggctcgagcacatcgaaaacttacagaaaattcctagcaatcatgtaaggcaattccaaatagccccgcagcccctcaagaaacccttccgcgccccgctacaggaccaagcaccttcccacagcccggtcggagaccaccccatgcttcttcgtcgtatcgccatcaccccacgcgccgtcatcggcttcgccatcctcgcctcgctgctggtggcgctcggcctcttcgcgcacaaccgcatgggttcgctgaaccgcgccgccaaggatatcggcgaggtctggctgcccagcgtcgaagcctcggcccagctcagcggcctgatgagcgaactgcgcctcggcgagatgaaccacgtgctgctgcacgacgccacgcgcatgcgccagcaggaacaacggatggacgaggtcatcgctaccctcgccagggtggaaagggaataccgccccttgctggtcctggacgaggagcgcgcgttgctcgaccagttcgtccagcgccagcaggagtacctcgaaggacacgccgccctgctcgcgctgtcccgtgacaaccgtaccgacgaagccagcgtgctgatgggcagggcccagttgcagcgctacgagcaggtgcagcggaccctgaagcaactcatcgccctcgaccgcgaggccgcccgcgcctccaccgccgaagccgccgatgtctactcccgggcctccaccgcgatcctcgcggtgctgctggtggccctggcggccagcgtgacgatcgcctggctgctgacccgcagcatcgtcgtgccgatccgccaggcggtgtcctgcgccgaccgcatcgcggcccgcgacctgaccggcgagatcgccagcgacggcgacgacgagccggcgcaactgatgaaggccatgcgcagcatgcaggccagcctgcacgacaccatcgagcagatcggcgattccgccgcgctgctggccgccgctgccgagcaactgaacgcggtgaccgaggaaggcaaccggtcgctggcccggcagaacgatgagatcgagatggccgccaccgcggtcaacgaaatgagcgcggcggtcgaggaggtcgcgcgcaacgccagctccaccgccgaggcctccagtctctcggaacgggccgccggcaacggccgcgcacgggtcggacagaccgtccgctcgatccgccagatgaacgccgagatcggccagaccgcgcgcctggtggaaggcctggccagccaggcgcaggacatcggcaaggtgctcgacgtgatccgcgccatcgccgagcagaccaacctcctcgccctcaatgccgccatcgaggccgcccgcgccggcgagcagggccgcggattcgcggtggtcgccgacgaagtgcgcgccctcgcccaccgcacccagcaatcgacccatgagatcgaaggcatgatcgccagcgtccgcgagggcaccgacaccgcggtgtccgcgatgcgcgagaacgaccagcgcgcccggcagatgctcgacgaggccgaggccgccgaccacgccctgggcgagatcgccgagcacgccacgcggatcaacgagcgcaccctggtgatcgccagcgctgccgaggagcaggcccacgtcgcccgcgaggtcgatcgcaacctggtgaacatccgcgacgttgccgtgcagaccacccagggcgccgagcagacccgcggcgccagccacgagctgtcgcgcctggccaacgacctcaagggcatgatcggtcgcttcgtggtctga

SEQ ID NO: 3527 - DNA, 2226 bp, Pseudomonas aeruginosa
cccgcaagcgagctagggcgtcgcgcggcgcagcaccaactgcccgccgtcgcccttctgcacccggtagtcgccctcgccctggcgaccgaggagcatcagggtcaggccgccgcgttcgagcagcgcgatcccggccggggtaggcctccaggcgcgcggctcgctgggcagccagcgcgtgaggcaggcggtatcgccgcccaggtcgtagccactggcttccgccacttcgctatcgcgcagctccaggtggcagatcgcgggcgcctcgtcctgctgcagggtccattgcccggcgagatcggaagcgctgagaagaatcagactgctggccatactgatacctgtgctgaaaaaaccgcagagcaagcaaaccatcctggagagcttcgcgcttgccgacatcgagagatctccttcaagcctggaacatcggataacacggcgaacgccgcccgccatcctcgcttcgaacgccagcgcgcgccaggcgccgcgggcctccgttcgtccgccaggccgccggcccacgggcgcgccacagttcacaacttcgctcctgtggaagacacctatcaattcgaacagtgcccggccggccgaagggccgcggttcgtaccgccgcaccgaaccgcgcccgcttcagcgcgtcagacgacgatgtcggcctgggtcgcctggccgatcagattgatcgcgaaatcggcatgggcgtccccgctgaagtcgatcgccaggctgccggccttgctcgccgcgtcgtaggacaggatcgcctggccggccttgccggcgaaggcgtcgacgtattgcagcaccagcccgccgttgacgaaggcatccagcccggacaggtcgatcttgtcctggccgctgacgaagtcgcgcagggtatccggcgccgccgcggaggactcggcgatatcgccgtagacgaaggtgtcggcccccgcgccgccccacaactggtccgcgccgaggccgccgtagaggatgtcgttgccggcgccgcccttgagcacgttggccacgtcgttgccgatcaacaggtcgctacccgagccgccgatggcgttttccacggtgaccccggcagcgatcgacacattacccttcaacccgccgacatcggacagcgccttctcgttgaggttgatcttctggttctggctgaagccggagaagtccagggtgtcgttgccgccggcgtcccacaccgagaacaccagcttggaactggacgaggtggcgctgtagaagtcgcgctcggtgttggagttgaagccgtacaccgtgtcgccggtgcgggtggtcaggttggccccgtagagcttctggatcgccgcgatgtcgtccagcagcggtgccgaggaataggcgcccttgaagtcctggccggtgttctgctcttcccagtagctcatcaccgaataggcgcgggtgtcctcggcgtaggtagcgtcggcgtaggtgggatcgccctcgccggcgttgtagtcgccggggtggctcaggcccagggtatggccgatctcgtgggtcagggtctggcgtccgtagttgccgttggccggattgacgttggcgctgtagctgctgttgatcaggtaccaggattgccccttgagcgcatccggtacatccggcaggaaggcgaacgccgcaccgccgacactactgctgaagttgccgaaggtcaggtcgccctggtcgccctggccggcgtcgacgaagtggatattggtgacgtccgaccaggattgcagcgacaacttggcctgggcctgctgctgcgcggagaaggcgctgaacttgcccagcgagtagatatcgctgacatacttccacggcgtattgaagaagtcgttcggtttggtcaggaacgaataggacagggtcagcaccgagtcgcccggcgctttctgccaagacgcctgttcgcggaggatctgctccgccgcctggtcgacggtataggacggatggccattgaccaattcgtccccaccccgcgcataggcatgcaggaagttgtctacctgggtatacgcatcgctacgacctttcaatgcaagagaattgctggacattgtcatatccctttaagttgtaaaggaaataactcggatacaattatcggatggataattgcagttatcggccagatcaggccgaagtccaaactgacacagctcattttccaatgtccacaggtttcatga

SEQ ID NO: 3528 - DNA, 468 bp, Pseudomonas aeruginosa
gggtctcgcggaccttgtcgtccaggtcgtaatggctcttctccatgcgatgcgtggcctggcgcgtcgccgccagggtctcgccgccggagaacagcggaacgctcaactggatgccgacgctgtcggtctcgtagcgctggttgtaggtgttctccgaaccggacttggacttgccggtgctggcgtacaggcccaggcgcggcaggaagtcggcgcggttctgctcgacctcgtagcgggccacgtccaccgcgtggcgcagcgaggccagctcgggattctcggccagcgccaggtcgcgccaggcggtgtagctggcggggctcagcgggcgcacctggaagcgttcgccgagcggcgccaggtcggcgatctccagcggcgccccgaccagccgctccagctcgcgcagggcggcatcctggctgtcccgcgcctcgatttcctgggcctgggccaggttga

SEQ ID NO: 3529 - DNA, 450 bp, Pseudomonas aeruginosa
cttccttgcggtactcctcctcgcgttgggcgatgcgcatctgcgcctcggcgatgctctggcggatctgcccgaagcgaccgctgctctccgatagccgggcgttcacctcggccagttggcgctcctgttcgagcaactggttgcgcggcatgtagccttcctcggcgaggtcgcgcgcaccgctcaactggctgttcaacaggcgttgttgcaggcgctggttgccctcggtctggcgcaacccttcgagctgggcgcgcagcccctcgatgttcgcccgcaatgcggagagttcgttggccagcgcggtctggcggctgtgcagcaactgccgctgcaactccaggcgctcgccgagggtcggcagcggggcctgctcggccagccccgcgggcatctccagggtccgccggccgtcgtattcggcctgcaggcgcgcctggttga

SEQ ID NO: 3530 - DNA, 432 bp, Pseudomonas aeruginosa
gtctcgacgaggcggcgagccgcgcgcgcctggggctgggcgccacgctgcacgtcccggtgctgcgccacggccggctggaggcgctgctggcgatccacttcgcccatccgcaggcgctcggcgaagattcgcgccgcctggcggaggaagccgccaagctggcctggacctcgctcacccatgcccgcgcggagctggcgctgcgcaccagttccgcgcaactggcggcgatgttcgaccaggccagcgcgggcatcgcggtatgcgaccggaactggcgcttcacccgggtcaacgatcgctactgcgagatcgccggccgttcgcgcgagaccctgctcggcctgcgcatgcaggacatcctcgaccccgccgacttcgccctccccgcggcgccaggcggagcgaccggcgcggcgttcgagatga

SEQ ID NO: 3531 - DNA, 1926 bp, Pseudomonas aeruginosa
ccaagccgttccgccacaacgaactcgccgaacgcctcgcccggctgctggaagcctcgccgtgaggccccgggccggcggaacgcctcagcgcacgcgctcgcggctcttcaccgccaggtccagggctttctgcatgtccagccgcgccgagcggccgacgtcgcggtggtccaggcggtagccgcgctccgagggcaggatcggtgcggtgaggtcctcggcatcggccggctcgaaatcgtagtcgccgccgatggtcatggcgctgcgccggagcagcatgcggatctcctcgggtcgcagccgcgggttgagggaaagcatggcggcgaccgtgccggcgaccatcggcgtggcataggaggtgccgcagtgcacctcgccccgcgcgtcccgctccagggtcgaggcatgggtacaggcggcggcggtgacatccacccgcatgtcgacgttcgaggtgctgcgcttgaccgcgtaggccgggtcgtccaccgccaggccttggcgctcgctgcgctcgtggccgcccaccaccagcaactgctcggtgacgaacgaggacggcaggcggtattcgtcggtaccggagtaggacgagccgttgccggcggagttgaccaccagcacgtccggatgctccttgcgcagccagaggaagaactcctcgagcaactcctcgtagccgctcatggcaatccccgagcgcaccagcgaatccacctcgtcgccgtcgacgtcgcgagcgccgacgcggtggatgccccagctccagttgagcacccgcacgccatcctccaccaggttcaccgaagcggcgacgttggccgtgatgccagcgtcggaattgcgctcgacgatcacttcgaaaccctggctggcgcggtccagcccacgcaggaagccactgttgccgccctggtcccagcgcgcggcgaggatgccggcgaccgtcgaaccgtggttgtcgggacgttcggcatcgcgcgcgtagaggcaggtacgcggcgcgggcgccttgcagggaccgaggtagtcggcgaagtcgggggcgtcgaagtcgacgtcgcgctcgatcaccccgatgcgcaccgggcgggtctccagcggggcctggcgggcgcggacccgacgctggtaatagttcaccgcgtccatgaaacgattggccgcccactcgtcggagtcgctgtccggcttgtccacgggccggcgcgccgcctcggtttcctcgccctgctccggcgcggactcctccaccaccacggcgtccacgctggtctcgctgccgatgcggaggaccagcgcgtcgcgctggacgaggtcgcgcgccggcaggcgcaactggtagaggttcaacggcgggatcgcgccgaccacccgcgcgccatatttatcggccaggcgttcggcctcccggcgaccgtcgtggttctcctcgatcaacaggctgaccaggtcgacgtaggtggtcaggccatccatgttcttcgccacctcgtcgggaccggcggcgagcacatggctgccgttcagggtcagccataccggattgctgctgcgcccgccctgctccagccaaagcggaccgctggcgtggccacggcggtccaggcggagccgcaggccgtcgccctcgcgccgcagggcggtggccggcagttcgcggccgtccagcaacaggcgcggcaggccggagcccaggccgcgcacgcgcaggcaccactcctgccgctcgctggccaggagatcgccgcagcgctccaggcgctccaggcgcaggggtgtttcggcggctaccaaaggactgcccagggacgcgaaaaggatggcgaaaacggcacggcgcagcggcatggactcggcttccggaacggggacctgttgttccgaccgcctggcgaaacgcttcgttcaggttga

SEQ ID NO: 3532 - DNA, 846 bp, Pseudomonas aeruginosa
ctagaagaagtttccgctccaccaacccaagcacaggagagaggcatcatgagcgaagccaacagcggcccgggccgcgtcacccgagagcagcgcggtcatctgtttctcatcggcctggaccgcgcgggcaagcgcaacgccttcgacagcgcaatgctggcggacctggcgctggccatgggtgaatacgagcgcagcgaggaatcccgctgtgccgtgctcttcgcccatggcgagcacttcaccgccgggctcgacctgatggaactggcaccgaagctcgccgccagcggtttccgctatccggacggcggcgtcgatccctggggcgtggtccagccgcgtcggagcaagccgctggtggtcgcggtgcaaggcacctgctggaccgccgggatagagctaatgctcaatgccgacatcgcggtggccgcgcgcggcacgcgcttcgcccatctggaggtgctacgcggcatcccgccgctgggcggatccaccgtgcgcttcccgcgcgcggcgggctggaccgacgccatgcgctacatcctcaccggcgatgagttcgatgccgacgaagccctgcgcatgcgcctgctcaccgaggtggtggaacccggcgaggaactggcacgggccctcgaatacgccgagcggatcgcccgggccgcgccgctggcggtgcgcgccgcgctgcaatcggcgttccaggggcgcgacgagggggacgatgcggcgctgtcgcgggtcaacgagtcgctggccgcgttaatcggcagcgaggacgtccgcgagggcgtgctggcgatggtgcaaaagcgcgcgccggcgttcaaaggccgctag

SEQ ID NO: 3533 - DNA, 609 bp, Pseudomonas aeruginosa
agggcttcgccatgtcctacctggactgggcctaccgggacctcgccgccgccgtcgagctgctcggccgggaggagcggccgctgtactggatcggccactccttcggcggccacgccatcggcctgctgcccgaccatgggcggctcgccgcctgctacagcttcggcagcggcgccggctggagcggctggatgtcgcgccgcgaagcgctcaaggtgcgccatgcctgtggaccctggtgctgccgccgctggtggcctggaaaaggctacatggcctggagcctgctgggcatgggcgacgacctgccgctgggggtctaccgcgactggaagcgctggtgccgccatccccgctactatttcgacgacccggcgatgcgccacctccaccagcgctacgccgcagtgcgcacgccctgtctgttcgccaccgccctggacgatccctgggcaccgccgcgctcgcgggacgccttcgtcgaggcctaccgcaacgcaccgctggaaaccctcgacctgcgacccgacggtggaccgctcggacacatgggctacttccgcgccggtgcagaggcgctgtgggacgacgccctgcgctggctga

SEQ ID NO: 3534 - DNA, 297 bp, Pseudomonas aeruginosa
gacggcatccggagaacgcctgaaagaccagcgagagcgcgccatgcacccgttgccgttgtcccttcgcctgttcgccgtcgcattctggctgggcgtggtcgccgtggagttccttctcgaacgcagccgcgccgaaagccgcgaccggggtttcgccgggagaccgccaccaaggccgacagctttgccgggatgaaccgctgctcccggcagatccaccgcatctccctgctggccatcccggccgggctgctggcccagggctgcggcccgtacctgatgcggcaacgctga

SEQ ID NO: 3535 - DNA, 1122 bp, Pseudomonas aeruginosa
ctggcgcttttgccggcgcaggccgcctgcgcctgccttaccgttccccgctctttcagacacgggagcaaggcaatgccgcttgccagtcatctgcgttgcgtggcgctggcgctggggatctccaccgcgctgggctgcgcgaaccgcaaccaacccgcgccacgcgcggaaagcctcgaccctggcctgtcgagggtggcgggaacccgcggcgacgcgctgcccgcccagtggtggacgctctaccaggaccctgggctgaaccacctggtggccgccgcgctgcgccacaaccgcgacctggccgcagccgatgcccatgcccgcgcgctcctcggccatctgcgcggcgcacagggcgaacgctggccacggaccgaggtcggctatggctaccagtatgggcgcgacggcgacgaccagaccctcgccgaagccaccgacgaggacctgcacagccagtggaaacacaccgtccgcctcgacctgtcctaccagttggacctgtggggcgaagtccgcgcccgcatcgccgcggcgaaggcggatgccgaagcggcgcaagcggcgcgcgacctgctcagggtcagcgtggccagccagaccaccctcgcctacgtccgcgcctgcgccctggcgcgacgggcagaggtacaacgccgatcggtcggtctgctcgacgcgagcctggcgctgagcgaacgccagctcgccgccggcctttccagcgagctgcagcgacgccggctgctggccttgcgcgagcggacccgcgccgcgctgccgatgctcgaggcgcggcggcgcgcggcactctacgaactggcgctgctcagcgggcgctcgccgcgccagttggacgctcctgccgcgacctgcgccggcataccgcaactgcgccgtgccctgcccaccggcgacaggtggagcctgctggcgcgccgcccggacgtccgcgcgggcgaacgcccggtcgccgccgccgacgcccggcgcgcgctggccgaagccgagctgttaccgcgcatcaatttccccggtcggcgccgaaacataccgcagagaccatcgccggcatcggcggcagcggcgcgatggcatatgcggccggcccgatga

SEQ ID NO: 3536 - DNA, 2196 bp, Pseudomonas aeruginosa
atagcgccttattggaaaaacaattccatgcgtattgttcgacctctgtcgacccgcccgggacatcgacttcacgccaggcgaacaattgcctgcacgtccttcgcggtctcaatggagcgcgctccggttttcctccgtatcggtcttcgacagggtgtgcagcggcgccgggcaatccgtcgtcgcgcagtcgcggcggcgcgccggcgtctcgccggaaacgaagttcgccgccaccagttccaggtcggcttcgtccagcaccccggcgtagaaacgcaggcgtgcccaggccgtgaggtagtcgtacttggccttggacagctcgttcatcgcgctgtacagcgcctgctcggcgttcagcaggtcgaggttgacccgcaccccggcggcgatgctcttgcgcgtggccatcaccagcgtccgcgccgaatccacggtcatctcgtaggcgcggatcttcgccgcgctgctgctgctctggttgtacatcttgcgcacctggttgagggtctcgcggaccttgtcgtccaggtcgtaatggctcttctccatgcgatgcgtggcctggcgcgtcgccgccagggtctcgccgccggagaacagcggaacgctcaactggatgccgacgctgtcggtctcgtagcgctggttgtaggtgttctccgaaccggacttggacttgccggtgctggcgtacaggcccaggcgcggcaggaagtcggcgcggttctgctcgacctcgtagcgggccacgtccaccgcgtggcgcagcgaggccagctcgggattctcggccagcgccaggtcgcgccaggcggtgtagctggcggggctcagcgggcgcacctggaagcgttcgccgagcggcgccaggtcggcgatctccagcggcgccccgaccagccgctccagctcgcgcagggcggcatcctggctgtcccgcgcctcgatttcctgggcctgggccaggttgaagcgggcctgggtctccagggtgtcggtgcgggtgccgttgccgcgctcgaactggcgctggttgagctggaactgctcgcggtaggagcgtttctgcgcccgcgccagttcgatctggtcctgggccagcagcgcgccggtataggcttccaggacccggaccagcagttcctggctctggctgcggaagcgctcgtcggacagcagcgcctgggccacgcccttgcggtagcggctgaaggcctcgtagtcgaacaacggctgttgcaggctgagggtggagacgtagctgtcgtagtcgcggtcttccttgaaatcgccgcgggtggtggtctgggtcacatcggaccagctgcgcccacggttgtagctgtacaccaggcgcggcagcagcgccgcgcggccgagcgcacggtattgcctgccggcctcgtgctcctggatcgcggcctggaactgcgggtcgttctccagggccaggtgatagccgtccagcaggccgagggcgaaggcgtcctcgcgcagcagcaacaggaaggcgccgaacagccaggtcatcaggcggcgcatggtcatcggtcagttctccgccagcgccacgtgggcgcggtcgaacaggggcttgaacaggtaattgagcagcgagcgctcgccggtgcggacgaacacctgcaccgccatccccgggcggatctgcaggcccttcagcttacccatcgcggccgcgtcgacctgggcgcgcagcgcgtagtagggctgcttgttctgctcgtcgagcaggcggtcggcgctgaccatggtcacctcgccggtgacccgcggggtcttgctctggttgaaggcggtgaacagcatctccaccggcagcccgctgtggatccggtcgaccaggttcaccgcgagctggccctccacttccaggctgtcgctgttgggcacgatgtacatcagcaattcgccggggccgatcaccccgccatcggtgaacaccttcaagccggccacgtagccgctgaccggcgcgcggatctcggcgtggcgcagttcgtagcgcgccgaggacagctcctcccagagcgtccgcgcattgacctgggtttccgccagttgcccgttgacttccttgcggtactcctcctcgcgttgggcgatgcgcatctgcgcctcggcgatgctctggcggatctgcccgaagcgaccgctgctctccgatag

SEQ ID NO: 3537 - DNA, 1119 bp, Pseudomonas aeruginosa
  unsure (274): Identity of nucleotide at the above locations are unknown.
gatgtgcttgaccaccccgcccagcggatgctgcaccgacttgcgctggccggagatgatcaccgtggccggcaccgccacgccctggtcgagcggcgcgaaggcggcccagagcagcgcgccgccgaagccgaacaggaccagcagccagcccagtcgcgcataggcgttctcgtcgcgtttcaccgtgcgggtcattccacacctccctggcgcggcgcggccaccacctggcggcgcgccgtagccggccacccggtagtccgcgcgctgntgcgacgccgacgcggcgcgctggttgttcaaggcggcgagcacctggtcgcgctcgccgtacaggtgcaactggccggcgttcagcgccggccggcggtcggcgcaacccagcaacgcgggccccggggggagatcagcaggcaccgtgcagccacgcgccttgagcgcctggatcgccgccagcagcgcatgctcccggctgtcgtcgaggttcgagttgggttcgtcgagcaccaccagggtcggcgcgccgtacagcgcccgggccagggcgatgcgctggcgctggccgccggaaagcccggcgccgccgacgccgagcacggtgtcgtagcccatgcggcaggcgcaggaccagttcatggaccccggccaggcgcgccgcctccaccaccttgtcggcctgcacatcgccgaagcgggcgatgttttccgccaccgtgccggcgaacagttcgatgtcctgcggcaggtagccgatgcgcgggccgagggtctcgcgctcgtactggcggatctcggcgccgtccaggcgcacgctgccgtgcagggtcggccagatgcccagcactacccgcgccaggctcgacttgccggagccggacggaccgatcacgccgaccaccgagccggccgggatcgccagggtcaggccacgcagggtgcgcgcctcgctgccgggcggcgccgcgtccagcgattccagcagcaggtggccatgcggctcgggcaattccatgcgccgctcgcgggcggggaattcgtcgagcaggccgctcagccggcgataggcatcgcgcgccgcgccccactgcttccacacgccgatcagttggtcgatag

SEQ ID NO: 3538 - DNA, 339 bp, Pseudomonas aeruginosa
ctcttcagaaacggagtacccagcatgacgaaggatgaaaaggaaaagacccacgtcgacgcaatcatcgaacgctacaaggacctgatggtcgagattccccccgccgaccggcaacccggtctctccctgctctggccggttcccgcccagcccgccatcgacaagggcgtccgccaggccgagaactggcttgccgaccagatcgaaggccagctatggaccgccttcgccttcggccgcgacagcctgcccacaccgatgcagaagaccgccttcgaagtggccttcctgacgcgcctgcagcagcgcctggtagccgctcgacgttccggttga

SEQ ID NO: 3539 - DNA, 1002 bp, Pseudomonas aeruginosa
acgccgccaggcgttcctcctggaactgggccagaccctgccgtccctggccgatcccctggaaatcgaagccaccgccctgcgccggctcggcgaggagctgggcgcgtcgcggatattcttcggcgaggacaacggcgacggcatgaccttccaggtccatcgcgactatctccacgacggccgctcggcggtcggtcggcatcgctacctggcgttcggcgccaccctgtccggcgaactgcataccggacgcagcgtggcgcgggaagacctcgccggggagcgcggcatgagtctcgacgaggcggcgagccgcgcgcgcctggggctgggcgccacgctgcacgtcccggtgctgcgccacggccggctggaggcgctgctggcgatccacttcgcccatccgcaggcgctcggcgaagattcgcgccgcctggcggaggaagccgccaagctggcctggacctcgctcacccatgcccgcgcggagctggcgctgcgcaccagttccgcgcaactggcggcgatgttcgaccaggccagcgcgggcatcgcggtatgcgaccggaactggcgcttcacccgggtcaacgatcgctactgcgagatcgccggccgttcgcgcgagaccctgctcggcctgcgcatgcaggacatcctcgaccccgccgacttcgccctccccgcggcgccaggcggagcgaccggcgcggcgttcgagatgagcggccgatacgttcgccccgacggcgatacggtgtgggtgcagaaccaggtcacgccgctggtggacgagcagcatgccgccagcggcctgctctgcgtgtgcatggacatcagcgcgcgggtacgcgccgagaacgagctgcgcgaactcaacgaaagcctggaagaacgtgtcgcgaccatgctcgcccagcgcgaaagcgccctggcgcagcttcacgaggcacgcaagatggagatggtcggccagttgaccggcggcattgcccatga

SEQ ID NO: 3540 - DNA, 1176 bp, Pseudomonas aeruginosa
cttcaacaacctgctgacgccgatcatggcctcgctggaactgatccgccggcggctcgacgacgcccgctccgccgacctcatcgacggcgcgctacagtccgccgaacgggcgcggaatctcgtcggtcgcctgctcaccttcgcccgccggcaaaccctcaaaccgcaggcggtggccctgcgcgagctggtcgaaggcatgcacgacctgatcgagcgctcgctcggcccgaccatcgaggtccgcatcgagatcccggaacgcctacctgcggtggtggtggatccgcaccagttcgaactggccatcctcaacctcgcggtgaacgcccgcgacgccatgggcgaaggcggccgcctggaaataggcgcgcggaccgacctggtgatcgacggcgcagtggacggtctcggcgccggccgctacgtgtgcctggaagtcgccgacaacggcggaggcatgcccgccgaggtgctggcccgctgcatggagccgttcttttccaccaagggcgtgggcaagggcaccggcctcggcctgtcgatggtccagggcctggtcgcccagtccggcggcggcctgggcatccactcggagatcggcaaggggacccgggtgagcatctggctgccgatcaccgcggagcagacgcaatccaccgcagaaagctgcccggacgcaccggaggcgttgcggccgacccacgtgctgctggtcgacgacgacaggatggtgcgctacaccaccgcgctgctgctcggcgatctcggctaccaggtcagcgaggcggcgtcggcggaggaagccctgggcgaggtcgagcgcggcctggcgcccgacctgctggtcaccgaccatctcatggccgacaagaccggcgtgcagcttgccgaggaactgcgccagcgcttcccgcaattgccggtgctggtcatcaccggctacgccaacctcaggcccgagcaactcaacggcttcgaggtgttgaccaagccgttccgccacaacgaactcgccgaacgcctcgcccggctgctggaagcctcgccgtgaggccccgggccggcggaacgcctcagcgcacgcgctcgcggctcttcaccgccaggtccagggctttctgcatgtccagccgcgccgagcggccgacgtcgcggtggtccaggcggtag

SEQ ID NO: 3541 - DNA, 1074 bp, Pseudomonas aeruginosa
gtggtcaggccatccatgttcttcgccacctcgtcgggaccggcggcgagcacatggctgccgttcagggtcagccataccggattgctgctgcgcccgccctgctccagccaaagcggaccgctggcgtggccacggcggtccaggcggagccgcaggccgtcgccctcgcgccgcagggcggtggccggcagttcgcggccgtccagcaacaggcgcggcaggccggagcccaggccgcgcacgcgcaggcaccactcctgccgctcgctggccaggagatcgccgcagcgctccaggcgctccaggcgcaggggtgtttcggcggctaccaaaggactgcccagggacgcgaaaaggatggcgaaaacggcacggcgcagcggcatggactcggcttccggaacggggacctgttgttccgaccgcctggcgaaacgcttcgttcaggttgaaggcgggcgcaggctagcccgccagttgctccagcgctcgccgggtgacgccatcgatatagcccggctcgccatagatgcgcgccagcaggatggcgccttcgaaatcagccaccagttgccggccgcgctccagcgcctgcgcctcgtcgaaggccgggcggtagagctgggcgaaggcttgcgcccagtcgtcgaggaaactgcggatcggcgccatcagctcgctgcgaccatagctggcgtcgaccgcgaccacgcccatcaggcagccgatgctgtcgtcctggaacaaccgggcggccttgcggccgagtttttccaggcgctcgcggggcgtcagcagcgggtcgtaggcgatgctgaagagcgtctcggcgagccgctggtgggtccattcgagaacgtcgcggagcaaggcttccttgttcgggtaatggtggtagaacgaggccttggtcaagccgcaggcgctggacagcatgtccatggtggtgccgtggtagccgtagcgacggaaggtgccggcgcagcgctggagaagctcgtcgcgggagattttcaacggacgcacggaaggttcctgctctcgatcaaaggcgttgattctatgccataa

SEQ ID NO: 3542 - DNA, 1194 bp, Pseudomonas aeruginosa
tcggcagcgaggacgtccgcgagggcgtgctggcgatggtgcaaaagcgcgcgccggcgttcaaaggccgctagctcccctgcgggtcgacccccggtcgctccgctccatctctcctgcggaaaccgacatgacttcgttgactcaacattccgcagcgccggtgcggatggaacgcctggccctgcccgcgaccgacggctatccgctgtccgcctaccgctaccacgcgccgggccacgcccatggcaacctgctggtggccggcgcgacgggcgtcgcccagcgcttctaccggcgtttcgccgaacacgccgcgcgccagggcttcgacgtactcaccctggactatcgcggcatcggcgaatccgcgccggcaagcctgaagggcttcgccatgtcctacctggactgggcctaccgggacctcgccgccgccgtcgagctgctcggccgggaggagcggccgctgtactggatcggccactccttcggcggccacgccatcggcctgctgcccgaccatgggcggctcgccgcctgctacagcttcggcagcggcgccggctggagcggctggatgtcgcgccgcgaagcgctcaaggtgcgccatgcctgtggaccctggtgctgccgccgctggtggcctggaaaaggctacatggcctggagcctgctgggcatgggcgacgacctgccgctgggggtctaccgcgactggaagcgctggtgccgccatccccgctactatttcgacgacccggcgatgcgccacctccaccagcgctacgccgcagtgcgcacgccctgtctgttcgccaccgccctggacgatccctgggcaccgccgcgctcgcgggacgccttcgtcgaggcctaccgcaacgcaccgctggaaaccctcgacctgcgacccgacggtggaccgctcggacacatgggctacttccgcgccggtgcagaggcgctgtgggacgacgccctgcgctggctgagacggcatccggagaacgcctgaaagaccagcgagagcgcgccatgcacccgttgccgttgtcccttcgcctgttcgccgtcgcattctggctgggcgtggtcgccgtggagttccttctcgaacgcagccgcgccgaaagccgcgaccggggtttcgccgggagaccgccaccaaggccgacagctttgccgggatga

SEQ ID NO: 3543 - DNA, 435 bp, Pseudomonas aeruginosa
accacctggtggccgccgcgctgcgccacaaccgcgacctggccgcagccgatgcccatgcccgcgcgctcctcggccatctgcgcggcgcacagggcgaacgctggccacggaccgaggtcggctatggctaccagtatgggcgcgacggcgacgaccagaccctcgccgaagccaccgacgaggacctgcacagccagtggaaacacaccgtccgcctcgacctgtcctaccagttggacctgtggggcgaagtccgcgcccgcatcgccgcggcgaaggcggatgccgaagcggcgcaagcggcgcgcgacctgctcagggtcagcgtggccagccagaccaccctcgcctacgtccgcgcctgcgccctggcgcgacgggcagaggtacaacgccgatcggtcggtctgctcgacgcgagcctggcgctga

SEQ ID NO: 3544 - DNA, 900 bp, Pseudomonas aeruginosa
gcgaacgccagctcgccgccggcctttccagcgagctgcagcgacgccggctgctggccttgcgcgagcggacccgcgccgcgctgccgatgctcgaggcgcggcggcgcgcggcactctacgaactggcgctgctcagcgggcgctcgccgcgccagttggacgctcctgccgcgacctgcgccggcataccgcaactgcgccgtgccctgcccaccggcgacaggtggagcctgctggcgcgccgcccggacgtccgcgcgggcgaacgcccggtcgccgccgccgacgcccggcgcgcgctggccgaagccgagctgttaccgcgcatcaatttccccggtcggcgccgaaacataccgcagagaccatcgccggcatcggcggcagcggcgcgatggcatatgcggccggcccgatgatgagctggcgcttccccaaccgggaaagcgcgcgaggccgcttggacagcgcagcggcagagcgcgacgccgccctggcgcgattcgacggagcggtgctcggcgccctgcgcgaggtcgagcgtgccctggcgctgaatgccggcgagcgccagcggcgtgccgacctccagcgtgccctcgacgagcagcgccacgcataccggttggcgcgcagcaactatcgcgccggcgccctcgatgccctcgagctgctcgacagccaacgcagcctggtcgccgaccgggcgcgcctggtcgacgccgagatgcgcgtcgccgagcgccaggtcgaactgttccgggctatcggcggcggatggcaagccgctcccagcccctcccatcaggaaaacggacaatgaaccaggcaatcagggaacccatcgaacacaccactggcgaaaccagcgccgcaccacgcactcagaccggacct

SEQ ID NO: 3545 - DNA, 1344 bp, Pseudomonas aeruginosa
ctggcaagcggcattgccttgctcccgtgtctgaaagagcggggaacggtaaggcaggcgcaggcggcctgcgccggcaaaagcgccagtcatcgtcgcgaaatggacagtcggcggatttttcagcgttgccgcatcaggtacgggccgcagccctgggccagcagcccggccgggatggccagcagggagatgcggtggatctgccgggagcagcggttcatcccggcaaagctgtcggccttggtggcggtctcccggcgaaaccccggtcgcggctttcggcgcggctgcgttcgagaaggaactccacggcgaccacgcccagccagaatgcgacggcgaacaggcgaagggacaacggcaacgggtgcatggcgcgctctcgctggtctttcaggcgttctccggatgccgtctcagccagcgcagggcgtcgtcccacagcgcctctgcaccggcgcggaagtagcccatgtgtccgagcggtccaccgtcgggtcgcaggtcgagggtttccagcggtgcgttgcggtaggcctcgacgaaggcgtcccgcgagcgcggcggtgcccagggatcgtccagggcggtggcgaacagacagggcgtgcgcactgcggcgtagcgctggtggaggtggcgcatcgccgggtcgtcgaaatagtagcggggatggcggcaccagcgcttccagtcgcggtagacccccagcggcaggtcgtcgcccatgcccagcaggctccaggccatgtagccttttccaggccaccagcggcggcagcaccagggtccacaggcatggcgcaccttgagcgcttcgcggcgcgacatccagccgctccagccggcgccgctgccgaagctgtagcaggcggcgagccgcccatggtcgggcagcaggccgatggcgtggccgccgaaggagtggccgatccagtacagcggccgctcctcccggccgagcagctcgacggcggcggcgaggtcccggtaggcccagtccaggtaggacatggcgaagcccttcaggcttgccggcgcggattcgccgatgccgcgatagtccagggtgagtacgtcgaagccctggcgcgcggcgtgttcggcgaaacgccggtagaagcgctgggcgacgcccgtcgcgccggccaccagcaggttgccatgggcgtggcccggcgcgtggtagcggtaggcggacagcggatagccgtcggtcgcgggcagggccaggcgttccatccgcaccggcgctgcggaatgttgagtcaacgaagtcatgtcggtttccgcaggagagatggagcggagcgaccgggggtcgacccgcaggggagctag

SEQ ID NO: 3546 - DNA, 432 bp, Pseudomonas aeruginosa
gcggctacgaggagttgctcgaggagttcttcctctggctgcgcaaggagcatccggacgtgctggtggtcaactccgccggcaacggctcgtcctactccggtaccgacgaataccgcctgccgtcctcgttcgtcaccgagcagttgctggtggtgggcggccacgagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatga

SEQ ID NO: 3547 - DNA, 834 bp, Pseudomonas aeruginosa
agagccgcgagcgcgtgcgctgaggcgttccgccggcccggggcctcacggcgaggcttccagcagccgggcgaggcgttcggcgagttcgttgtggcggaacggcttggtcaacacctcgaagccgttgagttgctcgggcctgaggttggcgtagccggtgatgaccagcaccggcaattgcgggaagcgctggcgcagttcctcggcaagctgcacgccggtcttgtcggccatgagatggtcggtgaccagcaggtcgggcgccaggccgcgctcgacctcgcccagggcttcctccgccgacgccgcctcgctgacctggtagccgagatcgccgagcagcagcgcggtggtgtagcgcaccatcctgtcgtcgtcgaccagcagcacgtgggtcggccgcaacgcctccggtgcgtccgggcagctttctgcggtggattgcgtctgctccgcggtgatcggcagccagatgctcacccgggtccccttgccgatctccgagtggatgcccaggccgccgccggactgggcgaccaggccctggaccatcgacaggccgaggccggtgcccttgcccacgcccttggtggaaaagaacggctccatgcagcgggccagcacctcggcgggcatgcctccgccgttgtcggcgacttccaggcacacgtagcggccggcgccgagaccgtccactgcgccgtcgatcaccaggtcggtccgcgcgcctatttccaggcggccgccttcgcccatggcgtcgcgggcgttcaccgcgaggttgaggatggccagttcgaactggtgcggatccaccaccaccgcaggtag

SEQ ID NO: 3548 - DNA, 1644 bp, Pseudomonas aeruginosa
cgcgccgtcgatgaggtcggcggagcgggcgtcgtcgagccgccggcggatcagttccagcgaggccatgatcggcgtcagcaggttgttgaagtcatgggcaatgccgccggtcaactggccgaccatctccatcttgcgtgcctcgtgaagctgcgccagggcgctttcgcgctgggcgagcatggtcgcgacacgttcttccaggctttcgttgagttcgcgcagctcgttctcggcgcgtacccgcgcgctgatgtccatgcacacgcagagcaggccgctggcggcatgctgctcgtccaccagcggcgtgacctggttctgcacccacaccgtatcgccgtcggggcgaacgtatcggccgctcatctcgaacgccgcgccggtcgctccgcctggcgccgcggggagggcgaagtcggcggggtcgaggatgtcctgcatgcgcaggccgagcagggtctcgcgcgaacggccggcgatctcgcagtagcgatcgttgacccgggtgaagcgccagttccggtcgcataccgcgatgcccgcgctggcctggtcgaacatcgccgccagttgcgcggaactggtgcgcagcgccagctccgcgcgggcatgggtgagcgaggtccaggccagcttggcggcttcctccgccaggcggcgcgaatcttcgccgagcgcctgcggatgggcgaagtggatcgccagcagcgcctccagccggccgtggcgcagcaccgggacgtgcagcgtggcgcccagccccaggcgcgcgcggctcgccgcctcgtcgagactcatgccgcgctccccggcgaggtcttcccgcgccacgctgcgtccggtatgcagttcgccggacagggtggcgccgaacgccaggtagcgatgccgaccgaccgccgagcggccgtcgtggagatagtcgcgatggacctggaaggtcatgccgtcgccgttgtcctcgccgaagaatatccgcgacgcgcccagctcctcgccgagccggcgcagggcggtggcttcgatttccaggggatcggccagggacggcagggtctggcccagttccaggaggaacgcctggcggcgttcaaaacgcacccgctcggtggtctcggtgacgatgcacagcacgccgccgacggaaccgtcggtttcccgcaccgccgaataggacacgtcgaaatagaccgtctcgccgcgcccgtggcgttcgatgtagaagggccgatcctttgccgcgaaggtctcgccggtctcgtacaccccgcgcagcagcggttcgaggtcatcccacagctcccgccagttctctatcgccggccgaccgagggcgcgcggatgcttgtcgccgatgctcggcgcgtaggcatcgttgtacagggcgacgaattccgcgccccagaacagcacgatctgcgccttggccggcagcagcgtggccatcgtcgtcttcaggctcgccgaccaggcgtccggcgggccgaggggcgaaccggccgcgtcgaggctgagcaacagtttcccgaccgctcctccgttggccaggaaggccggtggatggtcgagggtgttcgggtccggttcgatggtgaaaggctgtgccatgtctgcggagtcttgctcggttccggttga

SEQ ID NO: 3549 - DNA, 1581 bp, Pseudomonas aeruginosa
gcgcgctcgatggcaaggctcggttccagcgttaccaacgaaatcaaacaggccctggcggccagccgcggcgcattgcgcagcgtggcggcgttctccggggtgatcaacctgctgatgctggtgccctcgctgtacatgctgcaggtgtacgaccgcgtgctgtcctcggccaacgaagtcaccctgttgatgctgaccctgatggcgcttggcgtgttcgtcttcatgggcgcgctggaggcgctgcgcagcttcgtcctggtgcgggtcagcgaacgcttcgacggccagttgcacgggcggatgtacgccgccgccttcgaacgcaacctgcgcgccggcggccaggaggccagccaggcgctgcacgacctgaccaccctgcgccagttcatcaccggccaggcgctgttcgctttattagacgcaccctggttcccggtctacctgctggtgatcttcctcttcgacccctggctcggcctgctctcgatggtcggcgcgctggccctgatggccctcgcctggttcaacgaacgcgccacccgtgcgccgctggccaaggccggcgagttgtcgatcaagtccggccaactggccagcaacaacctgcgcaacgccgaggtgatcgaggcgatgggcatgctcggcagcatgcgcgggcgctgggaacggctgcaccaggcgttcctcgaccagcagagcctggccagcgagcgcgcggcgcggatcaacgcgctgagcaaatacctgcgcatcgccctgcaatccctggtgctcggcctcggcgcctggctggcggtggagggacgcatcaccccggggatgatgatcgccggctcgatcctgatgggacgtgcgctggggcctatcgaccaactgatcggcgtgtggaagcagtggggcgcggcgcgcgatgcctatcgccggctgagcggcctgctcgacgaattccccgcccgcgagcggcgcatggaattgcccgagccgcatggccacctgctgctggaatcgctggacgcggcgccgcccggcagcgaggcgcgcaccctgcgtggcctgaccctggcgatcccggccggctcggtggtcggcgtgatcggtccgtccggctccggcaagtcgagcctggcgcgggtagtgctgggcatctggccgaccctgcacggcagcgtgcgcctggacggcgccgagatccgccagtacgagcgcgagaccctcggcccgcgcatcggctacctgccgcaggacatcgaactgttcgccggcacggtggcggaaaacatcgcccgcttcggcgatgtgcaggccgacaaggtggtggaggcggcgcgcctggccggggtccatgaactggtcctgcgcctgccgcatgggctacgacaccgtgctcggcgtcggcggcgccgggctttccggcggccagcgccagcgcatcgccctggcccgggcgctgtacggcgcgccgaccctggtggtgctcgacgaacccaactcgaacctcgacgacagccgggagcatgcgctgctggcggcgatccaggcgctcaaggcgcgtggctgcacggtgcctgctga

SEQ ID NO: 3550 - DNA, 1380 bp, Pseudomonas aeruginosa
  unsure (136): Identity of nucleotide at the above locations are unknown.
tctccccccggggcccgcgttgctgggttgcgccgaccgccggccggcgctgaacgccggccagttgcacctgtacggcgagcgcgaccaggtgctcgccgccttgaacaaccagcgcgccgcgtcggcgtcgcancagcgcgcggactaccgggtggccggctacggcgcgccgccaggtggtggccgcgccgcgccagggaggtgtggaatgacccgcacggtgaaacgcgacgagaacgcctatgcgcgactgggctggctgctggtcctgttcggcttcggcggcgcgctgctctgggccgccttcgcgccgctcgaccagggcgtggcggtgccggccacggtgatcatctccggccagcgcaagtcggtgcagcatccgctgggcggggtggtcaagcacatcctagtgcgcgacggccagcatgtggaggcgggcgagccgctgatccgcatggaaccgacccaggcccgggccaacgtcgattcgctgctcaaccggtacgccaacgcgcggctcaaccaggcgcgcctgcaggccgaatacgacggccggcggaccctggagatgcccgcggggctggccgagcaggccccgctgccgaccctcggcgagcgcctggagttgcagcggcagttgctgcacagccgccagaccgcgctggccaacgaactctccgcattgcgggcgaacatcgaggggctgcgcgcccagctcgaagggttgcgccagaccgagggcaaccagcgcctgcaacaacgcctgttgaacagccagttgagcggtgcgcgcgacctcgccgaggaaggctacatgccgcgcaaccagttgctcgaacaggagcgccaactggccgaggtgaacgcccggctatcggagagcagcggtcgcttcgggcagatccgccagagcatcgccgaggcgcagatgcgcatcgcccaacgcgaggaggagtaccgcaaggaagtcaacgggcaactggcggaaacccaggtcaatgcgcggacgctctgggaggagctgtcctcggcgcgctacgaactgcgccacgccgagatccgcgcgccggtcagcggctacgtggccggcttgaaggtgttcaccgatggcggggtgatcggccccggcgaattgctgatgtacatcgtgcccaacagcgacagcctggaagtggagggccagctcgcggtgaacctggtcgaccggatccacagcgggctgccggtggagatgctgttcaccgccttcaaccagagcaagaccccgcgggtcaccggcgaggtgaccatggtcagcgccgaccgcctgctcgacgagcagaacaagcagccctactacgcgctgcgcgcccaggtcgacgcggccgcgatgggtaa

SEQ ID NO: 3551 - DNA, 1698 bp, Pseudomonas aeruginosa
gctgaagggcctgcagatccgcccggggatggcggtgcaggtgttcgtccgcaccggcgagcgctcgctgctcaattacctgttcaagcccctgttcgaccgcgcccacgtggcgctggcggagaactgaccgatgaccatgcgccgcctgatgacctggctgttcggcgccttcctgttgctgctgcgcgaggacgccttcgccctcggcctgctggacggctatcacctggccctggagaacgacccgcagttccaggccgcgatccaggagcacgaggccggcaggcaataccgtgcgctcggccgcgcggcgctgctgccgcgcctggtgtacagctacaaccgtgggcgcagctggtccgatgtgacccagaccaccacccgcggcgatttcaaggaagaccgcgactacgacagctacgtctccaccctcagcctgcaacagccgttgttcgactacgaggccttcagccgctaccgcaagggcgtggcccaggcgctgctgtccgacgagcgcttccgcagccagagccaggaactgctggtccgggtcctggaagcctataccggcgcgctgctggcccaggaccagatcgaactggcgcgggcgcagaaacgctcctaccgcgagcagttccagctcaaccagcgccagttcgagcgcggcaacggcacccgcaccgacaccctggagacccaggcccgcttcaacctggcccaggcccaggaaatcgaggcgcgggacagccaggatgccgccctgcgcgagctggagcggctggtcggggcgccgctggagatcgccgacctggcgccgctcggcgaacgcttccaggtgcgcccgctgagccccgccagctacaccgcctggcgcgacctggcgctggccgagaatcccgagctggcctcgctgcgccacgcggtggacgtggcccgctacgaggtcgagcagaaccgcgccgacttcctgccgcgcctgggcctgtacgccagcaccggcaagtccaagtccggttcggagaacacctacaaccagcgctacgagaccgacagcgtcggcatccagttgagcgttccgctgttctccggcggcgagaccctggcggcgacgcgccaggccacgcatcgcatggagaagagccattacgacctggacgacaaggtccgcgagaccctcaaccaggtgcgcaagatgtacaaccagagcagcagcagcgcggcgaagatccgcgcctacgagatgaccgtggattcggcgcggacgctggtgatggccacgcgcaagagcatcgccgccggggtgcgggtcaacctcgacctgctgaacgccgagcaggcgctgtacagcgcgatgaacgagctgtccaaggccaagtacgactacctcacggcctgggcacgcctgcgtttctacgccggggtgctggacgaagccgacctggaactggtggcggcgaacttcgtttccggcgagacgccggcgcgccgccgcgactgcgcgacgacggattgcccggcgccgctgcacaccctgtcgaagaccgatacggaggaaaaccggagcgcgctccattgagaccgcgaaggacgtgcaggcaattgttcgcctggcgtgaagtcgatgtcccgggcgggtcgacagaggtcgaacaatacgcatggaattgtttttccaataaggcgctatttatatga

SEQ ID NO: 3552 - DNA, 1173 bp, Pseudomonas aeruginosa
tgctcctcggtcgccagggcgagggcgactaccgggtgcagaagggcgacggcgggcagttggtgctgcgccgcgcgacgccctagctcgcttgcgggtcagaccacgaagcgaccgatcatgcccttgaggtcgttggccaggcgcgacagctcgtggctggcgccgcgggtctgctcggcgccctgggtggtctgcacggcaacgtcgcggatgttcaccaggttgcgatcgacctcgcgggcgacgtgggcctgctcctcggcagcgctggcgatcaccagggtgcgctcgttgatccgcgtggcgtgctcggcgatctcgcccagggcgtggtcggcggcctcggcctcgtcgagcatctgccgggcgcgctggtcgttctcgcgcatcgcggacaccgcggtgtcggtgccctcgcggacgctggcgatcatgccttcgatctcatgggtcgattgctgggtgcggtgggcgagggcgcgcacttcgtcggcgaccaccgcgaatccgcggccctgctcgccggcgcgggcggcctcgatggcggcattgagggcgaggaggttggtctgctcggcgatggcgcggatcacgtcgagcaccttgccgatgtcctgcgcctggctggccaggccttccaccaggcgcgcggtctggccgatctcggcgttcatctggcggatcgagcggacggtctgtccgacccgtgcgcggccgttgccggcggcccgttccgagagactggaggcctcggcggtggagctggcgttgcgcgcgacctcctcgaccgccgcgctcatttcgttgaccgcggtggcggccatctcgatctcatcgttctgccgggccagcgaccggttgccttcctcggtcaccgcgttcagttgctcggcagcggcggccagcagcgcggcggaatcgccgatctgctcgatggtgtcgtgcaggctggcctgcatgctgcgcatggccttcatcagttgcgccggctcgtcgtcgccgtcgctggcgatctcgccggtcaggtcgcgggccgcgatgcggtcggcgcaggacaccgcctggcggatcggcacgacgatgctgcgggtcagcagccaggcgatcgtcacgctggccgccagggccaccagcagcaccgcgaggatcgcggtggaggcccgggagtag

SEQ ID NO: 3553 - DNA, 651 bp, Pseudomonas aeruginosa
aaactaaacaaacattcggtaaccgtcaaattgaggcgccaaggcttatggcatagaatcaacgcctttgatcgagagcaggaaccttccgtgcgtccgttgaaaatctcccgcgacgagcttctccagcgctgcgccggcaccttccgtcgctacggctaccacggcaccaccatggacatgctgtccagcgcctgcggcttgaccaaggcctcgttctaccaccattacccgaacaaggaagccttgctccgcgacgttctcgaatggacccaccagcggctcgccgagacgctcttcagcatcgcctacgacccgctgctgacgccccgcgagcgcctggaaaaactcggccgcaaggccgcccggttgttccaggacgacagcatcggctgcctgatgggcgtggtcgcggtcgacgccagctatggtcgcagcgagctgatggcgccgatccgcagtttcctcgacgactgggcgcaagccttcgcccagctctaccgcccggccttcgacgaggcgcaggcgctggagcgcggccggcaactggtggctgatttcgaaggcgccatcctgctggcgcgcatctatggcgagccgggctatatcgatggcgtcacccggcgagcgctggagcaactggcgggctag

SEQ ID NO: 3554 - DNA, 1443 bp, Pseudomonas aeruginosa
atatggcgcgcgggtggtcggcgcgatcccgccgttgaacctctaccagttgcgcctgccggcgcgcgacctcgtccagcgcgacgcgctggtcctccgcatcggcagcgagaccagcgtggacgccgtggtggtggaggagtccgcgccggagcagggcgaggaaaccgaggcggcgcgccggcccgtggacaagccggacagcgactccgacgagtgggcggccaatcgtttcatggacgcggtgaactattaccagcgtcgggtccgcgcccgccaggccccgctggagacccgcccggtgcgcatcggggtgatcgagcgcgacgtcgacttcgacgcccccgacttcgccgactacctcggtccctgcaaggcgcccgcgccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattccgacgctggcatcacggccaacgtcgccgcttcggtgaacctggtggaggatggcgtgcgggtgctcaactggagctggggcatccaccgcgtcggcgctcgcgacgtcgacggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctcgttcgtcaccgagcagttgctggtggtgggcggccacgagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgctgaggcgttccgccggcccggggcctcacggcgaggcttccagcagccgggcgaggcgttcggcgagttcgttgtggcggaacggcttggtcaacacctcgaagccgttgagttgctcgggcctgaggttggcgtag

SEQ ID NO: 3555 - DNA, 483 bp, Pseudomonas aeruginosa
cggccggcgccgagaccgtccactgcgccgtcgatcaccaggtcggtccgcgcgcctatttccaggcggccgccttcgcccatggcgtcgcgggcgttcaccgcgaggttgaggatggccagttcgaactggtgcggatccaccaccaccgcaggtaggcgttccgggatctcgatgcggacctcgatggtcgggccgagcgagcgctcgatcaggtcgtgcatgccttcgaccagctcgcgcagggccaccgcctgcggtttgagggtttgccggcgggcgaaggtgagcaggcgaccgacgagattccgcgcccgttcggcggactgtagcgcgccgtcgatgaggtcggcggagcgggcgtcgtcgagccgccggcggatcagttccagcgaggccatgatcggcgtcagcaggttgttgaagtcatgggcaatgccgccggtcaactggccgaccatctccatcttgcgtgcctcgtga

SEQ ID NO: 3556 - DNA, 1317 bp, Pseudomonas aeruginosa
ccggttcggtcggtaaacagcgacctgcgccggaaacgcgataaccgagacaactcaatcgaggaacagaagatgggattattcaatgcagccgcgaacctgttcggccaggtctacgagcgtgcgacgcaggtggccgccaccgccgtcacggcggtggcggacgtggccaggacattggtgggctccaccgtcgacgccgtggagcagcaggtgcacgaagcgcttacatcggtgcatgacgccgttgccagcgtggagcaggcgctggagggtacggtcggcgcggtggccggcacgctcggcgagatcgccggcgacgccctcgacaccgtaggctccgcggtcggcacgctgggcgggctggccggcaactcgctggcgatcgccgacgacttgttgcacgggcgcgtcgagccggaggattacctgaagctggtcggtgacctggggcagggcgtcggtgccaccgtcggccatgcctgggaattcggcagcgacagcctgaaggccgccaacgatctctaccacgccgcctaccagggtggctcgctaagcctcggcaatagcgacggcctgctcggggtcaatgtgatcggctcgctgctcggcggcaatcacgaccagggcgtgattcccgatagccgcggcatcctcggcccgctgccgatcaacgtctccttcaccgagcaaggcctgaccttcggcggcgagacgccgctgactccgctggtcaccgcagccctggcgctgaatccgatcaccgcgccgctggtgccggtgctggcgccgctcaacctcggcggcctgggagtggtcggctcggtcgacaaggaaggcttcagcgccaagttctacggtatcgccggacccagctacaacctcggcgtggccaatctcggcggcaccctggagctgggtagctacaacgaggtcaagctgctgagctggaacgaggtgaccctcaaggacctgcccatcgtcggcggcatcctcggctacgtgccggtggtcaaggacatcggtgtctcgctgccgacgctggacctgcacttcgacagcaagctgtatgcgcaaacgattgccggtgtcgatgtcgccggggtcgggccgaagggccagatcgagctggtgcatgacctcgacaatgacctgtcgatcgtcgccggtatcgccggggataccgcgcacagcgcactggacggggccggcaaggtgctcgcggcgctgctcggccacggcggcgaagcggcgccgccgacaatccagctgatcggcgccgacccggcgccggagcatcaggccctggccgcctga

SEQ ID NO: 3557 - DNA, 1947 bp, Pseudomonas aeruginosa
  unsure (573): Identity of nucleotide at the above locations are unknown.
tgctgggcatctggccgaccctgcacggcagcgtgcgcctggacggcgccgagatccgccagtacgagcgcgagaccctcggcccgcgcatcggctacctgccgcaggacatcgaactgttcgccggcacggtggcggaaaacatcgcccgcttcggcgatgtgcaggccgacaaggtggtggaggcggcgcgcctggccggggtccatgaactggtcctgcgcctgccgcatgggctacgacaccgtgctcggcgtcggcggcgccgggctttccggcggccagcgccagcgcatcgccctggcccgggcgctgtacggcgcgccgaccctggtggtgctcgacgaacccaactcgaacctcgacgacagccgggagcatgcgctgctggcggcgatccaggcgctcaaggcgcgtggctgcacggtgcctgctgatctccccccggggcccgcgttgctgggttgcgccgaccgccggccggcgctgaacgccggccagttgcacctgtacggcgagcgcgaccaggtgctcgccgccttgaacaaccagcgcgccgcgtcggcgtcgcancagcgcgcggactaccgggtggccggctacggcgcgccgccaggtggtggccgcgccgcgccagggaggtgtggaatgacccgcacggtgaaacgcgacgagaacgcctatgcgcgactgggctggctgctggtcctgttcggcttcggcggcgcgctgctctgggccgccttcgcgccgctcgaccagggcgtggcggtgccggccacggtgatcatctccggccagcgcaagtcggtgcagcatccgctgggcggggtggtcaagcacatcctagtgcgcgacggccagcatgtggaggcgggcgagccgctgatccgcatggaaccgacccaggcccgggccaacgtcgattcgctgctcaaccggtacgccaacgcgcggctcaaccaggcgcgcctgcaggccgaatacgacggccggcggaccctggagatgcccgcggggctggccgagcaggccccgctgccgaccctcggcgagcgcctggagttgcagcggcagttgctgcacagccgccagaccgcgctggccaacgaactctccgcattgcgggcgaacatcgaggggctgcgcgcccagctcgaagggttgcgccagaccgagggcaaccagcgcctgcaacaacgcctgttgaacagccagttgagcggtgcgcgcgacctcgccgaggaaggctacatgccgcgcaaccagttgctcgaacaggagcgccaactggccgaggtgaacgcccggctatcggagagcagcggtcgcttcgggcagatccgccagagcatcgccgaggcgcagatgcgcatcgcccaacgcgaggaggagtaccgcaaggaagtcaacgggcaactggcggaaacccaggtcaatgcgcggacgctctgggaggagctgtcctcggcgcgctacgaactgcgccacgccgagatccgcgcgccggtcagcggctacgtggccggcttgaaggtgttcaccgatggcggggtgatcggccccggcgaattgctgatgtacatcgtgcccaacagcgacagcctggaagtggagggccagctcgcggtgaacctggtcgaccggatccacagcgggctgccggtggagatgctgttcaccgccttcaaccagagcaagaccccgcgggtcaccggcgaggtgaccatggtcagcgccgaccgcctgctcgacgagcagaacaagcagccctactacgcgctgcgcgcccaggtcgacgcggccgcgatgggtaagctgaagggcctgcagatccgcccggggatggcggtgcaggtgttcgtccgcaccggcgagcgctcgctgctcaattacctgttcaagcccctgttcgaccgcgcccacgtggcgctggcggagaactga

SEQ ID NO: 3558 - DNA, 1449 bp, Pseudomonas aeruginosa
ccgatgaccatgcgccgcctgatgacctggctgttcggcgccttcctgttgctgctgcgcgaggacgccttcgccctcggcctgctggacggctatcacctggccctggagaacgacccgcagttccaggccgcgatccaggagcacgaggccggcaggcaataccgtgcgctcggccgcgcggcgctgctgccgcgcctggtgtacagctacaaccgtgggcgcagctggtccgatgtgacccagaccaccacccgcggcgatttcaaggaagaccgcgactacgacagctacgtctccaccctcagcctgcaacagccgttgttcgactacgaggccttcagccgctaccgcaagggcgtggcccaggcgctgctgtccgacgagcgcttccgcagccagagccaggaactgctggtccgggtcctggaagcctataccggcgcgctgctggcccaggaccagatcgaactggcgcgggcgcagaaacgctcctaccgcgagcagttccagctcaaccagcgccagttcgagcgcggcaacggcacccgcaccgacaccctggagacccaggcccgcttcaacctggcccaggcccaggaaatcgaggcgcgggacagccaggatgccgccctgcgcgagctggagcggctggtcggggcgccgctggagatcgccgacctggcgccgctcggcgaacgcttccaggtgcgcccgctgagccccgccagctacaccgcctggcgcgacctggcgctggccgagaatcccgagctggcctcgctgcgccacgcggtggacgtggcccgctacgaggtcgagcagaaccgcgccgacttcctgccgcgcctgggcctgtacgccagcaccggcaagtccaagtccggttcggagaacacctacaaccagcgctacgagaccgacagcgtcggcatccagttgagcgttccgctgttctccggcggcgagaccctggcggcgacgcgccaggccacgcatcgcatggagaagagccattacgacctggacgacaaggtccgcgagaccctcaaccaggtgcgcaagatgtacaaccagagcagcagcagcgcggcgaagatccgcgcctacgagatgaccgtggattcggcgcggacgctggtgatggccacgcgcaagagcatcgccgccggggtgcgggtcaacctcgacctgctgaacgccgagcaggcgctgtacagcgcgatgaacgagctgtccaaggccaagtacgactacctcacggcctgggcacgcctgcgtttctacgccggggtgctggacgaagccgacctggaactggtggcggcgaacttcgtttccggcgagacgccggcgcgccgccgcgactgcgcgacgacggattgcccggcgccgctgcacaccctgtcgaagaccgatacggaggaaaaccggagcgcgctccattga

SEQ ID NO: 3559 - DNA, 411 bp, Pseudomonas aeruginosa
cgacctgttgatcggcaacgacgtggccaacgtgctcaagggcggcgccggcaacgacatcctctacggcggcctcggcgcggaccagttgtggggcggcgcgggggccgacaccttcgtctacggcgatatcgccgagtcctccgcggcggcgccggataccctgcgcgacttcgtcagcggccaggacaagatcgacctgtccgggctggatgccttcgtcaacggcgggctggtgctgcaatacgtcgacgccttcgccggcaaggccggccaggcgatcctgtcctacgacgcggcgagcaaggccggcagcctggcgatcgacttcagcggggacgcccatgccgatttcgcgatcaatctgatcggccaggcgacccaggccgacatcgtcgtctgacgcgctga

SEQ ID NO: 3560 - DNA, 417 bp, Pseudomonas aeruginosa
ccgcggtggcggccatctcgatctcatcgttctgccgggccagcgaccggttgccttcctcggtcaccgcgttcagttgctcggcagcggcggccagcagcgcggcggaatcgccgatctgctcgatggtgtcgtgcaggctggcctgcatgctgcgcatggccttcatcagttgcgccggctcgtcgtcgccgtcgctggcgatctcgccggtcaggtcgcgggccgcgatgcggtcggcgcaggacaccgcctggcggatcggcacgacgatgctgcgggtcagcagccaggcgatcgtcacgctggccgccagggccaccagcagcaccgcgaggatcgcggtggaggcccgggagtagacatcggcggcttcggcggtggaggcgcgggcggcctcgcggtcgagggcgatga

SEQ ID NO: 3561 - DNA, 1065 bp, Pseudomonas aeruginosa
ggtcaagagaaggctgtcgcggcaggccaccctagggattggtcgaacaaggagaagcccgtgatccgaatgacgctggacgaggtccgcgagctggccgtgcgcatcctgcgccggcacgctttcagcgaagcccatgtacaggcggtggccgataccctggtggcgggggagcgtgacgaatgcgcgtcccacggtatctggcggttgctcggctgcatcgccaccctgaaggccggcaaggtatccgccgacgccgagccggaactgcacgacatcgctcccggcctgctgcgggtcgacgcccatggcgggttctcccagtgcgcattccggctggggctgccgcatctgctggagaaggcccgcagccagggtatcgcggcgatggcggtaaaccgctgtgtgcatttctccgcgctatgggttgaggtcgaggcactcaccgaggcgggcctggtggccctggcgaccacgccgagtcatgcctgggtggcgccggcgggcggacgcaagccgatcttcggcaccaacccgatcgcctttggctggccgcgtccggacggcccgccgttcgtcttcgacttcgccaccagcgccgtggcgcgtggcgagatccagttgcacgaacgcgccggcaagccaatcccgctgggctggggggtggacgagcagggcgagccgaccaccgatgccagcgccgcgttgcgaggcgccatgctcactttcggcgggcacaagggctcggccctggcggcgatggtcgaactgctcgccggtccgctgatcggcgacctgaccagtgccgagtcgctggcctacgacgagggcacccgttcttctccctacggtggcgaactgctgatcgccatcgatccgcggcgcatgctcggcgcctcggcggaggagcacctggcgcgcgccgagacgctgttcgaaggcatcgtcgaacagggcgcgcgcttgccctcgcagcgacgcttcgaagcgcgcgaacgcagcgccagggacggtgtgacgattcccgaggcgttgcaccgggagctgctggcgttgctggagtga

SEQ ID NO: 3562 - DNA, 1746 bp, Pseudomonas aeruginosa
cagctcggcttcggccagcgcgcgccgggcgtcggcggcggcgaccgggcgttcgcccgcgcggacgtccgggcggcgcgccagcaggctccacctgtcgccggtgggcagggcacggcgcagttgcggtatgccggcgcaggtcgcggcaggagcgtccaactggcgcggcgagcgcccgctgagcagcgccagttcgtagagtgccgcgcgccgccgcgcctcgagcatcggcagcgcggcgcgggtccgctcgcgcaaggccagcagccggcgtcgctgcagctcgctggaaaggccggcggcgagctggcgttcgctcagcgccaggctcgcgtcgagcagaccgaccgatcggcgttgtacctctgcccgtcgcgccagggcgcaggcgcggacgtaggcgagggtggtctggctggccacgctgaccctgagcaggtcgcgcgccgcttgcgccgcttcggcatccgccttcgccgcggcgatgcgggcgcggacttcgccccacaggtccaactggtaggacaggtcgaggcggacggtgtgtttccactggctgtgcaggtcctcgtcggtggcttcggcgagggtctggtcgtcgccgtcgcgcccatactggtagccatagccgacctcggtccgtggccagcgttcgccctgtgcgccgcgcagatggccgaggagcgcgcgggcatgggcatcggctgcggccaggtcgcggttgtggcgcagcgcggcggccaccaggtggttcagcccagggtcctggtagagcgtccaccactgggcgggcagcgcgtcgccgcgggttcccgccaccctcgacaggccagggtcgaggctttccgcgcgtggcgcgggttggttgcggttcgcgcagcccagcgcggtggagatccccagcgccagcgccacgcaacgcagatgactggcaagcggcattgccttgctcccgtgtctgaaagagcggggaacggtaaggcaggcgcaggcggcctgcgccggcaaaagcgccagtcatcgtcgcgaaatggacagtcggcggatttttcagcgttgccgcatcaggtacgggccgcagccctgggccagcagcccggccgggatggccagcagggagatgcggtggatctgccgggagcagcggttcatcccggcaaagctgtcggccttggtggcggtctcccggcgaaaccccggtcgcggctttcggcgcggctgcgttcgagaaggaactccacggcgaccacgcccagccagaatgcgacggcgaacaggcgaagggacaacggcaacgggtgcatggcgcgctctcgctggtctttcaggcgttctccggatgccgtctcagccagcgcagggcgtcgtcccacagcgcctctgcaccggcgcggaagtagcccatgtgtccgagcggtccaccgtcgggtcgcaggtcgagggtttccagcggtgcgttgcggtaggcctcgacgaaggcgtcccgcgagcgcggcggtgcccagggatcgtccagggcggtggcgaacagacagggcgtgcgcactgcggcgtagcgctggtggaggtggcgcatcgccgggtcgtcgaaatagtagcggggatggcggcaccagcgcttccagtcgcggtagacccccagcggcaggtcgtcgcccatgcccagcaggctccaggccatgtagccttttccaggccaccagcggcggcagcaccagggtccacaggcatggcgcaccttga

SEQ ID NO: 3563 - DNA, 1830 bp, Pseudomonas aeruginosa
acgaagcgtttcgccaggcggtcggaacaacaggtccccgttccggaagccgagtccatgccgctgcgccgtgccgttttcgccatccttttcgcgtccctgggcagtcctttggtagccgccgaaacacccctgcgcctggagcgcctggagcgctgcggcgatctcctggccagcgagcggcaggagtggtgcctgcgcgtgcgcggcctgggctccggcctgccgcgcctgttgctggacggccgcgaactgccggccaccgccctgcggcgcgagggcgacggcctgcggctccgcctggaccgccgtggccacgccagcggtccgctttggctggagcagggcgggcgcagcagcaatccggtatggctgaccctgaacggcagccatgtgctcgccgccggtcccgacgaggtggcgaagaacatggatggcctgaccacctacgtcgacctggtcagcctgttgatcgaggagaaccacgacggtcgccgggaggccgaacgcctggccgataaatatggcgcgcgggtggtcggcgcgatcccgccgttgaacctctaccagttgcgcctgccggcgcgcgacctcgtccagcgcgacgcgctggtcctccgcatcggcagcgagaccagcgtggacgccgtggtggtggaggagtccgcgccggagcagggcgaggaaaccgaggcggcgcgccggcccgtggacaagccggacagcgactccgacgagtgggcggccaatcgtttcatggacgcggtgaactattaccagcgtcgggtccgcgcccgccaggccccgctggagacccgcccggtgcgcatcggggtgatcgagcgcgacgtcgacttcgacgcccccgacttcgccgactacctcggtccctgcaaggcgcccgcgccgcgtacctgcctctacgcgcgcgatgccgaacgtcccgacaaccacggttcgacggtcgccggcatcctcgccgcgcgctgggaccagggcggcaacagtggcttcctgcgtgggctggaccgcgccagccagggtttcgaagtgatcgtcgagcgcaattccgacgctggcatcacggccaacgtcgccgcttcggtgaacctggtggaggatggcgtgcgggtgctcaactggagctggggcatccaccgcgtcggcgctcgcgacgtcgacggcgacgaggtggattcgctggtgcgctcggggattgccatgagcggctacgaggagttgctcgaggagttcttcctctggctgcgcaaggagcatccggacgtgctggtggtcaactccgccggcaacggctcgtcctactccggtaccgacgaataccgcctgccgtcctcgttcgtcaccgagcagttgctggtggtgggcggccacgagcgcagcgagcgccaaggcctggcggtggacgacccggcctacgcggtcaagcgcagcacctcgaacgtcgacatgcgggtggatgtcaccgccgccgcctgtacccatgcctcgaccctggagcgggacgcgcggggcgaggtgcactgcggcacctcctatgccacgccgatggtcgccggcacggtcgccgccatgctttccctcaacccgcggctgcgacccgaggagatccgcatgctgctccggcgcagcgccatgaccatcggcggcgactacgatttcgagccggccgatgccgaggacctcaccgcaccgatcctgccctcggagcgcggctaccgcctggaccaccgcgacgtcggccgctcggcgcggctggacatgcagaaagccctggacctggcggtgaagagccgcgagcgcgtgcgctga

SEQ ID NO: 3564 - DNA, 504 bp, Pseudomonas aeruginosa
gcgaggtccaggccagcttggcggcttcctccgccaggcggcgcgaatcttcgccgagcgcctgcggatgggcgaagtggatcgccagcagcgcctccagccggccgtggcgcagcaccgggacgtgcagcgtggcgcccagccccaggcgcgcgcggctcgccgcctcgtcgagactcatgccgcgctccccggcgaggtcttcccgcgccacgctgcgtccggtatgcagttcgccggacagggtggcgccgaacgccaggtagcgatgccgaccgaccgccgagcggccgtcgtggagatagtcgcgatggacctggaaggtcatgccgtcgccgttgtcctcgccgaagaatatccgcgacgcgcccagctcctcgccgagccggcgcagggcggtggcttcgatttccaggggatcggccagggacggcagggtctggcccagttccaggaggaacgcctggcggcgttcaaaacgcacccgctcggtggtctcggtga

SEQ ID NO: 3565 - DNA, 1476 bp, Pseudomonas aeruginosa
tcggcgccgacccggcgccggagcatcaggccctggccgcctgacggcgagggaacgcccggcacagggaggtgccatccgggctcattcgggattccagcggcagtcgtggcagaagtgagcgcgctcgatggcaaggctcggttccagcgttaccaacgaaatcaaacaggccctggcggccagccgcggcgcattgcgcagcgtggcggcgttctccggggtgatcaacctgctgatgctggtgccctcgctgtacatgctgcaggtgtacgaccgcgtgctgtcctcggccaacgaagtcaccctgttgatgctgaccctgatggcgcttggcgtgttcgtcttcatgggcgcgctggaggcgctgcgcagcttcgtcctggtgcgggtcagcgaacgcttcgacggccagttgcacgggcggatgtacgccgccgccttcgaacgcaacctgcgcgccggcggccaggaggccagccaggcgctgcacgacctgaccaccctgcgccagttcatcaccggccaggcgctgttcgctttattagacgcaccctggttcccggtctacctgctggtgatcttcctcttcgacccctggctcggcctgctctcgatggtcggcgcgctggccctgatggccctcgcctggttcaacgaacgcgccacccgtgcgccgctggccaaggccggcgagttgtcgatcaagtccggccaactggccagcaacaacctgcgcaacgccgaggtgatcgaggcgatgggcatgctcggcagcatgcgcgggcgctgggaacggctgcaccaggcgttcctcgaccagcagagcctggccagcgagcgcgcggcgcggatcaacgcgctgagcaaatacctgcgcatcgccctgcaatccctggtgctcggcctcggcgcctggctggcggtggagggacgcatcaccccggggatgatgatcgccggctcgatcctgatgggacgtgcgctggggcctatcgaccaactgatcggcgtgtggaagcagtggggcgcggcgcgcgatgcctatcgccggctgagcggcctgctcgacgaattccccgcccgcgagcggcgcatggaattgcccgagccgcatggccacctgctgctggaatcgctggacgcggcgccgcccggcagcgaggcgcgcaccctgcgtggcctgaccctggcgatcccggccggctcggtggtcggcgtgatcggtccgtccggctccggcaagtcgagcctggcgcgggtagtgctgggcatctggccgaccctgcacggcagcgtgcgcctggacggcgccgagatccgccagtacgagcgcgagaccctcggcccgcgcatcggctacctgccgcaggacatcgaactgttcgccggcacggtggcggaaaacatcgcccgcttcggcgatgtgcaggccgacaaggtggtggaggcggcgcgcctggccggggtccatga

SEQ ID NO: 3566 - DNA, 321 bp, Pseudomonas aeruginosa
tccgcatggaaccgacccaggcccgggccaacgtcgattcgctgctcaaccggtacgccaacgcgcggctcaaccaggcgcgcctgcaggccgaatacgacggccggcggaccctggagatgcccgcggggctggccgagcaggccccgctgccgaccctcggcgagcgcctggagttgcagcggcagttgctgcacagccgccagaccgcgctggccaacgaactctccgcattgcgggcgaacatcgaggggctgcgcgcccagctcgaagggttgcgccagaccgagggcaaccagcgcctgcaacaacgcctgttga

SEQ ID NO: 3567 - DNA, 480 bp, Pseudomonas aeruginosa
cccagaccaccacccgcggcgatttcaaggaagaccgcgactacgacagctacgtctccaccctcagcctgcaacagccgttgttcgactacgaggccttcagccgctaccgcaagggcgtggcccaggcgctgctgtccgacgagcgcttccgcagccagagccaggaactgctggtccgggtcctggaagcctataccggcgcgctgctggcccaggaccagatcgaactggcgcgggcgcagaaacgctcctaccgcgagcagttccagctcaaccagcgccagttcgagcgcggcaacggcacccgcaccgacaccctggagacccaggcccgcttcaacctggcccaggcccaggaaatcgaggcgcgggacagccaggatgccgccctgcgcgagctggagcggctggtcggggcgccgctggagatcgccgacctggcgccgctcggcgaacgcttccaggtgcgcccgctga

SEQ ID NO: 3568 - DNA, 1452 bp, Pseudomonas aeruginosa
agggatatgacaatgtccagcaattctcttgcattgaaaggtcgtagcgatgcgtatacccaggtagacaacttcctgcatgcctatgcgcggggtggggacgaattggtcaatggccatccgtcctataccgtcgaccaggcggcggagcagatcctccgcgaacaggcgtcttggcagaaagcgccgggcgactcggtgctgaccctgtcctattcgttcctgaccaaaccgaacgacttcttcaatacgccgtggaagtatgtcagcgatatctactcgctgggcaagttcagcgccttctccgcgcagcagcaggcccaggccaagttgtcgctgcaatcctggtcggacgtcaccaatatccacttcgtcgacgccggccagggcgaccagggcgacctgaccttcggcaacttcagcagtagtgtcggcggtgcggcgttcgccttcctgccggatgtaccggatgcgctcaaggggcaatcctggtacctgatcaacagcagctacagcgccaacgtcaatccggccaacggcaactacggacgccagaccctgacccacgagatcggccataccctgggcctgagccaccccggcgactacaacgccggcgagggcgatcccacctacgccgacgctacctacgccgaggacacccgcgcctattcggtgatgagctactgggaagagcagaacaccggccaggacttcaagggcgcctattcctcggcaccgctgctggacgacatcgcggcgatccagaagctctacggggccaacctgaccacccgcaccggcgacacggtgtacggcttcaactccaacaccgagcgcgacttctacagcgccacctcgtccagttccaagctggtgttctcggtgtgggacgccggcggcaacgacaccctggacttctccggcttcagccagaaccagaagatcaacctcaacgagaaggcgctgtccgatgtcggcgggttgaagggtaatgtgtcgatcgctgccggggtcaccgtggaaaacgccatcggcggctcgggtagcgacctgttgatcggcaacgacgtggccaacgtgctcaagggcggcgccggcaacgacatcctctacggcggcctcggcgcggaccagttgtggggcggcgcgggggccgacaccttcgtctacggcgatatcgccgagtcctccgcggcggcgccggataccctgcgcgacttcgtcagcggccaggacaagatcgacctgtccgggctggatgccttcgtcaacggcgggctggtgctgcaatacgtcgacgccttcgccggcaaggccggccaggcgatcctgtcctacgacgcggcgagcaaggccggcagcctggcgatcgacttcagcggggacgcccatgccgatttcgcgatcaatctgatcggccaggcgacccaggccgacatcgtcgtctga

SEQ ID NO: 3569 - DNA, 642 bp, Pseudomonas aeruginosa
cgcgctgaagcgggcgcggttcggtgcggcggtacgaaccgcggcccttcggccggccgggcactgttcgaattgataggtgtcttccacaggagcgaagttgtgaactgtggcgcgcccgtgggccggcggcctggcggacgaacggaggcccgcggcgcctggcgcgcgctggcgttcgaagcgaggatggcgggcggcgttcgccgtgttatccgatgttccaggcttgaaggagatctctcgatgtcggcaagcgcgaagctctccaggatggtttgcttgctctgcggttttttcagcacaggtatcagtatggccagcagtctgattcttctcagcgcttccgatctcgccgggcaatggaccctgcagcaggacgaggcgcccgcgatctgccacctggagctgcgcgatagcgaagtggcggaagccagtggctacgacctgggcggcgataccgcctgcctcacgcgctggctgcccagcgagccgcgcgcctggaggcctaccccggccgggatcgcgctgctcgaacgcggcggcctgaccctgatgctcctcggtcgccagggcgagggcgactaccgggtgcagaagggcgacggcgggcagttggtgctgcgccgcgcgacgccctag

SEQ ID NO: 3570 - DNA, 1683 bp, Pseudomonas aeruginosa
ctcgcttgcgggtcagaccacgaagcgaccgatcatgcccttgaggtcgttggccaggcgcgacagctcgtggctggcgccgcgggtctgctcggcgccctgggtggtctgcacggcaacgtcgcggatgttcaccaggttgcgatcgacctcgcgggcgacgtgggcctgctcctcggcagcgctggcgatcaccagggtgcgctcgttgatccgcgtggcgtgctcggcgatctcgcccagggcgtggtcggcggcctcggcctcgtcgagcatctgccgggcgcgctggtcgttctcgcgcatcgcggacaccgcggtgtcggtgccctcgcggacgctggcgatcatgccttcgatctcatgggtcgattgctgggtgcggtgggcgagggcgcgcacttcgtcggcgaccaccgcgaatccgcggccctgctcgccggcgcgggcggcctcgatggcggcattgagggcgaggaggttggtctgctcggcgatggcgcggatcacgtcgagcaccttgccgatgtcctgcgcctggctggccaggccttccaccaggcgcgcggtctggccgatctcggcgttcatctggcggatcgagcggacggtctgtccgacccgtgcgcggccgttgccggcggcccgttccgagagactggaggcctcggcggtggagctggcgttgcgcgcgacctcctcgaccgccgcgctcatttcgttgaccgcggtggcggccatctcgatctcatcgttctgccgggccagcgaccggttgccttcctcggtcaccgcgttcagttgctcggcagcggcggccagcagcgcggcggaatcgccgatctgctcgatggtgtcgtgcaggctggcctgcatgctgcgcatggccttcatcagttgcgccggctcgtcgtcgccgtcgctggcgatctcgccggtcaggtcgcgggccgcgatgcggtcggcgcaggacaccgcctggcggatcggcacgacgatgctgcgggtcagcagccaggcgatcgtcacgctggccgccagggccaccagcagcaccgcgaggatcgcggtggaggcccgggagtagacatcggcggcttcggcggtggaggcgcgggcggcctcgcggtcgagggcgatgagttgcttcagggtccgctgcacctgctcgtagcgctgcaactgggccctgcccatcagcacgctggcttcgtcggtacggttgtcacgggacagcgcgagcagggcggcgtgtccttcgaggtactcctgctggcgctggacgaactggtcgagcaacgcgcgctcctcgtccaggaccagcaaggggcggtattccctttccaccctggcgagggtagcgatgacctcgtccatccgttgttcctgctggcgcatgcgcgtggcgtcgtgcagcagcacgtggttcatctcgccgaggcgcagttcgctcatcaggccgctgagctgggccgaggcttcgacgctgggcagccagacctcgccgatatccttggcggcgcggttcagcgaacccatgcggttgtgcgcgaagaggccgagcgccaccagcagcgaggcgaggatggcgaagccgatgacggcgcgtggggtgatggcgatacgacgaagaagcatggggtggtctccgaccgggctgtgggaaggtgcttggtcctgtag

SEQ ID NO: 3571 - DNA, 408 bp, Pseudomonas aeruginosa
  unsure (200),(340),(355): Identity of nucleotide at the above locations are unknown.
ctaaaaaaaatttccgctccaccaacccaagcacaggagagaagcatcatgagcgaagccaacagcggcccgggccgcgtcacccgagagcagcgcggtcatctgtttctcatcggcctggaacgcgcgggcgagcgcaacgccttcgacagcgcaatgctggcggaactggcgctggccatgggtgaataccaacgccncaagaatcccgctgtgccgtgctcctccccatggggagcaattcaccccccgggtcgaactgatggaactggcaccaaaaccccccccagccgttttccctatccggacgggggggttcaatccctggggctttgttcanccgccttcgaaccanccccttggtggtccccggtgcacggcaaccccctggaaaccccggggatataa

SEQ ID NO: 3572 - DNA, 204 bp, Pseudomonas aeruginosa
  unsure (132),(153): Identity of nucleotide at the above locations are unknown.
aaactaaacaaacattcggtaaccgtcaaattgaggcgccaaggcttatggcatagaatcaacgcctttgatcgagagcaggaaccttccgtgcgtccgttgaaaatctcccgcgacgagtttctccagcgntgcgccggcaccttccgtcgntacggtaccacggcaccaccatggacatgctgtccagcgcctgcggcttga

SEQ ID NO: 3573 - DNA, 579 bp, Pseudomonas aeruginosa
  unsure (61),(82): Identity of nucleotide at the above locations are unknown.
tcgagagcaggaaccttccgtgcgtccgttgaaaatctcccgcgacgagtttctccagcgntgcgccggcaccttccgtcgntacggtaccacggcaccaccatggacatgctgtccagcgcctgcggcttgaccaaggcctcgttctaccaccattacccgaacaaggaagccttgctccgcgacgttctcgaatggacccaccagcggctcgccgagacgctcttcagcatcgcctacgacccgctgctgacgccccgcgagcgcctggaaaaattcggccgcaaggccgcccggttgttccaggacgacagcatcggctgcctgatgggcgtggtcgcggtcgacgccagctatggtcgcagcgagctgatggcgccgatccgcagtttcctcgacgactgggcgcaagccttcgcccagttctaccgcccggccttcgacgaggcgcaggcgctggagcgcggccggcaactggtggctgatttcgaaggcgccatcctgctggcgcgcatctatggcgagccgggctatatcgatggcgtcacccggcgagcgctggagcaactggcgggatag

SEQ ID NO: 3574 - DNA, 1056 bp, Pseudomonas aeruginosa
accagtaccatgtaccgttgcatcgcccggctgttgaacagcagccaggcacaggcgccgccgccgagcgccaccaggcccgacgtctcgccgcatggccacgcgcagcaccggcaggtcggccaacttcagcatggccttgatctcgcgttccttggcgccatcgaacaccggggtcgccatcggtacgccaccgcgcaagttcttggccagcgcgaggatctcgttgtcgcccagctcgtcgaggttttcctcacgaccgccgatctcgttgtagatctcgtgcaggaacttacgcagttcggcgaccttgcgctgctcttcgagcatgcggttgatcttctcgcccagccccttggccgcgaggcccaggtgggtttcgaggatctgaccgacgttcatacgcgacggtacgcccagcgggttgaggacgatgtcgaccggggtgccgttggcatcgtgcggcatgtcttccaccggcatgatcaccgagaccacacccttgttaccgtgacggccggccatcttgtcgcccggctggatgcgacgcttgatcgccaggtagaccttgacgatcttcagcacgcccggagccaggtcgtcgccctgctgcagcttacgcttcttgtcctcgaacttgtcgtccaggagctggcgacgatcgctgatgtaggcctgggccttctccagctgttcgttcagggcgtcgtcggccatgcgcagcttgaaccactggccgcgctcgagaccgtcgaggtagtcgtcggtgatctccgtgcccttcttcagcgccgggccaccttcagccttggcaccgaccagggcggcacgcaaacgctcaaaggtcgcgccttcgacgatgcggaactcttcgttcaggtccttgcggatctggtcgagttgcatcttctcgatggacagcgcgcgggaatcgcgctcgacgccgtcgcgggtgaagacctgaacttccatgaccgtacccttgggtcccggtcggcacacgcagggaaggtgtccttcccgtccgacgccttcccacccaaatatcccccccca

SEQ ID NO: 3575 - DNA, 225 bp, Pseudomonas aeruginosa
agttggccgacctgccggtgctgcgcgtggccatgcggcgagacgtcgggcctggtggcgctcggcggcggcgcctgtgcctggctgctgttcaacagccgggcgatgcaacggtacatggtactggtttacgcccagcgcctgtaccgcgcccagtcggccaaccgccccggttcggcgcagcggcgcctggccaaccaggccgcctaccgcgaacgcaagtga

SEQ ID NO: 3576 - DNA, 1206 bp, Pseudomonas aeruginosa
tggggggggatatttgggtgggaaggcgtcggacgggaaggacaccttccctgcgtgtgccgaccgggacccaagggtacggtcatggaagttcaggtcttcacccgcgacggcgtcgagcgcgattcccgcgcgctgtccatcgagaagatgcaactcgaccagatccgcaaggacctgaacgaagagttccgcatcgtcgaaggcgcgacctttgagcgtttgcgtgccgccctggtcggtgccaaggctgaaggtggcccggcgctgaagaagggcacggagatcaccgacgactacctcgacggtctcgagcgcggccagtggttcaagctgcgcatggccgacgacgccctgaacgaacagctggagaaggcccaggcctacatcagcgatcgtcgccagctcctggacgacaagttcgaggacaagaagcgtaagctgcagcagggcgacgacctggctccgggcgtgctgaagatcgtcaaggtctacctggcgatcaagcgtcgcatccagccgggcgacaagatggccggccgtcacggtaacaagggtgtggtctcggtgatcatgccggtggaagacatgccgcacgatgccaacggcaccccggtcgacatcgtcctcaacccgctgggcgtaccgtcgcgtatgaacgtcggtcagatcctcgaaacccacctgggcctcgcggccaaggggctgggcgagaagatcaaccgcatgctcgaagagcagcgcaaggtcgccgaactgcgtaagttcctgcacgagatctacaacgagatcggcggtcgtgaggaaaacctcgacgagctgggcgacaacgagatcctcgcgctggccaagaacttgcgcggtggcgtaccgatggcgaccccggtgttcgatggcgccaaggaacgcgagatcaaggccatgctgaagttggccgacctgccggtgctgcgcgtggccatgcggcgagacgtcgggcctggtggcgctcggcggcggcgcctgtgcctggctgctgttcaacagccgggcgatgcaacggtacatggtactggtttacgcccagcgcctgtaccgcgcccagtcggccaaccgccccggttcggcgcagcggcgcctggccaaccaggccgcctaccgcgaacgcaagtgacgcgagcggtccgggcgatcctgagccagaatgtgtctgaccacggggtagga

SEQ ID NO: 3577 - DNA, 1572 bp, Pseudomonas aeruginosa
ttacttgagcagcgcagcctcgacaacagccagaccggtgcgatcagtggcaagggggccgtggagattcgtaccggcaacctgaacaacagccggaaagccagtatcggcagcgatgcgggactcaccctggtcgccgctcgggtagacaacagccaggcgggccggatcgctgccaagggtgcgatcgatgcggatctccaagggctggaccagcatgacaggggcaacctggtcagcgataccggcatcacgctcgatctgaacaagggaagcctggtcaatcgcgctcaaggcctgatcgccacgcctggcactttgctcctgcgccaactcggcgtggtggacaacagcggtggggaaatctccagcgaccgcgcgttcactcttgccacctccgcgttgaacaaccaggagggacgcctgctcagcggcggagccctgaccttgcgtatcgcgcaggccctggacaacagcctcgaggggattgtctccggtgccggaggtctggatatccaggcattcgtcctggacaaccgtagtggctccatcggcagcaagggtgccatcgatatcggtgtgacccgcctggaaaacgacgctggcacgctgatcgccgaacgcggcctgaagctggcggccgatgaggcgaacagttccaaggggcgtatcgccgccaatggtagcctgcatgccaaggttggcacgctgagccagaagggaggagaactgaccagtcaggactcgctgactctcgacctgggcatcctaaacaataacgctggccgtatcgctggcaaccagggcgtagacatcacggcccggcaggtggacaacagcgtcggcgagattgccagccagggcgtggtggcgctgaacctcactgagcagctggacaaccgcggtggcaagatcgtcggtgacagtggcctggacatcacaacgccacgcatgctcaaccaggacaagggggtactcgccagccgcgatgggctgcgcctgagtgctacggagttgttcaacggcgcggggggcctgctgtccagccagaagggtatcgacgtctccctggccggtgcgttcgataaccaggccggcagcctggacagccggggcttcctgacggtgaagtcagcctggctcgacaaccagggcggtacgctatccagcgcaggggcattggcagtgaccagccagggcgccctgaacaatcagggcggcagactggcgagcgacgccggaattagcttgagcagcgccagcctcgacaacagccagaccggtgcgatcagtggcaagggggccgtggagattcgtaccggcaacctgaacaacagccggaaagccagtatcggcagcgatgcgggactcaccctggtcgccgctcgggtagacaacagccaggcgggccggatcgctgccaagggtgcgatcgatgcggatctccaagggttggaccagcatgacaggggcaacctggtcagcgataccggcatcacgctcgatctgaacaagggaagcctggtcaatcgcgctcaaggcctgatcgccacgccggcgatttgtaccgta

SEQ ID NO: 3578 - DNA, 213 bp, Pseudomonas aeruginosa
  unsure (179): Identity of nucleotide at the above locations are unknown.
agcagtcgcaagaacagctatgagtccgatagcgccaactgtgtagatcgcggctcgatcagttttagactcctctatcctcgcttcaagggcagcaagctctgcccgcttttctgcaatttgtttttctatttcttcatttccgctcattgcttcacctcgattccggcttcgcgcancgcctttacaatctctgcgcgctctcgctgttga

SEQ ID NO: 3579 - DNA, 501 bp, Pseudomonas aeruginosa
gatcgaaaggatcatcgaagtagctctggaaggagccaagccatgaccgacatcaacaagctgaaggagctggcggagcggtacatcgccaatccatccggcgagtactgctcggtgctggataccctgctgatggcccgcgagcgccatccgggccagcgcaacaacctcgatgcgttgtgcaagcgctacggcgtggacaactccggtcgcgacctgcacggcgcgttgctcgacgccgagatcctcgccgacgtctacctggcgatgaccggcggccagaccagcctgtcgctggccggcagcggcgcggaaggcgacggcagcggccggccgatggtcagcccgatccgtcggctcgatccggcgcgggtagccaccccggtgctgcgcgccaacgccgaagagctggctgcgcatgcggcgcggctggcggtgatcgagaagtcggcaggtggtccgtcactctgggcgcaactggaggcgccggtcggcgaatag

SEQ ID NO: 3580 - DNA, 450 bp, Pseudomonas aeruginosa
tcgagccgcgatctacacagttggcgctatcggactcatagctgttcttgcgactgctttagcagaaaaaccaaaacccaaaaggtggtgggaataattatgatcgacaacgcagagctgcggagactggctgaagaagtgatccgaattgagcagaatgaggatgagccgatctccgctgcttgggagctattcgattccgccgccaaccccaataccatcctcgccctgctggacgagatcgacaggctcaaggcggagaacgaggcgctgcggggagcgctacatgccgttcaagccgaggtcgacgggaatctccgcccacttacccgcgacctcgtgaacatggtcagcggcttgaagaacggctgccacccgaatgacatctacgagcactgcgatgagatcgaaaggatcatcgaagtagctctggaaggagccaagccatga

SEQ ID NO: 3581 - DNA, 255 bp, Pseudomonas aeruginosa
ctcgccccgcaaatggtggtgaagaggcacatcctctcgatggagcgcgaagcgcagaagctgctggccccgctgaccggtcagaatcccccgcaggaaaccccgccgccggcggccgagagcccggcgccgagcgtacccacgccgccgccgaccagcacgcctgcggttccgcccgcggacgccgcggcatcgccggcagtcgctgcctccactccccctgcgccaccgtccgacacgccccgttttccatga

SEQ ID NO: 3582 - DNA, 639 bp, Pseudomonas aeruginosa
ccatcgagcggcctcctaccggagggcacgagttctatctccactgacgtccgctcgccgagcagcgcgccggtcaaactgaccatggtggtggcgctgttcctcgccatgccggtgatcctcgcgcatgtctggggcttcatcgcgcccgggctgtacaagcacgagaaacgcgtggcgctgccgctgctggtgtccagcatcatcctgttctacgccgggatggccttcgcctacttcctggtgttcccgatgatcttccacttcttcgccagcgtgacgcccgagggcgtggcgatgatgacggacatcaacagctacctggacttcgtcctgactctgttcttcgccttcggcgtcgccttcgagatcccggtggccacggtgctgctgatctggatcggagtggtcgacgtcgagtacctgaagaatatccgcccgtacgtgatcatcggctgtttcgtggtcggcatggtcctgaccccgccggacatcttctcccagaccatgctcgcggtgccgatgtggctgctgttcgagatcggcctgctgttcggccgcctggtacgcaagcgcggcgagcatccggacgaccaatcggccagcgacggcgaacagcctccggccacccgccagtga

SEQ ID NO: 3583 - DNA, 417 bp, Pseudomonas aeruginosa
gggcggggcaacttcggacaggggcaggaggcggcgatcgggcaggaccgcacgatccgccgacacgaagtcggcgtcctcgaggagcagcaggttcactggcgggtggccggaggctgttcgccgtcgctggccgattggtcgtccggatgctcgccgcgcttgcgtaccaggcggccgaacagcaggccgatctcgaacagcagccacatcggcaccgcgagcatggtctgggagaagatgtccggcggggtcaggaccatgccgaccacgaaacagccgatgatcacgtacgggcggatattcttcaggtactcgacgtcgaccactccgatccagatcagcagcaccgtggccaccgggatctcgaaggcgacgccgaaggcgaagaacagagtcaggacgaagtccaggtag

SEQ ID NO: 3584 - DNA, 630 bp, Pseudomonas aeruginosa
aacaggatgatgctggacaccagcagcggcagcgccacgcgtttctcgtgcttgtacagcccgggcgcgatgaagccccagacatgcgcgaggatcaccggcatggcgaggaacagcgccaccaccatggtcagtttgaccggcgcgctgctcggcgagcggacgtcagtggagatagaactcgtgccctccggtaggaggccgctcgatggtcacgcaaacgccggcgtagagcaccttgtggatggtaataggctcgtggtggatggggccattggacaaatgccgggccgcaggcgcattcggatattggttagtccgatgaccagccggaagtcagtcttcgcggtatgggagctcaggatatttcggctctcatggaaaacggggcgtgtcggacggtggcgcagggggagtggaggcagcgactgccggcgatgccgcggcgtccgcgggcggaaccgcaggcgtgctggtcggcggcggcgtgggtacgctcggcgccgggctctcggccgccggcggcggggtttcctgcgggggattctgaccggtcagcggggccagcagcttctgcgcttcgcgctccatcgagaggatgtgcctcttcaccaccatttgcggggcgag

SEQ ID NO: 3585 - DNA, 831 bp, Pseudomonas aeruginosa
aagcgacaatttcccagggtcgccttctccaggcgtcgaggtttcagcagggcaaccttccccaatcccaacccccggaggcggccgaacccgcaggggttcgccgttctaggggcggggcaacttcggacaggggcaggaggcggcgatcgggcaggaccgcacgatccgccgacacgaagtcggcgtcctcgaggagcagcaggttcactggcgggtggccggaggctgttcgccgtcgctggccgattggtcgtccggatgctcgccgcgcttgcgtaccaggcggccgaacagcaggccgatctcgaacagcagccacatcggcaccgcgagcatggtctgggagaagatgtccggcggggtcaggaccatgccgaccacgaaacagccgatgatcacgtacgggcggatattcttcaggtactcgacgtcgaccactccgatccagatcagcagcaccgtggccaccgggatctcgaaggcgacgccgaaggcgaagaacagagtcaggacgaagtccaggtagctgttgatgtccgtcatcatcgccacgccctcgggcgtcacgctggcgaagaagtggaagatcatcgggaacaccaggaagtaggcgaaggccatcccggcgtagaacaggatgatgctggacaccagcagcggcagcgccacgcgtttctcgtgcttgtacagcccgggcgcgatgaagccccagacatgcgcgaggatcaccggcatggcgaggaacagcgccaccaccatggtcagtttgaccggcgcgctgctcggcgagcggacgtcagtggagatagaactcgtgccctccggtag

SEQ ID NO: 3586 - DNA, 435 bp, Pseudomonas aeruginosa
acgcctccgccgaccaggtcatcgctctcatcgatgaacagcgcgccaagggcatcgccgccgagcggatcatcctcgccggtttctcgcagggcggcgcggtggtcctgcataccgccttccgccgctacgcccagccgctcggcggggtgctggcgctatccacctacgcgccgaccttcgacgacctggcgctggacgagcgccacaagcggattccggtcctgcacctgcacggcagccaggacgacgtggtcgacccggcgcttggccgcgcggcccatgacgccttgcaggcgcagggcgtggaggtgggctggcacgactacccgatgggccacgaggtgtccctggaggaaatccacgacatcggcgcctggctgcgcaagcgcctctgacgcccggagcttctctcagacggcgtgcagccggtag

SEQ ID NO: 3587 - DNA, 480 bp, Pseudomonas aeruginosa
ccgccgagcagctcttccagcgccgcctggcgtctttcgtcaagcgcgggaacgtgcaggtgggcgagctggccgtggcgctcgtcggcgaccacctccacgcggatatcctcggcgatcctccggctttcctcctccagcacccggcggatcgcgtccaggcgcagcgccggcttgaaggtcttgcccaccgcggtgaccggcatgctctcgatcagccagatatccttgggcaccgccgcgcgctccggtacgtggcggctggcgtgctccagcagctcttcctcgctggcgctggcgccgggcttgagctggatatacgccaccggcagctcgccggccttggcgtccggcttgcccaccgccgccgccagggccacggccggatgccggtgcagcgcttcttcgatcatctgtgggtcgatgttgtggccaccgcgaatgatcaggtccttgctgcgcccggtgagccagatgtag

SEQ ID NO: 3588 - DNA, 1755 bp, Pseudomonas aeruginosa
gtgggcggacactcgccggatcgctccggcaccgtcccgaagatgccacccccgtcgtcgccctaccgttgtctttttgtagcgcgccaccggtcgcgcgcacgagtcctcccgaaggctgccccgggagcttcgcgcagccccctccaggccccgtccggccagggctggagggcgccggccaagcatggatttctccccgctggcaacatgctttacactggcgcccgttcattccttaaccactacgagatcgccgtgctcaaagcactcaagaaaatcttcggcaaggccgacggaacccagccgcagagcggttcctccccggtcccgcaaggccctgccggcgctaccgcgaaaggtaccgcccccaccggcgaaaagccgaccgagaaacgcccacgcaaaccgcgccccccgcgcgccgctgaaaaggccgagaaaggcgaaaagcccgccaaacccgccggcaaagaaggccgggacgccaagccgcgcagcgacaagccgcgccgcgaacgcaagccgaagccggtggacaactggaagctggaagacttcgtggtcgaaccgcaggaaggcaagacccgcttccacgacttcaacctcgccccgagcctgatgcacgccatccatgacctcggcttcccctactgcaccccgatccaggcgcaggtactgggcttcaccctgcgcggccaggacgccatcggccgcgcccagaccggcaccggcaagaccgccgcgttcctcatctcgatcatcacccaattgctgcagaccccgccgccgaaagagcgctacatgggcgagccgcgcgcgctgatcatcgccccgacccgcgaactggtggtacagatcgccaaggacgccgcggcgctgaccaagtacaccgggctgaacgtgatgaccttcgtcggcggcatggacttcgacaagcaactcaagcagctggaagcgcgcttctgcgacatcctggtagccaccccaggccgtctgctggacttcaaccagcgcggcgaggtgcacctggacatggtcgaggtgatggtcctcgacgaagccgaccgcatgctcgacatgggcttcatcccgcaggtccggcagatcatccggcagaccccgcacaagggcgaacgccagaccctgctgttctcggcgaccttcaccgacgacgtgatgaacctcgccaagcagtggaccgtcgatccggcgatcgtcgagatcgagccggagaacgtcgccagcgacaccgtcgagcagcatgtctacgccgtggccggcagcgacaagtacaagctgctgtacaacctggtggcacagaacaactgggaacgggtgatggtcttcgccaaccgcaaggacgaagtccgccgcatcgaggaacgcctgaccaaggacggcatcagcgccgcccagatgtccggcgacgtaccgcagcacaagcgcatccgcaccctggaaggcttccgcgaaggcaagatccgcgtcctggtggcaaccgacgtggccggccgcggcatccacatcgacggcatcagccatgtgatcaacttcaccctgccggaggacccggacgactacgtgcaccgtatcggtcgtaccggccgcgccggcgcctcgggcacctcgatcagcttcgccggcgaggacgatgccttcgccctgccgccgatcgaagaactgctgggccgcaagatcacctgcgagatgccgccggccgaactgctcaagccggtaccgcgcaagcactga

SEQ ID NO: 3589 - DNA, 501 bp, Pseudomonas aeruginosa
agtccagaatggacaaattgtttacatccattccggagatcgcatgagcgccgccactcccctgatcgtccagcaggccgaagccgagcaactgctcgcccgtatcgacgtcctccaggccatgcgccagctgttcctcgacctggccgccggccaggcgctccagccggcccagcaactggtggagttccccgccggtcgcggcgacttcatcaactacctcggcgtgctcgcccaggaacaggtctacggagtcaagacttcaccctacatcgttcgcgaacagggcccgttggtcaccgcctggaccctgctgatgtcgatgcagaccggccagcccttgctgctctgcgatgccgcccggctgaccaccgcgcgcaccgccgccaccaccgccgtggcggtggatgccctggctccggccgaagccggccgcctagcgctgatcggcagcggaccggtagcccatgcccacctgcaatacgtgaagggcctgcgtga

SEQ ID NO: 3590 - DNA, 747 bp, Pseudomonas aeruginosa
tcgaagcggattacctcgtcatcggtgccggcatcgccggcgcatccaccggctactggctgtcggcccacggccgggtcgtggtgctggagcgcgaggcgcagcccggctaccactccaccggccgctccgccgcgcactacacggtggcctacggcacaccccaggtgcgcgcgctcaccgccgccagccgggccttcttcgacaacccgccggccggcttctgcgagcatccgctgctcagcccgcgtccggaaatggtggtcgacttcagcgacgatccggaagaactccgccgccaatacgaaagcggcaaggcgctggtgccgcagatgcgcctgctggacgcggaacaggcctgctcgatcgtgccggtgctgcgtcgcgacaaggtcttcggcgccacctacgaccccaccggcgccgacatcgataccgacgccctgcaccagggctacctgcgcggcatccgccgcaaccaggggcaggtcctgtgcaaccacgaagcgctggagatccgccgggtcgacggcgcctgggaagtccgctgcgacgccggcaactaccgcgcggcggtgctggtcaacgccgcaggcgcctggtgcgacgccatcgccgggctggccggcgtccgcccgctgggcctgcagcccaagcgccgctcagccttcatcttcgccccgccgccgggcatcgactgccacgactggccgatgctggtcagcctcgacgaatccttctacctga

SEQ ID NO: 3591 - DNA, 1272 bp, Pseudomonas aeruginosa
cgacgagcgcaacatcggcccctacgagaagctcaactgggacgggcagaagatccgctcggtcagcaccgtgctgcgcgactccgccggccagccgctggcggtgctgtgcatcaacctgaacatcagcctgttcgagagcgccaaggcggcactcgacctgttcctctcgccgagcaagctgatcccgcaaccggacgcgctgttccgcgacgactggcaggagcgcatcaacaccttcctgcacggctggctgcggcagcgccagctcggcttgaacctgctgacccgcgagcacaagcgcgaactggtcctggccctgcacgccgagggcgcgttcaagggcaagagcgccgccaactatgtggccaacgtgctgaacatgggccgggcgacggtctacaagcacctcaaggagctgaaggaaggcggcgactgacggcagccgccgccggcgagcggtcagtcgccgtagatgtcgctcttgaagtacttgccctcgatgcgcttgtaggtcccgtcggcacgaatcgcgtcgatcgccgcgttgagcttgccgaccagctcggcgtcccccttgcgcaccgcgatcccggcgccctcgccgaagtatttcgggtccttgaactccggcccgacgaaggcgtagcccttgccgcgcggggtatcgaggaagccggtctgcaacgggatggagtcggcgaaggtggcgtcgaggcggccggccaccaggtccaggtagatctcgtcctggctggtgtagcgcaccacttcagcaccggccttggccagcaccgcgctggcgaagcggtcggcggtagcgccgcgctgcacgccgatgcgcttgccggccaactggctgaagctgtcgtcgagctgggcgccttccttcatcaccaggcggcccggcgtgaagtagtacttgtgggtgaagtccaccgagcgccggcgctcctcggtgatggtgatggaggacagcgcggcgtctatcttgcgaactttcagcgagggaatcaggccgtcgtactcctgctcgatccactggcacttcacctgcatctgcgcgcacagcgcgttgccgatgtcgtagtcgaagccggccagttcgccttcggcggtcttgaaggaaaacggcgggtaggcggcctcgatgccgatccgcaggttgccatcggcggcgacggcggatccgctggcgagcacgccgagcagcaggcctcccagcaggttcttggtgttcagcgacttgatcatggacgactccaggggtga

SEQ ID NO: 3592 - DNA, 642 bp, Pseudomonas aeruginosa
tccagtaacgatttctcgctttcaaaattcacctatgctgcctttcgcgcatttctgaacgaaatcatgctgattgggtacgtgcgcatttccaccgacgatcaactactggacctgcaacgcgatgcgatggccaaggcgggttgcgagcgagtgttcgaagacactgccagcggcgccaaggccgatcgaatcggcctggccgcgcttctcgccaatctaaggcggggcgacacggtggtggtctggcggctggaccggcttggccgctcgatcaaggacctgatctacctggtcgagcaattggaggatgccggcgtgggtctgaagagcctccaggagaacatcgacaccacatccaccggagggcgtttggttttccacctctttgccgcgctagccgagttcgagcgcaacctgatccgtgaatgcacccatgcgagactatctgcagcacgtgctcgcggtcggctgggcggccgcaagaaacgcctggatcccgccaagcgcaaagtcgccctgaagctctatcacgagcgccaatacaccgtggtggagatctgtcggatgatgggaatcggccgctcgacgctctacaactacatcaccgaggcagaacggaatgcccaccagcaggcgtaa

SEQ ID NO: 3593 - DNA, 1407 bp, Pseudomonas aeruginosa
gcagcccaccgctccgaccagggcaagccccgcgtcctgccccaggcggaactggagcgctactgcgaactgattgcggcgttgaagctgcgcaccaccaacaagcaggggcggcatctatctacacaccgcgccattgagctgctggaagagtacggtgtagaaactgaccggggcctcattgttgccccaagaggcgtactccacagacccaccgtcaaccgatatctatcacattggcgattaaggcctgctcaactgtcccgggagccaggcgcaactcggttccaggctgagcacagcaacgattgttggcagttcgacatgtcgccgtcggacctcaagcatattgagcatccgcggtggatcgatcccgccaagggcgaacccaccctgatgctgttcagcgtggtggatgaccgcagcggtgtggcctaccaggaataccactgcgtttatggtgaggatgcggagacggcacttcgttttctgttcaactcgatggcgccgaaagcggacccgagttttccctttcagggccggcccaagctgatctatctggacaacggtccggtggccaagcgtcgcgttttccagagcgtcatgcgggcgctgggcatcgagtggcagacacacatccctgccagcaaggatggaacgcgcaccacggcccgctcgaaaggcaaggtcgaacgtcctttccgcacagtgaaggaagcccacgagaccctgtaccacttccacaagccggaaaccgaagcccaggccaacgagtggctgttgcgctacctagtgcgcacctacaaccagcagacacatcgtgccgaacccctttcacggatcgaggactggatcacccatgtgccaacagaggggatccgtgaaatgtgctcatgggatcagttctgccgctttgctcgggagcccgagcggcgcaaagtcgggcctgatgcccgaatcaccaccgacggtaccgcgtacgagcttgagccagagatggccggcgactacgtcgtgctgctctgggggctgttcgacgatgagctgcatgccgagttcgatggcgagcggttcggtcctcactacccggtgtccggccccattccgcagcaccgctaccgggctttcaagcgcagcaaggcagacgagcgctcggctcgtatccgatctctcgcggaccagttggggctgccgatcgcggcgctttccggggaagatgtacgactagagcccggttctgctgactcgacgctccccatccagcccttcgttttcgagccccaggaatcccgcattgcggccaagctggctatcgccgaggaactggcaatgccgctggccaagctttcaatggatgaccgcgccttcatcgaccaggtgctgagcgagaccctggctacggactga

SEQ ID NO: 3594 - DNA, 1254 bp, Pseudomonas aeruginosa
gtcgcctcagccgccgctcatgttcatgaagcgcagcacctgcacctcgccggcggcgctgaattcatggcgcgccggcttgcgctggagcgcctcgccgatcgcttccagcaacggtccgtcgtgcagtgggtggcggcgcagcagcgcgcgcaggtcgagcgaatgctcgtggccgaggcacagcagcaggcggccctcgacggtcaggcgcaggcggttgcaggtggcgcagaagttgtgcgagtgcggcgagatgaagccgatgcgtgtctgcggatgctcgaccaggcgcacgtagcgcgccggcccgccgctctgctcggcgctgtcgagcaaggcgtggcgctgggcgatcagcgcgcgtacttcgtcgctggagcagaagctctcgccacgttcgcggccgacctggccaagcggcatctcctcgatgaagctgatatccaggccgcgggcgatggcgaagtccaccagcgccggcacctcatcggcgttgcgccccttcatcaccaccgcgttcagcttgatccggcggaaaccggcggcctgggcggcgtcgatgccggccagcaccttgtccagctcgccgttgcgggtgatcgcccggaagcgcagcggatcgagggtgtcgaggctgatgttgagacgcgacaggccggcgtcgtacaacggccgggcgtagcgcaccagttgcgagccgttgctggtcatgcacagttcgcgcaaccccggcagtgccgccaggcgctcgcacaggccgacgatgccgggccgcaccagcggctcgccgccggtcaggcgcagcttgcgcacaccgccggcgacgaacagccgggcgacccgctcgatctcctccagggtcagcacctgctggcgcggcaggaagcgcatgtcctcggccatgcagtagacacagcggaagtcgcaacggtcggtgaccgacaggcgcaggtagtcgatctgtcggccttggccatcgatccagtcggtcatgtcctgggtactccgtttgatcttcgggaaggagagggaaacatcggcgccgaaggctattgcaccagcgccccatccgcaccctcgaaggcgaagccctcgatacaggcgtctcccgccagcacgccgatgtactgtcccaccgctcgctgcaacacctgcacctgcaggtgcgcggcgatctgtgcgcgggccgcgtcgaagtcgagcggctcgccgccttcgcgcgccagcagttccaccacatgcaggccatag

SEQ ID NO: 3595 - DNA, 495 bp, Pseudomonas aeruginosa
cggctttccagcggatgctcgagcagcccgggcgcgcggcgcagcaggcgcttctcgaattcggggacggtctgccccggctcgatccagccgaggtcgccgcccgcctccttcgacggacaggcggagaaacgccgggccaggtcgacgaagcgctcgggatgcccgcgcaactcgtcgagcagctccgcggcctgcttgcgcgccgtctcgcggccttccaggtcgtccggcgcgcaggccagcagcacatggcgcaattgcaggcgccaggggccgagcaagcgccccggattggccgcgtaccaggtccggcaggcgtcttcgtcggcttccgggacctgcacctcttcctccagcaattggcggatgcgcgcttcctccggcgtctcgccgtcttcgcagcgggcctcgatgcccagcgcgtcggcccgttgcaggagcaactggcggacgatcagcgcacggcaggcggcctccagcgccagcgcgtag

SEQ ID NO: 3596 - DNA, 462 bp, Pseudomonas aeruginosa
agctcaccggggtttcctcccaggcccggtcgatggcctccaggctgtcgtcgcgctgttcctgggcctggtcgcgacgcaacgcgccgaggtccgggcgctcgccgccgagttccagcaacgcctcgaaaatcgccgcataggcgctgccgcgttcctccaggcgcagcgccagcaggccgaggatgtgcgccacttcggcgagcccttcgctggccgccgcgaacggcagcagcgacaggtattcgaggtacagcggcaggtagtccggcagctccggtacgtcgatttgcaggccggccccggtatagcggtcgagcaggtcgaccatcgcctggccacggtcgcggctctcgccgtggacgtgctcgaagagcagcagcgagaccgagcggccgcgctcgaagagaccgtcgtagcgcgcctggacgtccagcaggtcgccctggcagagctcgttga

SEQ ID NO: 3597 - DNA, 1842 bp, Pseudomonas aeruginosa
gcagcgccgcgaggccgtcgcgcagcgcttccggcagttcgcaggtgcggatcagcgcatgcaggccgaggctctcctcgcgcagctcggcgcgtggatagtcgagtagcagggcgagcaggcggaacagttggctgtgatcgttcatggcgctcactcctggatctgcacgacctggatcacgtcgcggcggttggtcggcttgccgccgaacaggttgacggcggagttgctgccgccggaacagccgttgccgaagctgaagccacagccggaacgctcggcgaaggcatcggaaagcgcttcctcgcggtgcgcgctggggatcacgaagcgatcctcgtagttggcgatggccaggtagcggtacatctcctccacctgctccacgctcaacccgaccttggccagcacctccaggtcctggcggccttcgacgtgctcggcgcgcttgtaggcgcgcatcgccagcaggcgcttgagcgccagcagcaccggcgcggtgtcgccggcggtgagcaggttggccaggtactgcacggggatgcgcagcgactcgacgtccgggatcaccccgtcgctgccgatgtgcccctcggcggcggcgttctggatcggcgacagcggcggcacgtaccagaccatcggcagcgtgcggtattccgggtgcagcggcagggccagcttccagtccatcgccagcttgtacaccggcgacttctgcgccgcctcgatgacgctgtcggccaccccatccttgcgcgcctgggcgatcaccgccgggtcgaacggatcgaggaagatctccagttgcttctcgtacagctcgcgctcgttctcgcaactggccacttcgtggatacggtcggcgtcgtagagcagcacgccgaggtagcggatgcgcccgacgcaggtctccgagcagacggtgggctggccggcctcgatgcgcgggtagcagaagatgcacttctcggacttgccgctcttccagttgaagtagatcttcttgtacgggcagccggagatgcacatccgccagccgcggcacttgtcctggtcgatcaggacgatgccgtcctcctcgcgcttgtagatcgccccgctcgggcaggacgccacgcacgccgggttcaggcagtgctcgcagaggcgcggcaggtacatcatgaaggtgttctcgtactcaccgtagatgtccgcctggacctggtcgaagttcttgtccttgcgccgcttggcgaactcggtgccgaggatctcctcccagttcgggccccactcgatcttctccatgcgctgcccggagaccagcgagcgcgggcgcgccaccggctggtgctcggccttgggcgcggtatgcaggtgctggtagtcgaagtcgaacggttcgtagtagtcgtcgatctcgggcaggtccgggttggcgaagatgttcgccagcacgcggaacttgccgccgatgcgcgggcggatcgaaccgtctgccgcgcgcacccagccgcccttccacttctcctggttttcccattccttcgggtagccgatcccgggtttggtctcgacgttgttgaaccaggcgtactccatgccttcgcggctggtccagacgttcttgcaggtgatcgagcaggtgtggcaaccgatgcatttgtcgaggttcagcaccatgccgacttgcgaacgaattttcatggcgtctctcctcaaatgtcctggggcagcggttgcggcagggcgtcgccgccgagtccgccgtggcggggttcgtccagccagtcgaccttgctcatcttgcgcaccacgacgaactcgtcgcggttgcagccgaccgtgccgtag

SEQ ID NO: 3598 - DNA, 432 bp, Pseudomonas aeruginosa
atctcccagtcgctcttggcttcccaggccggatcggtggccgccgacagcggatggatgaaggggtgcatgtcggaggtgttgaggtcgtccttctcgtaccaggtagcggtcggcaggacgatgtccgagtacatgcaggtggaggacatgcggaagtccagggtggtgaccaggtcgagcttgccctcggcaccgtcgtcgacccagtcgacctcggtgggacgcggaccgccggccttgccgaggtcatcgttcatcaccccgttcttcgccccgagcaggtacttgagcatgtactcgtgccccttgccggaggagcccagcaggttggagcgccagatgaacatgttgcgcgggaagttctgcggatcgtccggcgattcgctggcgaagcgcaggccgccgctcttcagttcgcgcaccacatag

SEQ ID NO: 3599 - DNA, 345 bp, Pseudomonas aeruginosa
agggcgccctcggcgctgccggtcatgtgcagcgaggtgccgaacgccttcgggatgaagaacccgccgaaggcgccgatggcggcggagaagccgatcaccgcggccgactccatgctcgcgttgcgcgccgcgccggttttgtcggcctggccgtcgcgcacccgccgggcccactcgttgcggaagatcaccgggatcatgcggaaggtggagccgttgccgatgccggcgaagaagcacagcaggatgaaggcgccaaggaagccgaagaagttgccctggccgccgtcgcccggcaggaaggcgatcaccgcgaacaccccgccgatcatcagcgcgtag

SEQ ID NO: 3600 - DNA, 1077 bp, Pseudomonas aeruginosa
ttccacagggtgatccgcgcgccgccgaacttgtccgccagccagccgcccaggggccggctgagggcgcccaccagcggaccgaggaaggcgtattgcagcgggttgacgtcggggaactgggtcttggctgagcatcgcgaagccggccgagaagccgatgaacgagccgaaggtggccacgtacagccagcacatcagccagttgtgcttgcgcttgaagatcaccgcctggtcgcggaacgaggccttggcgtcggcgatgtcgttcatcccgaaccaggccgcgaccgataccacggcgatgaacggcacccagatccagccggcgttctgcagccacaggcgaccgccgtcgccgagctgctgcggctcgccgccgaaggcgccgaacaggccgccggccaccgccagcggcacggcgaactgcatcaccgagacgccgaggttgccgagcccggcattcaggccgagggcggtgccctgctggctcttcggatagaagaagctgatattggacatgctcgaggcgaagttgccgccgccgaagccgcagagcagcgcgatcagggcgaacacccagtacggggtgttcgggtcctgcacggcgaagcccagccagatgcacgggatcagcatcgaggcggtgctcagggcggtccagcgacgaccgccgaagatcggcaccatgaacgaatagaacacccgcagggtggcgccggagatcgacggcagcgccgcgagcaggaacagctggtcgttgctgaaggcgaagccggcgctgttcaggcgcacagtcaccgtgctccagatcatccacacggcgaaggcgagcagcagcgcggggatcgagatccacaggttgcggctggcgatgcgcttgccgttgcgcgcccagaactcggggtcctcggggcgccagtcgagcagcagcggtccccgtgcggctttcagttgggtattggcgatcatgcccatgacggcattcctcaggagtgggtgggaagggtgggaggaaggtcgacgtcggccgaggcggcctggccgtcgatgcggcgttgctgcttgatcgcgtag

SEQ ID NO: 3601 - DNA, 519 bp, Pseudomonas aeruginosa
tcaaccacgccggctcgttgcgcatgctcacctaccgggtcgccctggagcccagcctggaaggccgccaggcgctgctcgggaccctcggcgaacgcctcgacagcggcgacatccgccgcctgctgcaacgccaggacgccgacgacccgatccgccagttgcaccaggagctgcgcgagggcctcgcgcgcctggacccgcgcgcgctgcccggacgcgccgtgctggacgcctacgtcggcgacatcgaccgtttcgtcggcatcctccaggccaaggccgagcgccgctcgcaactgctcagcacggtgcagggcctgtgcctgttcctcagcctgctggtggtgttcgtcaccctctacgacctcagctatcacgtcatcggcccgctgcgcgaactcaccagcaccgcccgccgcctgggccgcggcgagctggacgcgcgggtcacctacagcggcgaggacgaactggcgcaactgggcgagcgcttcaaccagatggccggcgagctga

SEQ ID NO: 3602 - DNA, 879 bp, Pseudomonas aeruginosa
gcatcgccgtcgaggacgatggcgtcggctttgatccgcagcagaaccgtagcggccattatgggcttaccatcatgcaggagcgcggccagaccctcggcagccagttgcgcttcgaagcgcgcgcgccccacggcacgcgagtgctcttcagcttcgtgccgaccgccctgcaaccctccgccgccaaggagccgaccccatgacggacatgccagccaccgccgacgaaccggttcgcctgctgctggtggacgaccatccgatgatgcgcaagggcgtcgcccagttgctcgaactggaagacgacctcagcgtggtcggcgaggccggcagcggcgaggaagccctgcgcctggccgccgagctggacccggacatgatcctgctggacctgaacatgaagggcatgaacggcctggacaccctgcgcgcgttgcgcgaggccggagtcgacgcgcgcatcgtggtgttcaccgtgtccgacgacaagggcgacgtggtcaacgtcctgcgcgccggcgccgacggctacctgctcaaggacatggagccggagcgcctgctcgagcacatccgccaggccgccaccggacagatgaccctcagcccgcagttgacccagatcctcgcccaggccctgcggggcgacgaccgctcgaagagcctcgacgagctgaccgagcgcgaacggcagatcctccgccagatcgcccacggctacagcaacaagatgatcgcgcgaaagctggacatcaccgaaggcacggtgaaggtccatgtcaagcgggtgctgcacaagctcggcatgcgttcgcgggtcgaggccgcggtgtgggcggtggagaacgacctggtgtgagccgcgcgcgggcttga

SEQ ID NO: 3603 - DNA, 642 bp, Pseudomonas aeruginosa
ttccggtcaagaaatccaccgcggcgctgcgtcgatactggcggcttccttccacgaggcgcccgtcatgatgttcgaacgcagccccgacgatccccttcccctggtctacgcctgctccggctgctccaacgtggcgcaactggccaacgatctcgcgctgcgcctggatcgcgcccggctggcggagatgtcctgcatcgccggagtcggcggcgacgtcccgctgctggtccgccgggcccgctccgggcgaccgatcctggccctcgacggttgcccgctgcattgcgtgaaaggctgcctggcgcgccacgaggtagtcccgaccctgcacctgaccctcagcgaacacggcctgaagaagcgctacggcgaggactgcgaggcgcaggacgccgagcgcctgttcgtcgagctggagcgtctgctgacgccgggcggcaagcgccgctgcgaatgaccggcgaggccgggggcggcggctatccccagcctgccgaaacccgcatccccgactttcggcctcccttgcgcatatcgcggcgcctccgccgcgtaagcgtgcccgtaccgcctgcgatacgcagcagtgcgctaggatgtcccctcggcttcgaagaaaggacatttcaatgctga

SEQ ID NO: 3604 - DNA, 558 bp, Pseudomonas aeruginosa
agaacggcagcgaccgtccgttgctggagctacgctggaggatcgccgcctaccgccccggcgacagcgtcaacctggccgacaccagcttcgacagcccgcgctaccgggcgccgaacgccctgctcggcggcgacagctggcacgattgcctgccgctgccgccgctgcgtccgggctatcgcgccagcaccctggaattccgcgccgaacgcctggacgggcgtttcggcaactgaccgagggaggacccgatggaaacccgccgtctgttcgaccagggctccgctgcctacgccagcgcccgcccgcgttatcccgatgcgctctaccgccatctcgccgggctctgcggccagcgccggcgcgcctgggactgcgccaccggtaccggccaggccgcgctcggcctggcgcagtacttcggcgaagtcctcgccagcgacaccagcgcgcagcagatcgaacacgccgttgtccatccgggtatccgctacagcgtgcaggacgccgaagccaccgactatcccgacgccgccttcgacctggtctgcgtag

SEQ ID NO: 3605 - DNA, 1098 bp, Pseudomonas aeruginosa
cccaggcctggcactggttcgaccattcgcgcttcaaccgcgagctgctgcgcgtgctgcgtcccggcggcgtgttcgccgcctggggctacggctggttcagcatcgacgcgcagatcgatgccgccatcgacgaggaatacctgcgcccgatcggcccgtactgggcgcaacagaaccgcctgctgtggaacgcctaccgggatgtcgagctgccgctgggcgaactccccgctccggccttcgtcatcgagcaacaatggagcctggcccggttgttcgactacatggccacctggtcggccagccgcctgtgccgcgaggcgcagggcaacgctttcgtgcgccaggccctgcaacgggtcgccgcgctctggggcgagccgacctcgacacgcagggttcgcatgccgctggcgctgcggatctcgcgcaaggacgcctgaccgagccttcgggcggttttccgcggccggccaatccagtacggtaggccgccctccttccaactcccagccaaggaacgctgcccatgagccaacccgtcgccttcgtcaccggctgctccagcggcatcggccgcgccctctccgacgccttccagcgcgccggctaccgggtctgggccagcgcgcgcaaggaggacgacgtgcgtgccctggccgaggccggcttccaggcggtgcaactggacgtcaacgacgccgccgcgctggcccgtctggccgaggaactggaagtcgaagccgccggcctcgacgtgctggtcaacaacgccggctacggcgccatgggtccgctgctggacggcggcgtcgacgccatgcgccggcagttcgagaccaacgtgttcgccgtggtcggcgtgacccgcgcgctgttcccgctactgaggcgcaagtccggcctggtggtgaacgtcggcagcgtctccggcgtgctggtcacgcccttcgccggcgcctactgcgcctccaaggccgcggtgcatgcgctgagcgatgccctgcgcctggagctggcaccgttcggcgtcgaggtgctggaagtgcagccgggcgccatcgcctcgaatttcggcgccagcgccagccgtga

SEQ ID NO: 3606 - DNA, 672 bp, Pseudomonas aeruginosa
gatggacagcgtggtcgacgtacgctcgcccaggtggccgttgcgccggcagatccaggcgcgcgccgcggcatcccaggacaatcccacgtccgccgaagacttcgcccgccagttgctagccgccgtgcagcgccgtccgcgcccgccgctggtgcgcatcggcaatggcagccgggccctgccggcgctggcccgctggctaccgcgcggcctgctggagcggctgctgaagaagcgcttcggtctcgacacgcgcctctgaaaccgccaggagataccgccatgggcgaccgccttgccgtacccatccgctactacgccctggccgggatcgccgcggcgatcctgctcaacgtgctgctgcgcggggtggttcgcttcggcggcctgccggccagcctgctgatcgccgcgctggtcgccggcggcctggcctggtggttcgcccgcgcgcagcggcgctggccgacctggggcgagcgcttgcgcctggtcgccctgtatggcggagtgctcggggtcctttacctgctgctggtcggcctcgcctcgctgaaaggcgatcccagcccggcggcactgctcatcgtggtgctgcactacctgtgctatccggcgctgttgctggtgttcttctccggcagggtctatggattcttcctgcgctga

SEQ ID NO: 3607 - DNA, 1689 bp, Pseudomonas aeruginosa
tgttggccacccaccgcacgaggccgacatgcaccgttcaccgctcgcctggctccgcctgctcctcgccgccgtgctcagcgccttcctgctcggcggcccgctgcatgccgccgagactgccgccacgcgttcgccagcctgggcgcaagcggtcgacccgtcgatcaacctctaccgcatgagccccaccctctatcgcagcgcgctgcccaacgcacagagcgtcgcgctgctgcaacgcctgcaggtgaagacggtggtcagcttcatcaaggacgacgaccgcgcctggctgggccaggctccggtgcgggtgctcagcctgccgacccacgccgaccgggtcgacgacgccgaggtgctcagcgtcctccgccagttgcaggcagccgagcgcgaaggtccggtactgatgcactgcaagcacggcaacaaccgcaccggactgttcgccgccatgtaccgcatcgtcgtgcagggctgggacaagcaggccgcgctggaggaaatgcagcacggcggtttcggcgacgaggacgacatgcgcgacgccagcgcctatgtgcgcggcgccgacgtcgacggcctgcgcctggcgatggccaacggcgaatgcagcccgtcgcgcttcgccgtctgccatgtgcgcgagtggatggcccaggcgctcgaccggccgtaaacacgcgcagggccgaaaggcttggtcccgtcacgcaagtttggcacccttgggactcgccgccgcacgcggcggcccacttcgacagccgcgacgagactcccatgagcgatgccccgacctccccgcgcttcagcgccgccaccagcacccgcctgctcgaccatgcgcaactggaggcgctctgcgccgactatgacggcttccttctcgatctctggggcgtagtgatggacggcgccgaggcgttccccggcgcccttgcctggctcgcccggcggcacgccgaaggccgcccggtctggttcctcagcaactcgtccagcagcgtggcggaaatgagcgccgggctcgagcgcctgggcatccggcgcgactggttcgccggcatcaccacgtccggccagttgaccatcgacgccctgctacaaaccgccgaataccggcgtggcggtatctacctggccggcgtcggcctggcccagcagagctggccggcggaaatccgcgagcgcttcgtcgaggacatcgcccaggcggcgctgatcgtcggcgtcggcagctttccccaggatgaactggaacagcgcttcgcgcccctgcgcggcgccaccgacctgccgttcctctgcgccaacccggaccgcgtggtggtttccggcggccgcacggtatacggcgcgggcatgctcgccgagctgttcagcgaggaaggcggccaggtcagctggtacggcaagcccgacccggcggccttccgcatcgcccagcggcaactggaagcgcgcggcgcgcggcacatcctgttcgtcggcgactcgctggtgaccgacgtccccggcgccctcgccgcgcgcatcgatacgctctggctgggcgccaccggcatccaccgcgaagccctgggcgccgagttcaacggagcactcgacgaggagcgggtcaggtcgctgctgcacggctatccgatccgaccgcactttgccgcgccagggctggtctga

SEQ ID NO: 3608 - DNA, 2070 bp, Pseudomonas aeruginosa
aacacctaccccaaaaggccgatccgtgaaccgtggggtgcgaatgtctggaaaagcccgagaaaatttcggaacccgcatcataaccgcagaaaagccctggacgtccagcgcaccgatacggtgcatggcgcgccgccgacgcggcagcgccattatcgaccgcttccccggggaaaatttcttcgttcgccgccagcccaggcgagacggcggctgcggccgcttgcccaggcccggtcatggcacaagcatggccgtttcgttgaacctccgcgaacgacgaacggtcaaccctttcagggtcgggaattcggtgcccatccgaagcctttgatttccggcctgtttccgcgcttcgacgaagcgcccgacagcgtagccaacgctcattccgaagggagtcccgaccatggtgaaaacctgtggcaaggccctgctcggcctctgcgccgcagccgccgtactggccttgctgatccactggatcacccccgcgaccatcctccactaccgcgaggacctgctgttctacttgcaggcccacctggtgctggtcttcagttcgatggcggccgccctgctggtcggcgtgccggccggcatcctgctcagccgtcccggcatgcaggcccaggccgaacgcctgatgcaggtgttcaacgtcggcaacaccatcccaccgctggcggtgctggccatcgccctggcgatcatcggcatcggcaacggcccggcaatcctcgccctgttcctcgcctcgctgctgccgatcgtgcgcaacacctacgagggcctgcgcaatgtctcgccggcgctgaaggaagccgccaccggcatcggcatgacgcccaaccaggtgctgctgagggtggaactgccgaacgcggtgccgatcatcgtcggcggcgtgcgcgtggccctggcgctgaacgtcggctccgcgccgctggcgttcctgatcggcgccaacagcctgggcagcctgatcttccccggcatttacctgaacaaccaccagcaactgctgctcggcgccgcctgcacggcgctcctcgccctgctactggacgccctggtggtgctgttcagccgcatgttcctggaacgcggcctgaccgccaaggaggcctgatgaaccgactgatccgctcactctgcctggcctgcgccggcctgttcgccgccggcctggcgcaggcggaaaccctgcgcatcggcggcaagaccttcaccgagcagcgcatcctcaccgccatcaccgcgcagttcctgcagaagcgcggatacgacgtgacggtcaccaccggcctgggcagcaccctggcccgcgccgcccaggaaagcggccaactggatatcgtctgggagtacaccggctcgtcgctgatcgtctacaaccacatcgacgagaagctcgacgccgcggcttcctaccgccgggtcaagcaactcgacgaagcccagggcctggtctggctgaagccgacccgcttcaacaacacctatgccctggccatgcccgaggaacaggccgagcacctgggcatccagagcgtcagcgatctcgcgcgggtgctcgccgaacagcaggaggccgagcccgggagcacccacctgttcgccatggacccggagttcgccggccgccccgacggcctcggccccatgagcgagctgtacggcctgcacttcacccgcaacgacatccgccagatggacgccgggctggtctacaccgcgctgaagaaccgccaggtgttcctcggcctcgtctacaccaccgacggccgcctgaaggatttcaagctgcgcgtgctgaaggacgacaagcagtacttccccttctacaacgccgccccggtggtgcgtaaggaggtcatgcagcgccatccggagttcgccacgctgttcgatccgatcatcgagcggctcgacgacgccaccatgcaggcgctcaacgcgcgggtcgatatcgagcagcagacgccacagaaggtcgccgccgacttcctccgcgaacaccacctgctcgacgacggccaggccggccagggaggtagccagtaa

SEQ ID NO: 3609 - DNA, 1383 bp, Pseudomonas aeruginosa
tcgtgtcgccggccgaacaggtcggggcctaggccgccgggtggatattcaccgccggcagccgccaaccgcagcgtattcctggcgagtggcgccctcttccgccccgccgaaacgaaaaagcccggcatccgccgggcttctccctgccccttccactcaaccggcccgccccggcgcctgcgccgccgaggcctggtcgtcgcgcccttgcggcttgacgatcaccgtgcaggtgatccccgccgagagcagcacgccgtccggcacttcgtcgatgtgtacccgcaccggcacgcgctgggccaggcgcacccagttgaaagtggggttgacgtcggcggtcagctcgcggctttccgggttgtcgcggtcgtagatgccgcgggcgatgctttccacgtggcccttgaggtgttcgccgctcatcagctgcatgtccaccgggtcgccttcgcggatgtacggcagcttggtttcctcgaagtagccgtagacccagtaggagttcttgtcgatcaccgccatcttcgcctcgccgacccgcgcgtagtcgccacggtgcacgttgaggttggtaacgtacccgtcgacctgcgccaccacccgggtgcgctccaggttcaggcgcgcggcgtcgagctgggccttggcctgctcgtagtcggccatcgccgcggcggcggtgttgtgggcgtcgtcgcggctttcgcgggagaccaccatctcatccatttccgcgcgccgccgggcgttcaactggcgcatctccagggtcgccttgcgcgaggcaaccagcgactcggcctgcttcaccgcaatacggtagtggtcggggtcgatctgcatcagcaggtcgcctttcttcaccaactggttgtcgcgcaccgggacgtcgacgacgatcccggaaacgtcggcggcgacattgatcacgtcggcgcgcacgcgaccgtcacgggtccagggggtgtccatgtagttgacccacagggtccgcccgatgaatacggcgaccagcaggatcagcagggtcgccagcaggctgattacggatttcaaggtcatggtcggctcacgataacgaagaggtgcgctaccgcctcagcggtagatggtcagggacaggccgccgtacaggcaggcgaacaggctgacccggaacagcgccgggtgccaggtgaagcgatacaggccaaccgaggcgaagatccggtcgagcccccaggtgagcgccgcggcgatcacgaacaacagcgtcagggtcggcatgtagaccccatggatggcgatttcacgaggcatggacggtaccttggccgctcgtccggccggccagttcggtcagtggcgaggtcggcgcgagcagggaagaacggatga

SEQ ID NO: 3610 - DNA, 1605 bp, Pseudomonas aeruginosa
tggggtagaacgaagaacagcccgcggaaagcccaagccagccccgccggccatggtgccgatgcccatctgcatggcgaccttcttcgggttcggcgccgccgaagccagcgccgagaccgccaccgcgttgagggcgaaggtgccgccgctgggccaggtgctgtagatccagaaacagccgaacagcaggatcatcaacccggtgcgcatccccgccactgccgccgccaccgcgttggccttggcggtgaaggcgtccttccactgctcgcgctcgtggcggtgggcggccagcgaggcatgggtcagggcgtagtcgtgcatttcctcagcgaaacggtagagcagctcggcggcggtattgaagtccagccgcgcctcttcgcccggctcccgcgccagcagctcgccgcgcgcctggcggatacgcgccatcaggcgttcgcggcagtcggcgaggcgctgggcgaagcgctcggcgtcatggtcggtgacggcgcggccacggatctcctcgagcagcccggtgatttcctccaggcacggctcgaacgcatccagcacctgggtggagccctgcgcgcgcaagcgttcgagcaactggtggagggcgtggaaacgggtattcatggccatgaactcgctgctcaggcgaatcagccggccattgcgcaggcgcatgtgcggatcctcgaaggcgctcgccgcgcgcatcgtctccaggcccacggcctgggcggcgaaggccacgttgctgctttcgaagcgctcgcgcccgccgaccccgcgcaggctgtcgaggacgaacgcggcgaacaggccgaagcgcacgtacagcgcattgcgcatcgccgcgctggtggtctgcggcatgatcaccgcgctgaccacccccgagcagaggatcgccaggctgatttccaggacccgccagatcgcctgcatgaaggcgccttccggatggctggtggcggggatgccgatcagcgtcgcggtgtagccggcgagcacgcaggcgtaggagcggaagtcacggtagcgggcggccccggcggtgcagaggccgatccagatcgccgagctgagcaggaacagcactcgctcctgggcgaacagggcgatcagggtgaccatcacgctgaggccgaccagggtgccgaggatgcggtagaagctcttggcgaacacctggccgctctgcggctgcatgacgatgaacacggtgatggtcgccgtgctcggctgcggcaattccaggcgcatcgccagccagagggtcaggaaggccgcgcagagcaccttgaacacgtagatccaggtcgccccgtcgctgcgcgcccactcggccagcgcgcgccgccactcgtcgcggctgggcagggcgaaaccagcggagcggccactcatcgcgaagacaccgctctgaccgggacgttctccggcgccagcttccgctgcgccggcgtatcggcgccggccccgacgccgccgccgagggcggtgagcaggctggcgtgggcggccagccgggcggcctgcacctgctcctggaccagttgctgctggaacagccgggtctgcgcgttgagcacgttgaggtaa

SEQ ID NO: 3611 - DNA, 1026 bp, Pseudomonas aeruginosa
tgtgaaataatccgccctcgcaacaatctgacacacttctgcgcgtgcctaggaggccccgtcgatggacaccctgcaaaacatgcgagccttcgtctgcgtggcggaaaccggaagcttcaccgcggcgtcccagcagctcaacaccaccaccgcctatgtttcgcgggcggtggccaacctcgagacgcacctgcgcacccgcctgctcaaccgtaccactcgtcgcatcgccctcaccgaggccggccagcgctacctgctgcgctgcgagcagatcctcgcctacgtcgaggaagccgaggccgaagccagcgacgcccatgcccgacccgccggcaagctgaagctgcattcgatgaccggcatcggccagcactacgtgatccgcgccatcgccggctaccgccagcagtaccgcgacgtgaccttcgacctgaccatggccaaccgcgtgccggacctgctcgacgagggcttcgacgtggccatcgtggtggcctccgagctgcccgattccggcttcatttcccagcgcatcggcgagacctacagcattctttgcgcctcgccggagtacctgcgcctgaacggcacgccgagcgagccttcggagctggccagccacgactgcctgcgcctggtcagcccggtggtgccgctggatcgctggctgttcgacggtcccaacggccaggaaatggtctccatcggcgcctcgccgttccaggtcaatgtcggcgacgccatgaccgaggcaatccgctccggactgggcatcggcatcctgccggtgtattcggccatcgaggacctgggcaagggcaccctggtgcgggtcctgccgcaacaccgcctgcaacagctcaacgtctatgcgctgtacccttcgcggcagtatctcgacgcgaagatcaagacctgggtggaatacctcaaggaaagcctgcccggcctgctccagcgcgacgaagcggcgctggtggagctgggcctggaactcggaagaccctcctgagccgataa

SEQ ID NO: 3612 - DNA, 375 bp, Pseudomonas aeruginosa
ccctgccgcacatcggctcggccacccacgagacccgccgggccatggccgagcgggcgctgcagaacttcgaggcggccctgcgcggcgagcggccgctggacctggtcaatccgcaggtgtggcgacgcggctgagcgcgcctccctctccgctaggtcgagcgcgccggcccggccagcgccggcgccttcggcttgcggaacaccaagacgttgccgagcatcaccaggaccagcccggccagcgccggtgcggtccagcggtagccctcggcgaaggccgagatgttcagcgccaccaccgggaacagcacggtgcagtaggcggcgcgatccgggcccatgcgcccgaccagggtcaggtaggcggtga

SEQ ID NO: 3613 - DNA, 1029 bp, Pseudomonas aeruginosa
gcaggtacagcgaaagattcatggcgactccgcaacgacaggatgccgtcagtctgcgggcgaggccgggcgcgaccattgtccattcttgcgcttttcatccgccgcctctcgcggcagcgtccgggcgcgggtagcatggccggcatgcaccaacccagtgatttccaggtattccgcaccctcgaccggacctccaatgcgcgcctgctgcgcagcagcacgctcagcgacggcctggcgctcgcccattggtaccgcgacgaagcggagatcctcggctacagcgaccccggccatcacaccctgtcgctctacctgcagggcggctggcagaccttccgccgcgatcgtcccgggctctatggcggccccgaccgcttctgcgtgatgccggccgaacaccactccgactgggcggtgacacgcggcctgggcttcatgcacctgtacataagcccggaacgcctggccggcgcggcggtacgcaccctcgattgcgaaccacgcagcctgcaactggaggagcgcacctacatccaggacgagccgctggccgccctgtgccggaccctggaacgacaggactggaacgaacccggcgagcgcctgctatgcaccagcctcgcccaccaggcggtggaccacctgctgctcaccgggtgcggcaggcgtaccgacgtgcgctggcagggcgggctggccgcgcacgtgcggcggcgcctggccgactacatcgaaagccacttggagcagccgctggaactggggtcgctggcggagctggcggcgctctccgagtaccacttcgcgcgcatgttccgcgtctccttcggcctgccgccgcaccgctacgtgctggaacgacgcctggcgcgggcccgcgacctgctggcgtactccgcgcagccgctccaggaggtctcgctggcctgcggcttcgccagtccgagccatttcaaccggcgcttccgcgaagcccatggcgccaccccggggcagtaccgcgccgccctgaaaggctcctga

SEQ ID NO: 3614 - DNA, 1509 bp, Pseudomonas aeruginosa
aatgataactattatcattcgttaatccttctgctccgggaatgtccaggtgtcgagcgccgacctcgcccatgcggccgcgttgcataccctctacagcgaccaccaccactggctcacgggctggctgcggcgccgcctcggctgcccgcagaacgccgccgacctggcccaggacaccttcgtcaaggtcctggtttcgcgccaggccgcgcgcatcgacgaaccgcgcgccttcctcaccaccatcgcccgccgcgtgctgtgcaaccactaccgccgccaggacgtcgagcgcgcctacctggaagccctggccagcctgcccgagcgggaagtccccagcgaagagacccgcgccatcgtcctggagaccctggtcgagctggaccgtctgctcgacggtctgccgccgctggccaaggagaccttcctgctggcccaactcgacggcctgggctacgccgagatcgccacgcagctgggcatctccctgagcagcgtcaagcgctacatgctcaaggctgcgcaacgctgctacttcgccgagctgccatgagcctgcccgccgcacccaaggtgccgccgcaggtggctgaacaggccgtgcgctggctggtcgagctgcagggcggcgccgacgacgaacgcctgcgccaggcctggcagcgctggcgccaggcggccccggaacacgagcaggcctggcgccacatcgaggcggtcaaccagcgcctggccgggataggcacgccactggccctggccgccatcaacgcaccgcattcgccgcaacgccggcgcgcgctgaagaccctgctgctggtcctggccgccggcggcagcgcctggggcctgcgcgagagcggcagcctgcagcgctggagcgccgactatgccaccggcgtcggcgaacgccggcgcctggccctggccgacggcagtcgcctcgagctgaacagcgacacggcggtggatgtccgcttcgatgccggcgaacggcgcctgctcctgctgcgcggggaaatccagctcagcaccggccaggacccgcgcccgctgcacgtgtacagcgcggaaggccggctgcgaccggtgggcacccggttcgacgtgcgccagttcgccggacgcacccgcgtcgccgtccacgaaggcgcggtgcaggtggagaaccacgccggccagggcctgctgctgcccagcggccggcagctggacttcgaccgcgagcgactcggcgctccgcagccgctgccggtcggcagcggcgcctggaccgacggcatgctggtggccgccggcatgcgcctggacgaattcctcgccgaagtcgcgcgctaccgccccggccggctgggctgcgacccgcgcatcggcggcctgcggatttccggcagctatccgctggacgatagcgagcggatcctcgccaccctgccggcggtgctgcccgtggaggtacggcgcgtcacccgctactgggtcggcgtgcacccgcgcgaatga

SEQ ID NO: 3615 - DNA, 3297 bp, Pseudomonas aeruginosa
gcggaaagatatttccgcgcacctgagcctttttccccacctcgcgtgacagaggaggaaagccaacctcgaaagatccactggagtgtccctcatgtccccgtcacgcgccctgtcgccgctcagccgcgccctgctcctcgcctgcctcggcggtcccgtcctggtttccgccggcagcgcctgcgccgccgagatccgcaccgatacccgccagtactaccggctgcccgccgagccgctggagcaggcgctgaaccacctaggccgccaggccggcgtgctgatcgccttcagcccggaacagaccgccgcgcggcgcagccaggcgctggacggcgagtacaccctggaggaagccctggccgccctgctcgccggctccggcctggaggcgcgcgcccgcggcgacggcgcctataccctggaggcgctgccggtggaagacccggccaacctgcaggcgctcaccgtggtcggcgactggctggccgacgccagcgccgccgacgtcttcgagcatcccggtgcgcgcgacgtggtccgccgcgagcagttccaggcccaaggcgcggccagcacccgcgaagtgctggagcgcattcccggggtcagcgcgccgctcaacaacggcaccggcagccacgacctggcattgaacttcggcattcgcggcctcaacccgcgcctggcgtcgcgctcgacggtgctgatggacggtatcccggtgcccttcgccccctacggccagccacagttgtcgctggcgccggtgtccatcggcaacatggacgcggtggacgtggtccgcggcggcggcgcggtgcgctacgggccgcagaacgtcggcggcatcgtcaacttcgtgacccgggcgatccccgaggacttcgccaccaagctcgacgtgcacagcgaactcagccccagctccagccaggacggcctgaagaccacccacaacgtgctgatcggcggcaccggcgccaacggcctcggcggcgccctgctctactccggcacccgcggcggcgattggcgcgagcacagcgatacgcggatcgacgacctgatcctcaagggccgcttccagcccagcgacgaacacacgttttcggcgatgacccagtactacgacggcgaggccgacatgcccggcggcctcggcaccgcggcctaccgcgacgacccgtaccagtcgacccgtccctacgacaagttctggggccgccgtaccctggccagcgccagctacgaatacacccccaacgccagccagaagctcaacgtcaccggcttcttcaccaagaccctgcgcagcggctacctcgaccagggccgcaacctcaccctgtcgccgcgcgagtactgggtacgcggcctggaaacccgtttcagccagggcttcgagctgggcgaaagtcgccacgaagtgggcatcggccaccgctacgtcaacgaagccagccacgagctgcgctactggacccgcgccgacagcggccagctacccagcaccggcagccgcaacgaccgcgacacccgcggcagcaccgaagccaacgcgttctacatcgacgatcgcatcgacatcggcaattggaccatcacccccggcatccgctacgagaagatcgattccgaacagaagaacctgctgaagaacagcaaggacagcggccgctacaacgcctcgctgccggcgctcaacgtgatctaccacctcacgccgagctggaacctctacgccaacaccgagggctcgttcggcaccgtgcagtacagccagatgggcaaggcggtgcgcagcggcgacatcgagccggagaaggcccgcacctgggaactcggcagccgctacgacgacggcatcctgcgcgccgaactgggcgccttcctgatcaacttcgacaaccagtacgagagcaaccagcagaccgacagcgtgaccgcccgcggcaagacccggcacaagggcatcgaggcggcgatcgcctacgacctggccgatctcgacccgctgctctccggcttcgacgtctatgccagctacgcctacgtcgacgcgagcattcgcgaagacgggccgaacaagggcaaccaagtgccgttctcctcgaagcacaagggcacccttggcgccaactatcgcaccggcgcctggagctacaacctcgacggcagcttccagaccagccagtacgccgacaacgccaacaccgagagcgaaagcgccgacggcagcaccgggcggatcgccggctggatggtctggagcgcgcgcggcacctacgacttcggcccgcaactgaacgacctctagctcggcctgggggtgaagaacctgttcgatcgccgctactacacccgctcgttcgacgacaacaacaagggcctctacgtcggccagccgcgcaccctgtacgtacaggcctcggtcggtttctgaagaaagaccgcgggagcgcatggcgcaacggcggacgatcgccagcgatcatccgccccccccgccgccgggcctggttaccctcaggcccggcgtcacttccagttcggatcgctctccaactgtttcatcagcagctcgcggacctgcctggagggttcgccgtaccagcgataggtggcgtacttgctcggcgtctgcatgacttcggcgggctcgtccggcaggctcacctgcagcccgtaggcggcactcttgtcgccgcggaacgccaccagcaggcggttgttgccgcaatcgtggggtttgcaactgttggccaggacgtagggctggccctccaggctcaggctggtggacggggaactcgggccgctggcgtcggaaacccatttcggcacgtcgctctcgcccttgaacatggcatgccaggtggccttgtagccgggctggccgagcagttcgaacagccgcggctgctcctcggcctgcgccggcgcccagtgcagcgccgcgcccagcaacgccagggagagcagtctggatactccgttcatggtgatttccttcgatcgggtgaaatgaaagcagtctatccggcggtggccgccgctggctgcttggaacggcacgactgcgacaagttcgctgtccaccggcaattccatcgatcgccggatgacaggcatcccgacgcgccgcgttttaccgctataatcccgcgtttttccgggccgtcccgcgcccacgccaacggattccagcaggcacgcatccatgaccactcaggccgccgaagtcgcgaagcgccgtaccttcgcgatcatttcccaccccgacgccggtaa

SEQ ID NO: 3616 - DNA, 1581 bp, Pseudomonas aeruginosa
gaccaccatcaccgagaagctcctgctgatgggcaaggcgatcgccgtcgccggtaccgtgaagtcgcgcaagtccgaccgccacgccacgtccgactggatggagatggaaaagcagcgcggcatctccatcaccacctcggtgatgcagttcccctaccgcgagcacatgatcaacctgctcgacacccccggccacgaagacttctccgaagacacctaccgcaccctgaccgcggtggactcggcgctgatggtgctcgacggcggcaagggcgtcgaaccgcggaccatcgccctgatggaagtctgccggctgcgcgacacgcccatcgtcagcttcatcaacaagctcgaccgcgacatccgcgaccccatcgagctgctcgacgagatcgaggcggtgctgaagatcaaggccgcgccgatcacctggccgatcggctgctacaaggacttcaagggcgtctaccacctggccgacgacaggatcatcgtctacgtccccggccacggccacgagcgcatcgagaccaaggtcatcgaaaagctcgactccgacgaagcccgcgcccacctcggcgatctctacgacaatttcgtcgaggagctggagctggtgcagggcgcctgccacgaattcgacaaggacgccttcctcaagggcgagatgaccccggtgttcttcggcaccgcgctgggcaacttcggcgtcgaccaggtcctcgactgcatcgtcgactgggcgccgcagccgctgtcgcgcgccacccacgaacgcagcgtggagccgaccgaggagaagttctccggcttcgtgttcaagatccaggcgaacatggatcccaagcaccgcgaccgcatcgccttcatgcgcatctgctcgggcaagtacgagaaaggcatgaagatgcgccacgtgcgcctgggcaaggacgtgaagatcgccgacgcgctgaccttcttctcctccgagcgcgagcaactggaagaggcctatgccggcgacatcatcggcctgcacaaccacggcaccatccagatcggcgacaccttcagcgaaggcgagaacttcggtttcaccggcatcccgcacttcgccccggaactgttccgccgcgtgcgcctgaaagacccgctgaaatccaagcagttgcgccagggcctgcaggaactggccgaggaaggtgcgacccaggtgttcttccccgagcgcaacaacgacatcatcctcggtgcggtgggcgtactgcagttcgacgtggtcgccagccgcctgaaggaggaatacaaggtcgagtgcgcctacgaggcgatcaacgtctggtcggcacgctggatcgagtgcgacgacgagaagaagctcaaggagttcaaggacaaggccttcgagaacctctccgtggacggcggcgggcacctcacctacctggcaccgacccgcgtcaacctcagcctgatggaagaacgctggccggacatccgcttccgcgcgacgcgcgagcatcactgatcgcacgggaggagccaggaacagcctccctgtctcctcccgcggcggtctcggcgcagggcggataa

SEQ ID NO: 3617 - DNA, 717 bp, Pseudomonas aeruginosa
ccgggaaacggagcggaccgccgatgcttgaactggatgccggccaactggatcgcctgcagcgggtccgcgacgacgaagtcatcgagcgggtcctgctggaggtacgccgggaggctcccgcctggctcgaacgacgcggcctgctgcccgccatccggcaactcggcgagctgcgcgcgacggcgctggaactgggtatcgaagagcccgggacgatcgaacgctttcttctgcacggcctggccttccccgctttccaggacacgccggcgtttctcgcacacatgcgccggccgctggcggacagcccggaacaacgcttccaggactacgaacggatcgtcgagtttcgcctggccagccagaaatggcgcgcgtacgaaacctcggggagaccggcatgagcggcataggcgcgcttttccgaccgctgccccgcatgggtccgcggctgcccttcgaactacccgcgccgccccggccgcacttgccgatgccggcgccgcgcccgctgccgcgaccggcccccggcgcgctgcccaggccggtaccgcgtccgatgccggttccgcagcccctgcccaggaccgagaccggcacgctgagccgcgaccggacccgggaagccgagcgcgattgcagcaagagccagggccgcgacaaggactgcgtggagtgcccgccgtcccggggcgaaatggccatcgccaataa

SEQ ID NO: 3618 - DNA, 1188 bp, Pseudomonas aeruginosa
cggcaagggccacagcatgtcggacctgtccgcgcgctaccagcagtgggtgaccaatttcccgtttccccacgaatggttctggagcggcacctggtgggacggcttcgacgagccgcgctgcaccctgctggaggcgaaggccaactacgccttcctgttcgtcccgctgctcggcgtgcccaggccctgggcgcgggccaaggtgaagtcggacctgctgcagaaggccgaggttcacagcgacaaggcccgaccgaccccgccggtgttcgtcgaatggcacttcctgcagcggatcgtctacgagtactgcgccgcggagtacctgcgcatgggactggccaacctgaaggcattctggaatccgatgccgggaacggacgagcacgacgactaccaggaaacccgcgcgaaggaacaggaagagatgaaaaggttttgcgaagagaacccggggtattgcgcatgacggacgccaaggctttcaggcgctacatattcgagctgtacttcgatccggcacggctcctcgcactggacgacgaccagcacctgcaacggatagagcgcttcctcgatgccctcgcgcccctccatccggtgctggagaactggtacctgtgcggcgactccctgcgcgatgccctcagccacaacgtcaccgagcaccgccaggatctcgccaaggccctgtcgcgtgaccgacgcacccgggcggtggaactggtgctatggaacggcgaggaggatccgctcaagggcgggttgtcgctggactacgaggccagcggcagggccgtctcgtccaggctccagttggaagatgccggcagcctgctgcaggtgttcgacgcaccggcgtcctccttcgtcgcgatcttcctcgcggcgctggaaatctggcccgaaacgacctggggcatgctcgctccgcatgcgtacttcgtacaccagcggaccttcccggaccgccgcagcatcggctggatcggcttctgcccgcatccgctaagggccacggacttcccggcggctacggagctggtcgacattcccggccgtggcaccctgctgctgaacggccgcgaaccgatggacgaaacccgtcgcgaacatttcgagcgcgtcggcgaagcggacatcaagctgatggaactgggctacctgccgccgctgcgcggctga

SEQ ID NO: 3619 - DNA, 411 bp, Pseudomonas aeruginosa
cgtcgctgccgttgccgccgtcgtagacgaagatgccttcggaggtcgccgggtcgccgtccaccgtggcatcttcctgctgcacgtagaagcccttcagctcgctggcgttctggaagtcgccgaccaccacgccctcgatggcgacccgctggttcaccagcggactttcggcgccggcgccctgcacctcgtggatcggtcgcaggccggcctcctcgccgccgccgggctcgccagcgccatgctggccgaggttggcgaaggtgtcgcgcgggtagcccagccattgcgccgccgggtcgaaggcgtcgctgggatcgctgtcgccgtcgcggatgtcggccttgcgcaccaggctccggtcgagggtctgcacatcgccgctgccccaggtcgtgccggggttga

SEQ ID NO: 3620 - DNA, 528 bp, Pseudomonas aeruginosa
ggccggcgaaatggcgggcgttggtgtcgtcgcggaaaccgacgtagatggcatcggcgccctgtcgcagggccgacttcaaggcgggcaggctgcccgccggacagaccagttgcatggggttgctcctctggcgaaaaacgcgctccgcggcagtgggcaaccccggggcacaggcgccacactctagaaagacgctcccggtcggcgcttgaccgggatcaagaaggcctcaggccatcagtgcggagaacggcagaaagtcgatcgcatcacccacgcccagggtggcgccgcgctcgatcaccgccagcccgtccgcccaactggcggcaagcagcatcgccgagccctgctgcgggtggatttccacccgcccccgttcatcgagccgcgcccgcaggtactggcgacgcgcccgcggttgcggccagtcgaaggccgccggcagcgccagcggccgcggcactacgtcgaacagtccctgctggcgaagcaggaacggacgcgccaccagcaatgcggtga

SEQ ID NO: 3621 - DNA, 411 bp, Pseudomonas aeruginosa
gcgcatcgcggctggccaccagttcgtcggcgagcacttcctcgtcgtgcacctcgaagcccagaccgcgcagcaaggcgccgatgcagtaacggttggcgttgtagatctgcccggccaacagtgtctggccgggctcgcgcaattcgtcgccgctgctcagcaggccgatgcgcaagcgccgacgcaccgagaccgtggcgacgccgagactcgccagcaggccgagttcctgcgggcgcaagcgctgtccggcacgcagcaccggcgcgccacgacgcaactcctcgccgcgccggcgcacatgctggccggcgctcaccggcggcaactgcacgcgctcgccgtcgaccacgcagagttcctgcggcaccacgcagtcggcgccggtcggcagcggcgcgccggtga

SEQ ID NO: 3622 - DNA, 1083 bp, Pseudomonas aeruginosa
agatccgcgccgcctggcccagcggcaggctcatgccgcgggtgtcgccggcggcgatccgcgcgccgaccgtcaggctgccgccgctgcgcggcaggtcggcggagcacaaggcgtagccgtccatcgcgctgttgtcccaatgcggcaggtccatcggcgccagcaggtcctcgccgagcactcgtcccagcgcccgctccagggccaggctctcgcaggctggcgggcgcggcgcgcgcgccagcagttcggccagcgcctcgtcgagcgggcgcagttggccgccatcgcaggcgcaagcgctcacgagcggcacccgcagccggccaccggcgccacggctggcggggtcttcaggtgcgggacgaaattgcacgggcgggtgcggctgtccagttgcgccaggagaatctcgttccaggcggtgcgacaggcgcccggcgagccgggcaggcagcacaccagggtaccgttgctgagcccggccagcgcccgcgactggatggtggaagtgccgatctcgcgctgcgagacctggcggaacagttcgccgaagccctcgacatcgcgctcgaacagcggcccgaccgcctgcggggtgttgtcccgcgcggtgaagccggtgccgccggtgatcaggccgacctgtacctcggggtcggcgatccaggccgagaccaccgcgcggatctggtagatgtcatcggtcttcaggctccgctggtgcaggcgatgaccggcggccagcagcgcgtcggcgagggtctggccggaagtatcggtttccagggtacgggtgtcgctgacggtgaggatggcgatgttcagcggctggaaggtggaggtggccaggtggctcatggaaggggtcctaggaacgggcgatgcctcagcctgaaccgcgggcccccggctggctattcctccgaagaggtaagccggcggcgcgaggaggtagacgtcactcctcccagcgctgcgcggcggcctggtcgctgcagcggccttcgacccagcgcgggccttcggcggtgtcttccttcttccagaacggcgcgcgggtcttcaggtagtccatga

SEQ ID NO: 3623 - DNA, 1710 bp, Pseudomonas aeruginosa
ggcaggccggcgcaaggcgcctcatcccgatcgggtaacgatgcgggcccggtccccggaccgggcctggcaggatgtatatcccgcccggctttttcaaccgggcgggatatcggccggcgattgccgccggctacctcacatgtgcgcctcggcgtactccgccagcaccgagcgcggcaccccttgcagggtcacgtgcacgccgtgggggaagtccttgaagcgttcggtgaggtaggtcaggccggagctggtggcggacaggtagggcgtgtcgatctgcgccaggttgcccaggcagatcaccttcgaaccgctgccggcgcgggtgatgatggtcttcatctggtgcggcgtgaggttctggcattcgtcgatgaggatcaggctctgctggaagctgcgcccgcggatgtagttcagcgacttgaactgcaacggcaccttgctgaggatgtagtcgacgctgccatgggtgcattcgtcgtccatgtgcagcgcttcgaggttgtcggtgatggcgccgagccagggctccatcttttccgcctcggtgccgggcaggaagccgatgtcctcgtccaggccctgcacgctgcgggtggcgatgatgcgccggtagcgcttgctgaccatggtctgctcgatggccgcggcgagcgccaggatggtcttgccggaaccggcggcaccggacaggttgaccaggtggatgtccgggtcgagcagcgcgtacagcgccagcgactggtacacgtcgcgtggccgcaggccccaggcttcctggtgcaggagcggctcctggtgcaggtcgaggatggtcagctcgtcctgctggatgcccttgatccagccgacgaagccctgttcgtcgacgatgaactcgttgatgtgcaccgccggcaggttgtcggtgagctgcacgcgatgccaggtacggccgtggtcctggcgggtctcgaccttgctcacgcggtcccagaaagagccggcgagggaatggtagccgcgcgacagcagggccacgtcgtcgatcaactggtcggtgtggtagtcctccgcgtccaccccgcaggcgcgcgccttcaggcgcatgttgatgtccttggtcaccagcaccacgcgcacgccgctgtggcggctcttcagctcgaccaactggttgatgatcttgttgtcgttgaggtgctccggcagccaggtgatgggctcggcacgcttgctcatgaggatcgacaggctgccgctggggccgttcttgccacgctggatcggtacccctccctctacctgctcgggcgtggcctcgccgagtacctggtcgatcaggcggatggcctggcggcactcggcggcgatggtgtgctttccggtcttcagcttgtccagctcttcgagcaccgtcatcgggatcgcgacgcggtgttcctggaagttcaacagggcattcggatcgtggatcaggacattggtatcgaggacgtacagggtgggctgggtggggcgggaacgtccgtggtcatccatacgcgatcaccttctgctaagggcctggcgacggaatgccgggtcggcgctccgccggggggcgagccgccttctctcttccggtggggagagcctgacagcagaggtgagggccggggccgccacctgtgctgcagggttcggcggtctacggttccacaaataccgcaaaaaatatga

SEQ ID NO: 3624 - DNA, 1092 bp, Pseudomonas aeruginosa
acctggcgacagatctcaccggcgcctcccagggcgcctgcgatgccacttctgtccattccaaggaggactcatgaacagcgccacgctaaccgagctcgatctgccggtcagcggcatgacttgcgcgtcctgcgccggccgtgtcgaacgagccctgaagaaagtgcccggggtcgcggccgcctcggtcaacctggccagcgagcaggcccgcgtacaggccccggcggacagcctgccggccctggtggcggcggtcgagcaggccggctaccaggttccggcgcgcagcctggaactgtccatcgagggcatgacctgcgccagttgcgtcggccgggtcgagcgggcgctgaagaaggtgcccggcgtacgcgaggtcagcgtcaacctggccagcgagcgcgcccacctcgagctgctcggcgccgtggacagccaggccttgctacaggcggtggaacaggccggctacaaggcccgcctgctcgacgcggggcaaccacgccaggacgatgccgagcgccgcctgcgccgcgaacgctggtgggtgatcgccgcgctgttgctggcgttgccgctggtgctgccgatgctggtggaatgggccggcctgcactggatgctgccgccgtgggcgcagttcctcctggcgaccccggtgcagttcgtcatcggcgcgcgcttctatgtctccgcctggcgcgcggtgaaggccggtgccggcaacatggacctgctggtcgccctcggcaccagcgccggctacggcctcagcgtctacctctggctgaccgccccgcctggccacatgccgcacctctacttcgaagcctccaccgtggtgatcgccctgatcctcctcggcaagtacctggaaagccgcgccaagcgccagaccgccagcgccatccgcgccctctaggccgttgcgcccggagcgcgcggtgcgcctgcgcgacggtcgcgaggaagaggtggcgatcgccgagttgcgcttcggcgacgaggtggtggtgcgtcccggcgaacgcttcccggtggacggcgaggtgctcgacggcagcagccacgccgacgaggcgctga

SEQ ID NO: 3625 - DNA, 1650 bp, Pseudomonas aeruginosa
ccagacgccggccagttcggtctggccctgggccagccagagttcgcacttgatcagggtgatcgccgccaggtagtagatcggcgggatatcccaggcatgcatcaaccgctcgacgtcgccaagccgggcgaacgccgccgcgtagttgcccaggcgcccttccaggctggccaggacgcaatagccgatcaccaggctgacatcccggcagctgcgggtttcctcgattccctgcttgatccacttgcgcgcttcgtccggctgcagcgccaggctgcgcaggtagccgcggtacagcaggagccgcccgcgcaccgcgtagcggcgttgcgccggcaggtgctggaggcgttccaggccctggcgcacctcctcctcggcgcgcgccacctcgccgcgcgcctggaggacgcgggcgcggtcgtaatggaccagtgcctcgaacagcgggttgccgtagcgctgggcgaactccagggcgtcgcggttgtagttgcgcgcctgccagaagtcgccacgggtcaccgccaggttgctcagcgtcgacaggcattgcaggcgggtgccatagcgctccccggcgaggtcctgcaaggcctcgcggcagtgcgcctcggccttgtcgatatcgccgcggccgcgcgcgatcaccccgctcagggcctgccactgggccagcaggtcgcgctgcgcggactcgtccggcgccggcaggaaacgcgccagttggccggccagttcttccgcggcatccagctggcaggccagcgccagcgcccagccgtacagcaggatcaggcgcggcgtgctcgccaggaggctgtccggcaggtccatcttccagcgcagcagggtggcgatgttctgctccgccagcagttgctcttccgacaggttctgcaccaggctcgccgccacgtccggctggccggcgcgcagcgcctgctccaccgcctggtcgagcaggccatggcggctgaaccagccgcaggcgcgcaggtgcagggagccggcggacggaccgaagtcgggcaagggacgcgccagcagcaggtcggagaacaggtggtggtagcggaaccactggccgttttcgtccagcggcacgaggaagacctggtgctgctgcaggtggtcgaggatcgccgcgctgtcgccggcctcgcgcacggtatcgcagagctcggcgcagaagcgctcgaagcgcgcggtctgggcgaggaacgcctggacctcgggcggctgccgctcgatcacctcctccagcaggtagtcgcggatcagttcgtcggcgccgtgtaccccggggctgacctgctcctctggatcgccgcgcgccagcagccagaggcgcagcccggcgacccagccttcgctgcgctcgagcagcgcgtccagcgcgtcctcgtcgagttcgaggccgctggcggccatcagcgccccgctctcctcggcggtcaggcgcaggtcctgttcgctgagttcgagcaattgccgcgacaggcgcaggcgcgccaggtgccagtccggccgctgccggctggtgaccagcagcaccaggccctcgggcaggtgattgaggaggaattgcaggcaacggtcgagcaccgcgccctgggccaggtggtaatcgtccagcaccagtag

SEQ ID NO: 3626 - DNA, 1887 bp, Pseudomonas aeruginosa
ccgggcggtcgcgaaaacgcggagaccaagcgtttgcttggcctccgggcgtttcagcggtgtaggaaagccccgtcagacggtcgacaggaaggcgctgccggcttcctgccactgggcgatctcgatacggatgcgcttcttgtccagcttgccgacgctggtcttgggaatatcggtaacaaccgcgatctgcgaggggatcgcccacttgttgatgttgccctgctcgacgaaaggcttgaggtgctccttcaggccacgggcgtccagttgctggccctcgcgcaccaccagcagggcgaacgggcgctcgccccattgcggatcgggcaccccgaccaccgccacttcgcgtaccgccggatggcggctgatcaggtcttccagctccagggaggacagccactcgccgccggtcttgatcacgtccttgatgcggtcgcggatctcgatgaagcccatgccgtccagggtcgccacgtcgccggtgtgcatccagccgccgcgccacaactcctcgccgcgctcgggttcgcggaaatacccctgggtcagccatggcgagcgcaacaccagctcgccctgggattcgccgtcggccgggaggaagcggccctgttcgtccatgatcgccgcatccaccagcggcaccggcacgccggccttgatccggtaggtggtgcgctcgtcctcgcttccggccagcagttcgtcgttgaggtaggcgcaggaaatcagcggacaggtctccgacatgccgtaggcggcggtcagctggatgccgcgcgccttggccgcctcgtagagcgagcggttcagcgcgctcccgccgatgatcaccttccagcccttgaagtccacgccctgggcagccctggcgttcatcaccatctgcaggatggtcggcacgcagtgggagaaggtgaccttctcgcgcttccacagttcgaccagcagttccggatcgtaacgcccgggatagacctgcttgaccccgagcatggtcgccacgtacggagtgccccaggcgtggacatggaacatcggggtgatcggcatgtacacgtcgctggtaccgagcaggcggatgctgtccaggctgccgatggtcgaagccatcgccagggtgtgcaggaccagttgccggtggctgaaatacacacctttcggattgccggtggtgccggtggtgtagaaggtggtggcgatggagttctcgtcgaaatcggggaagtcgtagcgcgggctggccgcggccagcagcgactcgtattcgccgaccaggccgggcagttccgcgctcttctccgcgccgtcggtgagcaggatggtccgctccaccgtggccaactgccccgccaccgcctggtagagcgggacgaactcgctgttcaccagcacgaagcgatcctcggcgtggttcatggtgtagaggatctgctccggggagaggcggatattgatggtatgcagcaccgccccgatcatcgggatggcgaacatgcattccaggtagcgatggctgtcccagtccatcaccgccaccgtgtcgccggccttcaccccggcctcgctgagtacgttggccaggcgcgcgacgcgctcgttgaaggtggcgtagctgtagcgcacctggtcgcggtagacgatttcatgactcttttcgtaacgacggccggaaagcatcaggctcttgatcagcaacggatactgataagcgccggcggcggccgggatgagacgggtcttcagcatggggcgtacacctgggagcgggttcgttgtcaggatgaggccgactctagagccgtcggcgggctttgttcatcagtcaaaagagtgatttgccccgtgacctttcggagcctcccggtcacaagatag

SEQ ID NO: 3627 - DNA, 1239 bp, Pseudomonas aeruginosa
aatccgcccactgaatcgttcagaccctatccagaacaagaggtaacgttccatgtccgatatcgtcatcgtcgccggcgcccgtactcccatgggcggcttccagggcagcctggccggcgtttccgcggtcgacctgggtgccgtcgtgatccgcgaagcggtgcagcgcgccggcatcgccgccgaggacgtacaggaagtgatcatgggttgcgtcctgcccgccggcctgaagcagggcccggcccgccaggccgcgctggcggccggcctgcccgccgccaccggctgcaccaccatcaacaagctgtgcggctcggggatgaaggcggtgatgctggcccacgacctgctcaaggctggcaccaaccaggtgatggtcgccggtggcatggaaagcatgtccaacgcgccctatgtcctggagaaagcccgcagcggcctgcgcatgggccacggcgagatcaaggaccacatgttcctcgacggcctggaggacgcccgtaccggccgtttgatgggttcgttcgcccaggagaccgccgacaagtacggcgtgacccgcgaggagatggacgcctatgccatcgaatcgctcaagcgcgcccaggccgccatcgccgatggctcgctggcggcggaaatcgtcccggtcaccgtcaccagccgcaagggcgagagcgtggtgaaggacgacgagcaaccgctgaccgccaacctggagaagatcccgagcctcaggccggcgttccgcaaggacggtaccatcaccgccgccaatgccagctcgatctccgacggcgcctccgcgctggtcctgatgaccgccgaggaagcccagcgccgtggcctgaagccgctggcgcgaatcgtcggccatgccacccagagccaggacccgagcgagttcaccctggcgccgatcggcgcgatgaccaacctgttcgccaggaccggctggagcaaggacgacgtcgacctgttcgagatcaacgaagccttcgccatggtcaccatgctcgccatgcgcgaacacggcctcgatcatgccaaggtcaatgtctatggcggcgcctgcgcccagggccatccggtcggttccaccggctcgcggatcatcctcaccctgatcaacgccctgcgccagaaaggcggcaagcgcggcgtcgcctcgctgtgcatcggcggcggcgaagccaccgccgtggcgctcgaactgctctgatacggcgttga

SEQ ID NO: 3628 - DNA, 1287 bp, Pseudomonas aeruginosa
gccatcggcgcccggccggctcgcgctgtccgggcgccctcttcctcaggtgcccaccgcggcgctgcgcgccggacgcggaaacaccagcgccgcggcgaaggtcagcgcggcgaagcccgccagtaccaggtacaaccccagcagcccctgccgtggctccaggtaggcgatcatcgggatcgccgccgcgctggcgccgaacgacaggaaatagcgcagggcgaagacccgcgcctgccactgcggcgcgacgaagtgggcgaccatcgcatcgttcaccgtcacctggccgaacaccgcgaacatgaacagcgcgccgaacagcaccactgcgctgccgtggccgtaggccagggccagcagcagcggcacctggcagaaggtgaggaagacgaacggcaacttcaggttcaggcgatcgatcaggcggcccatgatcagttgcgctaccgcgccgaaggcataggccaggctgaccaccacgccgagggtctgcggcgacgccagcaagtcgctcaggcgctcctggaacagcttcgggtaggtcacggtgctggcgttgaacaccaccccgccggtggcggtgaccagcgccagcacgccgaacacccggcgcatcgacaggccctcgctgtcctcgccacgcgccgcggccttggccgacaggtgcggcgatggctcctcgcgcacgcagaagaaaaagccgatgccgagcaggatggccaccccgccgggcaagatgaacgccgcacgccaaccgaagtgcgcggtgagaaagccggtaagcagcgcggcgaaggcgaccccgaggttaccccacatgccgttgatgccgatctcgcggccgcggttctccgcgtgtgccaccagcatcgcggtgccaaccgggtggtagatcgcggcgaataccccgatcagggtcagcccggtcaccagcatcggtacgctgccggccagcccggtgagcagtgcggcggcgccgataccgaagaagaacaacagcatcatccgccgccggctccaggtatcgcccagccagccggccggcagcgaacaggcgccgaaggcgatgaaaccgcccagcgacaggccgatcagaccggcgtagtcgaggtcgaagctgccggccatgccgagcacggcggcggggaagatcagcatgaacatgtggtcgatgacatgcgcggcgttgatgaagcggataacggttcgaggtcggttcatggcgtgcggcctgaatggtcggtgaggaatgggcgtcatgacccgggcatgataggttga

SEQ ID NO: 3629 - DNA, 816 bp, Pseudomonas aeruginosa
acgcagcggcggacatcgccctacaaggatcgaagaatgaaaaaactgctcctgctgactgccctggcctccgtcatcagcgtttccgccaacgcagcggaaaagctcctcgtcgccgccacgccgatcccccacgcggaaatcctcgagctgatcaagccgaccctggcgaaggaaggcgtcgacctgcagatcaaggtgttcaccgactacgtgcagcccaacgtgcaggtcgccgagaagcgcctggacgccaactacttccagaccctgccgtacctggagaacttcaacaaaggcaagggcaccaacctggtcaccgtggtcggcgtacacgtcgagcccttcggtggttattcgaggaaatacaagtcgctggccgagttgcccgacggcgccaccgtcgccattcccaacgaaggcagcaacagcgggcgcgccctgctgctgttgcagaaggccggcctgctcaagttgaaggatccgaacaacgccctggccacgcccaaggacatcgccgagaacccgaagaacctgaaattcaaggaactcgaatcggccctgctgccgcgcgtgctggaccaggtcgacctggacctgatcaacaccaactacgcgctggaggccaagctcaacccggccaaggacgcgctggtcctggaagaccacgattcgccctatgtgaactacctggtggcgcgtcctgacaacaaggacagcgacgccctgaagaagctttccgccgcgctgaccagcccggaagtgaaagccttcatcgagaagaaatatgccggcgcggtggtcccggccttctga

SEQ ID NO: 3630 - DNA, 1149 bp, Pseudomonas aeruginosa
ccccagcccgtcccgactcccacgctgggcgccgttgcagcgccccttgttcacgccggtgtcgcatggcttgcaccggcgtttctttttccgcaacggcccccgcccgcagccgttccggccgtcgtcgcggcgcaggcgctggaggcgccccgtgccgccaaggagttacccatgagcgagaaaccacgccccgcgccgctgaccttccccgacgccgaccgcagtccgctgagcatccgcgccaaggccctggtgttcttcgacccacgctcgcaccgggtccgcgaagaactcgagcgcctcgcgccacagggccagccggtgctgatcgaaggcgagaccggcaccggcaaggagctgctcgcccggcagatccaccgccacagcgaacgcgccggtctgttcgtcgcggtcagttgcagcgccctcagtcgcaaccatgccgaagccgagctgttcggctacgctcccggcgcccataacggcccggtcggcagccgcgccggctggttcggttcggccaatggcggcaccctgtacctggacgagatcgccgacctgccgctgacgctgcaggccaggctgctacagacgctggaggaacgcgaggtgctgcgggtcggcgcgcagcagccgattccccatgacgtgcgcctggtcaccgccaccagcgtcgacctggaccaggcggtgcgcgccggcaagttcctagccggcctgcagcagtacctgcacgacggccgcctgagcctgccgccattgcgcgaacgtccgggagacatcctgccgctggcggaatacttcatcggcgtctatgcccagcgcctggacctgccggtgccggccatcggcgtggaaacccagcgggtcctcgagagctatccctggccaggcaacatccgcgagctggaaaacgtcgtccacttcgccctgctggtcagcgacaaggaagaaatcctgccgcagcatctgaattttggcggggcaacgccagacccatcgctggccggtctgcggcgcctgctcggccaagccggagcgccgtcgctggagcaggtacaggccctgctcctgcaactggccaccgagcaggcaggcggcgacgaggaggcgggaaggcggcgcctgggactggcggcgaactga

SEQ ID NO: 3631 - DNA, 2037 bp, Pseudomonas aeruginosa
ggacgaggagaccagcctgttttgactgacgcacaatcgccctccgccaccccctccacccccacgcccatccgcatgaatcccccggtgttctacggtgcggcgatcctgatcctgctgttcgccgcagtggtcatcggcttcccccagcgcgccggcgaatggctgctggccgcgcagacctgggcctcgcagaccgtcggctggtactacctgctggcgatgacgctgtacctgatcttcgtggtggtcaccgcgctttccggctacggcaagatcaagctcggtgccgaccacgacgagccggaattcagctacctgtcctgggccggcatgctgttcgccgccggcatcagcatcaccctgttcttcttctgcgtatccgaaccactgacccacttcctccagccgccgcaaggcgaggccggtacccaggaagccgcgcggcaggccatggaactgctgttcctgcactggggcctgcacggctggggcgtattcgccctggtggcgatggcgctggcctacttcgcctaccgccacaacctgccgctggccctgcgctcggcgctctacccgttgatcggcaagcgcatcaacgggccgatcggctacacggtggactgcttcggcatcatcgccacggtgttcggcctcggcgccgacatgggcttcggcgtgctccagctcaactccgggctggactacctgtacgccatcccgcatacccacccggtgcagatggcgctcatcgtgttgatgatgggcgcggcgatctcggtggcggtctccggggtcgacaagggcatccgcatcctctccgacatcaacatgctgctggcttgcagcctgttgctgttcgtgctgttcgccggtccgacccagcacctgctcaacaccctggtgcagaacgtcggcgactacctcggccacctgccgggcaagagcttcgacctctacgcctacggcggccccagcgactggctgggctcgtggacggtgttctactgggcctggtggatcgcctgggcgcccttcgtcggcctgttcatcgcgcgcatctcgcgcggccggacgatccgcgaattcgtcttcggcgtgctgttcatcccgctcggcttcaccctggcgtggatgtcgatcttcggcaacagcgccctggagcaggccctcggcggcgccagcgaactcggccgggtggccatcgagcagccgtcgatggccctctaccagatgctccagaactacccctggagccgcgcggtgatcaccgtcacggtgctggtcagcttcgtcttcttcgtcacctcggcggactccggcaccgtggtcctctccaccctctccgcccacggcggcagcgccgacgacgacgggccgaagtggctgcgggtgttctggggctcggtcaccgcgctggtcaccggcgggctgctgttcgccggcagcatcgacgcgctgaagtcggcggtggtgctgacctccctgcccttctcgctgatcctgctattgatgatgtggggcctgcacaaggccttctacatggagtcgcagcgccagcgggcgcggagccactccctggcgccgctgatgagcggcaacggcaagcgctccggcggctggaagcgacgcctgtcgcaggccgtgcacttcccctcgcgggacgaggtgtaccgcttcatgaacgacgtggtgcgcccggcgatcagcgaggtttccgaggtgttccgcgagaagggcctggcggtggacgcccagctcgacccgggcaacgcctcgctgagcctggagatcggtcatggcgagcagcatcggttcctctaccaggtgctgatgcgcggctacttcacgccgtccttcgcgcgtgccggcatgggcggcctgcacctgaagaatcgccgctacttccgtgccgaggtgcatctcgccgaaggtagccaggactacgatctgatgggctacaccaaggagcagatcatcaacgacatgctcgaccagtacgagcggcacctgcagttcctgcacctggtgcgttga

SEQ ID NO: 3632 - DNA, 1062 bp, Pseudomonas aeruginosa
  unsure (781),(820),(843),(913): Identity of nucleotide at the above locations are unknown.
aaactctcgaaacaattggacccgccaagcttaggcgagagcggcacgccgggacacgacagcgaatgtcgcagaggcgaccttttcgagagcaaaagctggcggaacgcacagttgccggcgcgggccgccggaggaagcccgcgcgcggcgtcgtcagaagggcttgtcgccgaggatggtggcgcgatgcatgacccgccgctgtggccggtaatcgtccaccgcgtagtgctgcgtcacgcggttgtcccagaacgccacgtcgttttcctgccagcgccagcgcacggtgaattcaggtcgcgtggcatgggcgaagaggaacttcagcagcgcatcgctctcggccggctccagttcgttgatgcgggtggtgaagccatcgctgacgaacaggcccttgcgcccggtgaccggatgggtgcgcaccaccggatgcgagcgcggcggattcttcaggcgggcctcctccaggcgcgccaggtcggcctcggtgacgccgaagcgctcgcgggggaaggacttgccgatgtcgtgggtcgccgtgaggccgtccagcagacgccgcagcggcgccgacagcgcctcgtaggccgccgtgctgctcgcccagagggtgtcgccgccgtacggcggcaattgcttggcggcgagcacggctcccagcgccggggtctcgaggaaggtcacgtcggtgtgccagatggcattgtcgcgcacgtcggtgaccgcggtgtcgaggacgatgacctccggctgctccggcacgctggggtanatcggatggatgtgcaggtcgccgaagcgggcggcgaancgcgcctggctcctgggttccancgactggtcgcggaagaacagcacctggtgttcgagcagggcctgctcgatggcccgctggccggtgtcntccagcggcgcgccgaggtcgatgccggaaacgatggcgcccagggccgggctgatgggttggatggtcaggctcatgtcgtgctactcgtcgggcaggttgcgggcgcgccctgcgcgccctcgctccggccttcgccgcgtgagtga

SEQ ID NO: 3633 - DNA, 1071 bp, Pseudomonas aeruginosa
gcgacggactgctcggcgtactcctggaggcccaccagttgcaggacctggcgcgcccgcgcggtgcgctcggccttgcccaggccacggatgcgcaggcccagggcgacgttgtcgagggcgttgagccagggcatcagggcgtcgtcctggaataccacgccgcgctcgccgccgggcccttcgagtgtccggccgtcgatctgcacgcgtccctggtccggcttctggaaaccggcaaggatgttcagcagtgtcgacttgccgcagcccgaaggacccagcaccaccagcgactcgcccttggccaggcccaggctgagatcgcggaggatggcgcggcgctggccgcgctgttcgaatgagaggctgatcgcctcggccgtcagacggctcatgtgttctgccctccgtagggtaagaaagcctccgctccgacaggccggagcggagtcgcggaattcagcgctggccgacctggacctgctccgcctggcgcacgaagtcggcgctgacgtagggcgagtagtcgccgaggacggccggcacgcgcttctgttccttgaggaattcggcagtgccggcgatagccttggcggtgccgccgccgagcaggtcggcggacagttgcgcctggctttccgggaaggtcgagccggccagcagttcggggacgtccctgggatcggcgccggtcagccgggcgatcttcttcaccggttcggagtcggcggtccattcggccttgtgcgcgttgtagtcggcgaaggaatcgaggctgacgcgggcgaagcgggcgacgatttcaggatgcttctcggcgaagtccttgcgcgccacccacacctcgaatgtcggcgcaccccactggccgacttcggcggcgtcggtgaggaccttgccgcttttcttgatctcgcccagcgccggcgaccagacgaaggccccgtcgatgtcgccgcgacgccaggcggcagcgatctcggccgggttgaggttgacgatcttcaccttggacggttcgatctgccagtgcttgagggcgccgagcaggctgtagtgggaggttga

SEQ ID NO: 3634 - DNA, 525 bp, Pseudomonas aeruginosa
tcgccgaccatcaccagctccgccggcgtcacgttccagcgtcgggcgatgcgcagcaagccatcagggtccggcttgggccgcgcctcgccgcgcccgaggatgtgctcggtggggaagcagccgcccaggccgatcgcttcgagggtgatcagcgccaactggtggtcgttgcgggtcaggatgcccaggcgcacgccgcgccgctgcaactcgcgcaccagttccagtgcgcccggcgccggccgcgcggcctcggccagggcgcgctcgtgttcgagcagccaggcgtgcttggccgccgcctcggcctcgggcagggcggcgaggtgcagcaggatgtcgtcctgctcggggatgtccagcgctcggcggatcgccgggaagtcgtgcacggcccgggtcagggtgccgtccatgtcgaacacccagtggcggatgtcggccagcctcacgcccagtcctcacgcttgcggatcaggccttcctggctcgacgaggcgaccagctggccgctctggttga

SEQ ID NO: 3635 - DNA, 519 bp, Pseudomonas aeruginosa
ccgcgaaaggcaccggcgagcgctccggcagcagcctgcgcagccaggcccgcagcagcccgacatcgatgccggcgcgcccgtccatgcgctgcgcgatacgccgccgatgcagcagcggtcgcagcggcaggccgggggttgtcgttgccgggctcgcccggtgcgaccctccacgggcgtgccggcaggcgcggcgcccgacatagcccatgtatccgctgcaactccggccagtcccggtactcccgcgacagccggttcggcgcgccggccaacggcagggccgccagtccttcgcacaggcgcggcgaaagggaaggctcctgcgtgagcgccggcccgatccagaacagtgcgtcgacgctctcgcactcggcgaagccgtcccggtcaaggccgaacaggccgtccagtgcgctttcggcgacgccgcgcagcaggcgcatctcccagccctggatcgccgcggcgatcgagaggcaggccagcgcgtggccgaggtcatgctggcagtag

SEQ ID NO: 3636 - DNA, 1491 bp, Pseudomonas aeruginosa
aaggtctgtgcggcagggccggcagttgtatggaaaggaaacgcgtccggcgcgaggcccggcgttcggctagaggcagccgaggccagggcggcggcgtcaggatccggagcaatagtcgagaaagtgctgttccggcatcggccgggcgaacaggtagccctgggctatggagcaaccgagttcgatcaggcgtacccgttgttcgtcgctctccaccccttccaccaccagggaaattcccagcgcctgcgccaacgccacgacactgctgatgacggcgcaactcctgggctgggtcttcatcttctggacgaaggttctgtccagcttgatctggctgaagggaaactcgcagagccggtcgagggacgaatagccggcgccgaaatcgtccatcgccaggccgcagcccatgatccgcagacgcacgaggttctccaggctgctggcaggagcgctgatcaacccggtctcggtgatctcgaacatcaccgaactgggcggcaggtggaactcggtcagcaacgccgagatgttctcggccagggcacgcgaacccagttgcgaaggatggacgttgaacgccaggttgatcggctgccccaactgcgccagcttcctgcgcgtcgccagcccctggctgaacagttgccagaacagcttgtcgaccaggttgtaggtttccatcacatagaggaaatgcgacggcggcaatacgccgagatgcgggtggttccagcgtgccaggacctcggcgccgatcaggccgccgccatccagggccaccttgggctggtagtaggcttcgaactcgccgttgtcgaggccgcgcaccacgtccgccacggagggcagctcggcgacttcgatctgtcgcggcaggtcctggcgacgagcgttgtagcgagtcaacagggcggtgatccgctccaggctgaatggcttgccaaggtcgccgagaaaattgaggcccaggcactcgatcatcgaaatggtggcctggcgcaggatgggatccacctcgctgctgaggatcaccgaatggaccttgccgctcaggcttgcgtggcgaaggaacgccaggccgtccatgccgctcatctgcaggtcgcagatggcgatgtcgacgtgtccgcaggactccaggatcgccaccgcctccttgccgtccgccgcctcgaggatcgatccgggcaccactttcttcagggctgtgacggctaccaggcgctgaaaaggctcatcctccaacaccagaacattcaaatcattcatcacggtccacacagggtttccaggaaataccggcgatatactgctgtgtttcccttactagacctatgggacaagtccccatgttttgtgggaattttcctactgatttggaggttcggttggattagcatggttccacatgaaaaaccgagtcgccccgccttaacaggctattctggacggcgatctcggcctagcgcccaacatggatga

SEQ ID NO: 3637 - DNA, 540 bp, Pseudomonas aeruginosa
cgcgccaccggtcgcgcgcacgagtcctcccgaaggctgccccgggagcttcgcgcagccccctccaggccccgtccggccagggctggagggcgccggccaagcatggatttctccccgctggcaacatgctttacactggcgcccgttcattccttaaccactacgagatcgccgtgctcaaagcactcaagaaaatcttcggcaaggccgacggaacccagccgcagagcggttcctccccggtcccgcaaggccctgccggcgctaccgcgaaaggtaccgcccccaccggcgaaaagccgaccgagaaacgcccacgcaaaccgcgccccccgcgcgccgctgaaaaggccgagaaaggcgaaaagcccgccaaacccgccggcaaagaaggccgggacgccaagccgcgcagcgacaagccgcgccgcgaacgcaagccgaagccggtggacaactggaagctggaagacttcgtggtcgaaccgcaggaaggcaagacccgcttccacgacttcaacctcgccccgagcctga

SEQ ID NO: 3638 - DNA, 1314 bp, Pseudomonas aeruginosa
tcaacttcaccctgccggaggacccggacgactacgtgcaccgtatcggtcgtaccggccgcgccggcgcctcgggcacctcgatcagcttcgccggcgaggacgatgccttcgccctgccgccgatcgaagaactgctgggccgcaagatcacctgcgagatgccgccggccgaactgctcaagccggtaccgcgcaagcactgaacgcaggcgtggagaaaaaaggcgaagccatccggcttcgcctttttcgtttctgcgacacgcaggtgccgccgccggtcatcgaggcgggtcggcgcttgcccggcaataccttaaagtccagaatggacaaattgtttacatccattccggagatcgcatgagcgccgccactcccctgatcgtccagcaggccgaagccgagcaactgctcgcccgtatcgacgtcctccaggccatgcgccagctgttcctcgacctggccgccggccaggcgctccagccggcccagcaactggtggagttccccgccggtcgcggcgacttcatcaactacctcggcgtgctcgcccaggaacaggtctacggagtcaagacttcaccctacatcgttcgcgaacagggcccgttggtcaccgcctggaccctgctgatgtcgatgcagaccggccagcccttgctgctctgcgatgccgcccggctgaccaccgcgcgcaccgccgccaccaccgccgtggcggtggatgccctggctccggccgaagccggccgcctagcgctgatcggcagcggaccggtagcccatgcccacctgcaatacgtgaagggcctgcgtgactggcagggcgtgcgagtccattcgccgtgcctggacgagcgccgcctgcaaagcctgcgcgccatcgacccgcgcgccgaagccgccggcagcctggaggaagcgctggacgaagccgatgtgatcctgctctgcacctcctcggcccgagcagtgatcgacccgcgccaactcaagcgcccggcgctggtcacctcgatcagcaccaacgcgccccgcgcccatgaggtaccggcggaaagcctggcggccatggacgtctattgcgactaccggcacaccaccccaggctccgccggcgagatgctgatcgccgccgaacagcatggctggagccccgaggcgatccgcggcgacctcgccgaactgctcagcggccaggcgccacgtccggaataccggcgcccggcgttcttccgctcgatcggcctgggcctggaagacgtagccctggccaacgccctctaccgcctgcgccaggcaggctga

SEQ ID NO: 3639 - DNA, 1845 bp, Pseudomonas aeruginosa
tcgcgtgatgcaggagagcagcatgatcgaagcggattacctcgtcatcggtgccggcatcgccggcgcatccaccggctactggctgtcggcccacggccgggtcgtggtgctggagcgcgaggcgcagcccggctaccactccaccggccgctccgccgcgcactacacggtggcctacggcacaccccaggtgcgcgcgctcaccgccgccagccgggccttcttcgacaacccgccggccggcttctgcgagcatccgctgctcagcccgcgtccggaaatggtggtcgacttcagcgacgatccggaagaactccgccgccaatacgaaagcggcaaggcgctggtgccgcagatgcgcctgctggacgcggaacaggcctgctcgatcgtgccggtgctgcgtcgcgacaaggtcttcggcgccacctacgaccccaccggcgccgacatcgataccgacgccctgcaccagggctacctgcgcggcatccgccgcaaccaggggcaggtcctgtgcaaccacgaagcgctggagatccgccgggtcgacggcgcctgggaagtccgctgcgacgccggcaactaccgcgcggcggtgctggtcaacgccgcaggcgcctggtgcgacgccatcgccgggctggccggcgtccgcccgctgggcctgcagcccaagcgccgctcagccttcatcttcgccccgccgccgggcatcgactgccacgactggccgatgctggtcagcctcgacgaatccttctacctgaagccggacgccggcatgctgctcggctcgccggccaacgccgatccggtcgaagcccacgacgtgcagcccgagcaactggacatcgccaccggcatgtacctgatcgaagaagccaccaccctcaccattcgccgcccggaacacacctgggcagggctgcgctcgttcgtcgccgacggcgacctggtggccggctacgccgccgatgcggaaggcttcttctgggtcgctgcccagggcggctacggtatccagacctcggcggcgatgggcgaggccagcgccgcgctgatccgccaccagccgctgccggcgcacctgcgcgagcacggcctggacgaggcgatgctgtcgccgcgccgcctgtccccctgatgacccggcggcgggtttgcggcacactcgcctcgcccgccgtcccacgagagttcctgcgcatgagcccgagccaagaccccagcctggagaactaccgggcgatcgccgacggcatcgccaccctgttcttcccccacgccgaagtggtcctgcacgacctgcgcagccagcgggtcgactacatcgccaacaacctgtccaagcgcgaggtcggcgacgactcggcgctggaagacatgctcgaaggcgatagcgacgagcgcaacatcggcccctacgagaagctcaactgggacgggcagaagatccgctcggtcagcaccgtgctgcgcgactccgccggccagccgctggcggtgctgtgcatcaacctgaacatcagcctgttcgagagcgccaaggcggcactcgacctgttcctctcgccgagcaagctgatcccgcaaccggacgcgctgttccgcgacgactggcaggagcgcatcaacaccttcctgcacggctggctgcggcagcgccagctcggcttgaacctgctgacccgcgagcacaagcgcgaactggtcctggccctgcacgccgagggcgcgttcaagggcaagagcgccgccaactatgtggccaacgtgctgaacatgggccgggcgacggtctacaagcacctcaaggagctgaaggaaggcggcgactga

SEQ ID NO: 3640 - DNA, 324 bp, Pseudomonas aeruginosa
cggcttgcaatcgaaaaccggcgggctcgcaatcagcgcgattttgggctcagattatctgtgactgacggtgggggcgggctcacattaattgcgagcgagcttgcaatccatgcggtgggcttgcagtccattaccgcgggctcacgctctttgcgactgacgctcataccggtaatacgccgatcccgttgcccgagtttcccgatgaagcagatgacctttgccgacgccgagtacgccggcaagcgcaagcagaggcgcgtctgtaatgggggaatggctgctgcgaggtgctcgcggcggctaaaaacacagaaatga

SEQ ID NO: 3641 - DNA, 426 bp, Pseudomonas aeruginosa
cacctgctggaagaggaaaagaaagtcacggagtccagatcgatggccatcgagaagcacaacatcaagctggccaccttcatcgccgcgctcttctatgacctttccacccagaaacaggtacgcattcccacccagatcgaaaaacgggatcgcgaactgtacgaactggtaaagaagagcaagcgccccgtggccctgctcgttgatgaaacccatgatctcaatggtcataccttgaccggtctgaagcgactgctcgaactggccgaagacgacagcggccggcgacgcttgtccattgtcctggctggccatcccaagctgtgtaacgatctgcgccgccccacgatggaagaaattggttaccgcaccgacattttcgagttgcaggaaaagatgcaaagtgccggattaccggtatga

SEQ ID NO: 3642 - DNA, 855 bp, Pseudomonas aeruginosa
tcgatctgtcggccttggccatcgatccagtcggtcatgtcctgggtactccgtttgatcttcgggaaggagagggaaacatcggcgccgaaggctattgcaccagcgccccatccgcaccctcgaaggcgaagccctcgatacaggcgtctcccgccagcacgccgatgtactgtcccaccgctcgctgcaacacctgcacctgcaggtgcgcggcgatctgtgcgcgggccgcgtcgaagtcgagcggctcgccgccttcgcgcgccagcagttccaccacatgcaggccatagcggctttccagcggatgctcgagcagcccgggcgcgcggcgcagcaggcgcttctcgaattcggggacggtctgccccggctcgatccagccgaggtcgccgcccgcctccttcgacggacaggcggagaaacgccgggccaggtcgacgaagcgctcgggatgcccgcgcaactcgtcgagcagctccgcggcctgcttgcgcgccgtctcgcggccttccaggtcgtccggcgcgcaggccagcagcacatggcgcaattgcaggcgccaggggccgagcaagcgccccggattggccgcgtaccaggtccggcaggcgtcttcgtcggcttccgggacctgcacctcttcctccagcaattggcggatgcgcgcttcctccggcgtctcgccgtcttcgcagcgggcctcgatgcccagcgcgtcggcccgttgcaggagcaactggcggacgatcagcgcacggcaggcggcctccagcgccagcgcgtagctgtccgccgggtggtattgcagctcgcgggccagcaggtcttcaccgatggccacgccgttga

SEQ ID NO: 3643 - DNA, 828 bp, Pseudomonas aeruginosa
gcatctggctggaaccggccttccaggtgtactgcgagaggtcgaagcgcgcccagctgccgaccaggcagatcagcagcgcgacatagggatagatcccgaagaacagaagattggtcgacatgctcagactccttcgcgggccgcgcggtactgcatctgcggtaccggctgggcgacccattgcaatggttgttcggtggacgccgttggacggcggccgctgctcgacgggcaaccgccggcggggtcggtgaagctcaccggggtttcctcccaggcccggtcgatggcctccaggctgtcgtcgcgctgttcctgggcctggtcgcgacgcaacgcgccgaggtccgggcgctcgccgccgagttccagcaacgcctcgaaaatcgccgcataggcgctgccgcgttcctccaggcgcagcgccagcaggccgaggatgtgcgccacttcggcgagcccttcgctggccgccgcgaacggcagcagcgacaggtattcgaggtacagcggcaggtagtccggcagctccggtacgtcgatttgcaggccggccccggtatagcggtcgagcaggtcgaccatcgcctggccacggtcgcggctctcgccgtggacgtgctcgaagagcagcagcgagaccgagcggccgcgctcgaagagaccgtcgtagcgcgcctggacgtccagcaggtcgccctggcagagctcgttgagcagcgccgcgaggccgtcgcgcagcgcttccggcagttcgcaggtgcggatcagcgcatgcaggccgaggctctcctcgcgcagctcggcgcgtggatagtcgagtag

SEQ ID NO: 3644 - DNA, 198 bp, Pseudomonas aeruginosa
aagaagctgatattggacatgctcgaggcgaagttgccgccgccgaagccgcagagcagcgcgatcagggcgaacacccagtacggggtgttcgggtcctgcacggcgaagcccagccagatgcacgggatcagcatcgaggcggtgctcagggcggtccagcgacgaccgccgaagatcggcaccatgaacgaatag

SEQ ID NO: 3645 - DNA, 939 bp, Pseudomonas aeruginosa
cagggccggaaagccgatcctgcgccgctccctggtagtccgcttcggctgctacctcaccctgctggtatcgctggcgctgatcgggatgttcagcgccctgctcttcgccgactacacgcaccaggacgccgcggtgatcaaccacgccggctcgttgcgcatgctcacctaccgggtcgccctggagcccagcctggaaggccgccaggcgctgctcgggaccctcggcgaacgcctcgacagcggcgacatccgccgcctgctgcaacgccaggacgccgacgacccgatccgccagttgcaccaggagctgcgcgagggcctcgcgcgcctggacccgcgcgcgctgcccggacgcgccgtgctggacgcctacgtcggcgacatcgaccgtttcgtcggcatcctccaggccaaggccgagcgccgctcgcaactgctcagcacggtgcagggcctgtgcctgttcctcagcctgctggtggtgttcgtcaccctctacgacctcagctatcacgtcatcggcccgctgcgcgaactcaccagcaccgcccgccgcctgggccgcggcgagctggacgcgcgggtcacctacagcggcgaggacgaactggcgcaactgggcgagcgcttcaaccagatggccggcgagctgaagagcatctacggcgacctggaagagcgcgtggaggacaagacccgcgccctctcgcagagccaccagcgcctcgaactgctctacgccagcgcccgccggctgggcgagaacccctacgacagccgcaccctgcaaccgctgctgaaccagttggagaaagtgctcgacgccggccgcgtgaccctctgcctgaacaaggacggggtcgagcgcgcctacagttcgctgaccaccaccgagcgcccggcggacttctgcctgcagggcgactgcggtag

SEQ ID NO: 3646 - DNA, 699 bp, Pseudomonas aeruginosa
ctgccgcgagcaggccagcgcctgcgaccaaccctcgtccctggcccagccattgctgatgcagcccttgtccatcgccggccaccgtttcggcgaactgttcatcgaaagccgcagcggccgcctggagaactggcagcagcaactgatcgagaccttctgcgacaacatcgcccgcaccttcgccctgtccctgcaacaggaacaggaaagccgcctggccctgttcgccgagcgcggcaccatcgcccgcgaactgcacgactcgctggcacagtcgctgtcctacctgaagatccaggtcagccgcctgggcaccctgctcaagcgcgaggcgccggcggagaagatcgaggacaccctcgacgaactgcgcgaaggcctcaacggcgcctaccggcaactgcgcgaactgctcaccaccttccgcctcagcctcgacgagccgagcctggaagccgcgctggggaacgccgtggccgagttcggcgagcgcggcgaggtgacgatcgaactggacaaccgcctgcaacacgtgccgctgagccccaacgaggaaatccacgtcctgcagatcgtccgcgaggcgctctccaacgtggttcgccattcgcaggcgcaacgggcctgggtgcgcctgagcagccaggccgacggccaggtgagcatcgccgtcgaggacgatggcgtcggctttga

SEQ ID NO: 3647 - DNA, 810 bp, Pseudomonas aeruginosa
cggccattatgggcttaccatcatgcaggagcgcggccagaccctcggcagccagttgcgcttcgaagcgcgcgcgccccacggcacgcgagtgctcttcagcttcgtgccgaccgccctgcaaccctccgccgccaaggagccgaccccatgacggacatgccagccaccgccgacgaaccggttcgcctgctgctggtggacgaccatccgatgatgcgcaagggcgtcgcccagttgctcgaactggaagacgacctcagcgtggtcggcgaggccggcagcggcgaggaagccctgcgcctggccgccgagctggacccggacatgatcctgctggacctgaacatgaagggcatgaacggcctggacaccctgcgcgcgttgcgcgaggccggagtcgacgcgcgcatcgtggtgttcaccgtgtccgacgacaagggcgacgtggtcaacgtcctgcgcgccggcgccgacggctacctgctcaaggacatggagccggagcgcctgctcgagcacatccgccaggccgccaccggacagatgaccctcagcccgcagttgacccagatcctcgcccaggccctgcggggcgacgaccgctcgaagagcctcgacgagctgaccgagcgcgaacggcagatcctccgccagatcgcccacggctacagcaacaagatgatcgcgcgaaagctggacatcaccgaaggcacggtgaaggtccatgtcaagcgggtgctgcacaagctcggcatgcgttcgcgggtcgaggccgcggtgtgggcggtggagaacgacctggtgtga

SEQ ID NO: 3648 - DNA, 480 bp, Pseudomonas aeruginosa
gccgcgcgcgggcttgattccggtcaagaaatccaccgcggcgctgcgtcgatactggcggcttccttccacgaggcgcccgtcatgatgttcgaacgcagccccgacgatccccttcccctggtctacgcctgctccggctgctccaacgtggcgcaactggccaacgatctcgcgctgcgcctggatcgcgcccggctggcggagatgtcctgcatcgccggagtcggcggcgacgtcccgctgctggtccgccgggcccgctccgggcgaccgatcctggccctcgacggttgcccgctgcattgcgtgaaaggctgcctggcgcgccacgaggtagtcccgaccctgcacctgaccctcagcgaacacggcctgaagaagcgctacggcgaggactgcgaggcgcaggacgccgagcgcctgttcgtcgagctggagcgtctgctgacgccgggcggcaagcgccgctgcgaatga

SEQ ID NO: 3649 - DNA, 1311 bp, Pseudomonas aeruginosa
gatgtcccctcggcttcgaagaaaggacatttcaatgctgatcggtgcgctgctggtcctcacctgggtcatcctcctcgtccgatacccggccaaggccctgccggtctccctggcggctctcgccgggctgggcctggtggcggcctgggtgatctggcaggacaacgacgaaagccgccacctgcaacgccaggaactgcgcctgagctatgcgccggaacgctgtccggtggaccggccgctggcggtcgaactgaagaacggcagcgaccgtccgttgctggagctacgctggaggatcgccgcctaccgccccggcgacagcgtcaacctggccgacaccagcttcgacagcccgcgctaccgggcgccgaacgccctgctcggcggcgacagctggcacgattgcctgccgctgccgccgctgcgtccgggctatcgcgccagcaccctggaattccgcgccgaacgcctggacgggcgtttcggcaactgaccgagggaggacccgatggaaacccgccgtctgttcgaccagggctccgctgcctacgccagcgcccgcccgcgttatcccgatgcgctctaccgccatctcgccgggctctgcggccagcgccggcgcgcctgggactgcgccaccggtaccggccaggccgcgctcggcctggcgcagtacttcggcgaagtcctcgccagcgacaccagcgcgcagcagatcgaacacgccgttgtccatccgggtatccgctacagcgtgcaggacgccgaagccaccgactatcccgacgccgccttcgacctggtctgcgtagcccaggcctggcactggttcgaccattcgcgcttcaaccgcgagctgctgcgcgtgctgcgtcccggcggcgtgttcgccgcctggggctacggctggttcagcatcgacgcgcagatcgatgccgccatcgacgaggaatacctgcgcccgatcggcccgtactgggcgcaacagaaccgcctgctgtggaacgcctaccgggatgtcgagctgccgctgggcgaactccccgctccggccttcgtcatcgagcaacaatggagcctggcccggttgttcgactacatggccacctggtcggccagccgcctgtgccgcgaggcgcagggcaacgctttcgtgcgccaggccctgcaacgggtcgccgcgctctggggcgagccgacctcgacacgcagggttcgcatgccgctggcgctgcggatctcgcgcaaggacgcctgaccgagccttcgggcggttttccgcggccggccaatccagtacggtag

SEQ ID NO: 3650 - DNA, 870 bp, Pseudomonas aeruginosa
gccgccctccttccaactcccagccaaggaacgctgcccatgagccaacccgtcgccttcgtcaccggctgctccagcggcatcggccgcgccctctccgacgccttccagcgcgccggctaccgggtctgggccagcgcgcgcaaggaggacgacgtgcgtgccctggccgaggccggcttccaggcggtgcaactggacgtcaacgacgccgccgcgctggcccgtctggccgaggaactggaagtcgaagccgccggcctcgacgtgctggtcaacaacgccggctacggcgccatgggtccgctgctggacggcggcgtcgacgccatgcgccggcagttcgagaccaacgtgttcgccgtggtcggcgtgacccgcgcgctgttcccgctactgaggcgcaagtccggcctggtggtgaacgtcggcagcgtctccggcgtgctggtcacgcccttcgccggcgcctactgcgcctccaaggccgcggtgcatgcgctgagcgatgccctgcgcctggagctggcaccgttcggcgtcgaggtgctggaagtgcagccgggcgccatcgcctcgaatttcggcgccagcgccagccgtgagatggacagcgtggtcgacgtacgctcgcccaggtggccgttgcgccggcagatccaggcgcgcgccgcggcatcccaggacaatcccacgtccgccgaagacttcgcccgccagttgctagccgccgtgcagcgccgtccgcgcccgccgctggtgcgcatcggcaatggcagccgggccctgccggcgctggcccgctggctaccgcgcggcctgctggagcggctgctgaagaagcgcttcggtctcgacacgcgcctctga

SEQ ID NO: 3651 - DNA, 744 bp, Pseudomonas aeruginosa
ggctgcctcaacgaattcttcacattctcttcagctcggcttgacccgccctcgcctagtgttggccacccaccgcacgaggccgacatgcaccgttcaccgctcgcctggctccgcctgctcctcgccgccgtgctcagcgccttcctgctcggcggcccgctgcatgccgccgagactgccgccacgcgttcgccagcctgggcgcaagcggtcgacccgtcgatcaacctctaccgcatgagccccaccctctatcgcagcgcgctgcccaacgcacagagcgtcgcgctgctgcaacgcctgcaggtgaagacggtggtcagcttcatcaaggacgacgaccgcgcctggctgggccaggctccggtgcgggtgctcagcctgccgacccacgccgaccgggtcgacgacgccgaggtgctcagcgtcctccgccagttgcaggcagccgagcgcgaaggtccggtactgatgcactgcaagcacggcaacaaccgcaccggactgttcgccgccatgtaccgcatcgtcgtgcagggctgggacaagcaggccgcgctggaggaaatgcagcacggcggtttcggcgacgaggacgacatgcgcgacgccagcgcctatgtgcgcggcgccgacgtcgacggcctgcgcctggcgatggccaacggcgaatgcagcccgtcgcgcttcgccgtctgccatgtgcgcgagtggatggcccaggcgctcgaccggccgtaa

SEQ ID NO: 3652 - DNA, 753 bp, Pseudomonas aeruginosa
ccaacgctcattccgaagggagtcccgaccatggtgaaaacctgtggcaaggccctgctcggcctctgcgccgcagccgccgtactggccttgctgatccactggatcacccccgcgaccatcctccactaccgcgaggacctgctgttctacttgcaggcccacctggtgctggtcttcagttcgatggcggccgccctgctggtcggcgtgccggccggcatcctgctcagccgtcccggcatgcaggcccaggccgaacgcctgatgcaggtgttcaacgtcggcaacaccatcccaccgctggcggtgctggccatcgccctggcgatcatcggcatcggcaacggcccggcaatcctcgccctgttcctcgcctcgctgctgccgatcgtgcgcaacacctacgagggcctgcgcaatgtctcgccggcgctgaaggaagccgccaccggcatcggcatgacgcccaaccaggtgctgctgagggtggaactgccgaacgcggtgccgatcatcgtcggcggcgtgcgcgtggccctggcgctgaacgtcggctccgcgccgctggcgttcctgatcggcgccaacagcctgggcagcctgatcttccccggcatttacctgaacaaccaccagcaactgctgctcggcgccgcctgcacggcgctcctcgccctgctactggacgccctggtggtgctgttcagccgcatgttcctggaacgcggcctgaccgccaaggaggcctga

SEQ ID NO: 3653 - DNA, 1548 bp, Pseudomonas aeruginosa
aggacgacaagcagtacttccccttctacaacgccgccccggtggtgcgtaaggaggtcatgcagcgccatccggagttcgccacgctgttcgatccgatcatcgagcggctcgacgacgccaccatgcaggcgctcaacgcgcgggtcgatatcgagcagcagacgccacagaaggtcgccgccgacttcctccgcgaacaccacctgctcgacgacggccaggccggccagggaggtagccagtaatggacttcttcagcgtgctttcccatctcgactggtcccaggtcggccagctcaccctccagcacctgctgctggtactggtcgccgtaggcctggcgatcctcgtcggcgtgccgctgggcgtgctgatgacccgcttcacgtggctggccggcccgctgcagggcgccgccacggtgatgctgaccatcccctcgatcgccctgttcggcctgctgatgccggtctactcggtattcggccagggcctcgggccgctgccggcgatcaccgcggtgttcctctattcgctgctgccgatcctgcgcaacacctacctcgccctgaccggcgtcgaagcgggcatccgcgaggccggcaagggcatcggcatgaccttctggcaacgcctgcggatggtcgacattcccctcgcggtgccggtgatcctcgccggcgtacgcaccgccgtggtgatgaacatcggcgtgatgaccatcgccgcggtgatcggcgccggcggcctgggcgtgctgatcctcacttccatcagccagagcaacatgccgatgctggtggtcggcgcggtactggtcagcctcctggccatcgccgccgacctgctgctgcaatggctgcaacgcatcctcacccccaagggactgcgcgccagcgcgcactgacaggagccgaacatgatcgaactggacaagctcagcaagaccttcacccagaagaacggcaaggagttccgcgccgtcgattccatcagcctgaccgtggagaaaggcgagatctgcgtcttcctcggcccctccggctgcggcaagaccaccaccctgaagatgatcaaccggatcatcccgccgacctccggccgcgtgctgatcgacggccaggacaccgcggacctcgacgaggtcaccctgcgccgccacatcggctacgtgatccagcagatcggcctgttcccgaacatgaccatcgaggaaaacatcatggtcgtgccgcgcctgctcggctgggacaaggcgcgctgcaaggagaaggcccgcgagctgatgagcatggtcaagctggagcccaagcagtacctgcaacgctacccgcgcgaactctccggcggccagcagcagcgcgtcggggtaatccgcgcgctggcggcggacgcgccgctgctgctgatggacgagccgttcggcgcggtcgatccgatcaaccgcgagtcgatccagaacgagttcttcgaaatgcagcgcaagctcggcatgaccgtgatcatggtcagccacgacatcgacgaagccatcaagctgggtga

SEQ ID NO: 3654 - DNA, 636 bp, Pseudomonas aeruginosa
ccagggcaagggcctgggctacgtgcgacgcaaggacctgcgccgccaggagggcacctgcgcgccgttcgtcaccccgttccgggtcaccgccagccacgacgagcacctgcgcatcctgttgtcgcggatgtacgagttcaacagctcctggctgccggtgctcgaccccgaccagcagttcctcggcgaggtcacccaggaatccatcgccgactacctcagctccggccgctcgcgcggcggcaagggcctgatcgtgtcgccggccgaacaggtcggggcctaggccgccgggtggatattcaccgccggcagccgccaaccgcagcgtattcctggcgagtggcgccctcttccgccccgccgaaacgaaaaagcccggcatccgccgggcttctccctgccccttccactcaaccggcccgccccggcgcctgcgccgccgaggcctggtcgtcgcgcccttgcggcttgacgatcaccgtgcaggtgatccccgccgagagcagcacgccgtccggcacttcgtcgatgtgtacccgcaccggcacgcgctgggccaggcgcacccagttgaaagtggggttgacgtcggcggtcagctcgcggctttccgggttgtcgcggtcgtag

SEQ ID NO: 3655 - DNA, 306 bp, Pseudomonas aeruginosa
ggccgcgctggtaggccagggtggcgatatcgtaggtcttctgcgcggaagccaccgattgcgcggcgaagtccttctggatgtccaccgaatgcaggcggatcaactggtcggaaatgttcttcagcgcatccaccagggtctggttgtattgctccaccgccgcgtcgtagccggccgccgcctcgcccaactgcgaacgcaggcggccgccgtcgaagatcggcagggtcaccgccgggccggcgctgtaggtgtacttggcgctgcggaagaactccagcatgccgccgccgacggcactga

SEQ ID NO: 3656 - DNA, 966 bp, Pseudomonas aeruginosa
gaggccccgtcgatggacaccctgcaaaacatgcgagccttcgtctgcgtggcggaaaccggaagcttcaccgcggcgtcccagcagctcaacaccaccaccgcctatgtttcgcgggcggtggccaacctcgagacgcacctgcgcacccgcctgctcaaccgtaccactcgtcgcatcgccctcaccgaggccggccagcgctacctgctgcgctgcgagcagatcctcgcctacgtcgaggaagccgaggccgaagccagcgacgcccatgcccgacccgccggcaagctgaagctgcattcgatgaccggcatcggccagcactacgtgatccgcgccatcgccggctaccgccagcagtaccgcgacgtgaccttcgacctgaccatggccaaccgcgtgccggacctgctcgacgagggcttcgacgtggccatcgtggtggcctccgagctgcccgattccggcttcatttcccagcgcatcggcgagacctacagcattctttgcgcctcgccggagtacctgcgcctgaacggcacgccgagcgagccttcggagctggccagccacgactgcctgcgcctggtcagcccggtggtgccgctggatcgctggctgttcgacggtcccaacggccaggaaatggtctccatcggcgcctcgccgttccaggtcaatgtcggcgacgccatgaccgaggcaatccgctccggactgggcatcggcatcctgccggtgtattcggccatcgaggacctgggcaagggcaccctggtgcgggtcctgccgcaacaccgcctgcaacagctcaacgtctatgcgctgtacccttcgcggcagtatctcgacgcgaagatcaagacctgggtggaatacctcaaggaaagcctgcccggcctgctccagcgcgacgaagcggcgctggtggagctgggcctggaactcggaagaccctcctga

SEQ ID NO: 3657 - DNA, 1539 bp, Pseudomonas aeruginosa
ggccgcgctggtcgccgccctgcgggagaagcgcatcctcggcgccggcctggatgtctacgagaaggaaccgctggccgaatcgccgctgttcgccctggacaacgtggtgaccctgccgcacatcggctcggccacccacgagacccgccgggccatggccgagcgggcgctgcagaacttcgaggcggccctgcgcggcgagcggccgctggacctggtcaatccgcaggtgtggcgacgcggctgagcgcgcctccctctccgctaggtcgagcgcgccggcccggccagcgccggcgccttcggcttgcggaacaccaagacgttgccgagcatcaccaggaccagcccggccagcgccggtgcggtccagcggtagccctcggcgaaggccgagatgttcagcgccaccaccgggaacagcacggtgcagtaggcggcgcgatccgggcccatgcgcccgaccagggtcaggtaggcggtgaagccgatcaccgagccggggatcgccaggtacagcagcgagccgacgtagcgcgcgctccagtcgaaattcagcggcacgccctggaacaggcacagcgccaggaggatcagggtgccgtagagcatgctccaggcattgccggtgagcgggcggatgccggccttctgttgcaggctggaaagcatgttgccggtggagaagcacagcgtgccgagcagggccaggccgaggccgtagaaggtttccggggtggcctggtgacccaccaattccggccagaacagcagccccaggccgagcaggccgagaccgccaccagccatcacgttcgacgcgatgcgctggccgaaccacaggcgggcgttcagcgcattccacagggtggcggtggagaacaccacggccaccaggccgctgggaatccactggctggcggtatagaagcagatgaaattcaggcagaacaggcatacgccctgagccatgcacaggcgttggccccgtgcgtccagcctttgcaggcggcggccgagcagcagcacggcgaacagcaccagcgccgccagggcgaagcggtaggcgatcgacagggtgatcgccaccgggcccatctgcagcttgatggcgatccaggtggtgccccagatgagcacggtgagcaggtacagcgaaagattcatggcgactccgcaacgacaggatgccgtcagtctgcgggcgaggccgggcgcgaccattgtccattcttgcgcttttcatccgccgcctctcgcggcagcgtccgggcgcgggtagcatggccggcatgcaccaacccagtgatttccaggtattccgcaccctcgaccggacctccaatgcgcgcctgctgcgcagcagcacgctcagcgacggcctggcgctcgcccattggtaccgcgacgaagcggagatcctcggctacagcgaccccggccatcacaccctgtcgctctacctgcagggcggctggcagaccttccgccgcgatcgtcccgggctctatggcggccccgaccgcttctgcgtga

SEQ ID NO: 3658 - DNA, 534 bp, Pseudomonas aeruginosa
tccttctgctccgggaatgtccaggtgtcgagcgccgacctcgcccatgcggccgcgttgcataccctctacagcgaccaccaccactggctcacgggctggctgcggcgccgcctcggctgcccgcagaacgccgccgacctggcccaggacaccttcgtcaaggtcctggtttcgcgccaggccgcgcgcatcgacgaaccgcgcgccttcctcaccaccatcgcccgccgcgtgctgtgcaaccactaccgccgccaggacgtcgagcgcgcctacctggaagccctggccagcctgcccgagcgggaagtccccagcgaagagacccgcgccatcgtcctggagaccctggtcgagctggaccgtctgctcgacggtctgccgccgctggccaaggagaccttcctgctggcccaactcgacggcctgggctacgccgagatcgccacgcagctgggcatctccctgagcagcgtcaagcgctacatgctcaaggctgcgcaacgctgctacttcgccgagctgccatga

SEQ ID NO: 3659 - DNA, 600 bp, Pseudomonas aeruginosa
acagcgacacggcggtggatgtccgcttcgatgccggcgaacggcgcctgctcctgctgcgcggggaaatccagctcagcaccggccaggacccgcgcccgctgcacgtgtacagcgcggaaggccggctgcgaccggtgggcacccggttcgacgtgcgccagttcgccggacgcacccgcgtcgccgtccacgaaggcgcggtgcaggtggagaaccacgccggccagggcctgctgctgcccagcggccggcagctggacttcgaccgcgagcgactcggcgctccgcagccgctgccggtcggcagcggcgcctggaccgacggcatgctggtggccgccggcatgcgcctggacgaattcctcgccgaagtcgcgcgctaccgccccggccggctgggctgcgacccgcgcatcggcggcctgcggatttccggcagctatccgctggacgatagcgagcggatcctcgccaccctgccggcggtgctgcccgtggaggtacggcgcgtcacccgctactgggtcggcgtgcacccgcgcgaatgagcggaaagatatttccgcgcacctgagcctttttccccacctcgcgtga

SEQ ID NO: 3660 - DNA, 2274 bp, Pseudomonas aeruginosa
cagaggaggaaagccaacctcgaaagatccactggagtgtccctcatgtccccgtcacgcgccctgtcgccgctcagccgcgccctgctcctcgcctgcctcggcggtcccgtcctggtttccgccggcagcgcctgcgccgccgagatccgcaccgatacccgccagtactaccggctgcccgccgagccgctggagcaggcgctgaaccacctaggccgccaggccggcgtgctgatcgccttcagcccggaacagaccgccgcgcggcgcagccaggcgctggacggcgagtacaccctggaggaagccctggccgccctgctcgccggctccggcctggaggcgcgcgcccgcggcgacggcgcctataccctggaggcgctgccggtggaagacccggccaacctgcaggcgctcaccgtggtcggcgactggctggccgacgccagcgccgccgacgtcttcgagcatcccggtgcgcgcgacgtggtccgccgcgagcagttccaggcccaaggcgcggccagcacccgcgaagtgctggagcgcattcccggggtcagcgcgccgctcaacaacggcaccggcagccacgacctggcattgaacttcggcattcgcggcctcaacccgcgcctggcgtcgcgctcgacggtgctgatggacggtatcccggtgcccttcgccccctacggccagccacagttgtcgctggcgccggtgtccatcggcaacatggacgcggtggacgtggtccgcggcggcggcgcggtgcgctacgggccgcagaacgtcggcggcatcgtcaacttcgtgacccgggcgatccccgaggacttcgccaccaagctcgacgtgcacagcgaactcagccccagctccagccaggacggcctgaagaccacccacaacgtgctgatcggcggcaccggcgccaacggcctcggcggcgccctgctctactccggcacccgcggcggcgattggcgcgagcacagcgatacgcggatcgacgacctgatcctcaagggccgcttccagcccagcgacgaacacacgttttcggcgatgacccagtactacgacggcgaggccgacatgcccggcggcctcggcaccgcggcctaccgcgacgacccgtaccagtcgacccgtccctacgacaagttctggggccgccgtaccctggccagcgccagctacgaatacacccccaacgccagccagaagctcaacgtcaccggcttcttcaccaagaccctgcgcagcggctacctcgaccagggccgcaacctcaccctgtcgccgcgcgagtactgggtacgcggcctggaaacccgtttcagccagggcttcgagctgggcgaaagtcgccacgaagtgggcatcggccaccgctacgtcaacgaagccagccacgagctgcgctactggacccgcgccgacagcggccagctacccagcaccggcagccgcaacgaccgcgacacccgcggcagcaccgaagccaacgcgttctacatcgacgatcgcatcgacatcggcaattggaccatcacccccggcatccgctacgagaagatcgattccgaacagaagaacctgctgaagaacagcaaggacagcggccgctacaacgcctcgctgccggcgctcaacgtgatctaccacctcacgccgagctggaacctctacgccaacaccgagggctcgttcggcaccgtgcagtacagccagatgggcaaggcggtgcgcagcggcgacatcgagccggagaaggcccgcacctgggaactcggcagccgctacgacgacggcatcctgcgcgccgaactgggcgccttcctgatcaacttcgacaaccagtacgagagcaaccagcagaccgacagcgtgaccgcccgcggcaagacccggcacaagggcatcgaggcggcgatcgcctacgacctggccgatctcgacccgctgctctccggcttcgacgtctatgccagctacgcctacgtcgacgcgagcattcgcgaagacgggccgaacaagggcaaccaagtgccgttctcctcgaagcacaagggcacccttggcgccaactatcgcaccggcgcctggagctacaacctcgacggcagcttccagaccagccagtacgccgacaacgccaacaccgagagcgaaagcgccgacggcagcaccgggcggatcgccggctggatggtctggagcgcgcgcggcacctacgacttcggcccgcaactgaacgacctctag

SEQ ID NO: 3661 - DNA, 1644 bp, Pseudomonas aeruginosa
tcccgcgtttttccgggccgtcccgcgcccacgccaacggattccagcaggcacgcatccatgaccactcaggccgccgaagtcgcgaagcgccgtaccttcgcgatcatttcccaccccgacgccggtaagaccaccatcaccgagaagctcctgctgatgggcaaggcgatcgccgtcgccggtaccgtgaagtcgcgcaagtccgaccgccacgccacgtccgactggatggagatggaaaagcagcgcggcatctccatcaccacctcggtgatgcagttcccctaccgcgagcacatgatcaacctgctcgacacccccggccacgaagacttctccgaagacacctaccgcaccctgaccgcggtggactcggcgctgatggtgctcgacggcggcaagggcgtcgaaccgcggaccatcgccctgatggaagtctgccggctgcgcgacacgcccatcgtcagcttcatcaacaagctcgaccgcgacatccgcgaccccatcgagctgctcgacgagatcgaggcggtgctgaagatcaaggccgcgccgatcacctggccgatcggctgctacaaggacttcaagggcgtctaccacctggccgacgacaggatcatcgtctacgtccccggccacggccacgagcgcatcgagaccaaggtcatcgaaaagctcgactccgacgaagcccgcgcccacctcggcgatctctacgacaatttcgtcgaggagctggagctggtgcagggcgcctgccacgaattcgacaaggacgccttcctcaagggcgagatgaccccggtgttcttcggcaccgcgctgggcaacttcggcgtcgaccaggtcctcgactgcatcgtcgactgggcgccgcagccgctgtcgcgcgccacccacgaacgcagcgtggagccgaccgaggagaagttctccggcttcgtgttcaagatccaggcgaacatggatcccaagcaccgcgaccgcatcgccttcatgcgcatctgctcgggcaagtacgagaaaggcatgaagatgcgccacgtgcgcctgggcaaggacgtgaagatcgccgacgcgctgaccttcttctcctccgagcgcgagcaactggaagaggcctatgccggcgacatcatcggcctgcacaaccacggcaccatccagatcggcgacaccttcagcgaaggcgagaacttcggtttcaccggcatcccgcacttcgccccggaactgttccgccgcgtgcgcctgaaagacccgctgaaatccaagcagttgcgccagggcctgcaggaactggccgaggaaggtgcgacccaggtgttcttccccgagcgcaacaacgacatcatcctcggtgcggtgggcgtactgcagttcgacgtggtcgccagccgcctgaaggaggaatacaaggtcgagtgcgcctacgaggcgatcaacgtctggtcggcacgctggatcgagtgcgacgacgagaagaagctcaaggagttcaaggacaaggccttcgagaacctctccgtggacggcggcgggcacctcacctacctggcaccgacccgcgtcaacctcagcctgatggaagaacgctggccggacatccgcttccgcgcgacgcgcgagcatcactga

SEQ ID NO: 3662 - DNA, 705 bp, Pseudomonas aeruginosa
cgtcggcacccacggcaacctggtggtcggcggggcgggcacggtgctgatcggcaacagcggcggcggcgcacccgctctcgccctcgccccaccgaagctgtgcctgcaatgcctgctgctggcggcacgccgcaaccaggccctggtgcccctggaaagcctcggcggcgcaccgtgagccggctccagccggcgctcgcggcgcctacgccggacagccgcctgttcgccctggcggacggcgcccgctacctgaccctggacacccgcctggaaaaggccgcgggggaaatccgctcgcgctggctgctggccgggagcgagctggacgaaatcgcccatgccgggccggtcctgatcgaattcatggacagcgccccgctttcgtcatcgggcgagttcctcggctggctgcgcgactgggaccgccgctcgcccatggcctcctggctgtggagccgggcgtccttcgaaaacctcgcgaaacacttcgccgggctactcttcacccgcatgcccgacggccgccgggcgctgttgcgctactacagcccggaagtgcgccgggcgctggaacaggtcatgaccgcgcggcaatggacgcaagtgatggcgccgctggagcgttggcaggtctggcagcccctgcagggcggctacctcgtctatgaccgggaaacggagcggaccgccgatgcttga

SEQ ID NO: 3663 - DNA, 1158 bp, Pseudomonas aeruginosa
actggatgccggccaactggatcgcctgcagcgggtccgcgacgacgaagtcatcgagcgggtcctgctggaggtacgccgggaggctcccgcctggctcgaacgacgcggcctgctgcccgccatccggcaactcggcgagctgcgcgcgacggcgctggaactgggtatcgaagagcccgggacgatcgaacgctttcttctgcacggcctggccttccccgctttccaggacacgccggcgtttctcgcacacatgcgccggccgctggcggacagcccggaacaacgcttccaggactacgaacggatcgtcgagtttcgcctggccagccagaaatggcgcgcgtacgaaacctcggggagaccggcatgagcggcataggcgcgcttttccgaccgctgccccgcatgggtccgcggctgcccttcgaactacccgcgccgccccggccgcacttgccgatgccggcgccgcgcccgctgccgcgaccggcccccggcgcgctgcccaggccggtaccgcgtccgatgccggttccgcagcccctgcccaggaccgagaccggcacgctgagccgcgaccggacccgggaagccgagcgcgattgcagcaagagccagggccgcgacaaggactgcgtggagtgcccgccgtcccggggcgaaatggccatcgccaataacggcaagggccacagcatgtcggacctgtccgcgcgctaccagcagtgggtgaccaatttcccgtttccccacgaatggttctggagcggcacctggtgggacggcttcgacgagccgcgctgcaccctgctggaggcgaaggccaactacgccttcctgttcgtcccgctgctcggcgtgcccaggccctgggcgcgggccaaggtgaagtcggacctgctgcagaaggccgaggttcacagcgacaaggcccgaccgaccccgccggtgttcgtcgaatggcacttcctgcagcggatcgtctacgagtactgcgccgcggagtacctgcgcatgggactggccaacctgaaggcattctggaatccgatgccgggaacggacgagcacgacgactaccaggaaacccgcgcgaaggaacaggaagagatgaaaaggttttgcgaagagaacccggggtattgcgcatga

SEQ ID NO: 3664 - DNA, 447 bp, Pseudomonas aeruginosa
agcgcttcctcgatgccctcgcgcccctccatccggtgctggagaactggtacctgtgcggcgactccctgcgcgatgccctcagccacaacgtcaccgagcaccgccaggatctcgccaaggccctgtcgcgtgaccgacgcacccgggcggtggaactggtgctatggaacggcgaggaggatccgctcaagggcgggttgtcgctggactacgaggccagcggcagggccgtctcgtccaggctccagttggaagatgccggcagcctgctgcaggtgttcgacgcaccggcgtcctccttcgtcgcgatcttcctcgcggcgctggaaatctggcccgaaacgacctggggcatgctcgctccgcatgcgtacttcgtacaccagcggaccttcccggaccgccgcagcatcggctggatcggcttctgcccgcatccgctaa

SEQ ID NO: 3665 - DNA, 1230 bp, Pseudomonas aeruginosa
tggaactgggctacctgccgccgctgcgcggctgacgacgtacgaacctggtggggcctccgttctgtggggcgaatacgccaccggcgttatccccgacctcccgccgcaacggcggataaccgcaggcggttattcgccctaccaggcccacgttccacgcagcaaggccaccctggagtgacctccgttccgtgggacgaatacgccaccggcgttatccgccggcatcccgccgcaacggcggataaccgcaggcgattattcgccctaccaggcccacgtgccacactggaaggccaccctggagggggctccgttccgtggggcgaatacgccaccggcgttatccgccggtatcccgccgcaacggcggataaccgcaagcggttattcgccctacaggcccacgtgccatgcagaaaggccacccgagggtggcctttctgcatggcgaccaacgccacgggcgctatccgctgcctacctgcggtgcttcttcatcgccacccggcgcaggtcgataccgatcaccaccgggtcgtggtcggaggcccggtacggctcggcgttgtacaggctgtcctgctgccgaggggtcttgaactcgacgttgtagtccagcacccggggctcgtcggcgttgatgtgccactccaccgcgccgcgtacctggcgcgccaggctggcgttggcgagggcgtggtcaaggtagccggactgcccggagaacacgtaggaatagccctttcctgcgcccgcctgacgcgccaccaggtcggtgtagccggcgctgcggatgacgttcaccgggtcttccttggcataggaattgaggtcgccgatgatcaggcgatcaggctccttggcgcccgtcggatcgcccgccagccagtccaccagggcctgggcggcgcgcgcccgggtcaggttgcagttgccctggccgtcgccggtgtccgggtcgccgtcgcaggccgagcccttcgacttcaggtggttcaccgcgatggtcaggcgttcgccgccattgatctcctggaaggtctgggccagggtcggacggttgcgggtgtcgtcgaactccgggttcaccgaactgtcgagcaccgccgcggatcgataggtgcggaccttgtcgccgcgatagatcagccccacggcaatttcgtcgctgcccagcttcgcccggttcgggttgacgaaggcatagcgctggccctggggtag

SEQ ID NO: 3666 - DNA, 4167 bp, Pseudomonas aeruginosa
gctggcgttgaggccgttgaccaggtcggcgatggcgctgaactcgccgtagccgtcgttctcgatctccatcaggccgacgatgtccgccttcgaggcgaggatcgccgcgacgatcttcgctttctgccgttggaactcctcggccgtgttggctccgcgcgaggtggggaaaccgccgcccttgccatcgccgttgaagtagttgagcacgttgaagctggccacccgcaggcgcccttccaccgccggctgggccggacgcggattggctgcctcgaaggtcggcgtctgcaacggctggatacggtagctgccggccgagtagtcgagcacgccgtcgatggcgctggtacggtcgccgacgcgcaggctgttgtaggcgctcagttccggtgccgggtagcggatcgggtcggggttctgcccgctgcggccgtcgtcgaggagaatccggtcgaggtcgttgcgcgcctgcatggccttggcctgttcgccgggagccaccacgttggtcggagtcatctggcggccgccggaggacagcaggacctcgccgtagcggccgaggttgtagacctcgttgacggtcagcgtctggcggagctgcacgcgcatgccttcgtagcgctccagcgcatcggcgctggccagcggcaggctgatgccggccggcgtcggcaacgccacgccgctcgccaggacgctgacctgcagcggcccgaccagctcggtgaggccgttgaactcgcggacctggccggtcacccggacgcggtcgccgagcttgacgtcgctgccgttgccgccgtcgtagacgaagatgccttcggaggtcgccgggtcgccgtccaccgtggcatcttcctgctgcacgtagaagcccttcagctcgctggcgttctggaagtcgccgaccaccacgccctcgatggcgacccgctggttcaccagcggactttcggcgccggcgccctgcacctcgtggatcggtcgcaggccggcctcctcgccgccgccgggctcgccagcgccatgctggccgaggttggcgaaggtgtcgcgcgggtagcccagccattgcgccgccgggtcgaaggcgtcgctgggatcgctgtcgccgtcgcggatgtcggccttgcgcaccaggctccggtcgagggtctgcacatcgccgctgccccaggtcgtgccggggttgaagccgacctggccgaggctgtcgaggatctcgccgctgcgccggcgcagcagcaccgcatcgttgccattgaaccagctgccttccacccgctggctggccagcgccagcaacgccgggtcggccacgccgttggcgaggacgaaggtcttgcccggcgccaggctgccgctcaggtcgatgctgcggcccgccgcgctggcgccgttgaaatagaactcgacgcggtaggcggagaggtcgaggacctggctgccgctgttgtagaactccagcgccttgttgttgccgctgccttcgacatactcggagatgatcagctcggcggcgttggccaccggcaggcccagcagggccaggccgcccagcagggcggcgttacgcaaggggtgcatcgggatactcctttatcggaatggggtcgccgcggctcaggcgccgtcgggctgcagttcctgggaaaacaccggctcgccgtcgaggtcgcgcagggtgacggtgagcgcgcggctttgcgcatcgatctccacctcgccgaagaactggtagccggcgaagggggaactgttctggaccagcggggccttctggaacatcacctgcgggccgaacgtgccatccagcgcgttgggtccgaaactaccggcattgagaggcccggcgacgaattcccagaacggcgcgaagtccttgaacgcggcacgctccgggctgtattggtgggctgcgcagtaatgcacgtcggcggtcagccagacggtgtttcgcacctcggcgcgctggacgaagcgcagcaggtcggcgatctccagctcgcggccgagggcggcgccgtcgttgccgttggcgatggcctcccagcggtcgcggccctgggcgtccttgccatcgggcacgcagaggccgatcggcatgtcggcggcgatcaccttccactgcgcgcgcgaaccgcgcaactcgcgcttgagccattgcaactgttcacggccgaggaaatcggtggcggcgctgcgccgcgcctgcaggttggcgctgttgccgccgcggtagctgcgcatgtcgaggacgaacacgtcgagcaaagggccgtaggcgaccttgcggtagatccgcccgtcgcgcccctggcgctggaagcgcagcggcgcgtattcgaggaacgcctggcgtgcacgggccgccagcacgtcgatgtccttcacctggtagcgctcgtcgagctgcttgctggaggaccagttgttggtggtctcgtggtcgtcccattgccagatctgcggcacctcggcgttgaagcggcgcaggttgtcgtcgagcaggttgtagcggtagttgccgcggaactcgtcgagggtctcggcgaccttgctcttggcctcggtcacccggttgcgccagatgcgcccgctctcggtctcgatgcgttcggggatcggcccatcggcatagatggtgtcgccgctgtgcaggaagaaatccggctggcgccggcgcatggcttcgtagatacgcatgccgccgatatccggattgatcccgaaaccttgcccgcaggtgtcgccgctccagacgaaacggatattgcgcgcctcgctcggcgcactgcgcaggtggccgaaccagggcttgctcaggctgccgtcgcgggcatcctcgaagcgcacccggtagaagatcgactggtcggccggcaggccacgcaggtcgatgcgcgcggtgtagtcgaggcgctcgtcggtgaccggcgagaccagccgacgcggctcgctgaagacgctacgggtgtcccattcgacgatcatccgcgccgggcggtcggtgcggctccagaccagcgcgcggtcgccctgcacatcgccggattgcacgccatcggtcagcttcggccgcgccctgggcgaggcgatcaccgccggcgcgcccagcgccggcaacagcagtccagcgcccaggccttgcacgacgcggcggcgcttgaggtccatcccactcataccggagttctccgcaggcttcacgaaggtccggtttaccggggcaagttgacaggggcgttacggggacagacaggctatccgtttggtcaggggaaacgcccattcgctccgcgccgcccatgcggcaacgaaccgggcgttgcctcgctgaaaagagcttcagtgagtttcaggcttcagggaatacacccaatcggaggggcgcgcccagcgacattggcgtcgctatacgcccctttccaccgacctcagccgccccgcgcgccctggaccggcccctggggcgcctcgccgcgctcctcctgcactgcccgcccggcccgttccacggcgttccacaaccagggcggcaggtgctccgggtcgaggctgtcgaggaggttcttgaccgccaggcccagctcggtgtcgccctcgatcaccaggcggcggcggaagaacagggtatccgggtcctcatgccggctggccagcagcaggaagtcgcgccagtcgccacggatggtcacgctggcccgtggccgttcgaccaggcgcaggccgccgggcacccgggtgacgcaccagccgacgccgaggtccctgacttccaggcgcagccagcgaccttccagcaggtcgaaggcgccctcctccagcggctgggcgaacagccggttggcgacccgttgcaggaccaggtgctggagcccgcgcggaaccttcgccgccagcggcaacaggcgtccggcgacgccgaggagcaggcgttggcggttcagcataaccctacctcctctgcccgcagcatccccggccggccgtgccagtagccgttgcagccttccacggcgagcggcggagcggcacccttgcatacccggtcgaaggccgcgatcacctcggccatgccctgcgcccgaggactcaggcgtagcaggtcagcgccgctatgttccagcgagcggtagtcggccagcaggttgctga

SEQ ID NO: 3667 - DNA, 669 bp, Pseudomonas aeruginosa
cgtcgagcggctggctggccatctcggcgtagaaatcgaatatctgccgcttgtcccagtagaacagcagcggtcccaggctcagtttcatcgcggcggtcctcactgccaggaacggtgataggcgcccagggtggtctggtgcccttcggaaagtccggccagcgcgcgctgccattgcggctgcacgctataggcgcccggcgcgctggcgtagctgtccagcgcctggcgccagacccgggtgacctgctcgacgtaggccgggctgcgctggcggccttcgatcttcaccgccgccacgccgatttccgccagttgcgggaccaggtccagggtgttcaggctggtcggttcctccagcgcatggaagcgctggccattgaccaggaaacggcccttgcagagggtcgggtagccggccgcctcgccggcggcgtagcggtcgatgagcacttcgttgaggcgcgaggtcaacccctccggttcctcgctccagcgcaccgccctggccggcgaacagacgccgcagaggttcggcgactcgccggtgacgtaggaggacaggtggcagcggccctcggccatgatgcacaggctgccgaaggcgaacacctccaccggcaccgggctaccggccgccacctggcgtacctgcgccagcgatag

SEQ ID NO: 3668 - DNA, 501 bp, Pseudomonas aeruginosa
cacgcggggcaggaccgcgcgacggatgccgtagcgttcgtgatagagggccagggccgcggcattggttgccgagccctgcaccgacagatgcaggttgagccgcggatgacgcttcgcggcatagccgagcaccgccacgtcggcggcgatcaacgcatcgacgccgaggtcggcggcctggtccaccgcgcgctgccagcgctcccagccctgcgcgctggaataggtgttgaccgctacgtagagctgccgcccggcctcgtggactcgccgcaggccttcctgcaactggcgttcgtcaaggttgaggccggcgaaatggcgggcgttggtgtcgtcgcggaaaccgacgtagatggcatcggcgccctgtcgcagggccgacttcaaggcgggcaggctgcccgccggacagaccagttgcatggggttgctcctctggcgaaaaacgcgctccgcggcagtgggcaaccccggggcacaggcgccacactctag

SEQ ID NO: 3669 - DNA, 1656 bp, Pseudomonas aeruginosa
aaagacgctcccggtcggcgcttgaccgggatcaagaaggcctcaggccatcagtgcggagaacggcagaaagtcgatcgcatcacccacgcccagggtggcgccgcgctcgatcaccgccagcccgtccgcccaactggcggcaagcagcatcgccgagccctgctgcgggtggatttccacccgcccccgttcatcgagccgcgcccgcaggtactggcgacgcgcccgcggttgcggccagtcgaaggccgccggcagcgccagcggccgcggcactacgtcgaacagtccctgctggcgaagcaggaacggacgcgccaccagcaatgcggtgaccagcgccgccgcagggttgccgggcagccccagccagggcttgccggccacggagccgaaggcgaacggcttgcccggctggatcgccaggcgccacaggttgacctcgccaagctcggcgatggcgcgcttgaggtggtcttcctcgcctaccgagacaccgccgctggtgaccagcgcgtcccattcggaggccgccaggctgagcgcatcgcggctggccaccagttcgtcggcgagcacttcctcgtcgtgcacctcgaagcccagaccgcgcagcaaggcgccgatgcagtaacggttggcgttgtagatctgcccggccaacagtgtctggccgggctcgcgcaattcgtcgccgctgctcagcaggccgatgcgcaagcgccgacgcaccgagaccgtggcgacgccgagactcgccagcaggccgagttcctgcgggcgcaagcgctgtccggcacgcagcaccggcgcgccacgacgcaactcctcgccgcgccggcgcacatgctggccggcgctcaccggcggcaactgcacgcgctcgccgtcgaccacgcagagttcctgcggcaccacgcagtcggcgccggtcggcagcggcgcgccggtgaagatccgcgccgcctggcccagcggcaggctcatgccgcgggtgtcgccggcggcgatccgcgcgccgaccgtcaggctgccgccgctgcgcggcaggtcggcggagcacaaggcgtagccgtccatcgcgctgttgtcccaatgcggcaggtccatcggcgccagcaggtcctcgccgagcactcgtcccagcgcccgctccagggccaggctctcgcaggctggcgggcgcggcgcgcgcgccagcagttcggccagcgcctcgtcgagcgggcgcagttggccgccatcgcaggcgcaagcgctcacgagcggcacccgcagccggccaccggcgccacggctggcggggtcttcaggtgcgggacgaaattgcacgggcgggtgcggctgtccagttgcgccaggagaatctcgttccaggcggtgcgacaggcgcccggcgagccgggcaggcagcacaccagggtaccgttgctgagcccggccagcgcccgcgactggatggtggaagtgccgatctcgcgctgcgagacctggcggaacagttcgccgaagccctcgacatcgcgctcgaacagcggcccgaccgcctgcggggtgttgtcccgcgcggtgaagccggtgccgccggtgatcaggccgacctgtacctcggggtcggcgatccaggccgagaccaccgcgcggatctggtag

SEQ ID NO: 3670 - DNA, 474 bp, Pseudomonas aeruginosa
acgtcactcctcccagcgctgcgcggcggcctggtcgctgcagcggccttcgacccagcgcgggccttcggcggtgtcttccttcttccagaacggcgcgcgggtcttcaggtagtccatgacgaagttgcaggcgtcgaacgccgcctgccggtgggcgctggcgcaaccgacgaagacgatcggctcgcccggctccaggcggccgatgcggtggaggatctccaggcgcagcagcggccagcgctgcccggcctcggcggcgatcttgccgagggccttctcggtcatgcccggataatgttcgaggaacatcccgccgacctcgcgaccgtcgttgaagtcgcgcacgtagccgacgaagccgaccaccgcgccgatgccgacgttctgcgcatgcagggcgttaagctcctgccccggatcgaaagctgcctgctggacgcggatggccatgggttcaacctccggtga

SEQ ID NO: 3671 - DNA, 807 bp, Pseudomonas aeruginosa
cggtggggaagaaggcgacttcgtcgccgtcctgcaacggctcgtcgaggccgcacagttcctgattgcgcgcgcacatcaggttctgctcgccgagggtacgctcccaggccccgccgcgctccaccaggagctggcgcaaggcgccgagggtcgccagcccggcgtcccagttcaactgctcgccgtcgatgcccagagcttcgcggtaacgggcgaaatactgcacgcggatcatgcctgcccttcctcctctttgcggtagtggccgctcttgccgccgagcttctccagcaactggacctgctcgatgaccatcccgcggtccaccgccttgcacatgtcgtagatggtcagggccgcgacgctggcggcggtgagcgcctccatctccacgccggtctgcccggccagccggcaacgcgcgcggatgcgcacggcgtccggcgcctcggcctgcagttcgagcttgacgctggtgagcagcagcggatggcacagcgggatcagttcgtgggtgcgcttggccgcctggatgccggcgatccgcgccacggcgaagacgtcgcccttgggatggccaccgtcctggatcagttgcagggtttccgggcgcatgcgcaccacggcctcggccgtggcttcacgggaggtcacggccttttccgtgacgtcgaccatgttggcgcggccctgggaatcgagatgggtcagcacgtgggtgctcctggaagaggatactggccagtcattgtaagccctggagggcatgacgcgatgcctgggggaggttcggaagggggatga

SEQ ID NO: 3672 - DNA, 945 bp, Pseudomonas aeruginosa
cacgatgtcaaggctgaacctggcgacagatctcaccggcgcctcccagggcgcctgcgatgccacttctgtccattccaaggaggactcatgaacagcgccacgctaaccgagctcgatctgccggtcagcggcatgacttgcgcgtcctgcgccggccgtgtcgaacgagccctgaagaaagtgcccggggtcgcggccgcctcggtcaacctggccagcgagcaggcccgcgtacaggccccggcggacagcctgccggccctggtggcggcggtcgagcaggccggctaccaggttccggcgcgcagcctggaactgtccatcgagggcatgacctgcgccagttgcgtcggccgggtcgagcgggcgctgaagaaggtgcccggcgtacgcgaggtcagcgtcaacctggccagcgagcgcgcccacctcgagctgctcggcgccgtggacagccaggccttgctacaggcggtggaacaggccggctacaaggcccgcctgctcgacgcggggcaaccacgccaggacgatgccgagcgccgcctgcgccgcgaacgctggtgggtgatcgccgcgctgttgctggcgttgccgctggtgctgccgatgctggtggaatgggccggcctgcactggatgctgccgccgtgggcgcagttcctcctggcgaccccggtgcagttcgtcatcggcgcgcgcttctatgtctccgcctggcgcgcggtgaaggccggtgccggcaacatggacctgctggtcgccctcggcaccagcgccggctacggcctcagcgtctacctctggctgaccgccccgcctggccacatgccgcacctctacttcgaagcctccaccgtggtgatcgccctgatcctcctcggcaagtacctggaaagccgcgccaagcgccagaccgccagcgccatccgcgccctctag

SEQ ID NO: 3673 - DNA, 450 bp, Pseudomonas aeruginosa
gccgttgcgcccggagcgcgcggtgcgcctgcgcgacggtcgcgaggaagaggtggcgatcgccgagttgcgcttcggcgacgaggtggtggtgcgtcccggcgaacgcttcccggtggacggcgaggtgctcgacggcagcagccacgccgacgaggcgctgatcaccggcgagagcctgccggtgcccaaggctcccggcgacaaggtcaccggcggcgcgatcaacggcgaaggccgcctgctcctgcgcaccactgcgctcggcggggaaacggtgctggcgaagatcatccgcctggtggaagacgcccaggccgccaaggcgccgatccagaagctggtggacaaggtcagccaggtcttcgtcccggtggtgatcctcatcgcgctggtcaccctcggcgcctggctggtcgccggggtcggcctggagcaggccctggttaa

SEQ ID NO: 3674 - DNA, 1110 bp, Pseudomonas aeruginosa
cgccgtggcggtgctggtgatcgcctgcccctgcgccctcggcctggccaccccgaccgcgatcatggccggcaccggcgtggccgcgcgccacggcatcctgatcaaggacgcagagtccctggaagtcgcccatgcggtcaccagcgtggccttcgacaagaccggcaccctgacctccgggcgaccgcagatcatccacctcggcggcgacgaccaggagcaactgctcaggctcgccggcgccctgcaacgcggcagcgagcacccgctggccaaggccgtgctcgagcgctgcgccgagcgcgacctggaggttccgccggtgaacgccagccaggccctcagcggtcgcggcatccagggcgaggtcgagggtcgccggctggccctgggcaaccgccgcctgctcgacgagcaggaactcaagcccggcgcgctggcgagtgccgccgcggactgggaggccgagggccgcaccctgtcctggctgctggaactggctccggagaaacgcgtgctcggcctgttcgccttcggcgacagcctcaaggacggcgccgccgaagcggtggaggccctgcgcggacgggatatccacagccacctgatcaccggcgacaaccgcggcagcgcggcggtggtggccaaggccctgggcatcgacgacgtacacgcggaagtgctgccggcggacaaggccgccacggtcgccgagctgaaaggccggggccgggtggtggcgatggtcggcgacggcatcaacgacgccccggcgctggccgccgccgacgtcggcatcgccatgggtggcggcaccgacgtggccatgcacgccgccggcatcaccctgatgcgcggcgacccgcgcctggtgccggcggcgctggacatctcgcggcggacctacgcgaagatccgccagaacctgttctgggccttcatctacaacgtgatcggcatcccgctggcggccttcggcctgctcaacccgatggtggcgggcgcagcgatggccttctccagcgtcagcgtggtcggcaacgccctgctcctgcgacgctggaagccctgagccagcacgccaggcacatggggtggcgcgcctag

SEQ ID NO: 3675 - DNA, 459 bp, Pseudomonas aeruginosa
gcgatcagctccagcaccgccagttcgcgcccgctgagcacctcgcccgcaccgcccgcgggctcggcgggcggctccggcaacagcgcgcgcatgcgctgggcgccgggacaggcagggaagcgctgcaactgttcgcgcaaccattccggctgctgcacgagcaattcgtggagcggcagcaaggctccgccgactgcgccctccatggcctgttgcagggtcgccagcgcctcgcgctcgcggccctgctccaggtgcagcgcggccagttggccgagggccaggcgagccggcagcaacgcgccgttctcccgcgtcgagcgggccagccggtccaggcgccgggcggcttcctccgggcgtccttcgcggcgctccaggccggcctggagcaactccacatgcagcggcagcagcggactgcattccggcggcgtggccgcctgcccaccgtag

SEQ ID NO: 3676 - DNA, 747 bp, Pseudomonas aeruginosa
tccctcgaaagtgtgatttgcgcggcgcaaccactctggctcgcgcctttgcggcggatggagaatgaccgggcggtcgcgaaaacgcggagaccaagcgtttgcttggcctccgggcgtttcagcggtgtaggaaagccccgtcagacggtcgacaggaaggcgctgccggcttcctgccactgggcgatctcgatacggatgcgcttcttgtccagcttgccgacgctggtcttgggaatatcggtaacaaccgcgatctgcgaggggatcgcccacttgttgatgttgccctgctcgacgaaaggcttgaggtgctccttcaggccacgggcgtccagttgctggccctcgcgcaccaccagcagggcgaacgggcgctcgccccattgcggatcgggcaccccgaccaccgccacttcgcgtaccgccggatggcggctgatcaggtcttccagctccagggaggacagccactcgccgccggtcttgatcacgtccttgatgcggtcgcggatctcgatgaagcccatgccgtccagggtcgccacgtcgccggtgtgcatccagccgccgcgccacaactcctcgccgcgctcgggttcgcggaaatacccctgggtcagccatggcgagcgcaacaccagctcgccctgggattcgccgtcggccgggaggaagcggccctgttcgtccatgatcgccgcatccaccagcggcaccggcacgccggccttgatccggtag

SEQ ID NO: 3677 - DNA, 1182 bp, Pseudomonas aeruginosa
cgttccatgtccgatatcgtcatcgtcgccggcgcccgtactcccatgggcggcttccagggcagcctggccggcgtttccgcggtcgacctgggtgccgtcgtgatccgcgaagcggtgcagcgcgccggcatcgccgccgaggacgtacaggaagtgatcatgggttgcgtcctgcccgccggcctgaagcagggcccggcccgccaggccgcgctggcggccggcctgcccgccgccaccggctgcaccaccatcaacaagctgtgcggctcggggatgaaggcggtgatgctggcccacgacctgctcaaggctggcaccaaccaggtgatggtcgccggtggcatggaaagcatgtccaacgcgccctatgtcctggagaaagcccgcagcggcctgcgcatgggccacggcgagatcaaggaccacatgttcctcgacggcctggaggacgcccgtaccggccgtttgatgggttcgttcgcccaggagaccgccgacaagtacggcgtgacccgcgaggagatggacgcctatgccatcgaatcgctcaagcgcgcccaggccgccatcgccgatggctcgctggcggcggaaatcgtcccggtcaccgtcaccagccgcaagggcgagagcgtggtgaaggacgacgagcaaccgctgaccgccaacctggagaagatcccgagcctcaggccggcgttccgcaaggacggtaccatcaccgccgccaatgccagctcgatctccgacggcgcctccgcgctggtcctgatgaccgccgaggaagcccagcgccgtggcctgaagccgctggcgcgaatcgtcggccatgccacccagagccaggacccgagcgagttcaccctggcgccgatcggcgcgatgaccaacctgttcgccaggaccggctggagcaaggacgacgtcgacctgttcgagatcaacgaagccttcgccatggtcaccatgctcgccatgcgcgaacacggcctcgatcatgccaaggtcaatgtctatggcggcgcctgcgcccagggccatccggtcggttccaccggctcgcggatcatcctcaccctgatcaacgccctgcgccagaaaggcggcaagcgcggcgtcgcctcgctgtgcatcggcggcggcgaagccaccgccgtggcgctcgaactgctctga

SEQ ID NO: 3678 - DNA, 2742 bp, Pseudomonas aeruginosa
ctcggcgtacggaccatatgcggcgcctcctcagtgatagccatcgccgtgcttcaccttgccgcggaacacgtagtagctccaggcggtgtagccgaggatgaagggaatgatgaacagcgcgccgaccagcatgaagccctggctctgcggcggcgccgaggcctcccagatgctcaccgccggcgggatgatgttcggccacaggctgatccccaggccgctgtagccgaggaagatcaacaccagggtgagcacgaacggcttcacgtggtcgttgttggccaccgagcgcagcagcgcatagaaggtcaccaggaccaggatcggcaccggcaggaaccagaacaggttcggcaggctgaaccagcgtgcggcgatctcggcatgggccagcggcgtccacaggctgaccaccccgatgatcgccagcagcaccaacgccagcgggcgcgccaggtcgtgcatgcgctcctgcaggcggccttcggtcttcatgatcagccaggtgcagccgagcagggtgtaggcgacgatcagggccaggccgcagaacagcgggaacggcgcgatccagtccagcgaaccgccggcgaagctgcggttctccaccgggatgccttcgatgaaggcgcccagcgccacgccctggaagaaggtcgccaccagcgaaccgccgatgaacgccttgtcccagatgtgctgcttggccggcttggccttgaagcggaactcgaaggcgacgccgcggaagatcagcccgacgagcatgaagatcaacggcaggtagagcgccgacaggaccaccgcgtaggccagcgggaaggccccgaacaacgccgcgccgcccagcaccagccaggtctcgttgccgtcccagaccggcgccacggtgttcatcatcacatcgcggtcgccgctgtccttgaagaacggatagagcatgccgatgcccaggtcgaagccgtccatcaccacgtacatcatgatgccgaagatgatgatgaccgcccagatgaggggaagatcgatacccatgtctcagttcctcttgtcctggtcgcggtcggccgcttgcgcgtggccgtcgtgctcttcgtcgaaaccttcgccggcggccgacaacggccgtgccggcgtgcgcttctgcccggcgcctcccgggttggtctcgcgtccctcatgggtgaccgggcccttgcgcaccaggcgcatcatgtagccgataccgacgccgaacagcgagaagtacaccaccacgaaggtcagcagggtcaggctcatctgcgtcacgctctgcgccgaggaggcgtcggcggtgcgcatcagtccgtagaccacccagggctggcggcccatctcagtggtgaaccagccggcgaggatcgcgatcaggccggacggtcccatcagcagggtcaggcgcaggaaggccttcgagttgaacagcttgtcctggccgcgccagcgcagccacaggctccagacgccgaccaggatcatcagcatgccgaggccggccatgatccggaacgaccagaacaccacggtggagttcggccggtcttccggcgggaagtccttcagcgccgggatcggctcggtcaggctgtgcttgaggatcaggctgccgagcaccgggatctccaccttgaagcgggtttcctcgcgctgcatgtccggccagccgaacaggatcagcggggtcggctcgccgctgctgttgtcccagtggccttccatcgcggcgatcttcgccggctggtgctccagggtattgaggccatgggcgtccccgatcagcgcctgtaccggggcgacgatcagcgccatccacatggccatcgagagcatcttgcggatccccgggttgtcgcgcccgcgcagcaggatccaggcggccgaggcgccgacgaagaaggcggtggcgaggaacgcggcgaccgacatgtgcagcaggcggtaggggaacgacgggttgaagatcaccgccagccagtccaccgggatcacccggccgtcgacgatctcgaaaccctgcggggtctgcatccagctgttggaagcgaggatccagaacgtcgagatcagcgtgccgatcgccaccatcaccgtggcgaagaaatgcaggcccggtcccacgcggttccagccgaacagcatgaccccgaggaaaccggcctcgaggaagaacgcggtgagcacctcgtaggtcagcagcggaccggtgatggacccggcgaagtcggagaaatggctccagttggtgccgaactggtacgccatgaccagcccggacaccacgcccatgccgaagttgaccgcgaaaatcttcgaccagaaatgatagaggtcgcggtagacctcttcgttcgttttcagccagaggccttccagtacggccaggtagctggccaacccgatggtgatcgccgggaagatgatgtggaaggacacggtgaacgcgaactggatgcgggcaaggtcgatagcctccaatccgaacatggcaactcctcttcaggttctcggcccttccggcttacgtgcggattcggccgtgcttcctcacgcgcaacgctacgcaaggttttggaacacatccttcagctatcgttcttgtcattggaaagcgaccgcagccctggatggcaggaatgcgggaagggtcgcaagcagattcccggaccgcccgccttgatgcagagcaattcggtacgaaaatcttacccgttagcctag

SEQ ID NO: 3679 - DNA, 324 bp, Pseudomonas aeruginosa
tcaagccgaccctggcgaaggaaggcgtcgacctgcagatcaaggtgttcaccgactacgtgcagcccaacgtgcaggtcgccgagaagcgcctggacgccaactacttccagaccctgccgtacctggagaacttcaacaaaggcaagggcaccaacctggtcaccgtggtcggcgtacacgtcgagcccttcggtggttattcgaggaaatacaagtcgctggccgagttgcccgacggcgccaccgtcgccattcccaacgaaggcagcaacagcgggcgcgccctgctgctgttgcagaaggccggcctgctcaagttga

SEQ ID NO: 3680 - DNA, 240 bp, Pseudomonas aeruginosa
tcgaaggcgagaccggcaccggcaaggagctgctcgcccggcagatccaccgccacagcgaacgcgccggtctgttcgtcgcggtcagttgcagcgccctcagtcgcaaccatgccgaagccgagctgttcggctacgctcccggcgcccataacggcccggtcggcagccgcgccggctggttcggttcggccaatggcggcaccctgtacctggacgagatcgccgacctgccgctga

SEQ ID NO: 3681 - DNA, 504 bp, Pseudomonas aeruginosa
tgggcgcggcgatctcggtggcggtctccggggtcgacaagggcatccgcatcctctccgacatcaacatgctgctggcttgcagcctgttgctgttcgtgctgttcgccggtccgacccagcacctgctcaacaccctggtgcagaacgtcggcgactacctcggccacctgccgggcaagagcttcgacctctacgcctacggcggccccagcgactggctgggctcgtggacggtgttctactgggcctggtggatcgcctgggcgcccttcgtcggcctgttcatcgcgcgcatctcgcgcggccggacgatccgcgaattcgtcttcggcgtgctgttcatcccgctcggcttcaccctggcgtggatgtcgatcttcggcaacagcgccctggagcaggccctcggcggcgccagcgaactcggccgggtggccatcgagcagccgtcgatggccctctaccagatgctccagaactacccctggagccgcgcggtga

SEQ ID NO: 3682 - DNA, 624 bp, Pseudomonas aeruginosa
tgggctacaccaaggagcagatcatcaacgacatgctcgaccagtacgagcggcacctgcagttcctgcacctggtgcgttgagcgcaggaaaagggggcgcgcagggcgccccttccctcatcctccgtccctgaccgcggggaatgacgctagcggcaacatcccatccccgtgcagctgcgaatccctcagcgcgccagcactcgccggtagaacagcacgcagatcgcgacgaataccaccagtcccagccactgggcgatgcccgcgaagccggcgccggccagcgccagcggcgcgtcctcgccggtggcgccgatcaccccggcgagcaggatgcccatcaggctctcgccgacgatcagccccgaagccagcagcacgccgcgtcgcttcggctcttcggcataagcctcttcgtcgaccccggccgccgccgcacgcttcttcagggcattttccagcagccaggaaatcagcgcaccgaccaccagggtcatgccgatggtcggcggcaggtagatccccaggcccaccgccagcaccggcaggcaggccttgccggtacggcgcaggagcaggtcgacgaggatcagggcgatgcccagggcgacgccgatga

SEQ ID NO: 3683 - DNA, 1122 bp, Pseudomonas aeruginosa
  unsure (186),(225),(248),(318): Identity of nucleotide at the above locations are unknown.
gccgccgtgctgctcgcccagagggtgtcgccgccgtacggcggcaattgcttggcggcgagcacggctcccagcgccggggtctcgaggaaggtcacgtcggtgtgccagatggcattgtcgcgcacgtcggtgaccgcggtgtcgaggacgatgacctccggctgctccggcacgctggggtanatcggatggatgtgcaggtcgccgaagcgggcggcgaancgcgcctggctcctgggttccancgactggtcgcggaagaacagcacctggtgttcgagcagggcctgctcgatggcccgctggccggtgtcntccagcggcgcgccgaggtcgatgccggaaacgatggcgcccagggccgggctgatgggttggatggtcaggctcatgtcgtgctactcgtcgggcaggttgcgggcgcgccctgcgcgccctcgctccggccttcgccgcgtgagtgaaggccggttcggaaatgactcgggactctcgcgatcaaccccaggcggcgaagcgccgctgggcccagcgcagccccagttcgaagcccagggcgatggcggcgatcagcaggatgccgaccaccaccaagtcggtggcgaggaattgcgcggcggactggaccatgaagccgaggcctcggttggccgcgatcagctcggcggcgaccagggtagaccagccgacgccgagggcgatgcgcaggccggtgaggacctccggcaaggcactcggcaggatcacgtagcgcaccacctgccagcggctggcccccaggcagcgcaccgcctgcacccgcgatcggtcgacgcgacgcacgccggcggcggtagcgatcagcagcggcgcgaacagcgccaggtagatcagcagcaccttgctcagctcgccgatgccgaaccagatgacgatcaacggcaggtaggccaacggcgggatcggccggtagaactccaccagcggatcgagggccgctccggccaagggattgaggcccatcagcacgcccagcgggatcgccgtcagcaccgccgcgccgagcgccaggagcacccgcagcaggctggtgccgacgtgttgcagcaggctggcatcgaggtagccatcctgccatag

SEQ ID NO: 3684 - DNA, 672 bp, Pseudomonas aeruginosa
ccgaccgtgatgtcggcggcctgggcggcgacggaaaggctggcaaaggccagggctgccaccaggcggtgcagggaattcgggcgtttcatcgggcgaacctcggaggcaacggtgccgcgctccggaggagaacggaccagggacgggcaatgggtggcgacagcaagtccggtggtccggtgcgatgcagattacagatataaaaaactcgatataaataatattttggaattagtttatgagcgcgaatgcgcccccggatgcccttccgcccttgctccatgcccccgtccctacagggccgcgcccagcaaacgggcttccagggcctgtcggcgcaggcaggcgagcagcccggcgcgggccaccgcctccgcctcgctcgccagcagcgacgccgccgcgctttcgcggaatgtcagcgcgccgccgcgggcgaatgccgcctggaaggactccgccgccagttcgacaagacgcagcgcgagggcgaggagacgcggcgcctctccctgccccgccacgtcgcccggcacccgcgcagcctggcccaggtcgaggttggcctgggccaatcgggtcaagccttcgcgcagttgcccgcacggggtcggcggcaggccgggcggcaccaggatgtcctcgggatgcagccgcagccgctggtaa

SEQ ID NO: 3685 - DNA, 1311 bp, Pseudomonas aeruginosa
tcagcgccaactggtggtcgttgcgggtcaggatgcccaggcgcacgccgcgccgctgcaactcgcgcaccagttccagtgcgcccggcgccggccgcgcggcctcggccagggcgcgctcgtgttcgagcagccaggcgtgcttggccgccgcctcggcctcgggcagggcggcgaggtgcagcaggatgtcgtcctgctcggggatgtccagcgctcggcggatcgccgggaagtcgtgcacggcccgggtcagggtgccgtccatgtcgaacacccagtggcggatgtcggccagcctcacgcccagtcctcacgcttgcggatcaggccttcctggctcgacgaggcgaccagctggccgctctggttgaagatgctgccgcgcacgaaaccgcgtgcgttgccggcccaggggctgtcgatggcgtagagcagccactcgtccgcgcgcaggtcgcggtggaaccacagggcgtggtcgaggctggcgacctgcatggtcttctgccacaccgaaacggcatggggctgcatcgaggtggtaaggaaaccgaaatccgaggcgtaggccagcaggtacttgtgcagcgccgggacgtccggcagcttgccgtcggcacggaaccagaggtacttcaccggttcgtcgggctgcgggtcgtaggggtcgtgctgggtgaccggacgaatctcgatgggcttcggatacagcagcttgtcgcggatgcgctcgggaatccgctcggcgcgctggcgggtcagctccagttccgaaggcagattatccgggccaaccacctcgggcatctcgatctggtggtggaaaccttcctcgtcgtactggaaggagctgctcagggtgaagatcggctggcctttctggatcgcggtgacccggcgggtgctgaagctgccgccgtcgcgcacccggtccacctggtacaccaccggcatgctggcgtcgccgggacgcaggaagtagccgtgcatggagtgtacgtggcgatcgtcctccaccgtctggctggccgccgacagcgcctgccccaggacctggccgccatagagctggcggaagccgagatcctggctcatgccccggaacaggttctcctcgatgggttccaggctcagcaaagccaccaggttgtccagtatctgggtcatggggtgtttcctcgaattcgggctgtcgacgggctagtcgcggcgcatggccgggtacgcgggcatgttgcaaagacgagtgtcccacaccgcgcggccgagggtgaaatggtagagactggccatggactcatccgttag

SEQ ID NO: 3686 - DNA, 429 bp, Pseudomonas aeruginosa
gcgccggcccgatccagaacagtgcgtcgacgctctcgcactcggcgaagccgtcccggtcaaggccgaacaggccgtccagtgcgctttcggcgacgccgcgcagcaggcgcatctcccagccctggatcgccgcggcgatcgagaggcaggccagcgcgtggccgaggtcatgctggcagtagcgataggctcgctcaccgtatttccaggcctcgcgccagggcacgctggtcaatgccaggaggcagccgccgggcggcaagcagtcatccagcagcgaaaccagcggcgccggcagttcgccgcgcacctccagggcatgcttgtcgggacggtagtgggcgagcagcggcgccggctccagggtaccgccgggaagcagcaggtaggcttcggtgggatgcaggttgccgctcgacggattga

SEQ ID NO: 3687 - DNA, 1797 bp, Pseudomonas aeruginosa
ccgatgaaaggatcaccgcccttgacctgcagcgcccaccagccaaaaccgtgctcggcgaagtgcgcgtcgatgcggcgcagcaacgcgtcgctctgggcacgatccaggcaggacggaaagaactccatcaccagtggatcggcattcagctcggcgaacctggcccggtcctgcaccagccagggccgcaggatcagacggtgggtatacagccgtggcgagcgaagatgctcgatgctcaggctggtcaggtcggccatcgcttggttcctttcgttcaacgcactccagaaggactatctgaccgcaggaatcggctggggtgcccgcgagggcggtattccgatctttggtcaggctccgcggaaaaggctccccaaccggagtgtagtcttttccgcgcctggacatgcccgatcctcgggcaaagcgatgacgattggtttaccgcccgggcaacgggcgcgggccgcgtcaatccgtgcactcttccaccaggctttcgtccagggcgaggatcgccagtttcaccccaacggcgcactcttccacccaggcgaacgaggcgttcgggctgaggcaggcatcctcgaggcgccggcagctttccaccagttgctcgccacgcaccaccctcgccgcgcccttgatccgatgcgccagctcggccagttcgccggtctcctggcgttgcaccagtccctcgagggtctccaggtccttgcggttgctggtcagcagttcgtcgagcagccgcctgagcatcgtcggctcgccgccggtcagcgcatgcagggaatccaggtcgtagagacggggggccgtcggtatggcgacgggttcggcatcgatggtgacgggcagctcgtcggcggcgaagcccagggccagcaggcgctcctcgaggacatcgaggccgatgggcttgatcaggcactcgttcattccagcctggatgcagcgctcgatctcctccggctgggcgtccgcggtgaggccgatgatgaccaccggctcctcgccattctcgcgctcctcctggcggatcgagcgggcaaggtcggagccgctcatcagcggcatgtggcagtcggtgatgaccatgtcgaacggttgcccatgccacaggttgagagcgctcaggccgttctccgcttcctccacgtcatgaccgaggaagctcagctgttgatggaggatctgccggttgaccgcatgatcgtccaccaccagcacctgcaaccgccgcgcctggcgactgccgagcgggatcgcccgcacgttctcgacgatcggttccagcacctgcaggcgcagctcgacgtcgatccgcgtaccctgccccagctcgctgctcatcaccaggcgccctcccatcatttcgcacagcgagcgcgagatcaccaggccgagcccggtgccctcggtgttctgcaggttgcggttgacctgggcgaaaggccggaacaactgctgctggtcgcccagggaaataccgatgccggtgtcttccacacagagattgacctgcaacagcgacggctccacctggcggccatcgatgcggatgcggatcgagccctcgtcggtgaacttgatcgcgttgctgaccaggttggagaggatctgcttgaagcgcatggcatccagcagtacgtcgccgttgatgctcgaatcgatctccagcaccaggctcaggcgcttttgccgggccaggccttcgaatacccgtgccaccgattccaccagctcgcgcaggttggcccgtttcggcgacaggctgaggcgacctga

SEQ ID NO: 3688 - DNA, 1857 bp, Pseudomonas aeruginosa
ctcgatgcgggcgatgtcgagaatatcgccgatcagctccagcaggctcttcgccgaggcataggcgatctcgatgctggaacggtccacccgaccggtctcggcacgcttgagcgccagttcgaggataccgatcaccgcgttcatcggcgtgcggatctcgtggctcatggtcgccaggaaggtggtcttagcccggctcgcttcgtcggccagattctttgcctcttccagctcatcgatcaactggcggtgctcggtgatgtccagccagccacagatgacaccgcggatggtcccgctggaatcgcggaacggctggatccagtggtcgatccagcgctcccgaccgcccagcgccaccgggtagaccgcctcgatggtcctgccctcgcgcatggccctcaggtagctgcgatggaactccggagcggtctcgaagttttccatgggcagttcgagcacggtgcggttcatcacctcctcggaactcaagccgacgctctgcaggtagctgcggttgcaggacagcatccgtccattgacatcgcgcacatacagcggcggaggcatgcagtcggtcagggcctcgacgaaccgcaactggtcgctgagcgcctgttcgacccgcgcgcgcaccctgatctgccggcgctgataagtgacccagcccaggcagagcagcagcaaggccgctgcgatcgccaggatctcggtgatcaccaggatgtagtcgacccaggtctggccgctcattcccggcggcgagcgccagcgattgacgatatcgctcaggtcgtccggcgagatgctcagcaaggccttgtcgagaatcgactggagttcggcgtcgcctcggcgaacggcgaagtgggcggtggccgcaccgatgggaaccaggtcggcgatcgccagcctctcgcggaacaaccggacgatgtagtagcgagcggtgaccagcggcaccaccgccgcgtcggcccgtccttcgtagaccaggttcatggcatccagcgcgacgccgacctccaccatcgaggcctgcggatagcgctcgcgcacctgttgcatgcccacatggccggcgggaatcgctatgcgcttgccgtcgaggctcccggggctctccgcgcgtcccttgtcgtccgcccgggtgacgaggacgtacgaggtggacaggaacgagcgggtgaaacgcagcatttcctcgcgcttgctgctgcggctcatgatcgccaggtccgcctccttcctggccaatacgccgatctgctcggggaagccgccactgcgaggcgtgacctggaaatgcaggccggtgcggcgggaaatcatgtccagcaggtcggaggcgatgcccgagaaggtctcgtcggaattgaagaaggccagcggcgccaggtcgtcgttgatgaccaaccgcaccaccgggtggcgagcgatccagcgactctcctgcggcgtcagcgcgatacgctggcccgttggcagggaaccgctgccgacccagcgcctggcgatgctttcgagacggtcctggttgatcgcgccgatggccgagttgacgacgcgcaacaggttcgtgtcgccgcgacgaaggaggaagccgtagcccccttccaggcgggcatcggcaaaccgctcgaacctcacgtagccgtaataggaccgattgatccggtggtaggcactgagcacatcgtcgagatacaggtcggtatgtccgaaagccaccgcggcaacggcctcgtcatggctgccgaagaccacgaaacgcgcccgcgggaaacgctggcgcaattccccgacatgctcccgggccaccgccacgctgagtccggcgagatcctccggtga

SEQ ID NO: 3689 - DNA, 777 bp, Pseudomonas aeruginosa
caaagcgcatccgcgggaaattggcgaatgcatgatctgcgacaatctggccgacttgcgagcgggaaagcgcctgttgtcgaatggtcctcccattccgaacgcatatgccccctgcctggagccgtcatgagcgaacccctgatcctcgatgccccgaatgccgacgcctgtatcatctggctgcacggcctgggcgccgaccgtaccgacttcaaaccggtggccgaagccctgcagatggtcctgccgagcacccgcttcatcctcccccaggcgccgagccaggcggtgacggtcaatggcggctgggtcatgccgagctggtacgacatccttgccttcagtccggcgcgggccatcgacgaagaccagttgaacgcctccgccgaccaggtcatcgctctcatcgatgaacagcgcgccaagggcatcgccgccgagcggatcatcctcgccggtttctcgcagggcggcgcggtggtcctgcataccgccttccgccgctacgcccagccgctcggcggggtgctggcgctatccacctacgcgccgaccttcgacgacctggcgctggacgagcgccacaagcggattccggtcctgcacctgcacggcagccaggacgacgtggtcgacccggcgcttggccgcgcggcccatgacgccttgcaggcgcagggcgtggaggtgggctggcacgactacccgatgggccacgaggtgtccctggaggaaatccacgacatcggcgcctggctgcgcaagcgcctctga

SEQ ID NO: 3690 - DNA, 2181 bp, Pseudomonas aeruginosa
cgcccggagcttctctcagacggcgtgcagccggtagttcagcgcgtagccgccgagcagctcttccagcgccgcctggcgtctttcgtcaagcgcgggaacgtgcaggtgggcgagctggccgtggcgctcgtcggcgaccacctccacgcggatatcctcggcgatcctccggctttcctcctccagcacccggcggatcgcgtccaggcgcagcgccggcttgaaggtcttgcccaccgcggtgaccggcatgctctcgatcagccagatatccttgggcaccgccgcgcgctccggtacgtggcggctggcgtgctccagcagctcttcctcgctggcgctggcgccgggcttgagctggatatacgccaccggcagctcgccggccttggcgtccggcttgcccaccgccgccgccagggccacggccggatgccggtgcagcgcttcttcgatcatctgtgggtcgatgttgtggccaccgcgaatgatcaggtccttgctgcgcccggtgagccagatgtagccgtcctcgtcgatacgaccgaggtcgccggtattgaaccagccatcgccgatccagatatcgcggttccggtcctgttgcaggtagcccttgaacaccgtcgggcccttcaggcagaggttgcccacctcgttcggcgcggcatcgcgcaggtaattgccctcgccgtcgagcaccgcgaccttcacctggcagtacggcaggcgcaggccgatcgaacccggccggcgctcgccgccacgcgggttgcaactggtgccgcaggtaccttcggtgaggccgtagccctcgatcaccttgagcccggtacgcgcctcgaactggcggatcagctccaccggcatcggcgccgcgccgcacagggcgaaacgcaggctggacaggtcgcggccatcgctggggacctgcagcaacgccgcgtagatggtcggcacgccactgaagctggtgacccggtagcgttccaccagcttccagaagtcctggatcagggtcggattgcggtagccctggggcccggccaggagcacctgggcgccgcgatggaagggcgccaggccggtaaccatcacgccgttgacgtggaacagcggcaggccgcagagcagcacgtcgtccaccccgtagtcggcgttcaggcccatgatctcggccatcgccacctcgttgaagtggctgtgcggcgccagcttcggcgtgccggtggtgccgccggtgtggaaataggaagcgacgtcgtccggatggatcgcccgtccgctctccaggcggtctgccgggcagtcggcgatcagcgtatcgaagtccagcacgccctccggcagcggcccgcgctgggccttgagcgcctcgcgctgcggcgccggcaacaggttggccggatcgaccacgacgatcgcatacagctccggcaactgtgcgcgcaggccggcgaccttctgccacaggtcggtgccggggaacggcgccagggtcaccagcacccgggtgttggaggcgcggatcagctcggcgatgtgctccggctccagcagcgggttgatcgcattgacgatcccggcggcctcgccgccccagatcacgtagtgggtctgcggcaggttgggcagcaggaaggacaccgcctggtggctttccaggcccagccggtgcaaggcgttggcggtctgggtgacgcgggcgaacagctcggcatagctgatccgcaacggttcttcggcggcgctgccatgcagcaggcagctcagggcgatacgctggccgtggcgctgggccgagcgttgcaacagttcgtaggtgctggacggcaggtcgcgctgttccagcggcacgcgttccagggcttcgatatcgctcagcccgacgatcgatggggacggattcatggttttcttgttcttccgttggtgagtgggcggacactcgccggatcgctccggcaccgtcccgaagatgccacccccgtcgtcgccctaccgttgtctttttgtagcgcgccaccggtcgcgcgcacgagtcctcccgaaggctgccccgggagcttcgcgcagccccctccaggccccgtccggccagggctggagggcgccggccaagcatggatttctccccgctggcaacatgctttacactggcgcccgttcattccttaa

SEQ ID NO: 3691 - DNA, 1281 bp, Pseudomonas aeruginosa
cctcggcttcccctactgcaccccgatccaggcgcaggtactgggcttcaccctgcgcggccaggacgccatcggccgcgcccagaccggcaccggcaagaccgccgcgttcctcatctcgatcatcacccaattgctgcagaccccgccgccgaaagagcgctacatgggcgagccgcgcgcgctgatcatcgccccgacccgcgaactggtggtacagatcgccaaggacgccgcggcgctgaccaagtacaccgggctgaacgtgatgaccttcgtcggcggcatggacttcgacaagcaactcaagcagctggaagcgcgcttctgcgacatcctggtagccaccccaggccgtctgctggacttcaaccagcgcggcgaggtgcacctggacatggtcgaggtgatggtcctcgacgaagccgaccgcatgctcgacatgggcttcatcccgcaggtccggcagatcatccggcagaccccgcacaagggcgaacgccagaccctgctgttctcggcgaccttcaccgacgacgtgatgaacctcgccaagcagtggaccgtcgatccggcgatcgtcgagatcgagccggagaacgtcgccagcgacaccgtcgagcagcatgtctacgccgtggccggcagcgacaagtacaagctgctgtacaacctggtggcacagaacaactgggaacgggtgatggtcttcgccaaccgcaaggacgaagtccgccgcatcgaggaacgcctgaccaaggacggcatcagcgccgcccagatgtccggcgacgtaccgcagcacaagcgcatccgcaccctggaaggcttccgcgaaggcaagatccgcgtcctggtggcaaccgacgtggccggccgcggcatccacatcgacggcatcagccatgtgatcaacttcaccctgccggaggacccggacgactacgtgcaccgtatcggtcgtaccggccgcgccggcgcctcgggcacctcgatcagcttcgccggcgaggacgatgccttcgccctgccgccgatcgaagaactgctgggccgcaagatcacctgcgagatgccgccggccgaactgctcaagccggtaccgcgcaagcactgaacgcaggcgtggagaaaaaaggcgaagccatccggcttcgcctttttcgtttctgcgacacgcaggtgccgccgccggtcatcgaggcgggtcggcgcttgcccggcaataccttaaagtccagaatggacaaattgtttacatccattccggagatcgcatga

SEQ ID NO: 3692 - DNA, 1191 bp, Pseudomonas aeruginosa
ccctggccaacgccctctaccgcctgcgccaggcaggctgatcgcgtgatgcaggagagcagcatgatcgaagcggattacctcgtcatcggtgccggcatcgccggcgcatccaccggctactggctgtcggcccacggccgggtcgtggtgctggagcgcgaggcgcagcccggctaccactccaccggccgctccgccgcgcactacacggtggcctacggcacaccccaggtgcgcgcgctcaccgccgccagccgggccttcttcgacaacccgccggccggcttctgcgagcatccgctgctcagcccgcgtccggaaatggtggtcgacttcagcgacgatccggaagaactccgccgccaatacgaaagcggcaaggcgctggtgccgcagatgcgcctgctggacgcggaacaggcctgctcgatcgtgccggtgctgcgtcgcgacaaggtcttcggcgccacctacgaccccaccggcgccgacatcgataccgacgccctgcaccagggctacctgcgcggcatccgccgcaaccaggggcaggtcctgtgcaaccacgaagcgctggagatccgccgggtcgacggcgcctgggaagtccgctgcgacgccggcaactaccgcgcggcggtgctggtcaacgccgcaggcgcctggtgcgacgccatcgccgggctggccggcgtccgcccgctgggcctgcagcccaagcgccgctcagccttcatcttcgccccgccgccgggcatcgactgccacgactggccgatgctggtcagcctcgacgaatccttctacctgaagccggacgccggcatgctgctcggctcgccggccaacgccgatccggtcgaagcccacgacgtgcagcccgagcaactggacatcgccaccggcatgtacctgatcgaagaagccaccaccctcaccattcgccgcccggaacacacctgggcagggctgcgctcgttcgtcgccgacggcgacctggtggccggctacgccgccgatgcggaaggcttcttctgggtcgctgcccagggcggctacggtatccagacctcggcggcgatgggcgaggccagcgccgcgctgatccgccaccagccgctgccggcgcacctgcgcgagcacggcctggacgaggcgatgctgtcgccgcgccgcctgtccccctga

SEQ ID NO: 3693 - DNA, 264 bp, Pseudomonas aeruginosa
gcctatattgtttgtagtccatgcaagggattgcaagccaactcagccccaaggtttccacctttattttctggaggcaattgttacaataaaagcatcatgcccaagagaagcatcttcctctgtactctctttcgctctagtgttattattattgacatcatcaggcacttttactggattgacaagcccttcaaatatggcatcaagtcttgcctcgaacctccctacatccttatgccagatgaatccctcaatttttga

SEQ ID NO: 3694 - DNA, 1869 bp, Pseudomonas aeruginosa
tcttcgggaaggagagggaaacatcggcgccgaaggctattgcaccagcgccccatccgcaccctcgaaggcgaagccctcgatacaggcgtctcccgccagcacgccgatgtactgtcccaccgctcgctgcaacacctgcacctgcaggtgcgcggcgatctgtgcgcgggccgcgtcgaagtcgagcggctcgccgccttcgcgcgccagcagttccaccacatgcaggccatagcggctttccagcggatgctcgagcagcccgggcgcgcggcgcagcaggcgcttctcgaattcggggacggtctgccccggctcgatccagccgaggtcgccgcccgcctccttcgacggacaggcggagaaacgccgggccaggtcgacgaagcgctcgggatgcccgcgcaactcgtcgagcagctccgcggcctgcttgcgcgccgtctcgcggccttccaggtcgtccggcgcgcaggccagcagcacatggcgcaattgcaggcgccaggggccgagcaagcgccccggattggccgcgtaccaggtccggcaggcgtcttcgtcggcttccgggacctgcacctcttcctccagcaattggcggatgcgcgcttcctccggcgtctcgccgtcttcgcagcgggcctcgatgcccagcgcgtcggcccgttgcaggagcaactggcggacgatcagcgcacggcaggcggcctccagcgccagcgcgtagctgtccgccgggtggtattgcagctcgcgggccagcaggtcttcaccgatggccacgccgttgaccttcagttgcggcagttcgaccttctcgacgcgttcttcgtagtgggagcaactcatgatcgatcacctcggttcggcgggccggcgccggatgcgccggccgcccagggttcaggcaggacgtttctgacgcacgatctggtagcgccggcccaggtaccacaccggcgcgctgacgatgtgcaccaggcgggtgaaggggaacagcacgaacagggtaaggcccaggccgacgtgcagcttgtagaccaggcccaccggcgcgatggcctcggccgccgccagcggacgcagggtgacgatggcctgggcccagtcggcgagcatcaccatcaccgagccatccatgtgatgggtcgaggcgacgatggtggagaggccgaggatcagctgggcgtagagcaccagcaggatcatcaggtcggaggcgttgccagtggcgcgcacccgtgcgtcggtcaggcggcgcaggatcagtccgctcaggccgatgaagcagagcacgccgaagaagccgccggagaccatcgccagcagttgcttgttctcggtgctgatcaggtggtggtagaccgaggccggggtcagcaggccgacgaagtggccggcgaggatgaacagcacgccgacgtggaacaggttgctgtatacccgcatgcccttcttgctgagcatctggctggaaccggccttccaggtgtactgcgagaggtcgaagcgcgcccagctgccgaccaggcagatcagcagcgcgacatagggatagatcccgaagaacagaagattggtcgacatgctcagactccttcgcgggccgcgcggtactgcatctgcggtaccggctgggcgacccattgcaatggttgttcggtggacgccgttggacggcggccgctgctcgacgggcaaccgccggcggggtcggtgaagctcaccggggtttcctcccaggcccggtcgatggcctccaggctgtcgtcgcgctgttcctgggcctggtcgcgacgcaacgcgccgaggtccgggcgctcgccgccgagttccagcaacgcctcgaaaatcgccgcatag

SEQ ID NO: 3695 - DNA, 4506 bp, Pseudomonas aeruginosa
tcgagcaggtgtggcaaccgatgcatttgtcgaggttcagcaccatgccgacttgcgaacgaattttcatggcgtctctcctcaaatgtcctggggcagcggttgcggcagggcgtcgccgccgagtccgccgtggcggggttcgtccagccagtcgaccttgctcatcttgcgcaccacgacgaactcgtcgcggttgcagccgaccgtgccgtagtagttgaagccccaggcctgctgggcgtagccgccgatcatgtgggtcggtttgagcaccacgcgggtcaccgagttgtggtggccgccacgggtgccggtggtctcgctgccgggtacgttcacgatgcgttcctgggcgtggtacatcatcaccatgccgtccttgacccgctggctgaccaccgcgcggcaggtcgccgcgccgttggcgttgaacacctcgacccagtcgttatcgacgatcccggccttggccgcgtcgtgctcgctgagccagatgatcggaccgccgcgcgacagggtgagcatcagcaggttgtcgctgtaggtggagtggatgccccatttctggtgcggggtgatccagttcagggtgatctccgggttgccgttgggcttcctgttcaacagtttctcggtggtccgggtgttgaccggcggccggtagctgacgaagccttcgccgaacgcctgcatccacgggtgatcctggtagaactgctggcgaccggtgatggtgcgccacgggatcagctcgtggacgttggtgtagccggcgttgtagctgacgtgctcgtcctcgaggccggaccaggtcgggctggagatgatcttgcgcggctgcacctggatgtcgcggaagcggatcttctcgtcttccttgggcagcgccaggtgggcgtgctcgcggccggtgatcttcgacagcgcttcccaggccttgaccgcgacctggccgttggtttccggagccagggcgaggaccacctcggcggcgtcgatggcgctgtcgatacgcggccggccctggctgacgccgctctcgaccacgcgatggttgaggtcgccgaccagcttcacttccttctcggtgttccagccgatgcccttgccgccgttgcccagcttgtccagcagcggaccgagcgaggtgaacttgcggtagacgttcgggtagtcgcgctcgaccaggtgcagcgtcggcaggttgcgtcccggcaccggctcgcactcgcccttcttccagtcatggccgtcgccgccgaacggctgcgccagctcggtgggggtgtcatgcagcagcggcaccgtgaccaggtcctgctccacgccgaggtggccttcggcgacggcggagaacttcttggcgatggccttgtagatctcccagtcgctcttggcttcccaggccggatcggtggccgccgacagcggatggatgaaggggtgcatgtcggaggtgttgaggtcgtccttctcgtaccaggtagcggtcggcaggacgatgtccgagtacatgcaggtggaggacatgcggaagtccagggtggtgaccaggtcgagcttgccctcggcaccgtcgtcgacccagtcgacctcggtgggacgcggaccgccggccttgccgaggtcatcgttcatcaccccgttcttcgccccgagcaggtacttgagcatgtactcgtgccccttgccggaggagcccagcaggttggagcgccagatgaacatgttgcgcgggaagttctgcggatcgtccggcgattcgctggcgaagcgcaggccgccgctcttcagttcgcgcaccacatagtcggcgaccggcaggccggcggcctcggcctcggcggcgatgcgcagcgggttgcggttcagttgcggcgccgacggcagccagccgaggcgttcggcctggatgttgtagtccagggcgtgttcggcgaagcggctggcgtcggccagcggcgacagcacctcgtgcatcgacagcttctcgtggcgccattgcgagctgtgcaggtagaagaagctggtgccgttcatctgccgcggcggccggctccagtccaggccgaaggccagcggcgcccagccggtctgcgggcgcagcttctcctggccgacatagtgcgcccagccgccgccgctctggccgatgcagccgcacatcatcagcatgttgatgaccgcgcggtagttcatgtccatgtggtaccagtggttcatcgccgcgccgatgatcaccatcgccttgccgcgggtcttgtcggcgctgtcggcgaactcgcgggcgacctgcgtcgcgcgcgccgccgggacgccggtgatgcgctcctgccaggccggggtatagggcgtgtcggcgtcctcgtaggaggtcgccacgttgtcgccgcccaggccgcggtcgatgctgtagttggccatctgcaggtcatagacggtggccacccgcaggcgcttgccgtccgccgcgacgatctcgcggaacggcacccggcgcagcagtacctcgtcgttggcgacgcccttgaagtgcgggtgctcctgcccggcgaagtacgggaaggccacctcgcaggcatgttccgggccatcgagcagcgacagttgcaggcgcgtctggtcaccgctcctgccgtccagctcggcgatgttccacttgccagactcgccccagcggtagccgatggcgccggtgggcgagaccagcccgccgctgcgctcgtcgtaggcgatggtcttccactcggggttgttgtcctggccgaggttgtccgccaggtcggcggcgcgcaggtagcgggtcggcttgaacgcgccgccggcgtgttcttccagcaacaccagcatcggcatgtcggtgtactggcggcagtagtcgacgaagtaggcgctcggccggtcgaggtggaactccttcaggatcacgtgaccgaaggccatgcccagcgcggcgtcggtgccctgcttggggttgagccagaggtcggtgagcttggccacctcggaatagtccggggtgatggagacggtcttggtgcccttgtagcgcacctcggtgaagaagtgcgcgtccggggtccgcgtctgcggcacgttggagccccaggcgatgatgtagctggagttgtaccagtcggccgactccggcacgtcggtctgctcgccccagatctgcgggctggccggcggcaggtcgcagtaccagtcgtagaagctcaggcagaccccgccgatcagcgacaggtagcgggcgccggcggcgtagctgaccatcgacatggccgggatcggcgagaagccgatcacccggtccggaccgtaggtcttggtggtgtagacgttggccgcggcgatgatctcggtgacctcgtcccagctggaacggacgaagccgcccaggccgcgctggctcttgtagctcttcgccttggcggcgtcctcgacgatgctggcccaggcgttcaccgggtcgccgtgctgcgcccgcgcctcgcgccagagcttgagcaacggcttgcgcaccttcgggtacttcaggcggttggcgctgtagatgtaccaggaatagctggccccgcgcgggcagccgcgcggctcgtggttgggcaggtccggacgggtgcgcgggtagtcggtctgctgggtttcccaggtgatcaggccgttcttcacgtagatcttccaggagcaggagccggtgcagttcaccccgtgggtggagcgcacgatcttgtcgtgctgccagcgctgccggtaggcaccttcccaggcgcggctctcgttgctggtctcgccgtggccatcggcgaattcgccctgcttcttcttgaagaactgcaggcggtcgagcaggtgactcatcttgatctcctcacccggtctgtgccgggcgttacaacgctaatcaggggttgccgcgggctgctgccgacggactcaacagggactctccgcacccttgcgcgcgtaccaccaccaggtggcgacgatgcagctcaggtagtaggcgatgaacacgtagagggcgccctcggcgctgccggtcatgtgcagcgaggtgccgaacgccttcgggatgaagaacccgccgaaggcgccgatggcggcggagaagccgatcaccgcggccgactccatgctcgcgttgcgcgccgcgccggttttgtcggcctggccgtcgcgcacccgccgggcccactcgttgcggaagatcaccgggatcatgcggaaggtggagccgttgccgatgccggcgaagaagcacagcaggatgaaggcgccaaggaagccgaagaagttgccctggccgccgtcgcccggcaggaaggcgatcaccgcgaacaccccgccgatcatcagcgcgtagttccacagggtgatccgcgcgccgccgaacttgtccgccagccagccgcccaggggccggctgagggcgcccaccagcggaccgaggaaggcgtattgcagcgggttgacgtcggggaactgggtcttggctga

SEQ ID NO: 3696 - DNA, 1296 bp, Pseudomonas aeruginosa
cggcattcctcaggagtgggtgggaagggtgggaggaaggtcgacgtcggccgaggcggcctggccgtcgatgcggcgttgctgcttgatcgcgtagtgcatccagaccatgcagaccacggtcaggccgaacagcaacatgaagcaggaggagcgcacgccgatgtggtctgcggcgtatccgaacacgatcggcaagcagaagccgccgaggccgccgatcaccccgaccatgccgccgacggtgcccatgttgctcgggtagtagtcgtggatgatccggtacacgctggccttgccgaagccctgggcaatgccgacgacgaacaccaggaaggtgaacagccagacgttcaggccgatgcccaggctgaggtcgccctggatgccgtggatggtcatggtggtctgcgggtaggagaggaagaacaggcacaccaggcagacccagaacacgccccagttcaccgagcgcgcgccgtagtggtcgctgaaccagccgccgagggcgcggatcaggccggacggcaaggtgaacagcatggtgatgaaggacgcggtcttcaggtccaggccgtattcggcgatgtagtacttcggcagccacagggccagggcgaccaacccgccgaagacgaagaagtagtacaggccgaagcgccagacgcgcagctcggcgagcggcgccagttgcttggccagggtcggccgctggctggcctcggcggcacccttgaggtgcgccggatcggtccaggtgaacagccagaacagcacggcggtgaccagcatggccaccgagtagacctgcggcaccatgcgccagccgaaggcgaccacgatcatcggcgccaccaggttggtgatcgccgcgccggcgttgccggcgccgaagatgcccatcgcggtgccctggcgctccttctcgaaccaggccgaggtgtaggcgatgccgaccgcgaaggagccgccagccaggccgacgaacaggccgagcaccaggtagtgccagtactggctggcgaaggccaggccgtagatcgggatggccaccagcagcatgtggatgaagaacacgatgcggccgccgaagcggtcggtgatcaggcccagcggcaggcgcaccagggagccggtgaggatcggcagggcgaccatcaggccgaactgggattcgctcaggccaagctcgtccttgatgcggatgccgatgatcgaaaacatcgtccacacggcgaaattcaccgcgaaggacaaggtactcatgccgaggacggagtactgtttctgacgtag

SEQ ID NO: 3697 - DNA, 1881 bp, Pseudomonas aeruginosa
aaggcttttctcatgaacaaggcgaccgcgccggacgctgaccagcgggacagattctttggaggtagtgacagggccggaaagccgatcctgcgccgctccctggtagtccgcttcggctgctacctcaccctgctggtatcgctggcgctgatcgggatgttcagcgccctgctcttcgccgactacacgcaccaggacgccgcggtgatcaaccacgccggctcgttgcgcatgctcacctaccgggtcgccctggagcccagcctggaaggccgccaggcgctgctcgggaccctcggcgaacgcctcgacagcggcgacatccgccgcctgctgcaacgccaggacgccgacgacccgatccgccagttgcaccaggagctgcgcgagggcctcgcgcgcctggacccgcgcgcgctgcccggacgcgccgtgctggacgcctacgtcggcgacatcgaccgtttcgtcggcatcctccaggccaaggccgagcgccgctcgcaactgctcagcacggtgcagggcctgtgcctgttcctcagcctgctggtggtgttcgtcaccctctacgacctcagctatcacgtcatcggcccgctgcgcgaactcaccagcaccgcccgccgcctgggccgcggcgagctggacgcgcgggtcacctacagcggcgaggacgaactggcgcaactgggcgagcgcttcaaccagatggccggcgagctgaagagcatctacggcgacctggaagagcgcgtggaggacaagacccgcgccctctcgcagagccaccagcgcctcgaactgctctacgccagcgcccgccggctgggcgagaacccctacgacagccgcaccctgcaaccgctgctgaaccagttggagaaagtgctcgacgccggccgcgtgaccctctgcctgaacaaggacggggtcgagcgcgcctacagttcgctgaccaccaccgagcgcccggcggacttctgcctgcagggcgactgcggtagctgccgcgagcaggccagcgcctgcgaccaaccctcgtccctggcccagccattgctgatgcagcccttgtccatcgccggccaccgtttcggcgaactgttcatcgaaagccgcagcggccgcctggagaactggcagcagcaactgatcgagaccttctgcgacaacatcgcccgcaccttcgccctgtccctgcaacaggaacaggaaagccgcctggccctgttcgccgagcgcggcaccatcgcccgcgaactgcacgactcgctggcacagtcgctgtcctacctgaagatccaggtcagccgcctgggcaccctgctcaagcgcgaggcgccggcggagaagatcgaggacaccctcgacgaactgcgcgaaggcctcaacggcgcctaccggcaactgcgcgaactgctcaccaccttccgcctcagcctcgacgagccgagcctggaagccgcgctggggaacgccgtggccgagttcggcgagcgcggcgaggtgacgatcgaactggacaaccgcctgcaacacgtgccgctgagccccaacgaggaaatccacgtcctgcagatcgtccgcgaggcgctctccaacgtggttcgccattcgcaggcgcaacgggcctgggtgcgcctgagcagccaggccgacggccaggtgagcatcgccgtcgaggacgatggcgtcggctttgatccgcagcagaaccgtagcggccattatgggcttaccatcatgcaggagcgcggccagaccctcggcagccagttgcgcttcgaagcgcgcgcgccccacggcacgcgagtgctcttcagcttcgtgccgaccgccctgcaaccctccgccgccaaggagccgaccccatga

SEQ ID NO: 3698 - DNA, 666 bp, Pseudomonas aeruginosa
cgccgggcggcaagcgccgctgcgaatgaccggcgaggccgggggcggcggctatccccagcctgccgaaacccgcatccccgactttcggcctcccttgcgcatatcgcggcgcctccgccgcgtaagcgtgcccgtaccgcctgcgatacgcagcagtgcgctaggatgtcccctcggcttcgaagaaaggacatttcaatgctgatcggtgcgctgctggtcctcacctgggtcatcctcctcgtccgatacccggccaaggccctgccggtctccctggcggctctcgccgggctgggcctggtggcggcctgggtgatctggcaggacaacgacgaaagccgccacctgcaacgccaggaactgcgcctgagctatgcgccggaacgctgtccggtggaccggccgctggcggtcgaactgaagaacggcagcgaccgtccgttgctggagctacgctggaggatcgccgcctaccgccccggcgacagcgtcaacctggccgacaccagcttcgacagcccgcgctaccgggcgccgaacgccctgctcggcggcgacagctggcacgattgcctgccgctgccgccgctgcgtccgggctatcgcgccagcaccctggaattccgcgccgaacgcctggacgggcgtttcggcaactga

SEQ ID NO: 3699 - DNA, 765 bp, Pseudomonas aeruginosa
ccgagggaggacccgatggaaacccgccgtctgttcgaccagggctccgctgcctacgccagcgcccgcccgcgttatcccgatgcgctctaccgccatctcgccgggctctgcggccagcgccggcgcgcctgggactgcgccaccggtaccggccaggccgcgctcggcctggcgcagtacttcggcgaagtcctcgccagcgacaccagcgcgcagcagatcgaacacgccgttgtccatccgggtatccgctacagcgtgcaggacgccgaagccaccgactatcccgacgccgccttcgacctggtctgcgtagcccaggcctggcactggttcgaccattcgcgcttcaaccgcgagctgctgcgcgtgctgcgtcccggcggcgtgttcgccgcctggggctacggctggttcagcatcgacgcgcagatcgatgccgccatcgacgaggaatacctgcgcccgatcggcccgtactgggcgcaacagaaccgcctgctgtggaacgcctaccgggatgtcgagctgccgctgggcgaactccccgctccggccttcgtcatcgagcaacaatggagcctggcccggttgttcgactacatggccacctggtcggccagccgcctgtgccgcgaggcgcagggcaacgctttcgtgcgccaggccctgcaacgggtcgccgcgctctggggcgagccgacctcgacacgcagggttcgcatgccgctggcgctgcggatctcgcgcaaggacgcctga

SEQ ID NO: 3700 - DNA, 333 bp, Pseudomonas aeruginosa
gccaacccgtcgccttcgtcaccggctgctccagcggcatcggccgcgccctctccgacgccttccagcgcgccggctaccgggtctgggccagcgcgcgcaaggaggacgacgtgcgtgccctggccgaggccggcttccaggcggtgcaactggacgtcaacgacgccgccgcgctggcccgtctggccgaggaactggaagtcgaagccgccggcctcgacgtgctggtcaacaacgccggctacggcgccatgggtccgctgctggacggcggcgtcgacgccatgcgccggcagttcgagaccaacgtgttcgccgtggtcggcgtga

SEQ ID NO: 3701 - DNA, 690 bp, Pseudomonas aeruginosa
agaagcgcttcggtctcgacacgcgcctctgaaaccgccaggagataccgccatgggcgaccgccttgccgtacccatccgctactacgccctggccgggatcgccgcggcgatcctgctcaacgtgctgctgcgcggggtggttcgcttcggcggcctgccggccagcctgctgatcgccgcgctggtcgccggcggcctggcctggtggttcgcccgcgcgcagcggcgctggccgacctggggcgagcgcttgcgcctggtcgccctgtatggcggagtgctcggggtcctttacctgctgctggtcggcctcgcctcgctgaaaggcgatcccagcccggcggcactgctcatcgtggtgctgcactacctgtgctatccggcgctgttgctggtgttcttctccggcagggtctatggattcttcctgcgctgacaggtgaggctgcctcaacgaattcttcacattctcttcagctcggcttgacccgccctcgcctagtgttggccacccaccgcacgaggccgacatgcaccgttcaccgctcgcctggctccgcctgctcctcgccgccgtgctcagcgccttcctgctcggcggcccgctgcatgccgccgagactgccgccacgcgttcgccagcctgggcgcaagcggtcgacccgtcgatcaacctctaccgcatga

SEQ ID NO: 3702 - DNA, 468 bp, Pseudomonas aeruginosa
tgcactgcaagcacggcaacaaccgcaccggactgttcgccgccatgtaccgcatcgtcgtgcagggctgggacaagcaggccgcgctggaggaaatgcagcacggcggtttcggcgacgaggacgacatgcgcgacgccagcgcctatgtgcgcggcgccgacgtcgacggcctgcgcctggcgatggccaacggcgaatgcagcccgtcgcgcttcgccgtctgccatgtgcgcgagtggatggcccaggcgctcgaccggccgtaaacacgcgcagggccgaaaggcttggtcccgtcacgcaagtttggcacccttgggactcgccgccgcacgcggcggcccacttcgacagccgcgacgagactcccatgagcgatgccccgacctccccgcgcttcagcgccgccaccagcacccgcctgctcgaccatgcgcaactggaggcgctctgcgccgactatga

SEQ ID NO: 3703 - DNA, 669 bp, Pseudomonas aeruginosa
ccagtaatggacttcttcagcgtgctttcccatctcgactggtcccaggtcggccagctcaccctccagcacctgctgctggtactggtcgccgtaggcctggcgatcctcgtcggcgtgccgctgggcgtgctgatgacccgcttcacgtggctggccggcccgctgcagggcgccgccacggtgatgctgaccatcccctcgatcgccctgttcggcctgctgatgccggtctactcggtattcggccagggcctcgggccgctgccggcgatcaccgcggtgttcctctattcgctgctgccgatcctgcgcaacacctacctcgccctgaccggcgtcgaagcgggcatccgcgaggccggcaagggcatcggcatgaccttctggcaacgcctgcggatggtcgacattcccctcgcggtgccggtgatcctcgccggcgtacgcaccgccgtggtgatgaacatcggcgtgatgaccatcgccgcggtgatcggcgccggcggcctgggcgtgctgatcctcacttccatcagccagagcaacatgccgatgctggtggtcggcgcggtactggtcagcctcctggccatcgccgccgacctgctgctgcaatggctgcaacgcatcctcacccccaagggactgcgcgccagcgcgcactga

SEQ ID NO: 3704 - DNA, 1176 bp, Pseudomonas aeruginosa
caggagccgaacatgatcgaactggacaagctcagcaagaccttcacccagaagaacggcaaggagttccgcgccgtcgattccatcagcctgaccgtggagaaaggcgagatctgcgtcttcctcggcccctccggctgcggcaagaccaccaccctgaagatgatcaaccggatcatcccgccgacctccggccgcgtgctgatcgacggccaggacaccgcggacctcgacgaggtcaccctgcgccgccacatcggctacgtgatccagcagatcggcctgttcccgaacatgaccatcgaggaaaacatcatggtcgtgccgcgcctgctcggctgggacaaggcgcgctgcaaggagaaggcccgcgagctgatgagcatggtcaagctggagcccaagcagtacctgcaacgctacccgcgcgaactctccggcggccagcagcagcgcgtcggggtaatccgcgcgctggcggcggacgcgccgctgctgctgatggacgagccgttcggcgcggtcgatccgatcaaccgcgagtcgatccagaacgagttcttcgaaatgcagcgcaagctcggcatgaccgtgatcatggtcagccacgacatcgacgaagccatcaagctgggtgacaaggtggcggtgttcaagagcggccggctgctccagtacgaccacccggacaccctgctggcgcacccggcggacgagttcgtcagcgccttcaccggccaggacagcacgctcaagcgcctgctcctggtgcgcgccgaagacgccgccgacagcagcctggtcaccgcccggccgcagaccccggtggccgaggcgctggaactgatggacgagaacgaccggcgctacctgatcgtggtggatgaccagggcaagggcctgggctacgtgcgacgcaaggacctgcgccgccaggagggcacctgcgcgccgttcgtcaccccgttccgggtcaccgccagccacgacgagcacctgcgcatcctgttgtcgcggatgtacgagttcaacagctcctggctgccggtgctcgaccccgaccagcagttcctcggcgaggtcacccaggaatccatcgccgactacctcagctccggccgctcgcgcggcggcaagggcctgatcgtgtcgccggccgaacaggtcggggcctag

SEQ ID NO: 3705 - DNA, 1629 bp, Pseudomonas aeruginosa
acacgtagatccaggtcgccccgtcgctgcgcgcccactcggccagcgcgcgccgccactcgtcgcggctgggcagggcgaaaccagcggagcggccactcatcgcgaagacaccgctctgaccgggacgttctccggcgccagcttccgctgcgccggcgtatcggcgccggccccgacgccgccgccgagggcggtgagcaggctggcgtgggcggccagccgggcggcctgcacctgctcctggaccagttgctgctggaacagccgggtctgcgcgttgagcacgttgaggtaatcggtgaggccgcgctggtaggccagggtggcgatatcgtaggtcttctgcgcggaagccaccgattgcgcggcgaagtccttctggatgtccaccgaatgcaggcggatcaactggtcggaaatgttcttcagcgcatccaccagggtctggttgtattgctccaccgccgcgtcgtagccggccgccgcctcgcccaactgcgaacgcaggcggccgccgtcgaagatcggcagggtcaccgccgggccggcgctgtaggtgtacttggcgctgcggaagaactccagcatgccgccgccgacggcactgaagccgaccgaggccatcaggtcgacgttggggtagaagtcggcgcgcgccacgtccacgcccttggccagggcggcgacctgccagcggcgggcgaccacatccgggcggcgaccgagcagttcggccggcaaggcgctgggcaggctcggctgcgccgccaggttcaggcttggccggcggatcgtgcggccctcgcccgggcccttgccggccagtgcggcgagcaggttgcgggtgagctggatttcttcgtcgatcacctcgatgcggcgctcggtctcgggcagcggcacttccgcctggctgacctcgaaatgcgtgccgatgccgccgcgcaggcgacgctgggccagggcgaggatgtcgcgctgctgttgcagcatggccttggcgatgtccatctcggcgtactgcaacgagagctggacgtaggcgcggacgatgttgccctccagctcgagctgcgcctggcgcgcctcggcggcggccatgtgggccaggtcgacggcgcgctcgctgtcgctgcggtcgcgcccccagagatcgagcttgtagttcaggccgatctcggtggagttgttccaggaagtggtccgcgccaggtcgccggggccgtaaaaatagtcgtccggccagcggtggcggaccagcgagcccttgccctcgatctgcggcgactcgatggactccaccagcccggccatggacttcgcctggcgtacccgcgcatgggctaccgccaggcctggattgccgtccagcgccttctcgatccaggcgtccagctgcggatcggcatacaccttccaccactgcgcctgcggccagccggcctcgcgggcggcagcctggatcgcatggtcggtggccagggcgttggcgtcgagcgtggcggcctcgggggcgatatcgcctgtactgacacaaccggatattgcggagaaaacgacgagaaaaccgacgaaggagccgaccaaggtcagttccttcctgagagcacgcggcacgttgtctga

SEQ ID NO: 3706 - DNA, 1338 bp, Pseudomonas aeruginosa
ccgaggcaatccgctccggactgggcatcggcatcctgccggtgtattcggccatcgaggacctgggcaagggcaccctggtgcgggtcctgccgcaacaccgcctgcaacagctcaacgtctatgcgctgtacccttcgcggcagtatctcgacgcgaagatcaagacctgggtggaatacctcaaggaaagcctgcccggcctgctccagcgcgacgaagcggcgctggtggagctgggcctggaactcggaagaccctcctgagccgataatcgcccgcccagtggcgggcccctgcccgccgcttcgatggcggtggtatggtcggcgctttcgctcccgcttgcagagtcccgtcatgaaaaagaacgtcttcgtcttcagtcgcctcgcccccgagcatctcgaacgcctgcaatgccagttcaacgtccgcgtgctcgaaccgaaacagggcgacatcgacgcccagtacgccgccgccctgcccgatacccacggcatgatcggcgtcggccggccgctcggcgccaggcaactggaacaggcgatgcagctggaagtcatctccagcgtctcggtcggctacgacaactatgacctggactacctgaaccgccgcggcatcgctctcaccaacacgcccgacgtcctcaccgagaccaccgccgacctcggcttcgccctgctgatcagcgccgcgcgacgggtcgccgagctggacgcctgggtcaaggccgggaactggaagcgcaccgtcgacgccccgcagttcggcaccgacgtgcatggcaagaaactcggcatcctcggcctcggccggatcggcgcggccatcgcccggcgcggccgtttcggcttcggcatgcaggtgctctaccacggcaacaaccgcaagccggaactggaacaggaactcggcgcgcgcttcctcggcttcgacgaactgctcggcgaggccgacttcgtctgcgtggtggtgccgctgggagcgcagacccggcagttgatcggtgcgcgcgaactgggcctgatgaaaccctcggcgatcctggtcaacgtcgcccgcggccaggtggtcgatgaggccgcgctggtcgccgccctgcgggagaagcgcatcctcggcgccggcctggatgtctacgagaaggaaccgctggccgaatcgccgctgttcgccctggacaacgtggtgaccctgccgcacatcggctcggccacccacgagacccgccgggccatggccgagcgggcgctgcagaacttcgaggcggccctgcgcggcgagcggccgctggacctggtcaatccgcaggtgtggcgacgcggctga

SEQ ID NO: 3707 - DNA, 489 bp, Pseudomonas aeruginosa
ctattatcattcgttaatccttctgctccgggaatgtccaggtgtcgagcgccgacctcgcccatgcggccgcgttgcataccctctacagcgaccaccaccactggctcacgggctggctgcggcgccgcctcggctgcccgcagaacgccgccgacctggcccaggacaccttcgtcaaggtcctggtttcgcgccaggccgcgcgcatcgacgaaccgcgcgccttcctcaccaccatcgcccgccgcgtgctgtgcaaccactaccgccgccaggacgtcgagcgcgcctacctggaagccctggccagcctgcccgagcgggaagtccccagcgaagagacccgcgccatcgtcctggagaccctggtcgagctggaccgtctgctcgacggtctgccgccgctggccaaggagaccttcctgctggcccaactcgacggcctgggctacgccgagatcgccacgcagctgggcatctccctga

SEQ ID NO: 3708 - DNA, 819 bp, Pseudomonas aeruginosa
acaggccgtgcgctggctggtcgagctgcagggcggcgccgacgacgaacgcctgcgccaggcctggcagcgctggcgccaggcggccccggaacacgagcaggcctggcgccacatcgaggcggtcaaccagcgcctggccgggataggcacgccactggccctggccgccatcaacgcaccgcattcgccgcaacgccggcgcgcgctgaagaccctgctgctggtcctggccgccggcggcagcgcctggggcctgcgcgagagcggcagcctgcagcgctggagcgccgactatgccaccggcgtcggcgaacgccggcgcctggccctggccgacggcagtcgcctcgagctgaacagcgacacggcggtggatgtccgcttcgatgccggcgaacggcgcctgctcctgctgcgcggggaaatccagctcagcaccggccaggacccgcgcccgctgcacgtgtacagcgcggaaggccggctgcgaccggtgggcacccggttcgacgtgcgccagttcgccggacgcacccgcgtcgccgtccacgaaggcgcggtgcaggtggagaaccacgccggccagggcctgctgctgcccagcggccggcagctggacttcgaccgcgagcgactcggcgctccgcagccgctgccggtcggcagcggcgcctggaccgacggcatgctggtggccgccggcatgcgcctggacgaattcctcgccgaagtcgcgcgctaccgccccggccggctgggctgcgacccgcgcatcggcggcctgcggatttccggcagctatccgctggacgatag

SEQ ID NO: 3709 - DNA, 537 bp, Pseudomonas aeruginosa
cccagtactacgacggcgaggccgacatgcccggcggcctcggcaccgcggcctaccgcgacgacccgtaccagtcgacccgtccctacgacaagttctggggccgccgtaccctggccagcgccagctacgaatacacccccaacgccagccagaagctcaacgtcaccggcttcttcaccaagaccctgcgcagcggctacctcgaccagggccgcaacctcaccctgtcgccgcgcgagtactgggtacgcggcctggaaacccgtttcagccagggcttcgagctgggcgaaagtcgccacgaagtgggcatcggccaccgctacgtcaacgaagccagccacgagctgcgctactggacccgcgccgacagcggccagctacccagcaccggcagccgcaacgaccgcgacacccgcggcagcaccgaagccaacgcgttctacatcgacgatcgcatcgacatcggcaattggaccatcacccccggcatccgctacgagaagatcgattccgaacagaagaacctgctga

SEQ ID NO: 3710 - DNA, 468 bp, Pseudomonas aeruginosa
gcagttcagataggttgtccgcccccgagtggcacggcagagtgccagggtttatctcatagggacttgagcatgagcggcaaacccgctgcgcgcctgggcgatccgaccgcgtgtccgctgccgggccacggcagcaacccgatcgtcggcggctcgcccgacgtcttcttcgaccatctgtccgctgcccgccagggtgacgccaccgcctgcggcgccaccctcagcgccaacgtcatcgccaacgtactgatcaacggcaagcccgccaccgtggtaggtagcgtcggcacccacggcaacctggtggtcggcggggcgggcacggtgctgatcggcaacagcggcggcggcgcacccgctctcgccctcgccccaccgaagctgtgcctgcaatgcctgctgctggcggcacgccgcaaccaggccctggtgcccctggaaagcctcggcggcgcaccgtga

SEQ ID NO: 3711 - DNA, 468 bp, Pseudomonas aeruginosa
tggcgccgctggagcgttggcaggtctggcagcccctgcagggcggctacctcgtctatgaccgggaaacggagcggaccgccgatgcttgaactggatgccggccaactggatcgcctgcagcgggtccgcgacgacgaagtcatcgagcgggtcctgctggaggtacgccgggaggctcccgcctggctcgaacgacgcggcctgctgcccgccatccggcaactcggcgagctgcgcgcgacggcgctggaactgggtatcgaagagcccgggacgatcgaacgctttcttctgcacggcctggccttccccgctttccaggacacgccggcgtttctcgcacacatgcgccggccgctggcggacagcccggaacaacgcttccaggactacgaacggatcgtcgagtttcgcctggccagccagaaatggcgcgcgtacgaaacctcggggagaccggcatga

SEQ ID NO: 3712 - DNA, 480 bp, Pseudomonas aeruginosa
caggtcagcgccgctatgttccagcgagcggtagtcggccagcaggttgctgaccttgccggacatggtctggatgccgttgagggtgaacagcgcctcgccctcctggctgagcagcgggataccttcgggatactgctggcagcagaactggcagtcgtccttgggccggttctccgcccgcgcggtgaagcagcgcgccgagtaggccagcggcaggtgaccgtaggcgaagacctcggtctgcaattgctccaggcccagctgcgcagcctggtcgagcaccccgcgcagcagcttgccggagacttccaccggcggaatccagcggcgcatgccccaggaatacagttcggccagggcatgaccgttgtagaggttcagcgccggaccgccgacaaagggcacgccgcgctggctgaggtaatagacggcggccatgtcgttggcctcgacccggagttcgccgttctcgcatag

SEQ ID NO: 3713 - DNA, 612 bp, Pseudomonas aeruginosa
ccgggatcaagaaggcctcaggccatcagtgcggagaacggcagaaagtcgatcgcatcacccacgcccagggtggcgccgcgctcgatcaccgccagcccgtccgcccaactggcggcaagcagcatcgccgagccctgctgcgggtggatttccacccgcccccgttcatcgagccgcgcccgcaggtactggcgacgcgcccgcggttgcggccagtcgaaggccgccggcagcgccagcggccgcggcactacgtcgaacagtccctgctggcgaagcaggaacggacgcgccaccagcaatgcggtgaccagcgccgccgcagggttgccgggcagccccagccagggcttgccggccacggagccgaaggcgaacggcttgcccggctggatcgccaggcgccacaggttgacctcgccaagctcggcgatggcgcgcttgaggtggtcttcctcgcctaccgagacaccgccgctggtgaccagcgcgtcccattcggaggccgccaggctgagcgcatcgcggctggccaccagttcgtcggcgagcacttcctcgtcgtgcacctcgaagcccagaccgcgcagcaaggcgccgatgcagtaa

SEQ ID NO: 3714 - DNA, 423 bp, Pseudomonas aeruginosa
atctgcccggccaacagtgtctggccgggctcgcgcaattcgtcgccgctgctcagcaggccgatgcgcaagcgccgacgcaccgagaccgtggcgacgccgagactcgccagcaggccgagttcctgcgggcgcaagcgctgtccggcacgcagcaccggcgcgccacgacgcaactcctcgccgcgccggcgcacatgctggccggcgctcaccggcggcaactgcacgcgctcgccgtcgaccacgcagagttcctgcggcaccacgcagtcggcgccggtcggcagcggcgcgccggtgaagatccgcgccgcctggcccagcggcaggctcatgccgcgggtgtcgccggcggcgatccgcgcgccgaccgtcaggctgccgccgctgcgcggcaggtcggcggagcacaaggcgtag

SEQ ID NO: 3715 - DNA, 363 bp, Pseudomonas aeruginosa
ccgtccatcgcgctgttgtcccaatgcggcaggtccatcggcgccagcaggtcctcgccgagcactcgtcccagcgcccgctccagggccaggctctcgcaggctggcgggcgcggcgcgcgcgccagcagttcggccagcgcctcgtcgagcgggcgcagttggccgccatcgcaggcgcaagcgctcacgagcggcacccgcagccggccaccggcgccacggctggcggggtcttcaggtgcgggacgaaattgcacgggcgggtgcggctgtccagttgcgccaggagaatctcgttccaggcggtgcgacaggcgcccggcgagccgggcaggcagcacaccagggtaccgttgctga

SEQ ID NO: 3716 - DNA, 1593 bp, Pseudomonas aeruginosa
tcctcctcggcaagtacctggaaagccgcgccaagcgccagaccgccagcgccatccgcgccctctaggccgttgcgcccggagcgcgcggtgcgcctgcgcgacggtcgcgaggaagaggtggcgatcgccgagttgcgcttcggcgacgaggtggtggtgcgtcccggcgaacgcttcccggtggacggcgaggtgctcgacggcagcagccacgccgacgaggcgctgatcaccggcgagagcctgccggtgcccaaggctcccggcgacaaggtcaccggcggcgcgatcaacggcgaaggccgcctgctcctgcgcaccactgcgctcggcggggaaacggtgctggcgaagatcatccgcctggtggaagacgcccaggccgccaaggcgccgatccagaagctggtggacaaggtcagccaggtcttcgtcccggtggtgatcctcatcgcgctggtcaccctcggcgcctggctggtcgccggggtcggcctggagcaggccctggttaacgccgtggcggtgctggtgatcgcctgcccctgcgccctcggcctggccaccccgaccgcgatcatggccggcaccggcgtggccgcgcgccacggcatcctgatcaaggacgcagagtccctggaagtcgcccatgcggtcaccagcgtggccttcgacaagaccggcaccctgacctccgggcgaccgcagatcatccacctcggcggcgacgaccaggagcaactgctcaggctcgccggcgccctgcaacgcggcagcgagcacccgctggccaaggccgtgctcgagcgctgcgccgagcgcgacctggaggttccgccggtgaacgccagccaggccctcagcggtcgcggcatccagggcgaggtcgagggtcgccggctggccctgggcaaccgccgcctgctcgacgagcaggaactcaagcccggcgcgctggcgagtgccgccgcggactgggaggccgagggccgcaccctgtcctggctgctggaactggctccggagaaacgcgtgctcggcctgttcgccttcggcgacagcctcaaggacggcgccgccgaagcggtggaggccctgcgcggacgggatatccacagccacctgatcaccggcgacaaccgcggcagcgcggcggtggtggccaaggccctgggcatcgacgacgtacacgcggaagtgctgccggcggacaaggccgccacggtcgccgagctgaaaggccggggccgggtggtggcgatggtcggcgacggcatcaacgacgccccggcgctggccgccgccgacgtcggcatcgccatgggtggcggcaccgacgtggccatgcacgccgccggcatcaccctgatgcgcggcgacccgcgcctggtgccggcggcgctggacatctcgcggcggacctacgcgaagatccgccagaacctgttctgggccttcatctacaacgtgatcggcatcccgctggcggccttcggcctgctcaacccgatggtggcgggcgcagcgatggccttctccagcgtcagcgtggtcggcaacgccctgctcctgcgacgctggaagccctga

SEQ ID NO: 3717 - DNA, 495 bp, Pseudomonas aeruginosa
gcacctcgcccgcaccgcccgcgggctcggcgggcggctccggcaacagcgcgcgcatgcgctgggcgccgggacaggcagggaagcgctgcaactgttcgcgcaaccattccggctgctgcacgagcaattcgtggagcggcagcaaggctccgccgactgcgccctccatggcctgttgcagggtcgccagcgcctcgcgctcgcggccctgctccaggtgcagcgcggccagttggccgagggccaggcgagccggcagcaacgcgccgttctcccgcgtcgagcgggccagccggtccaggcgccgggcggcttcctccgggcgtccttcgcggcgctccaggccggcctggagcaactccacatgcagcggcagcagcggactgcattccggcggcgtggccgcctgcccaccgtaggtgccgcccaggcgctgtagccagacgccggccagttcggtctggccctgggccagccagagttcgcacttga

SEQ ID NO: 3718 - DNA, 741 bp, Pseudomonas aeruginosa
tccacttgcgcgcttcgtccggctgcagcgccaggctgcgcaggtagccgcggtacagcaggagccgcccgcgcaccgcgtagcggcgttgcgccggcaggtgctggaggcgttccaggccctggcgcacctcctcctcggcgcgcgccacctcgccgcgcgcctggaggacgcgggcgcggtcgtaatggaccagtgcctcgaacagcgggttgccgtagcgctgggcgaactccagggcgtcgcggttgtagttgcgcgcctgccagaagtcgccacgggtcaccgccaggttgctcagcgtcgacaggcattgcaggcgggtgccatagcgctccccggcgaggtcctgcaaggcctcgcggcagtgcgcctcggccttgtcgatatcgccgcggccgcgcgcgatcaccccgctcagggcctgccactgggccagcaggtcgcgctgcgcggactcgtccggcgccggcaggaaacgcgccagttggccggccagttcttccgcggcatccagctggcaggccagcgccagcgcccagccgtacagcaggatcaggcgcggcgtgctcgccaggaggctgtccggcaggtccatcttccagcgcagcagggtggcgatgttctgctccgccagcagttgctcttccgacaggttctgcaccaggctcgccgccacgtccggctggccggcgcgcagcgcctgctccaccgcctggtcgagcaggccatggcggctga

SEQ ID NO: 3719 - DNA, 567 bp, Pseudomonas aeruginosa
ggaggaattgcaggcaacggtcgagcaccgcgccctgggccaggtggtaatcgtccagcaccagtagcaggggacgctgcgggtccaggcagggggcgagttcgtcgagcaggtcgtcgagccaggtctcgaaggcgaacggctggtgacgctggcgcatcttcagcaggccgagggcctcttcgcccagggtcgggtggtactgtcgcaagccatcgagcaggcgttcgaggaaacgtccgggatcgctctcgcggctgctcagtcccagccagaggctctgccagcgcggatcgaggctttcgcagaactcgatggccagggaactcttgccgaatccggcgggcgcggcgatcagcagcaggcgaccgtccagtccgtcgcgcagtcgacggcaaagacgcgggcgcgccacatgggccgacggcagcggggggcggaaaaagcggttggccgtcggcagaacggcggatggagtgcccgagaaggtgcgcgagaagtcagtcatcacccggtttcttggtttatgtatggggcgtgaacgctccggagactaaccacaagtga

SEQ ID NO: 3720 - DNA, 3417 bp, Pseudomonas aeruginosa
gaacgccgtttctcagcgtaccccttcctggcgcagcgccgccggggtgtagtcgctttccgatgcgctgtagttgaagtcgtaggcctgtttctcctcgttcttcatgccaagcgccaggtagcggccggagagcaggtcgtagagggtttccaccgcgtaccagggcacctgcttgtcgtagtactgctcggcatgcgcctcggccacgcgccacagggtgccgcgaccgtcgtaatggtcgatctcggcggcctgccaggtgtcctcgtcgatgtagaagtcacgcttggcgtagatgtgccgctcgcccggcttcagggtcgcgaccacatgccagacgcggtgcagctcgtagcgggtcaggtcctggttgatgtggccggccttgacgatttcgctgtacttgatcttcggatcgtcgagcttgtagctgttgtagggaatgtagatttccttcttgccttccagcttccagtcgtagcggtccggcgcaccgttgtacatgtcgaagttgtccgaggtgcgcaggccgtcggcggcggtgccgggaccgtcgtaggacacctgcggagcccgccgcacgcggcgctggccggcgttgtagagccacgccaggcgcggctccttgacctggttgagggtctcgtggaccagcagcacgttaccggccaggcgcgagggcgcggtgacccgctgcttgaagtagaacagcacgttgctcggcttgttcgggttgtagtccttcaggttagtacggaaggtgaaggcatcctggaagtagaccagctggtaggagccgttgacctgcggagtggcctgggtcaccaggcgccggacgctgccgccgcggtagcgggtgatgtggttccagatcacctccaggccgttctgcgggatcgggaacgggttggcggtatcgaagttctccaggccgttgccgccttccaccagcttggtggtggtggcgttgcgcttggccgcctcctgcaccgccgccgggacggtggcgctgcggtgggtcttgtataccgggatcttgtaggtatccgggtagcgcttgaacatggccagttggccgggagtcagcttgtccttgtactggtcgacgttctgcgcggtgatggtgaacagcggttgctcgctggcataggggttggcgaggaagccacggctgtcgacgctgccggcgttggtcgccaggccgccgtcccaggcggggatgctgccgtcggcgttgccggccttctccgcccccaacggagtcaggctggtgccgagcttggccgcttcgtcggcggataccgccgccatcacctgggtggccagcaggctcagggccagtacaccggtatgcagaagaatcttcgttgttttcattcgctcgtcgtcctcgttaagtcctgctcgccggcccggttcgcaccgggccggcgtacatcagaagttcatgccgaagctgagcgcgacgaagtcgcgatcgtccacggtggtgtacttgccgtcgaagaagttggtgtaggagaggctcgcggtgtaggtgttctggtactccgcgtccacccccaggctgaccgccttgcggccttcctcgaagttggcgccgggaccgggcgaatagccatcgacgtcgtgcgaccaggccacgctgggcttgaggttcacgcccatgaacacgtcgttgtagtcccagatcgcacgggcgcgataaccccaggcatccgaggtggtatagccatcgttctcgcagtagcggctgacgttgttcgcttcggcggtgcccagcgtgctgacgttcagcgcctggcagctggccaggccggagatggtccccggcagcggccccggtccgaagaccgggtcacgcccgtagcgtgccttggaggtgctttccaggccgccgacgtgggtccagccgatctcgcccaccagggtcaggcgctcggcgcccatcacctggtcgaagaagtgcgtcagggtggtctgcagttgggtgatctccttgcgccgatagccgtgcaggtcctgcccggcctggccgttcagcaccgaggcgttgtcgtaggggcggttgccgccgatgctcaccgggtcgaggccggcgaagaggatgtcggtggtgttcaactgcaccggcgcgttgggccggtagctgacttcgccgctccacgcggtgccgttgggcaacgtggtggagaagctcaggccgaacatgcggatatcttccgggtactcgatgaagtagctggagttgccggcggtggccgccgccgcggcctgggcggccagtgccgggttgatcgcggcgaggcgggtggcgaggtcgttgatcgccgccatggtgctggccgaggcgccctggccgctgaagatcggcaggcggctgtggtagttcatgtagtaggcgccgaactcggtgttcagttcgtcggcgaagtagcgcagggcgaagccgtactggccgctgtcgcgagcgtcgcggtccggcccgcggcggaccaggatgccctcgtcccagggcgacggggtaacgctcaggccagccccggcgagcacgttgttgagcaggttgatggacgccttgttgttggtcagcaccgccaggttctggtcgcagccatcggccaccacgtccggctgggagaagaaggtgccacagttgtcgaccaccgtctggtcccactcgatctggtagaagccttcggcggacaggttgtcggtgaggttctgcgacaggtagaacatgttcaccgggatcaggccttccttgatctccgagccgggccggcggaaggcggtgacgtcgatcgggttgatggcgctgatgccgttctggatgaaggtgctctcgccccagttcaccacctgcttgcccaggcgcacgctgcccggcaggtcgccgatggcatagttgtggtagatgaaggcgtcgagcagttcggctccggaggacttggccagggtcttgcggccgctgtcgtcgatgtccttgaactcgcggtgctcgtccttcagctcgaagtcgtaccagtacttgccgcgcaggaacacaccggtatcgccgtacttcagttcgaggtcatggatgcccttgaagaccttcgagaacgtttccccacgcttgaagttcaagtggctgtcgtcggaggtctgggaaagtcccttgccgccgttgttcacaccgatcaggttcttgttcggcttggcggtcgaccaactggccccgaccgacaacgccgaatcgaaggaaccttcgatttccccgatgttgaaggtcaccccaaaggccggagccgccagcgaggaagccaggctgacggccaacggcaaccgggcccgacgcgagaacggattacgggttgtcatcgacgctactccatgtgtgttttttgttatgagtgcgtggactatagctag

SEQ ID NO: 3721 - DNA, 417 bp, Pseudomonas aeruginosa
tcaacgccctgcgccagaaaggcggcaagcgcggcgtcgcctcgctgtgcatcggcggcggcgaagccaccgccgtggcgctcgaactgctctgatacggcgttgagccatcggcgcccggccggctcgcgctgtccgggcgccctcttcctcaggtgcccaccgcggcgctgcgcgccggacgcggaaacaccagcgccgcggcgaaggtcagcgcggcgaagcccgccagtaccaggtacaaccccagcagcccctgccgtggctccaggtaggcgatcatcgggatcgccgccgcgctggcgccgaacgacaggaaatagcgcagggcgaagacccgcgcctgccactgcggcgcgacgaagtgggcgaccatcgcatcgttcaccgtcacctggccgaacaccgcgaacatga

SEQ ID NO: 3722 - DNA, 849 bp, Pseudomonas aeruginosa
cccgggcatgataggttgaccgaaaagcgcagacaggacagcgaggtcatcgaaacggacatgctgatcgagcaccgcccggacggcctgctggccgccatctccctcgacttccccgacggccatcacctggggcggcatttccacccgcaggcgcagttcctctacgccgctcgcggcctgatgcgcctggccacccaccacggcgcctgggtgatcccgccgacccgcgcggtatggattccgccccgggtggagcacgagatattcatgtccggcgaggtgcacatgcgcaccctgttcatcgagcaacccgaaacaccgacaccgctaagcgactgttgcgtactggcggtgacgccgctgctgcgggaaatgatcctgcgcgccatccacctcgagagccagccgcgcctggacgacttccgccagcgcctgcaagggctgatcctcagcgagatcgccaacctcgaacggatgccgctgtacctgccgatgccccgcgaccgccgcttgcaggcgatctgccaggcattgctgaaacagccggaactggggctgaccctcgatgactggggcctgcgggtcggcgccagctcgcgcaccctggcgcggctgttcgcccaggaactgcagatgagcttccatgagtggcgccagcaactgcgcctgaccgaagccctgccgcgcctgctggccggcgacagcgtgcaggtggtcgcccgcgacctcggctacggcagtacgcgggccttcagcagcatgttccgccgcctgctcggcgaaaccccgcgcgactacctggggcgactggagcaactggcacggatcaggggccgcgaggactga

SEQ ID NO: 3723 - DNA, 261 bp, Pseudomonas aeruginosa
gcgacgatcagggccaggccgcagaacagcgggaacggcgcgatccagtccagcgaaccgccggcgaagctgcggttctccaccgggatgccttcgatgaaggcgcccagcgccacgccctggaagaaggtcgccaccagcgaaccgccgatgaacgccttgtcccagatgtgctgcttggccggcttggccttgaagcggaactcgaaggcgacgccgcggaagatcagcccgacgagcatgaagatcaacggcaggtag

SEQ ID NO: 3724 - DNA, 630 bp, Pseudomonas aeruginosa
accacccagggctggcggcccatctcagtggtgaaccagccggcgaggatcgcgatcaggccggacggtcccatcagcagggtcaggcgcaggaaggccttcgagttgaacagcttgtcctggccgcgccagcgcagccacaggctccagacgccgaccaggatcatcagcatgccgaggccggccatgatccggaacgaccagaacaccacggtggagttcggccggtcttccggcgggaagtccttcagcgccgggatcggctcggtcaggctgtgcttgaggatcaggctgccgagcaccgggatctccaccttgaagcgggtttcctcgcgctgcatgtccggccagccgaacaggatcagcggggtcggctcgccgctgctgttgtcccagtggccttccatcgcggcgatcttcgccggctggtgctccagggtattgaggccatgggcgtccccgatcagcgcctgtaccggggcgacgatcagcgccatccacatggccatcgagagcatcttgcggatccccgggttgtcgcgcccgcgcagcaggatccaggcggccgaggcgccgacgaagaaggcggtggcgaggaacgcggcgaccgacatgtgcagcaggcggtag

SEQ ID NO: 3725 - DNA, 789 bp, Pseudomonas aeruginosa
tatttttatggaataaaaagagtcgctactctccccttcaagccgcccctcgcgtgttggcgcccctccttcaccgccctgaacgcagcggcggacatcgccctacaaggatcgaagaatgaaaaaactgctcctgctgactgccctggcctccgtcatcagcgtttccgccaacgcagcggaaaagctcctcgtcgccgccacgccgatcccccacgcggaaatcctcgagctgatcaagccgaccctggcgaaggaaggcgtcgacctgcagatcaaggtgttcaccgactacgtgcagcccaacgtgcaggtcgccgagaagcgcctggacgccaactacttccagaccctgccgtacctggagaacttcaacaaaggcaagggcaccaacctggtcaccgtggtcggcgtacacgtcgagcccttcggtggttattcgaggaaatacaagtcgctggccgagttgcccgacggcgccaccgtcgccattcccaacgaaggcagcaacagcgggcgcgccctgctgctgttgcagaaggccggcctgctcaagttgaaggatccgaacaacgccctggccacgcccaaggacatcgccgagaacccgaagaacctgaaattcaaggaactcgaatcggccctgctgccgcgcgtgctggaccaggtcgacctggacctgatcaacaccaactacgcgctggaggccaagctcaacccggccaaggacgcgctggtcctggaagaccacgattcgccctatgtgaactacctggtggcgcgtcctga

SEQ ID NO: 3726 - DNA, 642 bp, Pseudomonas aeruginosa
cgtgcgcctggtcaccgccaccagcgtcgacctggaccaggcggtgcgcgccggcaagttcctagccggcctgcagcagtacctgcacgacggccgcctgagcctgccgccattgcgcgaacgtccgggagacatcctgccgctggcggaatacttcatcggcgtctatgcccagcgcctggacctgccggtgccggccatcggcgtggaaacccagcgggtcctcgagagctatccctggccaggcaacatccgcgagctggaaaacgtcgtccacttcgccctgctggtcagcgacaaggaagaaatcctgccgcagcatctgaattttggcggggcaacgccagacccatcgctggccggtctgcggcgcctgctcggccaagccggagcgccgtcgctggagcaggtacaggccctgctcctgcaactggccaccgagcaggcaggcggcgacgaggaggcgggaaggcggcgcctgggactggcggcgaactgaaggaatccttcggcgaacgtgcgggaaaagcgcggcgccgaaggcttccatacgtccgaaggattggctcccgggcccttgatcgtgtttatattgaacgcttgatcaaattaaggacgaggagaccagcctgttttgactga

SEQ ID NO: 3727 - DNA, 1908 bp, Pseudomonas aeruginosa
cgcacaatcgccctccgccaccccctccacccccacgcccatccgcatgaatcccccggtgttctacggtgcggcgatcctgatcctgctgttcgccgcagtggtcatcggcttcccccagcgcgccggcgaatggctgctggccgcgcagacctgggcctcgcagaccgtcggctggtactacctgctggcgatgacgctgtacctgatcttcgtggtggtcaccgcgctttccggctacggcaagatcaagctcggtgccgaccacgacgagccggaattcagctacctgtcctgggccggcatgctgttcgccgccggcatcagcatcaccctgttcttcttctgcgtatccgaaccactgacccacttcctccagccgccgcaaggcgaggccggtacccaggaagccgcgcggcaggccatggaactgctgttcctgcactggggcctgcacggctggggcgtattcgccctggtggcgatggcgctggcctacttcgcctaccgccacaacctgccgctggccctgcgctcggcgctctacccgttgatcggcaagcgcatcaacgggccgatcggctacacggtggactgcttcggcatcatcgccacggtgttcggcctcggcgccgacatgggcttcggcgtgctccagctcaactccgggctggactacctgtacgccatcccgcatacccacccggtgcagatggcgctcatcgtgttgatgatgggcgcggcgatctcggtggcggtctccggggtcgacaagggcatccgcatcctctccgacatcaacatgctgctggcttgcagcctgttgctgttcgtgctgttcgccggtccgacccagcacctgctcaacaccctggtgcagaacgtcggcgactacctcggccacctgccgggcaagagcttcgacctctacgcctacggcggccccagcgactggctgggctcgtggacggtgttctactgggcctggtggatcgcctgggcgcccttcgtcggcctgttcatcgcgcgcatctcgcgcggccggacgatccgcgaattcgtcttcggcgtgctgttcatcccgctcggcttcaccctggcgtggatgtcgatcttcggcaacagcgccctggagcaggccctcggcggcgccagcgaactcggccgggtggccatcgagcagccgtcgatggccctctaccagatgctccagaactacccctggagccgcgcggtgatcaccgtcacggtgctggtcagcttcgtcttcttcgtcacctcggcggactccggcaccgtggtcctctccaccctctccgcccacggcggcagcgccgacgacgacgggccgaagtggctgcgggtgttctggggctcggtcaccgcgctggtcaccggcgggctgctgttcgccggcagcatcgacgcgctgaagtcggcggtggtgctgacctccctgcccttctcgctgatcctgctattgatgatgtggggcctgcacaaggccttctacatggagtcgcagcgccagcgggcgcggagccactccctggcgccgctgatgagcggcaacggcaagcgctccggcggctggaagcgacgcctgtcgcaggccgtgcacttcccctcgcgggacgaggtgtaccgcttcatgaacgacgtggtgcgcccggcgatcagcgaggtttccgaggtgttccgcgagaagggcctggcggtggacgcccagctcgacccgggcaacgcctcgctgagcctggagatcggtcatggcgagcagcatcggttcctctaccaggtgctgatgcgcggctacttcacgccgtccttcgcgcgtgccggcatgggcggcctgcacctgaagaatcgccgctacttccgtgccgaggtgcatctcgccgaaggtag

SEQ ID NO: 3728 - DNA, 1833 bp, Pseudomonas aeruginosa
ccgcggggaatgacgctagcggcaacatcccatccccgtgcagctgcgaatccctcagcgcgccagcactcgccggtagaacagcacgcagatcgcgacgaataccaccagtcccagccactgggcgatgcccgcgaagccggcgccggccagcgccagcggcgcgtcctcgccggtggcgccgatcaccccggcgagcaggatgcccatcaggctctcgccgacgatcagccccgaagccagcagcacgccgcgtcgcttcggctcttcggcataagcctcttcgtcgaccccggccgccgccgcacgcttcttcagggcattttccagcagccaggaaatcagcgcaccgaccaccagggtcatgccgatggtcggcggcaggtagatccccaggcccaccgccagcaccggcaggcaggccttgccggtacggcgcaggagcaggtcgacgaggatcagggcgatgcccagggcgacgccgatgaggatcatgttccagttcagcgcgtcgtggaaaatcccgctggcgatcgccgtcatcagggtcgcctgcggcgcggccagggcctggccggggtccattccctcgcgcggcagggccccggtgaagccgtaggcgctgtagagcagttccagcaccggggggatcaccagcgcgccgacgatgcagccgacgatcagcgcgacctgctggcgccagggcgtggcgccgaccaggtagccggtcttgaggtcctgcaggttgtcgttggagatcgccgcgatggccagcaccaccgaggtggtaaacagcgccagggcgatcgccagcttgccgttctggcggtccagcaggccgccctcgatgctgccgaagccgagtatcagcaacgacaccaggatgaccgcgatgattccgatccccgagatcggactgctcgacgaaccgaccaggccggccatgtagccgcaggcggcggcgatcaggaagccgaagaagaaggcgaacaccacgcataccgccaccagactccagaactgcgggctggccatgtccggcgcggcggcaccgaggaagtggctgaagaccacgaacagcgagaccagcagtatcccggcgatcagcaggatccacttggccggcatgtccagctcggtgcgcaagctgttcgcctggctattgccgcgcactgccccgagggaggcccagacaccccgcaccatcggcttgaacagggtcgccagggtccacagcgcggccacgccgatggtgccggcgccgaggaagcgcacctgcgaactccacagttgggtggccaggtccgacaggctctggccgtcggccggcacgctgttgacggtcagcagcggcaccgcgacgccccaggagatcaccacgccgatgaggatcgcgatgccggcggtgatgcccatcaggtagccggcaccgaccagcgccagggaaaaaccggtggaaaggcggaacgccgcctgcccggcactgagccagacgctgaagccttcggcgagaaccttgaagccgctgctccagaggctgaacagcgccgccaccaggccgccgccgaggatgtcgtagagccccggcgcgttaccggcggcacgcggcgcgcgggcgtcttcctcgtcctcggcgccgtcgctgccgacccggaggatttccggccgccgccaccccttccggatacggcagttcgctctgcaccaccatcacccggcgcagcggaatggtatagagcaccccgagaatgccgccgatggagcagatcgccgcggtctgccagcacgggaagccactccagtagccgattatcagcaggccgggaaggatga

SEQ ID NO: 3729 - DNA, 291 bp, Pseudomonas aeruginosa
gtgaaggccggttcggaaatgactcgggactctcgcgatcaaccccaggcggcgaagcgccgctgggcccagcgcagccccagttcgaagcccagggcgatggcggcgatcagcaggatgccgaccaccaccaagtcggtggcgaggaattgcgcggcggactggaccatgaagccgaggcctcggttggccgcgatcagctcggcggcgaccagggtagaccagccgacgccgagggcgatgcgcaggccggtgaggacctccggcaaggcactcggcaggatcacgtag

SEQ ID NO: 3730 - DNA, 960 bp, Pseudomonas aeruginosa
ccatcctgccatagccgttgcagggcttcgaagagctgttcgggcgccggcaggaacagcacgtcgacccagccgaaacgggtcgccgcccaccacagcagggccagggccagcacgctggcaccggcggcccagcgccgacggtcgccgggcagacggcgcttgcgcgggacaggattggcaacggcgagtccgagggtatcagtgggcatgttcggcctccgcgacatcgaggaattcgtccagcaacgcctggcgcaaacggccgaactcgggatcagccttgatcgaacgcaccgtttcgccggcggcgtaacgccgcgcgaagtccaccggcaggcgcttgacgatgcgcgccggcgggccgtccatcaccaccaggtcggtagccaggaacagggcttcgtcgacgctgtgggtgatcaggaagaggcccttgccggtctgcttccacaggtccagcaggagcacctgcatgcgctcgcgggtcagcgcgtcgagcgcgccgaacggctcgtcgagcagcaggaagtccggctcgaccgccagcgcgcgtgccagcccgaggcgttgccgctggccgccggagagctgagcgacggactgctcggcgtactcctggaggcccaccagttgcaggacctggcgcgcccgcgcggtgcgctcggccttgcccaggccacggatgcgcaggcccagggcgacgttgtcgagggcgttgagccagggcatcagggcgtcgtcctggaataccacgccgcgctcgccgccgggcccttcgagtgtccggccgtcgatctgcacgcgtccctggtccggcttctggaaaccggcaaggatgttcagcagtgtcgacttgccgcagcccgaaggacccagcaccaccagcgactcgcccttggccaggcccaggctgagatcgcggaggatggcgcggcgctggccgcgctgttcgaatga

SEQ ID NO: 3731 - DNA, 1026 bp, Pseudomonas aeruginosa
tttatgagcgcgaatgcgcccccggatgcccttccgcccttgctccatgcccccgtccctacagggccgcgcccagcaaacgggcttccagggcctgtcggcgcaggcaggcgagcagcccggcgcgggccaccgcctccgcctcgctcgccagcagcgacgccgccgcgctttcgcggaatgtcagcgcgccgccgcgggcgaatgccgcctggaaggactccgccgccagttcgacaagacgcagcgcgagggcgaggagacgcggcgcctctccctgccccgccacgtcgcccggcacccgcgcagcctggcccaggtcgaggttggcctgggccaatcgggtcaagccttcgcgcagttgcccgcacggggtcggcggcaggccgggcggcaccaggatgtcctcgggatgcagccgcagccgctggtaatgcagccgctgcccggcgggcaagaacagccccgaaccatcggcgaggccggagatgtcgatgcctgcccgccccgtttcggcgacagcgatcaggtgagcgcgggagggcgcgtgccaggctgagatcagcaagcgatccacgtcttccacggcgaagcaatcgctaccccgtccacccaccaggaaaccgccccgccagtgctcctgcgcttcgggctgggcgcgccgcagatcgaccgcctcgctccacagccagcggcgctcgacgctggccggcaacaggcggcgctgctgttcaggactacccagcaggcgaatggaagcgatctgcagatgatgcagggccaggcgccgtgccagctcgagttcctgctcggccaggtggcggacgccagcgaagatgtccccccagtcccgctccatgccggcgaacacgcgcggcactgccagcgccagcagtccactgtcgcgcaggcttgccgcccaaccggccatgggtcgcggtgtcctggggtcgggcgagtggagccgggcttcgctcatgcggcacctcgaacggggagcgagggccaggcgttggcgcgaggtaa

SEQ ID NO: 3732 - DNA, 477 bp, Pseudomonas aeruginosa
ggatgcgtcgggcaaccgacgccggcatcattccggacagccgcgaaaacctctgtaacggctctgtcatgcgcgtcgtgcgaggaaacaaataagcggagaaaagggaaccttattcgcgccaagctgtttaaaatcacgcccgtttctgtgcgaggcccctcgcgcagtcttttaccaaggagctacaccaccatggcactgaccaaagaccaactgatccaggacatcgccgaagccatcgacgcgcagaagaccaccgttcgcagcgcgctcgaccagctcgccgagatcgtcaaggacgccctggagaacgatggcgaaatcaccctgccgggtatcggcaagctgaaggtctccgagcgtcccgcgcgcaccggccgcaacccgcagaccggcaaggcgatcgagatcgctgccaagcgtgtagccaagttcgttccggccaaggcactgaccgacgcgatcaacggctga

SEQ ID NO: 3733 - DNA, 498 bp, Pseudomonas aeruginosa
caccagggaccttcttcgagcgccgcgccgagatgggcgagcatggcgagcgcgacgcagccgtcgccggcgatgtcctgctggcaggagagatacgccgacagcgcgcgtgcatcgccttcctgcaacaggtacagcggcaactccggatcgacgcgctgccagaggaagtcctcgcgcatcggcggccgccgcaggccgctgcggtccagccagtacaaccccggcaccaggccccggacgcgatggacgaacagcagcagatcgacccgcgcggcctcgccggtgaccgcgaaaggcaccggcgagcgctccggcagcagcctgcgcagccaggcccgcagcagcccgacatcgatgccggcgcgcccgtccatgcgctgcgcgatacgccgccgatgcagcagcggtcgcagcggcaggccgggggttgtcgttgccgggctcgcccggtgcgaccctccacgggcgtgccggcaggcgcggcgcccgacatag

SEQ ID NO: 3734 - DNA, 654 bp, Pseudomonas aeruginosa
  unsure (642): Identity of nucleotide at the above locations are unknown.
atcgaatttatgcataccgtcctgatcgtcgacgaccaccccgtcatccgtctcgccgtgcgcgtcctgctggaaaagcatggtctgcaggtggtcgccgagacggacaatggcgtggatgccatccagttggtccgggagcacgaaccggacgtggtgattctcgacatcggcattcccaaactcgatggcctgaccgtgatctcgcggatcaagtccctgggactgcgtagccaggtgctggtactcatttcgcaatccgcagaggcgttctgcaagcgctgcatccaggtcggtgcccgtgggttcgtcaacaaggaagaagacctgaacaacctgatcaacgccctgaacgcggtgaccgctggctacacgttttttccttcgctcacgttcgataccctcggcaccccgccggaacgcatttccgaaagcgagcttatcggcctgctctccgaccgcgagatgatcgtcctccagcatctcgccatgggctattcgaacaaggccatcggcgagaagctgttcctcagcaacaagaccgtcagcacctacaagacccgcctgctgcagaagctcggcctgggttcgctggtcgacctcgcagacttcgccaagcgtcatcaccacgaattggggccnagggggaacgga

SEQ ID NO: 3735 - DNA, 1233 bp, Pseudomonas aeruginosa
gggaaacacagcagtatatcgccggtatttcctggaaaccctgtgtggaccgtgatgaatgatttgaatgttctggtgttggaggatgagccttttcagcgcctggtagccgtcacagccctgaagaaagtggtgcccggatcgatcctcgaggcggcggacggcaaggaggcggtggcgatcctggagtcctgcggacacgtcgacatcgccatctgcgacctgcagatgagcggcatggacggcctggcgttccttcgccacgcaagcctgagcggcaaggtccattcggtgatcctcagcagcgaggtggatcccatcctgcgccaggccaccatttcgatgatcgagtgcctgggcctcaattttctcggcgaccttggcaagccattcagcctggagcggatcaccgccctgttgactcgctacaacgctcgtcgccaggacctgccgcgacagatcgaagtcgccgagctgccctccgtggcggacgtggtgcgcggcctcgacaacggcgagttcgaagcctactaccagcccaaggtggccctggatggcggcggcctgatcggcgccgaggtcctggcacgctggaaccacccgcatctcggcgtattgccgccgtcgcatttcctctatgtgatggaaacctacaacctggtcgacaagctgttctggcaactgttcagccaggggctggcgacgcgcaggaagctggcgcagttggggcagccgatcaacctggcgttcaacgtccatccttcgcaactgggttcgcgtgccctggccgagaacatctcggcgttgctgaccgagttccacctgccgcccagttcggtgatgttcgagatcaccgagaccgggttgatcagcgctcctgccagcagcctggagaacctcgtgcgtctgcggatcatgggctgcggcctggcgatggacgatttcggcgccggctattcgtccctcgaccggctctgcgagtttcccttcagccagatcaagctggacagaaccttcgtccagaagatgaagacccagcccaggagttgcgccgtcatcagcagtgtcgtggcgttggcgcaggcgctgggaatttccctggtggtggaaggggtggagagcgacgaacaacgggtacgcctgatcgaactcggttgctccatagcccagggctacctgttcgcccggccgatgccggaacagcactttctcgactattgctccggatcctga

SEQ ID NO: 3736 - DNA, 627 bp, Pseudomonas aeruginosa
tccttctggagtgcgttgaacgaaaggaaccaagcgatggccgacctgaccagcctgagcatcgagcatcttcgctcgccacggctgtatacccaccgtctgatcctgcggccctggctggtgcaggaccgggccaggttcgccgagctgaatgccgatccactggtgatggagttctttccgtcctgcctggatcgtgcccagagcgacgcgttgctgcgccgcatcgacgcgcacttcgccgagcacggttttggctggtgggcgctgcaggtcaagggcggtgatcctttcatcggctacgtggggctggaggtcgtggacttcgatgcgcccttcgtacccgcggtggccatcggctggcgtctcgccgccgagcattgggcggagggcttcgcccacgaggcggccgaggcggcgctgagctacgccttcgatacccttggcctggaccaggtggtggctttcaccgtaccggccaacgagaactccctggggctgatggagcgcctggggatgcatcgcgatcccaccgacgacttcgagcatcccgacctgcctcccggccaccgcttgcggcatcatgtgctgtaccggttgacgcgcgaggactggcttcgcagatga

SEQ ID NO: 3737 - DNA, 312 bp, Pseudomonas aeruginosa
agtacctctggttccgtgccgacggcaagctgccggacgtcccggcgctgcacaagtacctgctggcctacgcctcggatttcggtttccttaccacctcgatgcagccccatgccgtttcggtgtggcagaagaccatgcaggtcgccagcctcgaccacgccctgtggttccaccgcgacctgcgcgcggacgagtggctgctctacgccatcgacagcccctgggccggcaacgcacgcggtttcgtgcgcggcagcatcttcaaccagagcggccagctggtcgcctcgtcgagccaggaaggcctga

SEQ ID NO: 3738 - DNA, 414 bp, Pseudomonas aeruginosa
tccgcaagcgtgaggactgggcgtgaggctggccgacatccgccactgggtgttcgacatggacggcaccctgacccgggccgtgcacgacttcccggcgatccgccgagcgctggacatccccgagcaggacgacatcctgctgcacctcgccgccctgcccgaggccgaggcggcggccaagcacgcctggctgctcgaacacgagcgcgccctggccgaggccgcgcggccggcgccgggcgcactggaactggtgcgcgagttgcagcggcgcggcgtgcgcctgggcatcctgacccgcaacgaccaccagttggcgctgatcaccctcgaagcgatcggcctgggcggctgcttccccaccgagcacatcctcgggcgcggcgaggcgcggcccaagccggaccctga

SEQ ID NO: 3739 - DNA, 1005 bp, Pseudomonas aeruginosa
gcaggacatcccgtccctttccatcaccggagcctgcttacctcgcgccaacgcctggccctcgctccccgttcgaggtgccgcatgagcgaagcccggctccactcgcccgaccccaggacaccgcgacccatggccggttgggcggcaagcctgcgcgacagtggactgctggcgctggcagtgccgcgcgtgttcgccggcatggagcgggactggggggacatcttcgctggcgtccgccacctggccgagcaggaactcgagctggcacggcgcctggccctgcatcatctgcagatcgcttccattcgcctgctgggtagtcctgaacagcagcgccgcctgttgccggccagcgtcgagcgccgctggctgtggagcgaggcggtcgatctgcggcgcgcccagcccgaagcgcaggagcactggcggggcggtttcctggtgggtggacggggtagcgattgcttcgccgtggaagacgtggatcgcttgctgatctcagcctggcacgcgccctcccgcgctcacctgatcgctgtcgccgaaacggggcgggcaggcatcgacatctccggcctcgccgatggttcggggctgttcttgcccgccgggcagcggctgcattaccagcggctgcggctgcatcccgaggacatcctggtgccgcccggcctgccgccgaccccgtgcgggcaactgcgcgaaggcttgacccgattggcccaggccaacctcgacctgggccaggctgcgcgggtgccgggcgacgtggcggggcagggagaggcgccgcgtctcctcgccctcgcgctgcgtcttgtcgaactggcggcggagtccttccaggcggcattcgcccgcggcggcgcgctgacattccgcgaaagcgcggcggcgtcgctgctggcgagcgaggcggaggcggtggcccgcgccgggctgctcgcctgcctgcgccgacaggccctggaagcccgtttgctgggcgcggccctgtag

SEQ ID NO: 3740 - DNA, 1116 bp, Pseudomonas aeruginosa
tctgcatcgcaccggaccaccggacttgctgtcgccacccattgcccgtccctggtccgttctcctccggagcgcggcaccgttgcctccgaggttcgcccgatgaaacgcccgaattccctgcaccgcctggtggcagccctggcctttgccagcctttccgtcgccgcccaggccgccgacatcacggtcggctaccagaccggcatcgacccgaccaaggtgccccaggccgatggcctgtacgagaaagccatcggcgagaagatcgactggcgccgcttcaacagcggtccggaagtgatcgccgcgctcgcctccggagacctgcaactcggcaacatcgggtccagcccgttggcagcggcgacctcgcggaagctgccgatcgtcgccttcatcgtttccgcgcagatcaacgccgccgaggcgctggtggtgcgcaatggaagcgggatcgggaaacccgaggacctggccggcaagaccatcgctaccccgttcgtttcaacctcccactacagcctgctcggcgccctcaagcactggcagatcgaaccgtccaaggtgaagatcgtcaacctcaacccggccgagatcgctgccgcctggcgtcgcggcgacatcgacggggccttcgtctggtcgccggcgctgggcgagatcaagaaaagcggcaaggtcctcaccgacgccgccgaagtcggccagtggggtgcgccgacattcgaggtgtgggtggcgcgcaaggacttcgccgagaagcatcctgaaatcgtcgcccgcttcgcccgcgtcagcctcgattccttcgccgactacaacgcgcacaaggccgaatggaccgccgactccgaaccggtgaagaagatcgcccggctgaccggcgccgatcccagggacgtccccgaactgctggccggctcgaccttcccggaaagccaggcgcaactgtccgccgacctgctcggcggcggcaccgccaaggctatcgccggcactgccgaattcctcaaggaacagaagcgcgtgccggccgtcctcggcgactactcgccctacgtcagcgccgacttcgtgcgccaggcggagcaggtccaggtcggccagcgctga

SEQ ID NO: 3741 - DNA, 780 bp, Pseudomonas aeruginosa
attccgcgactccgctccggcctgtcggagcggaggctttcttaccctacggagggcagaacacatgagccgtctgacggccgaggcgatcagcctctcattcgaacagcgcggccagcgccgcgccatcctccgcgatctcagcctgggcctggccaagggcgagtcgctggtggtgctgggtccttcgggctgcggcaagtcgacactgctgaacatccttgccggtttccagaagccggaccagggacgcgtgcagatcgacggccggacactcgaagggcccggcggcgagcgcggcgtggtattccaggacgacgccctgatgccctggctcaacgccctcgacaacgtcgccctgggcctgcgcatccgtggcctgggcaaggccgagcgcaccgcgcgggcgcgccaggtcctgcaactggtgggcctccaggagtacgccgagcagtccgtcgctcagctctccggcggccagcggcaacgcctcgggctggcacgcgcgctggcggtcgagccggacttcctgctgctcgacgagccgttcggcgcgctcgacgcgctgacccgcgagcgcatgcaggtgctcctgctggacctgtggaagcagaccggcaagggcctcttcctgatcacccacagcgtcgacgaagccctgttcctggctaccgacctggtggtgatggacggcccgccggcgcgcatcgtcaagcgcctgccggtggacttcgcgcggcgttacgccgccggcgaaacggtgcgttcgatcaaggctga

SEQ ID NO: 3742 - DNA, 357 bp, Pseudomonas aeruginosa
tcccgagttcggccgtttgcgccaggcgttgctggacgaattcctcgatgtcgcggaggccgaacatgcccactgataccctcggactcgccgttgccaatcctgtcccgcgcaagcgccgtctgcccggcgaccgtcggcgctgggccgccggtgccagcgtgctggccctggccctgctgtggtgggcggcgacccgtttcggctgggtcgacgtgctgttcctgccggcgcccgaacagctcttcgaagccctgcaacggctatggcaggatggctacctcgatgccagcctgctgcaacacgtcggcaccagcctgctgcgggtgctcctggcgctcggcgcggcggtgctga

SEQ ID NO: 3743 - DNA, 840 bp, Pseudomonas aeruginosa
  unsure (84),(154),(177),(216): Identity of nucleotide at the above locations are unknown.
cacgacatgagcctgaccatccaacccatcagcccggccctgggcgccatcgtttccggcatcgacctcggcgcgccgctggangacaccggccagcgggccatcgagcaggccctgctcgaacaccaggtgctgttcttccgcgaccagtcgntggaacccaggagccaggcgcgnttcgccgcccgcttcggcgacctgcacatccatccgatntaccccagcgtgccggagcagccggaggtcatcgtcctcgacaccgcggtcaccgacgtgcgcgacaatgccatctggcacaccgacgtgaccttcctcgagaccccggcgctgggagccgtgctcgccgccaagcaattgccgccgtacggcggcgacaccctctgggcgagcagcacggcggcctacgaggcgctgtcggcgccgctgcggcgtctgctggacggcctcacggcgacccacgacatcggcaagtccttcccccgcgagcgcttcggcgtcaccgaggccgacctggcgcgcctggaggaggcccgcctgaagaatccgccgcgctcgcatccggtggtgcgcacccatccggtcaccgggcgcaagggcctgttcgtcagcgatggcttcaccacccgcatcaacgaactggagccggccgagagcgatgcgctgctgaagttcctcttcgcccatgccacgcgacctgaattcaccgtgcgctggcgctggcaggaaaacgacgtggcgttctgggacaaccgcgtgacgcagcactacgcggtggacgattaccggccacagcggcgggtcatgcatcgcgccaccatcctcggcgacaagcccttctga

SEQ ID NO: 3744 - DNA, 537 bp, Pseudomonas aeruginosa
gcttggcgggtccaattgtttcgagagttttcatccatgcaagaacgcatcccggatgagctgaccctgccagagctcaccctgcgtggcctgatcctcggtgcgctgatcaccgtggtcttcaccgcctccaacgtctacctcggtctgaaggtcggcctgaccttcgcctcgtcgatcccggcggcggtgatctcgatggccgtcctgcgctacttctccggcgccaacatcctcgagaacaacatggtgcagacccaggcctcggcggccggcactctgtcctcgattatcttcatccttcccggcctgctgataatcggctactggagtggcttcccgtgctggcagaccgcggcgatctgctccatcggcggcattctcggggtgctctataccattccgctgcgccgggtgatggtggtgcagagcgaactgccgtatccggaaggggtggcggcggccggaaatcctccgggtcggcagcgacggcgccgaggacgaggaagacgcccgcgcgccgcgtgccgccggtaa

SEQ ID NO: 3745 - DNA, 1176 bp, Pseudomonas aeruginosa
ccaggcgaacagcttgcgcaccgagctggacatgccggccaagtggatcctgctgatcgccgggatactgctggtctcgctgttcgtggtcttcagccacttcctcggtgccgccgcgccggacatggccagcccgcagttctggagtctggtggcggtatgcgtggtgttcgccttcttcttcggcttcctgatcgccgccgcctgcggctacatggccggcctggtcggttcgtcgagcagtccgatctcggggatcggaatcatcgcggtcatcctggtgtcgttgctgatactcggcttcggcagcatcgagggcggcctgctggaccgccagaacggcaagctggcgatcgccctggcgctgtttaccacctcggtggtgctggccatcgcggcgatctccaacgacaacctgcaggacctcaagaccggctacctggtcggcgccacgccctggcgccagcaggtcgcgctgatcgtcggctgcatcgtcggcgcgctggtgatccccccggtgctggaactgctctacagcgcctacggcttcaccggggccctgccgcgcgagggaatggaccccggccaggccctggccgcgccgcaggcgaccctgatgacggcgatcgccagcgggattttccacgacgcgctgaactggaacatgatcctcatcggcgtcgccctgggcatcgccctgatcctcgtcgacctgctcctgcgccgtaccggcaaggcctgcctgccggtgctggcggtgggcctggggatctacctgccgccgaccatcggcatgaccctggtggtcggtgcgctgatttcctggctgctggaaaatgccctgaagaagcgtgcggcggcggccggggtcgacgaagaggcttatgccgaagagccgaagcgacgcggcgtgctgctggcttcggggctgatcgtcggcgagagcctgatgggcatcctgctcgccggggtgatcggcgccaccggcgaggacgcgccgctggcgctggccggcgccggcttcgcgggcatcgcccagtggctgggactggtggtattcgtcgcgatctgcgtgctgttctaccggcgagtgctggcgcgctgagggattcgcagctgcacggggatgggatgttgccgctagcgtcattccccgcggtcagggacggaggatga

SEQ ID NO: 3746 - DNA, 1515 bp, Pseudomonas aeruginosa
caggatcagcgagaagggcagggaggtcagcaccaccgccgacttcagcgcgtcgatgctgccggcgaacagcagcccgccggtgaccagcgcggtgaccgagccccagaacacccgcagccacttcggcccgtcgtcgtcggcgctgccgccgtgggcggagagggtggagaggaccacggtgccggagtccgccgaggtgacgaagaagacgaagctgaccagcaccgtgacggtgatcaccgcgcggctccaggggtagttctggagcatctggtagagggccatcgacggctgctcgatggccacccggccgagttcgctggcgccgccgagggcctgctccagggcgctgttgccgaagatcgacatccacgccagggtgaagccgagcgggatgaacagcacgccgaagacgaattcgcggatcgtccggccgcgcgagatgcgcgcgatgaacaggccgacgaagggcgcccaggcgatccaccaggcccagtagaacaccgtccacgagcccagccagtcgctggggccgccgtaggcgtagaggtcgaagctcttgcccggcaggtggccgaggtagtcgccgacgttctgcaccagggtgttgagcaggtgctgggtcggaccggcgaacagcacgaacagcaacaggctgcaagccagcagcatgttgatgtcggagaggatgcggatgcccttgtcgaccccggagaccgccaccgagatcgccgcgcccatcatcaacacgatgagcgccatctgcaccgggtgggtatgcgggatggcgtacaggtagtccagcccggagttgagctggagcacgccgaagcccatgtcggcgccgaggccgaacaccgtggcgatgatgccgaagcagtccaccgtgtagccgatcggcccgttgatgcgcttgccgatcaacgggtagagcgccgagcgcagggccagcggcaggttgtggcggtaggcgaagtaggccagcgccatcgccaccagggcgaatacgccccagccgtgcaggccccagtgcaggaacagcagttccatggcctgccgcgcggcttcctgggtaccggcctcgccttgcggcggctggaggaagtgggtcagtggttcggatacgcagaagaagaacagggtgatgctgatgccggcggcgaacagcatgccggcccaggacaggtagctgaattccggctcgtcgtggtcggcaccgagcttgatcttgccgtagccggaaagcgcggtgaccaccacgaagatcaggtacagcgtcatcgccagcaggtagtaccagccgacggtctgcgaggcccaggtctgcgcggccagcagccattcgccggcgcgctgggggaagccgatgaccactgcggcgaacagcaggatcaggatcgccgcaccgtagaacaccgggggattcatgcggatgggcgtgggggtggagggggtggcggagggcgattgtgcgtcagtcaaaacaggctggtctcctcgtccttaatttga

SEQ ID NO: 3747 - DNA, 543 bp, Pseudomonas aeruginosa
tcaagcgttcaatataaacacgatcaagggcccgggagccaatccttcggacgtatggaagccttcggcgccgcgcttttcccgcacgttcgccgaaggattccttcagttcgccgccagtcccaggcgccgccttcccgcctcctcgtcgccgcctgcctgctcggtggccagttgcaggagcagggcctgtacctgctccagcgacggcgctccggcttggccgagcaggcgccgcagaccggccagcgatgggtctggcgttgccccgccaaaattcagatgctgcggcaggatttcttccttgtcgctgaccagcagggcgaagtggacgacgttttccagctcgcggatgttgcctggccagggatagctctcgaggacccgctgggtttccacgccgatggccggcaccggcaggtccaggcgctgggcatagacgccgatgaagtattccgccagcggcaggatgtctcccggacgttcgcgcaatggcggcaggctcaggcggccgtcgtgcaggtactgctgcaggccggctag

SEQ ID NO: 3748 - DNA, 996 bp, Pseudomonas aeruginosa
ctccttggcggcacggggcgcctccagcgcctgcgccgcgacgacggccggaacggctgcgggcgggggccgttgcggaaaaagaaacgccggtgcaagccatgcgacaccggcgtgaacaaggggcgctgcaacggcgcccagcgtgggagtcgggacgggctggggtcagaaggccgggaccaccgcgccggcatatttcttctcgatgaaggctttcacttccgggctggtcagcgcggcggaaagcttcttcagggcgtcgctgtccttgttgtcaggacgcgccaccaggtagttcacatagggcgaatcgtggtcttccaggaccagcgcgtccttggccgggttgagcttggcctccagcgcgtagttggtgttgatcaggtccaggtcgacctggtccagcacgcgcggcagcagggccgattcgagttccttgaatttcaggttcttcgggttctcggcgatgtccttgggcgtggccagggcgttgttcggatccttcaacttgagcaggccggccttctgcaacagcagcagggcgcgcccgctgttgctgccttcgttgggaatggcgacggtggcgccgtcgggcaactcggccagcgacttgtatttcctcgaataaccaccgaagggctcgacgtgtacgccgaccacggtgaccaggttggtgcccttgcctttgttgaagttctccaggtacggcagggtctggaagtagttggcgtccaggcgcttctcggcgacctgcacgttgggctgcacgtagtcggtgaacaccttgatctgcaggtcgacgccttccttcgccagggtcggcttgatcagctcgaggatttccgcgtgggggatcggcgtggcggcgacgaggagcttttccgctgcgttggcggaaacgctgatgacggaggccagggcagtcagcaggagcagttttttcattcttcgatccttgtagggcgatgtccgccgctgcgttcagggcggtga

SEQ ID NO: 3749 - DNA, 207 bp, Pseudomonas aeruginosa
agcacggcgatggctatcactgaggaggcgccgcatatggtccgtacgccgagtcatcccgaacgagatagcgcggccaagccaccgctctggcgacgcctggcctggctggcgggtatctggaccgccagcgtgctggccctgggcgtcgccgcctggctgatgcgcctgttcatgagcgcggcggggctgggcgtcccgcactga

SEQ ID NO: 3750 - DNA, 1269 bp, Pseudomonas aeruginosa
cctcgctgtcctgtctgcgcttttcggtcaacctatcatgcccgggtcatgacgcccattcctcaccgaccattcaggccgcacgccatgaaccgacctcgaaccgttatccgcttcatcaacgccgcgcatgtcatcgaccacatgttcatgctgatcttccccgccgccgtgctcggcatggccggcagcttcgacctcgactacgccggtctgatcggcctgtcgctgggcggtttcatcgccttcggcgcctgttcgctgccggccggctggctgggcgatacctggagccggcggcggatgatgctgttgttcttcttcggtatcggcgccgccgcactgctcaccgggctggccggcagcgtaccgatgctggtgaccgggctgaccctgatcggggtattcgccgcgatctaccacccggttggcaccgcgatgctggtggcacacgcggagaaccgcggccgcgagatcggcatcaacggcatgtggggtaacctcggggtcgccttcgccgcgctgcttaccggctttctcaccgcgcacttcggttggcgtgcggcgttcatcttgcccggcggggtggccatcctgctcggcatcggctttttcttctgcgtgcgcgaggagccatcgccgcacctgtcggccaaggccgcggcgcgtggcgaggacagcgagggcctgtcgatgcgccgggtgttcggcgtgctggcgctggtcaccgccaccggcggggtggtgttcaacgccagcaccgtgacctacccgaagctgttccaggagcgcctgagcgacttgctggcgtcgccgcagaccctcggcgtggtggtcagcctggcctatgccttcggcgcggtagcgcaactgatcatgggccgcctgatcgatcgcctgaacctgaagttgccgttcgtcttcctcaccttctgccaggtgccgctgctgctggccctggcctacggccacggcagcgcagtggtgctgttcggcgcgctgttcatgttcgcggtgttcggccaggtgacggtgaacgatgcgatggtcgcccacttcgtcgcgccgcagtggcaggcgcgggtcttcgccctgcgctatttcctgtcgttcggcgccagcgcggcggcgatcccgatgatcgcctacctggagccacggcaggggctgctggggttgtacctggtactggcgggcttcgccgcgctgaccttcgccgcggcgctggtgtttccgcgtccggcgcgcagcgccgcggtgggcacctga

SEQ ID NO: 3751 - DNA, 465 bp, Pseudomonas aeruginosa
tcgaggccgtgttcgcgcatggcgagcatggtgaccatggcgaaggcttcgttgatctcgaacaggtcgacgtcgtccttgctccagccggtcctggcgaacaggttggtcatcgcgccgatcggcgccagggtgaactcgctcgggtcctggctctgggtggcatggccgacgattcgcgccagcggcttcaggccacggcgctgggcttcctcggcggtcatcaggaccagcgcggaggcgccgtcggagatcgagctggcattggcggcggtgatggtaccgtccttgcggaacgccggcctgaggctcgggatcttctccaggttggcggtcagcggttgctcgtcgtccttcaccacgctctcgcccttgcggctggtgacggtgaccgggacgatttccgccgccagcgagccatcggcgatggcggcctgggcgcgcttgagcgattcgatggcatag

SEQ ID NO: 3752 - DNA, 474 bp, Pseudomonas aeruginosa
ggcgcgttggacatgctttccatgccaccggcgaccatcacctggttggtgccagccttgagcaggtcgtgggccagcatcaccgccttcatccccgagccgcacagcttgttgatggtggtgcagccggtggcggcgggcaggccggccgccagcgcggcctggcgggccgggccctgcttcaggccggcgggcaggacgcaacccatgatcacttcctgtacgtcctcggcggcgatgccggcgcgctgcaccgcttcgcggatcacgacggcacccaggtcgaccgcggaaacgccggccaggctgccctggaagccgcccatgggagtacgggcgccggcgacgatgacgatatcggacatggaacgttacctcttgttctggatagggtctgaacgattcagtgggcggattctatcttgtgaccgggaggctccgaaaggtcacggggcaaatcactcttttgactga

SEQ ID NO: 3753 - DNA, 1752 bp, Pseudomonas aeruginosa
acaaagcccgccgacggctctagagtcggcctcatcctgacaacgaacccgctcccaggtgtacgccccatgctgaagacccgtctcatcccggccgccgccggcgcttatcagtatccgttgctgatcaagagcctgatgctttccggccgtcgttacgaaaagagtcatgaaatcgtctaccgcgaccaggtgcgctacagctacgccaccttcaacgagcgcgtcgcgcgcctggccaacgtactcagcgaggccggggtgaaggccggcgacacggtggcggtgatggactgggacagccatcgctacctggaatgcatgttcgccatcccgatgatcggggcggtgctgcataccatcaatatccgcctctccccggagcagatcctctacaccatgaaccacgccgaggatcgcttcgtgctggtgaacagcgagttcgtcccgctctaccaggcggtggcggggcagttggccacggtggagcggaccatcctgctcaccgacggcgcggagaagagcgcggaactgcccggcctggtcggcgaatacgagtcgctgctggccgcggccagcccgcgctacgacttccccgatttcgacgagaactccatcgccaccaccttctacaccaccggcaccaccggcaatccgaaaggtgtgtatttcagccaccggcaactggtcctgcacaccctggcgatggcttcgaccatcggcagcctggacagcatccgcctgctcggtaccagcgacgtgtacatgccgatcaccccgatgttccatgtccacgcctggggcactccgtacgtggcgaccatgctcggggtcaagcaggtctatcccgggcgttacgatccggaactgctggtcgaactgtggaagcgcgagaaggtcaccttctcccactgcgtgccgaccatcctgcagatggtgatgaacgccagggctgcccagggcgtggacttcaagggctggaaggtgatcatcggcgggagcgcgctgaaccgctcgctctacgaggcggccaaggcgcgcggcatccagctgaccgccgcctacggcatgtcggagacctgtccgctgatttcctgcgcctacctcaacgacgaactgctggccggaagcgaggacgagcgcaccacctaccggatcaaggccggcgtgccggtgccgctggtggatgcggcgatcatggacgaacagggccgcttcctcccggccgacggcgaatcccagggcgagctggtgttgcgctcgccatggctgacccaggggtatttccgcgaacccgagcgcggcgaggagttgtggcgcggcggctggatgcacaccggcgacgtggcgaccctggacggcatgggcttcatcgagatccgcgaccgcatcaaggacgtgatcaagaccggcggcgagtggctgtcctccctggagctggaagacctgatcagccgccatccggcggtacgcgaagtggcggtggtcggggtgcccgatccgcaatggggcgagcgcccgttcgccctgctggtggtgcgcgagggccagcaactggacgcccgtggcctgaaggagcacctcaagcctttcgtcgagcagggcaacatcaacaagtgggcgatcccctcgcagatcgcggttgttaccgatattcccaagaccagcgtcggcaagctggacaagaagcgcatccgtatcgagatcgcccagtggcaggaagccggcagcgccttcctgtcgaccgtctga

SEQ ID NO: 3754 - DNA, 225 bp, Pseudomonas aeruginosa
cggggctttcctacaccgctgaaacgcccggaggccaagcaaacgcttggtctccgcgttttcgcgaccgcccggtcattctccatccgccgcaaaggcgcgagccagagtggttgcgccgcgcaaatcacactttcgagggatcaagcggcaggcagcgctagctatagtccacgcactcataacaaaaaacacacatggagtagcgtcgatgacaacccgtaa

SEQ ID NO: 3755 - DNA, 1218 bp, Pseudomonas aeruginosa
cctcgaactgaagtacggcgataccggtgtgttcctgcgcggcaagtactggtacgacttcgagctgaaggacgagcaccgcgagttcaaggacatcgacgacagcggccgcaagaccctggccaagtcctccggagccgaactgctcgacgccttcatctaccacaactatgccatcggcgacctgccgggcagcgtgcgcctgggcaagcaggtggtgaactggggcgagagcaccttcatccagaacggcatcagcgccatcaacccgatcgacgtcaccgccttccgccggcccggctcggagatcaaggaaggcctgatcccggtgaacatgttctacctgtcgcagaacctcaccgacaacctgtccgccgaaggcttctaccagatcgagtgggaccagacggtggtcgacaactgtggcaccttcttctcccagccggacgtggtggccgatggctgcgaccagaacctggcggtgctgaccaacaacaaggcgtccatcaacctgctcaacaacgtgctcgccggggctggcctgagcgttaccccgtcgccctgggacgagggcatcctggtccgccgcgggccggaccgcgacgctcgcgacagcggccagtacggcttcgccctgcgctacttcgccgacgaactgaacaccgagttcggcgcctactacatgaactaccacagccgcctgccgatcttcagcggccagggcgcctcggccagcaccatggcggcgatcaacgacctcgccacccgcctcgccgcgatcaacccggcactggccgcccaggccgcggcggcggccaccgccggcaactccagctacttcatcgagtacccggaagatatccgcatgttcggcctgagcttctccaccacgttgcccaacggcaccgcgtggagcggcgaagtcagctaccggcccaacgcgccggtgcagttgaacaccaccgacatcctcttcgccggcctcgacccggtgagcatcggcggcaaccgcccctacgacaacgcctcggtgctgaacggccaggccgggcaggacctgcacggctatcggcgcaaggagatcacccaactgcagaccaccctgacgcacttcttcgaccaggtgatgggcgccgagcgcctgaccctggtgggcgagatcggctggacccacgtcggcggcctggaaagcacctccaaggcacgctacgggcgtga

SEQ ID NO: 3756 - DNA, 2766 bp, Pseudomonas aeruginosa
tctccggagcgttcacgccccatacataaaccaagaaaccgggtgatgactgacttctcgcgcaccttctcgggcactccatccgccgttctgccgacggccaaccgctttttccgccccccgctgccgtcggcccatgtggcgcgcccgcgtctttgccgtcgactgcgcgacggactggacggtcgcctgctgctgatcgccgcgcccgccggattcggcaagagttccctggccatcgagttctgcgaaagcctcgatccgcgctggcagagcctctggctgggactgagcagccgcgagagcgatcccggacgtttcctcgaacgcctgctcgatggcttgcgacagtaccacccgaccctgggcgaagaggccctcggcctgctgaagatgcgccagcgtcaccagccgttcgccttcgagacctggctcgacgacctgctcgacgaactcgccccctgcctggacccgcagcgtcccctgctactggtgctggacgattaccacctggcccagggcgcggtgctcgaccgttgcctgcaattcctcctcaatcacctgcccgagggcctggtgctgctggtcaccagccggcagcggccggactggcacctggcgcgcctgcgcctgtcgcggcaattgctcgaactcagcgaacaggacctgcgcctgaccgccgaggagagcggggcgctgatggccgccagcggcctcgaactcgacgaggacgcgctggacgcgctgctcgagcgcagcgaaggctgggtcgccgggctgcgcctctggctgctggcgcgcggcgatccagaggagcaggtcagccccggggtacacggcgccgacgaactgatccgcgactacctgctggaggaggtgatcgagcggcagccgcccgaggtccaggcgttcctcgcccagaccgcgcgcttcgagcgcttctgcgccgagctctgcgataccgtgcgcgaggccggcgacagcgcggcgatcctcgaccacctgcagcagcaccaggtcttcctcgtgccgctggacgaaaacggccagtggttccgctaccaccacctgttctccgacctgctgctggcgcgtcccttgcccgacttcggtccgtccgccggctccctgcacctgcgcgcctgcggctggttcagccgccatggcctgctcgaccaggcggtggagcaggcgctgcgcgccggccagccggacgtggcggcgagcctggtgcagaacctgtcggaagagcaactgctggcggagcagaacatcgccaccctgctgcgctggaagatggacctgccggacagcctcctggcgagcacgccgcgcctgatcctgctgtacggctgggcgctggcgctggcctgccagctggatgccgcggaagaactggccggccaactggcgcgtttcctgccggcgccggacgagtccgcgcagcgcgacctgctggcccagtggcaggccctgagcggggtgatcgcgcgcggccgcggcgatatcgacaaggccgaggcgcactgccgcgaggccttgcaggacctcgccggggagcgctatggcacccgcctgcaatgcctgtcgacgctgagcaacctggcggtgacccgtggcgacttctggcaggcgcgcaactacaaccgcgacgccctggagttcgcccagcgctacggcaacccgctgttcgaggcactggtccattacgaccgcgcccgcgtcctccaggcgcgcggcgaggtggcgcgcgccgaggaggaggtgcgccagggcctggaacgcctccagcacctgccggcgcaacgccgctacgcggtgcgcgggcggctcctgctgtaccgcggctacctgcgcagcctggcgctgcagccggacgaagcgcgcaagtggatcaagcagggaatcgaggaaacccgcagctgccgggatgtcagcctggtgatcggctattgcgtcctggccagcctggaagggcgcctgggcaactacgcggcggcgttcgcccggcttggcgacgtcgagcggttgatgcatgcctgggatatcccgccgatctactacctggcggcgatcaccctgatcaagtgcgaactctggctggcccagggccagaccgaactggccggcgtctggctacagcgcctgggcggcacctacggtgggcaggcggccacgccgccggaatgcagtccgctgctgccgctgcatgtggagttgctccaggccggcctggagcgccgcgaaggacgcccggaggaagccgcccggcgcctggaccggctggcccgctcgacgcgggagaacggcgcgttgctgccggctcgcctggccctcggccaactggccgcgctgcacctggagcagggccgcgagcgcgaggcgctggcgaccctgcaacaggccatggagggcgcagtcggcggagccttgctgccgctccacgaattgctcgtgcagcagccggaatggttgcgcgaacagttgcagcgcttccctgcctgtcccggcgcccagcgcatgcgcgcgctgttgccggagccgcccgccgagcccgcgggcggtgcgggcgaggtgctcagcgggcgcgaactggcggtgctggagctgatcgctcaggggttgtccaaccaggagatcagcgagcggctgttcatctcgctgcatacggtgaagagccacgcccgccatatcaacgacaagctcggcgtcgagcgtcgcacccaggcggtggcgcgggccaagcacatggggttgttgcgctag

SEQ ID NO: 3757 - DNA, 1398 bp, Pseudomonas aeruginosa
tcgcgtatggatgaccacggacgttcccgccccacccagcccaccctgtacgtcctcgataccaatgtcctgatccacgatccgaatgccctgttgaacttccaggaacaccgcgtcgcgatcccgatgacggtgctcgaagagctggacaagctgaagaccggaaagcacaccatcgccgccgagtgccgccaggccatccgcctgatcgaccaggtactcggcgaggccacgcccgagcaggtagagggaggggtaccgatccagcgtggcaagaacggccccagcggcagcctgtcgatcctcatgagcaagcgtgccgagcccatcacctggctgccggagcacctcaacgacaacaagatcatcaaccagttggtcgagctgaagagccgccacagcggcgtgcgcgtggtgctggtgaccaaggacatcaacatgcgcctgaaggcgcgcgcctgcggggtggacgcggaggactaccacaccgaccagttgatcgacgacgtggccctgctgtcgcgcggctaccattccctcgccggctctttctgggaccgcgtgagcaaggtcgagacccgccaggaccacggccgtacctggcatcgcgtgcagctcaccgacaacctgccggcggtgcacatcaacgagttcatcgtcgacgaacagggcttcgtcggctggatcaagggcatccagcaggacgagctgaccatcctcgacctgcaccaggagccgctcctgcaccaggaagcctggggcctgcggccacgcgacgtgtaccagtcgctggcgctgtacgcgctgctcgacccggacatccacctggtcaacctgtccggtgccgccggttccggcaagaccatcctggcgctcgccgcggccatcgagcagaccatggtcagcaagcgctaccggcgcatcatcgccacccgcagcgtgcagggcctggacgaggacatcggcttcctgcccggcaccgaggcggaaaagatggagccctggctcggcgccatcaccgacaacctcgaagcgctgcacatggacgacgaatgcacccatggcagcgtcgactacatcctcagcaaggtgccgttgcagttcaagtcgctgaactacatccgcgggcgcagcttccagcagagcctgatcctcatcgacgaatgccagaacctcacgccgcaccagatgaagaccatcatcacccgcgccggcagcggttcgaaggtgatctgcctgggcaacctggcgcagatcgacacgccctacctgtccgccaccagctccggcctgacctacctcaccgaacgcttcaaggacttcccccacggcgtgcacgtgaccctgcaaggggtgccgcgctcggtgctggcggagtacgccgaggcgcacatgtga

SEQ ID NO: 3758 - DNA, 762 bp, Pseudomonas aeruginosa
agacccgcgcgccgttctggaagaaggaagacaccgccgaaggcccgcgctgggtcgaaggccgctgcagcgaccaggccgccgcgcagcgctgggaggagtgacgtctacctcctcgcgccgccggcttacctcttcggaggaatagccagccgggggcccgcggttcaggctgaggcatcgcccgttcctaggaccccttccatgagccacctggccacctccaccttccagccgctgaacatcgccatcctcaccgtcagcgacacccgtaccctggaaaccgatacttccggccagaccctcgccgacgcgctgctggccgccggtcatcgcctgcaccagcggagcctgaagaccgatgacatctaccagatccgcgcggtggtctcggcctggatcgccgaccccgaggtacaggtcggcctgatcaccggcggcaccggcttcaccgcgcgggacaacaccccgcaggcggtcgggccgctgttcgagcgcgatgtcgagggcttcggcgaactgttccgccaggtctcgcagcgcgagatcggcacttccaccatccagtcgcgggcgctggccgggctcagcaacggtaccctggtgtgctgcctgcccggctcgccgggcgcctgtcgcaccgcctggaacgagattctcctggcgcaactggacagccgcacccgcccgtgcaatttcgtcccgcacctgaagaccccgccagccgtggcgccggtggccggctgcgggtgccgctcgtga

SEQ ID NO: 3759 - DNA, 672 bp, Pseudomonas aeruginosa
cctgctacgcctgagtcctcgggcgcagggcatggccgaggtgatcgcggccttcgaccgggtatgcaagggtgccgctccgccgctcgccgtggaaggctgcaacggctactggcacggccggccggggatgctgcgggcagaggaggtagggttatgctgaaccgccaacgcctgctcctcggcgtcgccggacgcctgttgccgctggcggcgaaggttccgcgcgggctccagcacctggtcctgcaacgggtcgccaaccggctgttcgcccagccgctggaggagggcgccttcgacctgctggaaggtcgctggctgcgcctggaagtcagggacctcggcgtcggctggtgcgtcacccgggtgcccggcggcctgcgcctggtcgaacggccacgggccagcgtgaccatccgtggcgactggcgcgacttcctgctgctggccagccggcatgaggacccggataccctgttcttccgccgccgcctggtgatcgagggcgacaccgagctgggcctggcggtcaagaacctcctcgacagcctcgacccggagcacctgccgccctggttgtggaacgccgtggaacgggccgggcgggcagtgcaggaggagcgcggcgaggcgccccaggggccggtccagggcgcgcggggcggctga

SEQ ID NO: 3760 - DNA, 426 bp, Pseudomonas aeruginosa
gcggcagcctggcgccgggcaagaccttcgtcctcgccaacggcgtggccgacccggcgttgctggcgctggccagccagcgggtggaaggcagctggttcaatggcaacgatgcggtgctgctgcgccggcgcagcggcgagatcctcgacagcctcggccaggtcggcttcaaccccggcacgacctggggcagcggcgatgtgcagaccctcgaccggagcctggtgcgcaaggccgacatccgcgacggcgacagcgatcccagcgacgccttcgacccggcggcgcaatggctgggctacccgcgcgacaccttcgccaacctcggccagcatggcgctggcgagcccggcggcggcgaggaggccggcctgcgaccgatccacgaggtgcagggcgccggcgccgaaagtccgctggtga

SEQ ID NO: 3761 - DNA, 672 bp, Pseudomonas aeruginosa
cgcgcggacaggtccgacatgctgtggcccttgccgttattggcgatggccatttcgccccgggacggcgggcactccacgcagtccttgtcgcggccctggctcttgctgcaatcgcgctcggcttcccgggtccggtcgcggctcagcgtgccggtctcggtcctgggcaggggctgcggaaccggcatcggacgcggtaccggcctgggcagcgcgccgggggccggtcgcggcagcgggcgcggcgccggcatcggcaagtgcggccggggcggcgcgggtagttcgaagggcagccgcggacccatgcggggcagcggtcggaaaagcgcgcctatgccgctcatgccggtctccccgaggtttcgtacgcgcgccatttctggctggccaggcgaaactcgacgatccgttcgtagtcctggaagcgttgttccgggctgtccgccagcggccggcgcatgtgtgcgagaaacgccggcgtgtcctggaaagcggggaaggccaggccgtgcagaagaaagcgttcgatcgtcccgggctcttcgatacccagttccagcgccgtcgcgcgcagctcgccgagttgccggatggcgggcagcaggccgcgtcgttcgagccaggcgggagcctcccggcgtacctccagcaggacccgctcgatga

SEQ ID NO: 3762 - DNA, 690 bp, Pseudomonas aeruginosa
gtggtcatggatgcgtgcctgctggaatccgttggcgtgggcgcgggacggcccggaaaaacgcgggattatagcggtaaaacgcggcgcgtcgggatgcctgtcatccggcgatcgatggaattgccggtggacagcgaacttgtcgcagtcgtgccgttccaagcagccagcggcggccaccgccggatagactgctttcatttcacccgatcgaaggaaatcaccatgaacggagtatccagactgctctccctggcgttgctgggcgcggcgctgcactgggcgccggcgcaggccgaggagcagccgcggctgttcgaactgctcggccagcccggctacaaggccacctggcatgccatgttcaagggcgagagcgacgtgccgaaatgggtttccgacgccagcggcccgagttccccgtccaccagcctgagcctggagggccagccctacgtcctggccaacagttgcaaaccccacgattgcggcaacaaccgcctgctggtggcgttccgcggcgacaagagtgccgcctacgggctgcaggtgagcctgccggacgagcccgccgaagtcatgcagacgccgagcaagtacgccacctatcgctggtacggcgaaccctccaggcaggtccgcgagctgctgatgaaacagttggagagcgatccgaactggaagtga

SEQ ID NO: 3763 - DNA, 3270 bp, Pseudomonas aeruginosa
gcacgcgcagaagtgtgtcagattgttgcgagggcggattatttcacattacgcaataaacaatcgcacttgagccagcttatcagcagccgccagcctcttaaaattcatcggcccccgagcgcacgaacgctcgagcgggttgaacggcgcccgtaccgttcaaattccgtgcttcgcccctccaggatcagacaacgtgccgcgtgctctcaggaaggaactgaccttggtcggctccttcgtcggttttctcgtcgttttctccgcaatatccggttgtgtcagtacaggcgatatcgcccccgaggccgccacgctcgacgccaacgccctggccaccgaccatgcgatccaggctgccgcccgcgaggccggctggccgcaggcgcagtggtggaaggtgtatgccgatccgcagctggacgcctggatcgagaaggcgctggacggcaatccaggcctggcggtagcccatgcgcgggtacgccaggcgaagtccatggccgggctggtggagtccatcgagtcgccgcagatcgagggcaagggctcgctggtccgccaccgctggccggacgactatttttacggccccggcgacctggcgcggaccacttcctggaacaactccaccgagatcggcctgaactacaagctcgatctctgggggcgcgaccgcagcgacagcgagcgcgccgtcgacctggcccacatggccgccgccgaggcgcgccaggcgcagctcgagctggagggcaacatcgtccgcgcctacgtccagctctcgttgcagtacgccgagatggacatcgccaaggccatgctgcaacagcagcgcgacatcctcgccctggcccagcgtcgcctgcgcggcggcatcggcacgcatttcgaggtcagccaggcggaagtgccgctgcccgagaccgagcgccgcatcgaggtgatcgacgaagaaatccagctcacccgcaacctgctcgccgcactggccggcaagggcccgggcgagggccgcacgatccgccggccaagcctgaacctggcggcgcagccgagcctgcccagcgccttgccggccgaactgctcggtcgccgcccggatgtggtcgcccgccgctggcaggtcgccgccctggccaagggcgtggacgtggcgcgcgccgacttctaccccaacgtcgacctgatggcctcggtcggcttcagtgccgtcggcggcggcatgctggagttcttccgcagcgccaagtacacctacagcgccggcccggcggtgaccctgccgatcttcgacggcggccgcctgcgttcgcagttgggcgaggcggcggccggctacgacgcggcggtggagcaatacaaccagaccctggtggatgcgctgaagaacatttccgaccagttgatccgcctgcattcggtggacatccagaaggacttcgccgcgcaatcggtggcttccgcgcagaagacctacgatatcgccaccctggcctaccagcgcggcctcaccgattacctcaacgtgctcaacgcgcagacccggctgttccagcagcaactggtccaggagcaggtgcaggccgcccggctggccgcccacgccagcctgctcaccgccctcggcggcggcgtcggggccggcgccgatacgccggcgcagcggaagctggcgccggagaacgtcccggtcagagcggtgtcttcgcgatgagtggccgctccgctggtttcgccctgcccagccgcgacgagtggcggcgcgcgctggccgagtgggcgcgcagcgacggggcgacctggatctacgtgttcaaggtgctctgcgcggccttcctgaccctctggctggcgatgcgcctggaattgccgcagccgagcacggcgaccatcaccgtgttcatcgtcatgcagccgcagagcggccaggtgttcgccaagagcttctaccgcatcctcggcaccctggtcggcctcagcgtgatggtcaccctgatcgccctgttcgcccaggagcgagtgctgttcctgctcagctcggcgatctggatcggcctctgcaccgccggggccgcccgctaccgtgacttccgctcctacgcctgcgtgctcgccggctacaccgcgacgctgatcggcatccccgccaccagccatccggaaggcgccttcatgcaggcgatctggcgggtcctggaaatcagcctggcgatcctctgctcgggggtggtcagcgcggtgatcatgccgcagaccaccagcgcggcgatgcgcaatgcgctgtacgtgcgcttcggcctgttcgccgcgttcgtcctcgacagcctgcgcggggtcggcgggcgcgagcgcttcgaaagcagcaacgtggccttcgccgcccaggccgtgggcctggagacgatgcgcgcggcgagcgccttcgaggatccgcacatgcgcctgcgcaatggccggctgattcgcctgagcagcgagttcatggccatgaatacccgtttccacgccctccaccagttgctcgaacgcttgcgcgcgcagggctccacccaggtgctggatgcgttcgagccgtgcctggaggaaatcaccgggctgctcgaggagatccgtggccgcgccgtcaccgaccatgacgccgagcgcttcgcccagcgcctcgccgactgccgcgaacgcctgatggcgcgtatccgccaggcgcgcggcgagctgctggcgcgggagccgggcgaagaggcgcggctggacttcaataccgccgccgagctgctctaccgtttcgctgaggaaatgcacgactacgccctgacccatgcctcgctggccgcccaccgccacgagcgcgagcagtggaaggacgccttcaccgccaaggccaacgcggtggcggcggcagtggcggggatgcgcaccgggttgatgatcctgctgttcggctgtttctggatctacagcacctggcccagcggcggcaccttcgccctcaacgcggtggcggtctcggcgctggcttcggcggcgccgaacccgaagaaggtcgccatgcagatgggcatcggcaccatggccggcggggctggcttgggctttccgcgggctgttcttcgttctaccccattatcgacggtttcccgctgctatgcctggtactggcgccggtgttcgccctcggcgcgttcatctcctcgcggccgcagtgggccggctacggtctcggcctgctggtgttcttctgcttcggttcggtgccggcgaacctga

SEQ ID NO: 3764 - DNA, 240 bp, Pseudomonas aeruginosa
ccgaactggccggccggacgagcggccaaggtaccgtccatgcctcgtgaaatcgccatccatggggtctacatgccgaccctgacgctgttgttcgtgatcgccgcggcgctcacctgggggctcgaccggatcttcgcctcggttggcctgtatcgcttcacctggcacccggcgctgttccgggtcagcctgttcgcctgcctgtacggcggcctgtccctgaccatctaccgctga

SEQ ID NO: 3765 - DNA, 945 bp, Pseudomonas aeruginosa
ggcggtagcgcacctcttcgttatcgtgagccgaccatgaccttgaaatccgtaatcagcctgctggcgaccctgctgatcctgctggtcgccgtattcatcgggcggaccctgtgggtcaactacatggacaccccctggacccgtgacggtcgcgtgcgcgccgacgtgatcaatgtcgccgccgacgtttccgggatcgtcgtcgacgtcccggtgcgcgacaaccagttggtgaagaaaggcgacctgctgatgcagatcgaccccgaccactaccgtattgcggtgaagcaggccgagtcgctggttgcctcgcgcaaggcgaccctggagatgcgccagttgaacgcccggcggcgcgcggaaatggatgagatggtggtctcccgcgaaagccgcgacgacgcccacaacaccgccgccgcggcgatggccgactacgagcaggccaaggcccagctcgacgccgcgcgcctgaacctggagcgcacccgggtggtggcgcaggtcgacgggtacgttaccaacctcaacgtgcaccgtggcgactacgcgcgggtcggcgaggcgaagatggcggtgatcgacaagaactcctactgggtctacggctacttcgaggaaaccaagctgccgtacatccgcgaaggcgacccggtggacatgcagctgatgagcggcgaacacctcaagggccacgtggaaagcatcgcccgcggcatctacgaccgcgacaacccggaaagccgcgagctgaccgccgacgtcaaccccactttcaactgggtgcgcctggcccagcgcgtgccggtgcgggtacacatcgacgaagtgccggacggcgtgctgctctcggcggggatcacctgcacggtgatcgtcaagccgcaagggcgcgacgaccaggcctcggcggcgcaggcgccggggcgggccggttga

SEQ ID NO: 3766 - DNA, 927 bp, Pseudomonas aeruginosa
agaagtccattactggctacctccctggccggcctggccgtcgtcgagcaggtggtgttcgcggaggaagtcggcggcgaccttctgtggcgtctgctgctcgatatcgacccgcgcgttgagcgcctgcatggtggcgtcgtcgagccgctcgatgatcggatcgaacagcgtggcgaactccggatggcgctgcatgacctccttacgcaccaccggggcggcgttgtagaaggggaagtactgcttgtcgtccttcagcacgcgcagcttgaaatccttcaggcggccgtcggtggtgtagacgaggccgaggaacacctggcggttcttcagcgcggtgtagaccagcccggcgtccatctggcggatgtcgttgcgggtgaagtgcaggccgtacagctcgctcatggggccgaggccgtcggggcggccggcgaactccgggtccatggcgaacaggtgggtgctcccgggctcggcctcctgctgttcggcgagcacccgcgcgagatcgctgacgctctggatgcccaggtgctcggcctgttcctcgggcatggccagggcataggtgttgttgaagcgggtcggcttcagccagaccaggccctgggcttcgtcgagttgcttgacccggcggtaggaagccgcggcgtcgagcttctcgtcgatgtggttgtagacgatcagcgacgagccggtgtactcccagacgatatccagttggccgctttcctgggcggcgcgggccagggtgctgcccaggccggtggtgaccgtcacgtcgtatccgcgcttctgcaggaactgcgcggtgatggcggtgaggatgcgctgctcggtgaaggtcttgccgccgatgcgcagggtttccgcctgcgccaggccggcggcgaacaggccggcgcaggccaggcagagtga

SEQ ID NO: 3767 - DNA, 1545 bp, Pseudomonas aeruginosa
ccgggcctgggcaagcggccgcagccgccgtctcgcctgggctggcggcgaacgaagaaattttccccggggaagcggtcgataatggcgctgccgcgtcggcggcgcgccatgcaccgtatcggtgcgctggacgtccagggcttttctgcggttatgatgcgggttccgaaattttctcgggcttttccagacattcgcaccccacggttcacggatcggccttttggggtaggtgttttaccttctgctaagggagtaccccgcgtcatgctcgatctcgtcgcggcattcattgccttgaccaccttgctcacctacgtgaactaccgcttcatccgcctgccgccgaccatcggcgtgatggccacggcgctggtgttctcgctgatcgtccaggggctgtcggaactgggctatccgatcctcgaggtggagatgcaggaaatcatccgccgcatcgacttctccgaagtgctgatgacctggttcctgcccgcgctgctgttcgccggcgcactgcacgtcgacctctccgacctgcgcagctacaagtggccgatcggcctgctggccaccgccggggtgctgatcgccaccttcgtcatcggtggcctggcctactacaccttcccgctgttcggctggcaggtggatttcatctactgcctgctgttcggcgcgctgatctcgccgaccgaccccattgccgtgctcggcatcctcaagtccgccggcgcgccgaaaccgctggcgaccaccatcgtcggcgagtcgctgttcaacgacggcaccgcggtggtggtgttcgccatcatcctcggcatcctccagctcggcgaggcgcccacggtcagcgccacggcgatcctcttcgtccaggaagccatcggcggcgtggtcttcggtgcggtgctcggctacggcgtgttcgtgatgatgcgcggcatcgaccagtaccaggtggaggtcatgctgaccctcgccctggtcatcggcggtgccgcgctggccgcgcgcctgcacgtatcggcgccgatcgcgatggtggtggccgggctgatcatcggcaaccacggacgccactacgcgatgtcggacgagacccggcgctacgtggacaagttctgggaactgatcgacgagatcctcaacgccctgctgttcgccctgatcggcctggagctgctgctgttgccgttctcctggctgcacgtggcggcggccttcgccctaggcggcgcggtgctggtctcgcgcctgctcacggtgggcccggcgatcctggtcctgcgccgtttccgtggcgccaaccggcaggtaccggcgggcaccatccgcatcctggtctggggtgggctgcgcggcggcgtctcggtggcgctggcgctgtccctgccgttggggccggagcgcgacctgatcctcagcctgacctacatcgtggtgctggtatcgatcctgctccaggggctttccatcggcccgctggtgcgtcgtatctacgccggccagccgctggagaaaagcgagggggcgcactga

SEQ ID NO: 3768 - DNA, 522 bp, Pseudomonas aeruginosa
agcgcgaatggtcgaaccagtgccaggcctgggctacgcagaccaggtcgaaggcggcgtcgggatagtcggtggcttcggcgtcctgcacgctgtagcggatacccggatggacaacggcgtgttcgatctgctgcgcgctggtgtcgctggcgaggacttcgccgaagtactgcgccaggccgagcgcggcctggccggtaccggtggcgcagtcccaggcgcgccggcgctggccgcagagcccggcgagatggcggtagagcgcatcgggataacgcgggcgggcgctggcgtaggcagcggagccctggtcgaacagacggcgggtttccatcgggtcctccctcggtcagttgccgaaacgcccgtccaggcgttcggcgcggaattccagggtgctggcgcgatagcccggacgcagcggcggcagcggcaggcaatcgtgccagctgtcgccgccgagcagggcgttcggcgcccggtagcgcgggctgtcgaagctggtgtcggccaggttga

SEQ ID NO: 3769 - DNA, 2784 bp, Pseudomonas aeruginosa
gctctcgctgaacgctgtccgtgcagagagtttagccatggcttccctacgtcagaaacagtactccgtcctcggcatgagtaccttgtccttcgcggtgaatttcgccgtgtggacgatgttttcgatcatcggcatccgcatcaaggacgagcttggcctgagcgaatcccagttcggcctgatggtcgccctgccgatcctcaccggctccctggtgcgcctgccgctgggcctgatcaccgaccgcttcggcggccgcatcgtgttcttcatccacatgctgctggtggccatcccgatctacggcctggccttcgccagccagtactggcactacctggtgctcggcctgttcgtcggcctggctggcggctccttcgcggtcggcatcgcctacacctcggcctggttcgagaaggagcgccagggcaccgcgatgggcatcttcggcgccggcaacgccggcgcggcgatcaccaacctggtggcgccgatgatcgtggtcgccttcggctggcgcatggtgccgcaggtctactcggtggccatgctggtcaccgccgtgctgttctggctgttcacctggaccgatccggcgcacctcaagggtgccgccgaggccagccagcggccgaccctggccaagcaactggcgccgctcgccgagctgcgcgtctggcgcttcggcctgtactacttcttcgtcttcggcgggttggtcgccctggccctgtggctgccgaagtactacatcgccgaatacggcctggacctgaagaccgcgtccttcatcaccatgctgttcaccttgccgtccggcctgatccgcgccctcggcggctggttcagcgaccactacggcgcgcgctcggtgaactggggcgtgttctgggtctgcctggtgtgcctgttcttcctctcctacccgcagaccaccatgaccatccacggcatccagggcgacctcagcctgggcatcggcctgaacgtctggctgttcaccttcctggtgttcgtcgtcggcattgcccagggcttcggcaaggccagcgtgtaccggatcatccacgactactacccgagcaacatgggcaccgtcggcggcatggtcggggtgatcggcggcctcggcggcttctgcttgccgatcgtgttcggatacgccgcagaccacatcggcgtgcgctcctcctgcttcatgttgctgttcggcctgaccgtggtctgcatggtctggatgcactacgcgatcaagcagcaacgccgcatcgacggccaggccgcctcggccgacgtcgaccttcctcccacccttcccacccactcctgaggaatgccgtcatgggcatgatcgccaatacccaactgaaagccgcacggggaccgctgctgctcgactggcgccccgaggaccccgagttctgggcgcgcaacggcaagcgcatcgccagccgcaacctgtggatctcgatccccgcgctgctgctcgccttcgccgtgtggatgatctggagcacggtgactgtgcgcctgaacagcgccggcttcgccttcagcaacgaccagctgttcctgctcgcggcgctgccgtcgatctccggcgccaccctgcgggtgttctattcgttcatggtgccgatcttcggcggtcgtcgctggaccgccctgagcaccgcctcgatgctgatcccgtgcatctggctgggcttcgccgtgcaggacccgaacaccccgtactgggtgttcgccctgatcgcgctgctctgcggcttcggcggcggcaacttcgcctcgagcatgtccaatatcagcttcttctatccgaagagccagcagggcaccgccctcggcctgaatgccgggctcggcaacctcggcgtctcggtgatgcagttcgccgtgccgctggcggtggccggcggcctgttcggcgccttcggcggcgagccgcagcagctcggcgacggcggtcgcctgtggctgcagaacgccggctggatctgggtgccgttcatcgccgtggtatcggtcgcggcctggttcgggatgaacgacatcgccgacgccaaggcctcgttccgcgaccaggcggtgatcttcaagcgcaagcacaactggctgatgtgctggctgtacgtggccaccttcggctcgttcatcggcttctcggccggcttcgcgatgctcagccaagacccagttccccgacgtcaacccgctgcaatacgccttcctcggtccgctggtgggcgccctcagccggcccctgggcggctggctggcggacaagttcggcggcgcgcggatcaccctgtggaactacgcgctgatgatcggcggggtgttcgcggtgatcgccttcctgccgggcgacggcggccagggcaacttcttcggcttccttggcgccttcatcctgctgtgcttcttcgccggcatcggcaacggctccaccttccgcatgatcccggtgatcttccgcaacgagtgggcccggcgggtgcgcgacggccaggccgacaaaaccggcgcggcgcgcaacgcgagcatggagtcggccgcggtgatcggcttctccgccgccatcggcgccttcggcgggttcttcatcccgaaggcgttcggcacctcgctgcacatgaccggcagcgccgagggcgccctctacgtgttcatcgcctactacctgagctgcatcgtcgccacctggtggtggtacgcgcgcaagggtgcggagagtccctgttgagtccgtcggcagcagcccgcggcaacccctga

SEQ ID NO: 3770 - DNA, 1251 bp, Pseudomonas aeruginosa
ggagatcaagatgagtcacctgctcgaccgcctgcagttcttcaagaagaagcagggcgaattcgccgatggccacggcgagaccagcaacgagagccgcgcctgggaaggtgcctaccggcagcgctggcagcacgacaagatcgtgcgctccacccacggggtgaactgcaccggctcctgctcctggaagatctacgtgaagaacggcctgatcacctgggaaacccagcagaccgactacccgcgcacccgtccggacctgcccaaccacgagccgcgcggctgcccgcgcggggccagctattcctggtacatctacagcgccaaccgcctgaagtacccgaaggtgcgcaagccgttgctcaagctctggcgcgaggcgcgggcgcagcacggcgacccggtgaacgcctgggccagcatcgtcgaggacgccgccaaggcgaagagctacaagagccagcgcggcctgggcggcttcgtccgttccagctgggacgaggtcaccgagatcatcgccgcggccaacgtctacaccaccaagacctacggtccggaccgggtgatcggcttctcgccgatcccggccatgtcgatggtcagctacgccgccggcgcccgctacctgtcgctgatcggcggggtctgcctgagcttctacgactggtactgcgacctgccgccggccagcccgcagatctggggcgagcagaccgacgtgccggagtcggccgactggtacaactccagctacatcatcgcctggggctccaacgtgccgcagacgcggaccccggacgcgcacttcttcaccgaggtgcgctacaagggcaccaagaccgtctccatcaccccggactattccgaggtggccaagctcaccgacctctggctcaaccccaagcagggcaccgacgccgcgctgggcatggccttcggtcacgtgatcctgaaggagttccacctcgaccggccgagcgcctacttcgtcgactactgccgccagtacaccgacatgccgatgctggtgttgctggaagaacacgccggcggcgcgttcaagccgacccgctacctgcgcgccgccgacctggcggacaacctcggccaggacaacaaccccgagtggaagaccatcgcctacgacgagcgcagcggcgggctggtctcgcccaccggcgccatcggctaccgctggggcgagtctggcaagtggaacatcgccgagctggacggcaggagcggtga

SEQ ID NO: 3771 - DNA, 795 bp, Pseudomonas aeruginosa
ctggaagaagggcgagtgcgagccggtgccgggacgcaacctgccgacgctgcacctggtcgagcgcgactacccgaacgtctaccgcaagttcacctcgctcggtccgctgctggacaagctgggcaacggcggcaagggcatcggctggaacaccgagaaggaagtgaagctggtcggcgacctcaaccatcgcgtggtcgagagcggcgtcagccagggccggccgcgtatcgacagcgccatcgacgccgccgaggtggtcctcgccctggctccggaaaccaacggccaggtcgcggtcaaggcctgggaagcgctgtcgaagatcaccggccgcgagcacgcccacctggcgctgcccaaggaagacgagaagatccgcttccgcgacatccaggtgcagccgcgcaagatcatctccagcccgacctggtccggcctcgaggacgagcacgtcagctacaacgccggctacaccaacgtccacgagctgatcccgtggcgcaccatcaccggtcgccagcagttctaccaggatcacccgtggatgcaggcgttcggcgaaggcttcgtcagctaccggccgccggtcaacacccggaccaccgagaaactgttgaacaggaagcccaacggcaacccggagatcaccctgaactggatcaccccgcaccagaaatggggcatccactccacctacagcgacaacctgctgatgctcaccctgtcgcgcggcggtccgatcatctggctcagcgagcacgacgcggccaaggccgggatcgtcgataa

SEQ ID NO: 3772 - DNA, 1923 bp, Pseudomonas aeruginosa
cgactgggtcgaggtgttcaacgccaacggcgcggcgacctgccgcgcggtggtcagccagcgggtcaaggacggcatggtgatgatgtaccacgcccaggaacgcatcgtgaacgtacccggcagcgagaccaccggcacccgtggcggccaccacaactcggtgacccgcgtggtgctcaaaccgacccacatgatcggcggctacgcccagcaggcctggggcttcaactactacggcacggtcggctgcaaccgcgacgagttcgtcgtggtgcgcaagatgagcaaggtcgactggctggacgaaccccgccacggcggactcggcggcgacgccctgccgcaaccgctgccccaggacatttgaggagagacgccatgaaaattcgttcgcaagtcggcatggtgctgaacctcgacaaatgcatcggttgccacacctgctcgatcacctgcaagaacgtctggaccagccgcgaaggcatggagtacgcctggttcaacaacgtcgagaccaaacccgggatcggctacccgaaggaatgggaaaaccaggagaagtggaagggcggctgggtgcgcgcggcagacggttcgatccgcccgcgcatcggcggcaagttccgcgtgctggcgaacatcttcgccaacccggacctgcccgagatcgacgactactacgaaccgttcgacttcgactaccagcacctgcataccgcgcccaaggccgagcaccagccggtggcgcgcccgcgctcgctggtctccgggcagcgcatggagaagatcgagtggggcccgaactgggaggagatcctcggcaccgagttcgccaagcggcgcaaggacaagaacttcgaccaggtccaggcggacatctacggtgagtacgagaacaccttcatgatgtacctgccgcgcctctgcgagcactgcctgaacccggcgtgcgtggcgtcctgcccgagcggggcgatctacaagcgcgaggaggacggcatcgtcctgatcgaccaggacaagtgccgcggctggcggatgtgcatctccggctgcccgtacaagaagatctacttcaactggaagagcggcaagtccgagaagtgcatcttctgctacccgcgcatcgaggccggccagcccaccgtctgctcggagacctgcgtcgggcgcatccgctacctcggcgtgctgctctacgacgccgaccgtatccacgaagtggccagttgcgagaacgagcgcgagctgtacgagaagcaactggagatcttcctcgatccgttcgacccggcggtgatcgcccaggcgcgcaaggatggggtggccgacagcgtcatcgaggcggcgcagaagtcgccggtgtacaagctggcgatggactggaagctggccctgccgctgcacccggaataccgcacgctgccgatggtctggtacgtgccgccgctgtcgccgatccagaacgccgccgccgaggggcacatcggcagcgacggggtgatcccggacgtcgagtcgctgcgcatccccgtgcagtacctggccaacctgctcaccgccggcgacaccgcgccggtgctgctggcgctcaagcgcctgctggcgatgcgcgcctacaagcgcgccgagcacgtcgaaggccgccaggacctggaggtgctggccaaggtcgggttgagcgtggagcaggtggaggagatgtaccgctacctggccatcgccaactacgaggatcgcttcgtgatccccagcgcgcaccgcgaggaagcgctttccgatgccttcgccgagcgttccggctgtggcttcagcttcggcaacggctgttccggcggcagcaactccgccgtcaacctgttcggcggcaagccgaccaaccgccgcgacgtgatccaggtcgtgcagatccaggagtga

SEQ ID NO: 3773 - DNA, 510 bp, Pseudomonas aeruginosa
tccgcacctgcgaactgccggaagcgctgcgcgacggcctcgcggcgctgctcaacgagctctgccagggcgacctgctggacgtccaggcgcgctacgacggtctcttcgagcgcggccgctcggtctcgctgctgctcttcgagcacgtccacggcgagagccgcgaccgtggccaggcgatggtcgacctgctcgaccgctataccggggccggcctgcaaatcgacgtaccggagctgccggactacctgccgctgtacctcgaatacctgtcgctgctgccgttcgcggcggccagcgaagggctcgccgaagtggcgcacatcctcggcctgctggcgctgcgcctggaggaacgcggcagcgcctatgcggcgattttcgaggcgttgctggaactcggcggcgagcgcccggacctcggcgcgttgcgtcgcgaccaggcccaggaacagcgcgacgacagcctggaggccatcgaccgggcctgggaggaaaccccggtga

SEQ ID NO: 3774 - DNA, 1785 bp, Pseudomonas aeruginosa
agacctgctggcccgcgagctgcaataccacccggcggacagctacgcgctggcgctggaggccgcctgccgtgcgctgatcgtccgccagttgctcctgcaacgggccgacgcgctgggcatcgaggcccgctgcgaagacggcgagacgccggaggaagcgcgcatccgccaattgctggaggaagaggtgcaggtcccggaagccgacgaagacgcctgccggacctggtacgcggccaatccggggcgcttgctcggcccctggcgcctgcaattgcgccatgtgctgctggcctgcgcgccggacgacctggaaggccgcgagacggcgcgcaagcaggccgcggagctgctcgacgagttgcgcgggcatcccgagcgcttcgtcgacctggcccggcgtttctccgcctgtccgtcgaaggaggcgggcggcgacctcggctggatcgagccggggcagaccgtccccgaattcgagaagcgcctgctgcgccgcgcgcccgggctgctcgagcatccgctggaaagccgctatggcctgcatgtggtggaactgctggcgcgcgaaggcggcgagccgctcgacttcgacgcggcccgcgcacagatcgccgcgcacctgcaggtgcaggtgttgcagcgagcggtgggacagtacatcggcgtgctggcgggagacgcctgtatcgagggcttcgccttcgagggtgcggatggggcgctggtgcaatagccttcggcgccgatgtttccctctccttcccgaagatcaaacggagtacccaggacatgaccgactggatcgatggccaaggccgacagatcgactacctgcgcctgtcggtcaccgaccgttgcgacttccgctgtgtctactgcatggccgaggacatgcgcttcctgccgcgccagcaggtgctgaccctggaggagatcgagcgggtcgcccggctgttcgtcgccggcggtgtgcgcaagctgcgcctgaccggcggcgagccgctggtgcggcccggcatcgtcggcctgtgcgagcgcctggcggcactgccggggttgcgcgaactgtgcatgaccagcaacggctcgcaactggtgcgctacgcccggccgttgtacgacgccggcctgtcgcgtctcaacatcagcctcgacaccctcgatccgctgcgcttccgggcgatcacccgcaacggcgagctggacaaggtgctggccggcatcgacgccgcccaggccgccggtttccgccggatcaagctgaacgcggtggtgatgaaggggcgcaacgccgatgaggtgccggcgctggtggacttcgccatcgcccgcggcctggatatcagcttcatcgaggagatgccgcttggccaggtcggccgcgaacgtggcgagagcttctgctccagcgacgaagtacgcgcgctgatcgcccagcgccacgccttgctcgacagcgccgagcagagcggcgggccggcgcgctacgtgcgcctggtcgagcatccgcagacacgcatcggcttcatctcgccgcactcgcacaacttctgcgccacctgcaaccgcctgcgcctgaccgtcgagggccgcctgctgctgtgcctcggccacgagcattcgctcgacctgcgcgcgctgctgcgccgccacccactgcacgacggaccgttgctggaagcgatcggcgaggcgctccagcgcaagccggcgcgccatgaattcagcgccgccggcgaggtgcaggtgctgcgcttcatgaacatgagcggcggctga

SEQ ID NO: 3775 - DNA, 897 bp, Pseudomonas aeruginosa
cgatgtatactttttggtccagattggacgaaaagtataaaggcggatcaccgtctgtttcctgcccgggccgcgggcgcaccttcgtcacccctggagtcgtccatgatcaagtcgctgaacaccaagaacctgctgggaggcctgctgctcggcgtgctcgccagcggatccgccgtcgccgccgatggcaacctgcggatcggcatcgaggccgcctacccgccgttttccttcaagaccgccgaaggcgaactggccggcttcgactacgacatcggcaacgcgctgtgcgcgcagatgcaggtgaagtgccagtggatcgagcaggagtacgacggcctgattccctcgctgaaagttcgcaagatagacgccgcgctgtcctccatcaccatcaccgaggagcgccggcgctcggtggacttcacccacaagtactacttcacgccgggccgcctggtgatgaaggaaggcgcccagctcgacgacagcttcagccagttggccggcaagcgcatcggcgtgcagcgcggcgctaccgccgaccgcttcgccagcgcggtgctggccaaggccggtgctgaagtggtgcgctacaccagccaggacgagatctacctggacctggtggccggccgcctcgacgccaccttcgccgactccatcccgttgcagaccggcttcctcgataccccgcgcggcaagggctacgccttcgtcgggccggagttcaaggacccgaaatacttcggcgagggcgccgggatcgcggtgcgcaagggggacgccgagctggtcggcaagctcaacgcggcgatcgacgcgattcgtgccgacgggacctacaagcgcatcgagggcaagtacttcaagagcgacatctacggcgactga

SEQ ID NO: 3776 - DNA, 1602 bp, Pseudomonas aeruginosa
ccggcggcggcacctgcgtgtcgcagaaacgaaaaaggcgaagccggatggcttcgccttttttctccacgcctgcgttcagtgcttgcgcggtaccggcttgagcagttcggccggcggcatctcgcaggtgatcttgcggcccagcagttcttcgatcggcggcagggcgaaggcatcgtcctcgccggcgaagctgatcgaggtgcccgaggcgccggcgcggccggtacgaccgatacggtgcacgtagtcgtccgggtcctccggcagggtgaagttgatcacatggctgatgccgtcgatgtggatgccgcggccggccacgtcggttgccaccaggacgcggatcttgccttcgcggaagccttccagggtgcggatgcgcttgtgctgcggtacgtcgccggacatctgggcggcgctgatgccgtccttggtcaggcgttcctcgatgcggcggacttcgtccttgcggttggcgaagaccatcacccgttcccagttgttctgtgccaccaggttgtacagcagcttgtacttgtcgctgccggccacggcgtagacatgctgctcgacggtgtcgctggcgacgttctccggctcgatctcgacgatcgccggatcgacggtccactgcttggcgaggttcatcacgtcgtcggtgaaggtcgccgagaacagcagggtctggcgttcgcccttgtgcggggtctgccggatgatctgccggacctgcgggatgaagcccatgtcgagcatgcggtcggcttcgtcgaggaccatcacctcgaccatgtccaggtgcacctcgccgcgctggttgaagtccagcagacggcctggggtggctaccaggatgtcgcagaagcgcgcttccagctgcttgagttgcttgtcgaagtccatgccgccgacgaaggtcatcacgttcagcccggtgtacttggtcagcgccgcggcgtccttggcgatctgtaccaccagttcgcgggtcggggcgatgatcagcgcgcgcggctcgcccatgtagcgctctttcggcggcggggtctgcagcaattgggtgatgatcgagatgaggaacgcggcggtcttgccggtgccggtctgggcgcggccgatggcgtcctggccgcgcagggtgaagcccagtacctgcgcctggatcggggtgcagtaggggaagccgaggtcatggatggcgtgcatcaggctcggggcgaggttgaagtcgtggaagcgggtcttgccttcctgcggttcgaccacgaagtcttccagcttccagttgtccaccggcttcggcttgcgttcgcggcgcggcttgtcgctgcgcggcttggcgtcccggccttctttgccggcgggtttggcgggcttttcgcctttctcggccttttcagcggcgcgcggggggcgcggtttgcgtgggcgtttctcggtcggcttttcgccggtgggggcggtacctttcgcggtagcgccggcagggccttgcgggaccggggaggaaccgctctgcggctgggttccgtcggccttgccgaagattttcttgagtgctttgagcacggcgatctcgtagtggttaaggaatga

SEQ ID NO: 3777 - DNA, 2082 bp, Pseudomonas aeruginosa
acgggcgccagtgtaaagcatgttgccagcggggagaaatccatgcttggccggcgccctccagccctggccggacggggcctggagggggctgcgcgaagctcccggggcagccttcgggaggactcgtgcgcgcgaccggtggcgcgctacaaaaagacaacggtagggcgacgacgggggtggcatcttcgggacggtgccggagcgatccggcgagtgtccgcccactcaccaacggaagaacaagaaaaccatgaatccgtccccatcgatcgtcgggctgagcgatatcgaagccctggaacgcgtgccgctggaacagcgcgacctgccgtccagcacctacgaactgttgcaacgctcggcccagcgccacggccagcgtatcgccctgagctgcctgctgcatggcagcgccgccgaagaaccgttgcggatcagctatgccgagctgttcgcccgcgtcacccagaccgccaacgccttgcaccggctgggcctggaaagccaccaggcggtgtccttcctgctgcccaacctgccgcagacccactacgtgatctggggcggcgaggccgccgggatcgtcaatgcgatcaacccgctgctggagccggagcacatcgccgagctgatccgcgcctccaacacccgggtgctggtgaccctggcgccgttccccggcaccgacctgtggcagaaggtcgccggcctgcgcgcacagttgccggagctgtatgcgatcgtcgtggtcgatccggccaacctgttgccggcgccgcagcgcgaggcgctcaaggcccagcgcgggccgctgccggagggcgtgctggacttcgatacgctgatcgccgactgcccggcagaccgcctggagagcggacgggcgatccatccggacgacgtcgcttcctatttccacaccggcggcaccaccggcacgccgaagctggcgccgcacagccacttcaacgaggtggcgatggccgagatcatgggcctgaacgccgactacggggtggacgacgtgctgctctgcggcctgccgctgttccacgtcaacggcgtgatggttaccggcctggcgcccttccatcgcggcgcccaggtgctcctggccgggccccagggctaccgcaatccgaccctgatccaggacttctggaagctggtggaacgctaccgggtcaccagcttcagtggcgtgccgaccatctacgcggcgttgctgcaggtccccagcgatggccgcgacctgtccagcctgcgtttcgccctgtgcggcgcggcgccgatgccggtggagctgatccgccagttcgaggcgcgtaccgggctcaaggtgatcgagggctacggcctcaccgaaggtacctgcggcaccagttgcaacccgcgtggcggcgagcgccggccgggttcgatcggcctgcgcctgccgtactgccaggtgaaggtcgcggtgctcgacggcgagggcaattacctgcgcgatgccgcgccgaacgaggtgggcaacctctgcctgaagggcccgacggtgttcaagggctacctgcaacaggaccggaaccgcgatatctggatcggcgatggctggttcaataccggcgacctcggtcgtatcgacgaggacggctacatctggctcaccgggcgcagcaaggacctgatcattcgcggtggccacaacatcgacccacagatgatcgaagaagcgctgcaccggcatccggccgtggccctggcggcggcggtgggcaagccggacgccaaggccggcgagctgccggtggcgtatatccagctcaagcccggcgccagcgccagcgaggaagagctgctggagcacgccagccgccacgtaccggagcgcgcggcggtgcccaaggatatctggctgatcgagagcatgccggtcaccgcggtgggcaagaccttcaagccggcgctgcgcctggacgcgatccgccgggtgctggaggaggaaagccggaggatcgccgaggatatccgcgtggaggtggtcgccgacgagcgccacggccagctcgcccacctgcacgttcccgcgcttga

SEQ ID NO: 3778 - DNA, 417 bp, Pseudomonas aeruginosa
cgaaagacgccaggcggcgctggaagagctgctcggcggctacgcgctgaactaccggctgcacgccgtctgagagaagctccgggcgtcagaggcgcttgcgcagccaggcgccgatgtcgtggatttcctccagggacacctcgtggcccatcgggtagtcgtgccagcccacctccacgccctgcgcctgcaaggcgtcatgggccgcgcggccaagcgccgggtcgaccacgtcgtcctggctgccgtgcaggtgcaggaccggaatccgcttgtggcgctcgtccagcgccaggtcgtcgaaggtcggcgcgtaggtggatagcgccagcaccccgccgagcggctgggcgtagcggcggaaggcggtatgcaggaccaccgcgccgccctgcgagaaaccggcgaggatga

SEQ ID NO: 3779 - DNA, 1320 bp, Pseudomonas aeruginosa
cggctccaggcagggggcatatgcgttcggaatgggaggaccattcgacaacaggcgctttcccgctcgcaagtcggccagattgtcgcagatcatgcattcgccaatttcccgcggatgcgctttgctaagggaagtgcgccgggtacgccgttcgtcgcccgccgcggtcgcgccgccggctgcctctgccggtgccgcggcgcttgcggttacagtgcggcgaccggcccgggaagcgaccggcgcggggccggcggttcacccaggggcggcgaagggagtggcgaacagatgacaataatgaaaggtacctggctgctgctggccgctgtctgcctcggcgccagcgccacggccgaggccggtgcgacgctggatgcggtgaagcgcaagggctacgtgcagtgcggcgtcagcgacggcctgccggggttctcctacgccgacgccaagggccgtttcaaggggctcgacgtcgacatctgccgggcgctggccgccgcgctgttcggcgatgccgagaaggtgcgcttcaccccgctgtccgccaccgagcggttttcggcgttgcagtccggcacggtcgacctgctgtcgcgcaacacctcatggaccagctcgcgggataccgcgctgggcatccacttcaccggcgtcacctatttcgacggccagggcttcctggtcaatcgcaagctcggcgtgtccagcgcccgcgaactgaaggacgcgacggtgtgcatccagtccggcaccaccaacgagctgaacgtggcggactacttccgggcccacggcatccgctacaaggcggtgctcgacgacagctacgagaagagcgcccgtgccctggaggcggggcagtgcgacgtgctcagctccgaccagtcgcagctctacgcccagcgcctgaagctggccaagccggagcagtacgtggtgctgccggaagtgatctccaaggagccgctcggcccggccgtgcggcagggcgacgaagcctggttcaacatcgtccgctggaccctgtacggcctgctcaacgcggaggagctgggggtcacctcgagcaacgtcgagcgccaggccagggacagccgcaacccggacgtcgcccgcctgctcggcagcgagggcgacgccggcaaggacttgcaactgccgcgcgactgggtggtgcagatggtgcgccaggtcggcaactatggcgagatcttcgcccgcaacgtcggcgacggcagcccgctgaagatgccgcgcggcctcaacgcgcaatggaatctcggcggcctgcactatgcgccgccgattcgctga

SEQ ID NO: 3780 - DNA, 783 bp, Pseudomonas aeruginosa
cagacagacgcaccggtgccggtgcactatagagcgacgcgtcatgccgaacaccgaacaagagaaatgcccgtgaacctatcgatgactcccatcaacaaagccaaggcctggggcgtccacgccgtcaccgccagcggcgtgatcctggccttgctggccctgctcgcgctggtcgacaacaaaccacaggcctgcctgctctggctcggcctggccctgctggtggacggcctcgacggcaccctggcgcgcaagtacgaagtcaaggaaatgctgccgcatttcgacggctcggtgctcgacctggtgatcgactacctgacctacgtgttcatcccggccatcttcatctaccgctacatccccctgccggagcatttcgagctgctggcggtgggcgtgatcctggtttcatcgctgttctgcttctgcaacgtcaacatgaagagcaccgataactacttcgtcggcttcccggccgcctggaacgtggtggcggtgtacttctacgtgctcgacctgcacccctgggtcaacctcgccacggtgctggtgctggctgccctgaccctgacccggatgaagttcctccacccgttccgcgtgcgccagttcatgccgctgaacatcgccgtgactttcgtctggctgatcagcagcggtctgctgatcgtccagcagccggccgacctgccgatcctgctcggcctctggttcgccgcctcggcctatttcgtcggtatctgcctctggcgcagcgcccgcgagtggttcggctga

SEQ ID NO: 3781 - DNA, 1515 bp, Pseudomonas aeruginosa
cgaggccgttgccgcggtggctttcggacataccgacctgtatctcgacgatgtgctcagtgcctaccaccggatcaatcggtcctattacggctacgtgaggttcgagcggtttgccgatgcccgcctggaagggggctacggcttcctccttcgtcgcggcgacacgaacctgttgcgcgtcgtcaactcggccatcggcgcgatcaaccaggaccgtctcgaaagcatcgccaggcgctgggtcggcagcggttccctgccaacgggccagcgtatcgcgctgacgccgcaggagagtcgctggatcgctcgccacccggtggtgcggttggtcatcaacgacgacctggcgccgctggccttcttcaattccgacgagaccttctcgggcatcgcctccgacctgctggacatgatttcccgccgcaccggcctgcatttccaggtcacgcctcgcagtggcggcttccccgagcagatcggcgtattggccaggaaggaggcggacctggcgatcatgagccgcagcagcaagcgcgaggaaatgctgcgtttcacccgctcgttcctgtccacctcgtacgtcctcgtcacccgggcggacgacaagggacgcgcggagagccccgggagcctcgacggcaagcgcatagcgattcccgccggccatgtgggcatgcaacaggtgcgcgagcgctatccgcaggcctcgatggtggaggtcggcgtcgcgctggatgccatgaacctggtctacgaaggacgggccgacgcggcggtggtgccgctggtcaccgctcgctactacatcgtccggttgttccgcgagaggctggcgatcgccgacctggttcccatcggtgcggccaccgcccacttcgccgttcgccgaggcgacgccgaactccagtcgattctcgacaaggccttgctgagcatctcgccggacgacctgagcgatatcgtcaatcgctggcgctcgccgccgggaatgagcggccagacctgggtcgactacatcctggtgatcaccgagatcctggcgatcgcagcggccttgctgctgctctgcctgggctgggtcacttatcagcgccggcagatcagggtgcgcgcgcgggtcgaacaggcgctcagcgaccagttgcggttcgtcgaggccctgaccgactgcatgcctccgccgctgtatgtgcgcgatgtcaatggacggatgctgtcctgcaaccgcagctacctgcagagcgtcggcttgagttccgaggaggtgatgaaccgcaccgtgctcgaactgcccatggaaaacttcgagaccgctccggagttccatcgcagctacctgagggccatgcgcgagggcaggaccatcgaggcggtctacccggtggcgctgggcggtcgggagcgctggatcgaccactggatccagccgttccgcgattccagcgggaccatccgcggtgtcatctgtggctggctggacatcaccgagcaccgccagttgatcgatga

SEQ ID NO: 3782 - DNA, 2112 bp, Pseudomonas aeruginosa
cgcgcgaggactggcttcgcagatgagtcggccgtttccgaaaaggcctcccatgaacgcgaaccttcccccttccgccatttccgaactgcatggcccgcgcctgctgctgcgcgcctggcgcgacagcgaccgcgaggcgttcgccgagatgtgcgccgacccgcaggtaatggaattcttccccagtgtgctcgaccgcgcgcagagcgacgccttggtcgatcgcgtccaggcgcattttgccgagcgtggctacgggccctgggccctggagctaccgggcgaggcggcgttcatcggattcaccggcctgttcgacgtgaccatggacgtgcacttcgccccgaccgtggagatcggctggcgcctggcgcccgcctactggggccgtggactcgcccgcgaagcggcggaaaccgccttggacttcgccttcgagcggctgcgcctgcccgaggtggtggccttcaccacgccgcccaaccgccgctcctggggcttgatggagcgcctgggcatgcgtcgcgatccggccgaggatttcgaccacccactcctggcagcggatcacccgatgcgccggcatatcctctatcgcgtcgacgcggcccgctgggcggagcggtgaacatgggcgacggcggcggcgaggtgctctcctaccatcgcctcagcatgcatcgcccggagcgctacgcacccggtcccggcggactggactgggcgacccagccggcgccgttccgccagtaccggggctgccggcaaatcgaactgctgcatcggccgctggaggagtcgccaccctacgacggggtgttttccgggccggcggccgcgccctctcggctcgatcgccgcagcctctcgcagatgctctacgacggattggcgctgtcggcctggaaggaggccggcggcactcgctgggcgctgcgggtcaatccgtcgagcggcaacctgcatcccaccgaagcctacctgctgcttcccggcggtaccctggagccggcgccgctgctcgcccactaccgtcccgacaagcatgccctggaggtgcgcggcgaactgccggcgccgctggtttcgctgctggatgactgcttgccgcccggcggctgcctcctggcattgaccagcgtgccctggcgcgaggcctggaaatacggtgagcgagcctatcgctactgccagcatgacctcggccacgcgctggcctgcctctcgatcgccgcggcgatccagggctgggagatgcgcctgctgcgcggcgtcgccgaaagcgcactggacggcctgttcggccttgaccgggacggcttcgccgagtgcgagagcgtcgacgcactgttctggatcgggccggcgctcacgcaggagccttccctttcgccgcgcctgtgcgaaggactggcggccctgccgttggccggcgcgccgaaccggctgtcgcgggagtaccgggactggccggagttgcagcggatacatgggctatgtcgggcgccgcgcctgccggcacgcccgtggagggtcgcaccgggcgagcccggcaacgacaacccccggcctgccgctgcgaccgctgctgcatcggcggcgtatcgcgcagcgcatggacgggcgcgccggcatcgatgtcgggctgctgcgggcctggctgcgcaggctgctgccggagcgctcgccggtgcctttcgcggtcaccggcgaggccgcgcgggtcgatctgctgctgttcgtccatcgcgtccggggcctggtgccggggttgtactggctggaccgcagcggcctgcggcggccgccgatgcgcgaggacttcctctggcagcgcgtcgatccggagttgccgctgtacctgttgcaggaaggcgatgcacgcgcgctgtcggcgtatctctcctgccagcaggacatcgccggcgacggctgcgtcgcgctcgccatgctcgcccatctcggcgcggcgctcgaagaaggtccctggtgctatccgcggctgtactgggaatgcggggaggtcggccagttgctctacctcgaggcggaggccgccgggctgtctgggacgggtatcggctgctactacgaccccctggtgcatga

SEQ ID NO: 3783 - DNA, 516 bp, Pseudomonas aeruginosa
gtccatggccagtctctaccatttcaccctcggccgcgcggtgtgggacactcgtctttgcaacatgcccgcgtacccggccatgcgccgcgactagcccgtcgacagcccgaattcgaggaaacaccccatgacccagatactggacaacctggtggctttgctgagcctggaacccatcgaggagaacctgttccggggcatgagccaggatctcggcttccgccagctctatggcggccaggtcctggggcaggcgctgtcggcggccagccagacggtggaggacgatcgccacgtacactccatgcacggctacttcctgcgtcccggcgacgccagcatgccggtggtgtaccaggtggaccgggtgcgcgacggcggcagcttcagcacccgccgggtcaccgcgatccagaaaggccagccgatcttcaccctgagcagctccttccagtacgacgaggaaggtttccaccaccagatcgagatgcccgaggtggttggcccggataa

SEQ ID NO: 3784 - DNA, 606 bp, Pseudomonas aeruginosa
ggactgggcgtgaggctggccgacatccgccactgggtgttcgacatggacggcaccctgacccgggccgtgcacgacttcccggcgatccgccgagcgctggacatccccgagcaggacgacatcctgctgcacctcgccgccctgcccgaggccgaggcggcggccaagcacgcctggctgctcgaacacgagcgcgccctggccgaggccgcgcggccggcgccgggcgcactggaactggtgcgcgagttgcagcggcgcggcgtgcgcctgggcatcctgacccgcaacgaccaccagttggcgctgatcaccctcgaagcgatcggcctgggcggctgcttccccaccgagcacatcctcgggcgcggcgaggcgcggcccaagccggaccctgatggcttgctgcgcatcgcccgacgctggaacgtgacgccggcggagctggtgatggtcggcgactaccgtttcgacctcgactgcggacgcgccgcgggtagtcgcacggtgctggtcaacctgccggaaaacccctggccggagctggccgactggcacgctgccgattgccatgcgttgctcgagcaactgcaaacgccgtag

SEQ ID NO: 3785 - DNA, 1089 bp, Pseudomonas aeruginosa
ccggcgccgatcccagggacgtccccgaactgctggccggctcgaccttcccggaaagccaggcgcaactgtccgccgacctgctcggcggcggcaccgccaaggctatcgccggcactgccgaattcctcaaggaacagaagcgcgtgccggccgtcctcggcgactactcgccctacgtcagcgccgacttcgtgcgccaggcggagcaggtccaggtcggccagcgctgaattccgcgactccgctccggcctgtcggagcggaggctttcttaccctacggagggcagaacacatgagccgtctgacggccgaggcgatcagcctctcattcgaacagcgcggccagcgccgcgccatcctccgcgatctcagcctgggcctggccaagggcgagtcgctggtggtgctgggtccttcgggctgcggcaagtcgacactgctgaacatccttgccggtttccagaagccggaccagggacgcgtgcagatcgacggccggacactcgaagggcccggcggcgagcgcggcgtggtattccaggacgacgccctgatgccctggctcaacgccctcgacaacgtcgccctgggcctgcgcatccgtggcctgggcaaggccgagcgcaccgcgcgggcgcgccaggtcctgcaactggtgggcctccaggagtacgccgagcagtccgtcgctcagctctccggcggccagcggcaacgcctcgggctggcacgcgcgctggcggtcgagccggacttcctgctgctcgacgagccgttcggcgcgctcgacgcgctgacccgcgagcgcatgcaggtgctcctgctggacctgtggaagcagaccggcaagggcctcttcctgatcacccacagcgtcgacgaagccctgttcctggctaccgacctggtggtgatggacggcccgccggcgcgcatcgtcaagcgcctgccggtggacttcgcgcggcgttacgccgccggcgaaacggtgcgttcgatcaaggctgatcccgagttcggccgtttgcgccaggcgttgctggacgaattcctcgatgtcgcggaggccgaacatgcccactga

SEQ ID NO: 3786 - DNA, 918 bp, Pseudomonas aeruginosa
taccctcggactcgccgttgccaatcctgtcccgcgcaagcgccgtctgcccggcgaccgtcggcgctgggccgccggtgccagcgtgctggccctggccctgctgtggtgggcggcgacccgtttcggctgggtcgacgtgctgttcctgccggcgcccgaacagctcttcgaagccctgcaacggctatggcaggatggctacctcgatgccagcctgctgcaacacgtcggcaccagcctgctgcgggtgctcctggcgctcggcgcggcggtgctgacggcgatcccgctgggcgtgctgatgggcctcaatcccttggccggagcggccctcgatccgctggtggagttctaccggccgatcccgccgttggcctacctgccgttgatcgtcatctggttcggcatcggcgagctgagcaaggtgctgctgatctacctggcgctgttcgcgccgctgctgatcgctaccgccgccggcgtgcgtcgcgtcgaccgatcgcgggtgcaggcggtgcgctgcctgggggccagccgctggcaggtggtgcgctacgtgatcctgccgagtgccttgccggaggtcctcaccggcctgcgcatcgccctcggcgtcggctggtctaccctggtcgccgccgagctgatcgcggccaaccgaggcctcggcttcatggtccagtccgccgcgcaattcctcgccaccgacttggtggtggtcggcatcctgctgatcgccgccatcgccctgggcttcgaactggggctgcgctgggcccagcggcgcttcgccgcctggggttgatcgcgagagtcccgagtcatttccgaaccggccttcactcacgcggcgaaggccggagcgagggcgcgcagggcgcgcccgcaacctgcccgacgagtagcacgacatga

SEQ ID NO: 3787 - DNA, 1656 bp, Pseudomonas aeruginosa
tggtggtgcagagcgaactgccgtatccggaaggggtggcggcggccggaaatcctccgggtcggcagcgacggcgccgaggacgaggaagacgcccgcgcgccgcgtgccgccggtaacgcgccggggctctacgacatcctcggcggcggcctggtggcggcgctgttcagcctctggagcagcggcttcaaggttctcgccgaaggcttcagcgtctggctcagtgccgggcaggcggcgttccgcctttccaccggtttttccctggcgctggtcggtgccggctacctgatgggcatcaccgccggcatcgcgatcctcatcggcgtggtgatctcctggggcgtcgcggtgccgctgctgaccgtcaacagcgtgccggccgacggccagagcctgtcggacctggccacccaactgtggagttcgcaggtgcgcttcctcggcgccggcaccatcggcgtggccgcgctgtggaccctggcgaccctgttcaagccgatggtgcggggtgtctgggcctccctcggggcagtgcgcggcaatagccaggcgaacagcttgcgcaccgagctggacatgccggccaagtggatcctgctgatcgccgggatactgctggtctcgctgttcgtggtcttcagccacttcctcggtgccgccgcgccggacatggccagcccgcagttctggagtctggtggcggtatgcgtggtgttcgccttcttcttcggcttcctgatcgccgccgcctgcggctacatggccggcctggtcggttcgtcgagcagtccgatctcggggatcggaatcatcgcggtcatcctggtgtcgttgctgatactcggcttcggcagcatcgagggcggcctgctggaccgccagaacggcaagctggcgatcgccctggcgctgtttaccacctcggtggtgctggccatcgcggcgatctccaacgacaacctgcaggacctcaagaccggctacctggtcggcgccacgccctggcgccagcaggtcgcgctgatcgtcggctgcatcgtcggcgcgctggtgatccccccggtgctggaactgctctacagcgcctacggcttcaccggggccctgccgcgcgagggaatggaccccggccaggccctggccgcgccgcaggcgaccctgatgacggcgatcgccagcgggattttccacgacgcgctgaactggaacatgatcctcatcggcgtcgccctgggcatcgccctgatcctcgtcgacctgctcctgcgccgtaccggcaaggcctgcctgccggtgctggcggtgggcctggggatctacctgccgccgaccatcggcatgaccctggtggtcggtgcgctgatttcctggctgctggaaaatgccctgaagaagcgtgcggcggcggccggggtcgacgaagaggcttatgccgaagagccgaagcgacgcggcgtgctgctggcttcggggctgatcgtcggcgagagcctgatgggcatcctgctcgccggggtgatcggcgccaccggcgaggacgcgccgctggcgctggccggcgccggcttcgcgggcatcgcccagtggctgggactggtggtattcgtcgcgatctgcgtgctgttctaccggcgagtgctggcgcgctga

SEQ ID NO: 3788 - DNA, 294 bp, Pseudomonas aeruginosa
aaggccttgtgcaggccccacatcatcaatagcaggatcagcgagaagggcagggaggtcagcaccaccgccgacttcagcgcgtcgatgctgccggcgaacagcagcccgccggtgaccagcgcggtgaccgagccccagaacacccgcagccacttcggcccgtcgtcgtcggcgctgccgccgtgggcggagagggtggagaggaccacggtgccggagtccgccgaggtgacgaagaagacgaagctgaccagcaccgtgacggtgatcaccgcgcggctccaggggtag

SEQ ID NO: 3789 - DNA, 351 bp, Pseudomonas aeruginosa
acgccgatgaagtattccgccagcggcaggatgtctcccggacgttcgcgcaatggcggcaggctcaggcggccgtcgtgcaggtactgctgcaggccggctaggaacttgccggcgcgcaccgcctggtccaggtcgacgctggtggcggtgaccaggcgcacgtcatggggaatcggctgctgcgcgccgacccgcagcacctcgcgttcctccagcgtctgtagcagcctggcctgcagcgtcagcggcaggtcggcgatctcgtccaggtacagggtgccgccattggccgaaccgaaccagccggcgcggctgccgaccgggccgttatgggcgccgggagcgtag

SEQ ID NO: 3790 - DNA, 414 bp, Pseudomonas aeruginosa
ccgaacagctcggcttcggcatggttgcgactgagggcgctgcaactgaccgcgacgaacagaccggcgcgttcgctgtggcggtggatctgccgggcgagcagctccttgccggtgccggtctcgccttcgatcagcaccggctggccctgtggcgcgaggcgctcgagttcttcgcggacccggtgcgagcgtgggtcgaagaacaccagggccttggcgcggatgctcagcggactgcggtcggcgtcggggaaggtcagcggcgcggggcgtggtttctcgctcatgggtaactccttggcggcacggggcgcctccagcgcctgcgccgcgacgacggccggaacggctgcgggcgggggccgttgcggaaaaagaaacgccggtgcaagccatgcgacaccggcgtga

SEQ ID NO: 3791 - DNA, 1182 bp, Pseudomonas aeruginosa
gccggaagggccgagaacctgaagaggagttgccatgttcggattggaggctatcgaccttgcccgcatccagttcgcgttcaccgtgtccttccacatcatcttcccggcgatcaccatcgggttggccagctacctggccgtactggaaggcctctggctgaaaacgaacgaagaggtctaccgcgacctctatcatttctggtcgaagattttcgcggtcaacttcggcatgggcgtggtgtccgggctggtcatggcgtaccagttcggcaccaactggagccatttctccgacttcgccgggtccatcaccggtccgctgctgacctacgaggtgctcaccgcgttcttcctcgaggccggtttcctcggggtcatgctgttcggctggaaccgcgtgggaccgggcctgcatttcttcgccacggtgatggtggcgatcggcacgctgatctcgacgttctggatcctcgcttccaacagctggatgcagaccccgcagggtttcgagatcgtcgacggccgggtgatcccggtggactggctggcggtgatcttcaacccgtcgttcccctaccgcctgctgcacatgtcggtcgccgcgttcctcgccaccgccttcttcgtcggcgcctcggccgcctggatcctgctgcgcgggcgcgacaacccggggatccgcaagatgctctcgatggccatgtggatggcgctgatcgtcgccccggtacaggcgctgatcggggacgcccatggcctcaataccctggagcaccagccggcgaagatcgccgcgatggaaggccactgggacaacagcagcggcgagccgaccccgctgatcctgttcggctggccggacatgcagcgcgaggaaacccgcttcaaggtggagatcccggtgctcggcagcctgatcctcaagcacagcctgaccgagccgatcccggcgctgaaggacttcccgccggaagaccggccgaactccaccgtggtgttctggtcgttccggatcatggccggcctcggcatgctgatgatcctggtcggcgtctggagcctgtggctgcgctggcgcggccaggacaagctgttcaactcgaaggccttcctgcgcctgaccctgctgatgggaccgtccggcctgatcgcgatcctcgccggctggttcaccactga

SEQ ID NO: 3792 - DNA, 1290 bp, Pseudomonas aeruginosa
gggacgcgagaccaacccgggaggcgccgggcagaagcgcacgccggcacggccgttgtcggccgccggcgaaggtttcgacgaagagcacgacggccacgcgcaagcggccgaccgcgaccaggacaagaggaactgagacatgggtatcgatcttcccctcatctgggcggtcatcatcatcttcggcatcatgatgtacgtggtgatggacggcttcgacctgggcatcggcatgctctatccgttcttcaaggacagcggcgaccgcgatgtgatgatgaacaccgtggcgccggtctgggacggcaacgagacctggctggtgctgggcggcgcggcgttgttcggggccttcccgctggcctacgcggtggtcctgtcggcgctctacctgccgttgatcttcatgctcgtcgggctgatcttccgcggcgtcgccttcgagttccgcttcaaggccaagccggccaagcagcacatctgggacaaggcgttcatcggcggttcgctggtggcgaccttcttccagggcgtggcgctgggcgccttcatcgaaggcatcccggtggagaaccgcagcttcgccggcggttcgctggactggatcgcgccgttcccgctgttctgcggcctggccctgatcgtcgcctacaccctgctcggctgcacctggctgatcatgaagaccgaaggccgcctgcaggagcgcatgcacgacctggcgcgcccgctggcgttggtgctgctggcgatcatcggggtggtcagcctgtggacgccgctggcccatgccgagatcgccgcacgctggttcagcctgccgaacctgttctggttcctgccggtgccgatcctggtcctggtgaccttctatgcgctgctgcgctcggtggccaacaacgaccacgtgaagccgttcgtgctcaccctggtgttgatcttcctcggctacagcggcctggggatcagcctgtggccgaacatcatcccgccggcggtgagcatctgggaggcctcggcgccgccgcagagccagggcttcatgctggtcggcgcgctgttcatcattcccttcatcctcggctacaccgcctggagctactacgtgttccgcggcaaggtgaagcacggcgatggctatcactgaggaggcgccgcatatggtccgtacgccgagtcatcccgaacgagatagcgcggccaagccaccgctctggcgacgcctggcctggctggcgggtatctggaccgccagcgtgctggccctgggcgtcgccgcctggctga

SEQ ID NO: 3793 - DNA, 507 bp, Pseudomonas aeruginosa
acagcgagttcgtcccgctctaccaggcggtggcggggcagttggccacggtggagcggaccatcctgctcaccgacggcgcggagaagagcgcggaactgcccggcctggtcggcgaatacgagtcgctgctggccgcggccagcccgcgctacgacttccccgatttcgacgagaactccatcgccaccaccttctacaccaccggcaccaccggcaatccgaaaggtgtgtatttcagccaccggcaactggtcctgcacaccctggcgatggcttcgaccatcggcagcctggacagcatccgcctgctcggtaccagcgacgtgtacatgccgatcaccccgatgttccatgtccacgcctggggcactccgtacgtggcgaccatgctcggggtcaagcaggtctatcccgggcgttacgatccggaactgctggtcgaactgtggaagcgcgagaaggtcaccttctcccactgcgtgccgaccatcctgcagatggtga

SEQ ID NO: 3794 - DNA, 2115 bp, Pseudomonas aeruginosa
aacgcccggaggccaagcaaacgcttggtctccgcgttttcgcgaccgcccggtcattctccatccgccgcaaaggcgcgagccagagtggttgcgccgcgcaaatcacactttcgagggatcaagcggcaggcagcgctagctatagtccacgcactcataacaaaaaacacacatggagtagcgtcgatgacaacccgtaatccgttctcgcgtcgggcccggttgccgttggccgtcagcctggcttcctcgctggcggctccggcctttggggtgaccttcaacatcggggaaatcgaaggttccttcgattcggcgttgtcggtcggggccagttggtcgaccgccaagccgaacaagaacctgatcggtgtgaacaacggcggcaagggactttcccagacctccgacgacagccacttgaacttcaagcgtggggaaacgttctcgaaggtcttcaagggcatccatgacctcgaactgaagtacggcgataccggtgtgttcctgcgcggcaagtactggtacgacttcgagctgaaggacgagcaccgcgagttcaaggacatcgacgacagcggccgcaagaccctggccaagtcctccggagccgaactgctcgacgccttcatctaccacaactatgccatcggcgacctgccgggcagcgtgcgcctgggcaagcaggtggtgaactggggcgagagcaccttcatccagaacggcatcagcgccatcaacccgatcgacgtcaccgccttccgccggcccggctcggagatcaaggaaggcctgatcccggtgaacatgttctacctgtcgcagaacctcaccgacaacctgtccgccgaaggcttctaccagatcgagtgggaccagacggtggtcgacaactgtggcaccttcttctcccagccggacgtggtggccgatggctgcgaccagaacctggcggtgctgaccaacaacaaggcgtccatcaacctgctcaacaacgtgctcgccggggctggcctgagcgttaccccgtcgccctgggacgagggcatcctggtccgccgcgggccggaccgcgacgctcgcgacagcggccagtacggcttcgccctgcgctacttcgccgacgaactgaacaccgagttcggcgcctactacatgaactaccacagccgcctgccgatcttcagcggccagggcgcctcggccagcaccatggcggcgatcaacgacctcgccacccgcctcgccgcgatcaacccggcactggccgcccaggccgcggcggcggccaccgccggcaactccagctacttcatcgagtacccggaagatatccgcatgttcggcctgagcttctccaccacgttgcccaacggcaccgcgtggagcggcgaagtcagctaccggcccaacgcgccggtgcagttgaacaccaccgacatcctcttcgccggcctcgacccggtgagcatcggcggcaaccgcccctacgacaacgcctcggtgctgaacggccaggccgggcaggacctgcacggctatcggcgcaaggagatcacccaactgcagaccaccctgacgcacttcttcgaccaggtgatgggcgccgagcgcctgaccctggtgggcgagatcggctggacccacgtcggcggcctggaaagcacctccaaggcacgctacgggcgtgacccggtcttcggaccggggccgctgccggggaccatctccggcctggccagctgccaggcgctgaacgtcagcacgctgggcaccgccgaagcgaacaacgtcagccgctactgcgagaacgatggctataccacctcggatgcctggggttatcgcgcccgtgcgatctgggactacaacgacgtgttcatgggcgtgaacctcaagcccagcgtggcctggtcgcacgacgtcgatggctattcgcccggtcccggcgccaacttcgaggaaggccgcaaggcggtcagcctgggggtggacgcggagtaccagaacacctacaccgcgagcctctcctacaccaacttcttcgacggcaagtacaccaccgtggacgatcgcgacttcgtcgcgctcagcttcggcatgaacttctga

SEQ ID NO: 3795 - DNA, 1428 bp, Pseudomonas aeruginosa
tgtacgccggcccggtgcgaaccgggccggcgagcaggacttaacgaggacgacgagcgaatgaaaacaacgaagattcttctgcataccggtgtactggccctgagcctgctggccacccaggtgatggcggcggtatccgccgacgaagcggccaagctcggcaccagcctgactccgttgggggcggagaaggccggcaacgccgacggcagcatccccgcctgggacggcggcctggcgaccaacgccggcagcgtcgacagccgtggcttcctcgccaacccctatgccagcgagcaaccgctgttcaccatcaccgcgcagaacgtcgaccagtacaaggacaagctgactcccggccaactggccatgttcaagcgctacccggatacctacaagatcccggtatacaagacccaccgcagcgccaccgtcccggcggcggtgcaggaggcggccaagcgcaacgccaccaccaccaagctggtggaaggcggcaacggcctggagaacttcgataccgccaacccgttcccgatcccgcagaacggcctggaggtgatctggaaccacatcacccgctaccgcggcggcagcgtccggcgcctggtgacccaggccactccgcaggtcaacggctcctaccagctggtctacttccaggatgccttcaccttccgtactaacctgaaggactacaacccgaacaagccgagcaacgtgctgttctacttcaagcagcgggtcaccgcgccctcgcgcctggccggtaacgtgctgctggtccacgagaccctcaaccaggtcaaggagccgcgcctggcgtggctctacaacgccggccagcgccgcgtgcggcgggctccgcaggtgtcctacgacggtcccggcaccgccgccgacggcctgcgcacctcggacaacttcgacatgtacaacggtgcgccggaccgctacgactggaagctggaaggcaagaaggaaatctacattccctacaacagctacaagctcgacgatccgaagatcaagtacagcgaaatcgtcaaggccggccacatcaaccaggacctgacccgctacgagctgcaccgcgtctggcatgtggtcgcgaccctgaagccgggcgagcggcacatctacgccaagcgtgacttctacatcgacgaggacacctggcaggccgccgagatcgaccattacgacggtcgcggcaccctgtggcgcgtggccgaggcgcatgccgagcagtactacgacaagcaggtgccctggtacgcggtggaaaccctctacgacctgctctccggccgctacctggcgcttggcatgaagaacgaggagaaacaggcctacgacttcaactacagcgcatcggaaagcgactacaccccggcggcgctgcgccaggaaggggtacgctga

SEQ ID NO: 3796 - DNA, 459 bp, Pseudomonas aeruginosa
tcgagcggcagccgcccgaggtccaggcgttcctcgcccagaccgcgcgcttcgagcgcttctgcgccgagctctgcgataccgtgcgcgaggccggcgacagcgcggcgatcctcgaccacctgcagcagcaccaggtcttcctcgtgccgctggacgaaaacggccagtggttccgctaccaccacctgttctccgacctgctgctggcgcgtcccttgcccgacttcggtccgtccgccggctccctgcacctgcgcgcctgcggctggttcagccgccatggcctgctcgaccaggcggtggagcaggcgctgcgcgccggccagccggacgtggcggcgagcctggtgcagaacctgtcggaagagcaactgctggcggagcagaacatcgccaccctgctgcgctggaagatggacctgccggacagcctcctggcgagcacgccgcgcctga

SEQ ID NO: 3797 - DNA, 1800 bp, Pseudomonas aeruginosa
agagccacgcccgccatatcaacgacaagctcggcgtcgagcgtcgcacccaggcggtggcgcgggccaagcacatggggttgttgcgctaggcgcgccaccccatgtgcctggcgtgctggctcagggcttccagcgtcgcaggagcagggcgttgccgaccacgctgacgctggagaaggccatcgctgcgcccgccaccatcgggttgagcaggccgaaggccgccagcgggatgccgatcacgttgtagatgaaggcccagaacaggttctggcggatcttcgcgtaggtccgccgcgagatgtccagcgccgccggcaccaggcgcgggtcgccgcgcatcagggtgatgccggcggcgtgcatggccacgtcggtgccgccacccatggcgatgccgacgtcggcggcggccagcgccggggcgtcgttgatgccgtcgccgaccatcgccaccacccggccccggcctttcagctcggcgaccgtggcggccttgtccgccggcagcacttccgcgtgtacgtcgtcgatgcccagggccttggccaccaccgccgcgctgccgcggttgtcgccggtgatcaggtggctgtggatatcccgtccgcgcagggcctccaccgcttcggcggcgccgtccttgaggctgtcgccgaaggcgaacaggccgagcacgcgtttctccggagccagttccagcagccaggacagggtgcggccctcggcctcccagtccgcggcggcactcgccagcgcgccgggcttgagttcctgctcgtcgagcaggcggcggttgcccagggccagccggcgaccctcgacctcgccctggatgccgcgaccgctgagggcctggctggcgttcaccggcggaacctccaggtcgcgctcggcgcagcgctcgagcacggccttggccagcgggtgctcgctgccgcgttgcagggcgccggcgagcctgagcagttgctcctggtcgtcgccgccgaggtggatgatctgcggtcgcccggaggtcagggtgccggtcttgtcgaaggccacgctggtgaccgcatgggcgacttccagggactctgcgtccttgatcaggatgccgtggcgcgcggccacgccggtgccggccatgatcgcggtcggggtggccaggccgagggcgcaggggcaggcgatcaccagcaccgccacggcgttaaccagggcctgctccaggccgaccccggcgaccagccaggcgccgagggtgaccagcgcgatgaggatcaccaccgggacgaagacctggctgaccttgtccaccagcttctggatcggcgccttggcggcctgggcgtcttccaccaggcggatgatcttcgccagcaccgtttccccgccgagcgcagtggtgcgcaggagcaggcggccttcgccgttgatcgcgccgccggtgaccttgtcgccgggagccttgggcaccggcaggctctcgccggtgatcagcgcctcgtcggcgtggctgctgccgtcgagcacctcgccgtccaccgggaagcgttcgccgggacgcaccaccacctcgtcgccgaagcgcaactcggcgatcgccacctcttcctcgcgaccgtcgcgcaggcgcaccgcgcgctccgggcgcaacggcctagagggcgcggatggcgctggcggtctggcgcttggcgcggctttccaggtacttgccgaggaggatcagggcgatcaccacggtggaggcttcgaagtagaggtgcggcatgtggccaggcggggcggtcagccagaggtagacgctga

SEQ ID NO: 3798 - DNA, 402 bp, Pseudomonas aeruginosa
ccatcctcgacctgcaccaggagccgctcctgcaccaggaagcctggggcctgcggccacgcgacgtgtaccagtcgctggcgctgtacgcgctgctcgacccggacatccacctggtcaacctgtccggtgccgccggttccggcaagaccatcctggcgctcgccgcggccatcgagcagaccatggtcagcaagcgctaccggcgcatcatcgccacccgcagcgtgcagggcctggacgaggacatcggcttcctgcccggcaccgaggcggaaaagatggagccctggctcggcgccatcaccgacaacctcgaagcgctgcacatggacgacgaatgcacccatggcagcgtcgactacatcctcagcaaggtgccgttgcagttcaagtcgctga

SEQ ID NO: 3799 - DNA, 657 bp, Pseudomonas aeruginosa
agccacggccgaggccgtggtgcgcatgcgcccggaaaccctgcaactgatccaggacggtggccatcccaagggcgacgtcttcgccgtggcgcggatcgccggcatccaggcggccaagcgcacccacgaactgatcccgctgtgccatccgctgctgctcaccagcgtcaagctcgaactgcaggccgaggcgccggacgccgtgcgcatccgcgcgcgttgccggctggccgggcagaccggcgtggagatggaggcgctcaccgccgccagcgtcgcggccctgaccatctacgacatgtgcaaggcggtggaccgcgggatggtcatcgagcaggtccagttgctggagaagctcggcggcaagagcggccactaccgcaaagaggaggaagggcaggcatgatccgcgtgcagtatttcgcccgttaccgcgaagctctgggcatcgacggcgagcagttgaactgggacgccgggctggcgaccctcggcgccttgcgccagctcctggtggagcgcggcggggcctgggagcgtaccctcggcgagcagaacctgatgtgcgcgcgcaatcaggaactgtgcggcctcgacgagccgttgcaggacggcgacgaagtcgccttcttccccaccgtcaccggaggttga

SEQ ID NO: 3800 - DNA, 1119 bp, Pseudomonas aeruginosa
agaccccgccagccgtggcgccggtggccggctgcgggtgccgctcgtgagcgcttgcgcctgcgatggcggccaactgcgcccgctcgacgaggcgctggccgaactgctggcgcgcgcgccgcgcccgccagcctgcgagagcctggccctggagcgggcgctgggacgagtgctcggcgaggacctgctggcgccgatggacctgccgcattgggacaacagcgcgatggacggctacgccttgtgctccgccgacctgccgcgcagcggcggcagcctgacggtcggcgcgcggatcgccgccggcgacacccgcggcatgagcctgccgctgggccaggcggcgcggatcttcaccggcgcgccgctgccgaccggcgccgactgcgtggtgccgcaggaactctgcgtggtcgacggcgagcgcgtgcagttgccgccggtgagcgccggccagcatgtgcgccggcgcggcgaggagttgcgtcgtggcgcgccggtgctgcgtgccggacagcgcttgcgcccgcaggaactcggcctgctggcgagtctcggcgtcgccacggtctcggtgcgtcggcgcttgcgcatcggcctgctgagcagcggcgacgaattgcgcgagcccggccagacactgttggccgggcagatctacaacgccaaccgttactgcatcggcgccttgctgcgcggtctgggcttcgaggtgcacgacgaggaagtgctcgccgacgaactggtggccagccgcgatgcgctcagcctggcggcctccgaatgggacgcgctggtcaccagcggcggtgtctcggtaggcgaggaagaccacctcaagcgcgccatcgccgagcttggcgaggtcaacctgtggcgcctggcgatccagccgggcaagccgttcgccttcggctccgtggccggcaagccctggctggggctgcccggcaaccctgcggcggcgctggtcaccgcattgctggtggcgcgtccgttcctgcttcgccagcagggactgttcgacgtagtgccgcggccgctggcgctgccggcggccttcgactggccgcaaccgcgggcgcgtcgccagtacctgcgggcgcggctcgatga

SEQ ID NO: 3801 - DNA, 441 bp, Pseudomonas aeruginosa
cccggtgccggtggaggtgttcgccttcggcagcctgtgcatcatggccgagggccgctgccacctgtcctcctacgtcaccggcgagtcgccgaacctctgcggcgtctgttcgccggccagggcggtgcgctggagcgaggaaccggaggggttgacctcgcgcctcaacgaagtgctcatcgaccgctacgccgccggcgaggcggccggctacccgaccctctgcaagggccgtttcctggtcaatggccagcgcttccatgcgctggaggaaccgaccagcctgaacaccctggacctggtcccgcaactggcggaaatcggcgtggcggcggtgaagatcgaaggccgccagcgcagcccggcctacgtcgagcaggtcacccgggtctggcgccaggcgctggacagctacgccagcgcgccgggcgcctatag

SEQ ID NO: 3802 - DNA, 990 bp, Pseudomonas aeruginosa
cgtgcagccgcaatggcagcgcgcgctggccggactttccgaagggcaccagaccaccctgggcgcctatcaccgttcctggcagtgaggaccgccgcgatgaaactgagcctgggaccgctgctgttctactgggacaagcggcagatattcgatttctacgccgagatggccagccagccgctcgacgtcatctacctcggcgagaccgtctgcgccaagcgccgggcgctgtccctgaatgactggcaggcgctggcccgcgagctggcgcaggcgacccgtgccgagctggtgctctccgggctggcgctgatcgaggccgcttcggagctgtccagcctgcgccggctatgcgagaacggcgaactccgggtcgaggccaacgacatggccgccgtctattacctcagccagcgcggcgtgccctttgtcggcggtccggcgctgaacctctacaacggtcatgccctggccgaactgtattcctggggcatgcgccgctggattccgccggtggaagtctccggcaagctgctgcgcggggtgctcgaccaggctgcgcagctgggcctggagcaattgcagaccgaggtcttcgcctacggtcacctgccgctggcctactcggcgcgctgcttcaccgcgcgggcggagaaccggcccaaggacgactgccagttctgctgccagcagtatcccgaaggtatcccgctgctcagccaggagggcgaggcgctgttcaccctcaacggcatccagaccatgtccggcaaggtcagcaacctgctggccgactaccgctcgctggaacatagcggcgctgacctgctacgcctgagtcctcgggcgcagggcatggccgaggtgatcgcggccttcgaccgggtatgcaagggtgccgctccgccgctcgccgtggaaggctgcaacggctactggcacggccggccggggatgctgcgggcagaggaggtagggttatgctga

SEQ ID NO: 3803 - DNA, 795 bp, Pseudomonas aeruginosa
cgtcttcagcgagccgcgtcggctggtctcgccggtcaccgacgagcgcctcgactacaccgcgcgcatcgacctgcgtggcctgccggccgaccagtcgatcttctaccgggtgcgcttcgaggatgcccgcgacggcagcctgagcaagccctggttcggccacctgcgcagtgcgccgagcgaggcgcgcaatatccgtttcgtctggagcggcgacacctgcgggcaaggtttcgggatcaatccggatatcggcggcatgcgtatctacgaagccatgcgccggcgccagccggatttcttcctgcacagcggcgacaccatctatgccgatgggccgatccccgaacgcatcgagaccgagagcgggcgcatctggcgcaaccgggtgaccgaggccaagagcaaggtcgccgagaccctcgacgagttccgcggcaactaccgctacaacctgctcgacgacaacctgcgccgcttcaacgccgaggtgccgcagatctggcaatgggacgaccacgagaccaccaacaactggtcctccagcaagcagctcgacgagcgctaccaggtgaaggacatcgacgtgctggcggcccgtgcacgccaggcgttcctcgaatacgcgccgctgcgcttccagcgccaggggcgcgacgggcggatctaccgcaaggtcgcctacggccctttgctcgacgtgttcgtcctcgacatgcgcagctaccgcggcggcaacagcgccaacctgcaggcgcggcgcagcgccgccaccgatttcctcggccgtga

SEQ ID NO: 3804 - DNA, 1953 bp, Pseudomonas aeruginosa
cgccgccctgctgggcggcctggccctgctgggcctgccggtggccaacgccgccgagctgatcatctccgagtatgtcgaaggcagcggcaacaacaaggcgctggagttctacaacagcggcagccaggtcctcgacctctccgcctaccgcgtcgagttctatttcaacggcgccagcgcggcgggccgcagcatcgacctgagcggcagcctggcgccgggcaagaccttcgtcctcgccaacggcgtggccgacccggcgttgctggcgctggccagccagcgggtggaaggcagctggttcaatggcaacgatgcggtgctgctgcgccggcgcagcggcgagatcctcgacagcctcggccaggtcggcttcaaccccggcacgacctggggcagcggcgatgtgcagaccctcgaccggagcctggtgcgcaaggccgacatccgcgacggcgacagcgatcccagcgacgccttcgacccggcggcgcaatggctgggctacccgcgcgacaccttcgccaacctcggccagcatggcgctggcgagcccggcggcggcgaggaggccggcctgcgaccgatccacgaggtgcagggcgccggcgccgaaagtccgctggtgaaccagcgggtcgccatcgagggcgtggtggtcggcgacttccagaacgccagcgagctgaagggcttctacgtgcagcaggaagatgccacggtggacggcgacccggcgacctccgaaggcatcttcgtctacgacggcggcaacggcagcgacgtcaagctcggcgaccgcgtccgggtgaccggccaggtccgcgagttcaacggcctcaccgagctggtcgggccgctgcaggtcagcgtcctggcgagcggcgtggcgttgccgacgccggccggcatcagcctgccgctggccagcgccgatgcgctggagcgctacgaaggcatgcgcgtgcagctccgccagacgctgaccgtcaacgaggtctacaacctcggccgctacggcgaggtcctgctgtcctccggcggccgccagatgactccgaccaacgtggtggctcccggcgaacaggccaaggccatgcaggcgcgcaacgacctcgaccggattctcctcgacgacggccgcagcgggcagaaccccgacccgatccgctacccggcaccggaactgagcgcctacaacagcctgcgcgtcggcgaccgtaccagcgccatcgacggcgtgctcgactactcggccggcagctaccgtatccagccgttgcagacgccgaccttcgaggcagccaatccgcgtccggcccagccggcggtggaagggcgcctgcgggtggccagcttcaacgtgctcaactacttcaacggcgatggcaagggcggcggtttccccacctcgcgcggagccaacacggccgaggagttccaacggcagaaagcgaagatcgtcgcggcgatcctcgcctcgaaggcggacatcgtcggcctgatggagatcgagaacgacggctacggcgagttcagcgccatcgccgacctggtcaacggcctcaacgccagcctaccccagggccagcgctatgccttcgtcaacccgaaccgggcgaagctgggcagcgacgaaattgccgtggggctgatctatcgcggcgacaaggtccgcacctatcgatccgcggcggtgctcgacagttcggtgaacccggagttcgacgacacccgcaaccgtccgaccctggcccagaccttccaggagatcaatggcggcgaacgcctgaccatcgcggtgaaccacctgaagtcgaagggctcggcctgcgacggcgacccggacaccggcgacggccagggcaactgcaacctgacccgggcgcgcgccgcccaggccctggtggactggctggcgggcgatccgacgggcgccaaggagcctga

SEQ ID NO: 3805 - DNA, 1302 bp, Pseudomonas aeruginosa
cgcctgaaagccttggcgtccgtcatgcgcaataccccgggttctcttcgcaaaaccttttcatctcttcctgttccttcgcgcgggtttcctggtagtcgtcgtgctcgtccgttcccggcatcggattccagaatgccttcaggttggccagtcccatgcgcaggtactccgcggcgcagtactcgtagacgatccgctgcaggaagtgccattcgacgaacaccggcggggtcggtcgggccttgtcgctgtgaacctcggccttctgcagcaggtccgacttcaccttggcccgcgcccagggcctgggcacgccgagcagcgggacgaacaggaaggcgtagttggccttcgcctccagcagggtgcagcgcggctcgtcgaagccgtcccaccaggtgccgctccagaaccattcgtggggaaacgggaaattggtcacccactgctggtagcgcgcggacaggtccgacatgctgtggcccttgccgttattggcgatggccatttcgccccgggacggcgggcactccacgcagtccttgtcgcggccctggctcttgctgcaatcgcgctcggcttcccgggtccggtcgcggctcagcgtgccggtctcggtcctgggcaggggctgcggaaccggcatcggacgcggtaccggcctgggcagcgcgccgggggccggtcgcggcagcgggcgcggcgccggcatcggcaagtgcggccggggcggcgcgggtagttcgaagggcagccgcggacccatgcggggcagcggtcggaaaagcgcgcctatgccgctcatgccggtctccccgaggtttcgtacgcgcgccatttctggctggccaggcgaaactcgacgatccgttcgtagtcctggaagcgttgttccgggctgtccgccagcggccggcgcatgtgtgcgagaaacgccggcgtgtcctggaaagcggggaaggccaggccgtgcagaagaaagcgttcgatcgtcccgggctcttcgatacccagttccagcgccgtcgcgcgcagctcgccgagttgccggatggcgggcagcaggccgcgtcgttcgagccaggcgggagcctcccggcgtacctccagcaggacccgctcgatgacttcgtcgtcgcggacccgctgcaggcgatccagttggccggcatccagttcaagcatcggcggtccgctccgtttcccggtcatagacgaggtagccgccctgcaggggctgccagacctgccaacgctccagcggcgccatcacttgcgtccattgccgcgcggtcatga

SEQ ID NO: 3806 - DNA, 675 bp, Pseudomonas aeruginosa
aacagttggagagcgatccgaactggaagtgacgccgggcctgagggtaaccaggcccggcggcggggggggcggatgatcgctggcgatcgtccgccgttgcgccatgcgctcccgcggtctttcttcagaaaccgaccgaggcctgtacgtacagggtgcgcggctggccgacgtagaggcccttgttgttgtcgtcgaacgagcgggtgtagtagcggcgatcgaacaggttcttcacccccaggccgagctagaggtcgttcagttgcgggccgaagtcgtaggtgccgcgcgcgctccagaccatccagccggcgatccgcccggtgctgccgtcggcgctttcgctctcggtgttggcgttgtcggcgtactggctggtctggaagctgccgtcgaggttgtagctccaggcgccggtgcgatagttggcgccaagggtgcccttgtgcttcgaggagaacggcacttggttgcccttgttcggcccgtcttcgcgaatgctcgcgtcgacgtaggcgtagctggcatagacgtcgaagccggagagcagcgggtcgagatcggccaggtcgtaggcgatcgccgcctcgatgcccttgtgccgggtcttgccgcgggcggtcacgctgtcggtctgctggttgctctcgtactggttgtcgaagttga

SEQ ID NO: 3807 - DNA, 2334 bp, Pseudomonas aeruginosa
ccgaggatctccgcttcgtcgcggtaccaatgggcgagcgccaggccgtcgctgagcgtgctgctgcgcagcaggcgcgcattggaggtccggtcgagggtgcggaatacctggaaatcactgggttggtgcatgccggccatgctacccgcgcccggacgctgccgcgagaggcggcggatgaaaagcgcaagaatggacaatggtcgcgcccggcctcgcccgcagactgacggcatcctgtcgttgcggagtcgccatgaatctttcgctgtacctgctcaccgtgctcatctggggcaccacctggatcgccatcaagctgcagatgggcccggtggcgatcaccctgtcgatcgcctaccgcttcgccctggcggcgctggtgctgttcgccgtgctgctgctcggccgccgcctgcaaaggctggacgcacggggccaacgcctgtgcatggctcagggcgtatgcctgttctgcctgaatttcatctgcttctataccgccagccagtggattcccagcggcctggtggccgtggtgttctccaccgccaccctgtggaatgcgctgaacgcccgcctgtggttcggccagcgcatcgcgtcgaacgtgatggctggtggcggtctcggcctgctcggcctggggctgctgttctggccggaattggtgggtcaccaggccaccccggaaaccttctacggcctcggcctggccctgctcggcacgctgtgcttctccaccggcaacatgctttccagcctgcaacagaaggccggcatccgcccgctcaccggcaatgcctggagcatgctctacggcaccctgatcctcctggcgctgtgcctgttccagggcgtgccgctgaatttcgactggagcgcgcgctacgtcggctcgctgctgtacctggcgatccccggctcggtgatcggcttcaccgcctacctgaccctggtcgggcgcatgggcccggatcgcgccgcctactgcaccgtgctgttcccggtggtggcgctgaacatctcggccttcgccgagggctaccgctggaccgcaccggcgctggccgggctggtcctggtgatgctcggcaacgtcttggtgttccgcaagccgaaggcgccggcgctggccgggccggcgcgctcgacctagcggagagggaggcgcgctcagccgcgtcgccacacctgcggattgaccaggtccagcggccgctcgccgcgcagggccgcctcgaagttctgcagcgcccgctcggccatggcccggcgggtctcgtgggtggccgagccgatgtgcggcagggtcaccacgttgtccagggcgaacagcggcgattcggccagcggttccttctcgtagacatccaggccggcgccgaggatgcgcttctcccgcagggcggcgaccagcgcggcctcatcgaccacctggccgcgggcgacgttgaccaggatcgccgagggtttcatcaggcccagttcgcgcgcaccgatcaactgccgggtctgcgctcccagcggcaccaccacgcagacgaagtcggcctcgccgagcagttcgtcgaagccgaggaagcgcgcgccgagttcctgttccagttccggcttgcggttgttgccgtggtagagcacctgcatgccgaagccgaaacggccgcgccgggcgatggccgcgccgatccggccgaggccgaggatgccgagtttcttgccatgcacgtcggtgccgaactgcggggcgtcgacggtgcgcttccagttcccggccttgacccaggcgtccagctcggcgacccgtcgcgcggcgctgatcagcagggcgaagccgaggtcggcggtggtctcggtgaggacgtcgggcgtgttggtgagagcgatgccgcggcggttcaggtagtccaggtcatagttgtcgtagccgaccgagacgctggagatgacttccagctgcatcgcctgttccagttgcctggcgccgagcggccggccgacgccgatcatgccgtgggtatcgggcagggcggcggcgtactgggcgtcgatgtcgccctgtttcggttcgagcacgcggacgttgaactggcattgcaggcgttcgagatgctcgggggcgaggcgactgaagacgaagacgttctttttcatgacgggactctgcaagcgggagcgaaagcgccgaccataccaccgccatcgaagcggcgggcaggggcccgccactgggcgggcgattatcggctcaggagggtcttccgagttccaggcccagctccaccagcgccgcttcgtcgcgctggagcaggccgggcaggctttccttga

SEQ ID NO: 3808 - DNA, 1647 bp, Pseudomonas aeruginosa
gccagcttatcagcagccgccagcctcttaaaattcatcggcccccgagcgcacgaacgctcgagcgggttgaacggcgcccgtaccgttcaaattccgtgcttcgcccctccaggatcagacaacgtgccgcgtgctctcaggaaggaactgaccttggtcggctccttcgtcggttttctcgtcgttttctccgcaatatccggttgtgtcagtacaggcgatatcgcccccgaggccgccacgctcgacgccaacgccctggccaccgaccatgcgatccaggctgccgcccgcgaggccggctggccgcaggcgcagtggtggaaggtgtatgccgatccgcagctggacgcctggatcgagaaggcgctggacggcaatccaggcctggcggtagcccatgcgcgggtacgccaggcgaagtccatggccgggctggtggagtccatcgagtcgccgcagatcgagggcaagggctcgctggtccgccaccgctggccggacgactatttttacggccccggcgacctggcgcggaccacttcctggaacaactccaccgagatcggcctgaactacaagctcgatctctgggggcgcgaccgcagcgacagcgagcgcgccgtcgacctggcccacatggccgccgccgaggcgcgccaggcgcagctcgagctggagggcaacatcgtccgcgcctacgtccagctctcgttgcagtacgccgagatggacatcgccaaggccatgctgcaacagcagcgcgacatcctcgccctggcccagcgtcgcctgcgcggcggcatcggcacgcatttcgaggtcagccaggcggaagtgccgctgcccgagaccgagcgccgcatcgaggtgatcgacgaagaaatccagctcacccgcaacctgctcgccgcactggccggcaagggcccgggcgagggccgcacgatccgccggccaagcctgaacctggcggcgcagccgagcctgcccagcgccttgccggccgaactgctcggtcgccgcccggatgtggtcgcccgccgctggcaggtcgccgccctggccaagggcgtggacgtggcgcgcgccgacttctaccccaacgtcgacctgatggcctcggtcggcttcagtgccgtcggcggcggcatgctggagttcttccgcagcgccaagtacacctacagcgccggcccggcggtgaccctgccgatcttcgacggcggccgcctgcgttcgcagttgggcgaggcggcggccggctacgacgcggcggtggagcaatacaaccagaccctggtggatgcgctgaagaacatttccgaccagttgatccgcctgcattcggtggacatccagaaggacttcgccgcgcaatcggtggcttccgcgcagaagacctacgatatcgccaccctggcctaccagcgcggcctcaccgattacctcaacgtgctcaacgcgcagacccggctgttccagcagcaactggtccaggagcaggtgcaggccgcccggctggccgcccacgccagcctgctcaccgccctcggcggcggcgtcggggccggcgccgatacgccggcgcagcggaagctggcgccggagaacgtcccggtcagagcggtgtcttcgcgatga

SEQ ID NO: 3809 - DNA, 1020 bp, Pseudomonas aeruginosa
tcctgctgttcggctgtttctggatctacagcacctggcccagcggcggcaccttcgccctcaacgcggtggcggtctcggcgctggcttcggcggcgccgaacccgaagaaggtcgccatgcagatgggcatcggcaccatggccggcggggctggcttgggctttccgcgggctgttcttcgttctaccccattatcgacggtttcccgctgctatgcctggtactggcgccggtgttcgccctcggcgcgttcatctcctcgcggccgcagtgggccggctacggtctcggcctgctggtgttcttctgcttcggttcggtgccggcgaacctgaccgtctacgacccggcccacgtgatcaacgagtacatcgccctgatcctctcgatgctgctctcggccgcggccgccgcggtcattctgccgcccaacagcgcctggctgtggaagcgcctcgagcgcgacctgcggatgcgcgtggtgttcgccatcagcggcaggagcagggggcttggctcggccttcgaaagcggcacccgcgacctgctgaaccaggcctatggcgtcgctgccgggcgcccggacgtgcagcgcgggctgctgcgctggatgttcctggtgctcgaggtcggccacgcgatcatcgagctgcgtcgcgagcaggagcgcctgccggacgaaccctgctacgccgaggccatgccctggcgccaggcgatccgcgccatggggcgggccctgatccggctgttcgtgcgccccggtgcggagaacctggagcgcgccctggcggctgtcgaccaggccatccacgcggccaggcacaccgacgaaccctgcgcgccgcacttcgacagctcgccgctacggcgggtgcgcagctacctgcacttcatccgttcttccctgctcgcgccgacctcgccactgaccgaactggccggccggacgagcggccaaggtaccgtccatgcctcgtgaaatcgccatccatggggtctacatgccgaccctga

SEQ ID NO: 3810 - DNA, 2253 bp, Pseudomonas aeruginosa
tcgtcaagccgcaagggcgcgacgaccaggcctcggcggcgcaggcgccggggcgggccggttgagtggaaggggcagggagaagcccggcggatgccgggctttttcgtttcggcggggcggaagagggcgccactcgccaggaatacgctgcggttggcggctgccggcggtgaatatccacccggcggcctaggccccgacctgttcggccggcgacacgatcaggcccttgccgccgcgcgagcggccggagctgaggtagtcggcgatggattcctgggtgacctcgccgaggaactgctggtcggggtcgagcaccggcagccaggagctgttgaactcgtacatccgcgacaacaggatgcgcaggtgctcgtcgtggctggcggtgacccggaacggggtgacgaacggcgcgcaggtgccctcctggcggcgcaggtccttgcgtcgcacgtagcccaggcccttgccctggtcatccaccacgatcaggtagcgccggtcgttctcgtccatcagttccagcgcctcggccaccggggtctgcggccgggcggtgaccaggctgctgtcggcggcgtcttcggcgcgcaccaggagcaggcgcttgagcgtgctgtcctggccggtgaaggcgctgacgaactcgtccgccgggtgcgccagcagggtgtccgggtggtcgtactggagcagccggccgctcttgaacaccgccaccttgtcacccagcttgatggcttcgtcgatgtcgtggctgaccatgatcacggtcatgccgagcttgcgctgcatttcgaagaactcgttctggatcgactcgcggttgatcggatcgaccgcgccgaacggctcgtccatcagcagcagcggcgcgtccgccgccagcgcgcggattaccccgacgcgctgctgctggccgccggagagttcgcgcgggtagcgttgcaggtactgcttgggctccagcttgaccatgctcatcagctcgcgggccttctccttgcagcgcgccttgtcccagccgagcaggcgcggcacgaccatgatgttttcctcgatggtcatgttcgggaacaggccgatctgctggatcacgtagccgatgtggcggcgcagggtgacctcgtcgaggtccgcggtgtcctggccgtcgatcagcacgcggccggaggtcggcgggatgatccggttgatcatcttcagggtggtggtcttgccgcagccggaggggccgaggaagacgcagatctcgcctttctccacggtcaggctgatggaatcgacggcgcggaactccttgccgttcttctgggtgaaggtcttgctgagcttgtccagttcgatcatgttcggctcctgtcagtgcgcgctggcgcgcagtcccttgggggtgaggatgcgttgcagccattgcagcagcaggtcggcggcgatggccaggaggctgaccagtaccgcgccgaccaccagcatcggcatgttgctctggctgatggaagtgaggatcagcacgcccaggccgccggcgccgatcaccgcggcgatggtcatcacgccgatgttcatcaccacggcggtgcgtacgccggcgaggatcaccggcaccgcgaggggaatgtcgaccatccgcaggcgttgccagaaggtcatgccgatgcccttgccggcctcgcggatgcccgcttcgacgccggtcagggcgaggtaggtgttgcgcaggatcggcagcagcgaatagaggaacaccgcggtgatcgccggcagcggcccgaggccctggccgaataccgagtagaccggcatcagcaggccgaacagggcgatcgaggggatggtcagcatcaccgtggcggcgccctgcagcgggccggccagccacgtgaagcgggtcatcagcacgcccagcggcacgccgacgaggatcgccaggcctacggcgaccagtaccagcagcaggtgctggagggtgagctggccgacctgggaccagtcgagatgggaaagcacgctgaagaagtccattactggctacctccctggccggcctggccgtcgtcgagcaggtggtgttcgcggaggaagtcggcggcgaccttctgtggcgtctgctgctcgatatcgacccgcgcgttgagcgcctgcatggtggcgtcgtcgagccgctcgatgatcggatcgaacagcgtggcgaactccggatggcgctgcatgacctccttacgcaccaccggggcggcgttgtag

SEQ ID NO: 3811 - DNA, 513 bp, Pseudomonas aeruginosa
tcggcgcagagcgcctccagttgcgcatggtcgagcaggcgggtgctggtggcggcgctgaagcgcggggaggtcggggcatcgctcatgggagtctcgtcgcggctgtcgaagtgggccgccgcgtgcggcggcgagtcccaagggtgccaaacttgcgtgacgggaccaagcctttcggccctgcgcgtgtttacggccggtcgagcgcctgggccatccactcgcgcacatggcagacggcgaagcgcgacgggctgcattcgccgttggccatcgccaggcgcaggccgtcgacgtcggcgccgcgcacataggcgctggcgtcgcgcatgtcgtcctcgtcgccgaaaccgccgtgctgcatttcctccagcgcggcctgcttgtcccagccctgcacgacgatgcggtacatggcggcgaacagtccggtgcggttgttgccgtgcttgcagtgcatcagtaccggaccttcgcgctcggctgcctgcaactggcggaggacgctga

SEQ ID NO: 3812 - DNA, 1998 bp, Pseudomonas aeruginosa
ggtcgtcttccagttcgagcaactgggcgacgcccttgcgcatcatcggatggtcgtccaccagcagcaggcgaaccggttcgtcggcggtggctggcatgtccgtcatggggtcggctccttggcggcggagggttgcagggcggtcggcacgaagctgaagagcactcgcgtgccgtggggcgcgcgcgcttcgaagcgcaactggctgccgagggtctggccgcgctcctgcatgatggtaagcccataatggccgctacggttctgctgcggatcaaagccgacgccatcgtcctcgacggcgatgctcacctggccgtcggcctggctgctcaggcgcacccaggcccgttgcgcctgcgaatggcgaaccacgttggagagcgcctcgcggacgatctgcaggacgtggatttcctcgttggggctcagcggcacgtgttgcaggcggttgtccagttcgatcgtcacctcgccgcgctcgccgaactcggccacggcgttccccagcgcggcttccaggctcggctcgtcgaggctgaggcggaaggtggtgagcagttcgcgcagttgccggtaggcgccgttgaggccttcgcgcagttcgtcgagggtgtcctcgatcttctccgccggcgcctcgcgcttgagcagggtgcccaggcggctgacctggatcttcaggtaggacagcgactgtgccagcgagtcgtgcagttcgcgggcgatggtgccgcgctcggcgaacagggccaggcggctttcctgttcctgttgcagggacagggcgaaggtgcgggcgatgttgtcgcagaaggtctcgatcagttgctgctgccagttctccaggcggccgctgcggctttcgatgaacagttcgccgaaacggtggccggcgatggacaagggctgcatcagcaatggctgggccagggacgagggttggtcgcaggcgctggcctgctcgcggcagctaccgcagtcgccctgcaggcagaagtccgccgggcgctcggtggtggtcagcgaactgtaggcgcgctcgaccccgtccttgttcaggcagagggtcacgcggccggcgtcgagcactttctccaactggttcagcagcggttgcagggtgcggctgtcgtaggggttctcgcccagccggcgggcgctggcgtagagcagttcgaggcgctggtggctctgcgagagggcgcgggtcttgtcctccacgcgctcttccaggtcgccgtagatgctcttcagctcgccggccatctggttgaagcgctcgcccagttgcgccagttcgtcctcgccgctgtaggtgacccgcgcgtccagctcgccgcggcccaggcggcgggcggtgctggtgagttcgcgcagcgggccgatgacgtgatagctgaggtcgtagagggtgacgaacaccaccagcaggctgaggaacaggcacaggccctgcaccgtgctgagcagttgcgagcggcgctcggccttggcctggaggatgccgacgaaacggtcgatgtcgccgacgtaggcgtccagcacggcgcgtccgggcagcgcgcgcgggtccaggcgcgcgaggccctcgcgcagctcctggtgcaactggcggatcgggtcgtcggcgtcctggcgttgcagcaggcggcggatgtcgccgctgtcgaggcgttcgccgagggtcccgagcagcgcctggcggccttccaggctgggctccagggcgacccggtaggtgagcatgcgcaacgagccggcgtggttgatcaccgcggcgtcctggtgcgtgtagtcggcgaagagcagggcgctgaacatcccgatcagcgccagcgataccagcagggtgaggtagcagccgaagcggactaccagggagcggcgcaggatcggctttccggccctgtcactacctccaaagaatctgtcccgctggtcagcgtccggcgcggtcgccttgttcatgagaaaagccttttaaaacagtga

SEQ ID NO: 3813 - DNA, 1368 bp, Pseudomonas aeruginosa
ttcctatcaaatttgcataggaacaccttccctaggctctcgctgaacgctgtccgtgcagagagtttagccatggcttccctacgtcagaaacagtactccgtcctcggcatgagtaccttgtccttcgcggtgaatttcgccgtgtggacgatgttttcgatcatcggcatccgcatcaaggacgagcttggcctgagcgaatcccagttcggcctgatggtcgccctgccgatcctcaccggctccctggtgcgcctgccgctgggcctgatcaccgaccgcttcggcggccgcatcgtgttcttcatccacatgctgctggtggccatcccgatctacggcctggccttcgccagccagtactggcactacctggtgctcggcctgttcgtcggcctggctggcggctccttcgcggtcggcatcgcctacacctcggcctggttcgagaaggagcgccagggcaccgcgatgggcatcttcggcgccggcaacgccggcgcggcgatcaccaacctggtggcgccgatgatcgtggtcgccttcggctggcgcatggtgccgcaggtctactcggtggccatgctggtcaccgccgtgctgttctggctgttcacctggaccgatccggcgcacctcaagggtgccgccgaggccagccagcggccgaccctggccaagcaactggcgccgctcgccgagctgcgcgtctggcgcttcggcctgtactacttcttcgtcttcggcgggttggtcgccctggccctgtggctgccgaagtactacatcgccgaatacggcctggacctgaagaccgcgtccttcatcaccatgctgttcaccttgccgtccggcctgatccgcgccctcggcggctggttcagcgaccactacggcgcgcgctcggtgaactggggcgtgttctgggtctgcctggtgtgcctgttcttcctctcctacccgcagaccaccatgaccatccacggcatccagggcgacctcagcctgggcatcggcctgaacgtctggctgttcaccttcctggtgttcgtcgtcggcattgcccagggcttcggcaaggccagcgtgtaccggatcatccacgactactacccgagcaacatgggcaccgtcggcggcatggtcggggtgatcggcggcctcggcggcttctgcttgccgatcgtgttcggatacgccgcagaccacatcggcgtgcgctcctcctgcttcatgttgctgttcggcctgaccgtggtctgcatggtctggatgcactacgcgatcaagcagcaacgccgcatcgacggccaggccgcctcggccgacgtcgaccttcctcccacccttcccacccactcctga

SEQ ID NO: 3814 - DNA, 627 bp, Pseudomonas aeruginosa
tgtgctggctgtacgtggccaccttcggctcgttcatcggcttctcggccggcttcgcgatgctcagccaagacccagttccccgacgtcaacccgctgcaatacgccttcctcggtccgctggtgggcgccctcagccggcccctgggcggctggctggcggacaagttcggcggcgcgcggatcaccctgtggaactacgcgctgatgatcggcggggtgttcgcggtgatcgccttcctgccgggcgacggcggccagggcaacttcttcggcttccttggcgccttcatcctgctgtgcttcttcgccggcatcggcaacggctccaccttccgcatgatcccggtgatcttccgcaacgagtgggcccggcgggtgcgcgacggccaggccgacaaaaccggcgcggcgcgcaacgcgagcatggagtcggccgcggtgatcggcttctccgccgccatcggcgccttcggcgggttcttcatcccgaaggcgttcggcacctcgctgcacatgaccggcagcgccgagggcgccctctacgtgttcatcgcctactacctgagctgcatcgtcgccacctggtggtggtacgcgcgcaagggtgcggagagtccctgttga

SEQ ID NO: 3815 - DNA, 3825 bp, Pseudomonas aeruginosa
cgttgtaacgcccggcacagaccgggtgaggagatcaagatgagtcacctgctcgaccgcctgcagttcttcaagaagaagcagggcgaattcgccgatggccacggcgagaccagcaacgagagccgcgcctgggaaggtgcctaccggcagcgctggcagcacgacaagatcgtgcgctccacccacggggtgaactgcaccggctcctgctcctggaagatctacgtgaagaacggcctgatcacctgggaaacccagcagaccgactacccgcgcacccgtccggacctgcccaaccacgagccgcgcggctgcccgcgcggggccagctattcctggtacatctacagcgccaaccgcctgaagtacccgaaggtgcgcaagccgttgctcaagctctggcgcgaggcgcgggcgcagcacggcgacccggtgaacgcctgggccagcatcgtcgaggacgccgccaaggcgaagagctacaagagccagcgcggcctgggcggcttcgtccgttccagctgggacgaggtcaccgagatcatcgccgcggccaacgtctacaccaccaagacctacggtccggaccgggtgatcggcttctcgccgatcccggccatgtcgatggtcagctacgccgccggcgcccgctacctgtcgctgatcggcggggtctgcctgagcttctacgactggtactgcgacctgccgccggccagcccgcagatctggggcgagcagaccgacgtgccggagtcggccgactggtacaactccagctacatcatcgcctggggctccaacgtgccgcagacgcggaccccggacgcgcacttcttcaccgaggtgcgctacaagggcaccaagaccgtctccatcaccccggactattccgaggtggccaagctcaccgacctctggctcaaccccaagcagggcaccgacgccgcgctgggcatggccttcggtcacgtgatcctgaaggagttccacctcgaccggccgagcgcctacttcgtcgactactgccgccagtacaccgacatgccgatgctggtgttgctggaagaacacgccggcggcgcgttcaagccgacccgctacctgcgcgccgccgacctggcggacaacctcggccaggacaacaaccccgagtggaagaccatcgcctacgacgagcgcagcggcgggctggtctcgcccaccggcgccatcggctaccgctggggcgagtctggcaagtggaacatcgccgagctggacggcaggagcggtgaccagacgcgcctgcaactgtcgctgctcgatggcccggaacatgcctgcgaggtggccttcccgtacttcgccgggcaggagcacccgcacttcaagggcgtcgccaacgacgaggtactgctgcgccgggtgccgttccgcgagatcgtcgcggcggacggcaagcgcctgcgggtggccaccgtctatgacctgcagatggccaactacagcatcgaccgcggcctgggcggcgacaacgtggcgacctcctacgaggacgccgacacgccctataccccggcctggcaggagcgcatcaccggcgtcccggcggcgcgcgcgacgcaggtcgcccgcgagttcgccgacagcgccgacaagacccgcggcaaggcgatggtgatcatcggcgcggcgatgaaccactggtaccacatggacatgaactaccgcgcggtcatcaacatgctgatgatgtgcggctgcatcggccagagcggcggcggctgggcgcactatgtcggccaggagaagctgcgcccgcagaccggctgggcgccgctggccttcggcctggactggagccggccgccgcggcagatgaacggcaccagcttcttctacctgcacagctcgcaatggcgccacgagaagctgtcgatgcacgaggtgctgtcgccgctggccgacgccagccgcttcgccgaacacgccctggactacaacatccaggccgaacgcctcggctggctgccgtcggcgccgcaactgaaccgcaacccgctgcgcatcgccgccgaggccgaggccgccggcctgccggtcgccgactatgtggtgcgcgaactgaagagcggcggcctgcgcttcgccagcgaatcgccggacgatccgcagaacttcccgcgcaacatgttcatctggcgctccaacctgctgggctcctccggcaaggggcacgagtacatgctcaagtacctgctcggggcgaagaacggggtgatgaacgatgacctcggcaaggccggcggtccgcgtcccaccgaggtcgactgggtcgacgacggtgccgagggcaagctcgacctggtcaccaccctggacttccgcatgtcctccacctgcatgtactcggacatcgtcctgccgaccgctacctggtacgagaaggacgacctcaacacctccgacatgcaccccttcatccatccgctgtcggcggccaccgatccggcctgggaagccaagagcgactgggagatctacaaggccatcgccaagaagttctccgccgtcgccgaaggccacctcggcgtggagcaggacctggtcacggtgccgctgctgcatgacacccccaccgagctggcgcagccgttcggcggcgacggccatgactggaagaagggcgagtgcgagccggtgccgggacgcaacctgccgacgctgcacctggtcgagcgcgactacccgaacgtctaccgcaagttcacctcgctcggtccgctgctggacaagctgggcaacggcggcaagggcatcggctggaacaccgagaaggaagtgaagctggtcggcgacctcaaccatcgcgtggtcgagagcggcgtcagccagggccggccgcgtatcgacagcgccatcgacgccgccgaggtggtcctcgccctggctccggaaaccaacggccaggtcgcggtcaaggcctgggaagcgctgtcgaagatcaccggccgcgagcacgcccacctggcgctgcccaaggaagacgagaagatccgcttccgcgacatccaggtgcagccgcgcaagatcatctccagcccgacctggtccggcctcgaggacgagcacgtcagctacaacgccggctacaccaacgtccacgagctgatcccgtggcgcaccatcaccggtcgccagcagttctaccaggatcacccgtggatgcaggcgttcggcgaaggcttcgtcagctaccggccgccggtcaacacccggaccaccgagaaactgttgaacaggaagcccaacggcaacccggagatcaccctgaactggatcaccccgcaccagaaatggggcatccactccacctacagcgacaacctgctgatgctcaccctgtcgcgcggcggtccgatcatctggctcagcgagcacgacgcggccaaggccgggatcgtcgataacgactgggtcgaggtgttcaacgccaacggcgcggcgacctgccgcgcggtggtcagccagcgggtcaaggacggcatggtgatgatgtaccacgcccaggaacgcatcgtgaacgtacccggcagcgagaccaccggcacccgtggcggccaccacaactcggtgacccgcgtggtgctcaaaccgacccacatgatcggcggctacgcccagcaggcctggggcttcaactactacggcacggtcggctgcaaccgcgacgagttcgtcgtggtgcgcaagatgagcaaggtcgactggctggacgaaccccgccacggcggactcggcggcgacgccctgccgcaaccgctgccccaggacatttga

SEQ ID NO: 3816 - DNA, 495 bp, Pseudomonas aeruginosa
acctcgacaaatgcatcggttgccacacctgctcgatcacctgcaagaacgtctggaccagccgcgaaggcatggagtacgcctggttcaacaacgtcgagaccaaacccgggatcggctacccgaaggaatgggaaaaccaggagaagtggaagggcggctgggtgcgcgcggcagacggttcgatccgcccgcgcatcggcggcaagttccgcgtgctggcgaacatcttcgccaacccggacctgcccgagatcgacgactactacgaaccgttcgacttcgactaccagcacctgcataccgcgcccaaggccgagcaccagccggtggcgcgcccgcgctcgctggtctccgggcagcgcatggagaagatcgagtggggcccgaactgggaggagatcctcggcaccgagttcgccaagcggcgcaaggacaagaacttcgaccaggtccaggcggacatctacggtgagtacgagaacaccttcatga

SEQ ID NO: 3817 - DNA, 1458 bp, Pseudomonas aeruginosa
tccaggtcgtgcagatccaggagtgagcgccatgaacgatcacagccaactgttccgcctgctcgccctgctactcgactatccacgcgccgagctgcgcgaggagagcctcggcctgcatgcgctgatccgcacctgcgaactgccggaagcgctgcgcgacggcctcgcggcgctgctcaacgagctctgccagggcgacctgctggacgtccaggcgcgctacgacggtctcttcgagcgcggccgctcggtctcgctgctgctcttcgagcacgtccacggcgagagccgcgaccgtggccaggcgatggtcgacctgctcgaccgctataccggggccggcctgcaaatcgacgtaccggagctgccggactacctgccgctgtacctcgaatacctgtcgctgctgccgttcgcggcggccagcgaagggctcgccgaagtggcgcacatcctcggcctgctggcgctgcgcctggaggaacgcggcagcgcctatgcggcgattttcgaggcgttgctggaactcggcggcgagcgcccggacctcggcgcgttgcgtcgcgaccaggcccaggaacagcgcgacgacagcctggaggccatcgaccgggcctgggaggaaaccccggtgagcttcaccgaccccgccggcggttgcccgtcgagcagcggccgccgtccaacggcgtccaccgaacaaccattgcaatgggtcgcccagccggtaccgcagatgcagtaccgcgcggcccgcgaaggagtctgagcatgtcgaccaatcttctgttcttcgggatctatccctatgtcgcgctgctgatctgcctggtcggcagctgggcgcgcttcgacctctcgcagtacacctggaaggccggttccagccagatgctcagcaagaagggcatgcgggtatacagcaacctgttccacgtcggcgtgctgttcatcctcgccggccacttcgtcggcctgctgaccccggcctcggtctaccaccacctgatcagcaccgagaacaagcaactgctggcgatggtctccggcggcttcttcggcgtgctctgcttcatcggcctgagcggactgatcctgcgccgcctgaccgacgcacgggtgcgcgccactggcaacgcctccgacctgatgatcctgctggtgctctacgcccagctgatcctcggcctctccaccatcgtcgcctcgacccatcacatggatggctcggtgatggtgatgctcgccgactgggcccaggccatcgtcaccctgcgtccgctggcggcggccgaggccatcgcgccggtgggcctggtctacaagctgcacgtcggcctgggccttaccctgttcgtgctgttccccttcacccgcctggtgcacatcgtcagcgcgccggtgtggtacctgggccggcgctaccagatcgtgcgtcagaaacgtcctgcctga

SEQ ID NO: 3818 - DNA, 825 bp, Pseudomonas aeruginosa
tcgatcatgagttgctcccactacgaagaacgcgtcgagaaggtcgaactgccgcaactgaaggtcaacggcgtggccatcggtgaagacctgctggcccgcgagctgcaataccacccggcggacagctacgcgctggcgctggaggccgcctgccgtgcgctgatcgtccgccagttgctcctgcaacgggccgacgcgctgggcatcgaggcccgctgcgaagacggcgagacgccggaggaagcgcgcatccgccaattgctggaggaagaggtgcaggtcccggaagccgacgaagacgcctgccggacctggtacgcggccaatccggggcgcttgctcggcccctggcgcctgcaattgcgccatgtgctgctggcctgcgcgccggacgacctggaaggccgcgagacggcgcgcaagcaggccgcggagctgctcgacgagttgcgcgggcatcccgagcgcttcgtcgacctggcccggcgtttctccgcctgtccgtcgaaggaggcgggcggcgacctcggctggatcgagccggggcagaccgtccccgaattcgagaagcgcctgctgcgccgcgcgcccgggctgctcgagcatccgctggaaagccgctatggcctgcatgtggtggaactgctggcgcgcgaaggcggcgagccgctcgacttcgacgcggcccgcgcacagatcgccgcgcacctgcaggtgcaggtgttgcagcgagcggtgggacagtacatcggcgtgctggcgggagacgcctgtatcgagggcttcgccttcgagggtgcggatggggcgctggtgcaatag

SEQ ID NO: 3819 - DNA, 480 bp, Pseudomonas aeruginosa
aggaaggcgcccagctcgacgacagcttcagccagttggccggcaagcgcatcggcgtgcagcgcggcgctaccgccgaccgcttcgccagcgcggtgctggccaaggccggtgctgaagtggtgcgctacaccagccaggacgagatctacctggacctggtggccggccgcctcgacgccaccttcgccgactccatcccgttgcagaccggcttcctcgataccccgcgcggcaagggctacgccttcgtcgggccggagttcaaggacccgaaatacttcggcgagggcgccgggatcgcggtgcgcaagggggacgccgagctggtcggcaagctcaacgcggcgatcgacgcgattcgtgccgacgggacctacaagcgcatcgagggcaagtacttcaagagcgacatctacggcgactgaccgctcgccggcggcggctgccgtcagtcgccgccttccttcagctccttga

SEQ ID NO: 3820 - DNA, 468 bp, Pseudomonas aeruginosa
acatgctgctcgacggtgtcgctggcgacgttctccggctcgatctcgacgatcgccggatcgacggtccactgcttggcgaggttcatcacgtcgtcggtgaaggtcgccgagaacagcagggtctggcgttcgcccttgtgcggggtctgccggatgatctgccggacctgcgggatgaagcccatgtcgagcatgcggtcggcttcgtcgaggaccatcacctcgaccatgtccaggtgcacctcgccgcgctggttgaagtccagcagacggcctggggtggctaccaggatgtcgcagaagcgcgcttccagctgcttgagttgcttgtcgaagtccatgccgccgacgaaggtcatcacgttcagcccggtgtacttggtcagcgccgcggcgtccttggcgatctgtaccaccagttcgcgggtcggggcgatgatcagcgcgcgcggctcgcccatgtag

SEQ ID NO: 3821 - DNA, 1986 bp, Pseudomonas aeruginosa
ggcgacgacgggggtggcatcttcgggacggtgccggagcgatccggcgagtgtccgcccactcaccaacggaagaacaagaaaaccatgaatccgtccccatcgatcgtcgggctgagcgatatcgaagccctggaacgcgtgccgctggaacagcgcgacctgccgtccagcacctacgaactgttgcaacgctcggcccagcgccacggccagcgtatcgccctgagctgcctgctgcatggcagcgccgccgaagaaccgttgcggatcagctatgccgagctgttcgcccgcgtcacccagaccgccaacgccttgcaccggctgggcctggaaagccaccaggcggtgtccttcctgctgcccaacctgccgcagacccactacgtgatctggggcggcgaggccgccgggatcgtcaatgcgatcaacccgctgctggagccggagcacatcgccgagctgatccgcgcctccaacacccgggtgctggtgaccctggcgccgttccccggcaccgacctgtggcagaaggtcgccggcctgcgcgcacagttgccggagctgtatgcgatcgtcgtggtcgatccggccaacctgttgccggcgccgcagcgcgaggcgctcaaggcccagcgcgggccgctgccggagggcgtgctggacttcgatacgctgatcgccgactgcccggcagaccgcctggagagcggacgggcgatccatccggacgacgtcgcttcctatttccacaccggcggcaccaccggcacgccgaagctggcgccgcacagccacttcaacgaggtggcgatggccgagatcatgggcctgaacgccgactacggggtggacgacgtgctgctctgcggcctgccgctgttccacgtcaacggcgtgatggttaccggcctggcgcccttccatcgcggcgcccaggtgctcctggccgggccccagggctaccgcaatccgaccctgatccaggacttctggaagctggtggaacgctaccgggtcaccagcttcagtggcgtgccgaccatctacgcggcgttgctgcaggtccccagcgatggccgcgacctgtccagcctgcgtttcgccctgtgcggcgcggcgccgatgccggtggagctgatccgccagttcgaggcgcgtaccgggctcaaggtgatcgagggctacggcctcaccgaaggtacctgcggcaccagttgcaacccgcgtggcggcgagcgccggccgggttcgatcggcctgcgcctgccgtactgccaggtgaaggtcgcggtgctcgacggcgagggcaattacctgcgcgatgccgcgccgaacgaggtgggcaacctctgcctgaagggcccgacggtgttcaagggctacctgcaacaggaccggaaccgcgatatctggatcggcgatggctggttcaataccggcgacctcggtcgtatcgacgaggacggctacatctggctcaccgggcgcagcaaggacctgatcattcgcggtggccacaacatcgacccacagatgatcgaagaagcgctgcaccggcatccggccgtggccctggcggcggcggtgggcaagccggacgccaaggccggcgagctgccggtggcgtatatccagctcaagcccggcgccagcgccagcgaggaagagctgctggagcacgccagccgccacgtaccggagcgcgcggcggtgcccaaggatatctggctgatcgagagcatgccggtcaccgcggtgggcaagaccttcaagccggcgctgcgcctggacgcgatccgccgggtgctggaggaggaaagccggaggatcgccgaggatatccgcgtggaggtggtcgccgacgagcgccacggccagctcgcccacctgcacgttcccgcgcttgacgaaagacgccaggcggcgctggaagagctgctcggcggctacgcgctgaactaccggctgcacgccgtctga

SEQ ID NO: 3822 - DNA, 294 bp, Pseudomonas aeruginosa
tctccaaggagccgctcggcccggccgtgcggcagggcgacgaagcctggttcaacatcgtccgctggaccctgtacggcctgctcaacgcggaggagctgggggtcacctcgagcaacgtcgagcgccaggccagggacagccgcaacccggacgtcgcccgcctgctcggcagcgagggcgacgccggcaaggacttgcaactgccgcgcgactgggtggtgcagatggtgcgccaggtcggcaactatggcgagatcttcgcccgcaacgtcggcgacggcagcccgctga

SEQ ID NO: 3823 - DNA, 699 bp, Pseudomonas aeruginosa
tcgtccagcagccggccgacctgccgatcctgctcggcctctggttcgccgcctcggcctatttcgtcggtatctgcctctggcgcagcgcccgcgagtggttcggctgaaacgacccggcacgacggcgttcccgcctggggacgcctggcaagtccctatcatcgcaaggaaccccgcatggcccaccccaacgccgaactgatcgagcgcttctaccaggccttccagcgcctcgacggcgaggccatggcggcctgctacgctccccaggcgaccttccacgacccggccttcggcgaactgcgcgggcgcgaggtgggcgacatgtggcgcctgctgaccagccgggcgcgggacttccgcctggactacgcgaacgtccgcgccgacgagaacgaggggcgtgcgcaatggggtggcccactacctgttcacccagaccgggcgcagggtggagaatcgcatcgaggcccgtttccgcttcgccgacggtttgatcgtcgagcatcgcgaccagttcgacctgtggcgctggagccgccaggcgcttggcgccaagggcctgctgctgggctgggcgccgccggtgcagcgggcgatccgcgggcaggcgcgcaagggcctggccgcctaccaggctgcccatccggcggccggctgaggctgtcggtggccgaagcgcggataatctcctaa

SEQ ID NO: 3824 - DNA, 4884 bp, Pseudomonas aeruginosa
gccttttcagcgcctggtagccgtcacagccctgaagaaagtggtgcccggatcgatcctcgaggcggcggacggcaaggaggcggtggcgatcctggagtcctgcggacacgtcgacatcgccatctgcgacctgcagatgagcggcatggacggcctggcgttccttcgccacgcaagcctgagcggcaaggtccattcggtgatcctcagcagcgaggtggatcccatcctgcgccaggccaccatttcgatgatcgagtgcctgggcctcaattttctcggcgaccttggcaagccattcagcctggagcggatcaccgccctgttgactcgctacaacgctcgtcgccaggacctgccgcgacagatcgaagtcgccgagctgccctccgtggcggacgtggtgcgcggcctcgacaacggcgagttcgaagcctactaccagcccaaggtggccctggatggcggcggcctgatcggcgccgaggtcctggcacgctggaaccacccgcatctcggcgtattgccgccgtcgcatttcctctatgtgatggaaacctacaacctggtcgacaagctgttctggcaactgttcagccaggggctggcgacgcgcaggaagctggcgcagttggggcagccgatcaacctggcgttcaacgtccatccttcgcaactgggttcgcgtgccctggccgagaacatctcggcgttgctgaccgagttccacctgccgcccagttcggtgatgttcgagatcaccgagaccgggttgatcagcgctcctgccagcagcctggagaacctcgtgcgtctgcggatcatgggctgcggcctggcgatggacgatttcggcgccggctattcgtccctcgaccggctctgcgagtttcccttcagccagatcaagctggacagaaccttcgtccagaagatgaagacccagcccaggagttgcgccgtcatcagcagtgtcgtggcgttggcgcaggcgctgggaatttccctggtggtggaaggggtggagagcgacgaacaacgggtacgcctgatcgaactcggttgctccatagcccagggctacctgttcgcccggccgatgccggaacagcactttctcgactattgctccggatcctgacgccgccgccctggcctcggctgcctctagccgaacgccgggcctcgcgccggacgcgtttcctttccatacaactgccggccctgccgcacagacctttcatgcgatcaaaactattcctgctgttcttctgcctgctgctgtcgggcggacgcctgttcgccgtcgaagcgcatccgtccctgacgctgttcagccagttgcgcatcgagcacgaggacatggcgatcgccgaggacgactgggcctggctgcgccacaagggtcacctgaggctcggcgcggcgctggacgagacctcgcccttcaacgtccggatcgacgacgagaactacgaaggcataacggcggacgtcgccacgctggtcgggcagttgctcggcatgcgcatcaaggtcgtgagcttcgatacccatgcggatgccgtggcggcgctcgctgccggaaagatcgacctgcttggcagccattacagctcggcgggtgattcctccctggtgctcagccaaccctatgcccgtgatcgattggcggtgttcaagcggatgggggaaaagcgcaactcaccggaggatctcgccggactcagcgtggcggtggcccgggagcatgtcggggaattgcgccagcgtttcccgcgggcgcgtttcgtggtcttcggcagccatgacgaggccgttgccgcggtggctttcggacataccgacctgtatctcgacgatgtgctcagtgcctaccaccggatcaatcggtcctattacggctacgtgaggttcgagcggtttgccgatgcccgcctggaagggggctacggcttcctccttcgtcgcggcgacacgaacctgttgcgcgtcgtcaactcggccatcggcgcgatcaaccaggaccgtctcgaaagcatcgccaggcgctgggtcggcagcggttccctgccaacgggccagcgtatcgcgctgacgccgcaggagagtcgctggatcgctcgccacccggtggtgcggttggtcatcaacgacgacctggcgccgctggccttcttcaattccgacgagaccttctcgggcatcgcctccgacctgctggacatgatttcccgccgcaccggcctgcatttccaggtcacgcctcgcagtggcggcttccccgagcagatcggcgtattggccaggaaggaggcggacctggcgatcatgagccgcagcagcaagcgcgaggaaatgctgcgtttcacccgctcgttcctgtccacctcgtacgtcctcgtcacccgggcggacgacaagggacgcgcggagagccccgggagcctcgacggcaagcgcatagcgattcccgccggccatgtgggcatgcaacaggtgcgcgagcgctatccgcaggcctcgatggtggaggtcggcgtcgcgctggatgccatgaacctggtctacgaaggacgggccgacgcggcggtggtgccgctggtcaccgctcgctactacatcgtccggttgttccgcgagaggctggcgatcgccgacctggttcccatcggtgcggccaccgcccacttcgccgttcgccgaggcgacgccgaactccagtcgattctcgacaaggccttgctgagcatctcgccggacgacctgagcgatatcgtcaatcgctggcgctcgccgccgggaatgagcggccagacctgggtcgactacatcctggtgatcaccgagatcctggcgatcgcagcggccttgctgctgctctgcctgggctgggtcacttatcagcgccggcagatcagggtgcgcgcgcgggtcgaacaggcgctcagcgaccagttgcggttcgtcgaggccctgaccgactgcatgcctccgccgctgtatgtgcgcgatgtcaatggacggatgctgtcctgcaaccgcagctacctgcagagcgtcggcttgagttccgaggaggtgatgaaccgcaccgtgctcgaactgcccatggaaaacttcgagaccgctccggagttccatcgcagctacctgagggccatgcgcgagggcaggaccatcgaggcggtctacccggtggcgctgggcggtcgggagcgctggatcgaccactggatccagccgttccgcgattccagcgggaccatccgcggtgtcatctgtggctggctggacatcaccgagcaccgccagttgatcgatgagctggaagaggcaaagaatctggccgacgaagcgagccgggctaagaccaccttcctggcgaccatgagccacgagatccgcacgccgatgaacgcggtgatcggtatcctcgaactggcgctcaagcgtgccgagaccggtcgggtggaccgttccagcatcgagatcgcctatgcctcggcgaagagcctgctggagctgatcggcgatattctcgacatcgcccgcatcgagtcaggtcgcctcagcctgtcgccgaaacgggccaacctgcgcgagctggtggaatcggtggcacgggtattcgaaggcctggcccggcaaaagcgcctgagcctggtgctggagatcgattcgagcatcaacggcgacgtactgctggatgccatgcgcttcaagcagatcctctccaacctggtcagcaacgcgatcaagttcaccgacgagggctcgatccgcatccgcatcgatggccgccaggtggagccgtcgctgttgcaggtcaatctctgtgtggaagacaccggcatcggtatttccctgggcgaccagcagcagttgttccggcctttcgcccaggtcaaccgcaacctgcagaacaccgagggcaccgggctcggcctggtgatctcgcgctcgctgtgcgaaatgatgggagggcgcctggtgatgagcagcgagctggggcagggtacgcggatcgacgtcgagctgcgcctgcaggtgctggaaccgatcgtcgagaacgtgcgggcgatcccgctcggcagtcgccaggcgcggcggttgcaggtgctggtggtggacgatcatgcggtcaaccggcagatcctccatcaacagctgagcttcctcggtcatgacgtggaggaagcggagaacggcctgagcgctctcaacctgtggcatgggcaaccgttcgacatggtcatcaccgactgccacatgccgctgatgagcggctccgaccttgcccgctcgatccgccaggaggagcgcgagaatggcgaggagccggtggtcatcatcggcctcaccgcggacgcccagccggaggagatcgagcgctgcatccaggctggaatgaacgagtgcctgatcaagcccatcggcctcgatgtcctcgaggagcgcctgctggccctgggcttcgccgccgacgagctgcccgtcaccatcgatgccgaacccgtcgccataccgacggccccccgtctctacgacctggattccctgcatgcgctgaccggcggcgagccgacgatgctcaggcggctgctcgacgaactgctgaccagcaaccgcaaggacctggagaccctcgagggactggtgcaacgccaggagaccggcgaactggccgagctggcgcatcggatcaagggcgcggcgagggtggtgcgtggcgagcaactggtggaaagctgccggcgcctcgaggatgcctgcctcagcccgaacgcctcgttcgcctgggtggaagagtgcgccgttggggtgaaactggcgatcctcgccctggacgaaagcctggtggaagagtgcacggattga

SEQ ID NO: 3825 - DNA, 945 bp, Pseudomonas aeruginosa
tcctttcatcggctacgtggggctggaggtcgtggacttcgatgcgcccttcgtacccgcggtggccatcggctggcgtctcgccgccgagcattgggcggagggcttcgcccacgaggcggccgaggcggcgctgagctacgccttcgatacccttggcctggaccaggtggtggctttcaccgtaccggccaacgagaactccctggggctgatggagcgcctggggatgcatcgcgatcccaccgacgacttcgagcatcccgacctgcctcccggccaccgcttgcggcatcatgtgctgtaccggttgacgcgcgaggactggcttcgcagatgagtcggccgtttccgaaaaggcctcccatgaacgcgaaccttcccccttccgccatttccgaactgcatggcccgcgcctgctgctgcgcgcctggcgcgacagcgaccgcgaggcgttcgccgagatgtgcgccgacccgcaggtaatggaattcttccccagtgtgctcgaccgcgcgcagagcgacgccttggtcgatcgcgtccaggcgcattttgccgagcgtggctacgggccctgggccctggagctaccgggcgaggcggcgttcatcggattcaccggcctgttcgacgtgaccatggacgtgcacttcgccccgaccgtggagatcggctggcgcctggcgcccgcctactggggccgtggactcgcccgcgaagcggcggaaaccgccttggacttcgccttcgagcggctgcgcctgcccgaggtggtggccttcaccacgccgcccaaccgccgctcctggggcttgatggagcgcctgggcatgcgtcgcgatccggccgaggatttcgaccacccactcctggcagcggatcacccgatgcgccggcatatcctctatcgcgtcgacgcggcccgctgggcggagcggtga

SEQ ID NO: 3826 - DNA, 1092 bp, Pseudomonas aeruginosa
ccagcgtgccctggcgcgaggcctggaaatacggtgagcgagcctatcgctactgccagcatgacctcggccacgcgctggcctgcctctcgatcgccgcggcgatccagggctgggagatgcgcctgctgcgcggcgtcgccgaaagcgcactggacggcctgttcggccttgaccgggacggcttcgccgagtgcgagagcgtcgacgcactgttctggatcgggccggcgctcacgcaggagccttccctttcgccgcgcctgtgcgaaggactggcggccctgccgttggccggcgcgccgaaccggctgtcgcgggagtaccgggactggccggagttgcagcggatacatgggctatgtcgggcgccgcgcctgccggcacgcccgtggagggtcgcaccgggcgagcccggcaacgacaacccccggcctgccgctgcgaccgctgctgcatcggcggcgtatcgcgcagcgcatggacgggcgcgccggcatcgatgtcgggctgctgcgggcctggctgcgcaggctgctgccggagcgctcgccggtgcctttcgcggtcaccggcgaggccgcgcgggtcgatctgctgctgttcgtccatcgcgtccggggcctggtgccggggttgtactggctggaccgcagcggcctgcggcggccgccgatgcgcgaggacttcctctggcagcgcgtcgatccggagttgccgctgtacctgttgcaggaaggcgatgcacgcgcgctgtcggcgtatctctcctgccagcaggacatcgccggcgacggctgcgtcgcgctcgccatgctcgcccatctcggcgcggcgctcgaagaaggtccctggtgctatccgcggctgtactgggaatgcggggaggtcggccagttgctctacctcgaggcggaggccgccgggctgtctgggacgggtatcggctgctactacgaccccctggtgcatgagctgcttggactaacggatgagtccatggccagtctctaccatttcaccctcggccgcgcggtgtgggacactcgtctttgcaacatgcccgcgtacccggccatgcgccgcgactag

SEQ ID NO: 3827 - DNA, 903 bp, Pseudomonas aeruginosa
cccgtcgacagcccgaattcgaggaaacaccccatgacccagatactggacaacctggtggctttgctgagcctggaacccatcgaggagaacctgttccggggcatgagccaggatctcggcttccgccagctctatggcggccaggtcctggggcaggcgctgtcggcggccagccagacggtggaggacgatcgccacgtacactccatgcacggctacttcctgcgtcccggcgacgccagcatgccggtggtgtaccaggtggaccgggtgcgcgacggcggcagcttcagcacccgccgggtcaccgcgatccagaaaggccagccgatcttcaccctgagcagctccttccagtacgacgaggaaggtttccaccaccagatcgagatgcccgaggtggttggcccggataatctgccttcggaactggagctgacccgccagcgcgccgagcggattcccgagcgcatccgcgacaagctgctgtatccgaagcccatcgagattcgtccggtcacccagcacgacccctacgacccgcagcccgacgaaccggtgaagtacctctggttccgtgccgacggcaagctgccggacgtcccggcgctgcacaagtacctgctggcctacgcctcggatttcggtttccttaccacctcgatgcagccccatgccgtttcggtgtggcagaagaccatgcaggtcgccagcctcgaccacgccctgtggttccaccgcgacctgcgcgcggacgagtggctgctctacgccatcgacagcccctgggccggcaacgcacgcggtttcgtgcgcggcagcatcttcaaccagagcggccagctggtcgcctcgtcgagccaggaaggcctgatccgcaagcgtgaggactgggcgtga

SEQ ID NO: 3828 - DNA, 567 bp, Pseudomonas aeruginosa
tggtcggcgactaccgtttcgacctcgactgcggacgcgccgcgggtagtcgcacggtgctggtcaacctgccggaaaacccctggccggagctggccgactggcacgctgccgattgccatgcgttgctcgagcaactgcaaacgccgtaggaatatccggcggaaaacctcgagggcggcagcgccagcggctccccgaaaacgaaaaaagcgcaggaggccaggctcctgcgcttttttcctgcgcatccgtgcgggatgcggcggccgttatcagccgttgatcgcgtcggtcagtgccttggccggaacgaacttggctacacgcttggcagcgatctcgatcgccttgccggtctgcgggttgcggccggtgcgcgcgggacgctcggagaccttcagcttgccgatacccggcagggtgatttcgccatcgttctccagggcgtccttgacgatctcggcgagctggtcgagcgcgctgcgaacggtggtcttctgcgcgtcgatggcttcggcgatgtcctggatcagttggtctttggtcagtgccatggtggtgtag

SEQ ID NO: 3829 - DNA, 603 bp, Pseudomonas aeruginosa
cgattgcttcgccgtggaagacgtggatcgcttgctgatctcagcctggcacgcgccctcccgcgctcacctgatcgctgtcgccgaaacggggcgggcaggcatcgacatctccggcctcgccgatggttcggggctgttcttgcccgccgggcagcggctgcattaccagcggctgcggctgcatcccgaggacatcctggtgccgcccggcctgccgccgaccccgtgcgggcaactgcgcgaaggcttgacccgattggcccaggccaacctcgacctgggccaggctgcgcgggtgccgggcgacgtggcggggcagggagaggcgccgcgtctcctcgccctcgcgctgcgtcttgtcgaactggcggcggagtccttccaggcggcattcgcccgcggcggcgcgctgacattccgcgaaagcgcggcggcgtcgctgctggcgagcgaggcggaggcggtggcccgcgccgggctgctcgcctgcctgcgccgacaggccctggaagcccgtttgctgggcgcggccctgtagggacgggggcatggagcaagggcggaagggcatccgggggcgcattcgcgctcataaactaa

SEQ ID NO: 3830 - DNA, 411 bp, Pseudomonas aeruginosa
aatcgtcgcccgcttcgcccgcgtcagcctcgattccttcgccgactacaacgcgcacaaggccgaatggaccgccgactccgaaccggtgaagaagatcgcccggctgaccggcgccgatcccagggacgtccccgaactgctggccggctcgaccttcccggaaagccaggcgcaactgtccgccgacctgctcggcggcggcaccgccaaggctatcgccggcactgccgaattcctcaaggaacagaagcgcgtgccggccgtcctcggcgactactcgccctacgtcagcgccgacttcgtgcgccaggcggagcaggtccaggtcggccagcgctgaattccgcgactccgctccggcctgtcggagcggaggctttcttaccctacggagggcagaacacatga

SEQ ID NO: 3831 - DNA, 978 bp, Pseudomonas aeruginosa
tggacggcccgccggcgcgcatcgtcaagcgcctgccggtggacttcgcgcggcgttacgccgccggcgaaacggtgcgttcgatcaaggctgatcccgagttcggccgtttgcgccaggcgttgctggacgaattcctcgatgtcgcggaggccgaacatgcccactgataccctcggactcgccgttgccaatcctgtcccgcgcaagcgccgtctgcccggcgaccgtcggcgctgggccgccggtgccagcgtgctggccctggccctgctgtggtgggcggcgacccgtttcggctgggtcgacgtgctgttcctgccggcgcccgaacagctcttcgaagccctgcaacggctatggcaggatggctacctcgatgccagcctgctgcaacacgtcggcaccagcctgctgcgggtgctcctggcgctcggcgcggcggtgctgacggcgatcccgctgggcgtgctgatgggcctcaatcccttggccggagcggccctcgatccgctggtggagttctaccggccgatcccgccgttggcctacctgccgttgatcgtcatctggttcggcatcggcgagctgagcaaggtgctgctgatctacctggcgctgttcgcgccgctgctgatcgctaccgccgccggcgtgcgtcgcgtcgaccgatcgcgggtgcaggcggtgcgctgcctgggggccagccgctggcaggtggtgcgctacgtgatcctgccgagtgccttgccggaggtcctcaccggcctgcgcatcgccctcggcgtcggctggtctaccctggtcgccgccgagctgatcgcggccaaccgaggcctcggcttcatggtccagtccgccgcgcaattcctcgccaccgacttggtggtggtcggcatcctgctgatcgccgccatcgccctgggcttcgaactggggctgcgctgggcccagcggcgcttcgccgcctggggttga

SEQ ID NO: 3832 - DNA, 1479 bp, Pseudomonas aeruginosa
agaggagttgccatgttcggattggaggctatcgaccttgcccgcatccagttcgcgttcaccgtgtccttccacatcatcttcccggcgatcaccatcgggttggccagctacctggccgtactggaaggcctctggctgaaaacgaacgaagaggtctaccgcgacctctatcatttctggtcgaagattttcgcggtcaacttcggcatgggcgtggtgtccgggctggtcatggcgtaccagttcggcaccaactggagccatttctccgacttcgccgggtccatcaccggtccgctgctgacctacgaggtgctcaccgcgttcttcctcgaggccggtttcctcggggtcatgctgttcggctggaaccgcgtgggaccgggcctgcatttcttcgccacggtgatggtggcgatcggcacgctgatctcgacgttctggatcctcgcttccaacagctggatgcagaccccgcagggtttcgagatcgtcgacggccgggtgatcccggtggactggctggcggtgatcttcaacccgtcgttcccctaccgcctgctgcacatgtcggtcgccgcgttcctcgccaccgccttcttcgtcggcgcctcggccgcctggatcctgctgcgcgggcgcgacaacccggggatccgcaagatgctctcgatggccatgtggatggcgctgatcgtcgccccggtacaggcgctgatcggggacgcccatggcctcaataccctggagcaccagccggcgaagatcgccgcgatggaaggccactgggacaacagcagcggcgagccgaccccgctgatcctgttcggctggccggacatgcagcgcgaggaaacccgcttcaaggtggagatcccggtgctcggcagcctgatcctcaagcacagcctgaccgagccgatcccggcgctgaaggacttcccgccggaagaccggccgaactccaccgtggtgttctggtcgttccggatcatggccggcctcggcatgctgatgatcctggtcggcgtctggagcctgtggctgcgctggcgcggccaggacaagctgttcaactcgaaggccttcctgcgcctgaccctgctgatgggaccgtccggcctgatcgcgatcctcgccggctggttcaccactgagatgggccgccagccctgggtggtctacggactgatgcgcaccgccgacgcctcctcggcgcagagcgtgacgcagatgagcctgaccctgctgaccttcgtggtggtgtacttctcgctgttcggcgtcggtatcggctacatgatgcgcctggtgcgcaagggcccggtcacccatgagggacgcgagaccaacccgggaggcgccgggcagaagcgcacgccggcacggccgttgtcggccgccggcgaaggtttcgacgaagagcacgacggccacgcgcaagcggccgaccgcgaccaggacaagaggaactga

SEQ ID NO: 3833 - DNA, 1011 bp, Pseudomonas aeruginosa
gacatgggtatcgatcttcccctcatctgggcggtcatcatcatcttcggcatcatgatgtacgtggtgatggacggcttcgacctgggcatcggcatgctctatccgttcttcaaggacagcggcgaccgcgatgtgatgatgaacaccgtggcgccggtctgggacggcaacgagacctggctggtgctgggcggcgcggcgttgttcggggccttcccgctggcctacgcggtggtcctgtcggcgctctacctgccgttgatcttcatgctcgtcgggctgatcttccgcggcgtcgccttcgagttccgcttcaaggccaagccggccaagcagcacatctgggacaaggcgttcatcggcggttcgctggtggcgaccttcttccagggcgtggcgctgggcgccttcatcgaaggcatcccggtggagaaccgcagcttcgccggcggttcgctggactggatcgcgccgttcccgctgttctgcggcctggccctgatcgtcgcctacaccctgctcggctgcacctggctgatcatgaagaccgaaggccgcctgcaggagcgcatgcacgacctggcgcgcccgctggcgttggtgctgctggcgatcatcggggtggtcagcctgtggacgccgctggcccatgccgagatcgccgcacgctggttcagcctgccgaacctgttctggttcctgccggtgccgatcctggtcctggtgaccttctatgcgctgctgcgctcggtggccaacaacgaccacgtgaagccgttcgtgctcaccctggtgttgatcttcctcggctacagcggcctggggatcagcctgtggccgaacatcatcccgccggcggtgagcatctgggaggcctcggcgccgccgcagagccagggcttcatgctggtcggcgcgctgttcatcattcccttcatcctcggctacaccgcctggagctactacgtgttccgcggcaaggtgaagcacggcgatggctatcactga

SEQ ID NO: 3834 - DNA, 570 bp, Pseudomonas aeruginosa
ccgaggtcgcgggcgaccacctgcacgctgtcgccggccagcaggcgcggcagggcttcggtcaggcgcagttgctggcgccactcatggaagctcatctgcagttcctgggcgaacagccgcgccagggtgcgcgagctggcgccgacccgcaggccccagtcatcgagggtcagccccagttccggctgtttcagcaatgcctggcagatcgcctgcaagcggcggtcgcggggcatcggcaggtacagcggcatccgttcgaggttggcgatctcgctgaggatcagcccttgcaggcgctggcggaagtcgtccaggcgcggctggctctcgaggtggatggcgcgcaggatcatttcccgcagcagcggcgtcaccgccagtacgcaacagtcgcttagcggtgtcggtgtttcgggttgctcgatgaacagggtgcgcatgtgcacctcgccggacatgaatatctcgtgctccacccggggcggaatccataccgcgcgggtcggcgggatcacccaggcgccgtggtgggtggccaggcgcatcaggccgcgagcggcgtag

SEQ ID NO: 3835 - DNA, 2034 bp, Pseudomonas aeruginosa
cctcggggtcgccttcgccgcgctgcttaccggctttctcaccgcgcacttcggttggcgtgcggcgttcatcttgcccggcggggtggccatcctgctcggcatcggctttttcttctgcgtgcgcgaggagccatcgccgcacctgtcggccaaggccgcggcgcgtggcgaggacagcgagggcctgtcgatgcgccgggtgttcggcgtgctggcgctggtcaccgccaccggcggggtggtgttcaacgccagcaccgtgacctacccgaagctgttccaggagcgcctgagcgacttgctggcgtcgccgcagaccctcggcgtggtggtcagcctggcctatgccttcggcgcggtagcgcaactgatcatgggccgcctgatcgatcgcctgaacctgaagttgccgttcgtcttcctcaccttctgccaggtgccgctgctgctggccctggcctacggccacggcagcgcagtggtgctgttcggcgcgctgttcatgttcgcggtgttcggccaggtgacggtgaacgatgcgatggtcgcccacttcgtcgcgccgcagtggcaggcgcgggtcttcgccctgcgctatttcctgtcgttcggcgccagcgcggcggcgatcccgatgatcgcctacctggagccacggcaggggctgctggggttgtacctggtactggcgggcttcgccgcgctgaccttcgccgcggcgctggtgtttccgcgtccggcgcgcagcgccgcggtgggcacctgaggaagagggcgcccggacagcgcgagccggccgggcgccgatggctcaacgccgtatcagagcagttcgagcgccacggcggtggcttcgccgccgccgatgcacagcgaggcgacgccgcgcttgccgcctttctggcgcagggcgttgatcagggtgaggatgatccgcgagccggtggaaccgaccggatggccctgggcgcaggcgccgccatagacattgaccttggcatgatcgaggccgtgttcgcgcatggcgagcatggtgaccatggcgaaggcttcgttgatctcgaacaggtcgacgtcgtccttgctccagccggtcctggcgaacaggttggtcatcgcgccgatcggcgccagggtgaactcgctcgggtcctggctctgggtggcatggccgacgattcgcgccagcggcttcaggccacggcgctgggcttcctcggcggtcatcaggaccagcgcggaggcgccgtcggagatcgagctggcattggcggcggtgatggtaccgtccttgcggaacgccggcctgaggctcgggatcttctccaggttggcggtcagcggttgctcgtcgtccttcaccacgctctcgcccttgcggctggtgacggtgaccgggacgatttccgccgccagcgagccatcggcgatggcggcctgggcgcgcttgagcgattcgatggcataggcgtccatctcctcgcgggtcacgccgtacttgtcggcggtctcctgggcgaacgaacccatcaaacggccggtacgggcgtcctccaggccgtcgaggaacatgtggtccttgatctcgccgtggcccatgcgcaggccgctgcgggctttctccaggacatagggcgcgttggacatgctttccatgccaccggcgaccatcacctggttggtgccagccttgagcaggtcgtgggccagcatcaccgccttcatccccgagccgcacagcttgttgatggtggtgcagccggtggcggcgggcaggccggccgccagcgcggcctggcgggccgggccctgcttcaggccggcgggcaggacgcaacccatgatcacttcctgtacgtcctcggcggcgatgccggcgcgctgcaccgcttcgcggatcacgacggcacccaggtcgaccgcggaaacgccggccaggctgccctggaagccgcccatgggagtacgggcgccggcgacgatgacgatatcggacatggaacgttacctcttgttctggatagggtctga

SEQ ID NO: 3836 - DNA, 1743 bp, Pseudomonas aeruginosa
aatcgtctaccgcgaccaggtgcgctacagctacgccaccttcaacgagcgcgtcgcgcgcctggccaacgtactcagcgaggccggggtgaaggccggcgacacggtggcggtgatggactgggacagccatcgctacctggaatgcatgttcgccatcccgatgatcggggcggtgctgcataccatcaatatccgcctctccccggagcagatcctctacaccatgaaccacgccgaggatcgcttcgtgctggtgaacagcgagttcgtcccgctctaccaggcggtggcggggcagttggccacggtggagcggaccatcctgctcaccgacggcgcggagaagagcgcggaactgcccggcctggtcggcgaatacgagtcgctgctggccgcggccagcccgcgctacgacttccccgatttcgacgagaactccatcgccaccaccttctacaccaccggcaccaccggcaatccgaaaggtgtgtatttcagccaccggcaactggtcctgcacaccctggcgatggcttcgaccatcggcagcctggacagcatccgcctgctcggtaccagcgacgtgtacatgccgatcaccccgatgttccatgtccacgcctggggcactccgtacgtggcgaccatgctcggggtcaagcaggtctatcccgggcgttacgatccggaactgctggtcgaactgtggaagcgcgagaaggtcaccttctcccactgcgtgccgaccatcctgcagatggtgatgaacgccagggctgcccagggcgtggacttcaagggctggaaggtgatcatcggcgggagcgcgctgaaccgctcgctctacgaggcggccaaggcgcgcggcatccagctgaccgccgcctacggcatgtcggagacctgtccgctgatttcctgcgcctacctcaacgacgaactgctggccggaagcgaggacgagcgcaccacctaccggatcaaggccggcgtgccggtgccgctggtggatgcggcgatcatggacgaacagggccgcttcctcccggccgacggcgaatcccagggcgagctggtgttgcgctcgccatggctgacccaggggtatttccgcgaacccgagcgcggcgaggagttgtggcgcggcggctggatgcacaccggcgacgtggcgaccctggacggcatgggcttcatcgagatccgcgaccgcatcaaggacgtgatcaagaccggcggcgagtggctgtcctccctggagctggaagacctgatcagccgccatccggcggtacgcgaagtggcggtggtcggggtgcccgatccgcaatggggcgagcgcccgttcgccctgctggtggtgcgcgagggccagcaactggacgcccgtggcctgaaggagcacctcaagcctttcgtcgagcagggcaacatcaacaagtgggcgatcccctcgcagatcgcggttgttaccgatattcccaagaccagcgtcggcaagctggacaagaagcgcatccgtatcgagatcgcccagtggcaggaagccggcagcgccttcctgtcgaccgtctgacggggctttcctacaccgctgaaacgcccggaggccaagcaaacgcttggtctccgcgttttcgcgaccgcccggtcattctccatccgccgcaaaggcgcgagccagagtggttgcgccgcgcaaatcacactttcgagggatcaagcggcaggcagcgctag

SEQ ID NO: 3837 - DNA, 2874 bp, Pseudomonas aeruginosa
cttctcgcgcaccttctcgggcactccatccgccgttctgccgacggccaaccgctttttccgccccccgctgccgtcggcccatgtggcgcgcccgcgtctttgccgtcgactgcgcgacggactggacggtcgcctgctgctgatcgccgcgcccgccggattcggcaagagttccctggccatcgagttctgcgaaagcctcgatccgcgctggcagagcctctggctgggactgagcagccgcgagagcgatcccggacgtttcctcgaacgcctgctcgatggcttgcgacagtaccacccgaccctgggcgaagaggccctcggcctgctgaagatgcgccagcgtcaccagccgttcgccttcgagacctggctcgacgacctgctcgacgaactcgccccctgcctggacccgcagcgtcccctgctactggtgctggacgattaccacctggcccagggcgcggtgctcgaccgttgcctgcaattcctcctcaatcacctgcccgagggcctggtgctgctggtcaccagccggcagcggccggactggcacctggcgcgcctgcgcctgtcgcggcaattgctcgaactcagcgaacaggacctgcgcctgaccgccgaggagagcggggcgctgatggccgccagcggcctcgaactcgacgaggacgcgctggacgcgctgctcgagcgcagcgaaggctgggtcgccgggctgcgcctctggctgctggcgcgcggcgatccagaggagcaggtcagccccggggtacacggcgccgacgaactgatccgcgactacctgctggaggaggtgatcgagcggcagccgcccgaggtccaggcgttcctcgcccagaccgcgcgcttcgagcgcttctgcgccgagctctgcgataccgtgcgcgaggccggcgacagcgcggcgatcctcgaccacctgcagcagcaccaggtcttcctcgtgccgctggacgaaaacggccagtggttccgctaccaccacctgttctccgacctgctgctggcgcgtcccttgcccgacttcggtccgtccgccggctccctgcacctgcgcgcctgcggctggttcagccgccatggcctgctcgaccaggcggtggagcaggcgctgcgcgccggccagccggacgtggcggcgagcctggtgcagaacctgtcggaagagcaactgctggcggagcagaacatcgccaccctgctgcgctggaagatggacctgccggacagcctcctggcgagcacgccgcgcctgatcctgctgtacggctgggcgctggcgctggcctgccagctggatgccgcggaagaactggccggccaactggcgcgtttcctgccggcgccggacgagtccgcgcagcgcgacctgctggcccagtggcaggccctgagcggggtgatcgcgcgcggccgcggcgatatcgacaaggccgaggcgcactgccgcgaggccttgcaggacctcgccggggagcgctatggcacccgcctgcaatgcctgtcgacgctgagcaacctggcggtgacccgtggcgacttctggcaggcgcgcaactacaaccgcgacgccctggagttcgcccagcgctacggcaacccgctgttcgaggcactggtccattacgaccgcgcccgcgtcctccaggcgcgcggcgaggtggcgcgcgccgaggaggaggtgcgccagggcctggaacgcctccagcacctgccggcgcaacgccgctacgcggtgcgcgggcggctcctgctgtaccgcggctacctgcgcagcctggcgctgcagccggacgaagcgcgcaagtggatcaagcagggaatcgaggaaacccgcagctgccgggatgtcagcctggtgatcggctattgcgtcctggccagcctggaagggcgcctgggcaactacgcggcggcgttcgcccggcttggcgacgtcgagcggttgatgcatgcctgggatatcccgccgatctactacctggcggcgatcaccctgatcaagtgcgaactctggctggcccagggccagaccgaactggccggcgtctggctacagcgcctgggcggcacctacggtgggcaggcggccacgccgccggaatgcagtccgctgctgccgctgcatgtggagttgctccaggccggcctggagcgccgcgaaggacgcccggaggaagccgcccggcgcctggaccggctggcccgctcgacgcgggagaacggcgcgttgctgccggctcgcctggccctcggccaactggccgcgctgcacctggagcagggccgcgagcgcgaggcgctggcgaccctgcaacaggccatggagggcgcagtcggcggagccttgctgccgctccacgaattgctcgtgcagcagccggaatggttgcgcgaacagttgcagcgcttccctgcctgtcccggcgcccagcgcatgcgcgcgctgttgccggagccgcccgccgagcccgcgggcggtgcgggcgaggtgctcagcgggcgcgaactggcggtgctggagctgatcgctcaggggttgtccaaccaggagatcagcgagcggctgttcatctcgctgcatacggtgaagagccacgcccgccatatcaacgacaagctcggcgtcgagcgtcgcacccaggcggtggcgcgggccaagcacatggggttgttgcgctaggcgcgccaccccatgtgcctggcgtgctggctcagggcttccagcgtcgcaggagcagggcgttgccgaccacgctgacgctggagaaggccatcgctgcgcccgccaccatcgggttgagcaggccgaaggccgccagcgggatgccgatcacgttgtag

SEQ ID NO: 3838 - DNA, 1833 bp, Pseudomonas aeruginosa
gtccgccgcgagatgtccagcgccgccggcaccaggcgcgggtcgccgcgcatcagggtgatgccggcggcgtgcatggccacgtcggtgccgccacccatggcgatgccgacgtcggcggcggccagcgccggggcgtcgttgatgccgtcgccgaccatcgccaccacccggccccggcctttcagctcggcgaccgtggcggccttgtccgccggcagcacttccgcgtgtacgtcgtcgatgcccagggccttggccaccaccgccgcgctgccgcggttgtcgccggtgatcaggtggctgtggatatcccgtccgcgcagggcctccaccgcttcggcggcgccgtccttgaggctgtcgccgaaggcgaacaggccgagcacgcgtttctccggagccagttccagcagccaggacagggtgcggccctcggcctcccagtccgcggcggcactcgccagcgcgccgggcttgagttcctgctcgtcgagcaggcggcggttgcccagggccagccggcgaccctcgacctcgccctggatgccgcgaccgctgagggcctggctggcgttcaccggcggaacctccaggtcgcgctcggcgcagcgctcgagcacggccttggccagcgggtgctcgctgccgcgttgcagggcgccggcgagcctgagcagttgctcctggtcgtcgccgccgaggtggatgatctgcggtcgcccggaggtcagggtgccggtcttgtcgaaggccacgctggtgaccgcatgggcgacttccagggactctgcgtccttgatcaggatgccgtggcgcgcggccacgccggtgccggccatgatcgcggtcggggtggccaggccgagggcgcaggggcaggcgatcaccagcaccgccacggcgttaaccagggcctgctccaggccgaccccggcgaccagccaggcgccgagggtgaccagcgcgatgaggatcaccaccgggacgaagacctggctgaccttgtccaccagcttctggatcggcgccttggcggcctgggcgtcttccaccaggcggatgatcttcgccagcaccgtttccccgccgagcgcagtggtgcgcaggagcaggcggccttcgccgttgatcgcgccgccggtgaccttgtcgccgggagccttgggcaccggcaggctctcgccggtgatcagcgcctcgtcggcgtggctgctgccgtcgagcacctcgccgtccaccgggaagcgttcgccgggacgcaccaccacctcgtcgccgaagcgcaactcggcgatcgccacctcttcctcgcgaccgtcgcgcaggcgcaccgcgcgctccgggcgcaacggcctagagggcgcggatggcgctggcggtctggcgcttggcgcggctttccaggtacttgccgaggaggatcagggcgatcaccacggtggaggcttcgaagtagaggtgcggcatgtggccaggcggggcggtcagccagaggtagacgctgaggccgtagccggcgctggtgccgagggcgaccagcaggtccatgttgccggcaccggccttcaccgcgcgccaggcggagacatagaagcgcgcgccgatgacgaactgcaccggggtcgccaggaggaactgcgcccacggcggcagcatccagtgcaggccggcccattccaccagcatcggcagcaccagcggcaacgccagcaacagcgcggcgatcacccaccagcgttcgcggcgcaggcggcgctcggcatcgtcctggcgtggttgccccgcgtcgagcaggcgggccttgtagccggcctgttccaccgcctgtag

SEQ ID NO: 3839 - DNA, 1389 bp, Pseudomonas aeruginosa
ccacggacgttcccgccccacccagcccaccctgtacgtcctcgataccaatgtcctgatccacgatccgaatgccctgttgaacttccaggaacaccgcgtcgcgatcccgatgacggtgctcgaagagctggacaagctgaagaccggaaagcacaccatcgccgccgagtgccgccaggccatccgcctgatcgaccaggtactcggcgaggccacgcccgagcaggtagagggaggggtaccgatccagcgtggcaagaacggccccagcggcagcctgtcgatcctcatgagcaagcgtgccgagcccatcacctggctgccggagcacctcaacgacaacaagatcatcaaccagttggtcgagctgaagagccgccacagcggcgtgcgcgtggtgctggtgaccaaggacatcaacatgcgcctgaaggcgcgcgcctgcggggtggacgcggaggactaccacaccgaccagttgatcgacgacgtggccctgctgtcgcgcggctaccattccctcgccggctctttctgggaccgcgtgagcaaggtcgagacccgccaggaccacggccgtacctggcatcgcgtgcagctcaccgacaacctgccggcggtgcacatcaacgagttcatcgtcgacgaacagggcttcgtcggctggatcaagggcatccagcaggacgagctgaccatcctcgacctgcaccaggagccgctcctgcaccaggaagcctggggcctgcggccacgcgacgtgtaccagtcgctggcgctgtacgcgctgctcgacccggacatccacctggtcaacctgtccggtgccgccggttccggcaagaccatcctggcgctcgccgcggccatcgagcagaccatggtcagcaagcgctaccggcgcatcatcgccacccgcagcgtgcagggcctggacgaggacatcggcttcctgcccggcaccgaggcggaaaagatggagccctggctcggcgccatcaccgacaacctcgaagcgctgcacatggacgacgaatgcacccatggcagcgtcgactacatcctcagcaaggtgccgttgcagttcaagtcgctgaactacatccgcgggcgcagcttccagcagagcctgatcctcatcgacgaatgccagaacctcacgccgcaccagatgaagaccatcatcacccgcgccggcagcggttcgaaggtgatctgcctgggcaacctggcgcagatcgacacgccctacctgtccgccaccagctccggcctgacctacctcaccgaacgcttcaaggacttcccccacggcgtgcacgtgaccctgcaaggggtgccgcgctcggtgctggcggagtacgccgaggcgcacatgtgaggtag

SEQ ID NO: 3840 - DNA, 726 bp, Pseudomonas aeruginosa
ccggcggcaatcgccggccgatatcccgcccggttgaaaaagccgggcgggatatacatcctgccaggcccggtccggggaccgggcccgcatcgttacccgatcgggatgaggcgccttgcgccggcctgccctacctctttatgtatacaatcatcccccttccgaacctcccccaggcatcgcgtcatgccctccagggcttacaatgactggccagtatcctcttccaggagcacccacgtgctgacccatctcgattcccagggccgcgccaacatggtcgacgtcacggaaaaggccgtgacctcccgtgaagccacggccgaggccgtggtgcgcatgcgcccggaaaccctgcaactgatccaggacggtggccatcccaagggcgacgtcttcgccgtggcgcggatcgccggcatccaggcggccaagcgcacccacgaactgatcccgctgtgccatccgctgctgctcaccagcgtcaagctcgaactgcaggccgaggcgccggacgccgtgcgcatccgcgcgcgttgccggctggccgggcagaccggcgtggagatggaggcgctcaccgccgccagcgtcgcggccctgaccatctacgacatgtgcaaggcggtggaccgcgggatggtcatcgagcaggtccagttgctggagaagctcggcggcaagagcggccactaccgcaaagaggaggaagggcaggcatga

SEQ ID NO: 3841 - DNA, 549 bp, Pseudomonas aeruginosa
tgtgcgcgcgcaatcaggaactgtgcggcctcgacgagccgttgcaggacggcgacgaagtcgccttcttccccaccgtcaccggaggttgaacccatggccatccgcgtccagcaggcagctttcgatccggggcaggagcttaacgccctgcatgcgcagaacgtcggcatcggcgcggtggtcggcttcgtcggctacgtgcgcgacttcaacgacggtcgcgaggtcggcgggatgttcctcgaacattatccgggcatgaccgagaaggccctcggcaagatcgccgccgaggccgggcagcgctggccgctgctgcgcctggagatcctccaccgcatcggccgcctggagccgggcgagccgatcgtcttcgtcggttgcgccagcgcccaccggcaggcggcgttcgacgcctgcaacttcgtcatggactacctgaagacccgcgcgccgttctggaagaaggaagacaccgccgaaggcccgcgctgggtcgaaggccgctgcagcgaccaggccgccgcgcagcgctgggaggagtga

SEQ ID NO: 3842 - DNA, 1617 bp, Pseudomonas aeruginosa
catctaccagatccgcgcggtggtctcggcctggatcgccgaccccgaggtacaggtcggcctgatcaccggcggcaccggcttcaccgcgcgggacaacaccccgcaggcggtcgggccgctgttcgagcgcgatgtcgagggcttcggcgaactgttccgccaggtctcgcagcgcgagatcggcacttccaccatccagtcgcgggcgctggccgggctcagcaacggtaccctggtgtgctgcctgcccggctcgccgggcgcctgtcgcaccgcctggaacgagattctcctggcgcaactggacagccgcacccgcccgtgcaatttcgtcccgcacctgaagaccccgccagccgtggcgccggtggccggctgcgggtgccgctcgtgagcgcttgcgcctgcgatggcggccaactgcgcccgctcgacgaggcgctggccgaactgctggcgcgcgcgccgcgcccgccagcctgcgagagcctggccctggagcgggcgctgggacgagtgctcggcgaggacctgctggcgccgatggacctgccgcattgggacaacagcgcgatggacggctacgccttgtgctccgccgacctgccgcgcagcggcggcagcctgacggtcggcgcgcggatcgccgccggcgacacccgcggcatgagcctgccgctgggccaggcggcgcggatcttcaccggcgcgccgctgccgaccggcgccgactgcgtggtgccgcaggaactctgcgtggtcgacggcgagcgcgtgcagttgccgccggtgagcgccggccagcatgtgcgccggcgcggcgaggagttgcgtcgtggcgcgccggtgctgcgtgccggacagcgcttgcgcccgcaggaactcggcctgctggcgagtctcggcgtcgccacggtctcggtgcgtcggcgcttgcgcatcggcctgctgagcagcggcgacgaattgcgcgagcccggccagacactgttggccgggcagatctacaacgccaaccgttactgcatcggcgccttgctgcgcggtctgggcttcgaggtgcacgacgaggaagtgctcgccgacgaactggtggccagccgcgatgcgctcagcctggcggcctccgaatgggacgcgctggtcaccagcggcggtgtctcggtaggcgaggaagaccacctcaagcgcgccatcgccgagcttggcgaggtcaacctgtggcgcctggcgatccagccgggcaagccgttcgccttcggctccgtggccggcaagccctggctggggctgcccggcaaccctgcggcggcgctggtcaccgcattgctggtggcgcgtccgttcctgcttcgccagcagggactgttcgacgtagtgccgcggccgctggcgctgccggcggccttcgactggccgcaaccgcgggcgcgtcgccagtacctgcgggcgcggctcgatgaacgggggcgggtggaaatccacccgcagcagggctcggcgatgctgcttgccgccagttgggcggacgggctggcggtgatcgagcgcggcgccaccctgggcgtgggtgatgcgatcgactttctgccgttctccgcactgatggcctga

SEQ ID NO: 3843 - DNA, 1110 bp, Pseudomonas aeruginosa
ggccttcttgatcccggtcaagcgccgaccgggagcgtctttctagagtgtggcgcctgtgccccggggttgcccactgccgcggagcgcgtttttcgccagaggagcaaccccatgcaactggtctgtccggcgggcagcctgcccgccttgaagtcggccctgcgacagggcgccgatgccatctacgtcggtttccgcgacgacaccaacgcccgccatttcgccggcctcaaccttgacgaacgccagttgcaggaaggcctgcggcgagtccacgaggccgggcggcagctctacgtagcggtcaacacctattccagcgcgcagggctgggagcgctggcagcgcgcggtggaccaggccgccgacctcggcgtcgatgcgttgatcgccgccgacgtggcggtgctcggctatgccgcgaagcgtcatccgcggctcaacctgcatctgtcggtgcagggctcggcaaccaatgccgcggccctggccctctatcacgaacgctacggcatccgtcgcgcggtcctgccccgcgtgctatcgctggcgcaggtacgccaggtggcggccggtagcccggtgccggtggaggtgttcgccttcggcagcctgtgcatcatggccgagggccgctgccacctgtcctcctacgtcaccggcgagtcgccgaacctctgcggcgtctgttcgccggccagggcggtgcgctggagcgaggaaccggaggggttgacctcgcgcctcaacgaagtgctcatcgaccgctacgccgccggcgaggcggccggctacccgaccctctgcaagggccgtttcctggtcaatggccagcgcttccatgcgctggaggaaccgaccagcctgaacaccctggacctggtcccgcaactggcggaaatcggcgtggcggcggtgaagatcgaaggccgccagcgcagcccggcctacgtcgagcaggtcacccgggtctggcgccaggcgctggacagctacgccagcgcgccgggcgcctatagcgtgcagccgcaatggcagcgcgcgctggccggactttccgaagggcaccagaccaccctgggcgcctatcaccgttcctggcagtga

SEQ ID NO: 3844 - DNA, 1623 bp, Pseudomonas aeruginosa
cgcccctgtcaacttgccccggtaaaccggaccttcgtgaagcctgcggagaactccggtatgagtgggatggacctcaagcgccgccgcgtcgtgcaaggcctgggcgctggactgctgttgccggcgctgggcgcgccggcggtgatcgcctcgcccagggcgcggccgaagctgaccgatggcgtgcaatccggcgatgtgcagggcgaccgcgcgctggtctggagccgcaccgaccgcccggcgcggatgatcgtcgaatgggacacccgtagcgtcttcagcgagccgcgtcggctggtctcgccggtcaccgacgagcgcctcgactacaccgcgcgcatcgacctgcgtggcctgccggccgaccagtcgatcttctaccgggtgcgcttcgaggatgcccgcgacggcagcctgagcaagccctggttcggccacctgcgcagtgcgccgagcgaggcgcgcaatatccgtttcgtctggagcggcgacacctgcgggcaaggtttcgggatcaatccggatatcggcggcatgcgtatctacgaagccatgcgccggcgccagccggatttcttcctgcacagcggcgacaccatctatgccgatgggccgatccccgaacgcatcgagaccgagagcgggcgcatctggcgcaaccgggtgaccgaggccaagagcaaggtcgccgagaccctcgacgagttccgcggcaactaccgctacaacctgctcgacgacaacctgcgccgcttcaacgccgaggtgccgcagatctggcaatgggacgaccacgagaccaccaacaactggtcctccagcaagcagctcgacgagcgctaccaggtgaaggacatcgacgtgctggcggcccgtgcacgccaggcgttcctcgaatacgcgccgctgcgcttccagcgccaggggcgcgacgggcggatctaccgcaaggtcgcctacggccctttgctcgacgtgttcgtcctcgacatgcgcagctaccgcggcggcaacagcgccaacctgcaggcgcggcgcagcgccgccaccgatttcctcggccgtgaacagttgcaatggctcaagcgcgagttgcgcggttcgcgcgcgcagtggaaggtgatcgccgccgacatgccgatcggcctctgcgtgcccgatggcaaggacgcccagggccgcgaccgctgggaggccatcgccaacggcaacgacggcgccgccctcggccgcgagctggagatcgccgacctgctgcgcttcgtccagcgcgccgaggtgcgaaacaccgtctggctgaccgccgacgtgcattactgcgcagcccaccaatacagcccggagcgtgccgcgttcaaggacttcgcgccgttctgggaattcgtcgccgggcctctcaatgccggtagtttcggacccaacgcgctggatggcacgttcggcccgcaggtgatgttccagaaggccccgctggtccagaacagttcccccttcgccggctaccagttcttcggcgaggtggagatcgatgcgcaaagccgcgcgctcaccgtcaccctgcgcgacctcgacggcgagccggtgttttcccaggaactgcagcccgacggcgcctga

SEQ ID NO: 3845 - DNA, 2355 bp, Pseudomonas aeruginosa
aggagtatcccgatgcaccccttgcgtaacgccgccctgctgggcggcctggccctgctgggcctgccggtggccaacgccgccgagctgatcatctccgagtatgtcgaaggcagcggcaacaacaaggcgctggagttctacaacagcggcagccaggtcctcgacctctccgcctaccgcgtcgagttctatttcaacggcgccagcgcggcgggccgcagcatcgacctgagcggcagcctggcgccgggcaagaccttcgtcctcgccaacggcgtggccgacccggcgttgctggcgctggccagccagcgggtggaaggcagctggttcaatggcaacgatgcggtgctgctgcgccggcgcagcggcgagatcctcgacagcctcggccaggtcggcttcaaccccggcacgacctggggcagcggcgatgtgcagaccctcgaccggagcctggtgcgcaaggccgacatccgcgacggcgacagcgatcccagcgacgccttcgacccggcggcgcaatggctgggctacccgcgcgacaccttcgccaacctcggccagcatggcgctggcgagcccggcggcggcgaggaggccggcctgcgaccgatccacgaggtgcagggcgccggcgccgaaagtccgctggtgaaccagcgggtcgccatcgagggcgtggtggtcggcgacttccagaacgccagcgagctgaagggcttctacgtgcagcaggaagatgccacggtggacggcgacccggcgacctccgaaggcatcttcgtctacgacggcggcaacggcagcgacgtcaagctcggcgaccgcgtccgggtgaccggccaggtccgcgagttcaacggcctcaccgagctggtcgggccgctgcaggtcagcgtcctggcgagcggcgtggcgttgccgacgccggccggcatcagcctgccgctggccagcgccgatgcgctggagcgctacgaaggcatgcgcgtgcagctccgccagacgctgaccgtcaacgaggtctacaacctcggccgctacggcgaggtcctgctgtcctccggcggccgccagatgactccgaccaacgtggtggctcccggcgaacaggccaaggccatgcaggcgcgcaacgacctcgaccggattctcctcgacgacggccgcagcgggcagaaccccgacccgatccgctacccggcaccggaactgagcgcctacaacagcctgcgcgtcggcgaccgtaccagcgccatcgacggcgtgctcgactactcggccggcagctaccgtatccagccgttgcagacgccgaccttcgaggcagccaatccgcgtccggcccagccggcggtggaagggcgcctgcgggtggccagcttcaacgtgctcaactacttcaacggcgatggcaagggcggcggtttccccacctcgcgcggagccaacacggccgaggagttccaacggcagaaagcgaagatcgtcgcggcgatcctcgcctcgaaggcggacatcgtcggcctgatggagatcgagaacgacggctacggcgagttcagcgccatcgccgacctggtcaacggcctcaacgccagcctaccccagggccagcgctatgccttcgtcaacccgaaccgggcgaagctgggcagcgacgaaattgccgtggggctgatctatcgcggcgacaaggtccgcacctatcgatccgcggcggtgctcgacagttcggtgaacccggagttcgacgacacccgcaaccgtccgaccctggcccagaccttccaggagatcaatggcggcgaacgcctgaccatcgcggtgaaccacctgaagtcgaagggctcggcctgcgacggcgacccggacaccggcgacggccagggcaactgcaacctgacccgggcgcgcgccgcccaggccctggtggactggctggcgggcgatccgacgggcgccaaggagcctgatcgcctgatcatcggcgacctcaattcctatgccaaggaagacccggtgaacgtcatccgcagcgccggctacaccgacctggtggcgcgtcaggcgggcgcaggaaagggctattcctacgtgttctccgggcagtccggctaccttgaccacgccctcgccaacgccagcctggcgcgccaggtacgcggcgcggtggagtggcacatcaacgccgacgagccccgggtgctggactacaacgtcgagttcaagacccctcggcagcaggacagcctgtacaacgccgagccgtaccgggcctccgaccacgacccggtggtgatcggtatcgacctgcgccgggtggcgatgaagaagcaccgcaggtag

SEQ ID NO: 3846 - DNA, 504 bp, Pseudomonas aeruginosa
tcctggaagcgttgttccgggctgtccgccagcggccggcgcatgtgtgcgagaaacgccggcgtgtcctggaaagcggggaaggccaggccgtgcagaagaaagcgttcgatcgtcccgggctcttcgatacccagttccagcgccgtcgcgcgcagctcgccgagttgccggatggcgggcagcaggccgcgtcgttcgagccaggcgggagcctcccggcgtacctccagcaggacccgctcgatgacttcgtcgtcgcggacccgctgcaggcgatccagttggccggcatccagttcaagcatcggcggtccgctccgtttcccggtcatagacgaggtagccgccctgcaggggctgccagacctgccaacgctccagcggcgccatcacttgcgtccattgccgcgcggtcatgacctgttccagcgcccggcgcacttccgggctgtagtagcgcaacagcgcccggcggccgtcgggcatgcgggtgaagagtag

SEQ ID NO: 3847 - DNA, 1896 bp, Pseudomonas aeruginosa
agggatttcctacctggaagtctcgtcacccgcctgcgaaaggcgcaggcgtacggagcgatggggaggggagcctgggaggagggaaggaggcgtttcgcacagcgtcgcgttcgctttgcctgcgcaggggctgtccgccgataccgcgctggagcgacggatagccgcgatacggttatccgccctgcgccgagaccgccgcgggaggagacagggaggctgttcctggctcctcccgtgcgatcagtgatgctcgcgcgtcgcgcggaagcggatgtccggccagcgttcttccatcaggctgaggttgacgcgggtcggtgccaggtaggtgaggtgcccgccgccgtccacggagaggttctcgaaggccttgtccttgaactccttgagcttcttctcgtcgtcgcactcgatccagcgtgccgaccagacgttgatcgcctcgtaggcgcactcgaccttgtattcctccttcaggcggctggcgaccacgtcgaactgcagtacgcccaccgcaccgaggatgatgtcgttgttgcgctcggggaagaacacctgggtcgcaccttcctcggccagttcctgcaggccctggcgcaactgcttggatttcagcgggtctttcaggcgcacgcggcggaacagttccggggcgaagtgcgggatgccggtgaaaccgaagttctcgccttcgctgaaggtgtcgccgatctggatggtgccgtggttgtgcaggccgatgatgtcgccggcataggcctcttccagttgctcgcgctcggaggagaagaaggtcagcgcgtcggcgatcttcacgtccttgcccaggcgcacgtggcgcatcttcatgcctttctcgtacttgcccgagcagatgcgcatgaaggcgatgcggtcgcggtgcttgggatccatgttcgcctggatcttgaacacgaagccggagaacttctcctcggtcggctccacgctgcgttcgtgggtggcgcgcgacagcggctgcggcgcccagtcgacgatgcagtcgaggacctggtcgacgccgaagttgcccagcgcggtgccgaagaacaccggggtcatctcgcccttgaggaaggcgtccttgtcgaattcgtggcaggcgccctgcaccagctccagctcctcgacgaaattgtcgtagagatcgccgaggtgggcgcgggcttcgtcggagtcgagcttttcgatgaccttggtctcgatgcgctcgtggccgtggccggggacgtagacgatgatcctgtcgtcggccaggtggtagacgcccttgaagtccttgtagcagccgatcggccaggtgatcggcgcggccttgatcttcagcaccgcctcgatctcgtcgagcagctcgatggggtcgcggatgtcgcggtcgagcttgttgatgaagctgacgatgggcgtgtcgcgcagccggcagacttccatcagggcgatggtccgcggttcgacgcccttgccgccgtcgagcaccatcagcgccgagtccaccgcggtcagggtgcggtaggtgtcttcggagaagtcttcgtggccgggggtgtcgagcaggttgatcatgtgctcgcggtaggggaactgcatcaccgaggtggtgatggagatgccgcgctgcttttccatctccatccagtcggacgtggcgtggcggtcggacttgcgcgacttcacggtaccggcgacggcgatcgccttgcccatcagcaggagcttctcggtgatggtggtcttaccggcgtcggggtgggaaatgatcgcgaaggtacggcgcttcgcgacttcggcggcctgagtggtcatggatgcgtgcctgctggaatccgttggcgtgggcgcgggacggcccggaaaaacgcgggattatag

SEQ ID NO: 3848 - DNA, 1245 bp, Pseudomonas aeruginosa
ctggccgctgtcggcgcgggtccagtagcgcagctcgtggctggcttcgttgacgtagcggtggccgatgcccacttcgtggcgactttcgcccagctcgaagccctggctgaaacgggtttccaggccgcgtacccagtactcgcgcggcgacagggtgaggttgcggccctggtcgaggtagccgctgcgcagggtcttggtgaagaagccggtgacgttgagcttctggctggcgttgggggtgtattcgtagctggcgctggccagggtacggcggccccagaacttgtcgtagggacgggtcgactggtacgggtcgtcgcggtaggccgcggtgccgaggccgccgggcatgtcggcctcgccgtcgtagtactgggtcatcgccgaaaacgtgtgttcgtcgctgggctggaagcggcccttgaggatcaggtcgtcgatccgcgtatcgctgtgctcgcgccaatcgccgccgcgggtgccggagtagagcagggcgccgccgaggccgttggcgccggtgccgccgatcagcacgttgtgggtggtcttcaggccgtcctggctggagctggggctgagttcgctgtgcacgtcgagcttggtggcgaagtcctcggggatcgcccgggtcacgaagttgacgatgccgccgacgttctgcggcccgtagcgcaccgcgccgccgccgcggaccacgtccaccgcgtccatgttgccgatggacaccggcgccagcgacaactgtggctggccgtagggggcgaagggcaccgggataccgtccatcagcaccgtcgagcgcgacgccaggcgcgggttgaggccgcgaatgccgaagttcaatgccaggtcgtggctgccggtgccgttgttgagcggcgcgctgaccccgggaatgcgctccagcacttcgcgggtgctggccgcgccttgggcctggaactgctcgcggcggaccacgtcgcgcgcaccgggatgctcgaagacgtcggcggcgctggcgtcggccagccagtcgccgaccacggtgagcgcctgcaggttggccgggtcttccaccggcagcgcctccagggtataggcgccgtcgccgcgggcgcgcgcctccaggccggagccggcgagcagggcggccagggcttcctccagggtgtactcgccgtccagcgcctggctgcgccgcgcggcggtctgttccgggctgaaggcgatcagcacgccggcctggcggcctag

SEQ ID NO: 3849 - DNA, 438 bp, Pseudomonas aeruginosa
cgcgccgtacctccacgggcagcaccgccggcagggtggcgaggatccgctcgctatcgtccagcggatagctgccggaaatccgcaggccgccgatgcgcgggtcgcagcccagccggccggggcggtagcgcgcgacttcggcgaggaattcgtccaggcgcatgccggcggccaccagcatgccgtcggtccaggcgccgctgccgaccggcagcggctgcggagcgccgagtcgctcgcggtcgaagtccagctgccggccgctgggcagcagcaggccctggccggcgtggttctccacctgcaccgcgccttcgtggacggcgacgcgggtgcgtccggcgaactggcgcacgtcgaaccgggtgcccaccggtcgcagccggccttccgcgctgtacacgtgcagcgggcgcgggtcctggccggtgctga

SEQ ID NO: 3850 - DNA, 978 bp, Pseudomonas aeruginosa
aaagcgcaagaatggacaatggtcgcgcccggcctcgcccgcagactgacggcatcctgtcgttgcggagtcgccatgaatctttcgctgtacctgctcaccgtgctcatctggggcaccacctggatcgccatcaagctgcagatgggcccggtggcgatcaccctgtcgatcgcctaccgcttcgccctggcggcgctggtgctgttcgccgtgctgctgctcggccgccgcctgcaaaggctggacgcacggggccaacgcctgtgcatggctcagggcgtatgcctgttctgcctgaatttcatctgcttctataccgccagccagtggattcccagcggcctggtggccgtggtgttctccaccgccaccctgtggaatgcgctgaacgcccgcctgtggttcggccagcgcatcgcgtcgaacgtgatggctggtggcggtctcggcctgctcggcctggggctgctgttctggccggaattggtgggtcaccaggccaccccggaaaccttctacggcctcggcctggccctgctcggcacgctgtgcttctccaccggcaacatgctttccagcctgcaacagaaggccggcatccgcccgctcaccggcaatgcctggagcatgctctacggcaccctgatcctcctggcgctgtgcctgttccagggcgtgccgctgaatttcgactggagcgcgcgctacgtcggctcgctgctgtacctggcgatccccggctcggtgatcggcttcaccgcctacctgaccctggtcgggcgcatgggcccggatcgcgccgcctactgcaccgtgctgttcccggtggtggcgctgaacatctcggccttcgccgagggctaccgctggaccgcaccggcgctggccgggctggtcctggtgatgctcggcaacgtcttggtgttccgcaagccgaaggcgccggcgctggccgggccggcgcgctcgacctag

SEQ ID NO: 3851 - DNA, 1350 bp, Pseudomonas aeruginosa
ccgaccgagacgctggagatgacttccagctgcatcgcctgttccagttgcctggcgccgagcggccggccgacgccgatcatgccgtgggtatcgggcagggcggcggcgtactgggcgtcgatgtcgccctgtttcggttcgagcacgcggacgttgaactggcattgcaggcgttcgagatgctcgggggcgaggcgactgaagacgaagacgttctttttcatgacgggactctgcaagcgggagcgaaagcgccgaccataccaccgccatcgaagcggcgggcaggggcccgccactgggcgggcgattatcggctcaggagggtcttccgagttccaggcccagctccaccagcgccgcttcgtcgcgctggagcaggccgggcaggctttccttgaggtattccacccaggtcttgatcttcgcgtcgagatactgccgcgaagggtacagcgcatagacgttgagctgttgcaggcggtgttgcggcaggacccgcaccagggtgcccttgcccaggtcctcgatggccgaatacaccggcaggatgccgatgcccagtccggagcggattgcctcggtcatggcgtcgccgacattgacctggaacggcgaggcgccgatggagaccatttcctggccgttgggaccgtcgaacagccagcgatccagcggcaccaccgggctgaccaggcgcaggcagtcgtggctggccagctccgaaggctcgctcggcgtgccgttcaggcgcaggtactccggcgaggcgcaaagaatgctgtaggtctcgccgatgcgctgggaaatgaagccggaatcgggcagctcggaggccaccacgatggccacgtcgaagccctcgtcgagcaggtccggcacgcggttggccatggtcaggtcgaaggtcacgtcgcggtactgctggcggtagccggcgatggcgcggatcacgtagtgctggccgatgccggtcatcgaatgcagcttcagcttgccggcgggtcgggcatgggcgtcgctggcttcggcctcggcttcctcgacgtaggcgaggatctgctcgcagcgcagcaggtagcgctggccggcctcggtgagggcgatgcgacgagtggtacggttgagcaggcgggtgcgcaggtgcgtctcgaggttggccaccgcccgcgaaacataggcggtggtggtgttgagctgctgggacgccgcggtgaagcttccggtttccgccacgcagacgaaggctcgcatgttttgcagggtgtccatcgacggggcctcctaggcacgcgcagaagtgtgtcagattgttgcgagggcggattatttcacattacgcaataa

SEQ ID NO: 3852 - DNA, 681 bp, Pseudomonas aeruginosa
tccgcctgcattcggtggacatccagaaggacttcgccgcgcaatcggtggcttccgcgcagaagacctacgatatcgccaccctggcctaccagcgcggcctcaccgattacctcaacgtgctcaacgcgcagacccggctgttccagcagcaactggtccaggagcaggtgcaggccgcccggctggccgcccacgccagcctgctcaccgccctcggcggcggcgtcggggccggcgccgatacgccggcgcagcggaagctggcgccggagaacgtcccggtcagagcggtgtcttcgcgatgagtggccgctccgctggtttcgccctgcccagccgcgacgagtggcggcgcgcgctggccgagtgggcgcgcagcgacggggcgacctggatctacgtgttcaaggtgctctgcgcggccttcctgaccctctggctggcgatgcgcctggaattgccgcagccgagcacggcgaccatcaccgtgttcatcgtcatgcagccgcagagcggccaggtgttcgccaagagcttctaccgcatcctcggcaccctggtcggcctcagcgtgatggtcaccctgatcgccctgttcgcccaggagcgagtgctgttcctgctcagctcggcgatctggatcggcctctgcaccgccggggccgcccgctaccgtga

SEQ ID NO: 3853 - DNA, 1122 bp, Pseudomonas aeruginosa
ggaaatgcacgactacgccctgacccatgcctcgctggccgcccaccgccacgagcgcgagcagtggaaggacgccttcaccgccaaggccaacgcggtggcggcggcagtggcggggatgcgcaccgggttgatgatcctgctgttcggctgtttctggatctacagcacctggcccagcggcggcaccttcgccctcaacgcggtggcggtctcggcgctggcttcggcggcgccgaacccgaagaaggtcgccatgcagatgggcatcggcaccatggccggcggggctggcttgggctttccgcgggctgttcttcgttctaccccattatcgacggtttcccgctgctatgcctggtactggcgccggtgttcgccctcggcgcgttcatctcctcgcggccgcagtgggccggctacggtctcggcctgctggtgttcttctgcttcggttcggtgccggcgaacctgaccgtctacgacccggcccacgtgatcaacgagtacatcgccctgatcctctcgatgctgctctcggccgcggccgccgcggtcattctgccgcccaacagcgcctggctgtggaagcgcctcgagcgcgacctgcggatgcgcgtggtgttcgccatcagcggcaggagcagggggcttggctcggccttcgaaagcggcacccgcgacctgctgaaccaggcctatggcgtcgctgccgggcgcccggacgtgcagcgcgggctgctgcgctggatgttcctggtgctcgaggtcggccacgcgatcatcgagctgcgtcgcgagcaggagcgcctgccggacgaaccctgctacgccgaggccatgccctggcgccaggcgatccgcgccatggggcgggccctgatccggctgttcgtgcgccccggtgcggagaacctggagcgcgccctggcggctgtcgaccaggccatccacgcggccaggcacaccgacgaaccctgcgcgccgcacttcgacagctcgccgctacggcgggtgcgcagctacctgcacttcatccgttcttccctgctcgcgccgacctcgccactgaccgaactggccggccggacgagcggccaaggtaccgtccatgcctcgtga

SEQ ID NO: 3854 - DNA, 699 bp, Pseudomonas aeruginosa
gatggtggtctcccgcgaaagccgcgacgacgcccacaacaccgccgccgcggcgatggccgactacgagcaggccaaggcccagctcgacgccgcgcgcctgaacctggagcgcacccgggtggtggcgcaggtcgacgggtacgttaccaacctcaacgtgcaccgtggcgactacgcgcgggtcggcgaggcgaagatggcggtgatcgacaagaactcctactgggtctacggctacttcgaggaaaccaagctgccgtacatccgcgaaggcgacccggtggacatgcagctgatgagcggcgaacacctcaagggccacgtggaaagcatcgcccgcggcatctacgaccgcgacaacccggaaagccgcgagctgaccgccgacgtcaaccccactttcaactgggtgcgcctggcccagcgcgtgccggtgcgggtacacatcgacgaagtgccggacggcgtgctgctctcggcggggatcacctgcacggtgatcgtcaagccgcaagggcgcgacgaccaggcctcggcggcgcaggcgccggggcgggccggttgagtggaaggggcagggagaagcccggcggatgccgggctttttcgtttcggcggggcggaagagggcgccactcgccaggaatacgctgcggttggcggctgccggcggtgaatatccacccggcggcctag

SEQ ID NO: 3855 - DNA, 447 bp, Pseudomonas aeruginosa
cgccggtcgttctcgtccatcagttccagcgcctcggccaccggggtctgcggccgggcggtgaccaggctgctgtcggcggcgtcttcggcgcgcaccaggagcaggcgcttgagcgtgctgtcctggccggtgaaggcgctgacgaactcgtccgccgggtgcgccagcagggtgtccgggtggtcgtactggagcagccggccgctcttgaacaccgccaccttgtcacccagcttgatggcttcgtcgatgtcgtggctgaccatgatcacggtcatgccgagcttgcgctgcatttcgaagaactcgttctggatcgactcgcggttgatcggatcgaccgcgccgaacggctcgtccatcagcagcagcggcgcgtccgccgccagcgcgcggattaccccgacgcgctgctgctggccgccggagagttcgcgcgggtag

SEQ ID NO: 3856 - DNA, 609 bp, Pseudomonas aeruginosa
ccgatgtggcggcgcagggtgacctcgtcgaggtccgcggtgtcctggccgtcgatcagcacgcggccggaggtcggcgggatgatccggttgatcatcttcagggtggtggtcttgccgcagccggaggggccgaggaagacgcagatctcgcctttctccacggtcaggctgatggaatcgacggcgcggaactccttgccgttcttctgggtgaaggtcttgctgagcttgtccagttcgatcatgttcggctcctgtcagtgcgcgctggcgcgcagtcccttgggggtgaggatgcgttgcagccattgcagcagcaggtcggcggcgatggccaggaggctgaccagtaccgcgccgaccaccagcatcggcatgttgctctggctgatggaagtgaggatcagcacgcccaggccgccggcgccgatcaccgcggcgatggtcatcacgccgatgttcatcaccacggcggtgcgtacgccggcgaggatcaccggcaccgcgaggggaatgtcgaccatccgcaggcgttgccagaaggtcatgccgatgcccttgccggcctcgcggatgcccgcttcgacgccggtcagggcgaggtag

SEQ ID NO: 3857 - DNA, 1077 bp, Pseudomonas aeruginosa
cagggcgaggagcgccgtgcaggcggcgccgagcagcagttgctggtggttgttcaggtaaatgccggggaagatcaggctgcccaggctgttggcgccgatcaggaacgccagcggcgcggagccgacgttcagcgccagggccacgcgcacgccgccgacgatgatcggcaccgcgttcggcagttccaccctcagcagcacctggttgggcgtcatgccgatgccggtggcggcttccttcagcgccggcgagacattgcgcaggccctcgtaggtgttgcgcacgatcggcagcagcgaggcgaggaacagggcgaggattgccgggccgttgccgatgccgatgatcgccagggcgatggccagcaccgccagcggtgggatggtgttgccgacgttgaacacctgcatcaggcgttcggcctgggcctgcatgccgggacggctgagcaggatgccggccggcacgccgaccagcagggcggccgccatcgaactgaagaccagcaccaggtgggcctgcaagtagaacagcaggtcctcgcggtagtggaggatggtcgcgggggtgatccagtggatcagcaaggccagtacggcggctgcggcgcagaggccgagcagggccttgccacaggttttcaccatggtcgggactcccttcggaatgagcgttggctacgctgtcgggcgcttcgtcgaagcgcggaaacaggccggaaatcaaaggcttcggatgggcaccgaattcccgaccctgaaagggttgaccgttcgtcgttcgcggaggttcaacgaaacggccatgcttgtgccatgaccgggcctgggcaagcggccgcagccgccgtctcgcctgggctggcggcgaacgaagaaattttccccggggaagcggtcgataatggcgctgccgcgtcggcggcgcgccatgcaccgtatcggtgcgctggacgtccagggcttttctgcggttatgatgcgggttccgaaattttctcgggcttttccagacattcgcaccccacggttcacggatcggccttttggggtaggtgttttaccttctgctaa

SEQ ID NO: 3858 - DNA, 1437 bp, Pseudomonas aeruginosa
gggagtaccccgcgtcatgctcgatctcgtcgcggcattcattgccttgaccaccttgctcacctacgtgaactaccgcttcatccgcctgccgccgaccatcggcgtgatggccacggcgctggtgttctcgctgatcgtccaggggctgtcggaactgggctatccgatcctcgaggtggagatgcaggaaatcatccgccgcatcgacttctccgaagtgctgatgacctggttcctgcccgcgctgctgttcgccggcgcactgcacgtcgacctctccgacctgcgcagctacaagtggccgatcggcctgctggccaccgccggggtgctgatcgccaccttcgtcatcggtggcctggcctactacaccttcccgctgttcggctggcaggtggatttcatctactgcctgctgttcggcgcgctgatctcgccgaccgaccccattgccgtgctcggcatcctcaagtccgccggcgcgccgaaaccgctggcgaccaccatcgtcggcgagtcgctgttcaacgacggcaccgcggtggtggtgttcgccatcatcctcggcatcctccagctcggcgaggcgcccacggtcagcgccacggcgatcctcttcgtccaggaagccatcggcggcgtggtcttcggtgcggtgctcggctacggcgtgttcgtgatgatgcgcggcatcgaccagtaccaggtggaggtcatgctgaccctcgccctggtcatcggcggtgccgcgctggccgcgcgcctgcacgtatcggcgccgatcgcgatggtggtggccgggctgatcatcggcaaccacggacgccactacgcgatgtcggacgagacccggcgctacgtggacaagttctgggaactgatcgacgagatcctcaacgccctgctgttcgccctgatcggcctggagctgctgctgttgccgttctcctggctgcacgtggcggcggccttcgccctaggcggcgcggtgctggtctcgcgcctgctcacggtgggcccggcgatcctggtcctgcgccgtttccgtggcgccaaccggcaggtaccggcgggcaccatccgcatcctggtctggggtgggctgcgcggcggcgtctcggtggcgctggcgctgtccctgccgttggggccggagcgcgacctgatcctcagcctgacctacatcgtggtgctggtatcgatcctgctccaggggctttccatcggcccgctggtgcgtcgtatctacgccggccagccgctggagaaaagcgagggggcgcactgagcgcagccttcgcaaagcgagcgcccgccgtcatggcgggcgttttcgttggcggccatcaggcgctgtcctgtggcgcttcgttgcgatgggtgccgcgcaggttcatcgccgccaggcagacctgcagcaggatcagcgcatag

SEQ ID NO: 3859 - DNA, 1632 bp, Pseudomonas aeruginosa
ctcaggcgcagttcctggcgttgcaggtggcggctttcgtcgttgtcctgccagatcacccaggccgccaccaggcccagcccggcgagagccgccagggagaccggcagggccttggccgggtatcggacgaggaggatgacccaggtgaggaccagcagcgcaccgatcagcattgaaatgtcctttcttcgaagccgaggggacatcctagcgcactgctgcgtatcgcaggcggtacgggcacgcttacgcggcggaggcgccgcgatatgcgcaagggaggccgaaagtcggggatgcgggtttcggcaggctggggatagccgccgcccccggcctcgccggtcattcgcagcggcgcttgccgcccggcgtcagcagacgctccagctcgacgaacaggcgctcggcgtcctgcgcctcgcagtcctcgccgtagcgcttcttcaggccgtgttcgctgagggtcaggtgcagggtcgggactacctcgtggcgcgccaggcagcctttcacgcaatgcagcgggcaaccgtcgagggccaggatcggtcgcccggagcgggcccggcggaccagcagcgggacgtcgccgccgactccggcgatgcaggacatctccgccagccgggcgcgatccaggcgcagcgcgagatcgttggccagttgcgccacgttggagcagccggagcaggcgtagaccaggggaaggggatcgtcggggctgcgttcgaacatcatgacgggcgcctcgtggaaggaagccgccagtatcgacgcagcgccgcggtggatttcttgaccggaatcaagcccgcgcgcggctcacaccaggtcgttctccaccgcccacaccgcggcctcgacccgcgaacgcatgccgagcttgtgcagcacccgcttgacatggaccttcaccgtgccttcggtgatgtccagctttcgcgcgatcatcttgttgctgtagccgtgggcgatctggcggaggatctgccgttcgcgctcggtcagctcgtcgaggctcttcgagcggtcgtcgccccgcagggcctgggcgaggatctgggtcaactgcgggctgagggtcatctgtccggtggcggcctggcggatgtgctcgagcaggcgctccggctccatgtccttgagcaggtagccgtcggcgccggcgcgcaggacgttgaccacgtcgcccttgtcgtcggacacggtgaacaccacgatgcgcgcgtcgactccggcctcgcgcaacgcgcgcagggtgtccaggccgttcatgcccttcatgttcaggtccagcaggatcatgtccgggtccagctcggcggccaggcgcagggcttcctcgccgctgccggcctcgccgaccacgctgaggtcgtcttccagttcgagcaactgggcgacgcccttgcgcatcatcggatggtcgtccaccagcagcaggcgaaccggttcgtcggcggtggctggcatgtccgtcatggggtcggctccttggcggcggagggttgcagggcggtcggcacgaagctgaagagcactcgcgtgccgtggggcgcgcgcgcttcgaagcgcaactggctgccgagggtctggccgcgctcctgcatgatggtaagcccataa

SEQ ID NO: 3860 - DNA, 1113 bp, Pseudomonas aeruginosa
ccgtggtctgcatggtctggatgcactacgcgatcaagcagcaacgccgcatcgacggccaggccgcctcggccgacgtcgaccttcctcccacccttcccacccactcctgaggaatgccgtcatgggcatgatcgccaatacccaactgaaagccgcacggggaccgctgctgctcgactggcgccccgaggaccccgagttctgggcgcgcaacggcaagcgcatcgccagccgcaacctgtggatctcgatccccgcgctgctgctcgccttcgccgtgtggatgatctggagcacggtgactgtgcgcctgaacagcgccggcttcgccttcagcaacgaccagctgttcctgctcgcggcgctgccgtcgatctccggcgccaccctgcgggtgttctattcgttcatggtgccgatcttcggcggtcgtcgctggaccgccctgagcaccgcctcgatgctgatcccgtgcatctggctgggcttcgccgtgcaggacccgaacaccccgtactgggtgttcgccctgatcgcgctgctctgcggcttcggcggcggcaacttcgcctcgagcatgtccaatatcagcttcttctatccgaagagccagcagggcaccgccctcggcctgaatgccgggctcggcaacctcggcgtctcggtgatgcagttcgccgtgccgctggcggtggccggcggcctgttcggcgccttcggcggcgagccgcagcagctcggcgacggcggtcgcctgtggctgcagaacgccggctggatctgggtgccgttcatcgccgtggtatcggtcgcggcctggttcgggatgaacgacatcgccgacgccaaggcctcgttccgcgaccaggcggtgatcttcaagcgcaagcacaactggctgatgtgctggctgtacgtggccaccttcggctcgttcatcggcttctcggccggcttcgcgatgctcagccaagacccagttccccgacgtcaacccgctgcaatacgccttcctcggtccgctggtgggcgccctcagccggcccctgggcggctggctggcggacaagttcggcggcgcgcggatcaccctgtggaactacgcgctga

SEQ ID NO: 3861 - DNA, 681 bp, Pseudomonas aeruginosa
aggagttccacctcgaccggccgagcgcctacttcgtcgactactgccgccagtacaccgacatgccgatgctggtgttgctggaagaacacgccggcggcgcgttcaagccgacccgctacctgcgcgccgccgacctggcggacaacctcggccaggacaacaaccccgagtggaagaccatcgcctacgacgagcgcagcggcgggctggtctcgcccaccggcgccatcggctaccgctggggcgagtctggcaagtggaacatcgccgagctggacggcaggagcggtgaccagacgcgcctgcaactgtcgctgctcgatggcccggaacatgcctgcgaggtggccttcccgtacttcgccgggcaggagcacccgcacttcaagggcgtcgccaacgacgaggtactgctgcgccgggtgccgttccgcgagatcgtcgcggcggacggcaagcgcctgcgggtggccaccgtctatgacctgcagatggccaactacagcatcgaccgcggcctgggcggcgacaacgtggcgacctcctacgaggacgccgacacgccctataccccggcctggcaggagcgcatcaccggcgtcccggcggcgcgcgcgacgcaggtcgcccgcgagttcgccgacagcgccgacaagacccgcggcaaggcgatggtga

SEQ ID NO: 3862 - DNA, 561 bp, Pseudomonas aeruginosa
acgatgacctcggcaaggccggcggtccgcgtcccaccgaggtcgactgggtcgacgacggtgccgagggcaagctcgacctggtcaccaccctggacttccgcatgtcctccacctgcatgtactcggacatcgtcctgccgaccgctacctggtacgagaaggacgacctcaacacctccgacatgcaccccttcatccatccgctgtcggcggccaccgatccggcctgggaagccaagagcgactgggagatctacaaggccatcgccaagaagttctccgccgtcgccgaaggccacctcggcgtggagcaggacctggtcacggtgccgctgctgcatgacacccccaccgagctggcgcagccgttcggcggcgacggccatgactggaagaagggcgagtgcgagccggtgccgggacgcaacctgccgacgctgcacctggtcgagcgcgactacccgaacgtctaccgcaagttcacctcgctcggtccgctgctggacaagctgggcaacggcggcaagggcatcggctggaacaccgagaaggaagtga

SEQ ID NO: 3863 - DNA, 603 bp, Pseudomonas aeruginosa
gcaaggtcgactggctggacgaaccccgccacggcggactcggcggcgacgccctgccgcaaccgctgccccaggacatttgaggagagacgccatgaaaattcgttcgcaagtcggcatggtgctgaacctcgacaaatgcatcggttgccacacctgctcgatcacctgcaagaacgtctggaccagccgcgaaggcatggagtacgcctggttcaacaacgtcgagaccaaacccgggatcggctacccgaaggaatgggaaaaccaggagaagtggaagggcggctgggtgcgcgcggcagacggttcgatccgcccgcgcatcggcggcaagttccgcgtgctggcgaacatcttcgccaacccggacctgcccgagatcgacgactactacgaaccgttcgacttcgactaccagcacctgcataccgcgcccaaggccgagcaccagccggtggcgcgcccgcgctcgctggtctccgggcagcgcatggagaagatcgagtggggcccgaactgggaggagatcctcggcaccgagttcgccaagcggcgcaaggacaagaacttcgaccaggtccaggcggacatctacggtga

SEQ ID NO: 3864 - DNA, 1779 bp, Pseudomonas aeruginosa
gtacgagaacaccttcatgatgtacctgccgcgcctctgcgagcactgcctgaacccggcgtgcgtggcgtcctgcccgagcggggcgatctacaagcgcgaggaggacggcatcgtcctgatcgaccaggacaagtgccgcggctggcggatgtgcatctccggctgcccgtacaagaagatctacttcaactggaagagcggcaagtccgagaagtgcatcttctgctacccgcgcatcgaggccggccagcccaccgtctgctcggagacctgcgtcgggcgcatccgctacctcggcgtgctgctctacgacgccgaccgtatccacgaagtggccagttgcgagaacgagcgcgagctgtacgagaagcaactggagatcttcctcgatccgttcgacccggcggtgatcgcccaggcgcgcaaggatggggtggccgacagcgtcatcgaggcggcgcagaagtcgccggtgtacaagctggcgatggactggaagctggccctgccgctgcacccggaataccgcacgctgccgatggtctggtacgtgccgccgctgtcgccgatccagaacgccgccgccgaggggcacatcggcagcgacggggtgatcccggacgtcgagtcgctgcgcatccccgtgcagtacctggccaacctgctcaccgccggcgacaccgcgccggtgctgctggcgctcaagcgcctgctggcgatgcgcgcctacaagcgcgccgagcacgtcgaaggccgccaggacctggaggtgctggccaaggtcgggttgagcgtggagcaggtggaggagatgtaccgctacctggccatcgccaactacgaggatcgcttcgtgatccccagcgcgcaccgcgaggaagcgctttccgatgccttcgccgagcgttccggctgtggcttcagcttcggcaacggctgttccggcggcagcaactccgccgtcaacctgttcggcggcaagccgaccaaccgccgcgacgtgatccaggtcgtgcagatccaggagtgagcgccatgaacgatcacagccaactgttccgcctgctcgccctgctactcgactatccacgcgccgagctgcgcgaggagagcctcggcctgcatgcgctgatccgcacctgcgaactgccggaagcgctgcgcgacggcctcgcggcgctgctcaacgagctctgccagggcgacctgctggacgtccaggcgcgctacgacggtctcttcgagcgcggccgctcggtctcgctgctgctcttcgagcacgtccacggcgagagccgcgaccgtggccaggcgatggtcgacctgctcgaccgctataccggggccggcctgcaaatcgacgtaccggagctgccggactacctgccgctgtacctcgaatacctgtcgctgctgccgttcgcggcggccagcgaagggctcgccgaagtggcgcacatcctcggcctgctggcgctgcgcctggaggaacgcggcagcgcctatgcggcgattttcgaggcgttgctggaactcggcggcgagcgcccggacctcggcgcgttgcgtcgcgaccaggcccaggaacagcgcgacgacagcctggaggccatcgaccgggcctgggaggaaaccccggtgagcttcaccgaccccgccggcggttgcccgtcgagcagcggccgccgtccaacggcgtccaccgaacaaccattgcaatgggtcgcccagccggtaccgcagatgcagtaccgcgcggcccgcgaaggagtctga

SEQ ID NO: 3865 - DNA, 1224 bp, Pseudomonas aeruginosa
tcgtccgccagttgctcctgcaacgggccgacgcgctgggcatcgaggcccgctgcgaagacggcgagacgccggaggaagcgcgcatccgccaattgctggaggaagaggtgcaggtcccggaagccgacgaagacgcctgccggacctggtacgcggccaatccggggcgcttgctcggcccctggcgcctgcaattgcgccatgtgctgctggcctgcgcgccggacgacctggaaggccgcgagacggcgcgcaagcaggccgcggagctgctcgacgagttgcgcgggcatcccgagcgcttcgtcgacctggcccggcgtttctccgcctgtccgtcgaaggaggcgggcggcgacctcggctggatcgagccggggcagaccgtccccgaattcgagaagcgcctgctgcgccgcgcgcccgggctgctcgagcatccgctggaaagccgctatggcctgcatgtggtggaactgctggcgcgcgaaggcggcgagccgctcgacttcgacgcggcccgcgcacagatcgccgcgcacctgcaggtgcaggtgttgcagcgagcggtgggacagtacatcggcgtgctggcgggagacgcctgtatcgagggcttcgccttcgagggtgcggatggggcgctggtgcaatagccttcggcgccgatgtttccctctccttcccgaagatcaaacggagtacccaggacatgaccgactggatcgatggccaaggccgacagatcgactacctgcgcctgtcggtcaccgaccgttgcgacttccgctgtgtctactgcatggccgaggacatgcgcttcctgccgcgccagcaggtgctgaccctggaggagatcgagcgggtcgcccggctgttcgtcgccggcggtgtgcgcaagctgcgcctgaccggcggcgagccgctggtgcggcccggcatcgtcggcctgtgcgagcgcctggcggcactgccggggttgcgcgaactgtgcatgaccagcaacggctcgcaactggtgcgctacgcccggccgttgtacgacgccggcctgtcgcgtctcaacatcagcctcgacaccctcgatccgctgcgcttccgggcgatcacccgcaacggcgagctggacaaggtgctggccggcatcgacgccgcccaggccgccggtttccgccggatcaagctgaacgcggtggtgatgaaggggcgcaacgccgatga

SEQ ID NO: 3866 - DNA, 2403 bp, Pseudomonas aeruginosa
ttgccgcatctggccggcctattgccgtgcattttctacctactactgcatcgctcaagaaggttctgtaaatatattggttcaactctttcgataggaaagccattcatgacaaataatagtgcgccaccacttgtcgtgaccagaggaaatgataatggttacgagcctgggtcgatggttattacgcatgtacaggctagtgggctagacataatccagtacattccaggtcggtcaagctacggtactccaccatttgtcccgccaggaccaagcccgtatgttggccctggaatgcaagagtacaggaggctaagagatactcttgataagtcccattcagaactcaagaaaaacctgaagaataaaaccttgaaggaggtggatgaactcaagagtgaagcggggttgccagttaaagcggtcagtgccaatgacatccgcgatgaaaagagtatcgttgatgcactcatggatgccaaagcaaaatcgctaaaggccattgaggatcgcccggccaatctttatacggcttcagactttcctcagaagtcagaggcgatgtaccagaatcagttgctagccagtcgaaagttctatggagagttccttgatcgacatatgagtgagctggccaaagcgtacagcgctgatatctataaggcgcaaatcgctatcttgaaacaaacgtctcaagcactggagagtaaagcccggtcaatggaggcgcaagcccagcaggtcactcaacagctcggtgccgacttcaacgcgatcaccactccgaccgccaccaaggtccagcaacgtgtgaaagcagtggatgctagtctgtctcaggtttccacccaggtcagtggtgcagtcgcctcggcaacccaggcggtgcaggtcaagacagcgcaagcccagcaacaagccaacagccagatttcgtccagccagaacctgatcagcgcggcatttcggaatcagattgccttggcagcacaggccagtggagaagcccaggtcacggctttcaacaccaaagtcaagcagatcgtcaacgaagccacggcgttttcgacagcacgaaaacaagcgctggctcagtttgctgccaatgcggccgccgaggtcgaaaccgaggtcaacaggctaaccgcccaggtcaaggcaagccccaccaaggcggcttcgcaagctgcacaagcaacccttcgacaattcactgaaagcacctatgccaaggtgaacacctatgcccagcagaccgaagcagagctgcaggccaaagccaaggaggtttcggcagcggtagccgaggcacagcgtgcggcgaccaacgatttgcaaaaaacagccgatgtagtaccaggtcagatcatccaggctgcgaacaccttggcgatgccggctacctctacgccgctggtttcggtggccgggtttggtagtgcggcagtggagacggctcgcctggcggcttccctaacgaatgctgtcaatcgcctggttcagattgctggtagtggacccggcgcatacgttgccaccttcgcggtgctgtcgctgtattccgaccaggctggtaaagacagtgacaaggttcctgccggcgttcgcaatgcattggcactggaggcgtccgctctggggcttcctggcacggctgatttgcaaagcgtcgccaaggcaggtggcacggttgatatgccggtacgactcacgagtgctgcacaagagagcccgagtggtaaatcgcagattgccgcgatgttgaccaacggtgcaactgtccccaagggcgtgcctgttcgcgccgcgaccctcaatgctgcgacgggccggtatgaggtgacggttcccgcaaagtccaccgtgccgaatacaccaccgctgatcttgacctggacccctgccacccctccaggaagccagaacccctcaagcaccactccggtcgtaccgcagccggttccggtgtatgagggagcaacgatcaccccagtacaggccgagccggagtcctatccgggagtgccgttagatctggacgatctgatcgtgatcttcccggtgggctcgggggttaagccaatctatataatgttcaatcataaccctcatgatgttgttattgatgataagatcagagagcaaattccaattagagggtggactgaggttgaaattagagatgttatcggaaaaggtgcaacaggtagttcttcagataagcgtcggcctaataagacgatagatgggctggggcggaatgactctgcaacagtatatggaagtcctcctaatggatatatagttgtgaacgataggacaggtgaaattattcaaattgcagatcggaacgattccgcatgggcggttgacgggcgaatcatctggagaaataagtaa

SEQ ID NO: 3867 - DNA, 1206 bp, Pseudomonas aeruginosa
gggaagtgcgccgggtacgccgttcgtcgcccgccgcggtcgcgccgccggctgcctctgccggtgccgcggcgcttgcggttacagtgcggcgaccggcccgggaagcgaccggcgcggggccggcggttcacccaggggcggcgaagggagtggcgaacagatgacaataatgaaaggtacctggctgctgctggccgctgtctgcctcggcgccagcgccacggccgaggccggtgcgacgctggatgcggtgaagcgcaagggctacgtgcagtgcggcgtcagcgacggcctgccggggttctcctacgccgacgccaagggccgtttcaaggggctcgacgtcgacatctgccgggcgctggccgccgcgctgttcggcgatgccgagaaggtgcgcttcaccccgctgtccgccaccgagcggttttcggcgttgcagtccggcacggtcgacctgctgtcgcgcaacacctcatggaccagctcgcgggataccgcgctgggcatccacttcaccggcgtcacctatttcgacggccagggcttcctggtcaatcgcaagctcggcgtgtccagcgcccgcgaactgaaggacgcgacggtgtgcatccagtccggcaccaccaacgagctgaacgtggcggactacttccgggcccacggcatccgctacaaggcggtgctcgacgacagctacgagaagagcgcccgtgccctggaggcggggcagtgcgacgtgctcagctccgaccagtcgcagctctacgcccagcgcctgaagctggccaagccggagcagtacgtggtgctgccggaagtgatctccaaggagccgctcggcccggccgtgcggcagggcgacgaagcctggttcaacatcgtccgctggaccctgtacggcctgctcaacgcggaggagctgggggtcacctcgagcaacgtcgagcgccaggccagggacagccgcaacccggacgtcgcccgcctgctcggcagcgagggcgacgccggcaaggacttgcaactgccgcgcgactgggtggtgcagatggtgcgccaggtcggcaactatggcgagatcttcgcccgcaacgtcggcgacggcagcccgctgaagatgccgcgcggcctcaacgcgcaatggaatctcggcggcctgcactatgcgccgccgattcgctgaccggcggggctggctga

SEQ ID NO: 3868 - DNA, 321 bp, Pseudomonas aeruginosa
ccagccgggcgcgggacttccgcctggactacgcgaacgtccgcgccgacgagaacgaggggcgtgcgcaatggggtggcccactacctgttcacccagaccgggcgcagggtggagaatcgcatcgaggcccgtttccgcttcgccgacggtttgatcgtcgagcatcgcgaccagttcgacctgtggcgctggagccgccaggcgcttggcgccaagggcctgctgctgggctgggcgccgccggtgcagcgggcgatccgcgggcaggcgcgcaagggcctggccgcctaccaggctgcccatccggcggccggctga

SEQ ID NO: 3869 - DNA, 345 bp, Pseudomonas aeruginosa
tctcctaagctcgccgcggacaacccgcaggacgccgcgatgatcacgctcttccagttccccgccgcattcaacgtacccaatgccagtccctactgcctgaaactggaaacctggttgcgcctggccggcctggagtatcaggtgaaggtcgtcagcgacccgcgcaaggcgcccaagggcaagctgccctacgtgcgtatcgagggcgaggcgatcggtgacagcgagatcgtcatccgtaccctcggcgagcgctacggggtcacactcgacgccggcctggatgcccggggcaagggctgggcacgggcgatcacgcgcctgtgcgacgaacacctgtac

SEQ ID NO: 3870 - DNA, 1782 bp, Pseudomonas aeruginosa
  unsure (865),(1420),(1531),(1569),(1669): Identity of nucleotide at the above locations are unknown.
catccccttggtgaagactggcgatacccgccgagcatctcaacgcctgcctcggccgccgctacgccgaggcgctccatcgcgccgggctgcgtgaggtcgacctgctcggctactgctccggcgggctggtcgccctggagaccgccaagtccctggtccagcgcggggtgcgcgtgcgccaactggatatcgtctccagctaccggattccctaccgggtggacgacgagcgcctgctgttgttcagcttcgccgcgaccctcggcctggataccgcggcgctcggcttccccgcgccggaacgtctcggcctggcggtgcaggcggcgctcgcgcaaacaccggagcgcctgggcgccgaggcgttggcggggctaccgggcctggccgatctcgtcgccctgcgcggccgcgtgctacaggcggccagcggtagcgccgacgccgtcagcgtcgaacgcgacaccctctaccgactgttctgtcactcggtgcgtgccagccaggccgcggcgccggagccctacgtcggcgcgctgcggctgttcgtgccggacgccggcaacccattggtgccgcgctacgccgaggccctggagacccaatggcgggccgccgcgctcggcgcgtgcggcatccacgaggtgcccggcgggcacttcgactgcctgggcgaagccctggcgcaatccctgtcgaaacccatgccagaggaggcgagccgatgagcgacgtccgttccgtggtggtcgccggttcccggttcggccagttctatgccgccggcgtcgccgccgatcggcgcttcgtcctgcgcggcatccttggccagggcagccggcgttcgcgggcgttggccgancgcctcggggtggagacctggtgcgaggtcgaggcgttgccggacgatgtccgcctggcctgcgtcgcggtcggcggcgcggcacgcggcgagcagggcccggcgctggccgaggcgctgatggcgcgtggcatcgacgtgctgatcgagcatccgttgctgccgcgcgaatggcaggacctgctgcgcagcgccgagcgcctgggccggcgctgcctgctcaacaccttctatccgcagttgccggcggtggcgcgtttcatcgagctgggccgccagttgcatcgccgggcggcggcatccgccacctggacgcggccctgcggggtgcaggtcggtttccccaccctggacatcctcgccgcgttgctggagggcgtcggcccctggtccctggaattcgcccctcgaacgacctgtcggcgatgcgcgggctgtccctggtgctggcggaagtgccgttgagcctgcacgtgctcaacgaactggcggccgccgacgacgggcgcatgaccttgttgcagcgcgtcagcctgaccaccgatcgcggcacgntgagcctgctcagcccccatggcccgttgttgtggacgcctgcggtggcggtaccggcagaggatgacgacggcctgttcgcgctgttcgacgagatagccggcgaaccgntgcccagcgcccagctttggtatgccgaaccgtgcagntgggcccaggtgcaccagcgcctgtggccggcggcggcggccgaggcgctggcgctgctcgccaacggcgacgaggtgcgccggcgcaaccagcgcagcntggaggtcgccgccctgtggcagcggatcggcgagcgccttggcttccccgaggcgccgccggcgtcgctggcgccggcgagcctggaacaggtgctggagcaagcctcgtga

SEQ ID NO: 3871 - DNA, 486 bp, Pseudomonas aeruginosa
agcgggtcggccacctcgccgcgctggtctacgtgcagttgtcgacgccctggctgctggcctgggtcctgctcggcgcgctggccctggatgccctcggcgtgccgctggcgctcggccaggcctgcgccttcctgctcctgttgcgggccctggccgccccggtacaggcgctcggccacggcggcgactcgctgctgggcgcgcgcgccgccgccgagcgcctgcagcaggtgttcgaccaggcgccgctggccgagggccgctcgacccgcgagccggtcgatggcgcggtggcgctgcacggcctgggccatgcctatgaaggcgtggaggtcctggccgatatcgatctggagctggaggatggcagcctggtggccctggtcggtccctcgggctccggcaagagcaccctgctgcacctgctggcgcgctacatggacgcgcagcgcggcgaactggaggttggcggcctggcactga

SEQ ID NO: 3872 - DNA, 2484 bp, Pseudomonas aeruginosa
gcattatcaaatcgtatatcccccgaggctgttcgaacgatgaaaacggagacgaaggtgatcaagggacgccagggcatcgcccgcaatcggcacaccccgttgtgcctggggctgctgctggcgctgagtccgctggccgcggccgtggccgacgcgcgcaaggacggcgagacggaactgccggacatggtgatcagcggagaaagcacgtctgccacccagccgccgggggtgactaccctgggcaaggtgccgctcaagccgcgcgagctgccgcagtccgccagcgtcatcgaccatgagcgcctcgaacagcagaatctgttcagcctcgacgaagccatgcagcaggccaccggggtcaccgtgcagccgttccagctgctgaccaccgcctactacgtgcgcggcttcaaggtcgactccttcgagctggacggggtgccggcgctgcttggcaatactgccagttcgccgcaggacatggcgatctacgagcgggtcgagatccttcgcggctccaacggactgctgcatggcaccggcaacccggcggccaccgtcaacctggtgcgcaagcggccgcagcgcgaattcgccgccagcactaccctcagcgccgggcgctgggaccgctaccgcgccgaggtcgacgtcggcggcccgctgagcgccagcggcaacgtgcgcggccgagcggtggccgcctacgaggaccgcgactacttttacgacgtggccgaccagggcacccgcctgcttttacggggtgaccgagttcgacctgagccccgacaccctgctcaccgtcggtgcgcaataccagcacatcgactcgatcaccaacatggccggggtaccgatggccaaggatgggtccaatctcgggctgtcccgcgacacgtacctcgatgtcgactgggaccgtttcaagtgggacacctaccgcgcgttcggctccctcgaacagcaactgggcggcggctggaaaggcaaggtcagcgccgaataccaggaagccgattcgcgcctgcgttacgccggctccttcggcgccatcgacccgcagaccggcgacggtggccagctgacgggcgccgcctacaagttcaagagcatccagcgcagcctcgacgccaacctcaatgggccggtgcgactgttcggcctgacccacgaactgctcggtggggtcacctacgcccagggcgagacccgccaggacaccgcacgcttcctcaacctgccgaacaccccggtcaatgtctaccgctgggacccgcacggcgtgccgcgcccgcagatcggccagtacacttcgccgggcaccaccaccaccacccagaaaggcctctatgccctgggtcggatcaagctcgccgagccgctgaccctggtggtcggcggccgcgaaagctggtgggaccaggacaccccggccacccgcttcaagcccggtcgccagttcacgccctacggcgggctgatctgggacttcgccagggactggtcgtggtatgtcagctacgccgaggtctaccagccgcaggcggatcgccagacctggaacagcgagccgttgagcccggtggaaggcaagacctacgaaaccgggatcaagggcgaactggccgacggccgcctgaacctgtcgctggcggcgttccgcatcgacctggagaacaatccgcaggaagacccggaccatccggggccgcccaacaatccgttctacatcagcggcggcaaggtgcgcagccagggcttcgagctggaaggcaccggctacctgacgccctactggagtctctcggccggctacacctacaccagcaccgagtacctcaaggacagccagaacgactcggggacgcgctactccaccttcaccccgaggcacctgctgcgcctgtggagcaactacgacctgccctggcaggatcggcgctggagcgtcggcggcggactccaggcgcagagcgactacagcgtcgactaccgcggcgtgagcatgcgccagggcggctacgcactggtcaacatgcgcctgggctacaagatcgacgagcactggacggcggcggtcaacgtcaacaacctgttcgaccggacctactaccagagcctgtccaaccccaactggaacaaccgctacggcgaaccgcgcagcttcaacgtcagcctgcggggcgcgttctgatgccgcgccagtcgggcttcggctgggcctggcgggttccgctggcgctcgccggcagcctggcggcggcgaccgccagcggctatctgttgactcgcgggctgcccctggacgacccgctcgagcgtctctacgccgggctcttcggcgcgctcggggtgggcttgttgctgcttgtcggcgggttgctggcgcgtggtccgggcaacttcgcctggcgcctgggcggtagcctgctggtactgggcctggcgttgtggctgctggcggggcgcggttga

SEQ ID NO: 3873 - DNA, 351 bp, Pseudomonas aeruginosa
gcctcagccatgccggggatgtcgccggcagcgtggagatcgccggtatccagcgtggcctgccgagtaccgcgaacttcgagcggcaccgctatcggctggccgacggcgccctgctcggcgagcgcagctcggcgcagcgcgggttctggctgcgcgccttcatcgccgtgcagccgttgcatttcgcccagtaccagtggctcgggccgggctggtccgccgcgttgcgcggcctgcacctggcgatgggcctcggcgcctgcctgctctgcgccagcggcctgtacctgtggctgcaacgacgcgcctcggcgccggacgcccgcgtacggctcttgcagcgcctga

SEQ ID NO: 3874 - DNA, 282 bp, Pseudomonas aeruginosa
gccagggtttctgtgccggcctggtggcggcggccgcgttgctcctgctggggctgcaactcgtgccctcggagctactcgccggaccctggacggggcggctgttccttgtcctgtgggccgccgctggcctggcggcgttgctgctgccgggcgactggccgctggcgcgcgggttgctcggcgtccccgggctggcctgcctggcggccgccgtcgcgcacctggcgccctgactcatgcgcggccggctgccggccctgggccccgacctcaccctga

SEQ ID NO: 3875 - DNA, 1335 bp, Pseudomonas aeruginosa
tcctctgcggcgcgctgctcatccggcacgcctggatgcaggcgcgcgccgccgcgccacccgcccacccccgtgtcaccggagaccaccatgcttgagctgtatcgccaccgccgcctggtcatcaccctggcgttgctctacctgtcccagggcattcccatcggcctggccatggacgccctgcccaccctcctgcgccaggatggcgcgccattgcaggcgctggccttcctgcccctggtggggctgccctgggtggtcaagttcctctgggcgccctgggtcgacaaccattggtcgcgccgtttcggccggcggcgtaactggatcctgccgatgcaatgcatcgtcctcgcctgcctgctcggcctggcgacgtttggcctcggcgtggccagcgccggttgggcggtcggcctgctggcgctggcttcgctggccagcgcgacccaggacatcgccaccgacggcatggcggcggagcacttcagcggcgagctgctggccaaggtcaacgcggtacagatcgccggggtgatgatcggcttcttcggcggcggcgccggcagcctgatcctcgccgggtatttcggccagcgcacggcgttcctggtcgtggcctgcgtgccgctggcaagcctgtgctgcgtgctcgccctggggcgcggcgccccccacgaactccccccggcaccggccgccaaggccagcctgctgcgcttcctgcgtcggccgctggcgccttcgctgctggcgctggcactgctgtcggcgatgaccgcggtatccggcttcggcctgtccaagctgtacctcagcgatgccggctgggccttgcaggacatcggccggctgggcatgagcggtggcctggtcacggtattcctcggctgcggcggcggcgcctggctggtcaggcggatcggcctgtggcgcggtttcgcccttggcgtggtgctcgccggttgttcggcgctgctctggtatctgcaggccggtcgctggttggcactgagtgaaggattggcgtggacctgcgtgctgatcggctcgctggctaccggcatcacctcggtggcgatcctcaccgcggcgatgcgcttcgccggccagggcggccaggccggcaccgatgtcaccgcggtgcagagcacccgagacctcggcgagatgctggcgtcttcgttcctggtcagcctcaccgcgcagatcggctatgccggcggtttcctcaccggcagcgccctggcggtgctggccctgctgctcgccctgcgcctgcaggccggcgaggggcgcggggagtggaaggggcgggcggaagaggcctga

SEQ ID NO: 3876 - DNA, 525 bp, Pseudomonas aeruginosa
ctgccggtgatcgcttccagcgccgcgctcttctcggtcttcggtcgcgaagccgcggcccattcctctttttcccgttcgcggttggccaggatgatcttgttggcggtcggccgccgcgcttcttcgtattcgcgcagggctgcggccacgtcggcgttgcgcgccagcgcggcggccagctcgatgccgtcgaggatcgcctgcgaagcgccgttggcgcccatcggatacatcaggtgggcggcgtcgccgagcagcgtgatgcgtccccggccccagtgcggcagcggatcgcggtcgaccatcgggtactgcaggatcaactggttgcgggtcagcaggtcgcggatgtcgaaccagcccaggtcccagtcggcgaagaacggcaacacgtcttccaggcgtccgttgcggttccagtcggcctcgttgtcgagctggccgacggcggcgctcggcaccatgcacacccagttcaccagcgacttgccttcggccgcgtggcgcgccgagatcggatag

SEQ ID NO: 3877 - DNA, 720 bp, Pseudomonas aeruginosa
cgcagctcatgggtggggatggcggtggccgccagcgccgggccgaggcccagttcggcgagggcctcgaccgctgccggctggatattgatgccgacgccaagggggcgtatctcgctgctgctttccagcagcgtgaccttgccgatgccggcctggtgcagggccagggcgcaactgaggccgccgatgccggcgccggcgatgaggatatcgatgggttcgctcatgggtgcttccttttctcgagtgttcgaatcgatgggggttcggctgggacggatgaccgtttaccgccatgaaacgtcggcgcagcggcggataacgccggtggcgttattcgccctacggcccgactacggggccgcgggacgcatatccgccgtgaaacgccggcgcagcggtgtcgtcacggttgcaggtagcggtgcttccagcctccttcgtcgcggtcgtagcgcaggcgctcgtgcagccgctcggtgccgttgccccagaactccaccgactccaggcacagttcgaacaggcagtagcccggcgggcgcggcagcgggccgtcggtttccgccaggcgccgggcttcggcgcgcagggcgtggatgtcggcgagggtttcgctctgccgcgaggcgatcgacatcgggtgggtctggtacgggcggctcagccactgggcgtcggcgcgctcgtcgggcaggcgttcggcgcggccgttga

SEQ ID NO: 3878 - DNA, 438 bp, Pseudomonas aeruginosa
aggtgtcctcggcatcgacgatcagcacctcgcgtccggacaggtcggcctgcaactgctggcgctcgctggcgccgcgcagccagaagtcggcgatcggcgcgttgcggctggccagcgccgccaccacgtgcgggtgcgagcccaggcgctgcggcgcctggctcttcagcgcggcgatcagcccggaagccttggcccggctttccgccgcctcgcccaggggatcggagtgacgcacgatggtcgagccgacgccgatgcgcaggcggccgtcgccctcgatctcggcggtgcggatcaggatcgccgagtccagcgtgcgcccgccctggccatcgccgccgatcagcgccgccaccccgctgtagtagccgcgaccctgcggctcgtagcggcggatcacccggcaggcgctttccagcgggctgccggtga

SEQ ID NO: 3879 - DNA, 1128 bp, Pseudomonas aeruginosa
cccgcccgaccacttcggcgtaggcctcgtcgtcgaggtcgaaaccttcctcgctcagttccagcgcctggttcggcagcagcgccagggcctgctccagcggcagcagctcctgctccaggaccttcagcgccagcagcggcgtgccgtcgtcgagcgcctcgaagccgcgctcggcgatctgccggtagggaatcagcgccagcaggtcatggcgcggcaggcccgggccgggctcgtccagcggcaggtcggccaggccgtgcagttcgagcgcctcgccgcggatcacgtcgagcaggcccgggccattgctttccgggcggtagagcaaggcgaacggcgccggccgttcgagcaggcgctgcaacagcgatgtgggcagggcgttcattccagcacctcgtcggtggtgaccaccatcgcgcagcggctggcggcgtattccagggccatgcggtggtgcgcctcgctgaagtcggcgatggcgtcggccaccaggaacggctggatgtcgttggagtaggcgtcgaccgtggagatcagcaccccgacgtgggcgtatacgccgcacagcaccaactggtcgcggccggcggcgcgcatccgctggagcaggtcggagtggaagaaggcgctgtagcgccacttggtcagcagccagtcgtccggccccggcgccagctcctcgaccacctcgcggtcggccggactggcgcacatgcccggcccccagaagtccttgagcaggccgcgctgctcctcggtcatgctgcccggctgggcggtgtaggcgatctgcacgccctgctcgacgcaccagcggcgcagccgcgcggcgttggccaccagtccggcgcgcaggctctcgggcagcgggcgcaggaagtagcgctgcatgtcgtgcaccagcagcaccgcgcgccgcggctccaggctccagcgcgccaggttggccggcaactgctgggcggtcggcaagggataggcggtgatttcgggaatgccgctcatgccacggtctccagggggaaggttgcgctcgggatcgcttctgcgccggaccaggccatcaccgcgctgagtgcctgccaggggttcagccgcggatcgcagaggctggtgtag

SEQ ID NO: 3880 - DNA, 498 bp, Pseudomonas aeruginosa
accggcagggtctgctcgccgacctgctcgtgcggcttggaacgcggcttggcgtactgcccggcgatgcgcccgacgcggatcaccggccgccggccggccaggcgcagggcgccggccagcagttccagcacggcggccttgcgcgccacgttctcggcatggtggtcgtccatgtcctcggcgcagtcgccgcactgcaccaccagcgcctcgccgcgggcgacccgcgccagggtcgcgcgcagggccaggatgtcgccggcgcggatcagcgccggactgccgcgcaggtacgcctgcacgtcgcgcaggcgcgacggatcgccccattcgggttgctgcagcgcttcgcagcgccgtacgcgttgcaatagatcgtccatggtgggtcccccttcggcaggagatatcgtttcgatcaagtgggaatgccttcgcgttttatttccgggaccggaatgctcaaggcgcgcaattgttggaagacgttcatga

SEQ ID NO: 3881 - DNA, 1107 bp, Pseudomonas aeruginosa
aagatgaataattcgaatcttgctgctgcgcgtaatttgatacaagttgttaccggggaatggaagtcccgttgcgtctacgtcgctacgcgcctcgggctggccgatctgatcgagagcgggatcgacagcgacgagacgctggccgccgcggtcggttccgatgccgagcgcatccatcgactgatgcgcctgctggtggccttcgagatcttccagggcgatacccgcgacggctacgccaatacccccaccagccacctgctgagggatgtcgagggctccttccgcgacatggtgctgttctacggcgaggagttccacgccgcctggacgcccgcctgcgaggcgctgctcagcggtaccccaggcttcgagctggcgttcggcgaagacttctatagctacctgaagcgctgcccggatgccggccggcgcttcctgctggcgatgaaggcgagcaacctggccttccacgagatccccaggctcctggatttccgcgggcgtagcttcgtcgacgtcggtggcggttccggcgaattgaccaaggccatcctgcaggccgagcccagcgcccggggcgtgatgctcgaccgcgaaggttcccttcggcgtggcccgcgacaacctctccagcctgttggcaggggagcgcgtcagcctggtgggcggcgacatgctgcaagaggtgccgtccaacggcgatatctacctgctgtcgcggatcatcggcgatctggacgaagccgccagcctgcggttgctcggcaattgccgcgaggcgatggccggcgacggccgggtggtggtgatcgagcggaccatctcggccagcgagccgtcgccgaagtcggtgctctgggacgtgcacctgttcatggcctgcgctggccgtcaccgcaccaccgaggaggtggtcgacctgctcgggcgcggcggcttcgcggtggagcggatcgtcgacctgccgatggaaacccgcatgatcgtcgctgccagggcctgaatcggaactttcaacggttggccccggcggtttcgccggcggccagttggccggcgcccggcgccaggtcgccgctgccccagccgagcgccttgtag

SEQ ID NO: 3882 - DNA, 1254 bp, Pseudomonas aeruginosa
ccgcttagcgccgatccgccggcccagcggcgtatcggcggatggccgagcgcaaggtcacggcaccgccacgaagcgcagatcgctcggcgaccccacctcgacgctttgcagcgtcttgcccacctggccgctctgcggatcgcgggcgaacacccgcaactggtcgctgttctggttggccacgaggacgaagcgcccgccgggcgagaaggcgaattcgcgcggctcggtgccttccaccgagcgccgttcgacgaaacgcaactggccgctggccgggtcgacggcgaaggtcaccagttggttgtcgtcgccgcgattgagcacgccgaggaagcggccgtcggcggacaggtgcagggcgccggcgccgactttgccctggaagccggcatgcgccaggtcgtgggtctgttattgacgcaggcgggcattgcccccatgggcgaacacctcacctggccgctcagttccagtgtcaggttcagcgaaacgcccgtcggcgctgaatattctatggcgcgggccgctgccgggcggggtcgggacgaatgccggatcggccgcctgcagcggacgttcggcctgttccggggcgtatcggtagacgaataccttgtcggcgccgaggtcgggggcgaacaggtactggccgtcgggcgaggacaccaccgagtgcacatgaccggaaacctggcgcggatgcaccttgctggcctggtgcgactccacctgcaccaccggcgccagcgagccgtccgcgcgcaccggcagtaccgccaccgagccttccggctgtaccgagtagttggcgacgaacaggtaacgaccgtcgtggctgaggctgctgtaggtcggatgatcgccgagggtctggacctggctgatctgttgcaggcggccgctgatcggatcgaaacggtaggacgtggcgcgaccgacggtatcgcccttgccgccccgtccgttctcgttgaccacgaacagagtgcgttggtccggggcgaaggtcaggtacgaggggttgctggtatgggccacgcgcagcgggcctttcaccgagccgtcggcgccgtcgaagcggtatacctggatgccttcgctggagccttcggtataggtccccaccagcaggttgtagaggctggcggcctgggcctggggcgccacgccggtgagcggcgcgagggccagcaggcagagggtgggcagtcttctcatgggcaactccttggctcgctattgttctga

SEQ ID NO: 3883 - DNA, 1131 bp, Pseudomonas aeruginosa
aaatattcttttatgaagatatattggtcaagcgtcggccgacgcggtgtcgtccgaccgggagagggaatcgccatgactgaccgcttcacgcgcctgctcggcatccagcagccgatcatccaggcacccatgctcggcgtctccacgccggcgctggccgccgccgtatccaacgccggcgggctcggttcgatcgccatcaccggtagcgccgccgagaagggccgggcgctgatccgcgaggtgcgcgggctgaccgacaagccgttcaacgtcaacctgttctgccaccgcccggggcaggccgacccggcccgcgagcgcgcctggctggactacctgaagccgctgttcgccgagttcggcgccgagccgccggcgcgcctgaacaacatctacctgagcttcctcgaagacccgaccctgctgccgatgctgctggaagagcggccggcggcggtcagcttccatttcggcgcgccgccccgcgaccaggttcgcgcgttgcaggcggcgggcatccgcgtactggtcagtgccaccacgccggaggaagcagccctggtggaggccgccggcgccgatgcggtggtcgcccagggcatcgaggccggtggccatcgcggggtgttcgagccggagcgcggcgacgccgccatcggcaccctggcgctggtccgcctgctggcggcgcgcggttcgctaccggtggtggctgccggcgggatcatggacggacggggcatccgcgccgccctggagctgggcgcgagcgccgtgcagatgggcaccgccttcgtcctctgtccggagtcctcggccaacgccgcctaccgcgaggcgctgaaggggccgcgcgcggcgcgcaccgcgctgaccgtgaccatgtccgggcgcagcgcccgcggcctgcccaaccggatgttcttcgatgccgccgcgcctggagtgccgcccttgccggactatccgttcgtctacgacgcgaccaaagcgttgcagaccgccgctctggctcgcggcaaccatgatttcgccgcccagtgggccggccagggcgcggcgctggcgcgggagctgccggccgccgaactgctgcgcacgctggtcgaggaactgcgcggctga

SEQ ID NO: 3884 - DNA, 2316 bp, Pseudomonas aeruginosa
tataaataccatataagttcccaggatcatcttccgcccatgagtccgcttcccgcttcgcctgcactcaacagcctcctgcgcctgctgcgcgagggcgcgccgctggtcgagcgggtcggtgcgctgcgccgcttgctgctcgaacatccgggcacgcgccaggcctggtacctggcctggcagccgcaggcgcagacctataccccggtgccgccgtcgccggcgctgccgccgggcgccggcgagccgaaccgggccagcgacctggcgttgcgcgagcggctggtgcgcgacggccggctggctctggacgaattgcggcgttccgcctcctggctcggcgcgcgcttgcggcgtgccggcgtggagcatggcatggccttcgccctcgacctgcaggccggcgacgaaggcctgctgctggtggccagcgatacgccgcagagcgctgcgctggactggctcggcctgctcctcgcaccgttgctcgccgccgcccgtggcgtcacccgcgctgcgccgttcctcgcggccgacccgcagccggcgctgctgctcgacggcgaggcgcaggcggtggaattcaaccaggccttccttgccttgcttggcgagcggccgcgcgaggcctggcgcgcttacctcccggccaaccatgggcaactggtgcgcgccagcctggggcaggcgcgggccctcggcgaggtggaggcggagtgcgacggacgcatcctgctctggcagttcattcccgacagcgccgaggcccgggtgctggcgcgctgccgcgacgccaccgccagcctgcgcggcgagcgcgaggcggcgcgggccagccggctgtaccggctgatcaccgagaacaccaccgacctgatttcccggcataccctcgacggcattttcctcgacgcctcgccggcttcctggaccctgctcggctactggccggaggaactgcgcgggcgtccggcgcaggcgttgttccacccccaggaccgcggccaggtggcgctgcgcgcgcgcgaagcgctggagcaggacggctacctgaccatcacctaccgtatccgccaccgcgacggccgctaccgctggttcgagaccgccagccgggcgatccgcgagacctacaccggggcggtggtggaggtggtcagcgtgtcccgcgatgtcacccggcgggtcgaggcggaggagaaccgccggcgcctggccgaagtggtcgaggcgaacaccgacctggtgctgttcgtcgagcatggcggccgcgtcacctacctcaatccttcggcacgtgccgccctcggcatcgccgacgggcaggaggcgccggcgctggaacgcctgctggccggcgacactccggcgcggctggccgaagagggttggcgacaggcgcgcgatggcggcgtttggagccgcgaggggcgcctgcaaccgcaggacggacgtccgtcgctgccagtctcgctggtgttgctggcccatcgcggccgcggcgaggagcgctattactcgctggtggcccgcgacatgaccgaacgcgaactgcgcgaggcccagcagcgccgtcaccaggacgaactggcgcacactgcgcggctggtcactctcggcgaactggcctcgggcatcgcccacgagatcaaccagccgctggcggcggtgatgaactacgccagcgccagccagcgttacctggccgtcctcggcagccagcccgaggccgccgggcgggtggccgaggggctggcgcggatcggcgagcacgccggccacgcggcggaggtgatcaagcgcctgcgcgccttcctgcgcaagggccagcggcgcctgcaggcgctcgacctcaaccaggtggcacgcgaggccatcggcctctgcgcgtgggaagccgggcactggcaagtggcggtggaagaggcgatgaccgacaatccgccgccgctgtatgccgaccgcgtgctgctcgaacaggtgttcctcaatctgctgcgcaacgccatcgaagccaaccgcgaggcgcatcccggctcgccgtcgcgggtcgtcatcggtagccgcgtcgagcccggcgggctgctctgcctgtgggttcgcgaccagggaccgggagtgccggcggatcagctggaacacattttcacgccgttccacaccagcaagccggaagggctgggcctgggcctgtcgatgagccgcagcatcgtcgagggcttcggcggcaccctcgaagccgagctgccggcggatggcgggttgctcatgaactgccggctgccgctcgccgccggcgccacgggagggtaa

SEQ ID NO: 3885 - DNA, 429 bp, Pseudomonas aeruginosa
cctcgacggcaagaaggtgctgacggtcaagggcggcacccaggagccgaacatccgcaaggcgttgcccaacgcccaggtggtcaccttcgagaccagccagcaggcgctgctggcgttgcagcagggcaagggtcaggccttcgtcgacgacgagtcggcactggtcaacgatttcggcaagctcggcgcggcggccggcggctacgccatcctgccggagaacctgagtaccgaggccctggccatcgccttccgcaagggcaatccgcaactcaagcaactggtcgactcgaccctcgccggcctggagcgcagcggcgtggcggagcagctgtacctcaagtggtacgggccgggcaccaagtccaacctcagcgagcgccacttcaagatcgattccgaccggatccccgagtgagcgcctga

SEQ ID NO: 3886 - DNA, 1419 bp, Pseudomonas aeruginosa
ctactggctgtacttcctcgtcggccagtaccccaacgggccgttgggcgggctggccctgaccctggtcctggcctcgctggcgctgctgctggcgctgccactgggcatcctgctcggcctggcgcgggtcagcccctggcgctggctgcgctggccgatcaccgcgctggtcttcgtggtgcgcggggtgccgttgctgatggtgatcttctgggcctatttcttcctgccgaccctcaccggccagcgcaccgaccagttcaccaccatgctgctggcgcttgtgctgttcgacgcggtgtacctggccgagatcgtccgcgccggcatccagggcctcgaccgtggccagttcgaggcggcgcgttcgctcggcctgggctacctggcgagcatgcgcctggtgatcctcccgcaggcgctgcgcaacatgctgccgtcgttggtcaaccaattcgtctcgacgatcaaggagacctccctgggctacatcatcggcctggccgaagtcagcttcatcgcctcgcagatcaatacccaggtgttcaccctgccgacccaggtctacctgatcctcggcctcacctatttcatcctgtgcttcggactgtcgcgtttcgccttctggctcgaacgccgccaggcgcagcgcggcaatcccaaggaggcccgatgatccggctggaaaaggtcaacaaatggtacggcgcctaccacgccctggcggatgtcgacgaacaggtcggccgcggtgaggtggtggtggtctgcggaccctcgggctccggaaaatccaccctgatccgtaccctgaaccgcctggaaccgatccagggcgggcgcatcctgatcgatggccaggacatccacgctcccggcctggacctcaatcgcttccgctcgcacatcggcttcgtgttccagcagttcaatctgttcccgcacctgaacgtgctggacaactgcaccctggcgccgctccgtttgcgcggcctgaaacccgcggaggcacgccgccaggccttggcgctgctggagcgggtcggcctggcggacaaagcggcggcgttccccgcacggctttccggcggccagcagcagcgcgtggcgatcgcccgcgcgctggcgatggagccgccgctgatgctgttcgacgaaccgaccagcgccctcgacccggagatggtcggcgaggtgctgctggtgatgcgcgacctggcccgcgacggcatgaccatggtggtggtaacgcatgagatgggcttcgcccacgacgtcgccgaccgcgtgctgttcatggacgccggccgggtgctggagcgcgccagccccgacgatttcttcaaccgcccgcagcacccgcgtgcgcggaagttcctcgccgacatccgcacccccttcgcccaacccctgtga

SEQ ID NO: 3887 - DNA, 483 bp, Pseudomonas aeruginosa
cggcggcgatcgcctcggcgctctcgtcgccgacgaagcgttgcaagcgccggcgcagcgactcgccgcgggtgtcggccatcagctcgcgcgcctcctccctggggaagctcaccaccagtcgcgcgcggtcgaaaccgatcggatagaagtaggccagcccgccctgcgagtccacgtacaggcggttgcgctcggccacgcagggcgccagggcgaaggtgccgaccagcatcggcgacgggtaggggcggcgttccacatcgatatcgagcagccggcggcgcacgtaggaggcgataccgtcggctcccaccaccacccgcggacgcagcacgcggccgtcgttcaggcgcacctggtcgatcgcgtggcgctcgtcgcgctgcaccgcttcgatgcgggtctcgaacagcatctcgacggtcgcttcgccgtcgattttttccagtaccaggcggcgcagcgactcgcagggcatga

SEQ ID NO: 3888 - DNA, 1446 bp, Pseudomonas aeruginosa
ctccttgtagccgccgaagggcgtcgaggcgtcgccctcgccgaagcagttgacggtgacgatccccgcgcggatctcccgcgacaggcgcagtgcgtggcgcaggctgccggtgtaggccgaggcggcgaggccgtagacggtgtcgttggccagggcgatggcttcgtcgatgtcgtcgaaagaggtgaccgagagcagcgggccgaagatttcctcgcggaacagccggctgtgcggcgagacgccatcgaccacggtcggctcgacgaagatgccagcctcggtggcgccgccgaagcgcaccgccaaccgctccgtcctggcctggtcgaggtacgcgcggaccttctcgaagtgcgccgggctgaccagcgcgccgaggcgattacacggatccagcgggtcgcccatgcgccactcgcggagctgcgcgccgatgcgttcgagcagcgcctcgcggacttcggcatggacgatcagccgcgaggacgccgagcagttctcgcccatgttccagaacgcgccgttgaccacgtgttgcgccaccaggtcgaggtcctcgacatcgttcatcaccaccgccgggttcttgccgccgcactccagtaccacccgcttgaggttggactcggcggcgtacttgaggaacaggcggccggtcgcggtggagccggtgaagctgaccatcgccacgtccgggtggcggcccagcggttcgccggcctcgcggccgccgccggggaccacgttgaacaccccggcggggatccccgcctggctggccagttcggcgacgcgcagggcggtcaggctggtctcgggggccggcttgaccactacggagcagcctgccgccagcgccgggccgatcttccaggcgagcatcagcagcgggaagttccacggcagcaccaggccgaccacgccgatcggctcgcgtaccaccatggccagcgccgccgaaccgaccggggcggtgctgtcgtagatcttgtcgatcagttcggcatgccagcgcagggtattgatggtttccggcaggtcggtgtgctggcattcgcggatcggcttgccgctgtcgaggctctccatcaccgccagttccagcaggtgctcttccagcagctcggccaggcgcagcagcgccgccttgcgctcggcgggcgtgcgcgagcgccagcggccgtcctcgaacgcccgccgcgcgctggccacggcgtgcccgacgtcctccgcgtcgcaggcggcgacctgcgccagcagctcgccggtggccgggttggtcgaggcgaaggtgcggccgccgcaggcatcgcggaaccctccgtcgatgaaggcgcgctggggaaggtccagcgtcgcggcgatggccgcgtattcctcccggctcagcagctcagtcatggcggccaccctcgacgatccgcgcgacctcgcccttga

SEQ ID NO: 3889 - DNA, 1110 bp, Pseudomonas aeruginosa
cggcaggcgtcgcggcccgctggccgggaacaagaagaacaagaggcacgaatcgatggaaagaaggcgtttcagcgccgccctgcaagggcagaacctcaggttcaccggggccggggaggggggctcggcacgggcgcgggtgggcttcctgctgctcgaacacttttccctgccggccttcacccaggcgctggacaccctggtgaccgccaacctgatccgcagcgagtccttcgcggtgagcaacttcagcctgagcggcgagccggtgaccagcgacctcgggttgctgatctgcccggacctggcgctcgcctcggcggcgctgcaaggactcgacctgctggtggtctgcggcggtttgcgcacgcccctgcgctcgtccgccgcgctgcgggaagcgttgcaggacgtggcgtcgcgcggcgtcgccctggccgggctgtggaacggtgcctggttcctcggcgacgccggcctgctggatggctaccgctgctgcatccatcccgagcaccgcgccgccctcgccgagatcgcccgcaacagccaggtgaccagcgacagctatatggtcgaccgcgaccgcctgaccgcggccagccccaccggcgccttcaacctggcgctggagtggatcgcccggcgccacgggcgcgacctggtggaggcggtggtggatatcctcgccttcgaggagtcgcgctaccggcgggtgcgccccgccctgcacgagaagatgagcgagccgctgcgcgaagtgatcaacctgatggcggcgaatatcgaggaaccgctcagccaggagcagctcgcccactacgtggggcgctcgcggcggcagatcgagcgattgttccagcagcagctcggaaccacgccggtgcgctactacctggagttgcggatcaccgagtgccggcgcctgctgcaacattccgacctgaccatgctggaggtcctggtcgcctgcggcttcgtctcgcccagccacttcagcaagtgctacaccgccttctacggctacccgccgtcgaaagaagtgcgctacggcaacgtccgctcgacgaaatgagggcgtttcgccggacgcggccggcatgctag

SEQ ID NO: 3890 - DNA, 441 bp, Pseudomonas aeruginosa
cactcgccgcggtcggcgccttcctcctgctggagggcagcgacgaggcgctggcgccgttccgcagcaccaccggcaccctgctggtggacgacatcgagccctatcaccggcggttgctggccgccggtgcgcagatcatcttcgggccggcgcgcgcgcccaccggcgcctgcttcaatgcgctgctgccggacggcacggtggtcgagttcgtccaccaccggccgcagccgggcgaggcctgaacctcagccctcgcgccgggcggcgcaatcgtccatggccgcgccgatcgcctgttcgccgcgcgccagcagcgctgcgctggcgccgcggatatcgcgggcttccttgttctggctgagcttgaacttgccgaccaggcgggtgatctcgatttcgatgccgacgatcagccggagcatctcgtcgatgtag

SEQ ID NO: 3891 - DNA, 1800 bp, Pseudomonas aeruginosa
aacgcagatggccaaggcagccgatgtggttgtgcaatgcctggaaaacgagggcgtgcagtacgtcttcggaattcccggcgaggagaatctcgacctgctggagtccctgcgcaagtcgcagatccggctggtgctcacccgccacgaacaatcggccggcttcatggccgccacctatgggcgcctcaccggcaagaccggggtcagcctgtcgaccctcggcccgggcgccaccaacctggtcaccgccggcgcctacgcctacctgggcggcatgccgatgctgatgatcaccgggcagaagccgatcaagaagtccaagcagggccgcttccagatcctcgacgtggtcggcatgatgcagccgctgaccaagtacacccaccaactggcctccgccgacaacattccctcgcgggtccgcgaggcgttccgcctggccgaggaagagaagcccggcgcggtgcacctggagctgccggaggacatcgccgccgagcagaccgacagcctgcccatcccgccgagcctgagccgccggccgctggcggaatacaaggcgatctgcgccgcggtggagaagctgcgcgccgcgcgcagcccgatcctggtgatcggcgccggggccaaccgcaagatgaccgccaaggtcctcaagcaactgatcgacaagaccggcattcccttcgtcaccacccagatgggcaagggcgtggtcgacgagcgtcacccgcgcttcctcggcaacgccgcgctgtccgccggcgacttcgtgcatcgcgcggtggaggcggccgacctgatcgtcaacgtcggccacgacgtgatcgagaagccgccgttcttcatggttcgcggcggtaccgaggtgatccacgtgaacttccgttccgccgaggtggacccggtgtatttcccgcagatcgaagtggtgggcgacatcgccaacgccatctggcagatcggcgaggcgctggacgataccgcgcactgggacttcacccgcctgctggcgatccgcgaggccaacgaggcgcaggtcgccgaaggcgccgacgacccgcgcttcccgctctatccgcagcgcctggtggccgacgtgcgccgggcgttgccgtcgcagggcatcgtcgccctggacaacggcatgtacaagatctggttcgcccgcaactacaaggcgcacatgcccaacaccgtgctgctggacaacgccctcgccaccatgggcgccggcctgccctcggcgatggccgcgcacctggtctacccggaccggccgatcgtcgcggtgtgcggcgatggcggcttcatgatgaacagccaggaactggaaaccgcggtgcggctgaagatgaacctgacggtgatcatcctgcgcgacaacggctacgggatgatccgctggaagcaatcgaacatgggcttcgccgacttcgggctggactacggcaacccggacttcgtgcgctatgccgaggcctacggcgcccacggccaccgggtcgacagtgccgagggcttcctgccgttgctggagcgctgcctgggcacgcccggggtgcatgtgatcgattgcccggtggattactcggagaacgaccgcatcctcaacgtcgagctgcgcgaacgcgccctggcggtctgaaccgccggagcgtcgcgccggcgtgcgttccggcgcgacggctcagaacagcgacaggttgtagctggcgatcaggcgcacctcgtccacgtcgcgcgccgagcgctcgaagtcggtgcggtaggtggcgttgcgcaggcgcaggctga

SEQ ID NO: 3892 - DNA, 1533 bp, Pseudomonas aeruginosa
gccgtcgccggcgacggtcagcaggcccgagccggacgagccgccttcgaccaccgccgacggccagtcgacgcgggtcagggcggtatgcccgtcgtaggtgacgcccactgccgagacgttgccctgcgagtacttcttggcgtcgccgcgcggatggtggatgtcatggccgagcgagccgttggcgatcggcgtggcgctccagccctggtagaacacgccggccggcggagtgcgcttgagttccagcagcagggtgtcgcgcttcgcgtcgcggtgcaggatattcgccccgccggtcagcacggtgacgctctggttgatggtcgaggcgtcgccgtagcactgggtggtgttgtagaaccagatggtctgcagcgtcgcggcggtggcctggtcctcgatgcagtgcgcggccgaccagaacaactggcgcttgggcgagttgccgttgttcagcagggtgccggtgcagatgtagctgccgccgtccgccgagctggtgaagaccatcttcgccaccgctgcggtggcgttgtcgtaggcccgcgtgccgctctgggtcgcgcagaccgcatccacctcgcagctgccgctggcgccgaagccgtcgcggtagccggccttgtacagggagtcggcgaaatacgatacctggggtaccgacaggcgcaggtcgcccggttgcaggttggccggcagcaccagttcgacggtcagggtatcgccctcgatgaccgggctccagtagggacggttgaccgagaggtccttgccgctggcctcgaagatttccttgccggcgccggcgaagtgcagcagcacgtcgtcgggcagcgagccgctgcgggtttccaggcgaatcgcggcgcgcaggctggcggcccccgcagcgctgatcgggaagcgcgcggtgtggcgcccgtccggagtgtcgatccattcgagggttgtcaggtcgatttccggagtcgccgttttcaggcccacgcccacttgcagcggcgtacccggtttcggcgccagcggcgcggcgcgggccacgcggcgggcggggggcgcggcgaagtggatgccggccgccgagatcgccgcgttggggttggcgaagcgggcgtgaccggtgctcgccggagaggcctggagcacggcgacgtcgccagccatctcgctcgcaccgggcgccgccaaggcctggctcgcgccggcagccaacgccagaaccaggcatgcattcaggtacgttctcttatgcatgaatcgactccttcagttttttgggagggcaacttcctcaatcgttcgcgtggcgaaagatatgcaggtgtgacggagtcgttcaaatattttttatattcgtttctgctagctattaaatatgaagaagcgtttgtggatagcagaatagatagctatttccttcacttgccattgatgttggattgctctctctaccaactaaagtttggtctggagtggctctgcagagccttcggtttgcttcagagaggtgcaggatgtagtgcatga

SEQ ID NO: 3893 - DNA, 1089 bp, Pseudomonas aeruginosa
agccctggccgcttaccattactccagggttttccaggatacgccgccgcccttgtttcagagcggcggatgcaacggcggcgcatgccgcgcgatcagttcggcgacccactcgatgaacacccgcagcttgccgctgacgtggcggttcggcgggaacgccaggtacagcggcatcggctccaggctccagtcctcgaacagcggcagcagctcgccgcgggcgaggggctcgcgcgccatgtagtgcggcagccagaggatgcccaggccggccagcccggccgccaggtaggcgttgccgtcgtccaccgccagcacatgacggcccgccacccgcaggcattcctcgcccctgcgcatggcgtagggcagggccttgccggtgcgcgcccagaggaagccgacgatacgctggtggctgtcctccagttcgcgcgggtggctcggcacgccggcgcgctgcaagtaggccggtgccgcgtagacccccagttgcaggtcgccgacccgccgcgctatcagcgactggtcgcgcagttcgccgccgcggatgacgcagtcgacgttctcgtcgatcaggtcgacgagccgatcgctcacgcccaggtcgatctggatctccggatagcgcgcatggaactcgggcaacgccgggatcagcagcagccgcgccagcgggctcggtacgtcgatccggagacgcccgcggggcgccagggcggcgctggagaggctggtctcggcatcgtccagttccgccagcagacgtaccacccgctcgtagtaggcggcgccgtcggcggtcaggttgagcttgcgcgtggtgcggttgagcaggcgtacccgcagccgcgcttccagttgctggaccaactgggtgacgctggtgcggctcatgtgcagcgtctccgccgccttggtgaagctgccggtatccaccacacgggcaaaggcctgcatcgcatcgaaacggtccatcgggactccgggtcgtcggggattgtttggattctacaaacagtcatggccagggttgcgcgtttatccacggcgcgcacgaccttaccgttcttccatcgacgatga

SEQ ID NO: 3894 - DNA, 507 bp, Pseudomonas aeruginosa
gatgcgcttgtcaacgctctcgtaactttttctgtagcgagacatactcatggtctttccgtcacgagcccgccgttcatgagaaacgacacccgcctctcgcgcatgctccatgtgctgatccatatggcccgccacgaagggccggcgacgtccgaagccatcgcgcagatgctcggcaccaacccggtggtggtgcgacggaccatggcgctgctgaagaacgaaggctacgtgagttcggagaagggccatcgcggcggttggcggctggccaagccgttggcggacatcaccttgctggatatccaccaggcgctgggagcgtcctcgatcttcgccatcggcctgtctaccgatcatccggaatgcctggtcgagcaggcggtcaacgaagcgctcggcgaggcgttcgaggcggcgcaggcgttgctcctggagcgcctggggagcgtcacgctggagcagttggcgagcgagttcgagcgccgctatcggccctgctga

SEQ ID NO: 3895 - DNA, 891 bp, Pseudomonas aeruginosa
  unsure (426): Identity of nucleotide at the above locations are unknown.
cgccgacgccgtcagcgtcgaacgcgacaccctctaccgactgttctgtcactcggtgcgtgccagccaggccgcggcgccggagccctacgtcggcgcgctgcggctgttcgtgccggacgccggcaacccattggtgccgcgctacgccgaggccctggagacccaatggcgggccgccgcgctcggcgcgtgcggcatccacgaggtgcccggcgggcacttcgactgcctgggcgaagccctggcgcaatccctgtcgaaacccatgccagaggaggcgagccgatgagcgacgtccgttccgtggtggtcgccggttcccggttcggccagttctatgccgccggcgtcgccgccgatcggcgcttcgtcctgcgcggcatccttggccagggcagccggcgttcgcgggcgttggccgancgcctcggggtggagacctggtgcgaggtcgaggcgttgccggacgatgtccgcctggcctgcgtcgcggtcggcggcgcggcacgcggcgagcagggcccggcgctggccgaggcgctgatggcgcgtggcatcgacgtgctgatcgagcatccgttgctgccgcgcgaatggcaggacctgctgcgcagcgccgagcgcctgggccggcgctgcctgctcaacaccttctatccgcagttgccggcggtggcgcgtttcatcgagctgggccgccagttgcatcgccgggcggcggcatccgccacctggacgcggccctgcggggtgcaggtcggtttccccaccctggacatcctcgccgcgttgctggagggcgtcggcccctggtccctggaattcgcccctcgaacgacctgtcggcgatgcgcgggctgtccctggtgctggcggaagtgccgttga

SEQ ID NO: 3896 - DNA, 1278 bp, Pseudomonas aeruginosa
  unsure (12),(50),(150): Identity of nucleotide at the above locations are unknown.
ccggcgaaccgntgcccagcgcccagctttggtatgccgaaccgtgcagntgggcccaggtgcaccagcgcctgtggccggcggcggcggccgaggcgctggcgctgctcgccaacggcgacgaggtgcgccggcgcaaccagcgcagcntggaggtcgccgccctgtggcagcggatcggcgagcgccttggcttccccgaggcgccgccggcgtcgctggcgccggcgagcctggaacaggtgctggagcaagcctcgtgaccccggtgctgtggcgcctgctgcgcacctatcgctggcggctggcggcggccatggggttgcaggccctggccgggctctgctcgctgttgccctggatgcttctcgcctggctcgccgagccgctggcgcgcggccaggcgcagccggccctgctggccctggtgctgctggcggtgctggcctggctgggctgccaggcgctggccgcgcacctggcccaccgggtcgacgcggacctctgcaacgacctgcgcctgcgcctgctggcgcacctgcaacggctgccgctggactggttcggtcgccagggcccggacggcgtggcgcgcctcgtggagcaggacgtgcgggccctgcaccaactgatcgcgcacgctcccaacgatctcagcaacctgttggtggtgccgctcgtcgcgttgctctggctggcctggctgcacccctggctgctgctgttctgcctgctgccgctggtgctggccgccgccggcttcctgctgctgcgctcggcgcgctatcgcgacctggtgctgcggcgcaacgccgcgctggaaaggctctcggcggactatggcgaattcgcccacaacctgctgctggcccgacagtaccccggcgccggcatacaacagggcgccgaggcgtcggcggcggccttcggcgaagcgttcggcgcctgggtgaagcgggtcggccacctcgccgcgctggtctacgtgcagttgtcgacgccctggctgctggcctgggtcctgctcggcgcgctggccctggatgccctcggcgtgccgctggcgctcggccaggcctgcgccttcctgctcctgttgcgggccctggccgccccggtacaggcgctcggccacggcggcgactcgctgctgggcgcgcgcgccgccgccgagcgcctgcagcaggtgttcgaccaggcgccgctggccgagggccgctcgacccgcgagccggtcgatggcgcggtggcgctgcacggcctgggccatgcctatga

SEQ ID NO: 3897 - DNA, 1605 bp, Pseudomonas aeruginosa
  unsure (457): Identity of nucleotide at the above locations are unknown.
cgcctgcctcgacgagcgcatcatggccctgccgcgtggctacgacagcgtgccgggacgcgacctgcaactgtccggcggcgaactgcaacgactggccctggcccgtgcgctgctatcgccggcgcgcctgttgctgctagacgagccaacctcggcgctggatccgcagaccgcccggcaggtcctgcgcaacctgcgcgaacgcggcggtggccggacccgggtgatcgtcgcccatcgtttggccgaagtcagcgatgccgacctgatcctggtgctggtcccctggccgtctggtcgaacgcggcgagcaccccgccctgttggcggcggacggcgcctatgcgcgcttgtggcgtgaacagaacggcgcggaggtggcggcatgaccctgttcgaacgaatgcgtgcgctgcccgaagactgccgtgccgcgttgcgccgggcgagcgcntgggcggtcctggcggcgctgctggacgccgcttgcggcgtattgctggtgccgttggtcgaggcctggttcgccgaaggcgcgttgccctggcgctgggtcgccgcgttgctcggtttgagcctggcgcaggcgctgttgcagtacctggccatgcgtcgcggtttcgccgccggcggctcgctggcggctggactggtgcgcagcctggtggcgcgcttgccgcgcctggcgccgccggcgttgcgccgggtcgcgccggccgaaggcctgctgcgcggcccggtgatgcaggcgatgggcattccggcgcacctgctggggccgctgatcgccgcgttggtgacgccgctcggggtgatcctcgggctgttcctgatcgacccgtccatcgccctcggcctgctccttgctggtgccttcctcgccgcgctgttgcgctggagcgggcggcgcaatctggcggcggaggatgcccggctggccgccgagcgcgacgccgcacggcagttgcaggcgttcgccgaacgccagccactgctgcgcgcggcgcagcgcgaaagcgtcgcccgccaggggctggaagaggccttgcgcagtctccaccgcagcaccctggatctgttgcggcgcagcctgcccagcggcctcggcttcaccctggcggtgcaggcggcgttcgccttcgccctgctcggcggcgcctgggcggtggatcggcaatggctggacggcgcgcgactggtggccgtgctggtgctgctggtgcgcttcatcgagccgctggcccagctcacccatctcgaccaggcgttggcccggcgcctggccaggcgctggataccctgctgccggttttcgccctggctccgctgcgcagtcccgagcccgggcgagcggccgcacgacgccagcctggcggccgaggccgtggaattgcgtctggaaaatggccgcgccttgctcgaggacatttccctgaggctggagccgggttcgctgaacgtcctcgtcggaccctccggggccggcaagagcagcctgctggcgctgctcgggcggctctacgacgtcgatgccgggcgtgtcctgctgggtggcgtggatatccgccggttgagcgaaacgaccctcgccgccaatcgtaa

SEQ ID NO: 3898 - DNA, 606 bp, Pseudomonas aeruginosa
cctggtgttccaggacaacggcctgttccgcggcagcgttgcctggaacctgcgcatggcgcgagcggacgccgatctcgaagcgctgcgctaggcggcgcgggcggttggcctgctggaagagatcgaggcctggccgcagggctgggacagcgacgtcggtcccggcggcgcgctgctgtccggcggccagcggcaacgcctgtgcctggctcgcgggctgctctcgacggcgccgttgctgctgctcgacaagcccaccgccagcctcgacgccgccagcgaggcgcaggtgctgcgcaacctgctcgggttgcgcggccggcgcaccctgatggtagtgacccaccgcccggcgctggcgcgtcaggccgaccaggaactgctgctggaggaggggcgcctgcgcctcagcggacgtcacgccgatctgctcgtccgggacgactggtatgccggtttcgtcgggctggcgggcgaggaaagttccgcgacggtcgtggatcgatagagaaagaccggcaatcgaaaaagccccggagacgatttcttcataatgataagcattatcaaatcgtatatcccccgaggctgttcgaacgatga

SEQ ID NO: 3899 - DNA, 1530 bp, Pseudomonas aeruginosa
gcgccagcggcaacgtgcgcggccgagcggtggccgcctacgaggaccgcgactacttttacgacgtggccgaccagggcacccgcctgcttttacggggtgaccgagttcgacctgagccccgacaccctgctcaccgtcggtgcgcaataccagcacatcgactcgatcaccaacatggccggggtaccgatggccaaggatgggtccaatctcgggctgtcccgcgacacgtacctcgatgtcgactgggaccgtttcaagtgggacacctaccgcgcgttcggctccctcgaacagcaactgggcggcggctggaaaggcaaggtcagcgccgaataccaggaagccgattcgcgcctgcgttacgccggctccttcggcgccatcgacccgcagaccggcgacggtggccagctgacgggcgccgcctacaagttcaagagcatccagcgcagcctcgacgccaacctcaatgggccggtgcgactgttcggcctgacccacgaactgctcggtggggtcacctacgcccagggcgagacccgccaggacaccgcacgcttcctcaacctgccgaacaccccggtcaatgtctaccgctgggacccgcacggcgtgccgcgcccgcagatcggccagtacacttcgccgggcaccaccaccaccacccagaaaggcctctatgccctgggtcggatcaagctcgccgagccgctgaccctggtggtcggcggccgcgaaagctggtgggaccaggacaccccggccacccgcttcaagcccggtcgccagttcacgccctacggcgggctgatctgggacttcgccagggactggtcgtggtatgtcagctacgccgaggtctaccagccgcaggcggatcgccagacctggaacagcgagccgttgagcccggtggaaggcaagacctacgaaaccgggatcaagggcgaactggccgacggccgcctgaacctgtcgctggcggcgttccgcatcgacctggagaacaatccgcaggaagacccggaccatccggggccgcccaacaatccgttctacatcagcggcggcaaggtgcgcagccagggcttcgagctggaaggcaccggctacctgacgccctactggagtctctcggccggctacacctacaccagcaccgagtacctcaaggacagccagaacgactcggggacgcgctactccaccttcaccccgaggcacctgctgcgcctgtggagcaactacgacctgccctggcaggatcggcgctggagcgtcggcggcggactccaggcgcagagcgactacagcgtcgactaccgcggcgtgagcatgcgccagggcggctacgcactggtcaacatgcgcctgggctacaagatcgacgagcactggacggcggcggtcaacgtcaacaacctgttcgaccggacctactaccagagcctgtccaaccccaactggaacaaccgctacggcgaaccgcgcagcttcaacgtcagcctgcggggcgcgttctga

SEQ ID NO: 3900 - DNA, 2139 bp, Pseudomonas aeruginosa
ctcgcgggctgcccctggacgacccgctcgagcgtctctacgccgggctcttcggcgcgctcggggtgggcttgttgctgcttgtcggcgggttgctggcgcgtggtccgggcaacttcgcctggcgcctgggcggtagcctgctggtactgggcctggcgttgtggctgctggcggggcgcggttgaagtggcggcgcgtcctctcctgctctcgctgcacggtggcgccggcgcgctgttcggcgtgctgctgttcgtggtgctgttcagtggcgcctggagtcttggccacgacgacctgcgcgagtggctgcgggccccggcgcaggcgggaggagaaacccttgcgctggagcgcctgctcgaacgggcgggcgaggaaggcgtcgacatccgcgatgcgaccctgctgctgcctgctcccggccatgccgccttcagcgtctgcgatgcgcgcctggactgccggctggacctcgacccggccagcggccggggtgttgccaccgacgccggcgatggacctcctgctgaacctgcacaagagcctgttcgtcggcttccccgggcgggtggtggtcagcctgttcggcgtatcgctgttgctgctgtgcctggccggcgtggtgctgcacagccgccgctggcgcgacctgcggcgttggcggcgggaccgcgggctgcgcctggcgctgttcgacctgcacggcctgatcggcatctggggactgccctggctgctgttgttcggtttcaccggcgcgctcagcgggctgggcgcgctcgggaccctgctgctggcgccggtggcctacccgcaggaaccgaaccgggtgttcgtcgagttgatgggaccgccgccgcccgccgccgaggggcggccattggcgtcccgcatcgatctcgaccgcctgcttgccggcgatgccgtgcgggcgcccggcttcgtcgcccagcgcttgagcctcagccatgccggggatgtcgccggcagcgtggagatcgccggtatccagcgtggcctgccgagtaccgcgaacttcgagcggcaccgctatcggctggccgacggcgccctgctcggcgagcgcagctcggcgcagcgcgggttctggctgcgcgccttcatcgccgtgcagccgttgcatttcgcccagtaccagtggctcgggccgggctggtccgccgcgttgcgcggcctgcacctggcgatgggcctcggcgcctgcctgctctgcgccagcggcctgtacctgtggctgcaacgacgcgcctcggcgccggacgcccgcgtacggctcttgcagcgcctgagccagggtttctgtgccggcctggtggcggcggccgcgttgctcctgctggggctgcaactcgtgccctcggagctactcgccggaccctggacggggcggctgttccttgtcctgtgggccgccgctggcctggcggcgttgctgctgccgggcgactggccgctggcgcgcgggttgctcggcgtccccgggctggcctgcctggcggccgccgtcgcgcacctggcgccctgactcatgcgcggccggctgccggccctgggccccgacctcaccctgatcctctgcggcgcgctgctcatccggcacgcctggatgcaggcgcgcgccgccgcgccacccgcccacccccgtgtcaccggagaccaccatgcttgagctgtatcgccaccgccgcctggtcatcaccctggcgttgctctacctgtcccagggcattcccatcggcctggccatggacgccctgcccaccctcctgcgccaggatggcgcgccattgcaggcgctggccttcctgcccctggtggggctgccctgggtggtcaagttcctctgggcgccctgggtcgacaaccattggtcgcgccgtttcggccggcggcgtaactggatcctgccgatgcaatgcatcgtcctcgcctgcctgctcggcctggcgacgtttggcctcggcgtggccagcgccggttgggcggtcggcctgctggcgctggcttcgctggccagcgcgacccaggacatcgccaccgacggcatggcggcggagcacttcagcggcgagctgctggccaaggtcaacgcggtacagatcgccggggtga

SEQ ID NO: 3901 - DNA, 1086 bp, Pseudomonas aeruginosa
aacgccggcgcagcggtgtcgtcacggttgcaggtagcggtgcttccagcctccttcgtcgcggtcgtagcgcaggcgctcgtgcagccgctcggtgccgttgccccagaactccaccgactccaggcacagttcgaacaggcagtagcccggcgggcgcggcagcgggccgtcggtttccgccaggcgccgggcttcggcgcgcagggcgtggatgtcggcgagggtttcgctctgccgcgaggcgatcgacatcgggtgggtctggtacgggcggctcagccactgggcgtcggcgcgctcgtcgggcaggcgttcggcgcggccgttgaggatgatctgctggctgctctcgcgccagtacagcacccccgaggcccaggggttctgtgccagttcgcggcccttctggctatcggcgtgggtggcgaacaccaccccgcgctcgcccagctcggcgatcaccacgatccgcgtcgacggccggccctgcccgtcgaccgtggccagggccagtgcccgcggctcgcgcacgccgtagcggcgggcgcgttccagccagttgcgcagcacctccatggggttcgccggcggcgcctcgaactccgggaaaggggcttcgatggtcccggtgagggactcggaaatgttcgcgttgacgcccatcatggcgttcctccgttctgcccgttcacaggtaggcccggccttcggcgaaggccgcgccgttgcccgacacttccaccgtcgagacccgctcgccggcgccctcggcgcgggcgtacatgcgcgacggccggccgatctcgacgccctggaggatctcgatctgctgcccgtagggaatctgccggtggcgcgccaggtggatcgccagcggcccggcggcggaaccggtggcggcgtcctcgaccacgccgtaggccggcgagaacatgcggctgcgccagtgccgcccggcgccggcgaagcagtttcaccgccaggtccgggaagtcgcacagcgcgcggtggtcggggtgcagcgcggacagcgcggcgacgctctccaggccgacgaagacgtggcgcgggccgttgcggtag

SEQ ID NO: 3902 - DNA, 2472 bp, Pseudomonas aeruginosa
acctcgatgggaaaggtcgagcccttcaggccgagggcggcgagcagctcggccgggcggctgaagtgctcccaggtggggatcggctgctgcatgctgcaggccaccaccttgccgtcctggcgctccagggcgaagggcacggtgcccatcctggtctccaggaacagcctgtccttgtcggtctcggcgcccagggcgatggcggtgcccagcagcgggtggccggcgaacggcagttcgttgaccggggtgaagatgcggatgcgcgcgtcgccgtcctgttgcgggcggagtacgaaggtgctctccgacaggttcatctcccgcgccatgcgctgcatgcgctcgccgctgaggtcgtcgcagtcgaagaacaccgccaccgggttgccttgcagcggttcgctggcgaaggcgtctatcacgacatatctgtgcatgggctctcctggctcagggccgccgctcgaccagcgcgtggcgcagcaggtcggcgatgatgcgcggaccctcgcgggtcagcaccgattcggggtggaattgcatggaggcgaagcgcggcccgcgcagggcatggacctcgccggtctcgcggtcgcggctgatctcgatcgggccgacctcgggaatctcgatgcggtcctgcagggcgcgcgcggcgaaggtgttgtagaagccgacgcgctcggcggcgccgaacaggtcgatctgtttctgcacgccctggttgggctcctgccggcgttgcaggtccaggcccaggcacaggctcagcacctggtggctcaggcacacggcgaggaacggccggcgctcgctgagcagcgaacggatggccaggtgcaggtggccgatcttcggctggccgatctcggtggggttgcccgggccggggcccatgatcaccaggtcgtagccgtcgaacgagtacggctcctggaagccgcgcacggtcaccgtcaggcccagcgacttgagctgcttggcgatcatcgaggtgaaggtgtcctcggcatcgacgatcagcacctcgcgtccggacaggtcggcctgcaactgctggcgctcgctggcgccgcgcagccagaagtcggcgatcggcgcgttgcggctggccagcgccgccaccacgtgcgggtgcgagcccaggcgctgcggcgcctggctcttcagcgcggcgatcagcccggaagccttggcccggctttccgccgcctcgcccaggggatcggagtgacgcacgatggtcgagccgacgccgatgcgcaggcggccgtcgccctcgatctcggcggtgcggatcaggatcgccgagtccagcgtgcgcccgccctggccatcgccgccgatcagcgccgccaccccgctgtagtagccgcgaccctgcggctcgtagcggcggatcacccggcaggcgctttccagcgggctgccggtgacggtcggggcgaacagcgtctcgcgcagcacctcgcgcacgtcgcggctggtctggccctcgatgaagtactcggtgtgcgccaggtgcgccatctccttgaggtagggaccgagcacccggccgccgtcctcgcagatccgcgccatcatcttcagctcctcgtccaccaccatgtacagctcgtcggcttccttgcggttgtcgaggaattccatgacctcggccaggttcggcccggccggcgggtagcggtaggtgccgctgatcgggttcatcaccgccaggccgtcgcgcacgctgatgtgtcgctcgggcgaggcgccgaccagggtgcgttcgccggtgtggacgatgaaggtccagtaggcgcccttctcgcgcagcagcaactggcggaagaagctcagcgcgctggccgtggcgtagccgtcgatgcgcgcctggaagcgccgcttgatcacgaagttggcgccttcgccgcgaccgatctcgtcggcgatgacccgcccgaccacttcggcgtaggcctcgtcgtcgaggtcgaaaccttcctcgctcagttccagcgcctggttcggcagcagcgccagggcctgctccagcggcagcagctcctgctccaggaccttcagcgccagcagcggcgtgccgtcgtcgagcgcctcgaagccgcgctcggcgatctgccggtagggaatcagcgccagcaggtcatggcgcggcaggcccgggccgggctcgtccagcggcaggtcggccaggccgtgcagttcgagcgcctcgccgcggatcacgtcgagcaggcccgggccattgctttccgggcggtagagcaaggcgaacggcgccggccgttcgagcaggcgctgcaacagcgatgtgggcagggcgttcattccagcacctcgtcggtggtgaccaccatcgcgcagcggctggcggcgtattccagggccatgcggtggtgcgcctcgctgaagtcggcgatggcgtcggccaccaggaacggctggatgtcgttggagtag

SEQ ID NO: 3903 - DNA, 708 bp, Pseudomonas aeruginosa
ccatgtcgccgcgatagaccggcagggtctgctcgccgacctgctcgtgcggcttggaacgcggcttggcgtactgcccggcgatgcgcccgacgcggatcaccggccgccggccggccaggcgcagggcgccggccagcagttccagcacggcggccttgcgcgccacgttctcggcatggtggtcgtccatgtcctcggcgcagtcgccgcactgcaccaccagcgcctcgccgcgggcgacccgcgccagggtcgcgcgcagggccaggatgtcgccggcgcggatcagcgccggactgccgcgcaggtacgcctgcacgtcgcgcaggcgcgacggatcgccccattcgggttgctgcagcgcttcgcagcgccgtacgcgttgcaatagatcgtccatggtgggtcccccttcggcaggagatatcgtttcgatcaagtgggaatgccttcgcgttttatttccgggaccggaatgctcaaggcgcgcaattgttggaagacgttcatgaattcgcggttgcgcttgatcttgccgtcttcaagttcgaaggaatgcaggaagtggttttcgtaataaccttcgggatatccggggaaaagaatcttgccgtgaccgtcgcattcgacccagaaatgattggggtcgtcggttccgaatatatttatgttgtaccactcccaatcgggaaagcacttcaatga

SEQ ID NO: 3904 - DNA, 183 bp, Pseudomonas aeruginosa
ttttattctttcggtacgcaggaaaaggctctggaacaggcagttggaaagttccagggttgtttccgcaacgagatccagggagcgctgatccgggggatgagcgcattttttctcaaagttccgaatgaaccggggtgttctgcggtatttctcgccgagcgggcaagaagtgcgaaatag

SEQ ID NO: 3905 - DNA, 420 bp, Pseudomonas aeruginosa
tgctcgaccgcgaaggttcccttcggcgtggcccgcgacaacctctccagcctgttggcaggggagcgcgtcagcctggtgggcggcgacatgctgcaagaggtgccgtccaacggcgatatctacctgctgtcgcggatcatcggcgatctggacgaagccgccagcctgcggttgctcggcaattgccgcgaggcgatggccggcgacggccgggtggtggtgatcgagcggaccatctcggccagcgagccgtcgccgaagtcggtgctctgggacgtgcacctgttcatggcctgcgctggccgtcaccgcaccaccgaggaggtggtcgacctgctcgggcgcggcggcttcgcggtggagcggatcgtcgacctgccgatggaaacccgcatgatcgtcgctgccagggcctga

SEQ ID NO: 3906 - DNA, 4704 bp, Pseudomonas aeruginosa
cctgcggcaactggtcgagccagcggtcgtcgaacagcgcgcgggcgctgcgcaggttggcgcgggcctcgcggatgtcgtggttgcgcgccagcgcctggtcgaccaggcgcaccagttgcggatcgtcgaagaaactccaccagggcgcttcccgccgctcgccggagaactcgccgaggtgctcgctggcgacgcgtggcggcggcgactgcggacgctggtagtcggggccgacgctgcaggcggccaggccggtgccgaccgctagggccagcgccaggcgcgaaaggttcgggtaggagcgcttcatgccttgttcaccagcagatcggcctcggccagttgccggctgcgcgggctcttgtcgacttccgcgtggttgcgcgccagcagggtatagacggtgggcagcacgaacagggtgaagagggtgccgaccagcatcccggagacgatcaccacgcccaggccgaagcggctggcggcgccggcgccgctggcgaagagcagcggcaccaggccgaagaccattgccgcggtggtcatcagcaccggccgcaggcggatctgcgcggcgcgcaggatcgccgcgcggcggtcgaggcgctcgtggagttgcagttcgttggcgaactcgaccatgaggatgccgtgcttgctgatcaggccgatcagggtgaccaggccgatctgcgtatagatgttcatcgtcgcgtagcccagcgccagcggcagcagcgcgccgcagatcgacagcggcacggtgatcaggatgatcagcgggtcggccaggctctcgtactgcgcggcgagcaccaggtagatcaccaccagggcggcgaggaaggcgaacaccagggtgttgccttcctgggtgtattgccgcgagtcggattgccagtcgtggctgaagccggccggcaggccgcgcgccacgtcgtcgaggaaggccaccgcctggcccatggagacgccgggcgcggggatcgcctggagggtcgcggcgttctgctggtcgaactggatcagcttgttcggttcgacctgaagcgccacccggaccaccgtcgacagcggcaccaggttgccgtcctgggtgcgcacgaactgtcgtgccagcgcttgcggagtgaaacgctggtcgcgcaggctctgtgggatcacgtcgtaggagcggccctccatgccgaagcggttgacgtagttctcgcccaccagcaccgccagcgactcgccgatgtcctgcatgcggatgcccaggctgttggccttggcgcggtcgatgcggacctggaccaccgggttgttgtagtcgaggtcgctgtcgaccaccacgaacagcccgctctgtcgggccttctgcttgatctcttccatggtccggtagagcaccggatagtcctgcgggctgcgcagcaccatctgcaccggcaggccgccggtggagccgggcagggcggccaactggaaggcgaagatgctgctgccctcgacgtcgccgaccttgccttgcagctcggactggatcgccgaggcgtcgcgctcgcgcttttcccaggccgccaggttgatcccgccgaagctcgccgccggtccgtcggtgccgttgatgatccaggtgctcacggtttccgggatgctggtgtagacctggtcgagcttgcgcgcgaacagttcgacatagtcgaggttggcgtgctgcggcgccttgatcgcggtgagcaccgcggcctggtcctcggtcggcgccagttcgcgcttgggcatcgaatacagcagcggcaggctgatgcacaccagcaatgccaggccgccggtcagccagcggtggcccagggagaactccaggacctgcccgtagcgccgcgtcaggccgccgaagaaccactcggcggcgcggcccatgcgcccctcgttctggtgcgcctggagcagcagcgaactcatcaccggcgacagggtcagcgccaccaccccggacacgatcaccgcgcccgccagggtcagggcgaactcgcggaacagcgcgccggtgaggccgcccatcaggccgatgggggtgtacacggcggccagggtgatggtcatggcgatcaccgggccggccacttcgcgggcgccgatcagcgccgccgccaccggcgacttgccttcctcgatgtggcggtggacgttctccaccaccacgatggcgtcgtccaccaccagcccgatggccagcaccatcgccagcagggtcagcaggttgacgctgaagccgaaggccagcatcagcgcggcggcgccgagcatcgacaggggaatggtcgccaccgggatcagcacgctgcgcagcgagccgaggcagaggtagatcaccagcaccacgatcagcagcgcttccaccagggtccgcaccacctcgtcgatggaggcctggatgaagcgcgaagtctcgtaggcgaggtcgacgcggacatccggcggcagggtcttctggatctccggcagcagcttgcggatgccgtcgacgatcaccagcgggttgccggtgggcgtcgggaacaaccccaggtgcaccgccgggtcgccgtccatcagtgcgctggtctcggtggccgcggcgcccagttcgacggtaccgacgtcgcgcaggcgcaccaggccgttgccatcgttgcggatgaccatctcgcggaagtcgtcgacgttggtcaggtcggtgttgacccgcacgttggacagcacgtactgccccttcaccatccccggcgccgcctggtagttgttgcggcggatcgcctcggccacgtcggaggcggtcaggccgcgcccggcgaggcggtcggcgtcgagccagaggcgcatggccaggcgctggccgccaaaggtctggaccttggccacgccgtcgatggaagagaacatcggctcgaccacccgcgacaggtagtcggtcaacgccgggatcggcagggtcttgctggaaaagccgacgtaggctaccgcggtggtctcgccggaagagcgttcgatcaccgagtcgtaggcacgctcgggcagcttgtagcgcaccgagttgaccttggccatggtctcggtcatcgcctgggtcgaatcgcggttgagcagcatgcggatggtcaccacgctacgcccctgcaccgaggtcgaggaaaggtagtcgatgccctccaccgacgacaccgcctgggcgatcggctgggtgacgaagccttgcatgagatcggcggaggcgccggggtactcggtggtgacggtgatggtcgagctttccagcagcgggtactggcggatcggcagcttgcccagggagaacaggccgagcagcaggatcagcgtgctgaccaccagcgccagcaccggccggcggacgaacaggtcggtaaaggtcatcgcggggttccttcagcggccggcgaccggcacggggggcgcggcgctgctcagggtgtcttccttgaccggttccacggccatcccgtcgctcaggttgatctgtccggaagtcactacccggtcgccctcggcgaggccctggaggatttccacgcgaccgtcccagcgctcgccgatccgcaccgagacgcgcttggcgctgagcggccggtcgccgtcctggtgggcgacgaacacggtgtcgccgtaggcggtataggtgaccgcggtttccggcacgctcagcgacggcgcgtcggctttgcgcgagacccggatgctggcgaacatgccggcggcgagcaggccttcggggttgtccagcaaggcctggacctgcaccgtgcgcgacttgccgatcagcgggtcgatggcgctgatgcgcgccgggaagctgcgccccggataggcgtcgaccaggacctcgaggggctggccgagcttcagctcgggactggtgctttcgtccagggagaaattgcttttcagggtccgcgcatccaccaggctggccaccggctcggcgacgccgaggtactggccgaggtgcacgcggcggatgccgagctggccggagaagggcgcgcggatcgccttctggtcgatcagcgcctgggtctggcgcaccgcgccgagcgccatgtcgcgggcggcgacggcgttgtccagctgttcctgcgaggcgacgttgcgctctaccagcttgcgcgcacgggcatggaggatctcggcattgcgcaactgcgccttgagacggatcagctcggcctgttccaccgcgtcgttgagttgcaccagcaactgcccttgctgcacctgctggcccgattcgaaggcgatgcgggtgatccgtcctgccgcttcggcggccacctggacctggcgaccggcctccagctcgccgacgccatcgaagacgcgcggcaccacccgccgctccaccgaggcgagggcgacctttaccggcgggtagccggcgaaaccgccggcgtctttcttcgccgagccggtggcgtagacggcgatgccgataaccgccgcgcagatgagcgcggcactggcgatcaggacgggtttctgcatgatcgcctcaggccttctggtaggtggcggccacggagacgtcctggcgcagccgctggcgttgcgcgctggcgatggccgtggcgatcaggccgccgatcaccgcgatgtgttcgagggcgaagaacatcgccagcttggcttcgacgccggtcttgctccagaaggtgtggacgatga

SEQ ID NO: 3907 - DNA, 408 bp, Pseudomonas aeruginosa
caacgcgcgactggtgccggtggagacttccagggcgacccgcggacaggccttgtgatagctcgccagcagcgccggcaggcggctggccgcggtgctttccatgctgcccaggcgcaggcgcccgccgggcttggcgggatgcatcgactgacgcgcctcgtcggcgagagccagcaactgctcggcgtaggcgaggaattcgctgccgcgttcggtcaggctcatgcgcttgccgtcgcgcaggaacagttcgacgcccaggtcctcctcgagctggcggatccgcgtggtgacgttcgactgcgctcgctgcaactgctgagcggcgcgggtgacgctggcctcgtgggcgaccgcgcggaagatttcgagggaggaaaggtccatcgatctatctctttatga

SEQ ID NO: 3908 - DNA, 1134 bp, Pseudomonas aeruginosa
ggaacgggacgtctccatcgccagcggcgcgcaggtgatccaggcgttgcgcagcgccggccaccaggtgctggcggtggataccgccagcggcctgctcggcgcggaggaagagcgccacctgctggcgagcaaggtcaaggaggtcccgccggactccgactcgctggcgatcatccgcagcggcaagcagagcctgctgagcgccggcgaactggctggggtcgacgtgttcttcctcgccctgcacggcggcaccggcgaggacggcaccctgcaggcgctgctggatgccggtggtttcgcctataccggcagcggccacctggccagcgccatggcgatggacaaggacgtggccaagcgcctgttcctcgccgccggggtggagaccgccagttggctgatggcgccggcctcggaagaggcggtgcgcgagcaactgggcttccccctggtggtcaagccgaacagccagggctccaccgtggggctgtccatcgtgcattcccaggccgaattgcagccggccatcgagctggccgggcgctatggcgacgaggtgatgctggagcgcttcgtcgccggccgcgaggtcaccgtcggggtgctcgacgaccaggcgctgccggtgggcgagattctcctcggcggccaggaggtcttcgactacgagcacaagtaccaggccggcgcggtgcgcgaggtgtttcccgccgacctgccgccggcgatcgccgccgaggcccagcgtctggcgctgaaggtacaccgggcgctgaagctgagcggctacagccgcaccgacttccgcctcgacgaacagggccggctctggtgcctggaggtcaataccctgccgggcatgaccgccaccagcctgctgccgcaggccgcggcggcggccgggatcggtttcgccgaactctgcgagcggatctgccggctcggaatcgagcgctgcaagggcgcgcgcaaggcgcgttcctgattcccgcggcccgccaccggggcgggccgcgcctttcgctcaggcctcgaggttctcgacccgctcgagggtgtcgtagaggctgtagcgctcctgttcgtcgcgtcgcacccggcccatggcgacgcacggatcatgggtga

SEQ ID NO: 3909 - DNA, 1320 bp, Pseudomonas aeruginosa
ccgcttcgcggttatccgccgttatcgcgggctgtcggcggacagcgcgttgcatgctgtcccggaaaaaacacgcggcccacgggccgcgcgacggaagcttcagaactgttccgcctccaggccgtacaggctttcgctgccggcttcgacggcggcggcgagggagtgcacgcggggcaggatgcgggcgaagtagaagcgcgcggtggccagcttgccgtcgtggaacgccgggtcgacctcgcgctggcgctgcgcggcggcggccatgcgcgcccagaggtaggcgtaggcggtatagccgaacagatgcaggtattccaccgaggctgcgccgatctcgcgcgggtcgttgccggcgcgggcgacgatgccctgggtgaggttgtccagcaggtccagggcggtcagcagcggggtgacgaactccgccagttcggcgttggcgccggcggcgaaggctcgcacctcgcggctgaagatggagaggaacagcccgccgttggcgaccaccttgcggcccatcaggtcgagcgcctggatgccgttggtgccttcgtagatctgcgcgatgcgtacgtcgcgcaccagttgctcctggccccattcgcggatgtagccgtggccgccgaacacctgctggccgagcacgcagctctccaggccggtatcggtgaagaaggccttggccaccggggtcaacagggccaccagggcttcggcctggctgcgttcttcctggtcctcggcgtacttggccaggtcgagctgctgcccgacataggtggaaaaggcgcggccgccctcggtcagcgccttcatggtgagcagcatgcggcgcacgtcggggtgcacgatgatcgggtcggcggccttgtccctggccaccgggccggtcggcgcgcggctttgcaggcgctcgcgggcgtaggcgacggcgctctggtaggacatctcggcgcagccgatgccctggatgccgatggacaggcgctcgtagttcatcatggtgaacatcgccgccaggcccttgttgacttcgccgaccagccagccactggcgccgtcgaagttcatcacgcaggtggccgaggccttgatccccatcttgtgctcgatggagccgcagtgcaccgcgttgcgtgcgccgagcgcgccgtcgtcgccgaccaggaacttcggcaccaggaacagcgagatgccgcgcgaaccggccggcgcgtcgggcagcttggccagcaccaggtggatgatgttctcggtgaggtcctgctcgccgccggtgatgaagatcttcgtcccgctgatcctgtatga

SEQ ID NO: 3910 - DNA, 1749 bp, Pseudomonas aeruginosa
  unsure (1162): Identity of nucleotide at the above locations are unknown.
acggccggcgggacggccgcaggtacagggttgcccgtgcgcatcctgcctacggccgccgtggcacggccgctgcacgggcaattcggctggcggcgctcagagggcggcggcccactcgcgcagcacgtatttctggatcttgccggtggaggtcttcggcagttccgagaacaccacggtacgcggaatcttgaacgcggccaggtgttcgcgacagaacgcgacgatctcgctctcggcgagcccctgatgatcgctcttcagggtaatgaacgcacagggcgtttccccccacttttcgtcgggccgcgccaccaccgccgcatccagcaccgccgggtggcggtagagcacgccctccagttcgatggtggagatgttttcgccgccggagatgatgatgtccttgagccggtcgcggatctcgatgtagccgtccggatggcagaccgccaggtcgccggtatggaaccagccgccggcgaaggcttcctcggtggcgctgggattcttcaggtagcccttcatcacggtattgccgcgcatgaatatctcgccgatggactggccgtcgcgcggcaccggctcaagggtcttcgggtcggccaccatcaccccttcgagggtcgggtagcgcacgccctggcgcgacttgatcgcggcgcgtcgctccagcggcaggtcgtcccactcgccgtgccaggcgcagaccgtgaccgggccgtagacctcggtgaggccgtagacatgggtgacgcggatgcccatctcttccaccgcgccgatcaccttggccggtggcgcggcgccggcgaccatggcatgcaccgggtggtcgatggcggccttggccgaatcgggcatgttgatcagggcgttgagcacgatgggcgcgccgcacaggtggctgacctggtgctcgcggatcagggtgaggaccttttgcggatcgacccgccgcaggcagacgtggacgccggccagcgcggtcaccgtccacggatagcaccagccgttgcagtggaacatcggcagggtccagaggtacaccgggtgctggcccatggaccaggtcatctggttgcccagcgcgttcaggtaggcgccgcggtgatggtagaccacgcccttggggttgccggtggtgcccgaggtgtanttcagcgagatcgcctgccactcgtcccggggccattcccaggcgaactgcgggtcgccctcggcgagcagcgcctcgtagtccagttcgccaaccgggcggccttcgccatactcggggtcgttgacgtcgaccaccagcggcgggtggtcgagcataccgatggcggcatggatcacctcgtggaattcgtagtcggtgatcagcaccttggcttcgccgtgttgcagcatgaaggcgatggcttcggcgtcgaggcgtacgttgagggtgttcagcaccgcgccgatcatcggcacgccatagtgcgcctcgagcatctcggggatgttcggcagcatcaccgccaccgtgtcgccctggccgatgccgcgcccggccagggcggaggccaggcgtcggcagcgttggtaggtctgcgcccagtcgcggcggatgttgccgtggatcaccgcggggtagtgcggatagacgctggcggtgcgctcgatgaagctcagcggcgtcagggcgatgtggttgacggcggcgggcgcgagaccctgttcgaagatcgacatgaagagtaccccgtggctgattgttag

SEQ ID NO: 3911 - DNA, 675 bp, Pseudomonas aeruginosa
cgaagcgctggtctacgtggtcgacgacgaccagggcatgctcgaatcgacggtctggctgctggaatcggtcggcctcaaggcacggcccttcacccagggtcgggacttcctcgatgcctgcgagggcggccgccatgcctgcgtcctgctcgacgtgcggatgcccggcatgggcgggctgaacgtgcaggacgaactgctggcgcgcggcatcgacctgccggtgatcttcgtcagcggccatgccgacgtgcccatcgtggtgcgcgccttcaaggccggtgcggtggatttcatcgagaaaccctacaacgaacaattgctgctcgacagcgtgcagcaggccctcgatcgccacgcccgtcggcgccggcaccgcgatctcgacgccgggttgcgcgaacgcttggacagcctcaccccgcgcgagcgcgacgtgctcttgccgctggtgcgcggccataccagccgcgaggtggccgagcaactggaagtcagcgtgaagaccgtcgacctctaccgcgcgcgggtgatgaagcgcatgcaggcccagaccctgccggagctggtgggcatggccatcgccgccgggctggtggacccgctgcgcttgcgcgagggcacctgagcgcgcgcgggccctggcgcagggcgggaagtggcatagtttga

SEQ ID NO: 3912 - DNA, 942 bp, Pseudomonas aeruginosa
tatctcatatggttatatgaaaaccatatttcaccggatgtttggttattaatagactgcggcccacccggcgcccgacgtcgaaccccattcctccgcgagatacccatcatgaagattcgcctgcttggcgcagccgtggcggctgtgttcaccctgatcggcagcgctgcccatgccgacgacctggccgacatccgcaaaaagggcgagatcgtcatcggcacccttggcaccgacgagccgaacagcttcatcgacccgaagacccgtcagatcatcggctacgaggtcgatcttggtaccgagatcgccaaggccatcggggtcaagccggtgttcaagcagatttccgtggcggcgcgtatcccggagttgcagcagggccacgtggacctgctcgccgcctcgctgacccacaacaaggagcgcgaggcgctggtggatttctcctattcgatcatcgtcaccgggcagaaggccctggtgaagaagaacgccggcttcgcctcgctgcatgacctcgacggcaagaaggtgctgacggtcaagggcggcacccaggagccgaacatccgcaaggcgttgcccaacgcccaggtggtcaccttcgagaccagccagcaggcgctgctggcgttgcagcagggcaagggtcaggccttcgtcgacgacgagtcggcactggtcaacgatttcggcaagctcggcgcggcggccggcggctacgccatcctgccggagaacctgagtaccgaggccctggccatcgccttccgcaagggcaatccgcaactcaagcaactggtcgactcgaccctcgccggcctggagcgcagcggcgtggcggagcagctgtacctcaagtggtacgggccgggcaccaagtccaacctcagcgagcgccacttcaagatcgattccgaccggatccccgagtga

SEQ ID NO: 3913 - DNA, 1353 bp, Pseudomonas aeruginosa
gatgctggtcgccggcctgctgctgtcgctgaagctggccgccgtcaccctggtcttcgccgtgccgctggcgatgctggtggcgctgctgcgcctggcgccgttccgcgccctgcaatggctcggtttcgcctatgtcgagagcatccgcaacgtaccgctgctggcgcacatgctgttctggtacttcgccgcgccggaatggctacccgaggacctcaaggcctggctttacgccggcaacatcgaggccgccagcgctatcgtcgcgctgaccctgtacaccgccgcgttcatgagcgaggacatgcgcagcggcatccgcgcggtgcccacggtgcaactggaggccgcccgcgcgctgggcttcggctacctggcgagcatgcgcctggtgatcctcccgcaggccttgcggatcaccgtaccgccgctgatctcgcaaaccctcaacctgtggaagaacaccagcatcgccacggtgatcggcgtcgccgagctgatgtaccaggccggccaggtggagagttctaccttccgcagcttcgagtcctttgccttcgccaccgcggcctatctcagcgtatcgctgctgatcaccggcgccgccgcctggtaccagcagcgctatccgggagtcgaacggcgatgaccaccctggaactgatcgatagctactggctgtacttcctcgtcggccagtaccccaacgggccgttgggcgggctggccctgaccctggtcctggcctcgctggcgctgctgctggcgctgccactgggcatcctgctcggcctggcgcgggtcagcccctggcgctggctgcgctggccgatcaccgcgctggtcttcgtggtgcgcggggtgccgttgctgatggtgatcttctgggcctatttcttcctgccgaccctcaccggccagcgcaccgaccagttcaccaccatgctgctggcgcttgtgctgttcgacgcggtgtacctggccgagatcgtccgcgccggcatccagggcctcgaccgtggccagttcgaggcggcgcgttcgctcggcctgggctacctggcgagcatgcgcctggtgatcctcccgcaggcgctgcgcaacatgctgccgtcgttggtcaaccaattcgtctcgacgatcaaggagacctccctgggctacatcatcggcctggccgaagtcagcttcatcgcctcgcagatcaatacccaggtgttcaccctgccgacccaggtctacctgatcctcggcctcacctatttcatcctgtgcttcggactgtcgcgtttcgccttctggctcgaacgccgccaggcgcagcgcggcaatcccaaggaggcccgatga

SEQ ID NO: 3914 - DNA, 852 bp, Pseudomonas aeruginosa
acggtgtcgttggccagggcgatggcttcgtcgatgtcgtcgaaagaggtgaccgagagcagcgggccgaagatttcctcgcggaacagccggctgtgcggcgagacgccatcgaccacggtcggctcgacgaagatgccagcctcggtggcgccgccgaagcgcaccgccaaccgctccgtcctggcctggtcgaggtacgcgcggaccttctcgaagtgcgccgggctgaccagcgcgccgaggcgattacacggatccagcgggtcgcccatgcgccactcgcggagctgcgcgccgatgcgttcgagcagcgcctcgcggacttcggcatggacgatcagccgcgaggacgccgagcagttctcgcccatgttccagaacgcgccgttgaccacgtgttgcgccaccaggtcgaggtcctcgacatcgttcatcaccaccgccgggttcttgccgccgcactccagtaccacccgcttgaggttggactcggcggcgtacttgaggaacaggcggccggtcgcggtggagccggtgaagctgaccatcgccacgtccgggtggcggcccagcggttcgccggcctcgcggccgccgccggggaccacgttgaacaccccggcggggatccccgcctggctggccagttcggcgacgcgcagggcggtcaggctggtctcgggggccggcttgaccactacggagcagcctgccgccagcgccgggccgatcttccaggcgagcatcagcagcgggaagttccacggcagcaccaggccgaccacgccgatcggctcgcgtaccaccatggccagcgccgccgaaccgaccggggcggtgctgtcgtag

SEQ ID NO: 3915 - DNA, 1392 bp, Pseudomonas aeruginosa
atcttgtcgatcagttcggcatgccagcgcagggtattgatggtttccggcaggtcggtgtgctggcattcgcggatcggcttgccgctgtcgaggctctccatcaccgccagttccagcaggtgctcttccagcagctcggccaggcgcagcagcgccgccttgcgctcggcgggcgtgcgcgagcgccagcggccgtcctcgaacgcccgccgcgcgctggccacggcgtgcccgacgtcctccgcgtcgcaggcggcgacctgcgccagcagctcgccggtggccgggttggtcgaggcgaaggtgcggccgccgcaggcatcgcggaaccctccgtcgatgaaggcgcgctggggaaggtccagcgtcgcggcgatggccgcgtattcctcccggctcagcagctcagtcatggcggccaccctcgacgatccgcgcgacctcgcccttgagcctggcgacgatctccgccagtgccgccttgccggcctcgtccagcgccttcagcggcgcacgtacgccgccggcgcgcaggccggccagttcgcagccgtgcttgatcgactggacgaagtgaccgctttcgagaaagtccatcagcggcatcatcgccgccatgatgcgccggcccttggcgaagtcgttctcgaccacgcaggcctggtacagggcgaggtgttcgccagggatgaagttggagccggcgcagacccaactgcgcgcgccccaggcgaagaactccagggcctggtcgtcccagccgcaggacaaggcgatccgcgggtggcggcaggccaggcggtgcaattgcgcggtggagccggagctttccttgatcgcgacgatgttgcggcagccggcgacggcggcgaagaacgcctcgtccatctccacgcccatccgcgccggatagttgtagagcatgatcggcaggccggcggcgcgatccaccgccagcacgtgctcggcgatctcccgcgaggtcggcagcgcgtagggcggcgagccgaccaggatggcgtcggcgccgatggcgcgggcggcttcggcgtaggccagcgagtcctcggtgcggatcgcgccggttcccaccaccagcggcaggcgcccggcgatgacttcgctggcgtgggcggcgagggccaggcgttcctcggcggtgtgcgcgtagtactcgccggtggagccgccgatcacgatgccgtgcaccttcgactcgacgagaaactccaggacctcggtgaaggcctgggtgtcgatgctgccgtcggcgctcagcggggtgatggcgggggtatagataccttcgaatttcacgggggttcctcctgtgggatgctgggccgcggcgcacccggcggacgctgccgcggcgggtggttcaggtga

SEQ ID NO: 3916 - DNA, 534 bp, Pseudomonas aeruginosa
cccgctctgcgtccgcgtcgcggcccttgctcagcagccagcgcggcgactcgggggtgccgatgcgtagcaggaacagcacggcaccgatcgccgcggtgctggccagtaccaggcgccaggcgtcctcgccgccgctgcgcaggatcaggtcgccgaccaggtaggcgaaggcggcgccggcgaaccagaggatggtcagggtggccaggcgcggtccgcgatacttcttcggcaggaactccaccagcaaggcggtggcgaccgggtactcgatgcccaccgccacgccgatcaggaagcgcaggacgaacagcgccgccgccgagtcgaccccgtactgcgccagggaagcgaggacgaacaggctggggccgacgaagaacagcctgcggcggcccaggcggtcggtcagccagccgccgaggaaaccgccgaagaagatgccgaccagcgccgaggcggcgatcatgccctgccagaaactgctcagttgcaatgccgcggtcatctgcagcatcgccacgccgatga

SEQ ID NO: 3917 - DNA, 1104 bp, Pseudomonas aeruginosa
tggagcgcccggggttttcgccgtgacggcaggcgtcgcggcccgctggccgggaacaagaagaacaagaggcacgaatcgatggaaagaaggcgtttcagcgccgccctgcaagggcagaacctcaggttcaccggggccggggaggggggctcggcacgggcgcgggtgggcttcctgctgctcgaacacttttccctgccggccttcacccaggcgctggacaccctggtgaccgccaacctgatccgcagcgagtccttcgcggtgagcaacttcagcctgagcggcgagccggtgaccagcgacctcgggttgctgatctgcccggacctggcgctcgcctcggcggcgctgcaaggactcgacctgctggtggtctgcggcggtttgcgcacgcccctgcgctcgtccgccgcgctgcgggaagcgttgcaggacgtggcgtcgcgcggcgtcgccctggccgggctgtggaacggtgcctggttcctcggcgacgccggcctgctggatggctaccgctgctgcatccatcccgagcaccgcgccgccctcgccgagatcgcccgcaacagccaggtgaccagcgacagctatatggtcgaccgcgaccgcctgaccgcggccagccccaccggcgccttcaacctggcgctggagtggatcgcccggcgccacgggcgcgacctggtggaggcggtggtggatatcctcgccttcgaggagtcgcgctaccggcgggtgcgccccgccctgcacgagaagatgagcgagccgctgcgcgaagtgatcaacctgatggcggcgaatatcgaggaaccgctcagccaggagcagctcgcccactacgtggggcgctcgcggcggcagatcgagcgattgttccagcagcagctcggaaccacgccggtgcgctactacctggagttgcggatcaccgagtgccggcgcctgctgcaacattccgacctgaccatgctggaggtcctggtcgcctgcggcttcgtctcgcccagccacttcagcaagtgctacaccgccttctacggctacccgccgtcgaaagaagtgcgctacggcaacgtccgctcgacgaaatga

SEQ ID NO: 3918 - DNA, 414 bp, Pseudomonas aeruginosa
tctcgatttcgatgccgacgatcagccggagcatctcgtcgatgtagtcggcggggccgtcggtcattttccagggcgtttcctgggtcgcctcgtgggtgcgggtcaggcgcgccaccagtccgcgcacatagcgttcgtcgtcgcggatccgcacccggccgtgggcgtggaccacccggtagttccaggtcggcacctggcggtggtgctcctgcttgctcgggtaccactgcggcgagatgtaggcatcgccggcgcggaacaccaccagcacctcgtcgccgtcgcgcagctcgctccaaaccgggttgttgcgcgcgacatgggcttccagggtgccttgcgcgcccttttccgggctcagctcgaacggcaggtggttggcgtccaggcccgcttcgccgtggctga

SEQ ID NO: 3919 - DNA, 1875 bp, Pseudomonas aeruginosa
gtggatttctaccatccgggctccgccctcaccatgaaatcagcgaatgaattattagctgtgctgatgatcgggtggtcgggttcagctgcgctaatggcgggagcgacgttcgcttgccggcgaagccggcgccagagccttccgccggccgggaggggctggacagcgagacgcgaggggcgcagtgttcgagcggtcagaaccgccaccacccgaggtagaacgcagatggccaaggcagccgatgtggttgtgcaatgcctggaaaacgagggcgtgcagtacgtcttcggaattcccggcgaggagaatctcgacctgctggagtccctgcgcaagtcgcagatccggctggtgctcacccgccacgaacaatcggccggcttcatggccgccacctatgggcgcctcaccggcaagaccggggtcagcctgtcgaccctcggcccgggcgccaccaacctggtcaccgccggcgcctacgcctacctgggcggcatgccgatgctgatgatcaccgggcagaagccgatcaagaagtccaagcagggccgcttccagatcctcgacgtggtcggcatgatgcagccgctgaccaagtacacccaccaactggcctccgccgacaacattccctcgcgggtccgcgaggcgttccgcctggccgaggaagagaagcccggcgcggtgcacctggagctgccggaggacatcgccgccgagcagaccgacagcctgcccatcccgccgagcctgagccgccggccgctggcggaatacaaggcgatctgcgccgcggtggagaagctgcgcgccgcgcgcagcccgatcctggtgatcggcgccggggccaaccgcaagatgaccgccaaggtcctcaagcaactgatcgacaagaccggcattcccttcgtcaccacccagatgggcaagggcgtggtcgacgagcgtcacccgcgcttcctcggcaacgccgcgctgtccgccggcgacttcgtgcatcgcgcggtggaggcggccgacctgatcgtcaacgtcggccacgacgtgatcgagaagccgccgttcttcatggttcgcggcggtaccgaggtgatccacgtgaacttccgttccgccgaggtggacccggtgtatttcccgcagatcgaagtggtgggcgacatcgccaacgccatctggcagatcggcgaggcgctggacgataccgcgcactgggacttcacccgcctgctggcgatccgcgaggccaacgaggcgcaggtcgccgaaggcgccgacgacccgcgcttcccgctctatccgcagcgcctggtggccgacgtgcgccgggcgttgccgtcgcagggcatcgtcgccctggacaacggcatgtacaagatctggttcgcccgcaactacaaggcgcacatgcccaacaccgtgctgctggacaacgccctcgccaccatgggcgccggcctgccctcggcgatggccgcgcacctggtctacccggaccggccgatcgtcgcggtgtgcggcgatggcggcttcatgatgaacagccaggaactggaaaccgcggtgcggctgaagatgaacctgacggtgatcatcctgcgcgacaacggctacgggatgatccgctggaagcaatcgaacatgggcttcgccgacttcgggctggactacggcaacccggacttcgtgcgctatgccgaggcctacggcgcccacggccaccgggtcgacagtgccgagggcttcctgccgttgctggagcgctgcctgggcacgcccggggtgcatgtgatcgattgcccggtggattactcggagaacgaccgcatcctcaacgtcgagctgcgcgaacgcgccctggcggtctga

SEQ ID NO: 3920 - DNA, 1578 bp, Pseudomonas aeruginosa
accgccggagcgtcgcgccggcgtgcgttccggcgcgacggctcagaacagcgacaggttgtagctggcgatcaggcgcacctcgtccacgtcgcgcgccgagcgctcgaagtcggtgcggtaggtggcgttgcgcaggcgcaggctgaggtccttgaagcggccgctctgcaccacgtacttcagctcgatgtcgcgctcccattccttgccctcgtcgccgttggccaggcggatatggtcgccgttgacgtagcgggtcatgaagctcaggccgggcacgccgacgctgcgcaggtcgaagtcgtagcgcagttgccaggagcgttcctcggggttggcgaagtcgttcacctgcaggtagttggccaggtacggattgctgccgtcgaggtagggcatcgagctggcgccgttcatccgctgccagccggcgctgagcgtgtggccgccctgggcgtaggcgagcagcaggctgagggcgcggttgtcgatcttgccggcgcgggccgcgccggcgtcctcgctgtcgaaccagcgcaggtcggcgctcagcttgccggcgccgagctgccgcttgcccacggcaccgaggtagcgctggcgatagacgttgcgcaggccgccctgggcgtattgcagcagcaggccgtcgttgacctggtagtcgagtcggtaggcgtcgaagcggttgccggtggtgtcgcaggcgtagcgtttgttcttgcagtgcaggcggatgtcctgggcatcgctggagtcccgcgcggtgtagcgctccaggcgggtggcggagaacctgagcccggcgatctcctcgctggtcagctgggcgccgtggaacagggtcggcagcaggcgtccgtcgttgtatttcagcaacggcatgtccggcagcatcgccccgtacctgaactgtgtctgcgagaagcgcatcttgccggcaacgccggccttggcgtactggtcgaccgagcgacgcggatcgtggccgctggaaggcagcaggccgctgttgctgtccgcggggctggagtcgagcttgatcccgagcatcgccagggtatccacgccgaagcccagcgcgccctcggtatagcccgagcgcaggtcgaggatgaagccctgcgcggcttcctcgcgcttggaggcgccctgcgggttggccgagctgccgtcgcggaagtcgcggttgaagtagacggtgcgcgcttccaggcgcgcgctgccgtcctcgaggaaggcggcaggggccggggcgacgaatccgccgcacagggcgagggcgcccaggccgcgaagggtgcggggcgaacggggggaaaacggggaggacatgcggtgactctcgacagcgggggtaaaaaagcgcgcgaaggtgtcacagatggccggcggggtctttgcgaccttggtctagccgagaaggcgcgcacggatcgtcggccaggcaggcctctagcgggtcggacgcagcgtgccgaaagcgacgaagaatcctccgcagccccctgtgaaacgctgccccgcccgtgccagcctgatcgtcacgtttgcgccaggatatccggaggctag

SEQ ID NO: 3921 - DNA, 294 bp, Pseudomonas aeruginosa
gagtatttccccatggcccgagccactgcccgccacatcctggtttccagcgaagccaagtgcaacgaactgaagaccgccatcgaaggcggtgccgacttcgccgaagtcgcccgcgagcattcctcctgcccctccggccgcgacggcggcaacctgggctcgttcggccccggccagatggtccgcgagttcgaccaggtggtcttcagcgcgccgctgaacgtggtccaggggccggtgaagacccagttcggctaccacctgctggaagtcaccagccgccaggactga

SEQ ID NO: 3922 - DNA, 765 bp, Pseudomonas aeruginosa
gcggcgccgtcggcggtcaggttgagcttgcgcgtggtgcggttgagcaggcgtacccgcagccgcgcttccagttgctggaccaactgggtgacgctggtgcggctcatgtgcagcgtctccgccgccttggtgaagctgccggtatccaccacacgggcaaaggcctgcatcgcatcgaaacggtccatcgggactccgggtcgtcggggattgtttggattctacaaacagtcatggccagggttgcgcgtttatccacggcgcgcacgaccttaccgttcttccatcgacgatgacggggccgggagccccaggatggaggtatcgcatgactgtacgcgacgtggttttccccgccggccgccaggccctctacgagcgcaaccgctattccccggcggtccgcagcgacggcctgctgttcgtctccggccaggtcggcagccgcgacgacggctctcccgaacccgagctggagacccaggtccgccgcgccttcgacaatctgaacgcggtgctcgccgcggccggttgcgggttcgacgatgtgctcgacgtcaccgtgttcattgtcgacgccgaggccaacttcgagcgcatctggaagatcgtcccggagtactggggcgaggcgccgtaccccacgctgacggcggtgggggtgaactggctgtatggcttcagcttcgagatcaaggtggtcgcgaggttgccggaggggcggtgagagccgatgcgcagtgccggggccagctcggctag

SEQ ID NO: 3923 - DNA, 717 bp, Pseudomonas aeruginosa
agactggcgatacccgccgagcatctcaacgcctgcctcggccgccgctacgccgaggcgctccatcgcgccgggctgcgtgaggtcgacctgctcggctactgctccggcgggctggtcgccctggagaccgccaagtccctggtccagcgcggggtgcgcgtgcgccaactggatatcgtctccagctaccggattccctaccgggtggacgacgagcgcctgctgttgttcagcttcgccgcgaccctcggcctggataccgcggcgctcggcttccccgcgccggaacgtctcggcctggcggtgcaggcggcgctcgcgcaaacaccggagcgcctgggcgccgaggcgttggcggggctaccgggcctggccgatctcgtcgccctgcgcggccgcgtgctacaggcggccagcggtagcgccgacgccgtcagcgtcgaacgcgacaccctctaccgactgttctgtcactcggtgcgtgccagccaggccgcggcgccggagccctacgtcggcgcgctgcggctgttcgtgccggacgccggcaacccattggtgccgcgctacgccgaggccctggagacccaatggcgggccgccgcgctcggcgcgtgcggcatccacgaggtgcccggcgggcacttcgactgcctgggcgaagccctggcgcaatccctgtcgaaacccatgccagaggaggcgagccgatga

SEQ ID NO: 3924 - DNA, 1977 bp, Pseudomonas aeruginosa
  unsure (44),(82),(182): Identity of nucleotide at the above locations are unknown.
cgacggcctgttcgcgctgttcgacgagatagccggcgaaccgntgcccagcgcccagctttggtatgccgaaccgtgcagntgggcccaggtgcaccagcgcctgtggccggcggcggcggccgaggcgctggcgctgctcgccaacggcgacgaggtgcgccggcgcaaccagcgcagcntggaggtcgccgccctgtggcagcggatcggcgagcgccttggcttccccgaggcgccgccggcgtcgctggcgccggcgagcctggaacaggtgctggagcaagcctcgtgaccccggtgctgtggcgcctgctgcgcacctatcgctggcggctggcggcggccatggggttgcaggccctggccgggctctgctcgctgttgccctggatgcttctcgcctggctcgccgagccgctggcgcgcggccaggcgcagccggccctgctggccctggtgctgctggcggtgctggcctggctgggctgccaggcgctggccgcgcacctggcccaccgggtcgacgcggacctctgcaacgacctgcgcctgcgcctgctggcgcacctgcaacggctgccgctggactggttcggtcgccagggcccggacggcgtggcgcgcctcgtggagcaggacgtgcgggccctgcaccaactgatcgcgcacgctcccaacgatctcagcaacctgttggtggtgccgctcgtcgcgttgctctggctggcctggctgcacccctggctgctgctgttctgcctgctgccgctggtgctggccgccgccggcttcctgctgctgcgctcggcgcgctatcgcgacctggtgctgcggcgcaacgccgcgctggaaaggctctcggcggactatggcgaattcgcccacaacctgctgctggcccgacagtaccccggcgccggcatacaacagggcgccgaggcgtcggcggcggccttcggcgaagcgttcggcgcctgggtgaagcgggtcggccacctcgccgcgctggtctacgtgcagttgtcgacgccctggctgctggcctgggtcctgctcggcgcgctggccctggatgccctcggcgtgccgctggcgctcggccaggcctgcgccttcctgctcctgttgcgggccctggccgccccggtacaggcgctcggccacggcggcgactcgctgctgggcgcgcgcgccgccgccgagcgcctgcagcaggtgttcgaccaggcgccgctggccgagggccgctcgacccgcgagccggtcgatggcgcggtggcgctgcacggcctgggccatgcctatgaaggcgtggaggtcctggccgatatcgatctggagctggaggatggcagcctggtggccctggtcggtccctcgggctccggcaagagcaccctgctgcacctgctggcgcgctacatggacgcgcagcgcggcgaactggaggttggcggcctggcactgaaggacatgcccgatgccgtgcgccatcggcatatcgcgctggtcggccagcaggcggcggcgctggagatatccctggccgacaacattgccctgttccgccccgatgccgatctccaggagattcgccaggcggcccgtgacgcctgcctcgacgagcgcatcatggccctgccgcgtggctacgacagcgtgccgggacgcgacctgcaactgtccggcggcgaactgcaacgactggccctggcccgtgcgctgctatcgccggcgcgcctgttgctgctagacgagccaacctcggcgctggatccgcagaccgcccggcaggtcctgcgcaacctgcgcgaacgcggcggtggccggacccgggtgatcgtcgcccatcgtttggccgaagtcagcgatgccgacctgatcctggtgctggtcccctggccgtctggtcgaacgcggcgagcaccccgccctgttggcggcggacggcgcctatgcgcgcttgtggcgtga

SEQ ID NO: 3925 - DNA, 1335 bp, Pseudomonas aeruginosa
  unsure (93): Identity of nucleotide at the above locations are unknown.
acagaacggcgcggaggtggcggcatgaccctgttcgaacgaatgcgtgcgctgcccgaagactgccgtgccgcgttgcgccgggcgagcgcntgggcggtcctggcggcgctgctggacgccgcttgcggcgtattgctggtgccgttggtcgaggcctggttcgccgaaggcgcgttgccctggcgctgggtcgccgcgttgctcggtttgagcctggcgcaggcgctgttgcagtacctggccatgcgtcgcggtttcgccgccggcggctcgctggcggctggactggtgcgcagcctggtggcgcgcttgccgcgcctggcgccgccggcgttgcgccgggtcgcgccggccgaaggcctgctgcgcggcccggtgatgcaggcgatgggcattccggcgcacctgctggggccgctgatcgccgcgttggtgacgccgctcggggtgatcctcgggctgttcctgatcgacccgtccatcgccctcggcctgctccttgctggtgccttcctcgccgcgctgttgcgctggagcgggcggcgcaatctggcggcggaggatgcccggctggccgccgagcgcgacgccgcacggcagttgcaggcgttcgccgaacgccagccactgctgcgcgcggcgcagcgcgaaagcgtcgcccgccaggggctggaagaggccttgcgcagtctccaccgcagcaccctggatctgttgcggcgcagcctgcccagcggcctcggcttcaccctggcggtgcaggcggcgttcgccttcgccctgctcggcggcgcctgggcggtggatcggcaatggctggacggcgcgcgactggtggccgtgctggtgctgctggtgcgcttcatcgagccgctggcccagctcacccatctcgaccaggcgttggcccggcgcctggccaggcgctggataccctgctgccggttttcgccctggctccgctgcgcagtcccgagcccgggcgagcggccgcacgacgccagcctggcggccgaggccgtggaattgcgtctggaaaatggccgcgccttgctcgaggacatttccctgaggctggagccgggttcgctgaacgtcctcgtcggaccctccggggccggcaagagcagcctgctggcgctgctcgggcggctctacgacgtcgatgccgggcgtgtcctgctgggtggcgtggatatccgccggttgagcgaaacgaccctcgccgccaatcgtaacctggtgttccaggacaacggcctgttccgcggcagcgttgcctggaacctgcgcatggcgcgagcggacgccgatctcgaagcgctgcgctag

SEQ ID NO: 3926 - DNA, 417 bp, Pseudomonas aeruginosa
gcggcgcgggcggttggcctgctggaagagatcgaggcctggccgcagggctgggacagcgacgtcggtcccggcggcgcgctgctgtccggcggccagcggcaacgcctgtgcctggctcgcgggctgctctcgacggcgccgttgctgctgctcgacaagcccaccgccagcctcgacgccgccagcgaggcgcaggtgctgcgcaacctgctcgggttgcgcggccggcgcaccctgatggtagtgacccaccgcccggcgctggcgcgtcaggccgaccaggaactgctgctggaggaggggcgcctgcgcctcagcggacgtcacgccgatctgctcgtccgggacgactggtatgccggtttcgtcgggctggcgggcgaggaaagttccgcgacggtcgtggatcgatag

SEQ ID NO: 3927 - DNA, 303 bp, Pseudomonas aeruginosa
gccccgacaccctgctcaccgtcggtgcgcaataccagcacatcgactcgatcaccaacatggccggggtaccgatggccaaggatgggtccaatctcgggctgtcccgcgacacgtacctcgatgtcgactgggaccgtttcaagtgggacacctaccgcgcgttcggctccctcgaacagcaactgggcggcggctggaaaggcaaggtcagcgccgaataccaggaagccgattcgcgcctgcgttacgccggctccttcggcgccatcgacccgcagaccggcgacggtggccagctga

SEQ ID NO: 3928 - DNA, 423 bp, Pseudomonas aeruginosa
gcatgcgccagggcggctacgcactggtcaacatgcgcctgggctacaagatcgacgagcactggacggcggcggtcaacgtcaacaacctgttcgaccggacctactaccagagcctgtccaaccccaactggaacaaccgctacggcgaaccgcgcagcttcaacgtcagcctgcggggcgcgttctgatgccgcgccagtcgggcttcggctgggcctggcgggttccgctggcgctcgccggcagcctggcggcggcgaccgccagcggctatctgttgactcgcgggctgcccctggacgacccgctcgagcgtctctacgccgggctcttcggcgcgctcggggtgggcttgttgctgcttgtcggcgggttgctggcgcgtggtccgggcaacttcgcctggcgcctgggcggtag

SEQ ID NO: 3929 - DNA, 1413 bp, Pseudomonas aeruginosa
cctgctggtactgggcctggcgttgtggctgctggcggggcgcggttgaagtggcggcgcgtcctctcctgctctcgctgcacggtggcgccggcgcgctgttcggcgtgctgctgttcgtggtgctgttcagtggcgcctggagtcttggccacgacgacctgcgcgagtggctgcgggccccggcgcaggcgggaggagaaacccttgcgctggagcgcctgctcgaacgggcgggcgaggaaggcgtcgacatccgcgatgcgaccctgctgctgcctgctcccggccatgccgccttcagcgtctgcgatgcgcgcctggactgccggctggacctcgacccggccagcggccggggtgttgccaccgacgccggcgatggacctcctgctgaacctgcacaagagcctgttcgtcggcttccccgggcgggtggtggtcagcctgttcggcgtatcgctgttgctgctgtgcctggccggcgtggtgctgcacagccgccgctggcgcgacctgcggcgttggcggcgggaccgcgggctgcgcctggcgctgttcgacctgcacggcctgatcggcatctggggactgccctggctgctgttgttcggtttcaccggcgcgctcagcgggctgggcgcgctcgggaccctgctgctggcgccggtggcctacccgcaggaaccgaaccgggtgttcgtcgagttgatgggaccgccgccgcccgccgccgaggggcggccattggcgtcccgcatcgatctcgaccgcctgcttgccggcgatgccgtgcgggcgcccggcttcgtcgcccagcgcttgagcctcagccatgccggggatgtcgccggcagcgtggagatcgccggtatccagcgtggcctgccgagtaccgcgaacttcgagcggcaccgctatcggctggccgacggcgccctgctcggcgagcgcagctcggcgcagcgcgggttctggctgcgcgccttcatcgccgtgcagccgttgcatttcgcccagtaccagtggctcgggccgggctggtccgccgcgttgcgcggcctgcacctggcgatgggcctcggcgcctgcctgctctgcgccagcggcctgtacctgtggctgcaacgacgcgcctcggcgccggacgcccgcgtacggctcttgcagcgcctgagccagggtttctgtgccggcctggtggcggcggccgcgttgctcctgctggggctgcaactcgtgccctcggagctactcgccggaccctggacggggcggctgttccttgtcctgtgggccgccgctggcctggcggcgttgctgctgccgggcgactggccgctggcgcgcgggttgctcggcgtccccgggctggcctgcctggcggccgccgtcgcgcacctggcgccctga

SEQ ID NO: 3930 - DNA, 696 bp, Pseudomonas aeruginosa
ctggatcctgccgatgcaatgcatcgtcctcgcctgcctgctcggcctggcgacgtttggcctcggcgtggccagcgccggttgggcggtcggcctgctggcgctggcttcgctggccagcgcgacccaggacatcgccaccgacggcatggcggcggagcacttcagcggcgagctgctggccaaggtcaacgcggtacagatcgccggggtgatgatcggcttcttcggcggcggcgccggcagcctgatcctcgccgggtatttcggccagcgcacggcgttcctggtcgtggcctgcgtgccgctggcaagcctgtgctgcgtgctcgccctggggcgcggcgccccccacgaactccccccggcaccggccgccaaggccagcctgctgcgcttcctgcgtcggccgctggcgccttcgctgctggcgctggcactgctgtcggcgatgaccgcggtatccggcttcggcctgtccaagctgtacctcagcgatgccggctgggccttgcaggacatcggccggctgggcatgagcggtggcctggtcacggtattcctcggctgcggcggcggcgcctggctggtcaggcggatcggcctgtggcgcggtttcgcccttggcgtggtgctcgccggttgttcggcgctgctctggtatctgcaggccggtcgctggttggcactgagtga

SEQ ID NO: 3931 - DNA, 1371 bp, Pseudomonas aeruginosa
gcgcgcagcgcccggcacccgcacggatgccgcctctcccgcggacgggagaggcgggagagggcaggcgcggtggcctgcccggtgttgctagcgtggccgttccacctggttgcggtagctgccggtgatcgcttccagcgccgcgctcttctcggtcttcggtcgcgaagccgcggcccattcctctttttcccgttcgcggttggccaggatgatcttgttggcggtcggccgccgcgcttcttcgtattcgcgcagggctgcggccacgtcggcgttgcgcgccagcgcggcggccagctcgatgccgtcgaggatcgcctgcgaagcgccgttggcgcccatcggatacatcaggtgggcggcgtcgccgagcagcgtgatgcgtccccggccccagtgcggcagcggatcgcggtcgaccatcgggtactgcaggatcaactggttgcgggtcagcaggtcgcggatgtcgaaccagcccaggtcccagtcggcgaagaacggcaacacgtcttccaggcgtccgttgcggttccagtcggcctcgttgtcgagctggccgacggcggcgctcggcaccatgcacacccagttcaccagcgacttgccttcggccgcgtggcgcgccgagatcggataggcgaccaggcgcgaccagtgctcgtcgttggcgacgatcatggtcttgccgtcgaggaagcggtcgaactcggtgacgccgcgccacatggtgatcccaccgtgggacagcggcccctggtcgggatgcaggtgcgcgcggaccgccgagtggatgccgtcggcgccgaccagcacatcggcaccgagcgccaggggcttgccgtgtccgtcgcgggcgccgatcagtacgcggccgtcgcgctcttcgatgcgctccacgccgagaccggtgcgtaccgcctgttggccgagacgctcgcgcaccgcggcgagcaggatcatctgcagttcgccgcgatggatcgagtactgcggataggcgttgccggcttccaccccgcgcggctcggaccataccgtggcgccgctctggtcgatgtagcgcagctcatgggtggggatggcggtggccgccagcgccgggccgaggcccagttcggcgagggcctcgaccgctgccggctggatattgatgccgacgccaagggggcgtatctcgctgctgctttccagcagcgtgaccttgccgatgccggcctggtgcagggccagggcgcaactgaggccgccgatgccggcgccggcgatgaggatatcgatgggttcgctcatgggtgcttccttttctcgagtgttcgaatcgatgggggttcggctgggacggatgaccgtttaccgccatga

SEQ ID NO: 3932 - DNA, 1224 bp, Pseudomonas aeruginosa
tttcgggaatgccgctcatgccacggtctccagggggaaggttgcgctcgggatcgcttctgcgccggaccaggccatcaccgcgctgagtgcctgccaggggttcagccgcggatcgcagaggctggtgtagtgccggctgacctggtgcaggccgctggaatcggcgacgcactcggtgacgtcgtccggggtggtctccaggtgcagcccggcggccacgccgccggagccggacaccgccaggcggaacgccgccacctcctcggcgatgctgcgcaccaggcgggtcttgttgccgcagggcgcgacgatggtgttgccgtgcatcgggtcgctcagccaaatcaccgggtggccggccgcgcgcaccgcttccaccagcggcggcaggcgctcgccgaccttctgcgcgcccatccgcgcgatcagcgtcaggcgccccggctcgcggcgcgggtcgaggcgctcgcagagcgccagcaactggtcgcggccgatctccgggccgaccttgcaggccaccgggttgagcacctcggccagcagcgccacatgggcgccgtcgacctggcgggtgcgctcgccgatccacggccagtgggtcgaaccgagatagacccggcgctgctcgtcctcgcgcagcatcgacagctcgtagtcgagcagcagcatctcgtggctggtccagaccggcgaggcattcgcctcctgcccggacgcggcgtcccagcccaggtggcgcatgatgttgcgcgccgccgcatagcccttgaggatccgctgcggatcggcccggcgctgttcggcatgggcctcgcggccgttgaccatgtcgccgcgatagaccggcagggtctgctcgccgacctgctcgtgcggcttggaacgcggcttggcgtactgcccggcgatgcgcccgacgcggatcaccggccgccggccggccaggcgcagggcgccggccagcagttccagcacggcggccttgcgcgccacgttctcggcatggtggtcgtccatgtcctcggcgcagtcgccgcactgcaccaccagcgcctcgccgcgggcgacccgcgccagggtcgcgcgcagggccaggatgtcgccggcgcggatcagcgccggactgccgcgcaggtacgcctgcacgtcgcgcaggcgcgacggatcgccccattcgggttgctgcagcgcttcgcagcgccgtacgcgttgcaatag

SEQ ID NO: 3933 - DNA, 1452 bp, Pseudomonas aeruginosa
tcgtcgctgccagggcctgaatcggaactttcaacggttggccccggcggtttcgccggcggccagttggccggcgcccggcgccaggtcgccgctgccccagccgagcgccttgtagagcgcgatgacgttgacgaacgaggcggtctccgcctgcgccagttcctcgcggatctggtacagcgcgcgctggttctccagcaccgccaggtagctgccggcgccggcgcggtagcgttcgttggcgatctccagggcgttcgcgccatgggtcgcggactggaacagggcgaccagccgacgctggtgttcggccagttggttgagcgcgttgccgacgtcctcctgggccagcagcagggagcgctggtagcgcgccagcgcggcgtcggactgcgcctcgacggcgcgcaggcgggcccgcacgttgcccaggcggaacgccggccaactgacgctgggcgccagttcgaaggcgcgcgaggcgctgccgaggtcgccgctgcgcagggcgaagaaaccgatgaagccgcccaggtcgaggcgcggatagagttcggcggtggccgcgccgacgtcttcagtgctcgctgccagttgccgctcggcgctgactacgtcggggcgctggaggatcaggcggtcgacgtcgcccagcggcaggttcttcgccaatggcgcggcgccgccaccgtcgaggatcggcgcgccgctgcccggcgcctcgccgcgcagcacgtcgaggcggtagcgggcgctctccagcgcggtcgccagtggcggaatcgccgcttcgctgcgcagcaggttggcctgggcgttctccacgtcctccggcaggccgctgcccagttgcaggctgctgcgggtcagctccagggtgtcgcgccaactgcgcacctgggcgcgcgccacgtccagccggcgctggtagccctggatctcgaagtaggcgcgggcggtgtcggcggcgatgctcaggcgtaccagccggaggtcggcgtcggccgcttcggcgcgggccagggcggcgtcggaaagtcggccgaggcggccgaacaggtcgatttcccactgcgcgtcgaagccggcgcggtagctctccgccaggcgccggcgcggctcgccgtcgtagtccagctgttgttcgatgctgcggctgtagccggcctggctggtgacctgcggcaactggtcgagccagcggtcgtcgaacagcgcgcgggcgctgcgcaggttggcgcgggcctcgcggatgtcgtggttgcgcgccagcgcctggtcgaccaggcgcaccagttgcggatcgtcgaagaaactccaccagggcgcttcccgccgctcgccggagaactcgccgaggtgctcgctggcgacgcgtggcggcggcgactgcggacgctggtagtcggggccgacgctgcaggcggccaggccggtgccgaccgctag

SEQ ID NO: 3934 - DNA, 492 bp, Pseudomonas aeruginosa
cgccgcgtcaggccgccgaagaaccactcggcggcgcggcccatgcgcccctcgttctggtgcgcctggagcagcagcgaactcatcaccggcgacagggtcagcgccaccaccccggacacgatcaccgcgcccgccagggtcagggcgaactcgcggaacagcgcgccggtgaggccgcccatcaggccgatgggggtgtacacggcggccagggtgatggtcatggcgatcaccgggccggccacttcgcgggcgccgatcagcgccgccgccaccggcgacttgccttcctcgatgtggcggtggacgttctccaccaccacgatggcgtcgtccaccaccagcccgatggccagcaccatcgccagcagggtcagcaggttgacgctgaagccgaaggccagcatcagcgcggcggcgccgagcatcgacaggggaatggtcgccaccgggatcagcacgctgcgcagcgagccgaggcagaggtag

SEQ ID NO: 3935 - DNA, 822 bp, Pseudomonas aeruginosa
cgccgccgagaagggccgggcgctgatccgcgaggtgcgcgggctgaccgacaagccgttcaacgtcaacctgttctgccaccgcccggggcaggccgacccggcccgcgagcgcgcctggctggactacctgaagccgctgttcgccgagttcggcgccgagccgccggcgcgcctgaacaacatctacctgagcttcctcgaagacccgaccctgctgccgatgctgctggaagagcggccggcggcggtcagcttccatttcggcgcgccgccccgcgaccaggttcgcgcgttgcaggcggcgggcatccgcgtactggtcagtgccaccacgccggaggaagcagccctggtggaggccgccggcgccgatgcggtggtcgcccagggcatcgaggccggtggccatcgcggggtgttcgagccggagcgcggcgacgccgccatcggcaccctggcgctggtccgcctgctggcggcgcgcggttcgctaccggtggtggctgccggcgggatcatggacggacggggcatccgcgccgccctggagctgggcgcgagcgccgtgcagatgggcaccgccttcgtcctctgtccggagtcctcggccaacgccgcctaccgcgaggcgctgaaggggccgcgcgcggcgcgcaccgcgctgaccgtgaccatgtccgggcgcagcgcccgcggcctgcccaaccggatgttcttcgatgccgccgcgcctggagtgccgcccttgccggactatccgttcgtctacgacgcgaccaaagcgttgcagaccgccgctctggctcgcggcaaccatga

SEQ ID NO: 3936 - DNA, 1107 bp, Pseudomonas aeruginosa
ctgtctctgttcagttacccctgtgttgtgcttttctgcctccagcactggaacgacaggtggaacatgggacaggacaagttgaaggtcgccgttctcttcggcggcagcagtgaggaacgggacgtctccatcgccagcggcgcgcaggtgatccaggcgttgcgcagcgccggccaccaggtgctggcggtggataccgccagcggcctgctcggcgcggaggaagagcgccacctgctggcgagcaaggtcaaggaggtcccgccggactccgactcgctggcgatcatccgcagcggcaagcagagcctgctgagcgccggcgaactggctggggtcgacgtgttcttcctcgccctgcacggcggcaccggcgaggacggcaccctgcaggcgctgctggatgccggtggtttcgcctataccggcagcggccacctggccagcgccatggcgatggacaaggacgtggccaagcgcctgttcctcgccgccggggtggagaccgccagttggctgatggcgccggcctcggaagaggcggtgcgcgagcaactgggcttccccctggtggtcaagccgaacagccagggctccaccgtggggctgtccatcgtgcattcccaggccgaattgcagccggccatcgagctggccgggcgctatggcgacgaggtgatgctggagcgcttcgtcgccggccgcgaggtcaccgtcggggtgctcgacgaccaggcgctgccggtgggcgagattctcctcggcggccaggaggtcttcgactacgagcacaagtaccaggccggcgcggtgcgcgaggtgtttcccgccgacctgccgccggcgatcgccgccgaggcccagcgtctggcgctgaaggtacaccgggcgctgaagctgagcggctacagccgcaccgacttccgcctcgacgaacagggccggctctggtgcctggaggtcaataccctgccgggcatgaccgccaccagcctgctgccgcaggccgcggcggcggccgggatcggtttcgccgaactctgcgagcggatctgccggctcggaatcgagcgctgcaagggcgcgcgcaaggcgcgttcctga

SEQ ID NO: 3937 - DNA, 501 bp, Pseudomonas aeruginosa
ttcatcatggtgaacatcgccgccaggcccttgttgacttcgccgaccagccagccactggcgccgtcgaagttcatcacgcaggtggccgaggccttgatccccatcttgtgctcgatggagccgcagtgcaccgcgttgcgtgcgccgagcgcgccgtcgtcgccgaccaggaacttcggcaccaggaacagcgagatgccgcgcgaaccggccggcgcgtcgggcagcttggccagcaccaggtggatgatgttctcggtgaggtcctgctcgccgccggtgatgaagatcttcgtcccgctgatcctgtatgaaccgtcggcctgcggctcggccttggtgcggatgatgcccaggtcggtgccggcgtgcggttcggtcaggcacatggagccggcccaggtgccggcgtacatgttcggcaggtacctgttcttcagctcctcgctgccgtgtgcatcgagggccaggcaggcaccggcggaaagggtcgagtag

SEQ ID NO: 3938 - DNA, 2061 bp, Pseudomonas aeruginosa
ataccatataagttcccaggatcatcttccgcccatgagtccgcttcccgcttcgcctgcactcaacagcctcctgcgcctgctgcgcgagggcgcgccgctggtcgagcgggtcggtgcgctgcgccgcttgctgctcgaacatccgggcacgcgccaggcctggtacctggcctggcagccgcaggcgcagacctataccccggtgccgccgtcgccggcgctgccgccgggcgccggcgagccgaaccgggccagcgacctggcgttgcgcgagcggctggtgcgcgacggccggctggctctggacgaattgcggcgttccgcctcctggctcggcgcgcgcttgcggcgtgccggcgtggagcatggcatggccttcgccctcgacctgcaggccggcgacgaaggcctgctgctggtggccagcgatacgccgcagagcgctgcgctggactggctcggcctgctcctcgcaccgttgctcgccgccgcccgtggcgtcacccgcgctgcgccgttcctcgcggccgacccgcagccggcgctgctgctcgacggcgaggcgcaggcggtggaattcaaccaggccttccttgccttgcttggcgagcggccgcgcgaggcctggcgcgcttacctcccggccaaccatgggcaactggtgcgcgccagcctggggcaggcgcgggccctcggcgaggtggaggcggagtgcgacggacgcatcctgctctggcagttcattcccgacagcgccgaggcccgggtgctggcgcgctgccgcgacgccaccgccagcctgcgcggcgagcgcgaggcggcgcgggccagccggctgtaccggctgatcaccgagaacaccaccgacctgatttcccggcataccctcgacggcattttcctcgacgcctcgccggcttcctggaccctgctcggctactggccggaggaactgcgcgggcgtccggcgcaggcgttgttccacccccaggaccgcggccaggtggcgctgcgcgcgcgcgaagcgctggagcaggacggctacctgaccatcacctaccgtatccgccaccgcgacggccgctaccgctggttcgagaccgccagccgggcgatccgcgagacctacaccggggcggtggtggaggtggtcagcgtgtcccgcgatgtcacccggcgggtcgaggcggaggagaaccgccggcgcctggccgaagtggtcgaggcgaacaccgacctggtgctgttcgtcgagcatggcggccgcgtcacctacctcaatccttcggcacgtgccgccctcggcatcgccgacgggcaggaggcgccggcgctggaacgcctgctggccggcgacactccggcgcggctggccgaagagggttggcgacaggcgcgcgatggcggcgtttggagccgcgaggggcgcctgcaaccgcaggacggacgtccgtcgctgccagtctcgctggtgttgctggcccatcgcggccgcggcgaggagcgctattactcgctggtggcccgcgacatgaccgaacgcgaactgcgcgaggcccagcagcgccgtcaccaggacgaactggcgcacactgcgcggctggtcactctcggcgaactggcctcgggcatcgcccacgagatcaaccagccgctggcggcggtgatgaactacgccagcgccagccagcgttacctggccgtcctcggcagccagcccgaggccgccgggcgggtggccgaggggctggcgcggatcggcgagcacgccggccacgcggcggaggtgatcaagcgcctgcgcgccttcctgcgcaagggccagcggcgcctgcaggcgctcgacctcaaccaggtggcacgcgaggccatcggcctctgcgcgtgggaagccgggcactggcaagtggcggtggaagaggcgatgaccgacaatccgccgccgctgtatgccgaccgcgtgctgctcgaacaggtgttcctcaatctgctgcgcaacgccatcgaagccaaccgcgaggcgcatcccggctcgccgtcgcgggtcgtcatcggtag

SEQ ID NO: 3939 - DNA, 897 bp, Pseudomonas aeruginosa
ccgcgtcgagcccggcgggctgctctgcctgtgggttcgcgaccagggaccgggagtgccggcggatcagctggaacacattttcacgccgttccacaccagcaagccggaagggctgggcctgggcctgtcgatgagccgcagcatcgtcgagggcttcggcggcaccctcgaagccgagctgccggcggatggcgggttgctcatgaactgccggctgccgctcgccgccggcgccacgggagggtaacgatggctatgcctgacgaagcgctggtctacgtggtcgacgacgaccagggcatgctcgaatcgacggtctggctgctggaatcggtcggcctcaaggcacggcccttcacccagggtcgggacttcctcgatgcctgcgagggcggccgccatgcctgcgtcctgctcgacgtgcggatgcccggcatgggcgggctgaacgtgcaggacgaactgctggcgcgcggcatcgacctgccggtgatcttcgtcagcggccatgccgacgtgcccatcgtggtgcgcgccttcaaggccggtgcggtggatttcatcgagaaaccctacaacgaacaattgctgctcgacagcgtgcagcaggccctcgatcgccacgcccgtcggcgccggcaccgcgatctcgacgccgggttgcgcgaacgcttggacagcctcaccccgcgcgagcgcgacgtgctcttgccgctggtgcgcggccataccagccgcgaggtggccgagcaactggaagtcagcgtgaagaccgtcgacctctaccgcgcgcgggtgatgaagcgcatgcaggcccagaccctgccggagctggtgggcatggccatcgccgccgggctggtggacccgctgcgcttgcgcgagggcacctga

SEQ ID NO: 3940 - DNA, 975 bp, Pseudomonas aeruginosa
gtaccgaggccctggccatcgccttccgcaagggcaatccgcaactcaagcaactggtcgactcgaccctcgccggcctggagcgcagcggcgtggcggagcagctgtacctcaagtggtacgggccgggcaccaagtccaacctcagcgagcgccacttcaagatcgattccgaccggatccccgagtgagcgcctgacgtctctgcgtgacggcgaccatgcgcgtcgccgcccgtcccctgtgagtcctcgcggacagcgtgcgccttttcccatgttcgagttcgatttctccctgctgctgcgcggccagtaccatgagatgctggtcgccggcctgctgctgtcgctgaagctggccgccgtcaccctggtcttcgccgtgccgctggcgatgctggtggcgctgctgcgcctggcgccgttccgcgccctgcaatggctcggtttcgcctatgtcgagagcatccgcaacgtaccgctgctggcgcacatgctgttctggtacttcgccgcgccggaatggctacccgaggacctcaaggcctggctttacgccggcaacatcgaggccgccagcgctatcgtcgcgctgaccctgtacaccgccgcgttcatgagcgaggacatgcgcagcggcatccgcgcggtgcccacggtgcaactggaggccgcccgcgcgctgggcttcggctacctggcgagcatgcgcctggtgatcctcccgcaggccttgcggatcaccgtaccgccgctgatctcgcaaaccctcaacctgtggaagaacaccagcatcgccacggtgatcggcgtcgccgagctgatgtaccaggccggccaggtggagagttctaccttccgcagcttcgagtcctttgccttcgccaccgcggcctatctcagcgtatcgctgctgatcaccggcgccgccgcctggtaccagcagcgctatccgggagtcgaacggcgatga

SEQ ID NO: 3941 - DNA, 501 bp, Pseudomonas aeruginosa
ggtggtggtggtctgcggaccctcgggctccggaaaatccaccctgatccgtaccctgaaccgcctggaaccgatccagggcgggcgcatcctgatcgatggccaggacatccacgctcccggcctggacctcaatcgcttccgctcgcacatcggcttcgtgttccagcagttcaatctgttcccgcacctgaacgtgctggacaactgcaccctggcgccgctccgtttgcgcggcctgaaacccgcggaggcacgccgccaggccttggcgctgctggagcgggtcggcctggcggacaaagcggcggcgttccccgcacggctttccggcggccagcagcagcgcgtggcgatcgcccgcgcgctggcgatggagccgccgctgatgctgttcgacgaaccgaccagcgccctcgacccggagatggtcggcgaggtgctgctggtgatgcgcgacctggcccgcgacggcatgaccatggtggtggtaacgcatga

SEQ ID NO: 3942 - DNA, 1173 bp, Pseudomonas aeruginosa
gatgggcttcgcccacgacgtcgccgaccgcgtgctgttcatggacgccggccgggtgctggagcgcgccagccccgacgatttcttcaaccgcccgcagcacccgcgtgcgcggaagttcctcgccgacatccgcacccccttcgcccaacccctgtgaggaacgccatgagcactccgagtctgccgatcatcgatatcgccgcccttgccggcagcgacccggcggcgcgacggtcggtcgccgtgcgaatcgaccgcgcctgccgcgagcagggcttcttctacgtggtcgggcacggcgtcgaggcgcaactggtcgagcgcctggagcgcctggcgcggcagttcttcgccctcgacgagacgagcaagctgcgctggcgcatggagcttggcgggcgcgcctggcgcggctatttccctcttggcggcgaactgacctccaaccgcccggactggaaggaaggcttgtacctgggcagcgaactggacgctgagcatcccgaagtgcgcgccgggacgccgctgcatggcgccaacctgttccccgaggtgcccggcctgcgcgagacgctgctggagtacctggacgcaaccacccgcgtcggccaccggctgatggagggcatcgccctcggtctgggactggaagccgactacttcgccgcgcgctataccggcgatccgctgatcctcttccgcctgttcaattatccgagccagccagtgccggagggcctcgacgtgcagtggggcgtcggcgaacacaccgactacggcctgctcacgctgctccaccaggacgccatcggcggcctgcaggtgcgcaccccacagggctggctggaggctccgccgataccgggctcgttcgtctgcaacctcggagacatgctcgaacgcatgaccggcggcctctaccgcagcacgccgcaccgggtggcacgcaacacttcggggcgagaccgcctgtcgttcccgctgttcttcgatccgaacttccatgcccgcgtgcagcccatcgaagggctgcccgaggtgccggaacaggatgacagcgcccgtcgctgggaccaggccaacgtccacgctttccacggcgagtacggcgactacctgctgaacaaggtggccaaggtattcccgcagttgcgccgcgacctgctctag

SEQ ID NO: 3943 - DNA, 1362 bp, Pseudomonas aeruginosa
  unsure (484),(654): Identity of nucleotide at the above locations are unknown.
ggatgcctagctttctctacctgctcgatactgcccccacctcaggttgaggttcacgccaagggaaaggagtggttcgggtggattgccgctgggaccgggcgcgcgcagcaggaagtcgatcagctcgttgcgttcgcccgccagccagtcggccagcagcttcccggtgacggtcccgcgggttacccccaggccgttgcagcacagggcgccataaacgttgggcgccagctcgccgaagtgccccatgtggttcctcgacagcgccagcgagccgccccaggtgtagtcgaagccgacttccgggagcatcgggaagcgctggcggaacgaggcgcgatggcgtacggcgaagcgctcaaggtacttcccggcgctgcgtccgtcagggttgaagctgaagctgttgcggatcagcaggcggttgtccggggtacgcctcaccgtggtgccgtaagggtcggccgggatcaggccccantaggggcgcccgccgaggcgggcctgctcctcggcatcgagcggccgggtcaggctggcgtaggtgaagatcggcagcatccgcccctggaggaagccgaagctcatgccgaacgcgttgttggcgaggaccaggcggtcggccaggatgctgccgtggggatggctcancagggtcctgtcgccatattccacggcggtgatcggtgtgtgttcgtaaaggctgacgttgcccggcaggctgtcggccaggcccttgaccatggccgatggctgcaccagcagggtaccgggggtgaacagggccttgcgatagaaagcggtgccgatgtgtcccgggaggtcgtccgcctcgatcacctcgtaggcctggccgagccgatcgaagccgcgccggtaggcgtcgagcacagccacgccgcgcgcctcgacggccgcctggtacttgccgcaggccttcatctggcagtcgatggcatggcgctgcacctgttcgcggagcagcgactggccggcgagattgagcttcaggccgatccgggcggtcgctatgtcgccgatgtagtcgtcggcgccgatgtcgtggggcaggtcgatggcgaagccggcgttgcgcccggcggtaccgaagccgacttcctgggcctcgaccaggacgatctcctcgtcgggaaaatgcagcgccagctggcgcgcggcggcgaggccggtgaagccggcgccgaccaccacccaacgggcggcgctcctgccgtagtgggccggcttcggccgccgcggcgggctgaggtgataccagccgcaggaacggtcgtcggccggaaggtgggttactttcgtcatcgcagggacctgactcttgttattggaacccggtaa

SEQ ID NO: 3944 - DNA, 621 bp, Pseudomonas aeruginosa
ccatgctggaggtcctggtcgcctgcggcttcgtctcgcccagccacttcagcaagtgctacaccgccttctacggctacccgccgtcgaaagaagtgcgctacggcaacgtccgctcgacgaaatgagggcgtttcgccggacgcggccggcatgctagaacggacctttcgccctggcctgcggaggtcctgcgccatgtcccagccttttctctggcgtcgcgtcaacgactcgtccggtttcgccgagccgcgggtgttcatccgtgtctacctggaaccgggcagcatcgatgcggccatcgctttctacgaagacctgcagggcgtcgcccacgacatgcgcttcgactttcccgagaaacgcctgacactcgccgcggtcggcgccttcctcctgctggagggcagcgacgaggcgctggcgccgttccgcagcaccaccggcaccctgctggtggacgacatcgagccctatcaccggcggttgctggccgccggtgcgcagatcatcttcgggccggcgcgcgcgcccaccggcgcctgcttcaatgcgctgctgccggacggcacggtggtcgagttcgtccaccaccggccgcagccgggcgaggcctga

SEQ ID NO: 3945 - DNA, 1434 bp, Pseudomonas aeruginosa
acctcagccctcgcgccgggcggcgcaatcgtccatggccgcgccgatcgcctgttcgccgcgcgccagcagcgctgcgctggcgccgcggatatcgcgggcttccttgttctggctgagcttgaacttgccgaccaggcgggtgatctcgatttcgatgccgacgatcagccggagcatctcgtcgatgtagtcggcggggccgtcggtcattttccagggcgtttcctgggtcgcctcgtgggtgcgggtcaggcgcgccaccagtccgcgcacatagcgttcgtcgtcgcggatccgcacccggccgtgggcgtggaccacccggtagttccaggtcggcacctggcggtggtgctcctgcttgctcgggtaccactgcggcgagatgtaggcatcgccggcgcggaacaccaccagcacctcgtcgccgtcgcgcagctcgctccaaaccgggttgttgcgcgcgacatgggcttccagggtgccttgcgcgcccttttccgggctcagctcgaacggcaggtggttggcgtccaggcccgcttcgccgtggctgaccagcaggcccagcggatagtcccggatcagcgcgtgcagcgcctgcgggtcggactcttcgaaatgcgaaggcaggtacatgttctgttctcctcggggactcggcccttatacgctgtcggtgggttccgtcgccacgcacagcaggcgcgagtcggcgcgcatgccgggcatcatcaggcgcaattcgtcgagcagcaggccgcccgcttcgtgcagggccgccagcggcatttccggcaggctctcgaggatgaaccacatgcgccgggcgctggcatccaggcgggtgcgcacgccctggcgccagttccagcggcggcaggtgacgccgaggtcgtcgcgccagaccacctcgccggggtcgggggattcgtcgaccgcctcgccgttcttcagggtgtcgaaggtctcgctgccgtcggcgaccaccaggcgcggcgggccggcataggcggcgagattctcgccgcctaccggaatggcgaattgcacgctgatggcgttgtacaggtccaccaccgggtcgatgctcggcagcccgccgtcgcgcagcgcgcgtttgcgcagggcttcggcggagcagggggtacgctgcggcttggcgccgaagcggcggaacgcctcggcccaggctgccaggtgcgcctcggcccagtccggttcgccacgcgccagcgcctggcaggcgcgctctacggcgcggccggcgatttccggacgaacgatcggcgccgcctcgacggtgaggctcagggcgcggaaaccgggggcgaaggcggccacttcggcggcgatgacggggaggatcggggcgtgctcgggcatggtcgtcttcagggttcggtgacatggagggggcgcggcgcgtaa

SEQ ID NO: 3946 - DNA, 417 bp, Pseudomonas aeruginosa
tggcgggagcgacgttcgcttgccggcgaagccggcgccagagccttccgccggccgggaggggctggacagcgagacgcgaggggcgcagtgttcgagcggtcagaaccgccaccacccgaggtagaacgcagatggccaaggcagccgatgtggttgtgcaatgcctggaaaacgagggcgtgcagtacgtcttcggaattcccggcgaggagaatctcgacctgctggagtccctgcgcaagtcgcagatccggctggtgctcacccgccacgaacaatcggccggcttcatggccgccacctatgggcgcctcaccggcaagaccggggtcagcctgtcgaccctcggcccgggcgccaccaacctggtcaccgccggcgcctacgcctacctgggcggcatgccgatgctga

SEQ ID NO: 3947 - DNA, 435 bp, Pseudomonas aeruginosa
acttccgttccgccgaggtggacccggtgtatttcccgcagatcgaagtggtgggcgacatcgccaacgccatctggcagatcggcgaggcgctggacgataccgcgcactgggacttcacccgcctgctggcgatccgcgaggccaacgaggcgcaggtcgccgaaggcgccgacgacccgcgcttcccgctctatccgcagcgcctggtggccgacgtgcgccgggcgttgccgtcgcagggcatcgtcgccctggacaacggcatgtacaagatctggttcgcccgcaactacaaggcgcacatgcccaacaccgtgctgctggacaacgccctcgccaccatgggcgccggcctgccctcggcgatggccgcgcacctggtctacccggaccggccgatcgtcgcggtgtgcggcgatggcggcttcatga

SEQ ID NO: 3948 - DNA, 819 bp, Pseudomonas aeruginosa
tgtccaggccggcgctgcgatagccgaaatcgaggaagtgccgcacgtgagggccggtaccgcaggccaggtccaggtgccgccggccctggttgccgaacaactggtgcaggcgacgcacgcagtggctctgcgcctggtagtcgatgtcggcgcacatcaggtcgtaatagtgggacaggtcggtgtacagcgcggtggcggacatgggcggcaaggaccggcggcgaagggcgcggcatggtaccccaggcccgggccttgccggcgaaaaaacaggcaccggccggcggatcgcgggcggacttcagtcgaaacgcggccagtcgtcggcgatcctgcaccagcaggccatcgatgcgacctggacatgcttctgtttcgccgccgggaagggcgtgttcaggctgccgagggcgaccgatacccagtcggcgaactcgccttcgctcctcgaccagaacagcggcgagccgcagcgcgagcagaagcgccggagcacggcgggtgaggagcggaacgcggcgagcaggtcggcgccgcggtcgatgtgcaggtccgcgacggggacgctgccatagctggcgaatgccgcgccatgggccttgcgacactggccgcagtggcagtgagagagtgcgcgcgggggcgaggacagtcggtagtgcagcgcgccgcacaggcaactgccgtggaaggtctggctcatcggagggcgttcccggattcgcaaaggcggcgagtcaagcagccctcgccacgcttgtcgagcgcctcctccggtcgcgggctgtcggtgcgggcgtcgatgtctgttag

SEQ ID NO: 3949 - DNA, 417 bp, Pseudomonas aeruginosa
cgtggcggttcggcgggaacgccaggtacagcggcatcggctccaggctccagtcctcgaacagcggcagcagctcgccgcgggcgaggggctcgcgcgccatgtagtgcggcagccagaggatgcccaggccggccagcccggccgccaggtaggcgttgccgtcgtccaccgccagcacatgacggcccgccacccgcaggcattcctcgcccctgcgcatggcgtagggcagggccttgccggtgcgcgcccagaggaagccgacgatacgctggtggctgtcctccagttcgcgcgggtggctcggcacgccggcgcgctgcaagtaggccggtgccgcgtagacccccagttgcaggtcgccgacccgccgcgctatcagcgactggtcgcgcagttcgccgccgcggatga

SEQ ID NO: 3950 - DNA, 594 bp, Pseudomonas aeruginosa
agctgccggtatccaccacacgggcaaaggcctgcatcgcatcgaaacggtccatcgggactccgggtcgtcggggattgtttggattctacaaacagtcatggccagggttgcgcgtttatccacggcgcgcacgaccttaccgttcttccatcgacgatgacggggccgggagccccaggatggaggtatcgcatgactgtacgcgacgtggttttccccgccggccgccaggccctctacgagcgcaaccgctattccccggcggtccgcagcgacggcctgctgttcgtctccggccaggtcggcagccgcgacgacggctctcccgaacccgagctggagacccaggtccgccgcgccttcgacaatctgaacgcggtgctcgccgcggccggttgcgggttcgacgatgtgctcgacgtcaccgtgttcattgtcgacgccgaggccaacttcgagcgcatctggaagatcgtcccggagtactggggcgaggcgccgtaccccacgctgacggcggtgggggtgaactggctgtatggcttcagcttcgagatcaaggtggtcgcgaggttgccggaggggcggtga

SEQ ID NO: 3951 - DNA, 897 bp, Pseudomonas aeruginosa
tcacctcgcgcaacccgggtgacttgcaggcgttcaacgaagccatcggcgaagccctgcaggcggccgcctgatcgtcattcgcggaggcgaccggtggacaccctgaagatcgccaccttcaacgtcaacggcatccagacccggctggccgcgctgctggcctggctggagcgggaagcgccggacatcgtctgcctgcaggaactgaaaacgcccgacgcgcgcttccccgccgcggcgctggagaaggccggatacggcgcgatctggcagggccagtcggcgtggaacggcgtcgccatcctcgcccgcgacagccagccgctggaggtacgccgcggcctgccgggcaacgccagcgatccccacagccgctacctcgaagcggccgtcgacggcctgctggtggccagcctgtacctgcccaatggcaatccccagccgggaccgaagttcgactacaagctggcctggttcgagcacctcatccgacacgccgccgagctgatggagagcggccatccggtggtgctggccggcgacttcaacgtggtgcccagcgacttcgatatctacgacacccgctcctggaaaaaggacgccctgctccagccggagtcccgcgagtgcttcgagcgcctcctgcggcagggctgggtggacgcgctacgccagcgtttccccgaccggcgcctctataccttctgggactacttccgccagcactggcaacgcgacgccgggctgcgcatcgaccacctgctgctcagcgccagcctggcggaccacctggaagacgccggggtggatcgctgggtgcgcggcgaggagcacgccagcgaccacgcgccggcctgggtaagcctgcggcgtccctcagagccccggcgctag

SEQ ID NO: 3952 - DNA, 957 bp, Pseudomonas aeruginosa
aatccaaacaatccccgacgacccggagtcccgatggaccgtttcgatgcgatgcaggcctttgcccgtgtggtggataccggcagcttcaccaaggcggcggagacgctgcacatgagccgcaccagcgtcacccagttggtccagcaactggaagcgcggctgcgggtacgcctgctcaaccgcaccacgcgcaagctcaacctgaccgccgacggcgccgcctactacgagcgggtggtacgtctgctggcggaactggacgatgccgagaccagcctctccagcgccgccctggcgccccgcgggcgtctccggatcgacgtaccgagcccgctggcgcggctgctgctgatcccggcgttgcccgagttccatgcgcgctatccggagatccagatcgacctgggcgtgagcgatcggctcgtcgacctgatcgacgagaacgtcgactgcgtcatccgcggcggcgaactgcgcgaccagtcgctgatagcgcggcgggtcggcgacctgcaactgggggtctacgcggcaccggcctacttgcagcgcgccggcgtgccgagccacccgcgcgaactggaggacagccaccagcgtatcgtcggcttcctctgggcgcgcaccggcaaggccctgccctacgccatgcgcaggggcgaggaatgcctgcgggtggcgggccgtcatgtgctggcggtggacgacggcaacgcctacctggcggccgggctggccggcctgggcatcctctggctgccgcactacatggcgcgcgagcccctcgcccgcggcgagctgctgccgctgttcgaggactggagcctggagccgatgccgctgtacctggcgttcccgccgaaccgccacgtcagcggcaagctgcgggtgttcatcgagtgggtcgccgaactgatcgcgcggcatgcgccgccgttgcatccgccgctctga

SEQ ID NO: 3953 - DNA, 1626 bp, Pseudomonas aeruginosa
aggagtcgattcatgcataagagaacgtacctgaatgcatgcctggttctggcgttggctgccggcgcgagccaggccttggcggcgcccggtgcgagcgagatggctggcgacgtcgccgtgctccaggcctctccggcgagcaccggtcacgcccgcttcgccaaccccaacgcggcgatctcggcggccggcatccacttcgccgcgccccccgcccgccgcgtggcccgcgccgcgccgctggcgccgaaaccgggtacgccgctgcaagtgggcgtgggcctgaaaacggcgactccggaaatcgacctgacaaccctcgaatggatcgacactccggacgggcgccacaccgcgcgcttcccgatcagcgctgcgggggccgccagcctgcgcgccgcgattcgcctggaaacccgcagcggctcgctgcccgacgacgtgctgctgcacttcgccggcgccggcaaggaaatcttcgaggccagcggcaaggacctctcggtcaaccgtccctactggagcccggtcatcgagggcgataccctgaccgtcgaactggtgctgccggccaacctgcaaccgggcgacctgcgcctgtcggtaccccaggtatcgtatttcgccgactccctgtacaaggccggctaccgcgacggcttcggcgccagcggcagctgcgaggtggatgcggtctgcgcgacccagagcggcacgcgggcctacgacaacgccaccgcagcggtggcgaagatggtcttcaccagctcggcggacggcggcagctacatctgcaccggcaccctgctgaacaacggcaactcgcccaagcgccagttgttctggtcggccgcgcactgcatcgaggaccaggccaccgccgcgacgctgcagaccatctggttctacaacaccacccagtgctacggcgacgcctcgaccatcaaccagagcgtcaccgtgctgaccggcggggcgaatatcctgcaccgcgacgcgaagcgcgacaccctgctgctggaactcaagcgcactccgccggccggcgtgttctaccagggctggagcgccacgccgatcgccaacggctcgctcggccatgacatccaccatccgcgcggcgacgccaagaagtactcgcagggcaacgtctcggcagtgggcgtcacctacgacgggcataccgccctgacccgcgtcgactggccgtcggcggtggtcgaaggcggctcgtccggctcgggcctgctgaccgtcgccggcgacggctcataccagctgcgcggtggcctgtacggcggcccctcgtactgcggcgcgcccacctcacagcgcaatgactacttctccgatttcagcggcgtctattcgcagatctcccgctcacttcgcgccctgaggccagccaggctatcgatcgcgcaccggcggataaccgcgcagcggttattcgccctacgcccggattggcgcctggaagtgcggcttctttcgtcgtccgggacaggtagggcggataacgccaacggcgttatccgccgtttatcccgcgcagcggttattcgccctacgcccggattggcgcctggaagtgcggcttctttcatcgtccgggacaggtag

SEQ ID NO: 3954 - DNA, 246 bp, Pseudomonas aeruginosa
cgccaacggcgttatccgccgtttatcccgcgcaatggttattcgccccacgcccggattggcacctggaagtgcggcttctttcgtcgtccgggacaggtagggcgcataacgccaacggcgttatccgccgtctatcccgcgcagcggttattcgccccacgcctggatcggcgcgtggaagaggggcgttatgcgccgccgtacgttcagtcctggcggctggtgacttccagcaggtggtag

SEQ ID NO: 3955 - DNA, 528 bp, Pseudomonas aeruginosa
ggtgaaacggcagagcctaacagacatcgacgcccgcaccgacagcccgcgaccggaggaggcgctcgacaagcgtggcgagggctgcttgactcgccgcctttgcgaatccgggaacgccctccgatgagccagaccttccacggcagttgcctgtgcggcgcgctgcactaccgactgtcctcgcccccgcgcgcactctctcactgccactgcggccagtgtcgcaaggcccatggcgcggcattcgccagctatggcagcgtccccgtcgcggacctgcacatcgaccgcggcgccgacctgctcgccgcgttccgctcctcacccgccgtgctccggcgcttctgctcgcgctgcggctcgccgctgttctggtcgaggagcgaaggcgagttcgccgactgggtatcggtcgccctcggcagcctgaacacgcccttcccggcggcgaaacagaagcatgtccaggtcgcatcgatggcctgctggtgcaggatcgccgacgactggccgcgtttcgactga

SEQ ID NO: 3956 - DNA, 843 bp, Pseudomonas aeruginosa
agtccgcccgcgatccgccggccggtgcctgttttttcgccggcaaggcccgggcctggggtaccatgccgcgcccttcgccgccggtccttgccgcccatgtccgccaccgcgctgtacaccgacctgtcccactattacgacctgatgtgcgccgacatcgactaccaggcgcagagccactgcgtgcgtcgcctgcaccagttgttcggcaaccagggccggcggcacctggacctggcctgcggtaccggccctcacgtgcggcacttcctcgatttcggctatcgcagcgccggcctggacatcaaccagccgatgctcgacctcgcccgacagcgctgtcccgaagcgcacttcagccggcaggacatggccggcttccaggtggacgagccgctggacctgatcacctgtttcctctattcgatccactacaacgcagggctggagcgcttgcgcgcatgcctggccagcgtgcatggcgcactggcggatggcggcgtgttctgtttcaacacggtggacaaggggcagatcgacaatcgcgcgttcgtccgccattccgtggagcatcgaggcagccgcttcaccttcggttccggctggtactacagcggcgagggcgagcgccaggcgctgcgcctcggtatcgagaaaaccacggacggaacaacccagacctgggaggacgaacaccccatggtcgccctcggcttcgccgaactgcagcacctgttgcagacgcatttcgaggtgcaggtcttcgaacacgactacgaacggatcacgccctgggccggcagctccgggaatgccctgttcgtctgcgtgaagcgctag

SEQ ID NO: 3957 - DNA, 672 bp, Pseudomonas aeruginosa
cgatcaggctggcacgggcggggcagcgtttcacagggggctgcggaggattcttcgtcgctttcggcacgctgcgtccgacccgctagaggcctgcctggccgacgatccgtgcgcgccttctcggctagaccaaggtcgcaaagaccccgccggccatctgtgacaccttcgcgcgcttttttacccccgctgtcgagagtcaccgcatgtcctccccgttttccccccgttcgccccgcacccttcgcggcctgggcgccctcgccctgtgcggcggattcgtcgccccggcccctgccgccttcctcgaggacggcagcgcgcgcctggaagcgcgcaccgtctacttcaaccgcgacttccgcgacggcagctcggccaacccgcagggcgcctccaagcgcgaggaagccgcgcagggcttcatcctcgacctgcgctcgggctataccgagggcgcgctgggcttcggcgtggataccctggcgatgctcgggatcaagctcgactccagccccgcggacagcaacagcggcctgctgccttccagcggccacgatccgcgtcgctcggtcgaccagtacgccaaggccggcgttgccggcaagatgcgcttctcgcagacacagttcaggtacggggcgatgctgccggacatgccgttgctga

SEQ ID NO: 3958 - DNA, 1521 bp, Pseudomonas aeruginosa
aaatccacctaccgctttacgcgccgcgccccctccatgtcaccgaaccctgaagacgaccatgcccgagcacgccccgatcctccccgtcatcgccgccgaagtggccgccttcgcccccggtttccgcgccctgagcctcaccgtcgaggcggcgccgatcgttcgtccggaaatcgccggccgcgccgtagagcgcgcctgccaggcgctggcgcgtggcgaaccggactgggccgaggcgcacctggcagcctgggccgaggcgttccgccgcttcggcgccaagccgcagcgtaccccctgctccgccgaagccctgcgcaaacgcgcgctgcgcgacggcgggctgccgagcatcgacccggtggtggacctgtacaacgccatcagcgtgcaattcgccattccggtaggcggcgagaatctcgccgcctatgccggcccgccgcgcctggtggtcgccgacggcagcgagaccttcgacaccctgaagaacggcgaggcggtcgacgaatcccccgaccccggcgaggtggtctggcgcgacgacctcggcgtcacctgccgccgctggaactggcgccagggcgtgcgcacccgcctggatgccagcgcccggcgcatgtggttcatcctcgagagcctgccggaaatgccgctggcggccctgcacgaagcgggcggcctgctgctcgacgaattgcgcctgatgatgcccggcatgcgcgccgactcgcgcctgctgtgcgtggcgacggaacccaccgacagcgtataagggccgagtccccgaggagaacagaacatgtacctgccttcgcatttcgaagagtccgacccgcaggcgctgcacgcgctgatccgggactatccgctgggcctgctggtcagccacggcgaagcgggcctggacgccaaccacctgccgttcgagctgagcccggaaaagggcgcgcaaggcaccctggaagcccatgtcgcgcgcaacaacccggtttggagcgagctgcgcgacggcgacgaggtgctggtggtgttccgcgccggcgatgcctacatctcgccgcagtggtacccgagcaagcaggagcaccaccgccaggtgccgacctggaactaccgggtggtccacgcccacggccgggtgcggatccgcgacgacgaacgctatgtgcgcggactggtggcgcgcctgacccgcacccacgaggcgacccaggaaacgccctggaaaatgaccgacggccccgccgactacatcgacgagatgctccggctgatcgtcggcatcgaaatcgagatcacccgcctggtcggcaagttcaagctcagccagaacaaggaagcccgcgatatccgcggcgccagcgcagcgctgctggcgcgcggcgaacaggcgatcggcgcggccatggacgattgcgccgcccggcgcgagggctgaggttcaggcctcgcccggctgcggccggtggtggacgaactcgaccaccgtgccgtccggcagcagcgcattga

SEQ ID NO: 3959 - DNA, 957 bp, Pseudomonas aeruginosa
  unsure (692),(862): Identity of nucleotide at the above locations are unknown.
caagagtcaggtccctgcgatgacgaaagtaacccaccttccggccgacgaccgttcctgcggctggtatcacctcagcccgccgcggcggccgaagccggcccactacggcaggagcgccgcccgttgggtggtggtcggcgccggcttcaccggcctcgccgccgcgcgccagctggcgctgcattttcccgacgaggagatcgtcctggtcgaggcccaggaagtcggcttcggtaccgccgggcgcaacgccggcttcgccatcgacctgccccacgacatcggcgccgacgactacatcggcgacatagcgaccgcccggatcggcctgaagctcaatctcgccggccagtcgctgctccgcgaacaggtgcagcgccatgccatcgactgccagatgaaggcctgcggcaagtaccaggcggccgtcgaggcgcgcggcgtggctgtgctcgacgcctaccggcgcggcttcgatcggctcggccaggcctacgaggtgatcgaggcggacgacctcccgggacacatcggcaccgctttctatcgcaaggccctgttcacccccggtaccctgctggtgcagccatcggccatggtcaagggcctggccgacagcctgccgggcaacgtcagcctttacgaacacacaccgatcaccgccgtggaatatggcgacaggaccctgntgagccatccccacggcagcatcctggccgaccgcctggtcctcgccaacaacgcgttcggcatgagcttcggcttcctccaggggcggatgctgccgatcttcacctacgccagcctgacccggccgctcgatgccgaggagcaggcccgcctcggcgggcgcccctantggggcctgatcccggccgacccttacggcaccacggtgaggcgtaccccggacaaccgcctgctgatccgcaacagcttcagcttcaaccctga

SEQ ID NO: 3960 - DNA, 1479 bp, Pseudomonas aeruginosa
  unsure (937): Identity of nucleotide at the above locations are unknown.
agaccggagctggagagcgttccagcctcgcggattcgctcggcccgaattcaccggcagcggttagaaccaggagacaataatgacaaatcctacgacctcgatcgaagacgtacccctcaacgccttccaccggctgttgaccctgcgctccggcggcggctccttcgtcgacggctacgtgctgagcatcatcggcgtggcgatgctgcagatgaccgcggcattgcaactgagcagtttctggcagggcatgatcgccgcctcggcgctggtcggcatcttcttcggcggtttcctcggcggctggctgaccgaccgcctgggccgccgcaggctgttcttcgtcggccccagcctgttcgtcctcgcttccctggcgcagtacggggtcgactcggcggcggcgctgttcgtcctgcgcttcctgatcggcgtggcggtgggcatcgagtacccggtcgccaccgccttgctggtggagttcctgccgaagaagtatcgcggaccgcgcctggccaccctgaccatcctctggttcgccggcgccgccttcgcctacctggtcggcgacctgatcctgcgcagcggcggcgaggacgcctggcgcctggtactggccagcaccgcggcgatcggtgccgtgctgttcctgctacgcatcggcacccccgagtcgccgcgctggctgctgagcaagggccgcgacgcggacgcagagcgggtcatccgccaggtctacggagaagccttctcgctggagaacctgcccgaacaggcgccggaacggaacgtcaccatctggcacctgctctacgccggctacggcaagcgcatgctcttcgtcaccctgttctggacctgctcggtgatccccgtgttcgccgtctacgccttcgcgcccaaggtgctgctggcgctgaacctgaagggcgantgggcttcctacggttcggtggcgatcaccctgctgttcgtcatcggctgcatcatcgccacccgcctgatcaaccgcatcggccggcgctgcatgctgctgcacagcttcctctggtccggcctggcgctgctcgggctgggcgtcttccacgccggctcggaggcgaccatcctcggcctgttcggtgcctacgcgctgttcatcggcggcgcccaggtgctgcaactggtctacccgaacgaactgttccccaccgagatccgcgccttcgcggtcggcgtcggcacctcgttatcgcgcgtcggcgccgcggtgggcacctacctggtgccgctttccctggaaaccctgggtaccgcccagaccatgtacgccgccgcgctggtgaccctgctcgggctgctcgtgacctgggccctggcgccggaaacccgttcgctgaacctgcagcaggcggcttcgctcacctgaaccacccgccgcggcagcgtccgccgggtgcgccgcggcccagcatcccacaggaggaacccccgtga

SEQ ID NO: 3961 - DNA, 588 bp, Pseudomonas aeruginosa
tcggcggctccaccggcgagtactacgcgcacaccgccgaggaacgcctggccctcgccgcccacgccagcgaagtcatcgccgggcgcctgccgctggtggtgggaaccggcgcgatccgcaccgaggactcgctggcctacgccgaagccgcccgcgccatcggcgccgacgccatcctggtcggctcgccgccctacgcgctgccgacctcgcgggagatcgccgagcacgtgctggcggtggatcgcgccgccggcctgccgatcatgctctacaactatccggcgcggatgggcgtggagatggacgaggcgttcttcgccgccgtcgccggctgccgcaacatcgtcgcgatcaaggaaagctccggctccaccgcgcaattgcaccgcctggcctgccgccacccgcggatcgccttgtcctgcggctgggacgaccaggccctggagttcttcgcctggggcgcgcgcagttgggtctgcgccggctccaacttcatccctggcgaacacctcgccctgtaccaggcctgcgtggtcgagaacgacttcgccaagggccggcgcatcatggcggcgatga

SEQ ID NO: 3962 - DNA, 1581 bp, Pseudomonas aeruginosa
aggcgctggacgaggccggcaaggcggcactggcggagatcgtcgccaggctcaagggcgaggtcgcgcggatcgtcgagggtggccgccatgactgagctgctgagccgggaggaatacgcggccatcgccgcgacgctggaccttccccagcgcgccttcatcgacggagggttccgcgatgcctgcggcggccgcaccttcgcctcgaccaacccggccaccggcgagctgctggcgcaggtcgccgcctgcgacgcggaggacgtcgggcacgccgtggccagcgcgcggcgggcgttcgaggacggccgctggcgctcgcgcacgcccgccgagcgcaaggcggcgctgctgcgcctggccgagctgctggaagagcacctgctggaactggcggtgatggagagcctcgacagcggcaagccgatccgcgaatgccagcacaccgacctgccggaaaccatcaataccctgcgctggcatgccgaactgatcgacaagatctacgacagcaccgccccggtcggttcggcggcgctggccatggtggtacgcgagccgatcggcgtggtcggcctggtgctgccgtggaacttcccgctgctgatgctcgcctggaagatcggcccggcgctggcggcaggctgctccgtagtggtcaagccggcccccgagaccagcctgaccgccctgcgcgtcgccgaactggccagccaggcggggatccccgccggggtgttcaacgtggtccccggcggcggccgcgaggccggcgaaccgctgggccgccacccggacgtggcgatggtcagcttcaccggctccaccgcgaccggccgcctgttcctcaagtacgccgccgagtccaacctcaagcgggtggtactggagtgcggcggcaagaacccggcggtggtgatgaacgatgtcgaggacctcgacctggtggcgcaacacgtggtcaacggcgcgttctggaacatgggcgagaactgctcggcgtcctcgcggctgatcgtccatgccgaagtccgcgaggcgctgctcgaacgcatcggcgcgcagctccgcgagtggcgcatgggcgacccgctggatccgtgtaatcgcctcggcgcgctggtcagcccggcgcacttcgagaaggtccgcgcgtacctcgaccaggccaggacggagcggttggcggtgcgcttcggcggcgccaccgaggctggcatcttcgtcgagccgaccgtggtcgatggcgtctcgccgcacagccggctgttccgcgaggaaatcttcggcccgctgctctcggtcacctctttcgacgacatcgacgaagccatcgccctggccaacgacaccgtctacggcctcgccgcctcggcctacaccggcagcctgcgccacgcactgcgcctgtcgcgggagatccgcgcggggatcgtcaccgtcaactgcttcggcgagggcgacgcctcgacgcccttcggcggctacaaggagtcaggcttcggcggtcgcgacaagtcggtctgggcacacgaccagtacacagagttgaagaccatctggatcgacgcttcctga

SEQ ID NO: 3963 - DNA, 519 bp, Pseudomonas aeruginosa
acaggcggaagaggatcagcggatcgccggtatagcgcgcggcgaagtagtcggcttccagtcccagaccgagggcgatgccctccatcagccggtggccgacgcgggtggttgcgtccaggtactccagcagcgtctcgcgcaggccgggcacctcggggaacaggttggcgccatgcagcggcgtcccggcgcgcacttcgggatgctcagcgtccagttcgctgcccaggtacaagccttccttccagtccgggcggttggaggtcagttcgccgccaagagggaaatagccgcgccaggcgcgcccgccaagctccatgcgccagcgcagcttgctcgtctcgtcgagggcgaagaactgccgcgccaggcgctccaggcgctcgaccagttgcgcctcgacgccgtgcccgaccacgtagaagaagccctgctcgcggcaggcgcggtcgattcgcacggcgaccgaccgtcgcgccgccgggtcgctgccggcaagggcggcgatatcgatga

SEQ ID NO: 3964 - DNA, 861 bp, Pseudomonas aeruginosa
tcggcagactcggagtgctcatggcgttcctcacaggggttgggcgaagggggtgcggatgtcggcgaggaacttccgcgcacgcgggtgctgcgggcggttgaagaaatcgtcggggctggcgcgctccagcacccggccggcgtccatgaacagcacgcggtcggcgacgtcgtgggcgaagcccatctcatgcgttaccaccaccatggtcatgccgtcgcgggccaggtcgcgcatcaccagcagcacctcgccgaccatctccgggtcgagggcgctggtcggttcgtcgaacagcatcagcggcggctccatcgccagcgcgcgggcgatcgccacgcgctgctgctggccgccggaaagccgtgcggggaacgccgccgctttgtccgccaggccgacccgctccagcagcgccaaggcctggcggcgtgcctccgcgggtttcaggccgcgcaaacggagcggcgccagggtgcagttgtccagcacgttcaggtgcgggaacagattgaactgctggaacacgaagccgatgtgcgagcggaagcgattgaggtccaggccgggagcgtggatgtcctggccatcgatcaggatgcgcccgccctggatcggttccaggcggttcagggtacggatcagggtggattttccggagcccgagggtccgcagaccaccaccacctcaccgcggccgacctgttcgtcgacatccgccagggcgtggtaggcgccgtaccatttgttgaccttttccagccggatcatcgggcctccttgggattgccgcgctgcgcctggcggcgttcgagccagaaggcgaaacgcgacagtccgaagcacaggatgaaatag

SEQ ID NO: 3965 - DNA, 2328 bp, Pseudomonas aeruginosa
ccatcgttaccctcccgtggcgccggcggcgagcggcagccggcagttcatgagcaacccgccatccgccggcagctcggcttcgagggtgccgccgaagccctcgacgatgctgcggctcatcgacaggcccaggcccagcccttccggcttgctggtgtggaacggcgtgaaaatgtgttccagctgatccgccggcactcccggtccctggtcgcgaacccacaggcagagcagcccgccgggctcgacgcggctaccgatgacgacccgcgacggcgagccgggatgcgcctcgcggttggcttcgatggcgttgcgcagcagattgaggaacacctgttcgagcagcacgcggtcggcatacagcggcggcggattgtcggtcatcgcctcttccaccgccacttgccagtgcccggcttcccacgcgcagaggccgatggcctcgcgtgccacctggttgaggtcgagcgcctgcaggcgccgctggcccttgcgcaggaaggcgcgcaggcgcttgatcacctccgccgcgtggccggcgtgctcgccgatccgcgccagcccctcggccacccgcccggcggcctcgggctggctgccgaggacggccaggtaacgctggctggcgctggcgtagttcatcaccgccgccagcggctggttgatctcgtgggcgatgcccgaggccagttcgccgagagtgaccagccgcgcagtgtgcgccagttcgtcctggtgacggcgctgctgggcctcgcgcagttcgcgttcggtcatgtcgcgggccaccagcgagtaatagcgctcctcgccgcggccgcgatgggccagcaacaccagcgagactggcagcgacggacgtccgtcctgcggttgcaggcgcccctcgcggctccaaacgccgccatcgcgcgcctgtcgccaaccctcttcggccagccgcgccggagtgtcgccggccagcaggcgttccagcgccggcgcctcctgcccgtcggcgatgccgagggcggcacgtgccgaaggattgaggtaggtgacgcggccgccatgctcgacgaacagcaccaggtcggtgttcgcctcgaccacttcggccaggcgccggcggttctcctccgcctcgacccgccgggtgacatcgcgggacacgctgaccacctccaccaccgccccggtgtaggtctcgcggatcgcccggctggcggtctcgaaccagcggtagcggccgtcgcggtggcggatacggtaggtgatggtcaggtagccgtcctgctccagcgcttcgcgcgcgcgcagcgccacctggccgcggtcctgggggtggaacaacgcctgcgccggacgcccgcgcagttcctccggccagtagccgagcagggtccaggaagccggcgaggcgtcgaggaaaatgccgtcgagggtatgccgggaaatcaggtcggtggtgttctcggtgatcagccggtacagccggctggcccgcgccgcctcgcgctcgccgcgcaggctggcggtggcgtcgcggcagcgcgccagcacccgggcctcggcgctgtcgggaatgaactgccagagcaggatgcgtccgtcgcactccgcctccacctcgccgagggcccgcgcctgccccaggctggcgcgcaccagttgcccatggttggccgggaggtaagcgcgccaggcctcgcgcggccgctcgccaagcaaggcaaggaaggcctggttgaattccaccgcctgcgcctcgccgtcgagcagcagcgccggctgcgggtcggccgcgaggaacggcgcagcgcgggtgacgccacgggcggcggcgagcaacggtgcgaggagcaggccgagccagtccagcgcagcgctctgcggcgtatcgctggccaccagcagcaggccttcgtcgccggcctgcaggtcgagggcgaaggccatgccatgctccacgccggcacgccgcaagcgcgcgccgagccaggaggcggaacgccgcaattcgtccagagccagccggccgtcgcgcaccagccgctcgcgcaacgccaggtcgctggcccggttcggctcgccggcgcccggcggcagcgccggcgacggcggcaccggggtataggtctgcgcctgcggctgccaggccaggtaccaggcctggcgcgtgcccggatgttcgagcagcaagcggcgcagcgcaccgacccgctcgaccagcggcgcgccctcgcgcagcaggcgcaggaggctgttgagtgcaggcgaagcgggaagcggactcatgggcggaagatgatcctgggaacttatatggtatttatactataa

SEQ ID NO: 3966 - DNA, 633 bp, Pseudomonas aeruginosa
agagcgatcatcaggggctcgccgagagcgagatcgtcgcgttctgtcgcgaacacctggccgcgttcaagattccgcgtaccgtggtgttctcggaactgccgaagacctccaccggcaagatccagaaatacgtgctgcgcgagtgggccgccgccctctgagcgccgccagccgaattgcccgtgcagcggccgtgccacggcggccgtaggcaggatgcgcacgggcaaccctgtacctgcggccgtcccgccggccgttcaccgacgaggtgtgcaatgcctgaatacaacgccccgctgcgcgacatgcgcttcctgctcaacgacgtgttcgacgcccccgccctgtggcagcgcctgccgcgactggccgagcggatcgacgccgacaccgccgacgccatcctcgaggaagcggccaaggtcaccggcggcctgctcgcgccgctcaaccgcagtggcgacgaagaaggcgcgcagtggcaggacggcgccgtgcgcaccccggccggcttccgcgaggcctacgcgacctacgccgagggcggctgggtcggcctcaccggcaatccggcccatggcggcatgggcatgccgaagatgctggcagtgcagttcgaggagatga

SEQ ID NO: 3967 - DNA, 879 bp, Pseudomonas aeruginosa
ccgcgaagcggttattctccctacgacgcccgggaagccggccaggcattcttgaaaaacgacgcaaccgccggttattcgctagacaaggaacaaggacatatccatgcgaaccctcaccaccctcctcggcaacagccagaaactcgacggcggcgccatgttcggcaatgccccgcgcgcgctctggtcacgctggatgcagcccgatgcggagaaccgcatcgacctcggctgccgtgccctgctggtgcgcgacggcgagcgcaacgtactggtggagaccggcatcggcgcgttcttcccgcccgccctgcgccagcgctacggcgtccaggaagagcgccacgtactgctcgacagcctcgccgcggtcggcctggacgacgccgacatcgacgtggtgctgctcacccacctgcacttcgaccacgccggcggcctgctcgccgcctgggaagaaggccagccggcgcgcctgctgttccccaacgcgcatttcgtcagcggccgccgccactggcagcgcgcgcgccagccgcacccgcgcgaccgagcctcgttcgtgccggaactgctcgacctgctgcaggccagcggacgcctggagctgctcgacgacggcgagcgctcggcgcatctgggcgagggctggcgtttccatttcagcgaaggccataccccgggccagatgctcccggagatcgccatgcccgacggcccggtggtattcagcggcgacctgatccccggcgcaccctgggtacacctaccgctgaccatgggctacgaccgcttcccggaaggcctgatcgaggaaaaggaacgcctgctggacagcctcatcgcccgcaacggccgactggtcttcacccatga

SEQ ID NO: 3968 - DNA, 465 bp, Pseudomonas aeruginosa
acagagacagtcatcgtcgcgcgcagcgaacggcctccctcagccgcgcagttcctcgaccagcgtgcgcagcagttcggcggccggcagctcccgcgccagcgccgcgccctggccggcccactgggcggcgaaatcatggttgccgcgagccagagcggcggtctgcaacgctttggtcgcgtcgtagacgaacggatagtccggcaagggcggcactccaggcgcggcggcatcgaagaacatccggttgggcaggccgcgggcgctgcgcccggacatggtcacggtcagcgcggtgcgcgccgcgcgcggccccttcagcgcctcgcggtaggcggcgttggccgaggactccggacagaggacgaaggcggtgcccatctgcacggcgctcgcgcccagctccagggcggcgcggatgccccgtccgtccatgatcccgccggcagccaccaccggtag

SEQ ID NO: 3969 - DNA, 825 bp, Pseudomonas aeruginosa
cgagccaaggagttgcccatgagaagactgcccaccctctgcctgctggccctcgcgccgctcaccggcgtggcgccccaggcccaggccgccagcctctacaacctgctggtggggacctataccgaaggctccagcgaaggcatccaggtataccgcttcgacggcgccgacggctcggtgaaaggcccgctgcgcgtggcccataccagcaacccctcgtacctgaccttcgccccggaccaacgcactctgttcgtggtcaacgagaacggacggggcggcaagggcgataccgtcggtcgcgccacgtcctaccgtttcgatccgatcagcggccgcctgcaacagatcagccaggtccagaccctcggcgatcatccgacctacagcagcctcagccacgacggtcgttacctgttcgtcgccaactactcggtacagccggaaggctcggtggcggtactgccggtgcgcgcggacggctcgctggcgccggtggtgcaggtggagtcgcaccaggccagcaaggtgcatccgcgccaggtttccggtcatgtgcactcggtggtgtcctcgcccgacggccagtacctgttcgcccccgacctcggcgccgacaaggtattcgtctaccgatacgccccggaacaggccgaacgtccgctgcaggcggccgatccggcattcgtcccgaccccgcccggcagcggcccgcgccatagaatattcagcgccgacgggcgtttcgctgaacctgacactggaactgagcggccaggtgaggtgttcgcccatgggggcaatgcccgcctgcgtcaataa

SEQ ID NO: 3970 - DNA, 360 bp, Pseudomonas aeruginosa
cagacccacgacctggcgcatgccggcttccagggcaaagtcggcgccggcgccctgcacctgtccgccgacggccgcttcctcggcgtgctcaatcgcggcgacgacaaccaactggtgaccttcgccgtcgacccggccagcggccagttgcgtttcgtcgaacggcgctcggtggaaggcaccgagccgcgcgaattcgccttctcgcccggcgggcgcttcgtcctcgtggccaaccagaacagcgaccagttgcgggtgttcgcccgcgatccgcagagcggccaggtgggcaagacgctgcaaagcgtcgaggtggggtcgccgagcgatctgcgcttcgtggcggtgccgtga

SEQ ID NO: 3971 - DNA, 453 bp, Pseudomonas aeruginosa
ctcgctcgaaagcaactggctctggctgaccgcccggatctgcctggccctgatgttcgtcgcctcgggactggcgaagctgttcgactatcaggccagcctggaggaaatgcgcgccgccggcctggagccggcctggctgttcaacatcgccaccgccgtgaccctgctggccggctccgcgctggtcctgctggaccgcaagctatggctcggcgccggggcgctggcggtgttcctgctgctgaccatcctcatcgtccacaccttctggagcaagaccggcgtcgaagccaagctggcgatgttcttcgccctcgaacacatcgcggtgatcggcggcctgatcgccacggccatcgccagcgcgcaacgccagcggctgcgccaggacgtctccgtggccgccacctaccagaaggcctgaggcgatcatgcagaaacccgtcctga

SEQ ID NO: 3972 - DNA, 462 bp, Pseudomonas aeruginosa
gcacctggatcatcaacggcaccgacggaccggcggcgagcttcggcgggatcaacctggcggcctgggaaaagcgcgagcgcgacgcctcggcgatccagtccgagctgcaaggcaaggtcggcgacgtcgagggcagcagcatcttcgccttccagttggccgccctgcccggctccaccggcggcctgccggtgcagatggtgctgcgcagcccgcaggactatccggtgctctaccggaccatggaagagatcaagcagaaggcccgacagagcgggctgttcgtggtggtcgacagcgacctcgactacaacaacccggtggtccaggtccgcatcgaccgcgccaaggccaacagcctgggcatccgcatgcaggacatcggcgagtcgctggcggtgctggtgggcgagaactacgtcaaccgcttcggcatggagggccgctcctacgacgtga

SEQ ID NO: 3973 - DNA, 921 bp, Pseudomonas aeruginosa
acaaggcatgaagcgctcctacccgaacctttcgcgcctggcgctggccctagcggtcggcaccggcctggccgcctgcagcgtcggccccgactaccagcgtccgcagtcgccgccgccacgcgtcgccagcgagcacctcggcgagttctccggcgagcggcgggaagcgccctggtggagtttcttcgacgatccgcaactggtgcgcctggtcgaccaggcgctggcgcgcaaccacgacatccgcgaggcccgcgccaacctgcgcagcgcccgcgcgctgttcgacgaccgctggctcgaccagttgccgcaggtcaccagccaggccggctacagccgcagcatcgaacaacagctggactacgacggcgagccgcgccggcgcctggcggagagctaccgcgccggcttcgacgcgcagtgggaaatcgacctgttcggccgcctcggccgactttccgacgccgccctggcccgcgccgaagcggccgacgccgacctccggctggtacgcctgagcatcgccgccgacaccgcccgcgcctacttcgagatccagggctaccagcgccggctggacgtggcgcgcgcccaggtgcgcagttggcgcgacaccctggagctgacccgcagcagcctgcaactgggcagcggcctgccggaggacgtggagaacgcccaggccaacctgctgcgcagcgaagcggcgattccgccactggcgaccgcgctggagagcgcccgctaccgcctcgacgtgctgcgcggcgaggcgccgggcagcggcgcgccgatcctcgacggtggcggcgccgcgccattggcgaagaacctgccgctgggcgacgtcgaccgcctgatcctccagcgccccgacgtagtcagcgccgagcggcaactggcagcgagcactga

SEQ ID NO: 3974 - DNA, 549 bp, Pseudomonas aeruginosa
ccgatgccgcgagggaaaagtttctccggcatacctggagagccctctcggaggcggcgcatgaacggtcagcggcacagggaaacacccctcgacatcgagcgtctgcggcgcctgaatcgcgccacggtggagcgctacatggcaatgaagggggccgaacggttacagcggcacagcctgttcgtcgaggacggctgcgccggcaactggaccacggaaagcggtgaacccctggttttccggggccatgagagcctcaggcggctcgccgagtggctcgagcgctgcttccccgactgggagtggcacaacgtgcggatcttcgagaccgaggatccgaaccacttctgggtcgagtgcgacgggcgcggcaaggcgctggtcccagggtatccgcagggctattgcgagaaccactacatccattccttcgaactcgagaacggccggataaaacgtaatcgcgagttcatgaacccgatacagaaactgcgtgcattgggaatagccgttccgcaaataaaacgtgacggtattcccacttga

SEQ ID NO: 3975 - DNA, 1896 bp, Pseudomonas aeruginosa
aacgcgaaggcattcccacttgatcgaaacgatatctcctgccgaagggggacccaccatggacgatctattgcaacgcgtacggcgctgcgaagcgctgcagcaacccgaatggggcgatccgtcgcgcctgcgcgacgtgcaggcgtacctgcgcggcagtccggcgctgatccgcgccggcgacatcctggccctgcgcgcgaccctggcgcgggtcgcccgcggcgaggcgctggtggtgcagtgcggcgactgcgccgaggacatggacgaccaccatgccgagaacgtggcgcgcaaggccgccgtgctggaactgctggccggcgccctgcgcctggccggccggcggccggtgatccgcgtcgggcgcatcgccgggcagtacgccaagccgcgttccaagccgcacgagcaggtcggcgagcagaccctgccggtctatcgcggcgacatggtcaacggccgcgaggcccatgccgaacagcgccgggccgatccgcagcggatcctcaagggctatgcggcggcgcgcaacatcatgcgccacctgggctgggacgccgcgtccgggcaggaggcgaatgcctcgccggtctggaccagccacgagatgctgctgctcgactacgagctgtcgatgctgcgcgaggacgagcagcgccgggtctatctcggttcgacccactggccgtggatcggcgagcgcacccgccaggtcgacggcgcccatgtggcgctgctggccgaggtgctcaacccggtggcctgcaaggtcggcccggagatcggccgcgaccagttgctggcgctctgcgagcgcctcgacccgcgccgcgagccggggcgcctgacgctgatcgcgcggatgggcgcgcagaaggtcggcgagcgcctgccgccgctggtggaagcggtgcgcgcggccggccacccggtgatttggctgagcgacccgatgcacggcaacaccatcgtcgcgccctgcggcaacaagacccgcctggtgcgcagcatcgccgaggaggtggcggcgttccgcctggcggtgtccggctccggcggcgtggccgccgggctgcacctggagaccaccccggacgacgtcaccgagtgcgtcgccgattccagcggcctgcaccaggtcagccggcactacaccagcctctgcgatccgcggctgaacccctggcaggcactcagcgcggtgatggcctggtccggcgcagaagcgatcccgagcgcaaccttccccctggagaccgtggcatgagcggcattcccgaaatcaccgcctatcccttgccgaccgcccagcagttgccggccaacctggcgcgctggagcctggagccgcggcgcgcggtgctgctggtgcacgacatgcagcgctacttcctgcgcccgctgcccgagagcctgcgcgccggactggtggccaacgccgcgcggctgcgccgctggtgcgtcgagcagggcgtgcagatcgcctacaccgcccagccgggcagcatgaccgaggagcagcgcggcctgctcaaggacttctgggggccgggcatgtgcgccagtccggccgaccgcgaggtggtcgaggagctggcgccggggccggacgactggctgctgaccaagtggcgctacagcgccttcttccactccgacctgctccagcggatgcgcgccgccggccgcgaccagttggtgctgtgcggcgtatacgcccacgtcggggtgctgatctccacggtcgacgcctactccaacgacatccagccgttcctggtggccgacgccatcgccgacttcagcgaggcgcaccaccgcatggccctggaatacgccgccagccgctgcgcgatggtggtcaccaccgacgaggtgctggaatga

SEQ ID NO: 3976 - DNA, 942 bp, Pseudomonas aeruginosa
cccgcgagggtccgcgcatcatcgccgacctgctgcgccacgcgctggtcgagcggcggccctgagccaggagagcccatgcacagatatgtcgtgatagacgccttcgccagcgaaccgctgcaaggcaacccggtggcggtgttcttcgactgcgacgacctcagcggcgagcgcatgcagcgcatggcgcgggagatgaacctgtcggagagcaccttcgtactccgcccgcaacaggacggcgacgcgcgcatccgcatcttcaccccggtcaacgaactgccgttcgccggccacccgctgctgggcaccgccatcgccctgggcgccgagaccgacaaggacaggctgttcctggagaccaggatgggcaccgtgcccttcgccctggagcgccaggacggcaaggtggtggcctgcagcatgcagcagccgatccccacctgggagcacttcagccgcccggccgagctgctcgccgccctcggcctgaagggctcgacctttcccatcgaggtctaccgcaacggcccgcgccacgtcttcgtcggcctggagagcgtcgccgcgctgtccgcgctgcaccccgaccaccgcgcgctgtgcgacttcccggacctggcggtgaaactgcttcgccggcgccgggcggcactggcgcagccgcatgttctcgccggcctacggcgtggtcgaggacgccgccaccggttccgccgccgggccgctggcgatccacctggcgcgccaccggcagattccctacgggcagcagatcgagatcctccagggcgtcgagatcggccggccgtcgcgcatgtacgcccgcgccgagggcgccggcgagcgggtctcgacggtggaagtgtcgggcaacggcgcggccttcgccgaaggccgggcctacctgtgaacgggcagaacggaggaacgccatga

SEQ ID NO: 3977 - DNA, 2349 bp, Pseudomonas aeruginosa
gctgcgctacatcgaccagagcggcgccacggtatggtccgagccgcgcggggtggaagccggcaacgcctatccgcagtactcgatccatcgcggcgaactgcagatgatcctgctcgccgcggtgcgcgagcgtctcggccaacaggcggtacgcaccggtctcggcgtggagcgcatcgaagagcgcgacggccgcgtactgatcggcgcccgcgacggacacggcaagcccctggcgctcggtgccgatgtgctggtcggcgccgacggcatccactcggcggtccgcgcgcacctgcatcccgaccaggggccgctgtcccacggtgggatcaccatgtggcgcggcgtcaccgagttcgaccgcttcctcgacggcaagaccatgatcgtcgccaacgacgagcactggtcgcgcctggtcgcctatccgatctcggcgcgccacgcggccgaaggcaagtcgctggtgaactgggtgtgcatggtgccgagcgccgccgtcggccagctcgacaacgaggccgactggaaccgcaacggacgcctggaagacgtgttgccgttcttcgccgactgggacctgggctggttcgacatccgcgacctgctgacccgcaaccagttgatcctgcagtacccgatggtcgaccgcgatccgctgccgcactggggccggggacgcatcacgctgctcggcgacgccgcccacctgatgtatccgatgggcgccaacggcgcttcgcaggcgatcctcgacggcatcgagctggccgccgcgctggcgcgcaacgccgacgtggccgcagccctgcgcgaatacgaagaagcgcggcggccgaccgccaacaagatcatcctggccaaccgcgaacgggaaaaagaggaatgggccgcggcttcgcgaccgaagaccgagaagagcgcggcgctggaagcgatcaccggcagctaccgcaaccaggtggaacggccacgctagcaacaccgggcaggccaccgcgcctgccctctcccgcctctcccgtccgcgggagaggcggcatccgtgcgggtgccgggcgctgcgcgcctatcggcagcgcctcaggcctcttccgcccgccccttccactccccgcgcccctcgccggcctgcaggcgcagggcgagcagcagggccagcaccgccagggcgctgccggtgaggaaaccgccggcatagccgatctgcgcggtgaggctgaccaggaacgaagacgccagcatctcgccgaggtctcgggtgctctgcaccgcggtgacatcggtgccggcctggccgccctggccggcgaagcgcatcgccgcggtgaggatcgccaccgaggtgatgccggtagccagcgagccgatcagcacgcaggtccacgccaatccttcactcagtgccaaccagcgaccggcctgcagataccagagcagcgccgaacaaccggcgagcaccacgccaagggcgaaaccgcgccacaggccgatccgcctgaccagccaggcgccgccgccgcagccgaggaataccgtgaccaggccaccgctcatgcccagccggccgatgtcctgcaaggcccagccggcatcgctgaggtacagcttggacaggccgaagccggataccgcggtcatcgccgacagcagtgccagcgccagcagcgaaggcgccagcggccgacgcaggaagcgcagcaggctggccttggcggccggtgccggggggagttcgtggggggcgccgcgccccagggcgagcacgcagcacaggcttgccagcggcacgcaggccacgaccaggaacgccgtgcgctggccgaaatacccggcgaggatcaggctgccggcgccgccgccgaagaagccgatcatcaccccggcgatctgtaccgcgttgaccttggccagcagctcgccgctgaagtgctccgccgccatgccgtcggtggcgatgtcctgggtcgcgctggccagcgaagccagcgccagcaggccgaccgcccaaccggcgctggccacgccgaggccaaacgtcgccaggccgagcaggcaggcgaggacgatgcattgcatcggcaggatccagttacgccgccggccgaaacggcgcgaccaatggttgtcgacccagggcgcccagaggaacttgaccacccagggcagccccaccaggggcaggaaggccagcgcctgcaatggcgcgccatcctggcgcaggagggtgggcagggcgtccatggccaggccgatgggaatgccctgggacaggtagagcaacgccagggtgatgaccaggcggcggtggcgatacagctcaagcatggtggtctccggtga

SEQ ID NO: 3978 - DNA, 426 bp, Pseudomonas aeruginosa
gtcagggcgccaggtgcgcgacggcggccgccaggcaggccagcccggggacgccgagcaacccgcgcgccagcggccagtcgcccggcagcagcaacgccgccaggccagcggcggcccacaggacaaggaacagccgccccgtccagggtccggcgagtagctccgagggcacgagttgcagccccagcaggagcaacgcggccgccgccaccaggccggcacagaaaccctggctcaggcgctgcaagagccgtacgcgggcgtccggcgccgaggcgcgtcgttgcagccacaggtacaggccgctggcgcagagcaggcaggcgccgaggcccatcgccaggtgcaggccgcgcaacgcggcggaccagcccggcccgagccactggtactgggcgaaatgcaacggctgcacggcgatga

SEQ ID NO: 3979 - DNA, 723 bp, Pseudomonas aeruginosa
ccaccacccgcccggggaagccgacgaacaggctcttgtgcaggttcagcaggaggtccatcgccggcgtcggtggcaacaccccggccgctggccgggtcgaggtccagccggcagtccaggcgcgcatcgcagacgctgaaggcggcatggccgggagcaggcagcagcagggtcgcatcgcggatgtcgacgccttcctcgcccgcccgttcgagcaggcgctccagcgcaagggtttctcctcccgcctgcgccggggcccgcagccactcgcgcaggtcgtcgtggccaagactccaggcgccactgaacagcaccacgaacagcagcacgccgaacagcgcgccggcgccaccgtgcagcgagagcaggagaggacgcgccgccacttcaaccgcgccccgccagcagccacaacgccaggcccagtaccagcaggctaccgcccaggcgccaggcgaagttgcccggaccacgcgccagcaacccgccgacaagcagcaacaagcccaccccgagcgcgccgaagagcccggcgtagagacgctcgagcgggtcgtccaggggcagcccgcgagtcaacagatagccgctggcggtcgccgccgccaggctgccggcgagcgccagcggaacccgccaggcccagccgaagcccgactggcgcggcatcagaacgcgccccgcaggctgacgttgaagctgcgcggttcgccgtag

SEQ ID NO: 3980 - DNA, 765 bp, Pseudomonas aeruginosa
ggcgcaggcgcccctcctccagcagcagttcctggtcggcctgacgcgccagcgccgggcggtgggtcactaccatcagggtgcgccggccgcgcaacccgagcaggttgcgcagcacctgcgcctcgctggcggcgtcgaggctggcggtgggcttgtcgagcagcagcaacggcgccgtcgagagcagcccgcgagccaggcacaggcgttgccgctggccgccggacagcagcgcgccgccgggaccgacgtcgctgtcccagccctgcggccaggcctcgatctcttccagcaggccaaccgcccgcgccgcctagcgcagcgcttcgagatcggcgtccgctcgcgccatgcgcaggttccaggcaacgctgccgcggaacaggccgttgtcctggaacaccaggttacgattggcggcgagggtcgtttcgctcaaccggcggatatccacgccacccagcaggacacgcccggcatcgacgtcgtagagccgcccgagcagcgccagcaggctgctcttgccggccccggagggtccgacgaggacgttcagcgaacccggctccagcctcagggaaatgtcctcgagcaaggcgcggccattttccagacgcaattccacggcctcggccgccaggctggcgtcgtgcggccgctcgcccgggctcgggactgcgcagcggagccagggcgaaaaccggcagcagggtatccagcgcctggccaggcgccgggccaacgcctggtcgagatgggtga

SEQ ID NO: 3981 - DNA, 858 bp, Pseudomonas aeruginosa
  unsure (656): Identity of nucleotide at the above locations are unknown.
agccgaggccgctgggcaggctgcgccgcaacagatccagggtgctgcggtggagactgcgcaaggcctcttccagcccctggcgggcgacgctttcgcgctgcgccgcgcgcagcagtggctggcgttcggcgaacgcctgcaactgccgtgcggcgtcgcgctcggcggccagccgggcatcctccgccgccagattgcgccgcccgctccagcgcaacagcgcggcgaggaaggcaccagcaaggagcaggccgagggcgatggacgggtcgatcaggaacagcccgaggatcaccccgagcggcgtcaccaacgcggcgatcagcggccccagcaggtgcgccggaatgcccatcgcctgcatcaccgggccgcgcagcaggccttcggccggcgcgacccggcgcaacgccggcggcgccaggcgcggcaagcgcgccaccaggctgcgcaccagtccagccgccagcgagccgccggcggcgaaaccgcgacgcatggccaggtactgcaacagcgcctgcgccaggctcaaaccgagcaacgcggcgacccagcgccagggcaacgcgccttcggcgaaccaggcctcgaccaacggcaccagcaatacgccgcaagcggcgtccagcagcgccgccaggaccgcccangcgctcgcccggcgcaacgcggcacggcagtcttcgggcagcgcacgcattcgttcgaacagggtcatgccgccacctccgcgccgttctgttcacgccacaagcgcgcataggcgccgtccgccgccaacagggcggggtgctcgccgcgttcgaccagacggccaggggaccagcaccaggatcaggtcggcatcgctga

SEQ ID NO: 3982 - DNA, 948 bp, Pseudomonas aeruginosa
tgcgctcgtcgaggcaggcgtcacgggccgcctggcgaatctcctggagatcggcatcggggcggaacagggcaatgttgtcggccagggatatctccagcgccgccgcctgctggccgaccagcgcgatatgccgatggcgcacggcatcgggcatgtccttcagtgccaggccgccaacctccagttcgccgcgctgcgcgtccatgtagcgcgccagcaggtgcagcagggtgctcttgccggagcccgagggaccgaccagggccaccaggctgccatcctccagctccagatcgatatcggccaggacctccacgccttcataggcatggcccaggccgtgcagcgccaccgcgccatcgaccggctcgcgggtcgagcggccctcggccagcggcgcctggtcgaacacctgctgcaggcgctcggcggcggcgcgcgcgcccagcagcgagtcgccgccgtggccgagcgcctgtaccggggcggccagggcccgcaacaggagcaggaaggcgcaggcctggccgagcgccagcggcacgccgagggcatccagggccagcgcgccgagcaggacccaggccagcagccagggcgtcgacaactgcacgtagaccagcgcggcgaggtggccgacccgcttcacccaggcgccgaacgcttcgccgaaggccgccgccgacgcctcggcgccctgttgtatgccggcgccggggtactgtcgggccagcagcaggttgtgggcgaattcgccatagtccgccgagagcctttccagcgcggcgttgcgccgcagcaccaggtcgcgatagcgcgccgagcgcagcagcaggaagccggcggcggccagcaccagcggcagcaggcagaacagcagcagccaggggtgcagccaggccagccagagcaacgcgacgagcggcaccaccaacaggttgctga

SEQ ID NO: 3983 - DNA, 1077 bp, Pseudomonas aeruginosa
  unsure (504),(604),(642),(753): Identity of nucleotide at the above locations are unknown.
gatcgttgggagcgtgcgcgatcagttggtgcagggcccgcacgtcctgctccacgaggcgcgccacgccgtccgggccctggcgaccgaaccagtccagcggcagccgttgcaggtgcgccagcaggcgcaggcgcaggtcgttgcagaggtccgcgtcgacccggtgggccaggtgcgcggccagcgcctggcagcccagccaggccagcaccgccagcagcaccagggccagcagggccggctgcgcctggccgcgcgccagcggctcggcgagccaggcgagaagcatccagggcaacagcgagcagagcccggccagggcctgcaaccccatggccgccgccagccgccagcgataggtgcgcagcaggcgccacagcaccggggtcacgaggcttgctccagcacctgttccaggctcgccggcgccagcgacgccggcggcgcctcggggaagccaaggcgctcgccgatccgctgccacagggcggcgacctccangctgcgctggttgcgccggcgcacctcgtcgccgttggcgagcagcgccagcgcctcggccgccgccgccggccacaggcgctggtgcacctgggcccanctgcacggttcggcataccaaagctgggcgctgggcancggttcgccggctatctcgtcgaacagcgcgaacaggccgtcgtcatcctctgccggtaccgccaccgcaggcgtccacaacaacgggccatgggggctgagcaggctcancgtgccgcgatcggtggtcaggctgacgcgctgcaacaaggtcatgcgcccgtcgtcggcggccgccagttcgttgagcacgtgcaggctcaacggcacttccgccagcaccagggacagcccgcgcatcgccgacaggtcgttcgaggggcgaattccagggaccaggggccgacgccctccagcaacgcggcgaggatgtccagggtggggaaaccgacctgcaccccgcagggccgcgtccaggtggcggatgccgccgcccggcgatgcaactggcggcccagctcgatgaaacgcgccaccgccggcaactgcggatag

SEQ ID NO: 3984 - DNA, 1353 bp, Pseudomonas aeruginosa
cgcccgcgcgcagttgctggcctatcccagcgtcgagtggctgtccgaagccgccgtcgcggcgaagaaggaggcggacggtttcgtggtgaaggccgccaacggagaacgtttcaccgcgcgccggctgatcctcgccagcggggtcgccgacgagctgccggagatccccggtcttgccgagcgctggggacggcacgtgttccattgcccgtattgccacggctacgaactggacggcgggccgattggcgtactggcggcctcaccgctggccatccaccacgccctgatgttgcccgactggggagcgaccacctttttcctcaacggcgtcttcgaaccggatgccgagcaaatgtccaggctggaccggcgcggcgtgacgatcgatcgcgaagccgtggtctcgctgggcggcgcgcgcgccgacgtgaccctggccagtggccgcacgattacgctcgcggggttgttcacccagccgcgtacgcgcatggccagcccgctggcggcgttgctcggctgcgagttcgaggacggcccgagcgggccgttcatcaggaccgacggcatgcgcgaaaccagcgttcccggcgtcttcgcctgcggcgacgcggcgctggcggccggcaacgtcgccatcgcggtgggcgacggcgcgcgcaccggtggcgcggcgcatcattcgctgctgttccgctgacgccggaggctgacaggccaaggatccggcccaccgcccggcaaatctttcgaactccccggcgctccagctttccactctcctgcatgtcacgccacggcgcccgccacgggcgccccagcagaggagaaaaccatgagcgcgaagctgcaaggcaagaacgtcctggtcatcaccgccaacaccggcatcgagcgcgacgagctgctcgaaccgctgaagaccctgaagcaacagggcgccacggtcacccacgcgaccatcgagggcggcgaagcgcagacctgggtgcacgacagcgagaaggacctgatcgtcaattccgacgccaggctgcaaggcctgcgcgccgaggactacgacttgctgctggtccccggcggcacggtgaatgccgacaccctacgccaggacagcgaggcccggcgcctggtcagggaattcagcgacgcaggcaagacggtcgccgccatctgccacggcccctggctgctgatcgacgcgggtgtcgcccgcggcaagaccctgacctcctattccagcgtgcgtatcgacctgaccaacgccggcgcggactgggtcgacacgcgggtgaaagtctgcccggcgaacggctggaccctgatcacctcgcgcaacccgggtga

SEQ ID NO: 3985 - DNA, 354 bp, Pseudomonas aeruginosa
tggagagcggccatccggtggtgctggccggcgacttcaacgtggtgcccagcgacttcgatatctacgacacccgctcctggaaaaaggacgccctgctccagccggagtcccgcgagtgcttcgagcgcctcctgcggcagggctgggtggacgcgctacgccagcgtttccccgaccggcgcctctataccttctgggactacttccgccagcactggcaacgcgacgccgggctgcgcatcgaccacctgctgctcagcgccagcctggcggaccacctggaagacgccggggtggatcgctgggtgcgcggcgaggagcacgccagcgaccacgcgccggcctgggtaa

SEQ ID NO: 3986 - DNA, 261 bp, Pseudomonas aeruginosa
tgtgcgccgacatcgactaccaggcgcagagccactgcgtgcgtcgcctgcaccagttgttcggcaaccagggccggcggcacctggacctggcctgcggtaccggccctcacgtgcggcacttcctcgatttcggctatcgcagcgccggcctggacatcaaccagccgatgctcgacctcgcccgacagcgctgtcccgaagcgcacttcagccggcaggacatggccggcttccaggtggacgagccgctggacctga

SEQ ID NO: 3987 - DNA, 1419 bp, Pseudomonas aeruginosa
caccttcgcgcgcttttttacccccgctgtcgagagtcaccgcatgtcctccccgttttccccccgttcgccccgcacccttcgcggcctgggcgccctcgccctgtgcggcggattcgtcgccccggcccctgccgccttcctcgaggacggcagcgcgcgcctggaagcgcgcaccgtctacttcaaccgcgacttccgcgacggcagctcggccaacccgcagggcgcctccaagcgcgaggaagccgcgcagggcttcatcctcgacctgcgctcgggctataccgagggcgcgctgggcttcggcgtggataccctggcgatgctcgggatcaagctcgactccagccccgcggacagcaacagcggcctgctgccttccagcggccacgatccgcgtcgctcggtcgaccagtacgccaaggccggcgttgccggcaagatgcgcttctcgcagacacagttcaggtacggggcgatgctgccggacatgccgttgctgaaatacaacgacggacgcctgctgccgaccctgttccacggcgcccagctgaccagcgaggagatcgccgggctcaggttctccgccacccgcctggagcgctacaccgcgcgggactccagcgatgcccaggacatccgcctgcactgcaagaacaaacgctacgcctgcgacaccaccggcaaccgcttcgacgcctaccgactcgactaccaggtcaacgacggcctgctgctgcaatacgcccagggcggcctgcgcaacgtctatcgccagcgctacctcggtgccgtgggcaagcggcagctcggcgccggcaagctgagcgccgacctgcgctggttcgacagcgaggacgccggcgcggcccgcgccggcaagatcgacaaccgcgccctcagcctgctgctcgcctacgcccagggcggccacacgctcagcgccggctggcagcggatgaacggcgccagctcgatgccctacctcgacggcagcaatccgtacctggccaactacctgcaggtgaacgacttcgccaaccccgaggaacgctcctggcaactgcgctacgacttcgacctgcgcagcgtcggcgtgcccggcctgagcttcatgacccgctacgtcaacggcgaccatatccgcctggccaacggcgacgagggcaaggaatgggagcgcgacatcgagctgaagtacgtggtgcagagcggccgcttcaaggacctcagcctgcgcctgcgcaacgccacctaccgcaccgacttcgagcgctcggcgcgcgacgtggacgaggtgcgcctgatcgccagctacaacctgtcgctgttctgagccgtcgcgccggaacgcacgccggcgcgacgctccggcggttcagaccgccagggcgcgttcgcgcagctcgacgttga

SEQ ID NO: 3988 - DNA, 801 bp, Pseudomonas aeruginosa
gggcggagcccggatggtagaaatccacctaccgctttacgcgccgcgccccctccatgtcaccgaaccctgaagacgaccatgcccgagcacgccccgatcctccccgtcatcgccgccgaagtggccgccttcgcccccggtttccgcgccctgagcctcaccgtcgaggcggcgccgatcgttcgtccggaaatcgccggccgcgccgtagagcgcgcctgccaggcgctggcgcgtggcgaaccggactgggccgaggcgcacctggcagcctgggccgaggcgttccgccgcttcggcgccaagccgcagcgtaccccctgctccgccgaagccctgcgcaaacgcgcgctgcgcgacggcgggctgccgagcatcgacccggtggtggacctgtacaacgccatcagcgtgcaattcgccattccggtaggcggcgagaatctcgccgcctatgccggcccgccgcgcctggtggtcgccgacggcagcgagaccttcgacaccctgaagaacggcgaggcggtcgacgaatcccccgaccccggcgaggtggtctggcgcgacgacctcggcgtcacctgccgccgctggaactggcgccagggcgtgcgcacccgcctggatgccagcgcccggcgcatgtggttcatcctcgagagcctgccggaaatgccgctggcggccctgcacgaagcgggcggcctgctgctcgacgaattgcgcctgatgatgcccggcatgcgcgccgactcgcgcctgctgtgcgtggcgacggaacccaccgacagcgtataa

SEQ ID NO: 3989 - DNA, 666 bp, Pseudomonas aeruginosa
gggccgagtccccgaggagaacagaacatgtacctgccttcgcatttcgaagagtccgacccgcaggcgctgcacgcgctgatccgggactatccgctgggcctgctggtcagccacggcgaagcgggcctggacgccaaccacctgccgttcgagctgagcccggaaaagggcgcgcaaggcaccctggaagcccatgtcgcgcgcaacaacccggtttggagcgagctgcgcgacggcgacgaggtgctggtggtgttccgcgccggcgatgcctacatctcgccgcagtggtacccgagcaagcaggagcaccaccgccaggtgccgacctggaactaccgggtggtccacgcccacggccgggtgcggatccgcgacgacgaacgctatgtgcgcggactggtggcgcgcctgacccgcacccacgaggcgacccaggaaacgccctggaaaatgaccgacggccccgccgactacatcgacgagatgctccggctgatcgtcggcatcgaaatcgagatcacccgcctggtcggcaagttcaagctcagccagaacaaggaagcccgcgatatccgcggcgccagcgcagcgctgctggcgcgcggcgaacaggcgatcggcgcggccatggacgattgcgccgcccggcgcgagggctga

SEQ ID NO: 3990 - DNA, 1674 bp, Pseudomonas aeruginosa
  unsure (1504),(1674): Identity of nucleotide at the above locations are unknown.
aaaggcctccatgaaagcccaacccgacgtcgactcgaacagcgccgatgcccccttcgaccgcaaggcggtgctgggcgatgcgctgcgccggcggatcctgagcatggaactggcgcccggcgcggtcgtcgacgaactcgccctgtgcgacgagttcggcctctcgcgcccgccggtgcgcgaactgctgcggcagatcgccgccgagggctacatcgaactggaagccaaccgtgcgccgcgcgtcgcggccatgagccacgactcgctgcacgccttctttctcgccgcgccgctgatctacatcgccaccacgcaactggcggccacccatgccagcgaagcggagatcgagacgctcaaggcgatccaggaagatttccgcaaggccatcgaagagaagcatgtggaaaaccgcgtcatccacaacgacgccttccacctggagatcggcaggatggcccacaacgactacctcatgccgagcctgcgccgcttgctgatcgaccatgcgcggctgggcaagatcttctaccgccatccgaccaccgacgacatgcaacgcgacctggaactcgcctgcgaccagcacgaccagatcgtcgatgccatcaagcggcgcgatccggatgcggcggcggacatcgtccgtgcgcatttcgagctgtcgcgccggcgcatggccgagtacgcggcaccggccggagtggaggtggcgctggtctacgagggttagcgagcccccgcgccacggccccgcccgagaagcggaggcggtcacgcaggggatggttaccgggttccaataacaagagtcaggtccctgcgatgacgaaagtaacccaccttccggccgacgaccgttcctgcggctggtatcacctcagcccgccgcggcggccgaagccggcccactacggcaggagcgccgcccgttgggtggtggtcggcgccggcttcaccggcctcgccgccgcgcgccagctggcgctgcattttcccgacgaggagatcgtcctggtcgaggcccaggaagtcggcttcggtaccgccgggcgcaacgccggcttcgccatcgacctgccccacgacatcggcgccgacgactacatcggcgacatagcgaccgcccggatcggcctgaagctcaatctcgccggccagtcgctgctccgcgaacaggtgcagcgccatgccatcgactgccagatgaaggcctgcggcaagtaccaggcggccgtcgaggcgcgcggcgtggctgtgctcgacgcctaccggcgcggcttcgatcggctcggccaggcctacgaggtgatcgaggcggacgacctcccgggacacatcggcaccgctttctatcgcaaggccctgttcacccccggtaccctgctggtgcagccatcggccatggtcaagggcctggccgacagcctgccgggcaacgtcagcctttacgaacacacaccgatcaccgccgtggaatatggcgacaggaccctgntgagccatccccacggcagcatcctggccgaccgcctggtcctcgccaacaacgcgttcggcatgagcttcggcttcctccaggggcggatgctgccgatcttcacctacgccagcctgacccggccgctcgatgccgaggagcaggcccgcctcggcgggcgcccctan

SEQ ID NO: 3991 - DNA, 477 bp, Pseudomonas aeruginosa
tggggcctgatcccggccgacccttacggcaccacggtgaggcgtaccccggacaaccgcctgctgatccgcaacagcttcagcttcaaccctgacggacgcagcgccgggaagtaccttgagcgcttcgccgtacgccatcgcgcctcgttccgccagcgcttcccgatgctcccggaagtcggcttcgactacacctggggcggctcgctggcgctgtcgaggaaccacatggggcacttcggcgagctggcgcccaacgtttatggcgccctgtgctgcaacggcctgggggtaacccgcgggaccgtcaccgggaagctgctggccgactggctggcgggcgaacgcaacgagctgatcgacttcctgctgcgcgcgcccggtcccagcggcaatccacccgaaccactcctttcccttggcgtgaacctcaacctgaggtgggggcagtatcgagcaggtagagaaagctag

SEQ ID NO: 3992 - DNA, 1344 bp, Pseudomonas aeruginosa
  unsure (870): Identity of nucleotide at the above locations are unknown.
aaccaggagacaataatgacaaatcctacgacctcgatcgaagacgtacccctcaacgccttccaccggctgttgaccctgcgctccggcggcggctccttcgtcgacggctacgtgctgagcatcatcggcgtggcgatgctgcagatgaccgcggcattgcaactgagcagtttctggcagggcatgatcgccgcctcggcgctggtcggcatcttcttcggcggtttcctcggcggctggctgaccgaccgcctgggccgccgcaggctgttcttcgtcggccccagcctgttcgtcctcgcttccctggcgcagtacggggtcgactcggcggcggcgctgttcgtcctgcgcttcctgatcggcgtggcggtgggcatcgagtacccggtcgccaccgccttgctggtggagttcctgccgaagaagtatcgcggaccgcgcctggccaccctgaccatcctctggttcgccggcgccgccttcgcctacctggtcggcgacctgatcctgcgcagcggcggcgaggacgcctggcgcctggtactggccagcaccgcggcgatcggtgccgtgctgttcctgctacgcatcggcacccccgagtcgccgcgctggctgctgagcaagggccgcgacgcggacgcagagcgggtcatccgccaggtctacggagaagccttctcgctggagaacctgcccgaacaggcgccggaacggaacgtcaccatctggcacctgctctacgccggctacggcaagcgcatgctcttcgtcaccctgttctggacctgctcggtgatccccgtgttcgccgtctacgccttcgcgcccaaggtgctgctggcgctgaacctgaagggcgantgggcttcctacggttcggtggcgatcaccctgctgttcgtcatcggctgcatcatcgccacccgcctgatcaaccgcatcggccggcgctgcatgctgctgcacagcttcctctggtccggcctggcgctgctcgggctgggcgtcttccacgccggctcggaggcgaccatcctcggcctgttcggtgcctacgcgctgttcatcggcggcgcccaggtgctgcaactggtctacccgaacgaactgttccccaccgagatccgcgccttcgcggtcggcgtcggcacctcgttatcgcgcgtcggcgccgcggtgggcacctacctggtgccgctttccctggaaaccctgggtaccgcccagaccatgtacgccgccgcgctggtgaccctgctcgggctgctcgtgacctgggccctggcgccggaaacccgttcgctgaacctgcagcaggcggcttcgctcacctga

SEQ ID NO: 3993 - DNA, 972 bp, Pseudomonas aeruginosa
accacccgccgcggcagcgtccgccgggtgcgccgcggcccagcatcccacaggaggaacccccgtgaaattcgaaggtatctatacccccgccatcaccccgctgagcgccgacggcagcatcgacacccaggccttcaccgaggtcctggagtttctcgtcgagtcgaaggtgcacggcatcgtgatcggcggctccaccggcgagtactacgcgcacaccgccgaggaacgcctggccctcgccgcccacgccagcgaagtcatcgccgggcgcctgccgctggtggtgggaaccggcgcgatccgcaccgaggactcgctggcctacgccgaagccgcccgcgccatcggcgccgacgccatcctggtcggctcgccgccctacgcgctgccgacctcgcgggagatcgccgagcacgtgctggcggtggatcgcgccgccggcctgccgatcatgctctacaactatccggcgcggatgggcgtggagatggacgaggcgttcttcgccgccgtcgccggctgccgcaacatcgtcgcgatcaaggaaagctccggctccaccgcgcaattgcaccgcctggcctgccgccacccgcggatcgccttgtcctgcggctgggacgaccaggccctggagttcttcgcctggggcgcgcgcagttgggtctgcgccggctccaacttcatccctggcgaacacctcgccctgtaccaggcctgcgtggtcgagaacgacttcgccaagggccggcgcatcatggcggcgatgatgccgctgatggactttctcgaaagcggtcacttcgtccagtcgatcaagcacggctgcgaactggccggcctgcgcgccggcggcgtacgtgcgccgctgaaggcgctggacgaggccggcaaggcggcactggcggagatcgtcgccaggctcaagggcgaggtcgcgcggatcgtcgagggtggccgccatga

SEQ ID NO: 3994 - DNA, 234 bp, Pseudomonas aeruginosa
ccgccctgcgcgtcgccgaactggccagccaggcggggatccccgccggggtgttcaacgtggtccccggcggcggccgcgaggccggcgaaccgctgggccgccacccggacgtggcgatggtcagcttcaccggctccaccgcgaccggccgcctgttcctcaagtacgccgccgagtccaacctcaagcgggtggtactggagtgcggcggcaagaacccggcggtggtga

SEQ ID NO: 3995 - DNA, 537 bp, Pseudomonas aeruginosa
tcgtccatgccgaagtccgcgaggcgctgctcgaacgcatcggcgcgcagctccgcgagtggcgcatgggcgacccgctggatccgtgtaatcgcctcggcgcgctggtcagcccggcgcacttcgagaaggtccgcgcgtacctcgaccaggccaggacggagcggttggcggtgcgcttcggcggcgccaccgaggctggcatcttcgtcgagccgaccgtggtcgatggcgtctcgccgcacagccggctgttccgcgaggaaatcttcggcccgctgctctcggtcacctctttcgacgacatcgacgaagccatcgccctggccaacgacaccgtctacggcctcgccgcctcggcctacaccggcagcctgcgccacgcactgcgcctgtcgcgggagatccgcgcggggatcgtcaccgtcaactgcttcggcgagggcgacgcctcgacgcccttcggcggctacaaggagtcaggcttcggcggtcgcgacaagtcggtctgggcacacgaccagtacacagagttga

SEQ ID NO: 3996 - DNA, 1734 bp, Pseudomonas aeruginosa
cgtccggccgcgcgcctagagcaggtcgcggcgcaactgcgggaataccttggccaccttgttcagcaggtagtcgccgtactcgccgtggaaagcgtggacgttggcctggtcccagcgacgggcgctgtcatcctgttccggcacctcgggcagcccttcgatgggctgcacgcgggcatggaagttcggatcgaagaacagcgggaacgacaggcggtctcgccccgaagtgttgcgtgccacccggtgcggcgtgctgcggtagaggccgccggtcatgcgttcgagcatgtctccgaggttgcagacgaacgagcccggtatcggcggagcctccagccagccctgtggggtgcgcacctgcaggccgccgatggcgtcctggtggagcagcgtgagcaggccgtagtcggtgtgttcgccgacgccccactgcacgtcgaggccctccggcactggctggctcggataattgaacaggcggaagaggatcagcggatcgccggtatagcgcgcggcgaagtagtcggcttccagtcccagaccgagggcgatgccctccatcagccggtggccgacgcgggtggttgcgtccaggtactccagcagcgtctcgcgcaggccgggcacctcggggaacaggttggcgccatgcagcggcgtcccggcgcgcacttcgggatgctcagcgtccagttcgctgcccaggtacaagccttccttccagtccgggcggttggaggtcagttcgccgccaagagggaaatagccgcgccaggcgcgcccgccaagctccatgcgccagcgcagcttgctcgtctcgtcgagggcgaagaactgccgcgccaggcgctccaggcgctcgaccagttgcgcctcgacgccgtgcccgaccacgtagaagaagccctgctcgcggcaggcgcggtcgattcgcacggcgaccgaccgtcgcgccgccgggtcgctgccggcaagggcggcgatatcgatgatcggcagactcggagtgctcatggcgttcctcacaggggttgggcgaagggggtgcggatgtcggcgaggaacttccgcgcacgcgggtgctgcgggcggttgaagaaatcgtcggggctggcgcgctccagcacccggccggcgtccatgaacagcacgcggtcggcgacgtcgtgggcgaagcccatctcatgcgttaccaccaccatggtcatgccgtcgcgggccaggtcgcgcatcaccagcagcacctcgccgaccatctccgggtcgagggcgctggtcggttcgtcgaacagcatcagcggcggctccatcgccagcgcgcgggcgatcgccacgcgctgctgctggccgccggaaagccgtgcggggaacgccgccgctttgtccgccaggccgacccgctccagcagcgccaaggcctggcggcgtgcctccgcgggtttcaggccgcgcaaacggagcggcgccagggtgcagttgtccagcacgttcaggtgcgggaacagattgaactgctggaacacgaagccgatgtgcgagcggaagcgattgaggtccaggccgggagcgtggatgtcctggccatcgatcaggatgcgcccgccctggatcggttccaggcggttcagggtacggatcagggtggattttccggagcccgagggtccgcagaccaccaccacctcaccgcggccgacctgttcgtcgacatccgccagggcgtggtag

SEQ ID NO: 3997 - DNA, 600 bp, Pseudomonas aeruginosa
cccgcgccaggccgagcaggatgcccagtggcagcgccagcagcagcgccagcgaggccaggaccagggtcagggccagcccgcccaacggcccgttggggtactggccgacgaggaagtacagccagtagctatcgatcagttccagggtggtcatcgccgttcgactcccggatagcgctgctggtaccaggcggcggcgccggtgatcagcagcgatacgctgagataggccgcggtggcgaaggcaaaggactcgaagctgcggaaggtagaactctccacctggccggcctggtacatcagctcggcgacgccgatcaccgtggcgatgctggtgttcttccacaggttgagggtttgcgagatcagcggcggtacggtgatccgcaaggcctgcgggaggatcaccaggcgcatgctcgccaggtagccgaagcccagcgcgcgggcggcctccagttgcaccgtgggcaccgcgcggatgccgctgcgcatgtcctcgctcatgaacgcggcggtgtacagggtcagcgcgacgatagcgctggcggcctcgatgttgccggcgtaaagccaggccttgaggtcctcgggtag

SEQ ID NO: 3998 - DNA, 441 bp, Pseudomonas aeruginosa
gcgcgccaggcctcgcgcggccgctcgccaagcaaggcaaggaaggcctggttgaattccaccgcctgcgcctcgccgtcgagcagcagcgccggctgcgggtcggccgcgaggaacggcgcagcgcgggtgacgccacgggcggcggcgagcaacggtgcgaggagcaggccgagccagtccagcgcagcgctctgcggcgtatcgctggccaccagcagcaggccttcgtcgccggcctgcaggtcgagggcgaaggccatgccatgctccacgccggcacgccgcaagcgcgcgccgagccaggaggcggaacgccgcaattcgtccagagccagccggccgtcgcgcaccagccgctcgcgcaacgccaggtcgctggcccggttcggctcgccggcgcccggcggcagcgccggcgacggcggcaccggggtatag

SEQ ID NO: 3999 - DNA, 1320 bp, Pseudomonas aeruginosa
  unsure (748): Identity of nucleotide at the above locations are unknown.
cttccatatatttttcatcgttgctataaatcgccccaacccaaggagcgcttcgcctggtccttggaagctgttcacgatctgccgagccagagaaaccagccgttttcgacgcagtctctccgcgcgcggcagatcgtgacccttacccagaacagagctaacaatcagccacggggtactcttcatgtcgatcttcgaacagggtctcgcgcccgccgccgtcaaccacatcgccctgacgccgctgagcttcatcgagcgcaccgccagcgtctatccgcactaccccgcggtgatccacggcaacatccgccgcgactgggcgcagacctaccaacgctgccgacgcctggcctccgccctggccgggcgcggcatcggccagggcgacacggtggcggtgatgctgccgaacatccccgagatgctcgaggcgcactatggcgtgccgatgatcggcgcggtgctgaacaccctcaacgtacgcctcgacgccgaagccatcgccttcatgctgcaacacggcgaagccaaggtgctgatcaccgactacgaattccacgaggtgatccatgccgccatcggtatgctcgaccacccgccgctggtggtcgacgtcaacgaccccgagtatggcgaaggccgcccggttggcgaactggactacgaggcgctgctcgccgagggcgacccgcagttcgcctgggaatggccccgggacgagtggcaggcgatctcgctgaantacacctcgggcaccaccggcaaccccaagggcgtggtctaccatcaccgcggcgcctacctgaacgcgctgggcaaccagatgacctggtccatgggccagcacccggtgtacctctggaccctgccgatgttccactgcaacggctggtgctatccgtggacggtgaccgcgctggccggcgtccacgtctgcctgcggcgggtcgatccgcaaaaggtcctcaccctgatccgcgagcaccaggtcagccacctgtgcggcgcgcccatcgtgctcaacgccctgatcaacatgcccgattcggccaaggccgccatcgaccacccggtgcatgccatggtcgccggcgccgcgccaccggccaaggtgatcggcgcggtggaagagatgggcatccgcgtcacccatgtctacggcctcaccgaggtctacggcccggtcacggtctgcgcctggcacggcgagtgggacgacctgccgctggagcgacgcgccgcgatcaagtcgcgccagggcgtgcgctacccgaccctcgaaggggtgatggtggccgacccgaagacccttga

SEQ ID NO: 4000 - DNA, 1920 bp, Pseudomonas aeruginosa
atacaacgccccgctgcgcgacatgcgcttcctgctcaacgacgtgttcgacgcccccgccctgtggcagcgcctgccgcgactggccgagcggatcgacgccgacaccgccgacgccatcctcgaggaagcggccaaggtcaccggcggcctgctcgcgccgctcaaccgcagtggcgacgaagaaggcgcgcagtggcaggacggcgccgtgcgcaccccggccggcttccgcgaggcctacgcgacctacgccgagggcggctgggtcggcctcaccggcaatccggcccatggcggcatgggcatgccgaagatgctggcagtgcagttcgaggagatgatgtacgcggccaacgccagcttcagcctctactcgaccctttccgccggtgcctgcctggccctcgatgcacacggcagcgaggagctgaagaacaggtacctgccgaacatgtacgccggcacctgggccggctccatgtgcctgaccgaaccgcacgccggcaccgacctgggcatcatccgcaccaaggccgagccgcaggccgacggttcatacaggatcagcgggacgaagatcttcatcaccggcggcgagcaggacctcaccgagaacatcatccacctggtgctggccaagctgcccgacgcgccggccggttcgcgcggcatctcgctgttcctggtgccgaagttcctggtcggcgacgacggcgcgctcggcgcacgcaacgcggtgcactgcggctccatcgagcacaagatggggatcaaggcctcggccacctgcgtgatgaacttcgacggcgccagtggctggctggtcggcgaagtcaacaagggcctggcggcgatgttcaccatgatgaactacgagcgcctgtccatcggcatccagggcatcggctgcgccgagatgtcctaccagagcgccgtcgcctacgcccgcgagcgcctgcaaagccgcgcgccgaccggcccggtggccagggacaaggccgccgacccgatcatcgtgcaccccgacgtgcgccgcatgctgctcaccatgaaggcgctgaccgagggcggccgcgccttttccacctatgtcgggcagcagctcgacctggccaagtacgccgaggaccaggaagaacgcagccaggccgaagccctggtggccctgttgaccccggtggccaaggccttcttcaccgataccggcctggagagctgcgtgctcggccagcaggtgttcggcggccacggctacatccgcgaatggggccaggagcaactggtgcgcgacgtacgcatcgcgcagatctacgaaggcaccaacggcatccaggcgctcgacctgatgggccgcaaggtggtcgccaacggcgggctgttcctctccatcttcagccgcgaggtgcgagccttcgccgccggcgccaacgccgaactggcggagttcgtcaccccgctgctgaccgccctggacctgctggacaacctcacccagggcatcgtcgcccgcgccggcaacgacccgcgcgagatcggcgcagcctcggtggaatacctgcatctgttcggctataccgcctacgcctacctctgggcgcgcatggccgccgccgcgcagcgccagcgcgaggtcgacccggcgttccacgacggcaagctggccaccgcgcgcttctacttcgcccgcatcctgccccgcgtgcactccctcgccgccgccgtcgaagccggcagcgaaagcctgtacggcctggaggcggaacagttctgaagcttccgtcgcgcggcccgtgggccgcgtgttttttccgggacagcatgcaacgcgctgtccgccgacagcccgcgataacggcggataaccgcgaagcggttattctccctacgacgcccgggaagccggccaggcattcttga

SEQ ID NO: 4001 - DNA, 888 bp, Pseudomonas aeruginosa
acaaggaacaaggacatatccatgcgaaccctcaccaccctcctcggcaacagccagaaactcgacggcggcgccatgttcggcaatgccccgcgcgcgctctggtcacgctggatgcagcccgatgcggagaaccgcatcgacctcggctgccgtgccctgctggtgcgcgacggcgagcgcaacgtactggtggagaccggcatcggcgcgttcttcccgcccgccctgcgccagcgctacggcgtccaggaagagcgccacgtactgctcgacagcctcgccgcggtcggcctggacgacgccgacatcgacgtggtgctgctcacccacctgcacttcgaccacgccggcggcctgctcgccgcctgggaagaaggccagccggcgcgcctgctgttccccaacgcgcatttcgtcagcggccgccgccactggcagcgcgcgcgccagccgcacccgcgcgaccgagcctcgttcgtgccggaactgctcgacctgctgcaggccagcggacgcctggagctgctcgacgacggcgagcgctcggcgcatctgggcgagggctggcgtttccatttcagcgaaggccataccccgggccagatgctcccggagatcgccatgcccgacggcccggtggtattcagcggcgacctgatccccggcgcaccctgggtacacctaccgctgaccatgggctacgaccgcttcccggaaggcctgatcgaggaaaaggaacgcctgctggacagcctcatcgcccgcaacggccgactggtcttcacccatgatccgtgcgtcgccatgggccgggtgcgacgcgacgaacaggagcgctacagcctctacgacaccctcgagcgggtcgagaacctcgaggcctga

SEQ ID NO: 4002 - DNA, 1326 bp, Pseudomonas aeruginosa
gcgaaaggcgcggcccgccccggtggcgggccgcgggaatcaggaacgcgccttgcgcgcgcccttgcagcgctcgattccgagccggcagatccgctcgcagagttcggcgaaaccgatcccggccgccgccgcggcctgcggcagcaggctggtggcggtcatgcccggcagggtattgacctccaggcaccagagccggccctgttcgtcgaggcggaagtcggtgcggctgtagccgctcagcttcagcgcccggtgtaccttcagcgccagacgctgggcctcggcggcgatcgccggcggcaggtcggcgggaaacacctcgcgcaccgcgccggcctggtacttgtgctcgtagtcgaagacctcctggccgccgaggagaatctcgcccaccggcagcgcctggtcgtcgagcaccccgacggtgacctcgcggccggcgacgaagcgctccagcatcacctcgtcgccatagcgcccggccagctcgatggccggctgcaattcggcctgggaatgcacgatggacagccccacggtggagccctggctgttcggcttgaccaccagggggaagcccagttgctcgcgcaccgcctcttccgaggccggcgccatcagccaactggcggtctccaccccggcggcgaggaacaggcgcttggccacgtccttgtccatcgccatggcgctggccaggtggccgctgccggtataggcgaaaccaccggcatccagcagcgcctgcagggtgccgtcctcgccggtgccgccgtgcagggcgaggaagaacacgtcgaccccagccagttcgccggcgctcagcaggctctgcttgccgctgcggatgatcgccagcgagtcggagtccggcgggacctccttgaccttgctcgccagcaggtggcgctcttcctccgcgccgagcaggccgctggcggtatccaccgccagcacctggtggccggcgctgcgcaacgcctggatcacctgcgcgccgctggcgatggagacgtcccgttcctcactgctgccgccgaagagaacggcgaccttcaacttgtcctgtcccatgttccacctgtcgttccagtgctggaggcagaaaagcacaacacaggggtaactgaacagagacagtcatcgtcgcgcgcagcgaacggcctccctcagccgcgcagttcctcgaccagcgtgcgcagcagttcggcggccggcagctcccgcgccagcgccgcgccctggccggcccactgggcggcgaaatcatggttgccgcgagccagagcggcggtctgcaacgctttggtcgcgtcgtag

SEQ ID NO: 4003 - DNA, 435 bp, Pseudomonas aeruginosa
gcggcgttggccgaggactccggacagaggacgaaggcggtgcccatctgcacggcgctcgcgcccagctccagggcggcgcggatgccccgtccgtccatgatcccgccggcagccaccaccggtagcgaaccgcgcgccgccagcaggcggaccagcgccagggtgccgatggcggcgtcgccgcgctccggctcgaacaccccgcgatggccaccggcctcgatgccctgggcgaccaccgcatcggcgccggcggcctccaccagggctgcttcctccggcgtggtggcactgaccagtacgcggatgcccgccgcctgcaacgcgcgaacctggtcgcggggcggcgcgccgaaatggaagctgaccgccgccggccgctcttccagcagcatcggcagcagggtcgggtcttcgaggaagctcaggtag

SEQ ID NO: 4004 - DNA, 567 bp, Pseudomonas aeruginosa
attaaaattggggtttttatattccccgctgcggtcataccgccccgtttccccaggaccacgaaccgcccccacggccgcttcgcggcgccggatggcgaccagcacaaggaacgacccatgcagcgcttcatcgataactcgctcgaaagcaactggctctggctgaccgcccggatctgcctggccctgatgttcgtcgcctcgggactggcgaagctgttcgactatcaggccagcctggaggaaatgcgcgccgccggcctggagccggcctggctgttcaacatcgccaccgccgtgaccctgctggccggctccgcgctggtcctgctggaccgcaagctatggctcggcgccggggcgctggcggtgttcctgctgctgaccatcctcatcgtccacaccttctggagcaagaccggcgtcgaagccaagctggcgatgttcttcgccctcgaacacatcgcggtgatcggcggcctgatcgccacggccatcgccagcgcgcaacgccagcggctgcgccaggacgtctccgtggccgccacctaccagaaggcctga

SEQ ID NO: 4005 - DNA, 1398 bp, Pseudomonas aeruginosa
ggcgatcatgcagaaacccgtcctgatcgccagtgccgcgctcatctgcgcggcggttatcggcatcgccgtctacgccaccggctcggcgaagaaagacgccggcggtttcgccggctacccgccggtaaaggtcgccctcgcctcggtggagcggcgggtggtgccgcgcgtcttcgatggcgtcggcgagctggaggccggtcgccaggtccaggtggccgccgaagcggcaggacggatcacccgcatcgccttcgaatcgggccagcaggtgcagcaagggcagttgctggtgcaactcaacgacgcggtggaacaggccgagctgatccgtctcaaggcgcagttgcgcaatgccgagatcctccatgcccgtgcgcgcaagctggtagagcgcaacgtcgcctcgcaggaacagctggacaacgccgtcgccgcccgcgacatggcgctcggcgcggtgcgccagacccaggcgctgatcgaccagaaggcgatccgcgcgcccttctccggccagctcggcatccgccgcgtgcacctcggccagtacctcggcgtcgccgagccggtggccagcctggtggatgcgcggaccctgaaaagcaatttctccctggacgaaagcaccagtcccgagctgaagctcggccagcccctcgaggtcctggtcgacgcctatccggggcgcagcttcccggcgcgcatcagcgccatcgacccgctgatcggcaagtcgcgcacggtgcaggtccaggccttgctggacaaccccgaaggcctgctcgccgccggcatgttcgccagcatccgggtctcgcgcaaagccgacgcgccgtcgctgagcgtgccggaaaccgcggtcacctataccgcctacggcgacaccgtgttcgtcgcccaccaggacggcgaccggccgctcagcgccaagcgcgtctcggtgcggatcggcgagcgctgggacggtcgcgtggaaatcctccagggcctcgccgagggcgaccgggtagtgacttccggacagatcaacctgagcgacgggatggccgtggaaccggtcaaggaagacaccctgagcagcgccgcgccccccgtgccggtcgccggccgctgaaggaaccccgcgatgacctttaccgacctgttcgtccgccggccggtgctggcgctggtggtcagcacgctgatcctgctgctcggcctgttctccctgggcaagctgccgatccgccagtacccgctgctggaaagctcgaccatcaccgtcaccaccgagtaccccggcgcctccgccgatctcatgcaaggcttcgtcacccagccgatcgcccaggcggtgtcgtcggtggagggcatcgactacctttcctcgacctcggtgcaggggcgtag

SEQ ID NO: 4006 - DNA, 4284 bp, Pseudomonas aeruginosa
cgtggtgaccatccgcatgctgctcaaccgcgattcgacccaggcgatgaccgagaccatggccaaggtcaactcggtgcgctacaagctgcccgagcgtgcctacgactcggtgatcgaacgctcttccggcgagaccaccgcggtagcctacgtcggcttttccagcaagaccctgccgatcccggcgttgaccgactacctgtcgcgggtggtcgagccgatgttctcttccatcgacggcgtggccaaggtccagacctttggcggccagcgcctggccatgcgcctctggctcgacgccgaccgcctcgccgggcgcggcctgaccgcctccgacgtggccgaggcgatccgccgcaacaactaccaggcggcgccggggatggtgaaggggcagtacgtgctgtccaacgtgcgggtcaacaccgacctgaccaacgtcgacgacttccgcgagatggtcatccgcaacgatggcaacggcctggtgcgcctgcgcgacgtcggtaccgtcgaactgggcgccgcggccaccgagaccagcgcactgatggacggcgacccggcggtgcacctggggttgttcccgacgcccaccggcaacccgctggtgatcgtcgacggcatccgcaagctgctgccggagatccagaagaccctgccgccggatgtccgcgtcgacctcgcctacgagacttcgcgcttcatccaggcctccatcgacgaggtggtgcggaccctggtggaagcgctgctgatcgtggtgctggtgatctacctctgcctcggctcgctgcgcagcgtgctgatcccggtggcgaccattcccctgtcgatgctcggcgccgccgcgctgatgctggccttcggcttcagcgtcaacctgctgaccctgctggcgatggtgctggccatcgggctggtggtggacgacgccatcgtggtggtggagaacgtccaccgccacatcgaggaaggcaagtcgccggtggcggcggcgctgatcggcgcccgcgaagtggccggcccggtgatcgccatgaccatcaccctggccgccgtgtacacccccatcggcctgatgggcggcctcaccggcgcgctgttccgcgagttcgccctgaccctggcgggcgcggtgatcgtgtccggggtggtggcgctgaccctgtcgccggtgatgagttcgctgctgctccaggcgcaccagaacgaggggcgcatgggccgcgccgccgagtggttcttcggcggcctgacgcggcgctacgggcaggtcctggagttctccctgggccaccgctggctgaccggcggcctggcattgctggtgtgcatcagcctgccgctgctgtattcgatgcccaagcgcgaactggcgccgaccgaggaccaggccgcggtgctcaccgcgatcaaggcgccgcagcacgccaacctcgactatgtcgaactgttcgcgcgcaagctcgaccaggtctacaccagcatcccggaaaccgtgagcacctggatcatcaacggcaccgacggaccggcggcgagcttcggcgggatcaacctggcggcctgggaaaagcgcgagcgcgacgcctcggcgatccagtccgagctgcaaggcaaggtcggcgacgtcgagggcagcagcatcttcgccttccagttggccgccctgcccggctccaccggcggcctgccggtgcagatggtgctgcgcagcccgcaggactatccggtgctctaccggaccatggaagagatcaagcagaaggcccgacagagcgggctgttcgtggtggtcgacagcgacctcgactacaacaacccggtggtccaggtccgcatcgaccgcgccaaggccaacagcctgggcatccgcatgcaggacatcggcgagtcgctggcggtgctggtgggcgagaactacgtcaaccgcttcggcatggagggccgctcctacgacgtgatcccacagagcctgcgcgaccagcgtttcactccgcaagcgctggcacgacagttcgtgcgcacccaggacggcaacctggtgccgctgtcgacggtggtccgggtggcgcttcaggtcgaaccgaacaagctgatccagttcgaccagcagaacgccgcgaccctccaggcgatccccgcgcccggcgtctccatgggccaggcggtggccttcctcgacgacgtggcgcgcggcctgccggccggcttcagccacgactggcaatccgactcgcggcaatacacccaggaaggcaacaccctggtgttcgccttcctcgccgccctggtggtgatctacctggtgctcgccgcgcagtacgagagcctggccgacccgctgatcatcctgatcaccgtgccgctgtcgatctgcggcgcgctgctgccgctggcgctgggctacgcgacgatgaacatctatacgcagatcggcctggtcaccctgatcggcctgatcagcaagcacggcatcctcatggtcgagttcgccaacgaactgcaactccacgagcgcctcgaccgccgcgcggcgatcctgcgcgccgcgcagatccgcctgcggccggtgctgatgaccaccgcggcaatggtcttcggcctggtgccgctgctcttcgccagcggcgccggcgccgccagccgcttcggcctgggcgtggtgatcgtctccgggatgctggtcggcaccctcttcaccctgttcgtgctgcccaccgtctataccctgctggcgcgcaaccacgcggaagtcgacaagagcccgcgcagccggcaactggccgaggccgatctgctggtgaacaaggcatgaagcgctcctacccgaacctttcgcgcctggcgctggccctagcggtcggcaccggcctggccgcctgcagcgtcggccccgactaccagcgtccgcagtcgccgccgccacgcgtcgccagcgagcacctcggcgagttctccggcgagcggcgggaagcgccctggtggagtttcttcgacgatccgcaactggtgcgcctggtcgaccaggcgctggcgcgcaaccacgacatccgcgaggcccgcgccaacctgcgcagcgcccgcgcgctgttcgacgaccgctggctcgaccagttgccgcaggtcaccagccaggccggctacagccgcagcatcgaacaacagctggactacgacggcgagccgcgccggcgcctggcggagagctaccgcgccggcttcgacgcgcagtgggaaatcgacctgttcggccgcctcggccgactttccgacgccgccctggcccgcgccgaagcggccgacgccgacctccggctggtacgcctgagcatcgccgccgacaccgcccgcgcctacttcgagatccagggctaccagcgccggctggacgtggcgcgcgcccaggtgcgcagttggcgcgacaccctggagctgacccgcagcagcctgcaactgggcagcggcctgccggaggacgtggagaacgcccaggccaacctgctgcgcagcgaagcggcgattccgccactggcgaccgcgctggagagcgcccgctaccgcctcgacgtgctgcgcggcgaggcgccgggcagcggcgcgccgatcctcgacggtggcggcgccgcgccattggcgaagaacctgccgctgggcgacgtcgaccgcctgatcctccagcgccccgacgtagtcagcgccgagcggcaactggcagcgagcactgaagacgtcggcgcggccaccgccgaactctatccgcgcctcgacctgggcggcttcatcggtttcttcgccctgcgcagcggcgacctcggcagcgcctcgcgcgccttcgaactggcgcccagcgtcagttggccggcgttccgcctgggcaacgtgcgggcccgcctgcgcgccgtcgaggcgcagtccgacgccgcgctggcgcgctaccagcgctccctgctgctggcccaggaggacgtcggcaacgcgctcaaccaactggccgaacaccagcgtcggctggtcgccctgttccagtccgcgacccatggcgcgaacgccctggagatcgccaacgaacgctaccgcgccggcgccggcagctacctggcggtgctggagaaccagcgcgcgctgtaccagatccgcgaggaactggcgcaggcggagaccgcctcgttcgtcaacgtcatcgcgctctacaaggcgctcggctggggcagcggcgacctggcgccgggcgccggccaactggccgccggcgaaaccgccggggccaaccgttga

SEQ ID NO: 4007 - DNA, 1359 bp, Pseudomonas aeruginosa
agacggcaagatcaagcgcaaccgcgaattcatgaacgtcttccaacaattgcgcgccttgagcattccggtcccggaaataaaacgcgaaggcattcccacttgatcgaaacgatatctcctgccgaagggggacccaccatggacgatctattgcaacgcgtacggcgctgcgaagcgctgcagcaacccgaatggggcgatccgtcgcgcctgcgcgacgtgcaggcgtacctgcgcggcagtccggcgctgatccgcgccggcgacatcctggccctgcgcgcgaccctggcgcgggtcgcccgcggcgaggcgctggtggtgcagtgcggcgactgcgccgaggacatggacgaccaccatgccgagaacgtggcgcgcaaggccgccgtgctggaactgctggccggcgccctgcgcctggccggccggcggccggtgatccgcgtcgggcgcatcgccgggcagtacgccaagccgcgttccaagccgcacgagcaggtcggcgagcagaccctgccggtctatcgcggcgacatggtcaacggccgcgaggcccatgccgaacagcgccgggccgatccgcagcggatcctcaagggctatgcggcggcgcgcaacatcatgcgccacctgggctgggacgccgcgtccgggcaggaggcgaatgcctcgccggtctggaccagccacgagatgctgctgctcgactacgagctgtcgatgctgcgcgaggacgagcagcgccgggtctatctcggttcgacccactggccgtggatcggcgagcgcacccgccaggtcgacggcgcccatgtggcgctgctggccgaggtgctcaacccggtggcctgcaaggtcggcccggagatcggccgcgaccagttgctggcgctctgcgagcgcctcgacccgcgccgcgagccggggcgcctgacgctgatcgcgcggatgggcgcgcagaaggtcggcgagcgcctgccgccgctggtggaagcggtgcgcgcggccggccacccggtgatttggctgagcgacccgatgcacggcaacaccatcgtcgcgccctgcggcaacaagacccgcctggtgcgcagcatcgccgaggaggtggcggcgttccgcctggcggtgtccggctccggcggcgtggccgccgggctgcacctggagaccaccccggacgacgtcaccgagtgcgtcgccgattccagcggcctgcaccaggtcagccggcactacaccagcctctgcgatccgcggctgaacccctggcaggcactcagcgcggtgatggcctggtccggcgcagaagcgatcccgagcgcaaccttccccctggagaccgtggcatga

SEQ ID NO: 4008 - DNA, 1731 bp, Pseudomonas aeruginosa
cctgctggcgctgattccctaccggcagatcgccgagcgcggcttcgaggcgctcgacgacggcacgccgctgctggcgctgaaggtcctggagcaggagctgctgccgctggagcaggccctggcgctgctgccgaaccaggcgctggaactgagcgaggaaggtttcgacctcgacgacgaggcctacgccgaagtggtcgggcgggtcatcgccgacgagatcggtcgcggcgaaggcgccaacttcgtgatcaagcggcgcttccaggcgcgcatcgacggctacgccacggccagcgcgctgagcttcttccgccagttgctgctgcgcgagaagggcgcctactggaccttcatcgtccacaccggcgaacgcaccctggtcggcgcctcgcccgagcgacacatcagcgtgcgcgacggcctggcggtgatgaacccgatcagcggcacctaccgctacccgccggccgggccgaacctggccgaggtcatggaattcctcgacaaccgcaaggaagccgacgagctgtacatggtggtggacgaggagctgaagatgatggcgcggatctgcgaggacggcggccgggtgctcggtccctacctcaaggagatggcgcacctggcgcacaccgagtacttcatcgagggccagaccagccgcgacgtgcgcgaggtgctgcgcgagacgctgttcgccccgaccgtcaccggcagcccgctggaaagcgcctgccgggtgatccgccgctacgagccgcagggtcgcggctactacagcggggtggcggcgctgatcggcggcgatggccagggcgggcgcacgctggactcggcgatcctgatccgcaccgccgagatcgagggcgacggccgcctgcgcatcggcgtcggctcgaccatcgtgcgtcactccgatcccctgggcgaggcggcggaaagccgggccaaggcttccgggctgatcgccgcgctgaagagccaggcgccgcagcgcctgggctcgcacccgcacgtggtggcggcgctggccagccgcaacgcgccgatcgccgacttctggctgcgcggcgccagcgagcgccagcagttgcaggccgacctgtccggacgcgaggtgctgatcgtcgatgccgaggacaccttcacctcgatgatcgccaagcagctcaagtcgctgggcctgacggtgaccgtgcgcggcttccaggagccgtactcgttcgacggctacgacctggtgatcatgggccccggcccgggcaaccccaccgagatcggccagccgaagatcggccacctgcacctggccatccgttcgctgctcagcgagcgccggccgttcctcgccgtgtgcctgagccaccaggtgctgagcctgtgcctgggcctggacctgcaacgccggcaggagcccaaccagggcgtgcagaaacagatcgacctgttcggcgccgccgagcgcgtcggcttctacaacaccttcgccgcgcgcgccctgcaggaccgcatcgagattcccgaggtcggcccgatcgagatcagccgcgaccgcgagaccggcgaggtccatgccctgcgcgggccgcgcttcgcctccatgcaattccaccccgaatcggtgctgacccgcgagggtccgcgcatcatcgccgacctgctgcgccacgcgctggtcgagcggcggccctgagccaggagagcccatgcacagatatgtcgtga

SEQ ID NO: 4009 - DNA, 294 bp, Pseudomonas aeruginosa
acctgtcggagagcaccttcgtactccgcccgcaacaggacggcgacgcgcgcatccgcatcttcaccccggtcaacgaactgccgttcgccggccacccgctgctgggcaccgccatcgccctgggcgccgagaccgacaaggacaggctgttcctggagaccaggatgggcaccgtgcccttcgccctggagcgccaggacggcaaggtggtggcctgcagcatgcagcagccgatccccacctgggagcacttcagccgcccggccgagctgctcgccgccctcggcctga

SEQ ID NO: 4010 - DNA, 285 bp, Pseudomonas aeruginosa
aactgcttcgccggcgccgggcggcactggcgcagccgcatgttctcgccggcctacggcgtggtcgaggacgccgccaccggttccgccgccgggccgctggcgatccacctggcgcgccaccggcagattccctacgggcagcagatcgagatcctccagggcgtcgagatcggccggccgtcgcgcatgtacgcccgcgccgagggcgccggcgagcgggtctcgacggtggaagtgtcgggcaacggcgcggccttcgccgaaggccgggcctacctgtga

SEQ ID NO: 4011 - DNA, 444 bp, Pseudomonas aeruginosa
ccagaagggccgcgaactggcacagaacccctgggcctcgggggtgctgtactggcgcgagagcagccagcagatcatcctcaacggccgcgccgaacgcctgcccgacgagcgcgccgacgcccagtggctgagccgcccgtaccagacccacccgatgtcgatcgcctcgcggcagagcgaaaccctcgccgacatccacgccctgcgcgccgaagcccggcgcctggcggaaaccgacggcccgctgccgcgcccgccgggctactgcctgttcgaactgtgcctggagtcggtggagttctggggcaacggcaccgagcggctgcacgagcgcctgcgctacgaccgcgacgaaggaggctggaagcaccgctacctgcaaccgtgacgacaccgctgcgccggcgtttcacggcggatatgcgtcccgcggccccgtag

SEQ ID NO: 4012 - DNA, 1269 bp, Pseudomonas aeruginosa
acggtcatccgtcccagccgaacccccatcgattcgaacactcgagaaaaggaagcacccatgagcgaacccatcgatatcctcatcgccggcgccggcatcggcggcctcagttgcgccctggccctgcaccaggccggcatcggcaaggtcacgctgctggaaagcagcagcgagatacgcccccttggcgtcggcatcaatatccagccggcagcggtcgaggccctcgccgaactgggcctcggcccggcgctggcggccaccgccatccccacccatgagctgcgctacatcgaccagagcggcgccacggtatggtccgagccgcgcggggtggaagccggcaacgcctatccgcagtactcgatccatcgcggcgaactgcagatgatcctgctcgccgcggtgcgcgagcgtctcggccaacaggcggtacgcaccggtctcggcgtggagcgcatcgaagagcgcgacggccgcgtactgatcggcgcccgcgacggacacggcaagcccctggcgctcggtgccgatgtgctggtcggcgccgacggcatccactcggcggtccgcgcgcacctgcatcccgaccaggggccgctgtcccacggtgggatcaccatgtggcgcggcgtcaccgagttcgaccgcttcctcgacggcaagaccatgatcgtcgccaacgacgagcactggtcgcgcctggtcgcctatccgatctcggcgcgccacgcggccgaaggcaagtcgctggtgaactgggtgtgcatggtgccgagcgccgccgtcggccagctcgacaacgaggccgactggaaccgcaacggacgcctggaagacgtgttgccgttcttcgccgactgggacctgggctggttcgacatccgcgacctgctgacccgcaaccagttgatcctgcagtacccgatggtcgaccgcgatccgctgccgcactggggccggggacgcatcacgctgctcggcgacgccgcccacctgatgtatccgatgggcgccaacggcgcttcgcaggcgatcctcgacggcatcgagctggccgccgcgctggcgcgcaacgccgacgtggccgcagccctgcgcgaatacgaagaagcgcggcggccgaccgccaacaagatcatcctggccaaccgcgaacgggaaaaagaggaatgggccgcggcttcgcgaccgaagaccgagaagagcgcggcgctggaagcgatcaccggcagctaccgcaaccaggtggaacggccacgctag

SEQ ID NO: 4013 - DNA, 1077 bp, Pseudomonas aeruginosa
ccgatctgcgcggtgaggctgaccaggaacgaagacgccagcatctcgccgaggtctcgggtgctctgcaccgcggtgacatcggtgccggcctggccgccctggccggcgaagcgcatcgccgcggtgaggatcgccaccgaggtgatgccggtagccagcgagccgatcagcacgcaggtccacgccaatccttcactcagtgccaaccagcgaccggcctgcagataccagagcagcgccgaacaaccggcgagcaccacgccaagggcgaaaccgcgccacaggccgatccgcctgaccagccaggcgccgccgccgcagccgaggaataccgtgaccaggccaccgctcatgcccagccggccgatgtcctgcaaggcccagccggcatcgctgaggtacagcttggacaggccgaagccggataccgcggtcatcgccgacagcagtgccagcgccagcagcgaaggcgccagcggccgacgcaggaagcgcagcaggctggccttggcggccggtgccggggggagttcgtggggggcgccgcgccccagggcgagcacgcagcacaggcttgccagcggcacgcaggccacgaccaggaacgccgtgcgctggccgaaatacccggcgaggatcaggctgccggcgccgccgccgaagaagccgatcatcaccccggcgatctgtaccgcgttgaccttggccagcagctcgccgctgaagtgctccgccgccatgccgtcggtggcgatgtcctgggtcgcgctggccagcgaagccagcgccagcaggccgaccgcccaaccggcgctggccacgccgaggccaaacgtcgccaggccgagcaggcaggcgaggacgatgcattgcatcggcaggatccagttacgccgccggccgaaacggcgcgaccaatggttgtcgacccagggcgcccagaggaacttgaccacccagggcagccccaccaggggcaggaaggccagcgcctgcaatggcgcgccatcctggcgcaggagggtgggcagggcgtccatggccaggccgatgggaatgccctgggacaggtag

SEQ ID NO: 4014 - DNA, 951 bp, Pseudomonas aeruginosa
ctccgagggcacgagttgcagccccagcaggagcaacgcggccgccgccaccaggccggcacagaaaccctggctcaggcgctgcaagagccgtacgcgggcgtccggcgccgaggcgcgtcgttgcagccacaggtacaggccgctggcgcagagcaggcaggcgccgaggcccatcgccaggtgcaggccgcgcaacgcggcggaccagcccggcccgagccactggtactgggcgaaatgcaacggctgcacggcgatgaaggcgcgcagccagaacccgcgctgcgccgagctgcgctcgccgagcagggcgccgtcggccagccgatagcggtgccgctcgaagttcgcggtactcggcaggccacgctggataccggcgatctccacgctgccggcgacatccccggcatggctgaggctcaagcgctgggcgacgaagccgggcgcccgcacggcatcgccggcaagcaggcggtcgagatcgatgcgggacgccaatggccgcccctcggcggcgggcggcggcggtcccatcaactcgacgaacacccggttcggttcctgcgggtaggccaccggcgccagcagcagggtcccgagcgcgcccagcccgctgagcgcgccggtgaaaccgaacaacagcagccagggcagtccccagatgccgatcaggccgtgcaggtcgaacagcgccaggcgcagcccgcggtcccgccgccaacgccgcaggtcgcgccagcggcggctgtgcagcaccacgccggccaggcacagcagcaacagcgatacgccgaacaggctgaccaccacccgcccggggaagccgacgaacaggctcttgtgcaggttcagcaggaggtccatcgccggcgtcggtggcaacaccccggccgctggccgggtcgaggtccagccggcagtccaggcgcgcatcgcagacgctga

SEQ ID NO: 4015 - DNA, 2223 bp, Pseudomonas aeruginosa
  unsure (2110): Identity of nucleotide at the above locations are unknown.
gcggtggtcagcagctggaacggctgcacggtgaccccggtggcctgctgcatggcttcgtcgaggctgaacagattctgctgttcgaggcgctcatggtcgatgacgctggcggactgcggcagctcgcgcggcttgagcggcaccttgcccagggtagtcacccccggcggctgggtggcagacgtgctttctccgctgatcaccatgtccggcagttccgtctcgccgtccttgcgcgcgtcggccacggccgcggccagcggactcagcgccagcagcagccccaggcacaacggggtgtgccgattgcgggcgatgccctggcgtcccttgatcaccttcgtctccgttttcatcgttcgaacagcctcgggggatatacgatttgataatgcttatcattatgaagaaatcgtctccggggctttttcgattgccggtctttctctatcgatccacgaccgtcgcggaactttcctcgcccgccagcccgacgaaaccggcataccagtcgtcccggacgagcagatcggcgtgacgtccgctgaggcgcaggcgcccctcctccagcagcagttcctggtcggcctgacgcgccagcgccgggcggtgggtcactaccatcagggtgcgccggccgcgcaacccgagcaggttgcgcagcacctgcgcctcgctggcggcgtcgaggctggcggtgggcttgtcgagcagcagcaacggcgccgtcgagagcagcccgcgagccaggcacaggcgttgccgctggccgccggacagcagcgcgccgccgggaccgacgtcgctgtcccagccctgcggccaggcctcgatctcttccagcaggccaaccgcccgcgccgcctagcgcagcgcttcgagatcggcgtccgctcgcgccatgcgcaggttccaggcaacgctgccgcggaacaggccgttgtcctggaacaccaggttacgattggcggcgagggtcgtttcgctcaaccggcggatatccacgccacccagcaggacacgcccggcatcgacgtcgtagagccgcccgagcagcgccagcaggctgctcttgccggccccggagggtccgacgaggacgttcagcgaacccggctccagcctcagggaaatgtcctcgagcaaggcgcggccattttccagacgcaattccacggcctcggccgccaggctggcgtcgtgcggccgctcgcccgggctcgggactgcgcagcggagccagggcgaaaaccggcagcagggtatccagcgcctggccaggcgccgggccaacgcctggtcgagatgggtgagctgggccagcggctcgatgaagcgcaccagcagcaccagcacggccaccagtcgcgcgccgtccagccattgccgatccaccgcccaggcgccgccgagcagggcgaaggcgaacgccgcctgcaccgccagggtgaagccgaggccgctgggcaggctgcgccgcaacagatccagggtgctgcggtggagactgcgcaaggcctcttccagcccctggcgggcgacgctttcgcgctgcgccgcgcgcagcagtggctggcgttcggcgaacgcctgcaactgccgtgcggcgtcgcgctcggcggccagccgggcatcctccgccgccagattgcgccgcccgctccagcgcaacagcgcggcgaggaaggcaccagcaaggagcaggccgagggcgatggacgggtcgatcaggaacagcccgaggatcaccccgagcggcgtcaccaacgcggcgatcagcggccccagcaggtgcgccggaatgcccatcgcctgcatcaccgggccgcgcagcaggccttcggccggcgcgacccggcgcaacgccggcggcgccaggcgcggcaagcgcgccaccaggctgcgcaccagtccagccgccagcgagccgccggcggcgaaaccgcgacgcatggccaggtactgcaacagcgcctgcgccaggctcaaaccgagcaacgcggcgacccagcgccagggcaacgcgccttcggcgaaccaggcctcgaccaacggcaccagcaatacgccgcaagcggcgtccagcagcgccgccaggaccgcccangcgctcgcccggcgcaacgcggcacggcagtcttcgggcagcgcacgcattcgttcgaacagggtcatgccgccacctccgcgccgttctgttcacgccacaagcgcgcatag

SEQ ID NO: 4016 - DNA, 2091 bp, Pseudomonas aeruginosa
  unsure (1547),(1647),(1685),(1796): Identity of nucleotide at the above locations are unknown.
cagcgcacgggccagggccagtcgttgcagttcgccgccggacagttgcaggtcgcgtcccggcacgctgtcgtagccacgcggcagggccatgatgcgctcgtcgaggcaggcgtcacgggccgcctggcgaatctcctggagatcggcatcggggcggaacagggcaatgttgtcggccagggatatctccagcgccgccgcctgctggccgaccagcgcgatatgccgatggcgcacggcatcgggcatgtccttcagtgccaggccgccaacctccagttcgccgcgctgcgcgtccatgtagcgcgccagcaggtgcagcagggtgctcttgccggagcccgagggaccgaccagggccaccaggctgccatcctccagctccagatcgatatcggccaggacctccacgccttcataggcatggcccaggccgtgcagcgccaccgcgccatcgaccggctcgcgggtcgagcggccctcggccagcggcgcctggtcgaacacctgctgcaggcgctcggcggcggcgcgcgcgcccagcagcgagtcgccgccgtggccgagcgcctgtaccggggcggccagggcccgcaacaggagcaggaaggcgcaggcctggccgagcgccagcggcacgccgagggcatccagggccagcgcgccgagcaggacccaggccagcagccagggcgtcgacaactgcacgtagaccagcgcggcgaggtggccgacccgcttcacccaggcgccgaacgcttcgccgaaggccgccgccgacgcctcggcgccctgttgtatgccggcgccggggtactgtcgggccagcagcaggttgtgggcgaattcgccatagtccgccgagagcctttccagcgcggcgttgcgccgcagcaccaggtcgcgatagcgcgccgagcgcagcagcaggaagccggcggcggccagcaccagcggcagcaggcagaacagcagcagccaggggtgcagccaggccagccagagcaacgcgacgagcggcaccaccaacaggttgctgagatcgttgggagcgtgcgcgatcagttggtgcagggcccgcacgtcctgctccacgaggcgcgccacgccgtccgggccctggcgaccgaaccagtccagcggcagccgttgcaggtgcgccagcaggcgcaggcgcaggtcgttgcagaggtccgcgtcgacccggtgggccaggtgcgcggccagcgcctggcagcccagccaggccagcaccgccagcagcaccagggccagcagggccggctgcgcctggccgcgcgccagcggctcggcgagccaggcgagaagcatccagggcaacagcgagcagagcccggccagggcctgcaaccccatggccgccgccagccgccagcgataggtgcgcagcaggcgccacagcaccggggtcacgaggcttgctccagcacctgttccaggctcgccggcgccagcgacgccggcggcgcctcggggaagccaaggcgctcgccgatccgctgccacagggcggcgacctccangctgcgctggttgcgccggcgcacctcgtcgccgttggcgagcagcgccagcgcctcggccgccgccgccggccacaggcgctggtgcacctgggcccanctgcacggttcggcataccaaagctgggcgctgggcancggttcgccggctatctcgtcgaacagcgcgaacaggccgtcgtcatcctctgccggtaccgccaccgcaggcgtccacaacaacgggccatgggggctgagcaggctcancgtgccgcgatcggtggtcaggctgacgcgctgcaacaaggtcatgcgcccgtcgtcggcggccgccagttcgttgagcacgtgcaggctcaacggcacttccgccagcaccagggacagcccgcgcatcgccgacaggtcgttcgaggggcgaattccagggaccaggggccgacgccctccagcaacgcggcgaggatgtccagggtggggaaaccgacctgcaccccgcagggccgcgtccaggtggcggatgccgccgcccggcgatgcaactggcggcccagctcgatga

SEQ ID NO: 4017 - DNA, 666 bp, Pseudomonas aeruginosa
  unsure (221): Identity of nucleotide at the above locations are unknown.
gcaggcagcgccggcccaggcgctcggcgctgcgcagcaggtcctgccattcgcgcggcagcaacggatgctcgatcagcacgtcgatgccacgcgccatcagcgcctcggccagcgccgggccctgctcgccgcgtgccgcgccgccgaccgcgacgcaggccaggcggacatcgtccggcaacgcctcgacctcgcaccaggtctccaccccgaggcgntcggccaacgcccgcgaacgccggctgccctggccaaggatgccgcgcaggacgaagcgccgatcggcggcgacgccggcggcatagaactggccgaaccgggaaccggcgaccaccacggaacggacgtcgctcatcggctcgcctcctctggcatgggtttcgacagggattgcgccagggcttcgcccaggcagtcgaagtgcccgccgggcacctcgtggatgccgcacgcgccgagcgcggcggcccgccattgggtctccagggcctcggcgtagcgcggcaccaatgggttgccggcgtccggcacgaacagccgcagcgcgccgacgtagggctccggcgccgcggcctggctggcacgcaccgagtgacagaacagtcggtagagggtgtcgcgttcgacgctgacggcgtcggcgctaccgctggccgcctgtag

SEQ ID NO: 4018 - DNA, 846 bp, Pseudomonas aeruginosa
cacaccacccgggtggacctcgccgacccgatgaaagtgatcctcggcgggcgcctggactggtacaaggccgacgccgataccgacagctacaaggtcacccgcaacgtcacccgctatgccggggtgatctacgacctgaaccagacctactcggtctacgccagctataccgacatcttcaagccgcagagcaacttcgacgccggcggcggcctgctcgacccgatcaccggcaagaactacgagatcggcctgaagggcgaacacttcggcggcgcgctcaattcgcagatcgcgctgttccagatcgaccaggaaaaccgcgccaccgaggacgtcggcggcccctcgccatgccccttcagccccacctcgcgctattgctcgcgcgcttcgggcaaggtccgcagccagggcgtcgacctggagctgagcggtgcgctgagcgacgactggcagatgatggccggctatacctacgtcgacgccaagtacaagcacgacagcaacaaggccaacgagggcaagccattcgacgcggccaagccacgccacctgttcaagctcgccaccagctatacgctacccggcgaactgcacaaatggcgcgtcggcggcgacctggccacccagagcaagaccgaggacagcagcaccggtttccagcagggcggctacaccgtggtcaacgccatgctcggctacaaggtcaacgaacggatcgacacgcggctgaacttcaacaacctgttcgacaagtactattacagcggcatcgacttcggcaacctcaactacggcgagccgcgcaacctgatgttcacggtgaagtactcgctctga

SEQ ID NO: 4019 - DNA, 945 bp, Pseudomonas aeruginosa
caagcgcatctcatgaaacttacgttgtttcgtgactatccgaatgggagatacgccatgactttcgacgtgatcatcgtgggtggcagctacgccggcatctccgcgggcatgcaactggcgcgggcgcggcgcagggtgctggtgatggatacgggactgcgacgcaaccgcttcgcccgggcctcccacggctttctcggccaggacggccgcgatccggcggccatcgccgatgacgcccgcgcgcagttgctggcctatcccagcgtcgagtggctgtccgaagccgccgtcgcggcgaagaaggaggcggacggtttcgtggtgaaggccgccaacggagaacgtttcaccgcgcgccggctgatcctcgccagcggggtcgccgacgagctgccggagatccccggtcttgccgagcgctggggacggcacgtgttccattgcccgtattgccacggctacgaactggacggcgggccgattggcgtactggcggcctcaccgctggccatccaccacgccctgatgttgcccgactggggagcgaccacctttttcctcaacggcgtcttcgaaccggatgccgagcaaatgtccaggctggaccggcgcggcgtgacgatcgatcgcgaagccgtggtctcgctgggcggcgcgcgcgccgacgtgaccctggccagtggccgcacgattacgctcgcggggttgttcacccagccgcgtacgcgcatggccagcccgctggcggcgttgctcggctgcgagttcgaggacggcccgagcgggccgttcatcaggaccgacggcatgcgcgaaaccagcgttcccggcgtcttcgcctgcggcgacgcggcgctggcggccggcaacgtcgccatcgcggtgggcgacggcgcgcgcaccggtggcgcggcgcatcattcgctgctgttccgctga

SEQ ID NO: 4020 - DNA, 699 bp, Pseudomonas aeruginosa
cgccggaggctgacaggccaaggatccggcccaccgcccggcaaatctttcgaactccccggcgctccagctttccactctcctgcatgtcacgccacggcgcccgccacgggcgccccagcagaggagaaaaccatgagcgcgaagctgcaaggcaagaacgtcctggtcatcaccgccaacaccggcatcgagcgcgacgagctgctcgaaccgctgaagaccctgaagcaacagggcgccacggtcacccacgcgaccatcgagggcggcgaagcgcagacctgggtgcacgacagcgagaaggacctgatcgtcaattccgacgccaggctgcaaggcctgcgcgccgaggactacgacttgctgctggtccccggcggcacggtgaatgccgacaccctacgccaggacagcgaggcccggcgcctggtcagggaattcagcgacgcaggcaagacggtcgccgccatctgccacggcccctggctgctgatcgacgcgggtgtcgcccgcggcaagaccctgacctcctattccagcgtgcgtatcgacctgaccaacgccggcgcggactgggtcgacacgcgggtgaaagtctgcccggcgaacggctggaccctgatcacctcgcgcaacccgggtgacttgcaggcgttcaacgaagccatcggcgaagccctgcaggcggccgcctga

SEQ ID NO: 4021 - DNA, 1194 bp, Pseudomonas aeruginosa
tcgtcattcgcggaggcgaccggtggacaccctgaagatcgccaccttcaacgtcaacggcatccagacccggctggccgcgctgctggcctggctggagcgggaagcgccggacatcgtctgcctgcaggaactgaaaacgcccgacgcgcgcttccccgccgcggcgctggagaaggccggatacggcgcgatctggcagggccagtcggcgtggaacggcgtcgccatcctcgcccgcgacagccagccgctggaggtacgccgcggcctgccgggcaacgccagcgatccccacagccgctacctcgaagcggccgtcgacggcctgctggtggccagcctgtacctgcccaatggcaatccccagccgggaccgaagttcgactacaagctggcctggttcgagcacctcatccgacacgccgccgagctgatggagagcggccatccggtggtgctggccggcgacttcaacgtggtgcccagcgacttcgatatctacgacacccgctcctggaaaaaggacgccctgctccagccggagtcccgcgagtgcttcgagcgcctcctgcggcagggctgggtggacgcgctacgccagcgtttccccgaccggcgcctctataccttctgggactacttccgccagcactggcaacgcgacgccgggctgcgcatcgaccacctgctgctcagcgccagcctggcggaccacctggaagacgccggggtggatcgctgggtgcgcggcgaggagcacgccagcgaccacgcgccggcctgggtaagcctgcggcgtccctcagagccccggcgctagccgagctggccccggcactgcgcatcggctctcaccgcccctccggcaacctcgcgaccaccttgatctcgaagctgaagccatacagccagttcacccccaccgccgtcagcgtggggtacggcgcctcgccccagtactccgggacgatcttccagatgcgctcgaagttggcctcggcgtcgacaatgaacacggtgacgtcgagcacatcgtcgaacccgcaaccggccgcggcgagcaccgcgttcagattgtcgaaggcgcggcggacctgggtctccagctcgggttcgggagagccgtcgtcgcggctgccgacctggccggagacgaacagcaggccgtcgctgcggaccgccggggaatag

SEQ ID NO: 4022 - DNA, 1047 bp, Pseudomonas aeruginosa
ctgtttgtagaatccaaacaatccccgacgacccggagtcccgatggaccgtttcgatgcgatgcaggcctttgcccgtgtggtggataccggcagcttcaccaaggcggcggagacgctgcacatgagccgcaccagcgtcacccagttggtccagcaactggaagcgcggctgcgggtacgcctgctcaaccgcaccacgcgcaagctcaacctgaccgccgacggcgccgcctactacgagcgggtggtacgtctgctggcggaactggacgatgccgagaccagcctctccagcgccgccctggcgccccgcgggcgtctccggatcgacgtaccgagcccgctggcgcggctgctgctgatcccggcgttgcccgagttccatgcgcgctatccggagatccagatcgacctgggcgtgagcgatcggctcgtcgacctgatcgacgagaacgtcgactgcgtcatccgcggcggcgaactgcgcgaccagtcgctgatagcgcggcgggtcggcgacctgcaactgggggtctacgcggcaccggcctacttgcagcgcgccggcgtgccgagccacccgcgcgaactggaggacagccaccagcgtatcgtcggcttcctctgggcgcgcaccggcaaggccctgccctacgccatgcgcaggggcgaggaatgcctgcgggtggcgggccgtcatgtgctggcggtggacgacggcaacgcctacctggcggccgggctggccggcctgggcatcctctggctgccgcactacatggcgcgcgagcccctcgcccgcggcgagctgctgccgctgttcgaggactggagcctggagccgatgccgctgtacctggcgttcccgccgaaccgccacgtcagcggcaagctgcgggtgttcatcgagtgggtcgccgaactgatcgcgcggcatgcgccgccgttgcatccgccgctctgaaacaagggcggcggcgtatcctggaaaaccctggagtaatggtaagcggccagggctctatatatgccccgcgattatag

SEQ ID NO: 4023 - DNA, 1395 bp, Pseudomonas aeruginosa
ctcgccgcctttgcgaatccgggaacgccctccgatgagccagaccttccacggcagttgcctgtgcggcgcgctgcactaccgactgtcctcgcccccgcgcgcactctctcactgccactgcggccagtgtcgcaaggcccatggcgcggcattcgccagctatggcagcgtccccgtcgcggacctgcacatcgaccgcggcgccgacctgctcgccgcgttccgctcctcacccgccgtgctccggcgcttctgctcgcgctgcggctcgccgctgttctggtcgaggagcgaaggcgagttcgccgactgggtatcggtcgccctcggcagcctgaacacgcccttcccggcggcgaaacagaagcatgtccaggtcgcatcgatggcctgctggtgcaggatcgccgacgactggccgcgtttcgactgaagtccgcccgcgatccgccggccggtgcctgttttttcgccggcaaggcccgggcctggggtaccatgccgcgcccttcgccgccggtccttgccgcccatgtccgccaccgcgctgtacaccgacctgtcccactattacgacctgatgtgcgccgacatcgactaccaggcgcagagccactgcgtgcgtcgcctgcaccagttgttcggcaaccagggccggcggcacctggacctggcctgcggtaccggccctcacgtgcggcacttcctcgatttcggctatcgcagcgccggcctggacatcaaccagccgatgctcgacctcgcccgacagcgctgtcccgaagcgcacttcagccggcaggacatggccggcttccaggtggacgagccgctggacctgatcacctgtttcctctattcgatccactacaacgcagggctggagcgcttgcgcgcatgcctggccagcgtgcatggcgcactggcggatggcggcgtgttctgtttcaacacggtggacaaggggcagatcgacaatcgcgcgttcgtccgccattccgtggagcatcgaggcagccgcttcaccttcggttccggctggtactacagcggcgagggcgagcgccaggcgctgcgcctcggtatcgagaaaaccacggacggaacaacccagacctgggaggacgaacaccccatggtcgccctcggcttcgccgaactgcagcacctgttgcagacgcatttcgaggtgcaggtcttcgaacacgactacgaacggatcacgccctgggccggcagctccgggaatgccctgttcgtctgcgtgaagcgctagcctccggatatcctggcgcaaacgtgacgatcaggctggcacgggcggggcagcgtttcacagggggctgcggaggattcttcgtcgctttcggcacgctgcgtccgacccgctag

SEQ ID NO: 4024 - DNA, 1374 bp, Pseudomonas aeruginosa
accaaggtcgcaaagaccccgccggccatctgtgacaccttcgcgcgcttttttacccccgctgtcgagagtcaccgcatgtcctccccgttttccccccgttcgccccgcacccttcgcggcctgggcgccctcgccctgtgcggcggattcgtcgccccggcccctgccgccttcctcgaggacggcagcgcgcgcctggaagcgcgcaccgtctacttcaaccgcgacttccgcgacggcagctcggccaacccgcagggcgcctccaagcgcgaggaagccgcgcagggcttcatcctcgacctgcgctcgggctataccgagggcgcgctgggcttcggcgtggataccctggcgatgctcgggatcaagctcgactccagccccgcggacagcaacagcggcctgctgccttccagcggccacgatccgcgtcgctcggtcgaccagtacgccaaggccggcgttgccggcaagatgcgcttctcgcagacacagttcaggtacggggcgatgctgccggacatgccgttgctgaaatacaacgacggacgcctgctgccgaccctgttccacggcgcccagctgaccagcgaggagatcgccgggctcaggttctccgccacccgcctggagcgctacaccgcgcgggactccagcgatgcccaggacatccgcctgcactgcaagaacaaacgctacgcctgcgacaccaccggcaaccgcttcgacgcctaccgactcgactaccaggtcaacgacggcctgctgctgcaatacgcccagggcggcctgcgcaacgtctatcgccagcgctacctcggtgccgtgggcaagcggcagctcggcgccggcaagctgagcgccgacctgcgctggttcgacagcgaggacgccggcgcggcccgcgccggcaagatcgacaaccgcgccctcagcctgctgctcgcctacgcccagggcggccacacgctcagcgccggctggcagcggatgaacggcgccagctcgatgccctacctcgacggcagcaatccgtacctggccaactacctgcaggtgaacgacttcgccaaccccgaggaacgctcctggcaactgcgctacgacttcgacctgcgcagcgtcggcgtgcccggcctgagcttcatgacccgctacgtcaacggcgaccatatccgcctggccaacggcgacgagggcaaggaatgggagcgcgacatcgagctgaagtacgtggtgcagagcggccgcttcaaggacctcagcctgcgcctgcgcaacgccacctaccgcaccgacttcgagcgctcggcgcgcgacgtggacgaggtgcgcctgatcgccagctacaacctgtcgctgttctga

SEQ ID NO: 4025 - DNA, 1824 bp, Pseudomonas aeruginosa
gccgtcgcgccggaacgcacgccggcgcgacgctccggcggttcagaccgccagggcgcgttcgcgcagctcgacgttgaggatgcggtcgttctccgagtaatccaccgggcaatcgatcacatgcaccccgggcgtgcccaggcagcgctccagcaacggcaggaagccctcggcactgtcgacccggtggccgtgggcgccgtaggcctcggcatagcgcacgaagtccgggttgccgtagtccagcccgaagtcggcgaagcccatgttcgattgcttccagcggatcatcccgtagccgttgtcgcgcaggatgatcaccgtcaggttcatcttcagccgcaccgcggtttccagttcctggctgttcatcatgaagccgccatcgccgcacaccgcgacgatcggccggtccgggtagaccaggtgcgcggccatcgccgagggcaggccggcgcccatggtggcgagggcgttgtccagcagcacggtgttgggcatgtgcgccttgtagttgcgggcgaaccagatcttgtacatgccgttgtccagggcgacgatgccctgcgacggcaacgcccggcgcacgtcggccaccaggcgctgcggatagagcgggaagcgcgggtcgtcggcgccttcggcgacctgcgcctcgttggcctcgcggatcgccagcaggcgggtgaagtcccagtgcgcggtatcgtccagcgcctcgccgatctgccagatggcgttggcgatgtcgcccaccacttcgatctgcgggaaatacaccgggtccacctcggcggaacggaagttcacgtggatcacctcggtaccgccgcgaaccatgaagaacggcggcttctcgatcacgtcgtggccgacgttgacgatcaggtcggccgcctccaccgcgcgatgcacgaagtcgccggcggacagcgcggcgttgccgaggaagcgcgggtgacgctcgtcgaccacgcccttgcccatctgggtggtgacgaagggaatgccggtcttgtcgatcagttgcttgaggaccttggcggtcatcttgcggttggccccggcgccgatcaccaggatcgggctgcgcgcggcgcgcagcttctccaccgcggcgcagatcgccttgtattccgccagcggccggcggctcaggctcggcgggatgggcaggctgtcggtctgctcggcggcgatgtcctccggcagctccaggtgcaccgcgccgggcttctcttcctcggccaggcggaacgcctcgcggacccgcgagggaatgttgtcggcggaggccagttggtgggtgtacttggtcagcggctgcatcatgccgaccacgtcgaggatctggaagcggccctgcttggacttcttgatcggcttctgcccggtgatcatcagcatcggcatgccgcccaggtaggcgtaggcgccggcggtgaccaggttggtggcgcccgggccgagggtcgacaggctgaccccggtcttgccggtgaggcgcccataggtggcggccatgaagccggccgattgttcgtggcgggtgagcaccagccggatctgcgacttgcgcagggactccagcaggtcgagattctcctcgccgggaattccgaagacgtactgcacgccctcgttttccaggcattgcacaaccacatcggctgccttggccatctgcgttctacctcgggtggtggcggttctgaccgctcgaacactgcgcccctcgcgtctcgctgtccagcccctcccggccggcggaaggctctggcgccggcttcgccggcaagcgaacgtcgctcccgccattag

SEQ ID NO: 4026 - DNA, 1269 bp, Pseudomonas aeruginosa
acacggatgaacacccgcggctcggcgaaaccggacgagtcgttgacgcgacgccagagaaaaggctgggacatggcgcaggacctccgcaggccagggcgaaaggtccgttctagcatgccggccgcgtccggcgaaacgccctcatttcgtcgagcggacgttgccgtagcgcacttctttcgacggcgggtagccgtagaaggcggtgtagcacttgctgaagtggctgggcgagacgaagccgcaggcgaccaggacctccagcatggtcaggtcggaatgttgcagcaggcgccggcactcggtgatccgcaactccaggtagtagcgcaccggcgtggttccgagctgctgctggaacaatcgctcgatctgccgccgcgagcgccccacgtagtgggcgagctgctcctggctgagcggttcctcgatattcgccgccatcaggttgatcacttcgcgcagcggctcgctcatcttctcgtgcagggcggggcgcacccgccggtagcgcgactcctcgaaggcgaggatatccaccaccgcctccaccaggtcgcgcccgtggcgccgggcgatccactccagcgccaggttgaaggcgccggtggggctggccgcggtcaggcggtcgcggtcgaccatatagctgtcgctggtcacctggctgttgcgggcgatctcggcgagggcggcgcggtgctcgggatggatgcagcagcggtagccatccagcaggccggcgtcgccgaggaaccaggcaccgttccacagcccggccagggcgacgccgcgcgacgccacgtcctgcaacgcttcccgcagcgcggcggacgagcgcaggggcgtgcgcaaaccgccgcagaccaccagcaggtcgagtccttgcagcgccgccgaggcgagcgccaggtccgggcagatcagcaacccgaggtcgctggtcaccggctcgccgctcaggctgaagttgctcaccgcgaaggactcgctgcggatcaggttggcggtcaccagggtgtccagcgcctgggtgaaggccggcagggaaaagtgttcgagcagcaggaagcccacccgcgcccgtgccgagcccccctccccggccccggtgaacctgaggttctgcccttgcagggcggcgctgaaacgccttctttccatcgattcgtgcctcttgttcttcttgttcccggccagcgggccgcgacgcctgccgtcacggcgaaaaccccgggcgctccatcatatgcgcaagccatgtga

SEQ ID NO: 4027 - DNA, 759 bp, Pseudomonas aeruginosa
acaaagcccatgacaagtagaaaggcctccatgaaagcccaacccgacgtcgactcgaacagcgccgatgcccccttcgaccgcaaggcggtgctgggcgatgcgctgcgccggcggatcctgagcatggaactggcgcccggcgcggtcgtcgacgaactcgccctgtgcgacgagttcggcctctcgcgcccgccggtgcgcgaactgctgcggcagatcgccgccgagggctacatcgaactggaagccaaccgtgcgccgcgcgtcgcggccatgagccacgactcgctgcacgccttctttctcgccgcgccgctgatctacatcgccaccacgcaactggcggccacccatgccagcgaagcggagatcgagacgctcaaggcgatccaggaagatttccgcaaggccatcgaagagaagcatgtggaaaaccgcgtcatccacaacgacgccttccacctggagatcggcaggatggcccacaacgactacctcatgccgagcctgcgccgcttgctgatcgaccatgcgcggctgggcaagatcttctaccgccatccgaccaccgacgacatgcaacgcgacctggaactcgcctgcgaccagcacgaccagatcgtcgatgccatcaagcggcgcgatccggatgcggcggcggacatcgtccgtgcgcatttcgagctgtcgcgccggcgcatggccgagtacgcggcaccggccggagtggaggtggcgctggtctacgagggttag

SEQ ID NO: 4028 - DNA, 1005 bp, Pseudomonas aeruginosa
acctgcagcaggcggcttcgctcacctgaaccacccgccgcggcagcgtccgccgggtgcgccgcggcccagcatcccacaggaggaacccccgtgaaattcgaaggtatctatacccccgccatcaccccgctgagcgccgacggcagcatcgacacccaggccttcaccgaggtcctggagtttctcgtcgagtcgaaggtgcacggcatcgtgatcggcggctccaccggcgagtactacgcgcacaccgccgaggaacgcctggccctcgccgcccacgccagcgaagtcatcgccgggcgcctgccgctggtggtgggaaccggcgcgatccgcaccgaggactcgctggcctacgccgaagccgcccgcgccatcggcgccgacgccatcctggtcggctcgccgccctacgcgctgccgacctcgcgggagatcgccgagcacgtgctggcggtggatcgcgccgccggcctgccgatcatgctctacaactatccggcgcggatgggcgtggagatggacgaggcgttcttcgccgccgtcgccggctgccgcaacatcgtcgcgatcaaggaaagctccggctccaccgcgcaattgcaccgcctggcctgccgccacccgcggatcgccttgtcctgcggctgggacgaccaggccctggagttcttcgcctggggcgcgcgcagttgggtctgcgccggctccaacttcatccctggcgaacacctcgccctgtaccaggcctgcgtggtcgagaacgacttcgccaagggccggcgcatcatggcggcgatgatgccgctgatggactttctcgaaagcggtcacttcgtccagtcgatcaagcacggctgcgaactggccggcctgcgcgccggcggcgtacgtgcgccgctgaaggcgctggacgaggccggcaaggcggcactggcggagatcgtcgccaggctcaagggcgaggtcgcgcggatcgtcgagggtggccgccatgactga

SEQ ID NO: 4029 - DNA, 1011 bp, Pseudomonas aeruginosa
gctgctgagccgggaggaatacgcggccatcgccgcgacgctggaccttccccagcgcgccttcatcgacggagggttccgcgatgcctgcggcggccgcaccttcgcctcgaccaacccggccaccggcgagctgctggcgcaggtcgccgcctgcgacgcggaggacgtcgggcacgccgtggccagcgcgcggcgggcgttcgaggacggccgctggcgctcgcgcacgcccgccgagcgcaaggcggcgctgctgcgcctggccgagctgctggaagagcacctgctggaactggcggtgatggagagcctcgacagcggcaagccgatccgcgaatgccagcacaccgacctgccggaaaccatcaataccctgcgctggcatgccgaactgatcgacaagatctacgacagcaccgccccggtcggttcggcggcgctggccatggtggtacgcgagccgatcggcgtggtcggcctggtgctgccgtggaacttcccgctgctgatgctcgcctggaagatcggcccggcgctggcggcaggctgctccgtagtggtcaagccggcccccgagaccagcctgaccgccctgcgcgtcgccgaactggccagccaggcggggatccccgccggggtgttcaacgtggtccccggcggcggccgcgaggccggcgaaccgctgggccgccacccggacgtggcgatggtcagcttcaccggctccaccgcgaccggccgcctgttcctcaagtacgccgccgagtccaacctcaagcgggtggtactggagtgcggcggcaagaacccggcggtggtgatgaacgatgtcgaggacctcgacctggtggcgcaacacgtggtcaacggcgcgttctggaacatgggcgagaactgctcggcgtcctcgcggctgatcgtccatgccgaagtccgcgaggcgctgctcgaacgcatcggcgcgcagctccgcgagtggcgcatgggcgacccgctggatccgtgtaa

SEQ ID NO: 4030 - DNA, 1881 bp, Pseudomonas aeruginosa
tcgcctcggcgcgctggtcagcccggcgcacttcgagaaggtccgcgcgtacctcgaccaggccaggacggagcggttggcggtgcgcttcggcggcgccaccgaggctggcatcttcgtcgagccgaccgtggtcgatggcgtctcgccgcacagccggctgttccgcgaggaaatcttcggcccgctgctctcggtcacctctttcgacgacatcgacgaagccatcgccctggccaacgacaccgtctacggcctcgccgcctcggcctacaccggcagcctgcgccacgcactgcgcctgtcgcgggagatccgcgcggggatcgtcaccgtcaactgcttcggcgagggcgacgcctcgacgcccttcggcggctacaaggagtcaggcttcggcggtcgcgacaagtcggtctgggcacacgaccagtacacagagttgaagaccatctggatcgacgcttcctgaagctgtccggcccgcaagggccggcactcccgcctggcggcgagaccggacaaccgggccggacaggcgaccaagtgcagacaacacccattctgcataacgttccgtcgctatgctgctgcctccacccttcccttttccgccaggaacgacacggagactcatccatgacggacaaccatatcgatgtactgatcaacggctgcggcatcggtggggcgatgctcgcctacctgctcggccgccagggccaccgcgtggtggtagtggagcaggcacggcgcgaacgcgcgatcaacggcgccgacctgctcaagccggccggcatccgggtggtcgaggcggccgggttgttggccgaggtgacccgtcgcggtgggcgggtccgccatgagctggaggtctatcacgacggcgagctgcttcgctatttcaactattccagcgtagacgcgcgcggatatttcatcctcatgccctgcgagtcgctgcgccgcctggtactggaaaaaatcgacggcgaagcgaccgtcgagatgctgttcgagacccgcatcgaagcggtgcagcgcgacgagcgccacgcgatcgaccaggtgcgcctgaacgacggccgcgtgctgcgtccgcgggtggtggtgggagccgacggtatcgcctcctacgtgcgccgccggctgctcgatatcgatgtggaacgccgcccctacccgtcgccgatgctggtcggcaccttcgccctggcgccctgcgtggccgagcgcaaccgcctgtacgtggactcgcagggcgggctggcctacttctatccgatcggtttcgaccgcgcgcgactggtggtgagcttccccagggaggaggcgcgcgagctgatggccgacacccgcggcgagtcgctgcgccggcgcttgcaacgcttcgtcggcgacgagagcgccgaggcgatcgccgccgtcaccggcacttcgcgcttcaagggcatccccatcggctacctgaacctggaccgctactgggcggacaacgtggcgatgctcggcgacgccatccacaacgtgcatccgatcaccggccagggcatgaacctggccatcgaggacgccagcgccctggccgacgccctcgacctggccttgcgcgacgcctgcgcgctgggggatgccctggccggctaccaggccgagcgcttcccggtgaaccaggcgatcgtctcctatggccatgcgctggccaccagcctggaggatcgccagcgcttcgccggggtcttcgacaccgccctgcagggcagcagccgtacgccggaagcccctgggcggcgagcgctcctaccagccggtgcggtcgccggcgccgctcggctgaacccgccagcgcggccggagcgtagcgtccggccgcgcgcctag

SEQ ID NO: 4031 - DNA, 741 bp, Pseudomonas aeruginosa
ccttttccagccggatcatcgggcctccttgggattgccgcgctgcgcctggcggcgttcgagccagaaggcgaaacgcgacagtccgaagcacaggatgaaataggtgaggccgaggatcaggtagacctgggtcggcagggtgaacacctgggtattgatctgcgaggcgatgaagctgacttcggccaggccgatgatgtagcccagggaggtctccttgatcgtcgagacgaattggttgaccaacgacggcagcatgttgcgcagcgcctgcgggaggatcaccaggcgcatgctcgccaggtagcccaggccgagcgaacgcgccgcctcgaactggccacggtcgaggccctggatgccggcgcggacgatctcggccaggtacaccgcgtcgaacagcacaagcgccagcagcatggtggtgaactggtcggtgcgctggccggtgagggtcggcaggaagaaataggcccagaagatcaccatcagcaacggcaccccgcgcaccacgaagaccagcgcggtgatcggccagcgcagccagcgccaggggctgacccgcgccaggccgagcaggatgcccagtggcagcgccagcagcagcgccagcgaggccaggaccagggtcagggccagcccgcccaacggcccgttggggtactggccgacgaggaagtacagccagtagctatcgatcagttccagggtggtcatcgccgttcgactcccggatag

SEQ ID NO: 4032 - DNA, 441 bp, Pseudomonas aeruginosa
cgccacgggcggcggcgagcaacggtgcgaggagcaggccgagccagtccagcgcagcgctctgcggcgtatcgctggccaccagcagcaggccttcgtcgccggcctgcaggtcgagggcgaaggccatgccatgctccacgccggcacgccgcaagcgcgcgccgagccaggaggcggaacgccgcaattcgtccagagccagccggccgtcgcgcaccagccgctcgcgcaacgccaggtcgctggcccggttcggctcgccggcgcccggcggcagcgccggcgacggcggcaccggggtataggtctgcgcctgcggctgccaggccaggtaccaggcctggcgcgtgcccggatgttcgagcagcaagcggcgcagcgcaccgacccgctcgaccagcggcgcgccctcgcgcagcaggcgcaggaggctgttga

SEQ ID NO: 4033 - DNA, 1668 bp, Pseudomonas aeruginosa
  unsure (606): Identity of nucleotide at the above locations are unknown.
cccttacccagaacagagctaacaatcagccacggggtactcttcatgtcgatcttcgaacagggtctcgcgcccgccgccgtcaaccacatcgccctgacgccgctgagcttcatcgagcgcaccgccagcgtctatccgcactaccccgcggtgatccacggcaacatccgccgcgactgggcgcagacctaccaacgctgccgacgcctggcctccgccctggccgggcgcggcatcggccagggcgacacggtggcggtgatgctgccgaacatccccgagatgctcgaggcgcactatggcgtgccgatgatcggcgcggtgctgaacaccctcaacgtacgcctcgacgccgaagccatcgccttcatgctgcaacacggcgaagccaaggtgctgatcaccgactacgaattccacgaggtgatccatgccgccatcggtatgctcgaccacccgccgctggtggtcgacgtcaacgaccccgagtatggcgaaggccgcccggttggcgaactggactacgaggcgctgctcgccgagggcgacccgcagttcgcctgggaatggccccgggacgagtggcaggcgatctcgctgaantacacctcgggcaccaccggcaaccccaagggcgtggtctaccatcaccgcggcgcctacctgaacgcgctgggcaaccagatgacctggtccatgggccagcacccggtgtacctctggaccctgccgatgttccactgcaacggctggtgctatccgtggacggtgaccgcgctggccggcgtccacgtctgcctgcggcgggtcgatccgcaaaaggtcctcaccctgatccgcgagcaccaggtcagccacctgtgcggcgcgcccatcgtgctcaacgccctgatcaacatgcccgattcggccaaggccgccatcgaccacccggtgcatgccatggtcgccggcgccgcgccaccggccaaggtgatcggcgcggtggaagagatgggcatccgcgtcacccatgtctacggcctcaccgaggtctacggcccggtcacggtctgcgcctggcacggcgagtgggacgacctgccgctggagcgacgcgccgcgatcaagtcgcgccagggcgtgcgctacccgaccctcgaaggggtgatggtggccgacccgaagacccttgagccggtgccgcgcgacggccagtccatcggcgagatattcatgcgcggcaataccgtgatgaagggctacctgaagaatcccagcgccaccgaggaagccttcgccggcggctggttccataccggcgacctggcggtctgccatccggacggctacatcgagatccgcgaccggctcaaggacatcatcatctccggcggcgaaaacatctccaccatcgaactggagggcgtgctctaccgccacccggcggtgctggatgcggcggtggtggcgcggcccgacgaaaagtggggggaaacgccctgtgcgttcattaccctgaagagcgatcatcaggggctcgccgagagcgagatcgtcgcgttctgtcgcgaacacctggccgcgttcaagattccgcgtaccgtggtgttctcggaactgccgaagacctccaccggcaagatccagaaatacgtgctgcgcgagtgggccgccgccctctga

SEQ ID NO: 4034 - DNA, 1899 bp, Pseudomonas aeruginosa
gcgccgccagccgaattgcccgtgcagcggccgtgccacggcggccgtaggcaggatgcgcacgggcaaccctgtacctgcggccgtcccgccggccgttcaccgacgaggtgtgcaatgcctgaatacaacgccccgctgcgcgacatgcgcttcctgctcaacgacgtgttcgacgcccccgccctgtggcagcgcctgccgcgactggccgagcggatcgacgccgacaccgccgacgccatcctcgaggaagcggccaaggtcaccggcggcctgctcgcgccgctcaaccgcagtggcgacgaagaaggcgcgcagtggcaggacggcgccgtgcgcaccccggccggcttccgcgaggcctacgcgacctacgccgagggcggctgggtcggcctcaccggcaatccggcccatggcggcatgggcatgccgaagatgctggcagtgcagttcgaggagatgatgtacgcggccaacgccagcttcagcctctactcgaccctttccgccggtgcctgcctggccctcgatgcacacggcagcgaggagctgaagaacaggtacctgccgaacatgtacgccggcacctgggccggctccatgtgcctgaccgaaccgcacgccggcaccgacctgggcatcatccgcaccaaggccgagccgcaggccgacggttcatacaggatcagcgggacgaagatcttcatcaccggcggcgagcaggacctcaccgagaacatcatccacctggtgctggccaagctgcccgacgcgccggccggttcgcgcggcatctcgctgttcctggtgccgaagttcctggtcggcgacgacggcgcgctcggcgcacgcaacgcggtgcactgcggctccatcgagcacaagatggggatcaaggcctcggccacctgcgtgatgaacttcgacggcgccagtggctggctggtcggcgaagtcaacaagggcctggcggcgatgttcaccatgatgaactacgagcgcctgtccatcggcatccagggcatcggctgcgccgagatgtcctaccagagcgccgtcgcctacgcccgcgagcgcctgcaaagccgcgcgccgaccggcccggtggccagggacaaggccgccgacccgatcatcgtgcaccccgacgtgcgccgcatgctgctcaccatgaaggcgctgaccgagggcggccgcgccttttccacctatgtcgggcagcagctcgacctggccaagtacgccgaggaccaggaagaacgcagccaggccgaagccctggtggccctgttgaccccggtggccaaggccttcttcaccgataccggcctggagagctgcgtgctcggccagcaggtgttcggcggccacggctacatccgcgaatggggccaggagcaactggtgcgcgacgtacgcatcgcgcagatctacgaaggcaccaacggcatccaggcgctcgacctgatgggccgcaaggtggtcgccaacggcgggctgttcctctccatcttcagccgcgaggtgcgagccttcgccgccggcgccaacgccgaactggcggagttcgtcaccccgctgctgaccgccctggacctgctggacaacctcacccagggcatcgtcgcccgcgccggcaacgacccgcgcgagatcggcgcagcctcggtggaatacctgcatctgttcggctataccgcctacgcctacctctgggcgcgcatggccgccgccgcgcagcgccagcgcgaggtcgacccggcgttccacgacggcaagctggccaccgcgcgcttctacttcgcccgcatcctgccccgcgtgcactccctcgccgccgccgtcgaagccggcagcgaaagcctgtacggcctggaggcggaacagttctga

SEQ ID NO: 4035 - DNA, 756 bp, Pseudomonas aeruginosa
cggcggataaccgcgaagcggttattctccctacgacgcccgggaagccggccaggcattcttgaaaaacgacgcaaccgccggttattcgctagacaaggaacaaggacatatccatgcgaaccctcaccaccctcctcggcaacagccagaaactcgacggcggcgccatgttcggcaatgccccgcgcgcgctctggtcacgctggatgcagcccgatgcggagaaccgcatcgacctcggctgccgtgccctgctggtgcgcgacggcgagcgcaacgtactggtggagaccggcatcggcgcgttcttcccgcccgccctgcgccagcgctacggcgtccaggaagagcgccacgtactgctcgacagcctcgccgcggtcggcctggacgacgccgacatcgacgtggtgctgctcacccacctgcacttcgaccacgccggcggcctgctcgccgcctgggaagaaggccagccggcgcgcctgctgttccccaacgcgcatttcgtcagcggccgccgccactggcagcgcgcgcgccagccgcacccgcgcgaccgagcctcgttcgtgccggaactgctcgacctgctgcaggccagcggacgcctggagctgctcgacgacggcgagcgctcggcgcatctgggcgagggctggcgtttccatttcagcgaaggccataccccgggccagatgctcccggagatcgccatgcccgacggcccggtggtattcagcggcgacctga

SEQ ID NO: 4036 - DNA, 444 bp, Pseudomonas aeruginosa
ctgaacagagacagtcatcgtcgcgcgcagcgaacggcctccctcagccgcgcagttcctcgaccagcgtgcgcagcagttcggcggccggcagctcccgcgccagcgccgcgccctggccggcccactgggcggcgaaatcatggttgccgcgagccagagcggcggtctgcaacgctttggtcgcgtcgtagacgaacggatagtccggcaagggcggcactccaggcgcggcggcatcgaagaacatccggttgggcaggccgcgggcgctgcgcccggacatggtcacggtcagcgcggtgcgcgccgcgcgcggccccttcagcgcctcgcggtaggcggcgttggccgaggactccggacagaggacgaaggcggtgcccatctgcacggcgctcgcgcccagctccagggcggcgcggatgccccgtccgtccatga

SEQ ID NO: 4037 - DNA, 867 bp, Pseudomonas aeruginosa
agagatagatcgatggacctttcctccctcgaaatcttccgcgcggtcgcccacgaggccagcgtcacccgcgccgctcagcagttgcagcgagcgcagtcgaacgtcaccacgcggatccgccagctcgaggaggacctgggcgtcgaactgttcctgcgcgacggcaagcgcatgagcctgaccgaacgcggcagcgaattcctcgcctacgccgagcagttgctggctctcgccgacgaggcgcgtcagtcgatgcatcccgccaagcccggcgggcgcctgcgcctgggcagcatggaaagcaccgcggccagccgcctgccggcgctgctggcgagctatcacaaggcctgtccgcgggtcgccctggaagtctccaccggcaccagtcgcgcgttgttagatggggtgcgggcgcggcgcctggactgcgcgctggtggccgccggcccgggctgggccggcgaactcgatggcagcggcctgcgcggcgagccgctgttccgcgaggaactgctgatgatcctgccggccgaacacccgccggtccacgacgtcgccgaggtgcgcctgcgcaccctggccggcttcgcccgtggctgcacctaccggcaactggccgaggacagcctgggcacgccgctgacggtgcaggaagtcggctcctaccatgcgatcctcgcctgcgtcgccgccggcgcctgtgtcggcgtgctgccgcgctcggtgctgcaactgctcggcacgccgccgctgcgcagcctgccccttgccgaagtagacacctggctggtctggcgcgaaggctacgcgaccgccgccttcgaacgctggcgcggcgtgctgggccaggccggcgactga

SEQ ID NO: 4038 - DNA, 786 bp, Pseudomonas aeruginosa
gcggccaggggcgaacccaacggcctggctccggtccaaccccgagccatcagaacaatagcgagccaaggagttgcccatgagaagactgcccaccctctgcctgctggccctcgcgccgctcaccggcgtggcgccccaggcccaggccgccagcctctacaacctgctggtggggacctataccgaaggctccagcgaaggcatccaggtataccgcttcgacggcgccgacggctcggtgaaaggcccgctgcgcgtggcccataccagcaacccctcgtacctgaccttcgccccggaccaacgcactctgttcgtggtcaacgagaacggacggggcggcaagggcgataccgtcggtcgcgccacgtcctaccgtttcgatccgatcagcggccgcctgcaacagatcagccaggtccagaccctcggcgatcatccgacctacagcagcctcagccacgacggtcgttacctgttcgtcgccaactactcggtacagccggaaggctcggtggcggtactgccggtgcgcgcggacggctcgctggcgccggtggtgcaggtggagtcgcaccaggccagcaaggtgcatccgcgccaggtttccggtcatgtgcactcggtggtgtcctcgcccgacggccagtacctgttcgcccccgacctcggcgccgacaaggtattcgtctaccgatacgccccggaacaggccgaacgtccgctgcaggcggccgatccggcattcgtcccgaccccgcccggcagcggcccgcgccatag

SEQ ID NO: 4039 - DNA, 1200 bp, Pseudomonas aeruginosa
tcgccacggccatcgccagcgcgcaacgccagcggctgcgccaggacgtctccgtggccgccacctaccagaaggcctgaggcgatcatgcagaaacccgtcctgatcgccagtgccgcgctcatctgcgcggcggttatcggcatcgccgtctacgccaccggctcggcgaagaaagacgccggcggtttcgccggctacccgccggtaaaggtcgccctcgcctcggtggagcggcgggtggtgccgcgcgtcttcgatggcgtcggcgagctggaggccggtcgccaggtccaggtggccgccgaagcggcaggacggatcacccgcatcgccttcgaatcgggccagcaggtgcagcaagggcagttgctggtgcaactcaacgacgcggtggaacaggccgagctgatccgtctcaaggcgcagttgcgcaatgccgagatcctccatgcccgtgcgcgcaagctggtagagcgcaacgtcgcctcgcaggaacagctggacaacgccgtcgccgcccgcgacatggcgctcggcgcggtgcgccagacccaggcgctgatcgaccagaaggcgatccgcgcgcccttctccggccagctcggcatccgccgcgtgcacctcggccagtacctcggcgtcgccgagccggtggccagcctggtggatgcgcggaccctgaaaagcaatttctccctggacgaaagcaccagtcccgagctgaagctcggccagcccctcgaggtcctggtcgacgcctatccggggcgcagcttcccggcgcgcatcagcgccatcgacccgctgatcggcaagtcgcgcacggtgcaggtccaggccttgctggacaaccccgaaggcctgctcgccgccggcatgttcgccagcatccgggtctcgcgcaaagccgacgcgccgtcgctgagcgtgccggaaaccgcggtcacctataccgcctacggcgacaccgtgttcgtcgcccaccaggacggcgaccggccgctcagcgccaagcgcgtctcggtgcggatcggcgagcgctgggacggtcgcgtggaaatcctccagggcctcgccgagggcgaccgggtagtgacttccggacagatcaacctgagcgacgggatggccgtggaaccggtcaaggaagacaccctgagcagcgccgcgccccccgtgccggtcgccggccgctga

SEQ ID NO: 4040 - DNA, 3102 bp, Pseudomonas aeruginosa
aggaaccccgcgatgacctttaccgacctgttcgtccgccggccggtgctggcgctggtggtcagcacgctgatcctgctgctcggcctgttctccctgggcaagctgccgatccgccagtacccgctgctggaaagctcgaccatcaccgtcaccaccgagtaccccggcgcctccgccgatctcatgcaaggcttcgtcacccagccgatcgcccaggcggtgtcgtcggtggagggcatcgactacctttcctcgacctcggtgcaggggcgtagcgtggtgaccatccgcatgctgctcaaccgcgattcgacccaggcgatgaccgagaccatggccaaggtcaactcggtgcgctacaagctgcccgagcgtgcctacgactcggtgatcgaacgctcttccggcgagaccaccgcggtagcctacgtcggcttttccagcaagaccctgccgatcccggcgttgaccgactacctgtcgcgggtggtcgagccgatgttctcttccatcgacggcgtggccaaggtccagacctttggcggccagcgcctggccatgcgcctctggctcgacgccgaccgcctcgccgggcgcggcctgaccgcctccgacgtggccgaggcgatccgccgcaacaactaccaggcggcgccggggatggtgaaggggcagtacgtgctgtccaacgtgcgggtcaacaccgacctgaccaacgtcgacgacttccgcgagatggtcatccgcaacgatggcaacggcctggtgcgcctgcgcgacgtcggtaccgtcgaactgggcgccgcggccaccgagaccagcgcactgatggacggcgacccggcggtgcacctggggttgttcccgacgcccaccggcaacccgctggtgatcgtcgacggcatccgcaagctgctgccggagatccagaagaccctgccgccggatgtccgcgtcgacctcgcctacgagacttcgcgcttcatccaggcctccatcgacgaggtggtgcggaccctggtggaagcgctgctgatcgtggtgctggtgatctacctctgcctcggctcgctgcgcagcgtgctgatcccggtggcgaccattcccctgtcgatgctcggcgccgccgcgctgatgctggccttcggcttcagcgtcaacctgctgaccctgctggcgatggtgctggccatcgggctggtggtggacgacgccatcgtggtggtggagaacgtccaccgccacatcgaggaaggcaagtcgccggtggcggcggcgctgatcggcgcccgcgaagtggccggcccggtgatcgccatgaccatcaccctggccgccgtgtacacccccatcggcctgatgggcggcctcaccggcgcgctgttccgcgagttcgccctgaccctggcgggcgcggtgatcgtgtccggggtggtggcgctgaccctgtcgccggtgatgagttcgctgctgctccaggcgcaccagaacgaggggcgcatgggccgcgccgccgagtggttcttcggcggcctgacgcggcgctacgggcaggtcctggagttctccctgggccaccgctggctgaccggcggcctggcattgctggtgtgcatcagcctgccgctgctgtattcgatgcccaagcgcgaactggcgccgaccgaggaccaggccgcggtgctcaccgcgatcaaggcgccgcagcacgccaacctcgactatgtcgaactgttcgcgcgcaagctcgaccaggtctacaccagcatcccggaaaccgtgagcacctggatcatcaacggcaccgacggaccggcggcgagcttcggcgggatcaacctggcggcctgggaaaagcgcgagcgcgacgcctcggcgatccagtccgagctgcaaggcaaggtcggcgacgtcgagggcagcagcatcttcgccttccagttggccgccctgcccggctccaccggcggcctgccggtgcagatggtgctgcgcagcccgcaggactatccggtgctctaccggaccatggaagagatcaagcagaaggcccgacagagcgggctgttcgtggtggtcgacagcgacctcgactacaacaacccggtggtccaggtccgcatcgaccgcgccaaggccaacagcctgggcatccgcatgcaggacatcggcgagtcgctggcggtgctggtgggcgagaactacgtcaaccgcttcggcatggagggccgctcctacgacgtgatcccacagagcctgcgcgaccagcgtttcactccgcaagcgctggcacgacagttcgtgcgcacccaggacggcaacctggtgccgctgtcgacggtggtccgggtggcgcttcaggtcgaaccgaacaagctgatccagttcgaccagcagaacgccgcgaccctccaggcgatccccgcgcccggcgtctccatgggccaggcggtggccttcctcgacgacgtggcgcgcggcctgccggccggcttcagccacgactggcaatccgactcgcggcaatacacccaggaaggcaacaccctggtgttcgccttcctcgccgccctggtggtgatctacctggtgctcgccgcgcagtacgagagcctggccgacccgctgatcatcctgatcaccgtgccgctgtcgatctgcggcgcgctgctgccgctggcgctgggctacgcgacgatgaacatctatacgcagatcggcctggtcaccctgatcggcctgatcagcaagcacggcatcctcatggtcgagttcgccaacgaactgcaactccacgagcgcctcgaccgccgcgcggcgatcctgcgcgccgcgcagatccgcctgcggccggtgctgatgaccaccgcggcaatggtcttcggcctggtgccgctgctcttcgccagcggcgccggcgccgccagccgcttcggcctgggcgtggtgatcgtctccgggatgctggtcggcaccctcttcaccctgttcgtgctgcccaccgtctataccctgctggcgcgcaaccacgcggaagtcgacaagagcccgcgcagccggcaactggccgaggccgatctgctggtgaacaaggcatga

SEQ ID NO: 4041 - DNA, 471 bp, Pseudomonas aeruginosa
cggtcggcaccggcctggccgcctgcagcgtcggccccgactaccagcgtccgcagtcgccgccgccacgcgtcgccagcgagcacctcggcgagttctccggcgagcggcgggaagcgccctggtggagtttcttcgacgatccgcaactggtgcgcctggtcgaccaggcgctggcgcgcaaccacgacatccgcgaggcccgcgccaacctgcgcagcgcccgcgcgctgttcgacgaccgctggctcgaccagttgccgcaggtcaccagccaggccggctacagccgcagcatcgaacaacagctggactacgacggcgagccgcgccggcgcctggcggagagctaccgcgccggcttcgacgcgcagtgggaaatcgacctgttcggccgcctcggccgactttccgacgccgccctggcccgcgccgaagcggccgacgccgacctccggctggtacgcctga

SEQ ID NO: 4042 - DNA, 1248 bp, Pseudomonas aeruginosa
tcagcgccgagcggcaactggcagcgagcactgaagacgtcggcgcggccaccgccgaactctatccgcgcctcgacctgggcggcttcatcggtttcttcgccctgcgcagcggcgacctcggcagcgcctcgcgcgccttcgaactggcgcccagcgtcagttggccggcgttccgcctgggcaacgtgcgggcccgcctgcgcgccgtcgaggcgcagtccgacgccgcgctggcgcgctaccagcgctccctgctgctggcccaggaggacgtcggcaacgcgctcaaccaactggccgaacaccagcgtcggctggtcgccctgttccagtccgcgacccatggcgcgaacgccctggagatcgccaacgaacgctaccgcgccggcgccggcagctacctggcggtgctggagaaccagcgcgcgctgtaccagatccgcgaggaactggcgcaggcggagaccgcctcgttcgtcaacgtcatcgcgctctacaaggcgctcggctggggcagcggcgacctggcgccgggcgccggccaactggccgccggcgaaaccgccggggccaaccgttgaaagttccgattcaggccctggcagcgacgatcatgcgggtttccatcggcaggtcgacgatccgctccaccgcgaagccgccgcgcccgagcaggtcgaccacctcctcggtggtgcggtgacggccagcgcaggccatgaacaggtgcacgtcccagagcaccgacttcggcgacggctcgctggccgagatggtccgctcgatcaccaccacccggccgtcgccggccatcgcctcgcggcaattgccgagcaaccgcaggctggcggcttcgtccagatcgccgatgatccgcgacagcaggtagatatcgccgttggacggcacctcttgcagcatgtcgccgcccaccaggctgacgcgctcccctgccaacaggctggagaggttgtcgcgggccacgccgaagggaaccttcgcggtcgagcatcacgccccgggcgctgggctcggcctgcaggatggccttggtcaattcgccggaaccgccaccgacgtcgacgaagctacgcccgcggaaatccaggagcctggggatctcgtggaaggccaggttgctcgccttcatcgccagcaggaagcgccggccggcatccgggcagcgcttcaggtagctatagaagtcttcgccgaacgccagctcgaagcctggggtaccgctga

SEQ ID NO: 4043 - DNA, 534 bp, Pseudomonas aeruginosa
cggtattcccacttgaatgacatctaccgccaaggagcattgacgatgcctgatacgacaaatccaatcggtttcaccgatgccaacgaacttcgcgaaaagaatcgcgccaccgtcgagaagtacatgaataccaaaggccaggatcgcctgcgccgccatgaacttttcgtcgaggacggctgtggcggtttatggaccaccgataccggctcgcccatcgtcattcgtggcaaagacaaacttgcggaacatgccgtctggtcattgaagtgctttcccgattgggagtggtacaacataaatatattcggaaccgacgaccccaatcatttctgggtcgaatgcgacggtcacggcaagattcttttccccggatatcccgaaggttattacgaaaaccacttcctgcattccttcgaacttgaagacggcaagatcaagcgcaaccgcgaattcatgaacgtcttccaacaattgcgcgccttgagcattccggtcccggaaataaaacgcgaaggcattcccacttga

SEQ ID NO: 4044 - DNA, 495 bp, Pseudomonas aeruginosa
tccgcgtcgggcgcatcgccgggcagtacgccaagccgcgttccaagccgcacgagcaggtcggcgagcagaccctgccggtctatcgcggcgacatggtcaacggccgcgaggcccatgccgaacagcgccgggccgatccgcagcggatcctcaagggctatgcggcggcgcgcaacatcatgcgccacctgggctgggacgccgcgtccgggcaggaggcgaatgcctcgccggtctggaccagccacgagatgctgctgctcgactacgagctgtcgatgctgcgcgaggacgagcagcgccgggtctatctcggttcgacccactggccgtggatcggcgagcgcacccgccaggtcgacggcgcccatgtggcgctgctggccgaggtgctcaacccggtggcctgcaaggtcggcccggagatcggccgcgaccagttgctggcgctctgcgagcgcctcgacccgcgccgcgagccggggcgcctga

SEQ ID NO: 4045 - DNA, 2562 bp, Pseudomonas aeruginosa
tggcctggtccggcgcagaagcgatcccgagcgcaaccttccccctggagaccgtggcatgagcggcattcccgaaatcaccgcctatcccttgccgaccgcccagcagttgccggccaacctggcgcgctggagcctggagccgcggcgcgcggtgctgctggtgcacgacatgcagcgctacttcctgcgcccgctgcccgagagcctgcgcgccggactggtggccaacgccgcgcggctgcgccgctggtgcgtcgagcagggcgtgcagatcgcctacaccgcccagccgggcagcatgaccgaggagcagcgcggcctgctcaaggacttctgggggccgggcatgtgcgccagtccggccgaccgcgaggtggtcgaggagctggcgccggggccggacgactggctgctgaccaagtggcgctacagcgccttcttccactccgacctgctccagcggatgcgcgccgccggccgcgaccagttggtgctgtgcggcgtatacgcccacgtcggggtgctgatctccacggtcgacgcctactccaacgacatccagccgttcctggtggccgacgccatcgccgacttcagcgaggcgcaccaccgcatggccctggaatacgccgccagccgctgcgcgatggtggtcaccaccgacgaggtgctggaatgaacgccctgcccacatcgctgttgcagcgcctgctcgaacggccggcgccgttcgccttgctctaccgcccggaaagcaatggcccgggcctgctcgacgtgatccgcggcgaggcgctcgaactgcacggcctggccgacctgccgctggacgagcccggcccgggcctgccgcgccatgacctgctggcgctgattccctaccggcagatcgccgagcgcggcttcgaggcgctcgacgacggcacgccgctgctggcgctgaaggtcctggagcaggagctgctgccgctggagcaggccctggcgctgctgccgaaccaggcgctggaactgagcgaggaaggtttcgacctcgacgacgaggcctacgccgaagtggtcgggcgggtcatcgccgacgagatcggtcgcggcgaaggcgccaacttcgtgatcaagcggcgcttccaggcgcgcatcgacggctacgccacggccagcgcgctgagcttcttccgccagttgctgctgcgcgagaagggcgcctactggaccttcatcgtccacaccggcgaacgcaccctggtcggcgcctcgcccgagcgacacatcagcgtgcgcgacggcctggcggtgatgaacccgatcagcggcacctaccgctacccgccggccgggccgaacctggccgaggtcatggaattcctcgacaaccgcaaggaagccgacgagctgtacatggtggtggacgaggagctgaagatgatggcgcggatctgcgaggacggcggccgggtgctcggtccctacctcaaggagatggcgcacctggcgcacaccgagtacttcatcgagggccagaccagccgcgacgtgcgcgaggtgctgcgcgagacgctgttcgccccgaccgtcaccggcagcccgctggaaagcgcctgccgggtgatccgccgctacgagccgcagggtcgcggctactacagcggggtggcggcgctgatcggcggcgatggccagggcgggcgcacgctggactcggcgatcctgatccgcaccgccgagatcgagggcgacggccgcctgcgcatcggcgtcggctcgaccatcgtgcgtcactccgatcccctgggcgaggcggcggaaagccgggccaaggcttccgggctgatcgccgcgctgaagagccaggcgccgcagcgcctgggctcgcacccgcacgtggtggcggcgctggccagccgcaacgcgccgatcgccgacttctggctgcgcggcgccagcgagcgccagcagttgcaggccgacctgtccggacgcgaggtgctgatcgtcgatgccgaggacaccttcacctcgatgatcgccaagcagctcaagtcgctgggcctgacggtgaccgtgcgcggcttccaggagccgtactcgttcgacggctacgacctggtgatcatgggccccggcccgggcaaccccaccgagatcggccagccgaagatcggccacctgcacctggccatccgttcgctgctcagcgagcgccggccgttcctcgccgtgtgcctgagccaccaggtgctgagcctgtgcctgggcctggacctgcaacgccggcaggagcccaaccagggcgtgcagaaacagatcgacctgttcggcgccgccgagcgcgtcggcttctacaacaccttcgccgcgcgcgccctgcaggaccgcatcgagattcccgaggtcggcccgatcgagatcagccgcgaccgcgagaccggcgaggtccatgccctgcgcgggccgcgcttcgcctccatgcaattccaccccgaatcggtgctgacccgcgagggtccgcgcatcatcgccgacctgctgcgccacgcgctggtcgagcggcggccctga

SEQ ID NO: 4046 - DNA, 1521 bp, Pseudomonas aeruginosa
gccaggagagcccatgcacagatatgtcgtgatagacgccttcgccagcgaaccgctgcaaggcaacccggtggcggtgttcttcgactgcgacgacctcagcggcgagcgcatgcagcgcatggcgcgggagatgaacctgtcggagagcaccttcgtactccgcccgcaacaggacggcgacgcgcgcatccgcatcttcaccccggtcaacgaactgccgttcgccggccacccgctgctgggcaccgccatcgccctgggcgccgagaccgacaaggacaggctgttcctggagaccaggatgggcaccgtgcccttcgccctggagcgccaggacggcaaggtggtggcctgcagcatgcagcagccgatccccacctgggagcacttcagccgcccggccgagctgctcgccgccctcggcctgaagggctcgacctttcccatcgaggtctaccgcaacggcccgcgccacgtcttcgtcggcctggagagcgtcgccgcgctgtccgcgctgcaccccgaccaccgcgcgctgtgcgacttcccggacctggcggtgaaactgcttcgccggcgccgggcggcactggcgcagccgcatgttctcgccggcctacggcgtggtcgaggacgccgccaccggttccgccgccgggccgctggcgatccacctggcgcgccaccggcagattccctacgggcagcagatcgagatcctccagggcgtcgagatcggccggccgtcgcgcatgtacgcccgcgccgagggcgccggcgagcgggtctcgacggtggaagtgtcgggcaacggcgcggccttcgccgaaggccgggcctacctgtgaacgggcagaacggaggaacgccatgatgggcgtcaacgcgaacatttccgagtccctcaccgggaccatcgaagcccctttcccggagttcgaggcgccgccggcgaaccccatggaggtgctgcgcaactggctggaacgcgcccgccgctacggcgtgcgcgagccgcgggcactggccctggccacggtcgacgggcagggccggccgtcgacgcggatcgtggtgatcgccgagctgggcgagcgcggggtggtgttcgccacccacgccgatagccagaagggccgcgaactggcacagaacccctgggcctcgggggtgctgtactggcgcgagagcagccagcagatcatcctcaacggccgcgccgaacgcctgcccgacgagcgcgccgacgcccagtggctgagccgcccgtaccagacccacccgatgtcgatcgcctcgcggcagagcgaaaccctcgccgacatccacgccctgcgcgccgaagcccggcgcctggcggaaaccgacggcccgctgccgcgcccgccgggctactgcctgttcgaactgtgcctggagtcggtggagttctggggcaacggcaccgagcggctgcacgagcgcctgcgctacgaccgcgacgaaggaggctggaagcaccgctacctgcaaccgtga

SEQ ID NO: 4047 - DNA, 663 bp, Pseudomonas aeruginosa
ccaggcggcggtggcgatacagctcaagcatggtggtctccggtgacacgggggtgggcgggtggcgcggcggcgcgcgcctgcatccaggcgtgccggatgagcagcgcgccgcagaggatcagggtgaggtcggggcccagggccggcagccggccgcgcatgagtcagggcgccaggtgcgcgacggcggccgccaggcaggccagcccggggacgccgagcaacccgcgcgccagcggccagtcgcccggcagcagcaacgccgccaggccagcggcggcccacaggacaaggaacagccgccccgtccagggtccggcgagtagctccgagggcacgagttgcagccccagcaggagcaacgcggccgccgccaccaggccggcacagaaaccctggctcaggcgctgcaagagccgtacgcgggcgtccggcgccgaggcgcgtcgttgcagccacaggtacaggccgctggcgcagagcaggcaggcgccgaggcccatcgccaggtgcaggccgcgcaacgcggcggaccagcccggcccgagccactggtactgggcgaaatgcaacggctgcacggcgatgaaggcgcgcagccagaacccgcgctgcgccgagctgcgctcgccgagcagggcgccgtcggccagccgatag

SEQ ID NO: 4048 - DNA, 2493 bp, Pseudomonas aeruginosa
gccaccggcgccagcagcagggtcccgagcgcgcccagcccgctgagcgcgccggtgaaaccgaacaacagcagccagggcagtccccagatgccgatcaggccgtgcaggtcgaacagcgccaggcgcagcccgcggtcccgccgccaacgccgcaggtcgcgccagcggcggctgtgcagcaccacgccggccaggcacagcagcaacagcgatacgccgaacaggctgaccaccacccgcccggggaagccgacgaacaggctcttgtgcaggttcagcaggaggtccatcgccggcgtcggtggcaacaccccggccgctggccgggtcgaggtccagccggcagtccaggcgcgcatcgcagacgctgaaggcggcatggccgggagcaggcagcagcagggtcgcatcgcggatgtcgacgccttcctcgcccgcccgttcgagcaggcgctccagcgcaagggtttctcctcccgcctgcgccggggcccgcagccactcgcgcaggtcgtcgtggccaagactccaggcgccactgaacagcaccacgaacagcagcacgccgaacagcgcgccggcgccaccgtgcagcgagagcaggagaggacgcgccgccacttcaaccgcgccccgccagcagccacaacgccaggcccagtaccagcaggctaccgcccaggcgccaggcgaagttgcccggaccacgcgccagcaacccgccgacaagcagcaacaagcccaccccgagcgcgccgaagagcccggcgtagagacgctcgagcgggtcgtccaggggcagcccgcgagtcaacagatagccgctggcggtcgccgccgccaggctgccggcgagcgccagcggaacccgccaggcccagccgaagcccgactggcgcggcatcagaacgcgccccgcaggctgacgttgaagctgcgcggttcgccgtagcggttgttccagttggggttggacaggctctggtagtaggtccggtcgaacaggttgttgacgttgaccgccgccgtccagtgctcgtcgatcttgtagcccaggcgcatgttgaccagtgcgtagccgccctggcgcatgctcacgccgcggtagtcgacgctgtagtcgctctgcgcctggagtccgccgccgacgctccagcgccgatcctgccagggcaggtcgtagttgctccacaggcgcagcaggtgcctcggggtgaaggtggagtagcgcgtccccgagtcgttctggctgtccttgaggtactcggtgctggtgtaggtgtagccggccgagagactccagtagggcgtcaggtagccggtgccttccagctcgaagccctggctgcgcaccttgccgccgctgatgtagaacggattgttgggcggccccggatggtccgggtcttcctgcggattgttctccaggtcgatgcggaacgccgccagcgacaggttcaggcggccgtcggccagttcgcccttgatcccggtttcgtaggtcttgccttccaccgggctcaacggctcgctgttccaggtctggcgatccgcctgcggctggtagacctcggcgtagctgacataccacgaccagtccctggcgaagtcccagatcagcccgccgtagggcgtgaactggcgaccgggcttgaagcgggtggccggggtgtcctggtcccaccagctttcgcggccgccgaccaccagggtcagcggctcggcgagcttgatccgacccagggcatagaggcctttctgggtggtggtggtggtgcccggcgaagtgtactggccgatctgcgggcgcggcacgccgtgcgggtcccagcggtagacattgaccggggtgttcggcaggttgaggaagcgtgcggtgtcctggcgggtctcgccctgggcgtaggtgaccccaccgagcagttcgtgggtcaggccgaacagtcgcaccggcccattgaggttggcgtcgaggctgcgctggatgctcttgaacttgtaggcggcgcccgtcagctggccaccgtcgccggtctgcgggtcgatggcgccgaaggagccggcgtaacgcaggcgcgaatcggcttcctggtattcggcgctgaccttgcctttccagccgccgcccagttgctgttcgagggagccgaacgcgcggtaggtgtcccacttgaaacggtcccagtcgacatcgaggtacgtgtcgcgggacagcccgagattggacccatccttggccatcggtaccccggccatgttggtgatcgagtcgatgtgctggtattgcgcaccgacggtgagcagggtgtcggggctcaggtcgaactcggtcaccccgtaaaagcaggcgggtgccctggtcggccacgtcgtaaaagtagtcgcggtcctcgtaggcggccaccgctcggccgcgcacgttgccgctggcgctcagcgggccgccgacgtcgacctcggcgcggtagcggtcccagcgcccggcgctga

SEQ ID NO: 4049 - DNA, 276 bp, Pseudomonas aeruginosa
cgcgccagcgccgggcggtgggtcactaccatcagggtgcgccggccgcgcaacccgagcaggttgcgcagcacctgcgcctcgctggcggcgtcgaggctggcggtgggcttgtcgagcagcagcaacggcgccgtcgagagcagcccgcgagccaggcacaggcgttgccgctggccgccggacagcagcgcgccgccgggaccgacgtcgctgtcccagccctgcggccaggcctcgatctcttccagcaggccaaccgcccgcgccgcctag

SEQ ID NO: 4050 - DNA, 1482 bp, Pseudomonas aeruginosa
  unsure (1065): Identity of nucleotide at the above locations are unknown.
agccgcccgagcagcgccagcaggctgctcttgccggccccggagggtccgacgaggacgttcagcgaacccggctccagcctcagggaaatgtcctcgagcaaggcgcggccattttccagacgcaattccacggcctcggccgccaggctggcgtcgtgcggccgctcgcccgggctcgggactgcgcagcggagccagggcgaaaaccggcagcagggtatccagcgcctggccaggcgccgggccaacgcctggtcgagatgggtgagctgggccagcggctcgatgaagcgcaccagcagcaccagcacggccaccagtcgcgcgccgtccagccattgccgatccaccgcccaggcgccgccgagcagggcgaaggcgaacgccgcctgcaccgccagggtgaagccgaggccgctgggcaggctgcgccgcaacagatccagggtgctgcggtggagactgcgcaaggcctcttccagcccctggcgggcgacgctttcgcgctgcgccgcgcgcagcagtggctggcgttcggcgaacgcctgcaactgccgtgcggcgtcgcgctcggcggccagccgggcatcctccgccgccagattgcgccgcccgctccagcgcaacagcgcggcgaggaaggcaccagcaaggagcaggccgagggcgatggacgggtcgatcaggaacagcccgaggatcaccccgagcggcgtcaccaacgcggcgatcagcggccccagcaggtgcgccggaatgcccatcgcctgcatcaccgggccgcgcagcaggccttcggccggcgcgacccggcgcaacgccggcggcgccaggcgcggcaagcgcgccaccaggctgcgcaccagtccagccgccagcgagccgccggcggcgaaaccgcgacgcatggccaggtactgcaacagcgcctgcgccaggctcaaaccgagcaacgcggcgacccagcgccagggcaacgcgccttcggcgaaccaggcctcgaccaacggcaccagcaatacgccgcaagcggcgtccagcagcgccgccaggaccgcccangcgctcgcccggcgcaacgcggcacggcagtcttcgggcagcgcacgcattcgttcgaacagggtcatgccgccacctccgcgccgttctgttcacgccacaagcgcgcataggcgccgtccgccgccaacagggcggggtgctcgccgcgttcgaccagacggccaggggaccagcaccaggatcaggtcggcatcgctgacttcggccaaacgatgggcgacgatcacccgggtccggccaccgccgcgttcgcgcaggttgcgcaggacctgccgggcggtctgcggatccagcgccgaggttggctcgtctagcagcaacaggcgcgccggcgatagcagcgcacgggccagggccagtcgttgcagttcgccgccggacagttgcaggtcgcgtcccggcacgctgtcgtag

SEQ ID NO: 4051 - DNA, 492 bp, Pseudomonas aeruginosa
cgcgccgagcgcagcagcaggaagccggcggcggccagcaccagcggcagcaggcagaacagcagcagccaggggtgcagccaggccagccagagcaacgcgacgagcggcaccaccaacaggttgctgagatcgttgggagcgtgcgcgatcagttggtgcagggcccgcacgtcctgctccacgaggcgcgccacgccgtccgggccctggcgaccgaaccagtccagcggcagccgttgcaggtgcgccagcaggcgcaggcgcaggtcgttgcagaggtccgcgtcgacccggtgggccaggtgcgcggccagcgcctggcagcccagccaggccagcaccgccagcagcaccagggccagcagggccggctgcgcctggccgcgcgccagcggctcggcgagccaggcgagaagcatccagggcaacagcgagcagagcccggccagggcctgcaaccccatggccgccgccagccgccagcgatag

SEQ ID NO: 4052 - DNA, 525 bp, Pseudomonas aeruginosa
gggaaaacgaggaaaagcacaaaaaaacgaagaaaaacggtgaacgcgcgaaaagaaaccacgaagaccacaaagacaaagacagagaccgagataaggagagggcaaagacagggcgcaagaagacgggcaaagaagggacagaccaaggagccaaagtcccggaggccggacccgggaggagcaccaaaggagagaagaggccaggaacgacaggagagcacacaaacaagaaaggagaaaaaaaaaaacaaaacagcacggagacgggaaaaggagaaaaagacgaaaggggcgacaaggagggacggcaagaagcgaaacgagagggagcaggagacgggagacacgacaaagcaacgagaacaggacaagcgacagggagcaaaggagaagaacaagaggaaagaggcgaaggaagaggagaggacgcggaagacgacaaaagcaagaggaacagacaagcgagaaggagagggaataaaagccgcccttctgtctctagcaaggttttcttttccatga

SEQ ID NO: 4053 - DNA, 522 bp, Pseudomonas aeruginosa
tcccggagaacctcgacaacacgttgttctactacaagtacaaggtggtcgcgccggcgcgcctggccggttcggcgctggtggtgcaggaaaccctcgaccaggtgctgtcgatccgcaaggcctggcgcttcaaccgtggcgagcggcgcgtgcgccgcttgccgaccctggcctacgacagcctgcagccggataccaacggcatggccacggcggacaccgtggatgtctacaacggtgcaccggaccactacgagtgggcgttgctcggcaagcgcgagatgctggtgccttacaacagctacgcggtgcaccagaagggcctcgcctatggcgacatactcaagagccgcttcatcaatcccgacctgctgcgctacgagctgcatcgcgtctgggtggtcgaggcgaccctgcgcaagggcttcagccatccctacgccaagcgccgcttctacctcgacgaagacagctggcagatcctcgccgccgacatctacgacaaggatggcgtgctga

SEQ ID NO: 4054 - DNA, 1152 bp, Pseudomonas aeruginosa
atggcggcgaccatgcggttggccatgccggcctcgtgctcgaggttgtcgaggtcgtgctccaccgcgcggaagaacgccaggatcgcctggttgatgccgaccgtggtcaggctgccgttgaggttgcgccgcaccttctgcaggtgctgttccatgcgttcgctgcggatcgtctcgcgcagcgtcgcgccctggtgctgcagcaggcgctggttggtcttcaggttgagcaggcggcggtggtggcggccgtggtcgtccttggtcttcgcggtcagttcgaacagcagttggccgctgtcgcgctgcttgtcgtcgagcagcgcgcgctgttcctcgaccttctccaggcgcaggcgcagcagatgctggctgttgtgcagcaggccaaggacctggccgagcacggagttctccagcagcgcttccttctgcgcgacgatgcgctcgcagagcagcgcttccagccgatccaggcgactgcgttcgagcagcgccggttcgccgcggaccttggccagcagcgcctgcttcgccgacagcggcagcacgtcgccgcgctgcaggccgagctggcgggccgtgccgtcctggatcaggcggatggcgttctgtacgaagcgctcgccggaaaggtcgtcccagagcacgtcgatcttgttcagcacggcgaacaggctgctgtggccgtcctcgcgcagtggctggatgtacttctgccagatatccatgtccgaggcggtgacaccggcgtcggcggacagcaggaacaggatcgcctgggcgttgggcagcatcgacagggtcagctccggctcgctgccgagggcattcaggccaggcgtgtcgaggatccgcaggccctggcgcagcagcgggtggtcgaagttgaccagggcgtggcgccaggccgggacgcgcacctggtcgggctcgtcggcggcttccagggcatccgggtggaagccgagctggatcgcctgttccaccggcagcgccttggtcttggcgacctgggcgaaggcctgggccatgccctccgggtcgccggtgtccagcggaatgttcacccagtggcgcggcacgcgcttgaactgggcgacgctggcgtcggccaggcgcgtctcgatcggcagcaggcggatgtag

SEQ ID NO: 4055 - DNA, 813 bp, Pseudomonas aeruginosa
ggcggatcttcaggcgttcgccgtgcagcccggcgaactcgtcgcggctcgccttgggctgcaggtggcaatcgaggagcaggtcctcgccgtcccagcggtagaagctcagaggaagatgctcaactgctggggcatgccggtcatggccgccaggttgttgatcaccagcatgtcgatcagcttcagcgcgaggaacgcgaagatcggcgagagatccagtccgccgaggttcggcaggagcttgcggaacggcatcagcagcggttcgcagatctggttcaccagttgcgcgccggggttgtagctgcccggggcgacccaggaaaggatcacgctgatgatcagggcgaagaagaacaccttcaggaacagcgaggtgacggcgatgatcgaccagatcagcagttgcatgatgaagccgccgacgccgtagcccatcagcatcaggatcaggatcatcagcaccagttggatcaggatcgccagcaccagcgaggccaggtcgatcccaccgaagccggggatgatccgccgcagcgggttcagcagcggcttggtggcgcgcacgatgaactggctgagggggttgtagaagtccgcgcggaccaactgcaggatgaagcgcagcagcacgatcagcaggtagaggctgccgagggtctggaggatatagatagcagcggtgttgaggccgatcatcgactactccttattggccaagctgttcggccagctcggcggagcgctggctggcggcgttcagggcctgctccaccagtgcttcgaagccgttggcctggaaggatttga

SEQ ID NO: 4056 - DNA, 1686 bp, Pseudomonas aeruginosa
tcgccgcctcggtggtgccgttgggcgaagtcacccggcgccgcagttcggccggctcgacctcgctggacagcgccatctgcgccgcgccgagggcggtctgcagggtcaggcgcgaggctgtctcgcgggacaggccgagcttctcgccggcgtcggtcatggcctgcatcagcaggaagaaatgctgctgcgcagcaagccggcacccatcgaacagcccgcttcggccggggagtgaacgagatgcgcaaacctgcattcggcgtatcggcgctgctgatcgccctgaccctcggcgcctgctccatggcgccgacctacgaacgtcccgccgcgccggtggcccacagctggagcggcgccgccgcccagcgccagggcgcggcgatcgacacgctggattggaagagtttcatcgtcgatgccgaactacgccgcctggtggacgtggccctggataacaaccgctcgttgcgccagaccctcctggatatcgaggcggcccgcgcgcagtatcgaatccagcgcgccgaccgggttccgggcctgaacgccgctgccaccggcaaccgccagcggcagccggccgacctgtccgccggcaatcgctcggaagtggccagcagctaccaggtcgggctggccctgccggagtacgaactggacctcttcggtcgggtcaagagcctgaccgacgcagccatgcaacagtacctggccagcgaggaggcagcgcgcgcggcacggatcgccctggtcgccgaggtcagccaggcctacctgagctatgacggcgccctgcggcgcctggcgctgacccgtcagaccctggtcagccgcgagtattccttcgccctgatcgaccagcgccgcgcggccggcgccgccaccgcgctggactaccaggaagcccttggcctggtggagcaggcgcgcgccgagcaggagcgcaacctgcggcagaaacagcaggcattcaacgcgctggtgttgctgctgggtagcgacgatgccgcgcaggcgattccgcggagtccggggcagcggccgaagctgctgcaggacatcgctcccggcacgccgtccgagctgatcgagcgacgcccggacatccttgccgccgaacatcgtttgcgggcgcgcaacgcggatatcggcgcggcgcgcgcggcgttcttcccgcgcatcagcctgaccggcagcttcggcacctccagcgcggaaatgtccggcctgttcgatggcggctcgcgctcctggagcttcctgccgacgctgacgctgccgatcttcgatggcgggcgcaaccgtgccaacctgagcctggccgaggcgcgcaaggattcggcggtggccgcctacgaggggaccatccagaccgctttccgcgaggtcgccgacgccctggcggccagcgataccctgcgtcgcgaagagaaggccctgcgcgccctggcgaacagcagcaacgaagccctgaagctggccaaggcacgctacgagagtggcgtcgacaaccacctgcgctacctcgatgcgcagcgcagcagcttcctcaacgagatcgccttcatcgacggcagcacccagcggcagatcgccctggtcgacctgttccgcgcgctcggcggaggctgggacgagggacggagcctggtggtacatcgaggcggcaggagttga

SEQ ID NO: 4057 - DNA, 1305 bp, Pseudomonas aeruginosa
ccctggatagctgggagatttcgctcaatgaccactgaccggttttccttcctgcgccggccggcattgtcgctcgccgccggcctggcggttgtcgcggcgctggcctggctggtcctcgccggcggcaccgcgaaacgcacggaaggggagcgctgggtcgccgtacgggcggccccgctggtgcatcagatcggcctggtcggacgcctggaaccggggcgcgtggtgaccctggcggcgcccttcgccggcaatgtcgaggcgctgctggtggagccgggacagcgggtcgcggaaggacaggagctgctgcgcatggacacccgcgagatcgccgtgcaggtgcgcgaggcacagtcggcgttgctcaaggcccgtcgcaccctgcaggacctgcgcgactgggagcgtggcgaggacatggcgcgggtccgtcgtgccctgcgcagcgcgcagctggcgcagagcagcaccgagcgcaagttgcgcgagacccgcgagctgttccagcgcgggatcgtcccgcgcaacgaactcgacgatctcgaacaacaggccagccagcagcgcatggacctggaggcggcccggcgggaagtggagtcgacccgcgccaaggggcagggcgagaatcgccagatcgccgaaatggacctggccaacgccagcgtgaaatacgagacgctgcaggcccagctggatggccgtacggtgcgcgcgccctttgccggtatcgtcgtcgcggcgcccggcctggctggcgagcagggcagccgcgaaccggtgcaggccggtagcaagctggggcagggccaggcgttgttcggcctggccagcgtcgagcggctgaaggtatctgcgaaggtttccgaactggatatcaaccagttgcgcgaagggcaggcggtggaaatcagtggcgacggcttcgagggcaccacgctggcgggcgtcatcgccgccctcggtggtcaggctctgcccggcatggcccagggaggcagcccgcagttcgaggtgacggtgtcggtagcgccgcttgatccccgccagttgcagaagattcgtctgggaatgagcgccaagctgacggtcaccacctatcgcaaagaacaggccatcgtcgtgccgccggaggcgatacgccacgagggtgaccggctgttcgtggactttcgccaggctcccggcgccagcgtgatggcgcaacaggtcaagatcggacgctccacgccggagggcgtggaggtgttcgagttgcagccgggtctcgttcgcgtgccgtcctcgtccgaccgatag

SEQ ID NO: 4058 - DNA, 663 bp, Pseudomonas aeruginosa
agcctctcccgaatcccggtacgcacggccaaggcgggtggtgtggttcgcctggcaggtggatcggacgggaaggcacaaggtggtcgtgggggcgggtcggcgacgatcctgccgcatgatcaaggctcggcaaccgcgagcgttgccaactcactggaaggatacaaaacaatgaaatccatcaagtccctgccgtcctttgctgctcttgctctctgcctgagcgtttcgtccatggccagcgcggccaccatcaccccggtcaactcggccttcaccgcacctggcaccatcagcgtgagctcgccggcgtcgctcaatctgccagtgacctgcaacatcaccttcaagggcaagaccgccgccgatggctcctatgcctcgatcgacagcgtcaccgtcagcggcagcaacaccctgtgcagcgtgccgcagatgaccggcctgccgtggaagctgaccgtttccagcaccaccgccggcaaggtcgatggcgtcggcttcaagattctctcctctacctgtggcccgagcaccgtcaacggttcctggagcaacgccaccaacaccctcagcgccagcaatcagtcgctggcaggcaactgcaagatcaacagcctgagcgtgaagccgaccccggccttcgtagtcaacccgtaa

SEQ ID NO: 4059 - DNA, 1221 bp, Pseudomonas aeruginosa
gatcggctacctgttcggccagtacaagcgcctgtccaaccagttcacctcggtgctgaccggcaagggcctgagctatggcggcagcctgatccgcccggaggcgaccggcttcggctgcgtctacttcgcccaggaaatgctcaaggatcgtggccgcggcttcgacggccagcgggtggcgatctccggctcgggcaacgtcgcccagtacgcggcgcgcaaggtcatggaaatgggcggcaaggtgatctcgctgtccgattccgaaggcaccctgtatgccgaggcggggctctccgacgagcagtgggaatacctgatggagctgaagaacgtgcgccgcgggcgcatccgcgagatggcggagcagttttccctgcagttcctcgaagggcgccggccctggggcctggcctgcgatatcgcgctgccctgcgcgacccagaacgaactggatgccgaggatgcgcggcgcctgctggccaacggctgcgtctgtgtcgccgaaggcgccaacatgccctcgaccctggaagccgtcgacctgttcctcgaggccggcatcctctacgcgccgggcaaggcgtcgaacgccggcggggtggcggtgagcggcctggagatgtcgcagaacgccatgcgcctgcgttggagcgagggcgaggtggataccaagctgcacggcatcatgcagtcgatccaccatgcctgcctgctgtacggcgaggagcaggggcgggtcaactacgtgaagggggcgaacatcgccggcttcgtcaaggtcgccgatgcgatgctggcgcagggcgtggtctgaggtcgtcccatagaggaaaaacggggctccaggggagccccgtttttccttgtggcggttattccgcgggacgcggcgtggtctccgtgctggccggcagcagcggatattcgacgcgcggctgcttgccgctcaggctgtgcaggaaggcgacgatgttctccacgtcgtccggcgccaactgcttgccgagctgggcgttgcccatgatcgccaccgcgtccttgagttcccagacctggccgctgtggaagtacggcgcggtgagggcgacgttgcgcaggggcgcggcgcggaatacgtactcgtcgctctgggtcttggtcacggcgaagcggcccttgtcgccgctgggcagcacgctggcgtcgggcttcttcaccaggccgaacgggaagtag

SEQ ID NO: 4060 - DNA, 414 bp, Pseudomonas aeruginosa
cgccggcctggccgaaggcgcagaagatcgcgcagatgtgctcgcagtcgatccgcagcagcagggcgttgcccggcccgtggtcctccgcgaggaactccagctggcgttcttcgtcgctccaaccgaggcgctggcggaccctctccagctcacgctcgccgacgtgcccgggaatcccggcgagcagcgcccgcgcctggcgccgcagcgccgcgccgggatgctccagttgcagcggccgccagcgtgccgggcgtacccgcgccagcagctcgccaccgccggcgggtacgaagccgtggcgcagcagttccaggtcgacttccgcgcccatccgctgcaacagcggcagccagctgtcgcggagaaagtccgccggcggcgccagtggattgtgggtgccgccgctga

SEQ ID NO: 4061 - DNA, 1893 bp, Pseudomonas aeruginosa
cctctcgaacgccaccggcggcaagcccaggcctgcatccagccaacgcaccgcgaacaacggacgcaggacgtagaggtatttcttcagccggacgctgtcgcccttcaggtagccccggtagttcttgcgtgccatcgacaggtagtgatggcgactgcctggtacggagtgaaaggcgctgcccagccagagcagttcctcgcgcacgccaggctcttcccgatacaccagcggcgagccgagccactccagcagggccgggttggatttgcgcatcaggcgcaacgccttgcgcagttcccagccgctgatgtccagctcgtcgctcagcggacgttctatcacgtcgcgaggttcctcgacgcgctgataccactcgggctgatgcacatagacgaagcgtacgtcgtagtcgctgtccggcgaagcgaagccccaggcccggctgcccgactcgcaggcgtagagcacgactacgtcgtgctcgcgttcgatccgttccagctcatccagtacccgctcgcgcatggcggcggggagcggatggcgttcttccctgttcatttcgattcttccccagcgggcgccacagggcgcccgtcatcctttcacgcacaccacctgacgcagggtgtgcagcacttccaccagctcgcgctgggcttccatgacccggtcgatgtccttgtaggccatcgggatctcgtcgatcacgtcggcgtccttgcggcattcgacgtgggcggtggcgcgcgcctggtcggcgacgctgaagaccttcttcgccttggtccggctcatggtccgcccggcgccgtggctgcacgagcagaacgcttcctggttgccgaggccgcggacgatgaagctcttcgcccccatcgagccgggaatgatgccgagctggcccttctgcgcggacaccgcgcctttgcgggtgaccagtacctcctggccgaagtggcgctccttctgcacgtagttgtggtggcaatcgaccgcctccaggttggcttcgaacggcttgcggatcacctggcgcgccgcctcgatcaccgcgtgcatcatcagcgcgcggttctgccgggcaaaatcctgggcccagccgaccgcttccacgtagtcgtcgaagtgccggctgccttcctcgaagtaggccaggtccttgtccggcaggttggcgatgtgctggcgcatgtccgccttggccagttcgatgaacaggttgccgatggcgttgccgaccccgcgcgaaccgctgtgcagcatgaaccagacgcggtcggcctcgtccaggcagacctcgatgaagtggttgccggtgccgagggttcccaggtgctggcggttgttggtcttctccagcctcgggtgcttgtcggtgatcgccttgaagcgaccggcgagcgccttccaggcctggtcggcggcctccggtacctcgtgccaggcgccgcggtcgcggcggccgaaggtcttgccgtggggtaccgcctgctcgatggcgctgcgcaggccgtgcaggttgtccggcaggtcggcggcgaccagcgaggtgcgcgcggcgatcattccgcagccgatatccacgcccaccgcggccgggatgatcgcgccgagggtagggatcacgctaccgatggtcgagcccttgcccaggtgtacgtcaggcatcaccgccaggtgcttgaagatgaagggcatcttcgccgtgttcagcaactgctggcgcgcttcctcctccaccgggacgccctgggtccagagcttgatcggcttgccgccggccacttcgaggatattcatgtctttcatcgtgctttccttgtgctccgcgccgtcttgtcgacggcgcggctatcgttcgtgatcaggcctgcttcagcgtga

SEQ ID NO: 4062 - DNA, 1602 bp, Pseudomonas aeruginosa
gcggtgatgaaacgcacggtcgccatcggcttcatcggcgccaccctcgaccgtctcggcaagggcgcggcgcgctggcaaaagtggcggccgagcatcggcctgtgccagcagccggacctgctgatcgaccgcctcgaactgatccacggcaacgacgcccgcgacctcggcctggccgagcggattcgcgccgacatcgccgcggtgtcgccgcataccgaggtccgcctgcagcagatggaactgcgcaacccctgggacttcgaggaggtctatggcgccctgcacgatttcgtcagcgcctaccccttcgacaccgagcgcgaggactacctggtgcatatcaccaccgggacccatgtcgcgcagatctgctggttcctccttaccgaggcgcgctacctgccggcccggctggtgcagacctcgccgtcgcggcgcaaggacgaggcgcgccatcccgagggctcggcgacgctgatcgacctcgacctgtcccgctacgaccgcatcgcctcgcggttccgccgcgaacaggaggaaagcctggcttttctcaagtcgggaatcgccacgcgcaatgccgctttcaaccgctccatcgagcagatcgagcgggtcgccgtgcgttcgcgggcacccatgctgctggtggggccgaccggtgccggcaaatcgttcctcgcccggcgcatctatgaactcaagcgcagccggcaccagctcgacgggcgtttcgtcgaggtcaactgcgccaccttgcgcggcgacggcgcgatgtcggcactgttcggtcacgtcaagggcgccttcaccggcgcgcagaatgcgcgcgaaggcctgctgcgcgcagccgacggtggcatgctgttcctcgacgagatcggcgagctgggcgccgacgaacaggcgatgctgctcaaggctatcgaagagaagcgcttcttcccgctgggttcggaccgtgaggtggagagcgacttccagcttatcgccgggacccaccgcgacttgcgcggacgagtggccgaaggcctgttccgcgaggacctgttcgcccgcatcaacctgtggaccttcgagctgccgggcctggctggacgccgcgaggacatcgagccgaacatcgacttcgaactggagcggcacgcccgcgagcaagggcggcaggtgcgtttcaacctggaggccaagcgtcgctacctggccttcgccggttccagcgaagcgcgctgggccggcaacttccgcgagctgtcggcttccatcacacggatggcgaccctggccgacagcgggcggatcgacgaggcgctggtcgaggaggagatcctccgcctgcgccaggcctgggggctcgatgcgggccgggagccactggccgatctgctggggcagcgggtggaggccctggatctgttcgaccgcctgcaactgcaggcggtgctggaggtgtgccgcggggctaagaccctttccgaggcgggacgccggctgttcgccgtttcgcgccaggacaagcgcaaccccaacgacgccgaccggctgcgcaagtacctggcgcgtttcggcctggactgggcgcagatacgcgcctga

SEQ ID NO: 4063 - DNA, 684 bp, Pseudomonas aeruginosa
gttgctcgagcgcatcctggcggcgcgcagcccaggcgaggcgaaggccctcggccgcgaagtcgccggcttcggcgaggcacgctggaacgccgagcgggtgggaatcgtgatcgaaggcaacctcggcaagttcggccagaacgcttcgctgaagaaataccttctgggcaccgccgaccgggtgctggtcgaggccagcccggtggacgcgatctggggcatcggcctggccgcgagcgatcccctggcagccgagccggcgacctggcaaggcctcaacctgctcggcttcgccctgatggaggtgcgccggaggctggctcagtagtagtaccagcgcagctccagcttcacctcgttgatcggcttgccgacatggctgaactcgcgttcggcgcccaggcgcaggccgaggtcgcggcccagctccacctgctggacgaagcccaggctgcggcgcacttcaccgttgtggaagtagtcgcccttggcctccagggtcaggttgcccagcgggttgcgccacagcaggccgctgtcgaagcccaccgccggggcgatggcggcggcgaagtccctgttgttctcgatccgcgcggtgcccatggcgtagagcagcaagtcgtcgccgaacatcccagactgtgtaaaaacgttggcatcgaccttgctgtgatttga

SEQ ID NO: 4064 - DNA, 798 bp, Pseudomonas aeruginosa
tcgattcaaatcagcggggggacgtcaatgaagcgttttatccagggagagcatcgaggccaaagctcgctgcttcccgagagcctggatgactacgtggcggacaccaacccggtgcgggtggtcgatgttttcgtcgatgaactcgaccttggccagctgggtttcgacggcgtcgtcccggctgaaacaggtcgtcccgcttaccatcctgccgacctcctgaagatctacatctacggctatctcaatcgcatccagtccagccgccgtctcgaacgtgaggctcagcgcaacgttgagttgatgtggctgaccggacgtttgatgccggacttcaagaccatcgctaacttccgcaaagataacggcaaggcaatccgcggtgtctgtcggcagttcgtggtgctgtgccagcagcttggcctgttctctgaagcgctggttggccttcccaccggcacaagtttccaggcgggtcacaacggcgaacgccattttcaccagcgctccactttcaccggggagtgggaagaggatcgactcccagcattcaatcgcctacctgagccccactggaatacccctggatcgtccggggacctgcccctggggccaggttcaaaaccgaaacccctcccacgacaagtatctcgaaaccttaataccaaaactgcccggagcccccgggagatcaaaggttcaccccccccaaatttacgcgaaaagcccgatttccctcgaccgaatccccgatgctcctttgcgaggaaaaacaccttgcgacccggaaatggt

SEQ ID NO: 4065 - DNA, 486 bp, Pseudomonas aeruginosa
ctgcgacgcgctggaagtgctgcgccactgcgtggccgacgccagcctcgatcggctgctgctgttcttccccgatccctggcacaagaagcgccaccacaagcggcggatcgtccagccggaattcgccgaactggtgcggcgcaagctgaaggtcggcggcgtgctgcacatggccaccgactgggagccttatgccgagcatatgctggacgtcatgagcgcggcgccgggctaccgcaaccaggccgaagacggccgcttcgtgccgcgcccgcaagagcgtccggtgaccaagttcgagcggcgcggggagcgcctgggacatggcgtctgggacctcaagttcgagcgcgtcgactgatccaccgcaccagcgacgtacccctggcgccgaaccggcgccgggactccaagcagaccgggaacacccggcggacctcaccttcaagctgcacgtttcccggcttcggccggatccaataa

SEQ ID NO: 4066 - DNA, 1461 bp, Pseudomonas aeruginosa
gagcggcacggctcggccggctgcaaaggagactgctgtgttgaagaaactgggcatcctgttgctcggggccggttgcgcctgggcggcgcaggccaaggtagacgaagtccaggccgcacgcctggaccaggacctgaccccgctgggggcggagcgggccggcaacgccgatggcagcatcccgccctggaccggcggcatcacccaggcgccggccggctaccggcccggcatgcatcacctcgacccgttcgccgccgatcgtccgcgcctggtcctcgacagccgcaacatggccgcctaccaggcgctgctgacgccgggcacccaggccttgctgcaggccaacccggaataccacctgcgggtcttccccacccgccgcagcgcatccctgccgcagcgcctgtacgacgctacccgcgccaacgccagccgcgccgagctgatcgccgacggcaacggcgtgcagggcgctgccgccggcgtgcccttccccctgccgcagagcggccaggaagcgatctggaaccacatcatgcgctaccgcggcgagcaactgcacctgcagaccaaccaggcggcggtgctggccaacggcagctacaacctgctcaagctcgaccgctacctgtacttcgtctatggccgcgaggggatgatcccggagaacctcgacaacacgttgttctactacaagtacaaggtggtcgcgccggcgcgcctggccggttcggcgctggtggtgcaggaaaccctcgaccaggtgctgtcgatccgcaaggcctggcgcttcaaccgtggcgagcggcgcgtgcgccgcttgccgaccctggcctacgacagcctgcagccggataccaacggcatggccacggcggacaccgtggatgtctacaacggtgcaccggaccactacgagtgggcgttgctcggcaagcgcgagatgctggtgccttacaacagctacgcggtgcaccagaagggcctcgcctatggcgacatactcaagagccgcttcatcaatcccgacctgctgcgctacgagctgcatcgcgtctgggtggtcgaggcgaccctgcgcaagggcttcagccatccctacgccaagcgccgcttctacctcgacgaagacagctggcagatcctcgccgccgacatctacgacaaggatggcgtgctgacccgggcccaggaggtccatccgatcaactactacgatgtgccgctggtctccagcaccctggaagcgatctacgacttcaagggcggccgctacttcgtcgatgggctggacaacaacgagccgatgtacgacttcggcgtgcaggtcgggccgcgcgacttcaccccgcaggcgctgcgccgggaggggaactgaggcggacggccctcagacgatcagctcggcgccgcgtagcgtgccgtcgtcgtccaggcgcgccggcgccgggctga

SEQ ID NO: 4067 - DNA, 1383 bp, Pseudomonas aeruginosa
ccgctgacctgcttgtggtcgcgcagccaggccaggagttcgccgtcgccgcagccgaggtcgaggacgcggctgccggcgggaatccattcctggatgatttcgagatcggcgcgcatcggatcctcacacgctgatgcggttcatgtaaccgctgaaggcttgcaggtaccgggggatcggcatgaggaaggcgtcgtggccttgcggggcgtcgatctccaggtagctgacgttctttttcgccgcgatcagggcgtcgacgatttcccgcgagcgggccggcgagaaacgccagtcggtggtgaaggacatcaggcagaagtccgcctcgacgccctccagggtgcgcaccaggtcgtcaccatgggcggcggcggggtcgaaatagtccagcgccttggtcatcagcaggtaggtattggcgtcgaagcgggtggagaactcctcgccctggtagcgcaggtagctctcgacctggaactcgacgctgtgcaggtcgtagttgagcttctcggtcttcagtacgcggccgaacttggcgcccatggcgtcgtcggacaggtaggtgatatggccgaccatccgcgccagcttgaggccgcgcttgggaatcacgccctgttcctggaagtagccgccgaggaactcagggtcggaaagaatcgcctgccgggcgacttcgttgaaggcgatgttctgcgccgacagcttcggcgcgctggcgatgcacaggcagtgacggacgcgctcggggtagctgatggtccattgcagcgcctgcatgccgccgaggctgccgccgaccaccgcggcccactggcggatgccgaggcggtctgccaggcgcgcctggctatgcacccagtcttccaccgtgaccatcgggaagtccgcgccgtagaccttgccggtcgccggattgatgctggcggggccgctggaaccgttgcaaccgccgaggttgttgagggcaacgacgaagaacttgcgggtgtcgatcggcttgcccggaccgatgcagctgtcccaccagcccggcttgcgctcgtcgacgctgtggtagccggcggcgtggtggtggccggagagggcgtggcagatcagcaccgcgttgctctgcgtggcattcagctcgccgtaggtttcgatcaccaggtcgtactcggccagggacttgccgctggtcagctcgagcggttcgttgaagtgcagcgtctggggggagaccagaccgacggagtcgtcggggaagactgtgggcatcgaccctgctctcgaacaaaggagggcgccagtctaaagagcgtcgcccccagcggcaagcgcgctggcgcgcgccgtgggagcggggtcaggcgcgctgcgagccgggcaggttga

SEQ ID NO: 4068 - DNA, 516 bp, Pseudomonas aeruginosa
gcaggcggcggtggtggcggccgtggtcgtccttggtcttcgcggtcagttcgaacagcagttggccgctgtcgcgctgcttgtcgtcgagcagcgcgcgctgttcctcgaccttctccaggcgcaggcgcagcagatgctggctgttgtgcagcaggccaaggacctggccgagcacggagttctccagcagcgcttccttctgcgcgacgatgcgctcgcagagcagcgcttccagccgatccaggcgactgcgttcgagcagcgccggttcgccgcggaccttggccagcagcgcctgcttcgccgacagcggcagcacgtcgccgcgctgcaggccgagctggcgggccgtgccgtcctggatcaggcggatggcgttctgtacgaagcgctcgccggaaaggtcgtcccagagcacgtcgatcttgttcagcacggcgaacaggctgctgtggccgtcctcgcgcagtggctggatgtacttctgccagatatccatgtccgaggcggtga

SEQ ID NO: 4069 - DNA, 498 bp, Pseudomonas aeruginosa
ggtcggtcaagcgggtcgagcggcgatccccagttcctccggcaatcgggtcggacggcggatgcgcacccgtttctgccggttcagctcgccgctttcgagactcaccaggctcttggccacgccgaaggccttgccgaggaaggccagcagatgggcgttggccttgccctccaccggcggtgcggtgaggcggatcttcaggcgttcgccgtgcagcccggcgaactcgtcgcggctcgccttgggctgcaggtggcaatcgaggagcaggtcctcgccgtcccagcggtagaagctcagaggaagatgctcaactgctggggcatgccggtcatggccgccaggttgttgatcaccagcatgtcgatcagcttcagcgcgaggaacgcgaagatcggcgagagatccagtccgccgaggttcggcaggagcttgcggaacggcatcagcagcggttcgcagatctggttcaccagttgcgcgccggggttgtag

SEQ ID NO: 4070 - DNA, 897 bp, Pseudomonas aeruginosa
tggtctgcgcagccgatccgtgcgctcaataccgcctgcccggagaggccgcgccatatggcgaagcccggcggaatcgagtaccggcattggccgggcggaccagccgctaccttcgctcggcgctggcgcctcggggtatcgttgccggtggtggcggcttgtgcgctgtctccatcatcagcagtatggccgttcggcctgtatcgccggccttgcggcggtacgaccgggcgggccttgaagggatgcgagcggtcgggtgcgaatgccaacaacaaacaagcacgaaccattgatctccctgcgggggatcggcaagggctacctcctgggggggcagccgctgcagatactgaaagacgtctgcctggacatctttcccggagaaagctgcgcgatcgtcggcgcgtcgggctcgggcaagagcaccctgctgaatatcctcggcctgctcgaccgcccggacagcggtgcctaccgcttcgccgagcacgacatcttcagcgtcgacggggaccgactggcggcgatccgcaaccgcctgatcggcttcgtcttccagagcttcaacctgttgccgcggctgaacgcgctggacaacgtcgcgctgcccctgagctatcgagggatgccgcgccgcgaggcactggagcgggccgaggcgatgctcgcccgggtcggcctggccgagcgcgccggccatcgtccggcggacctttccggcggccagcggcagcgcgtcgccatcgctcgcgcgctggtcggcgagccggcgctgatcctcgccgacgaaccaaccggcaacctcgacgcgagcaccgcgaaagaagtgctggagctgctcctcaccctcaaccgcgagcgccaggtgaccctggtggtggtcacccatga

SEQ ID NO: 4071 - DNA, 1275 bp, Pseudomonas aeruginosa
tcccagcctggccgcccgtctcgggcgccaactgacagtgcggcatggcgaggtgcacgaggacctggcggaggcctgccggtgagcgccagcccgtcgccccggcaattgcttcacgaggccctcgccagtcttcgcgggctggggcgccgctcgctgctggcgttgctgggtatcgtcatgggctgttcatcggtgatcgcgatgctgaacatcggcagcaacgcgaccgacgaagcgatgagcatcttcaaggacatgggcaccgacaccctggtggtgcagttcccgttcgccccgcaggcgccgatgccgatgccggcgtcgctagacaccgaaccgctgctccgcgacgtggccggtctggagcacctggcggtgctgggcctgtactcggcgccggtgacctttcacggacgcaccagcaacgccagtatcgtcggcgccagcgccgggctcgcggctgccgccaggctgcggctgcgcgaaggacgtttcctctcgcgcttcgacgatcacgacacctacgtggtggtgggcgcgacaatcgccgaggccctgggggcgcccggcgatccgctgcgcctcggcgagcaactgacggtcaacgactatctgtttcgcgtgatcggcattctccagccgcaggccagcgccgctctcttgccgttcgccgccaacgactcgctgttcgtgccggcgccgggcatgccgcgcctgcagccggccgccgaggtcagccatgtggtggcgcgggtctcgccgggagcggacgtctatagcgtcggcgcggccctgggcgcggccctgacggcgcggttgcccggtcacgaggcgcaggtccaggtctcgcagcaggtgctcgatggactcaagcggcagacccggaccttcacctacctgctggccggactggggatcatctccctgctcggcggcggcgtcggagtgatgaacgtgatgctgatgagtgtcgccgaacgccgccgggaaatcggcgtgcgcatggcgctgggcgcgcgccagcgggacatccgcaacctgttcctgatcgaggcggtgaccctgaccgccgcgggcgcgctctcgggcgcggtgctcggcgtggcggctgcgtatctctacgccaggttctccggctggaccttctccctggcctacgcggccctgccgctggggatgggcagtaccctgctggtggggctgttcttcgggctctatccggcggtctcggcggctcgcctgcaaccggtcgaggcgctgcgcgatgaatag

SEQ ID NO: 4072 - DNA, 1254 bp, Pseudomonas aeruginosa
cgcctacctgcaacggatcgcgcagaagttcgacctgcgcgtcgccgccgacgccttcaacccgaagctggtggtgcgcggcgactatcgcgccaaccgcgccaccgaagaccgcacgaggaccagcaatgtctcgcccaccgcgaccctgcttggcgaatatggcactcgcttcagcctggcctgggtcaagcagttccgcaccgccgacgaggccgggcgctaccgcagcgatggcctcgacctgaccgtcgtccagccgttgctgcgcgatgcgggctgggacgtcaccaccgcgccgctgcgcctggcacgtctctccgaagacgccaatcgcctgcaactcaaggccagcgtgtcgcagaccatcagccaggtcatcggcgcctaccgggagctgctgcgcgcccaggagcaggcgcgcatcgctcgcgaagccctggcgcggacccaggagctgctcgaggtcaaccgggcgatgatccgcgccgggcgaatggccgaattcgagatcgtgcagaccgaggccgacgtcgccagccaggagctcaatgtcgaggagtccaccaaccaggtcgacagcgcacgcctggccctgctgcaactgctggcgctggacctgtcgacgcaaatccgcgccagcgatgcgctggccgccacgccgatcgaggtcgaccgccagcaggcgatcaggaccgccctgcagcagcaaccggaatacctgcaacgcctgatcggcagtcgccaggccgacctcaacctggtgctggcgaagaaccagcgcctgtgggatgtctcgctggtgggcggcgccagccagatccgcgaccgctacagcgagggcggtggcgacaattcacgcagctgggacagctacgccggggtacaggtggaaattcccatcggcgacctcagccgccggcaggccgaggtgcgcgcccaggtcgacgtagagaaccagaagatcctgatcgaggatgcccggcagaccctggagcagaacgtcatcgatgcggtgcgcgacctcggcacgcgctggcgccagtaccagatcgcccagcgcgccaccgcgttgtcgcggcgcaagctggagatcgaacgggaaaagctgcgcgtcgggcgttcgagcaacttccaggtgctgagcttcgagaccgacctgcgcaacgtcgagaacacccaattgaatgccctgatctcgtttctcaatgcgcagacgcagctcgacctgatcgtcggcatgaccctggatag

SEQ ID NO: 4073 - DNA, 444 bp, Pseudomonas aeruginosa
ccctggcggcgcccttcgccggcaatgtcgaggcgctgctggtggagccgggacagcgggtcgcggaaggacaggagctgctgcgcatggacacccgcgagatcgccgtgcaggtgcgcgaggcacagtcggcgttgctcaaggcccgtcgcaccctgcaggacctgcgcgactgggagcgtggcgaggacatggcgcgggtccgtcgtgccctgcgcagcgcgcagctggcgcagagcagcaccgagcgcaagttgcgcgagacccgcgagctgttccagcgcgggatcgtcccgcgcaacgaactcgacgatctcgaacaacaggccagccagcagcgcatggacctggaggcggcccggcgggaagtggagtcgacccgcgccaaggggcagggcgagaatcgccagatcgccgaaatggacctggccaacgccagcgtga

SEQ ID NO: 4074 - DNA, 1362 bp, Pseudomonas aeruginosa
cagtccaccaggggtgaaaccttgaacaacaaaaacgatatttcctgcctgtttgccagaaaaccattgccattgctctgcgccctgatcgtcggcggactgttcggcacgtcccaggcgcaagccggtggcttcatggtgccgaccaccaacacggcgggctggggccgtgcgatggcaggcggctcgctgtttcccaacgatccgagcgccgcgttcaacaacccggcggccatggcgttcatcgacaagcggatcgcccagttgacggtcaactacgccgatatcgacatcaagtacaacggcgatgcctacgactaccagggtaatcccatgaccggcggctaccaggacgggccgggcacccccgagctgggtaccaacgatggcggccaggccggattcggcgcgtggctgccgaccggcttcctggtcgtaccgatcaacgaccgcttcgccttcggtctgagccaggtcgttccgatgggaatgcgcagcacctgggacccgaactggaaaggccgcgatttcgcggtggacaccaagatcgagacgatcggcctgaccggctccctgtcgttcaaggtcaacgacaacttctccctgggcgccggggtgatcatccagcgcacctccggcttcgtcagccagaacctcgatctctatgcctcggccgccaactccccgggcatgggcgggattccgttcccggcctcgaactcgtccgcgctgatgcgggtcaaggtggacaacacctcgcccggcttcttcgccggcgcggtgtggaagccgaccgaccgcgacaccctgggcttcgcctaccacgcgaagatccgcaacaagctgaaggggcactacaacctctacgaccacgacggtggactcaccgagggcgccatcgagggcggcaccccgggcctggcctatccgggcctggacctgcgtatgggcgcttccgcctcggcgcgcctggatatccccgcctacgcctcgctggattgggtacaccagttcaacgaccgtctgagcctgggcgccagcgccacctggaccgagtggtcgtcattccaggacctgaccctcaagtcccacggcaacacgatcgtctccatcccctacacctaccggaacacctggaccctggcggtgggcggcgactacaaggtgaccgaccagtggaccatgcgcgccggggtcgcctacgaccagacgccgacccacaatgccacccgcgacccgcggattcccgacggcgatcgctacttcgcctccgctgggcgccggctatcgcttccagtcgatgccggagttgtcgatcgacgcggcctactgggcggcaattcgtcaaggaggtgccgttga

SEQ ID NO: 4075 - DNA, 1353 bp, Pseudomonas aeruginosa
aaaccggtgagaaaaatgacgcaatccgtcgacgctttcctcgagcgcctgaagcggcgcgatcccgatcagcccgaattccaccaggcggtggaagaggtgctgcgttccctctggccgttcctcgaggccaacccgcactacctggaagccggcatcatcgaacgcatcgtcgaacccgagcgggcgatcctgttccgcgtaccctgggtcgacgaccagggccgggtacgggtcaaccgtggctaccgggtgcagatgagcagcgccatcggcccctacaagggcggcctgcgcttccatccctcggtcaacctcggggtgctgaagttcctcgccttcgagcaggtcttcaagaactccctgaccactctgcccatgggcggcggcaagggcggctccgacttcgatccgaagggcaagagcgacgccgaggtgatgcgtttctgccagtcgttcatgagcgagctgtaccgccacgtcggcgccgacctggacgtgccggccggcgacatcggcgtcggcgcgcgtgagatcggctacctgttcggccagtacaagcgcctgtccaaccagttcacctcggtgctgaccggcaagggcctgagctatggcggcagcctgatccgcccggaggcgaccggcttcggctgcgtctacttcgcccaggaaatgctcaaggatcgtggccgcggcttcgacggccagcgggtggcgatctccggctcgggcaacgtcgcccagtacgcggcgcgcaaggtcatggaaatgggcggcaaggtgatctcgctgtccgattccgaaggcaccctgtatgccgaggcggggctctccgacgagcagtgggaatacctgatggagctgaagaacgtgcgccgcgggcgcatccgcgagatggcggagcagttttccctgcagttcctcgaagggcgccggccctggggcctggcctgcgatatcgcgctgccctgcgcgacccagaacgaactggatgccgaggatgcgcggcgcctgctggccaacggctgcgtctgtgtcgccgaaggcgccaacatgccctcgaccctggaagccgtcgacctgttcctcgaggccggcatcctctacgcgccgggcaaggcgtcgaacgccggcggggtggcggtgagcggcctggagatgtcgcagaacgccatgcgcctgcgttggagcgagggcgaggtggataccaagctgcacggcatcatgcagtcgatccaccatgcctgcctgctgtacggcgaggagcaggggcgggtcaactacgtgaagggggcgaacatcgccggcttcgtcaaggtcgccgatgcgatgctggcgcagggcgtggtctga

SEQ ID NO: 4076 - DNA, 1251 bp, Pseudomonas aeruginosa
tcaggcctgcttcagcgtgaccagtccgttcaatacctggtccaggccaccgaataccgaaatccggtcgatgcgctcggccacccgctccagggtttccaattccttcagacgcagcgcggtcgggttttcctccatgaccttcgcggtattcagcagcgagcgggtcgccgaggtttcctcgcggcggcggatcacattggcctgggccgccttctccgcctccaccacctgcgccagcagggtcttcatttcgcccgggaggatgatgtcgcgtacgcccaggccgctcacttccaggccgctgtcttccagcttggcggccaggtgggcgctgaccgcttcgtcgatcgactgcttgttctccagcagttcgtcgagggtacgggtgcccactgccgcccgcaggccgaactgcagctcgcggtacagatactccagcggtttgctcagccgcgagaaggcggtgagcacgtcgctgtagcgccaattggcggcgaggttcaggcgcaggctgaccttgtcgcgggtgaggatctcctggccgctgacctccagcgcctggatacgggtgtcgaccagttccacgctgacttgccggttgtagcgccagaaaccgtattgtccagcttgcagcaggccggcaagggcgccgtcgaccttgagcacgccgacctggaacgccggcacctggaccagcaacactgcgtccaggcccgccagggcgcggtcgcgcaggttcggctggtgcaactgggcgaccagcgcggcggacaatcgatagtcctgggtcaggtcgatgcgctccaggcgctgctcggtctggcctttccagtacagtcggcggctgcccggtgcgagcaactccaccagcacgccgtcctcgtagcgcaggccggcctcgttgtcgcccaggtccatccgggtgaagtagcgctccaccagctgcggttcgctctgccgcaggtagccggccaggcggtgttcgaactgcggggtgttcaggctgaagctttccaggctcaggcggtcgtacggatcgaagcggcggtaggtgcccggttcgagcacggcgaggaagtcgccttcggaatacagcaggccgcgttcgttcttcttcacgataaagcgcttcagcattttcatctcttcattcctttcattcttccgtggtgccggtgttgccggcccgtcgagcgtcgtgggtggagcgcggaggaggttggcctggcggacgtcctgtccatatga

SEQ ID NO: 4077 - DNA, 339 bp, Pseudomonas aeruginosa
tccacggcaacgacgcccgcgacctcggcctggccgagcggattcgcgccgacatcgccgcggtgtcgccgcataccgaggtccgcctgcagcagatggaactgcgcaacccctgggacttcgaggaggtctatggcgccctgcacgatttcgtcagcgcctaccccttcgacaccgagcgcgaggactacctggtgcatatcaccaccgggacccatgtcgcgcagatctgctggttcctccttaccgaggcgcgctacctgccggcccggctggtgcagacctcgccgtcgcggcgcaaggacgaggcgcgccatcccgagggctcggcgacgctga

SEQ ID NO: 4078 - DNA, 1728 bp, Pseudomonas aeruginosa
tcgacctcgacctgtcccgctacgaccgcatcgcctcgcggttccgccgcgaacaggaggaaagcctggcttttctcaagtcgggaatcgccacgcgcaatgccgctttcaaccgctccatcgagcagatcgagcgggtcgccgtgcgttcgcgggcacccatgctgctggtggggccgaccggtgccggcaaatcgttcctcgcccggcgcatctatgaactcaagcgcagccggcaccagctcgacgggcgtttcgtcgaggtcaactgcgccaccttgcgcggcgacggcgcgatgtcggcactgttcggtcacgtcaagggcgccttcaccggcgcgcagaatgcgcgcgaaggcctgctgcgcgcagccgacggtggcatgctgttcctcgacgagatcggcgagctgggcgccgacgaacaggcgatgctgctcaaggctatcgaagagaagcgcttcttcccgctgggttcggaccgtgaggtggagagcgacttccagcttatcgccgggacccaccgcgacttgcgcggacgagtggccgaaggcctgttccgcgaggacctgttcgcccgcatcaacctgtggaccttcgagctgccgggcctggctggacgccgcgaggacatcgagccgaacatcgacttcgaactggagcggcacgcccgcgagcaagggcggcaggtgcgtttcaacctggaggccaagcgtcgctacctggccttcgccggttccagcgaagcgcgctgggccggcaacttccgcgagctgtcggcttccatcacacggatggcgaccctggccgacagcgggcggatcgacgaggcgctggtcgaggaggagatcctccgcctgcgccaggcctgggggctcgatgcgggccgggagccactggccgatctgctggggcagcgggtggaggccctggatctgttcgaccgcctgcaactgcaggcggtgctggaggtgtgccgcggggctaagaccctttccgaggcgggacgccggctgttcgccgtttcgcgccaggacaagcgcaaccccaacgacgccgaccggctgcgcaagtacctggcgcgtttcggcctggactgggcgcagatacgcgcctgaacaccacttcgggatatccttggcgtcttttcacgggctccagggacgaatgccgatgagcgagataatggacgtcgagcggctgcgccagcgctgcgcggccggcgaaagcttcaaatacctgtatttctggggacatcgcccggcgacggatgacaaggtcggcaagagctgtttcagccagtggtacgaggcttcgttcaagctcgacggggtgcgctacgccagcgccgagcattacatgatggcggccaaggcacgcttgttcgacgaccctaggttgctcgagcgcatcctggcggcgcgcagcccaggcgaggcgaaggccctcggccgcgaagtcgccggcttcggcgaggcacgctggaacgccgagcgggtgggaatcgtgatcgaaggcaacctcggcaagttcggccagaacgcttcgctgaagaaataccttctgggcaccgccgaccgggtgctggtcgaggccagcccggtggacgcgatctggggcatcggcctggccgcgagcgatcccctggcagccgagccggcgacctggcaaggcctcaacctgctcggcttcgccctgatggaggtgcgccggaggctggctcagtag

SEQ ID NO: 4079 - DNA, 1254 bp, Pseudomonas aeruginosa
gaaaacgaggaaaagcacaaaaaaacgaagaaaaacggtgaacgcgcgaaaagaaaccacgaagaccacaaagacaaagacagagaccgagataaggagagggcaaagacagggcgcaagaagacgggcaaagaagggacagaccaaggagccaaagtcccggaggccggacccgggaggagcaccaaaggagagaagaggccaggaacgacaggagagcacacaaacaagaaaggagaaaaaaaaaaacaaaacagcacggagacgggaaaaggagaaaaagacgaaaggggcgacaaggagggacggcaagaagcgaaacgagagggagcaggagacgggagacacgacaaagcaacgagaacaggacaagcgacagggagcaaaggagaagaacaagaggaaagaggcgaaggaagaggagaggacgcggaagacgacaaaagcaagaggaacagacaagcgagaaggagagggaataaaagccgcccttctgtctctagcaaggttttcttttccatgagcgataccccgcaatccccggcccaggactccctggcggaacacgacgaagcacggccgatgcgcaccgtgaagagcttcgtgatgcgcgccgggcgcatgaccgaaggccagcagcgtggcctcgacctgggctggccgaagttcggcctggaactgagcgatgaggttcaggacttcgacgcgatcttcggtcgccaggcgccgcggactttcgagatcggcttcggcatgggccattccaccctggaaatggccgccgccgcgcctgacatcgacttcatcggcgtcgaggtgcacaagccgggcgtcggcgcgctgctcaacggcctgctgacccagggcctgggcaacgtgcgggtgtatagctgcgacgcgctggaagtgctgcgccactgcgtggccgacgccagcctcgatcggctgctgctgttcttccccgatccctggcacaagaagcgccaccacaagcggcggatcgtccagccggaattcgccgaactggtgcggcgcaagctgaaggtcggcggcgtgctgcacatggccaccgactgggagccttatgccgagcatatgctggacgtcatgagcgcggcgccgggctaccgcaaccaggccgaagacggccgcttcgtgccgcgcccgcaagagcgtccggtgaccaagttcgagcggcgcggggagcgcctgggacatggcgtctgggacctcaagttcgagcgcgtcgactga

SEQ ID NO: 4080 - DNA, 1509 bp, Pseudomonas aeruginosa
tccaccgcaccagcgacgtacccctggcgccgaaccggcgccgggactccaagcagaccgggaacacccggcggacctcaccttcaagctgcacgtttcccggcttcggccggatccaataataagagcggcacggctcggccggctgcaaaggagactgctgtgttgaagaaactgggcatcctgttgctcggggccggttgcgcctgggcggcgcaggccaaggtagacgaagtccaggccgcacgcctggaccaggacctgaccccgctgggggcggagcgggccggcaacgccgatggcagcatcccgccctggaccggcggcatcacccaggcgccggccggctaccggcccggcatgcatcacctcgacccgttcgccgccgatcgtccgcgcctggtcctcgacagccgcaacatggccgcctaccaggcgctgctgacgccgggcacccaggccttgctgcaggccaacccggaataccacctgcgggtcttccccacccgccgcagcgcatccctgccgcagcgcctgtacgacgctacccgcgccaacgccagccgcgccgagctgatcgccgacggcaacggcgtgcagggcgctgccgccggcgtgcccttccccctgccgcagagcggccaggaagcgatctggaaccacatcatgcgctaccgcggcgagcaactgcacctgcagaccaaccaggcggcggtgctggccaacggcagctacaacctgctcaagctcgaccgctacctgtacttcgtctatggccgcgaggggatgatcccggagaacctcgacaacacgttgttctactacaagtacaaggtggtcgcgccggcgcgcctggccggttcggcgctggtggtgcaggaaaccctcgaccaggtgctgtcgatccgcaaggcctggcgcttcaaccgtggcgagcggcgcgtgcgccgcttgccgaccctggcctacgacagcctgcagccggataccaacggcatggccacggcggacaccgtggatgtctacaacggtgcaccggaccactacgagtgggcgttgctcggcaagcgcgagatgctggtgccttacaacagctacgcggtgcaccagaagggcctcgcctatggcgacatactcaagagccgcttcatcaatcccgacctgctgcgctacgagctgcatcgcgtctgggtggtcgaggcgaccctgcgcaagggcttcagccatccctacgccaagcgccgcttctacctcgacgaagacagctggcagatcctcgccgccgacatctacgacaaggatggcgtgctgacccgggcccaggaggtccatccgatcaactactacgatgtgccgctggtctccagcaccctggaagcgatctacgacttcaagggcggccgctacttcgtcgatgggctggacaacaacgagccgatgtacgacttcggcgtgcaggtcgggccgcgcgacttcaccccgcaggcgctgcgccgggaggggaactga

SEQ ID NO: 4081 - DNA, 1059 bp, Pseudomonas aeruginosa
tggccagggaaatgtccgacaggtggctgcggctccagcgcgacagggtggcgatcaggtccagcgcgtaatccatcgagggttccttgtaacgaatcggcgtgtcggtcggcggagtttacctgcctgccggcacggatgggcgtgcatccgtcgtcacggcaggaaatgttgcagcaggtcgttgaggaacagctggccgcgttcgctggggcgcaggcgctgcgggtcgtcggcgagcagcccggcgtcgcgcgcggcggcgcaggcatcggcgatcgccgccagtggctggccggtgcgctgtgggtagagcgcggcggggacgccgtcgaccaggcgcagcacgttcatcatgaactcgaatggcaggtcggccgcttccagcgggcgctcgccggcctggaaggccttttgcgggttgaggtagtccttcggcaggcgggtcttccaggtccgcacgatgcgtccgtccggcgcgctcagcttggcgtgggcgccggcgccgatgccgaggaagtcgccgaagctccagtagttcaggttgtgccgggcgtgcaggccgtcgcgggcgtaggcggaggtctcgtactggcggtagccgtgctcgtcgagcagggcctggccggcttcctggatgtcccagaggatgtcgtcctcgggcagctccggcggctggctccagaacaccgtgttcggctccatggtcagttggtaccaggagaggtgcgtgggggccagggcgagggcctggcgcaggtcggccagggcgtcgtcgaggctctgcccgggcaggccgtgcatcaggtcgaggttgaagttgtcgaagccggcctggcgcgccatgtcggcggcgcgcactgcctcggcgccgtcgtggatgcgccccagggcctgcagcttgtcggcctggaagctctgcacgccgatggacaggcgattgatgccgaggcgccggtagtcggcgaacttgacctgttcgaaggtgccgggattggcttccagggtgatctcgatgccgtcggcgaagccgaccctgcgctcgacgccttccagtag

SEQ ID NO: 4082 - DNA, 297 bp, Pseudomonas aeruginosa
ccggcccagggccttggccgagaacaggctgggcgtgccgccgccgaagaagatcgaacccaggcgccggccgtggacatggcgcaggtcttgctccaggtcggcgagcagggcgtcgacataggcctcttcgggcagctccgggccagcggcgtgggagttgaagtcgcaatacgggcacttgcgcacgcaccacgggatgtgcacgtacagggccaggggcgggagctggaacggggtggcttgggtcacggtggggcggggtggaggcggtttcggggcgctatcgtggcatga

SEQ ID NO: 4083 - DNA, 789 bp, Pseudomonas aeruginosa
gttcggccaacctccaaggcggccggacgaaacgccgtgccgacgccgcccgggggcggcgccgacggttgcggctcagagacccaggcgctgcttgagcagggccatggcgcgggctcggtggctgaggcggttcttctcctcgggcgccagctcggcgctggagcagtcgcgttccggcacccagaacagcgggtcgtagccgaagccgtgggcgccgcgggcttcgcggaggatgcggccttcccagatgccctcgcagaggatcggcagcgggtcgtcggcgtggcgcaccagcgccagcacgctgacgaactgtgcgccgcgctcggcgtccgggacatccttcatggcctccagcagcttggcgttgttcgccgcgtcgccccggccgtcggcatagcgcgccgagtagatgcccggcgcgccgccgaggaagtccaccgccagcccggagtcgtcggccagcgccggcaggccggagaggcgtgcggcgttgcgtgccttgaggatggcgttctcgacgaaggaaagaccggtttcctccggttccacctggctgaactcgccgatcgagcgcaccttcacgctggcgccgagcatggcctggagttccttgagtttgccggcattgtggctggccagcaccagctgttcgagcttgatcattcgtccgggaagatttccttgttgaaactgaaggtttgcgcaggttcgcccttggcctcgaccttgatggtgaagaccagggtctcgcgctggctgatcgggaattgcgccaggttgtag

SEQ ID NO: 4084 - DNA, 1377 bp, Pseudomonas aeruginosa
ctgcggcgcgtcgagggcgtagagcgggttctcctcgttgtgccggcggtagatggcggcgaccatgcggttggccatgccggcctcgtgctcgaggttgtcgaggtcgtgctccaccgcgcggaagaacgccaggatcgcctggttgatgccgaccgtggtcaggctgccgttgaggttgcgccgcaccttctgcaggtgctgttccatgcgttcgctgcggatcgtctcgcgcagcgtcgcgccctggtgctgcagcaggcgctggttggtcttcaggttgagcaggcggcggtggtggcggccgtggtcgtccttggtcttcgcggtcagttcgaacagcagttggccgctgtcgcgctgcttgtcgtcgagcagcgcgcgctgttcctcgaccttctccaggcgcaggcgcagcagatgctggctgttgtgcagcaggccaaggacctggccgagcacggagttctccagcagcgcttccttctgcgcgacgatgcgctcgcagagcagcgcttccagccgatccaggcgactgcgttcgagcagcgccggttcgccgcggaccttggccagcagcgcctgcttcgccgacagcggcagcacgtcgccgcgctgcaggccgagctggcgggccgtgccgtcctggatcaggcggatggcgttctgtacgaagcgctcgccggaaaggtcgtcccagagcacgtcgatcttgttcagcacggcgaacaggctgctgtggccgtcctcgcgcagtggctggatgtacttctgccagatatccatgtccgaggcggtgacaccggcgtcggcggacagcaggaacaggatcgcctgggcgttgggcagcatcgacagggtcagctccggctcgctgccgagggcattcaggccaggcgtgtcgaggatccgcaggccctggcgcagcagcgggtggtcgaagttgaccagggcgtggcgccaggccgggacgcgcacctggtcgggctcgtcggcggcttccagggcatccgggtggaagccgagctggatcgcctgttccaccggcagcgccttggtcttggcgacctgggcgaaggcctgggccatgccctccgggtcgccggtgtccagcggaatgttcacccagtggcgcggcacgcgcttgaactgggcgacgctggcgtcggccaggcgcgtctcgatcggcagcaggcggatgtagctgcgctcggcgcgcggatcgtggaacagctcggtggggcacatggtggtgcgcccggcgtgggacggcagcatgcgctggccgtagccggcgaagaacaggctgttgatcagctcggtcttgccacgcgagaactcgccgacgaaggccagggtgatgtggtccgcgcgtag

SEQ ID NO: 4085 - DNA, 1800 bp, Pseudomonas aeruginosa
cggcctggaatcggacggcgaacatccgccggcaaagcgccccgccccacgaaaaccggggtggctggccagctttctctcggtctgtcatatacttggccgagtttttttccttttcttcatgaggtgctcgttttggctcagtacgtctacaccatgcatcgggtcggcaagatcgttccgcccaagcgtgaaatcctcaaggacatctccctgtcgttcttccccggcgccaagatcggcgtgctcggcctgaacggcgcgggcaagtccaccctgctgcggatcatggccggcgtcgacaccgagatcgaaggcgaggcccggccgatgccggggatcaacgtcggctacctgccgcaggagcccaagctggacccgcaggccaccgtgcgcgacatcgtcgaagaggccgtcggccagatcaagcaggcccaggcgcggctggacgaggtctatgccgcctatgctgagccggatgccgacttcgacgccctggccgccgagcaggccaagctggaggcgatcctccaggcatccgacggacacaacctggaacgccagctggaagtcgccgccgacgccctgcgcctgccgccgtgggatgccaaggtcgagcacctgtccggcggcgaaaagcgccgcgtagcgctgtgccgcctgctgctgtcggctcccgacatgctgctgctggacgaaccgaccaaccacctggacgccgactcggtggcctggctggagcatttcctgcacgacttccccggcaccgtggtggcgatcacccacgaccgctacttcctcgacaacgtcgccggctggatcctcgaactcgaccgtggccatggcatcccgttcgaaggcaactactccggctggctggaatccaaggccgcccgcctggcccaggaagccaagcaggaagcctcccacgccaaggccatgaaggccgagctggagtgggtacgccagggcgccaagggccgccaggccaagtccaaggcgcgcctgcagcgcttcgaggaactgcagtcgcaggaattccagaagcgcagcgagaccaacgagatctacatcccggccggtccgcgcctgggcgacaaggtcatcgaactgcacaatgtgaccaagggctacggcgaccgcgtgctgatcgacaacctgtccctgagcattcccaagggcgccatcgtcggtgtgatcggcggcaacggcgcgggcaagtcgaccctgttccgcatgcttaccggcaaggagcagccggactccggcaccatcgagatcggcgagaccgtgcagatcgccagcgtcgaccagagccgtgacagcctggaaggcaacaagaccgtgtgggagcaggtttccgacggtttcgagcagatcaagatcggcaactacgaagtcccgtcgcgcagctatgtcggtcgcttcaacttcaagggcgccgaccagcagaagttcgtcaaggacctctccggcggtgagcgtggccgtctgcacctggccctgaccctgaagcagggcggcaacgtgctgctgctcgacgaaccgtccaacgacctcgacgtggaaaccctgcgtgcgatggaagaggcgctgctggacttccccggctccgccatcgtgatctcccacgaccgctggttcctcgaccggatcgccacccacatcctctcctacgaggacgatggcaaggtgaccttcttcgaaggcaactacaccgagttcgaggcggaccgcaagaagcgcctgggcgacgccgcggcccagccgcaccgcgtgcgctacaagaaactggcgtaa

SEQ ID NO: 4086 - DNA, 738 bp, Pseudomonas aeruginosa
agggatgcgagcggtcgggtgcgaatgccaacaacaaacaagcacgaaccattgatctccctgcgggggatcggcaagggctacctcctgggggggcagccgctgcagatactgaaagacgtctgcctggacatctttcccggagaaagctgcgcgatcgtcggcgcgtcgggctcgggcaagagcaccctgctgaatatcctcggcctgctcgaccgcccggacagcggtgcctaccgcttcgccgagcacgacatcttcagcgtcgacggggaccgactggcggcgatccgcaaccgcctgatcggcttcgtcttccagagcttcaacctgttgccgcggctgaacgcgctggacaacgtcgcgctgcccctgagctatcgagggatgccgcgccgcgaggcactggagcgggccgaggcgatgctcgcccgggtcggcctggccgagcgcgccggccatcgtccggcggacctttccggcggccagcggcagcgcgtcgccatcgctcgcgcgctggtcggcgagccggcgctgatcctcgccgacgaaccaaccggcaacctcgacgcgagcaccgcgaaagaagtgctggagctgctcctcaccctcaaccgcgagcgccaggtgaccctggtggtggtcacccatgatcccagcctggccgcccgtctcgggcgccaactgacagtgcggcatggcgaggtgcacgaggacctggcggaggcctgccggtga

SEQ ID NO: 4087 - DNA, 1680 bp, Pseudomonas aeruginosa
ccgccgcgggcgcgctctcgggcgcggtgctcggcgtggcggctgcgtatctctacgccaggttctccggctggaccttctccctggcctacgcggccctgccgctggggatgggcagtaccctgctggtggggctgttcttcgggctctatccggcggtctcggcggctcgcctgcaaccggtcgaggcgctgcgcgatgaataggtggggcctgggcgtgctgtggctggtcaccgctcttccggtggcggccagcgtcaacccggcgctgagtccggacgtaccgagcatggcccgcgagcagggcaggtcggtgctgctcagcgagcaggtgatcgacctcagcctgagcgacgcggtctatcttggcctgcgcaacaaccgtggaatccgtagcgcctacctgcaacggatcgcgcagaagttcgacctgcgcgtcgccgccgacgccttcaacccgaagctggtggtgcgcggcgactatcgcgccaaccgcgccaccgaagaccgcacgaggaccagcaatgtctcgcccaccgcgaccctgcttggcgaatatggcactcgcttcagcctggcctgggtcaagcagttccgcaccgccgacgaggccgggcgctaccgcagcgatggcctcgacctgaccgtcgtccagccgttgctgcgcgatgcgggctgggacgtcaccaccgcgccgctgcgcctggcacgtctctccgaagacgccaatcgcctgcaactcaaggccagcgtgtcgcagaccatcagccaggtcatcggcgcctaccgggagctgctgcgcgcccaggagcaggcgcgcatcgctcgcgaagccctggcgcggacccaggagctgctcgaggtcaaccgggcgatgatccgcgccgggcgaatggccgaattcgagatcgtgcagaccgaggccgacgtcgccagccaggagctcaatgtcgaggagtccaccaaccaggtcgacagcgcacgcctggccctgctgcaactgctggcgctggacctgtcgacgcaaatccgcgccagcgatgcgctggccgccacgccgatcgaggtcgaccgccagcaggcgatcaggaccgccctgcagcagcaaccggaatacctgcaacgcctgatcggcagtcgccaggccgacctcaacctggtgctggcgaagaaccagcgcctgtgggatgtctcgctggtgggcggcgccagccagatccgcgaccgctacagcgagggcggtggcgacaattcacgcagctgggacagctacgccggggtacaggtggaaattcccatcggcgacctcagccgccggcaggccgaggtgcgcgcccaggtcgacgtagagaaccagaagatcctgatcgaggatgcccggcagaccctggagcagaacgtcatcgatgcggtgcgcgacctcggcacgcgctggcgccagtaccagatcgcccagcgcgccaccgcgttgtcgcggcgcaagctggagatcgaacgggaaaagctgcgcgtcgggcgttcgagcaacttccaggtgctgagcttcgagaccgacctgcgcaacgtcgagaacacccaattgaatgccctgatctcgtttctcaatgcgcagacgcagctcgacctgatcgtcggcatgaccctggatagctgggagatttcgctcaatgaccactga

SEQ ID NO: 4088 - DNA, 762 bp, Pseudomonas aeruginosa
ccggttttccttcctgcgccggccggcattgtcgctcgccgccggcctggcggttgtcgcggcgctggcctggctggtcctcgccggcggcaccgcgaaacgcacggaaggggagcgctgggtcgccgtacgggcggccccgctggtgcatcagatcggcctggtcggacgcctggaaccggggcgcgtggtgaccctggcggcgcccttcgccggcaatgtcgaggcgctgctggtggagccgggacagcgggtcgcggaaggacaggagctgctgcgcatggacacccgcgagatcgccgtgcaggtgcgcgaggcacagtcggcgttgctcaaggcccgtcgcaccctgcaggacctgcgcgactgggagcgtggcgaggacatggcgcgggtccgtcgtgccctgcgcagcgcgcagctggcgcagagcagcaccgagcgcaagttgcgcgagacccgcgagctgttccagcgcgggatcgtcccgcgcaacgaactcgacgatctcgaacaacaggccagccagcagcgcatggacctggaggcggcccggcgggaagtggagtcgacccgcgccaaggggcagggcgagaatcgccagatcgccgaaatggacctggccaacgccagcgtgaaatacgagacgctgcaggcccagctggatggccgtacggtgcgcgcgccctttgccggtatcgtcgtcgcggcgcccggcctggctggcgagcagggcagccgcgaaccggtgcaggccggtag

SEQ ID NO: 4089 - DNA, 759 bp, Pseudomonas aeruginosa
tcaaggctcggcaaccgcgagcgttgccaactcactggaaggatacaaaacaatgaaatccatcaagtccctgccgtcctttgctgctcttgctctctgcctgagcgtttcgtccatggccagcgcggccaccatcaccccggtcaactcggccttcaccgcacctggcaccatcagcgtgagctcgccggcgtcgctcaatctgccagtgacctgcaacatcaccttcaagggcaagaccgccgccgatggctcctatgcctcgatcgacagcgtcaccgtcagcggcagcaacaccctgtgcagcgtgccgcagatgaccggcctgccgtggaagctgaccgtttccagcaccaccgccggcaaggtcgatggcgtcggcttcaagattctctcctctacctgtggcccgagcaccgtcaacggttcctggagcaacgccaccaacaccctcagcgccagcaatcagtcgctggcaggcaactgcaagatcaacagcctgagcgtgaagccgaccccggccttcgtagtcaacccgtaatccgggctgccgctggcgccctcggcgccagcggtttcgcgctcccgctgccaggcgtccttcgcgggccggcaggtccgagggagtttccgccggaagcggcgcagaacctcgttcgcacatggaaaacggtctgggggagggtgtccgccaggacgctcaagcaggccgaccatcgtgccccgtgcattagcagtccaccaggggtgaaaccttga

SEQ ID NO: 4090 - DNA, 741 bp, Pseudomonas aeruginosa
ccgccgccgtccagcgcctggtcgccgatcctcaccggcaggaagcgttcgataacccggcggttgctttgcagatgggcgctcagccgcggcgtggtgaagctgccggcgccggccagggccatgggcagcagcaattggtcggcgaggtgctcgtccgccgcgcagccgctttccatccagccgatggcttgcgtcgcgacctgttccgccacccgttcggcgctgacgccggcctggccgaaggcgcagaagatcgcgcagatgtgctcgcagtcgatccgcagcagcagggcgttgcccggcccgtggtcctccgcgaggaactccagctggcgttcttcgtcgctccaaccgaggcgctggcggaccctctccagctcacgctcgccgacgtgcccgggaatcccggcgagcagcgcccgcgcctggcgccgcagcgccgcgccgggatgctccagttgcagcggccgccagcgtgccgggcgtacccgcgccagcagctcgccaccgccggcgggtacgaagccgtggcgcagcagttccaggtcgacttccgcgcccatccgctgcaacagcggcagccagctgtcgcggagaaagtccgccggcggcgccagtggattgtgggtgccgccgctgatcctcacccggctttcgccgttggccgcgagcagcgccggcagcagggtttgcagtaccagcgagcaactgccggcggagccgatggcgaaggcgtag

SEQ ID NO: 4091 - DNA, 501 bp, Pseudomonas aeruginosa
ggtggagagcgacttccagcttatcgccgggacccaccgcgacttgcgcggacgagtggccgaaggcctgttccgcgaggacctgttcgcccgcatcaacctgtggaccttcgagctgccgggcctggctggacgccgcgaggacatcgagccgaacatcgacttcgaactggagcggcacgcccgcgagcaagggcggcaggtgcgtttcaacctggaggccaagcgtcgctacctggccttcgccggttccagcgaagcgcgctgggccggcaacttccgcgagctgtcggcttccatcacacggatggcgaccctggccgacagcgggcggatcgacgaggcgctggtcgaggaggagatcctccgcctgcgccaggcctgggggctcgatgcgggccgggagccactggccgatctgctggggcagcgggtggaggccctggatctgttcgaccgcctgcaactgcaggcggtgctggaggtgtgccgcggggctaa

SEQ ID NO: 4092 - DNA, 384 bp, Pseudomonas aeruginosa
cgtccccccgctgatttgaatcgatcaaatcacagcaaggtcgatgccaacgtttttacacagtctgggatgttcggcgacgacttgctgctctacgccatgggcaccgcgcggatcgagaacaacagggacttcgccgccgccatcgccccggcggtgggcttcgacagcggcctgctgtggcgcaacccgctgggcaacctgaccctggaggccaagggcgactacttccacaacggtgaagtgcgccgcagcctgggcttcgtccagcaggtggagctgggccgcgacctcggcctgcgcctgggcgccgaacgcgagttcagccatgtcggcaagccgatcaacgaggtgaagctggagctgcgctggtactactactga

SEQ ID NO: 4093 - DNA, 1773 bp, Pseudomonas aeruginosa
aaagacgccaaggatatcccgaagtggtgttcaggcgcgtatctgcgcccagtccaggccgaaacgcgccaggtacttgcgcagccggtcggcgtcgttggggttgcgcttgtcctggcgcgaaacggcgaacagccggcgtcccgcctcggaaagggtcttagccccgcggcacacctccagcaccgcctgcagttgcaggcggtcgaacagatccagggcctccacccgctgccccagcagatcggccagtggctcccggcccgcatcgagcccccaggcctggcgcaggcggaggatctcctcctcgaccagcgcctcgtcgatccgcccgctgtcggccagggtcgccatccgtgtgatggaagccgacagctcgcggaagttgccggcccagcgcgcttcgctggaaccggcgaaggccaggtagcgacgcttggcctccaggttgaaacgcacctgccgcccttgctcgcgggcgtgccgctccagttcgaagtcgatgttcggctcgatgtcctcgcggcgtccagccaggcccggcagctcgaaggtccacaggttgatgcgggcgaacaggtcctcgcggaacaggccttcggccactcgtccgcgcaagtcgcggtgggtcccggcgataagctggaagtcgctctccacctcacggtccgaacccagcgggaagaagcgcttctcttcgatagccttgagcagcatcgcctgttcgtcggcgcccagctcgccgatctcgtcgaggaacagcatgccaccgtcggctgcgcgcagcaggccttcgcgcgcattctgcgcgccggtgaaggcgcccttgacgtgaccgaacagtgccgacatcgcgccgtcgccgcgcaaggtggcgcagttgacctcgacgaaacgcccgtcgagctggtgccggctgcgcttgagttcatagatgcgccgggcgaggaacgatttgccggcaccggtcggccccaccagcagcatgggtgcccgcgaacgcacggcgacccgctcgatctgctcgatggagcggttgaaagcggcattgcgcgtggcgattcccgacttgagaaaagccaggctttcctcctgttcgcggcggaaccgcgaggcgatgcggtcgtagcgggacaggtcgaggtcgatcagcgtcgccgagccctcgggatggcgcgcctcgtccttgcgccgcgacggcgaggtctgcaccagccgggccggcaggtagcgcgcctcggtaaggaggaaccagcagatctgcgcgacatgggtcccggtggtgatatgcaccaggtagtcctcgcgctcggtgtcgaaggggtaggcgctgacgaaatcgtgcagggcgccatagacctcctcgaagtcccaggggttgcgcagttccatctgctgcaggcggacctcggtatgcggcgacaccgcggcgatgtcggcgcgaatccgctcggccaggccgaggtcgcgggcgtcgttgccgtggatcagttcgaggcggtcgatcagcaggtccggctgctggcacaggccgatgctcggccgccacttttgccagcgcgccgcgcccttgccgagacggtcgagggtggcgccgatgaagccgatggcgaccgtgcgtttcatcaccgcttatccttcaagataaagatcgatatgaaaatatatagaaatagccaggcatctctccatcgaattcgccgacgaagcgcaataaaaaatttattcacctttaaaatcaaacagttaagcaagaaacagtctcatcgataa

SEQ ID NO: 4094 - DNA, 1257 bp, Pseudomonas aeruginosa
ccgcgccgtcgacaagacggcgcggagcacaaggaaagcacgatgaaagacatgaatatcctcgaagtggccggcggcaagccgatcaagctctggacccagggcgtcccggtggaggaggaagcgcgccagcagttgctgaacacggcgaagatgcccttcatcttcaagcacctggcggtgatgcctgacgtacacctgggcaagggctcgaccatcggtagcgtgatccctaccctcggcgcgatcatcccggccgcggtgggcgtggatatcggctgcggaatgatcgccgcgcgcacctcgctggtcgccgccgacctgccggacaacctgcacggcctgcgcagcgccatcgagcaggcggtaccccacggcaagaccttcggccgccgcgaccgcggcgcctggcacgaggtaccggaggccgccgaccaggcctggaaggcgctcgccggtcgcttcaaggcgatcaccgacaagcacccgaggctggagaagaccaacaaccgccagcacctgggaaccctcggcaccggcaaccacttcatcgaggtctgcctggacgaggccgaccgcgtctggttcatgctgcacagcggttcgcgcggggtcggcaacgccatcggcaacctgttcatcgaactggccaaggcggacatgcgccagcacatcgccaacctgccggacaaggacctggcctacttcgaggaaggcagccggcacttcgacgactacgtggaagcggtcggctgggcccaggattttgcccggcagaaccgcgcgctgatgatgcacgcggtgatcgaggcggcgcgccaggtgatccgcaagccgttcgaagccaacctggaggcggtcgattgccaccacaactacgtgcagaaggagcgccacttcggccaggaggtactggtcacccgcaaaggcgcggtgtccgcgcagaagggccagctcggcatcattcccggctcgatgggggcgaagagcttcatcgtccgcggcctcggcaaccaggaagcgttctgctcgtgcagccacggcgccgggcggaccatgagccggaccaaggcgaagaaggtcttcagcgtcgccgaccaggcgcgcgccaccgcccacgtcgaatgccgcaaggacgccgacgtgatcgacgagatcccgatggcctacaaggacatcgaccgggtcatggaagcccagcgcgagctggtggaagtgctgcacaccctgcgtcaggtggtgtgcgtgaaaggatga

SEQ ID NO: 4095 - DNA, 849 bp, Pseudomonas aeruginosa
cgggcgccctgtggcgcccgctggggaagaatcgaaatgaacagggaagaacgccatccgctccccgccgccatgcgcgagcgggtactggatgagctggaacggatcgaacgcgagcacgacgtagtcgtgctctacgcctgcgagtcgggcagccgggcctggggcttcgcttcgccggacagcgactacgacgtacgcttcgtctatgtgcatcagcccgagtggtatcagcgcgtcgaggaacctcgcgacgtgatagaacgtccgctgagcgacgagctggacatcagcggctgggaactgcgcaaggcgttgcgcctgatgcgcaaatccaacccggccctgctggagtggctcggctcgccgctggtgtatcgggaagagcctggcgtgcgcgaggaactgctctggctgggcagcgcctttcactccgtaccaggcagtcgccatcactacctgtcgatggcacgcaagaactaccggggctacctgaagggcgacagcgtccggctgaagaaatacctctacgtcctgcgtccgttgttcgcggtgcgttggctggatgcaggcctgggcttgccgccggtggcgttcgagaggctagtggaagccacgctggacgatccgtcgctgcgcgaagaactggatgccctgctgagcctcaagcgtcagcgcgacgaatcggcctacggccctccgcgcctggcgctgcaacgcttcatcgaagcggagttgctccaggccgaacgaggggccacccaaccaaccggcgcgcgccaggacagccgactgctggatcgctacctccacgacaagatatggcaatacacaagggaaacctcatga

SEQ ID NO: 4096 - DNA, 564 bp, Pseudomonas aeruginosa
ggatcagcggcggcacccacaatccactggcgccgccggcggactttctccgcgacagctggctgccgctgttgcagcggatgggcgcggaagtcgacctggaactgctgcgccacggcttcgtacccgccggcggtggcgagctgctggcgcgggtacgcccggcacgctggcggccgctgcaactggagcatcccggcgcggcgctgcggcgccaggcgcgggcgctgctcgccgggattcccgggcacgtcggcgagcgtgagctggagagggtccgccagcgcctcggttggagcgacgaagaacgccagctggagttcctcgcggaggaccacgggccgggcaacgccctgctgctgcggatcgactgcgagcacatctgcgcgatcttctgcgccttcggccaggccggcgtcagcgccgaacgggtggcggaacaggtcgcgacgcaagccatcggctggatggaaagcggctgcgcggcggacgagcacctcgccgaccaattgctgctgcccatggccctggccggcgccggcagcttcaccacgccgcggctga

SEQ ID NO: 4097 - DNA, 1194 bp, Pseudomonas aeruginosa
cgcctgataaggagaaaaaaagatgcagtcctcgcaactgctcccgcttggcagcctgttgctgtcgttcgccacgcccctcgcccaggccgatgccctgcacgaccaggccagcgcgctgttcaaacccatccccgagcaggtcaccgagctgcgcggccagcccatcagcgagcaacagcgcgaactcggcaagaaactgttcttcgacccgcgcctgtcacgcagccatgtgctcagctgcaacacctgccacaacgtcggcaccggcggcgccgacaacgtaccgacgtcggtcggtcacggctggcagaaggggccacgcaattcgccgacggtcttcaacgccgtgttcaatgccgcgcagttctgggatggccgtgccaaggacctgggggagcaggccaagggtccgatccagaacagcgtcgagatgcacagtaccccgcagttggtcgaacagaccctgggcagcatcccggaatacgtggacgccttccgcaaggccttccccaaggccggcaagccggtcagcttcgacaacatggcgctggccatcgaggcctacgaggcgaccctggtgactccggactcgcccttcgacctgtatctcaagggcgacgacaaggccctcgacgcacagcagaagaaaggcctcaaggcattcatggacagtggctgcagcgcctgccacaacggcatcaacctgggcggccaggcctacttcccgttcggcctggtgaagaagcccgacgccagcgtgctgcccagcggcgacaagggccgcttcgccgtgaccaagacccagagcgacgagtacgtattccgcgccgcgcccctgcgcaacgtcgccctcaccgcgccgtacttccacagcggccaggtctgggaactcaaggacgcggtggcgatcatgggcaacgcccagctcggcaagcagttggcgccggacgacgtggagaacatcgtcgccttcctgcacagcctgagcggcaagcagccgcgcgtcgaatatccgctgctgccggccagcacggagaccacgccgcgtcccgcggaataaccgccacaaggaaaaacggggctcccctggagccccgtttttcctctatgggacgacctcagaccacgccctgcgccagcatcgcatcggcgaccttgacgaagccggcgatgttcgcccccttcacgtag

SEQ ID NO: 4098 - DNA, 447 bp, Pseudomonas aeruginosa
aggatgccggcctcgaggaacaggtcgacggcttccagggtcgagggcatgttggcgccttcggcgacacagacgcagccgttggccagcaggcgccgcgcatcctcggcatccagttcgttctgggtcgcgcagggcagcgcgatatcgcaggccaggccccagggccggcgcccttcgaggaactgcagggaaaactgctccgccatctcgcggatgcgcccgcggcgcacgttcttcagctccatcaggtattcccactgctcgtcggagagccccgcctcggcatacagggtgccttcggaatcggacagcgagatcaccttgccgcccatttccatgaccttgcgcgccgcgtactgggcgacgttgcccgagccggagatcgccacccgctggccgtcgaagccgcggccacgatccttgagcatttcctgggcgaagtag

SEQ ID NO: 4099 - DNA, 669 bp, Pseudomonas aeruginosa
gcgtcctggcggacaccctcccccagaccgttttccatgtgcgaacgaggttctgcgccgcttccggcggaaactccctcggacctgccggcccgcgaaggacgcctggcagcgggagcgcgaaaccgctggcgccgagggcgccagcggcagcccggattacgggttgactacgaaggccggggtcggcttcacgctcaggctgttgatcttgcagttgcctgccagcgactgattgctggcgctgagggtgttggtggcgttgctccaggaaccgttgacggtgctcgggccacaggtagaggagagaatcttgaagccgacgccatcgaccttgccggcggtggtgctggaaacggtcagcttccacggcaggccggtcatctgcggcacgctgcacagggtgttgctgccgctgacggtgacgctgtcgatcgaggcataggagccatcggcggcggtcttgcccttgaaggtgatgttgcaggtcactggcagattgagcgacgccggcgagctcacgctgatggtgccaggtgcggtgaaggccgagttgaccggggtgatggtggccgcgctggccatggacgaaacgctcaggcagagagcaagagcagcaaaggacggcagggacttgatggatttcattgttttgtatccttccagtga

SEQ ID NO: 4100 - DNA, 1347 bp, Pseudomonas aeruginosa
cggggcgtacctaccagaattggcagctcgcgaagcgacccagccaacccaaagttaggttgccaactatcggtcggacgaggacggcacgcgaacgagacccggctgcaactcgaacacctccacgccctccggcgtggagcgtccgatcttgacctgttgcgccatcacgctggcgccgggagcctggcgaaagtccacgaacagccggtcaccctcgtggcgtatcgcctccggcggcacgacgatggcctgttctttgcgataggtggtgaccgtcagcttggcgctcattcccagacgaatcttctgcaactggcggggatcaagcggcgctaccgacaccgtcacctcgaactgcgggctgcctccctgggccatgccgggcagagcctgaccaccgagggcggcgatgacgcccgccagcgtggtgccctcgaagccgtcgccactgatttccaccgcctgcccttcgcgcaactggttgatatccagttcggaaaccttcgcagataccttcagccgctcgacgctggccaggccgaacaacgcctggccctgccccagcttgctaccggcctgcaccggttcgcggctgccctgctcgccagccaggccgggcgccgcgacgacgataccggcaaagggcgcgcgcaccgtacggccatccagctgggcctgcagcgtctcgtatttcacgctggcgttggccaggtccatttcggcgatctggcgattctcgccctgccccttggcgcgggtcgactccacttcccgccgggccgcctccaggtccatgcgctgctggctggcctgttgttcgagatcgtcgagttcgttgcgcgggacgatcccgcgctggaacagctcgcgggtctcgcgcaacttgcgctcggtgctgctctgcgccagctgcgcgctgcgcagggcacgacggacccgcgccatgtcctcgccacgctcccagtcgcgcaggtcctgcagggtgcgacgggccttgagcaacgccgactgtgcctcgcgcacctgcacggcgatctcgcgggtgtccatgcgcagcagctcctgtccttccgcgacccgctgtcccggctccaccagcagcgcctcgacattgccggcgaagggcgccgccagggtcaccacgcgccccggttccaggcgtccgaccaggccgatctgatgcaccagcggggccgcccgtacggcgacccagcgctccccttccgtgcgtttcgcggtgccgccggcgaggaccagccaggccagcgccgcgacaaccgccaggccggcggcgagcgacaatgccggccggcgcaggaaggaaaaccggtcagtggtcattga

SEQ ID NO: 4101 - DNA, 360 bp, Pseudomonas aeruginosa
ggatttcacgcttgggcggaacgatcttgccgacccgatgcatggtgtagacgtactgagccaaaacgagcacctcatgaagaaaaggaaaaaaactcggccaagtatatgacagaccgagagaaagctggccagccaccccggttttcgtggggcggggcgctttgccggcggatgttcgccgtccgattccaggccgctacggtgacgctgagcagcgtactggccgcccttactgtctccgctaccctcgtcctgtcaaaggcgttctgcctgagcgaggcggcgaccatcgccccgtgcgaggtctgggtgggcctggcactgctcgcggccatggtgctgccgctcaagacctga

SEQ ID NO: 4102 - DNA, 2019 bp, Pseudomonas aeruginosa
cgcgaagcaaggcgtggggagatccagcctgctacaattgatccaaatcagtctcaaaagaacaaaaaaaacctcaaaaatgacactcgctcccagatccgcccagctacccgactccccgcacagggacagtctcgacccagcgccaaccccgtcgtctcaggaccagcgcctgctcaaggccctggccaccgcgatggtcaatcatccgcgcgccaccatgggagaactggcggaactggcaggagtgagcagggcaaccctgaaccgtcattgcggtacccgcgaaggtctcaagcggcgcctggaaagccatgccaggagtaccctcgaacgcctcacccacagcgccgccctgcagcggctggagccgcgggaagcgctacgcgagctgatccgggaacacctcgcccagcgcgacctgctggcgctgctgatgttcgagcagaacccgggacgccaggccgggcatggggacgccagttggcagtcctatgtcgaagccctggacgccttcttcctgcgcggccagcagaagcgtgtgttccgtatcgatatcagcgcggcgaccttcagcgaactcttcatcgtcctgatctacggcatggtcgatgccgagcgccgcggtcgcgcggccagcgccgggttgtccgccacgctggaggagctgttcctgcgtggcgcgtcgaaccccgcacaacctgccagcccttgagcgggcggcagttgccacccgctagcaccgtttcccacacgtttacccgctcaactcctgccgcctcgatgtaccaccaggctccgtccctcgtcccagcctccgccgagcgcgcggaacaggtcgaccagggcgatctgccgctgggtgctgccgtcgatgaaggcgatctcgttgaggaagctgctgcgctgcgcatcgaggtagcgcaggtggttgtcgacgccactctcgtagcgtgccttggccagcttcagggcttcgttgctgctgttcgccagggcgcgcagggccttctcttcgcgacgcagggtatcgctggccgccagggcgtcggcgacctcgcggaaagcggtctggatggtcccctcgtaggcggccaccgccgaatccttgcgcgcctcggccaggctcaggttggcacggttgcgcccgccatcgaagatcggcagcgtcagcgtcggcaggaagctccaggagcgcgagccgccatcgaacaggccggacatttccgcgctggaggtgccgaagctgccggtcaggctgatgcgcgggaagaacgccgcgcgcgccgcgccgatatccgcgttgcgcgcccgcaaacgatgttcggcggcaaggatgtccgggcgtcgctcgatcagctcggacggcgtgccgggagcgatgtcctgcagcagcttcggccgctgccccggactccgcggaatcgcctgcgcggcatcgtcgctacccagcagcaacaccagcgcgttgaatgcctgctgtttctgccgcaggttgcgctcctgctcggcgcgcgcctgctccaccaggccaagggcttcctggtagtccagcgcggtggcggcgccggccgcgcggcgctggtcgatcagggcgaaggaatactcgcggctgaccagggtctgacgggtcagcgccaggcgccgcagggcgccgtcatagctcaggtaggcctggctgacctcggcgaccagggcgatccgtgccgcgcgcgctgcctcctcgctggccaggtactgttgcatggctgcgtcggtcaggctcttgacccgaccgaagaggtccagttcgtactccggcagggccagcccgacctggtagctgctggccacttccgagcgattgccggcggacaggtcggccggctgccgctggcggttgccggtggcagcggcgttcaggcccggaacccggtcggcgcgctggattcgatactgcgcgcgggccgcctcgatatccaggagggtctggcgcaacgagcggttgttatccagggccacgtccaccaggcggcgtag

SEQ ID NO: 4103 - DNA, 597 bp, Pseudomonas aeruginosa
tcgatgatcggcctcaacaccgctgctatctatatcctccagaccctcggcagcctctacctgctgatcgtgctgctgcgcttcatcctgcagttggtccgcgcggacttctacaaccccctcagccagttcatcgtgcgcgccaccaagccgctgctgaacccgctgcggcggatcatccccggcttcggtgggatcgacctggcctcgctggtgctggcgatcctgatccaactggtgctgatgatcctgatcctgatgctgatgggctacggcgtcggcggcttcatcatgcaactgctgatctggtcgatcatcgccgtcacctcgctgttcctgaaggtgttcttcttcgccctgatcatcagcgtgatcctttcctgggtcgccccgggcagctacaaccccggcgcgcaactggtgaaccagatctgcgaaccgctgctgatgccgttccgcaagctcctgccgaacctcggcggactggatctctcgccgatcttcgcgttcctcgcgctgaagctgatcgacatgctggtgatcaacaacctggcggccatgaccggcatgccccagcagttgagcatcttcctctga

SEQ ID NO: 4104 - DNA, 2181 bp, Pseudomonas aeruginosa
tccacgccatccttcccccgccggtcccgcgccctggagcccctggatgagcatggaaagactcagccatcaaatcgacgcctacgtcgcctggaagcgcgagctgatgcgggaaatcacccgctatcgcggctggctggagcgcagccggctgaacagcccggcggtcgaggccaagctcgaacgcgccctgcgccaactacgcgcggaccacatcaccctggccttcgtcggcgagttctcgcgtggcaagaccgagctgatcaacagcctgttcttcgccggctacggccagcgcatgctgccgtcccacgccgggcgcaccaccatgtgccccaccgagctgttccacgatccgcgcgccgagcgcagctacatccgcctgctgccgatcgagacgcgcctggccgacgccagcgtcgcccagttcaagcgcgtgccgcgccactgggtgaacattccgctggacaccggcgacccggagggcatggcccaggccttcgcccaggtcgccaagaccaaggcgctgccggtggaacaggcgatccagctcggcttccacccggatgccctggaagccgccgacgagcccgaccaggtgcgcgtcccggcctggcgccacgccctggtcaacttcgaccacccgctgctgcgccagggcctgcggatcctcgacacgcctggcctgaatgccctcggcagcgagccggagctgaccctgtcgatgctgcccaacgcccaggcgatcctgttcctgctgtccgccgacgccggtgtcaccgcctcggacatggatatctggcagaagtacatccagccactgcgcgaggacggccacagcagcctgttcgccgtgctgaacaagatcgacgtgctctgggacgacctttccggcgagcgcttcgtacagaacgccatccgcctgatccaggacggcacggcccgccagctcggcctgcagcgcggcgacgtgctgccgctgtcggcgaagcaggcgctgctggccaaggtccgcggcgaaccggcgctgctcgaacgcagtcgcctggatcggctggaagcgctgctctgcgagcgcatcgtcgcgcagaaggaagcgctgctggagaactccgtgctcggccaggtccttggcctgctgcacaacagccagcatctgctgcgcctgcgcctggagaaggtcgaggaacagcgcgcgctgctcgacgacaagcagcgcgacagcggccaactgctgttcgaactgaccgcgaagaccaaggacgaccacggccgccaccaccgccgcctgctcaacctgaagaccaaccagcgcctgctgcagcaccagggcgcgacgctgcgcgagacgatccgcagcgaacgcatggaacagcacctgcagaaggtgcggcgcaacctcaacggcagcctgaccacggtcggcatcaaccaggcgatcctggcgttcttccgcgcggtggagcacgacctcgacaacctcgagcacgaggccggcatggccaaccgcatggtcgccgccatctaccgccggcacaacgaggagaacccgctctacgccctcgacgcgccgcagctacgggtccagcgctaccagcgcgaactgttgcaactgaagaagaagggcgaccagttccgcctgcagctgaagaccgtgcttaccgagcaacgcctgctgacccggcgcttcttcgccaccctggtgcaggaggtggtcggcctgcaccagcgcctgcgcgaggaaaccgagcgctgggccaacgacgcgctgatgccgctgatgcagcacaccctggaaaacaaacagttgctcgaaagccacatgctccgcctcaagggcctggcccaggagacccagcaggtacgccagcgcagccaggccttcgccgggttcgccggggaattgcaggaacagttgcgcgaagccggcgacatcctccgccagttgcgccgcccctcgcccctgcagcgccaggccaaggtggtcaacctgcccggctcgcagcgcgcctgaccccgctcccacggcgcgcgccagcgcgcttgccgctgggggcgacgctctttagactggcgccctcctttgttcgagagcagggtcgatgcccacagtcttccccgacgactccgtcggtctggtctccccccagacgctgcacttcaacgaaccgctcgagctga

SEQ ID NO: 4105 - DNA, 489 bp, Pseudomonas aeruginosa
tctgccacgccctctccggccaccaccacgccgccggctaccacagcgtcgacgagcgcaagccgggctggtgggacagctgcatcggtccgggcaagccgatcgacacccgcaagttcttcgtcgttgccctcaacaacctcggcggttgcaacggttccagcggccccgccagcatcaatccggcgaccggcaaggtctacggcgcggacttcccgatggtcacggtggaagactgggtgcatagccaggcgcgcctggcagaccgcctcggcatccgccagtgggccgcggtggtcggcggcagcctcggcggcatgcaggcgctgcaatggaccatcagctaccccgagcgcgtccgtcactgcctgtgcatcgccagcgcgccgaagctgtcggcgcagaacatcgccttcaacgaagtcgcccggcaggcgattctttccgaccctgagttcctcggcggctacttccaggaacagggcgtga

SEQ ID NO: 4106 - DNA, 645 bp, Pseudomonas aeruginosa
accgcatcagcgtgtgaggatccgatgcgcgccgatctcgaaatcatccaggaatggattcccgccggcagccgcgtcctcgacctcggctgcggcgacggcgaactcctggcctggctgcgcgaccacaagcaggtcagcggctacggcctggagatcgatcccgataacatcgcccgttgcatcgaaaacggggtgaacgtgatcgagcaggacctcgacaagggcctgggcaacttcgccagcgacagcttcgacgtggtggtgatgacccaggcgctacaggccgtgcactatccggacaagatcctcgaagagatgctgcgggtcggcaagacctgcatcatcactttccccaacttcggccactggcgctgccgctggtacctggcgcgcaacggccggatgccggtctccgagttcctgccgtatacctggtacaacacgccgaacatccatttctgcaccttccaggacttcgagcgcctgtgccgccagttgcgcatgcgcgtgctcgaccgcctggccgtggaccgtgaccaccggcatggctgggccagccggctgtggcctaatctattgggtgagattggaatctaccgggtcaccggacccggagtgcagacccgcaacctcgccgtctag

SEQ ID NO: 4107 - DNA, 855 bp, Pseudomonas aeruginosa
ccggcaaggtcatccccctggagttccgccgagtcagcgaggaaggcgccatctacaacctggcgcaattcccgatcagccagcgcgagaccctggtcttcaccatcaaggtcgaggccaagggcgaacctgcgcaaaccttcagtttcaacaaggaaatcttcccggacgaatgatcaagctcgaacagctggtgctggccagccacaatgccggcaaactcaaggaactccaggccatgctcggcgccagcgtgaaggtgcgctcgatcggcgagttcagccaggtggaaccggaggaaaccggtctttccttcgtcgagaacgccatcctcaaggcacgcaacgccgcacgcctctccggcctgccggcgctggccgacgactccgggctggcggtggacttcctcggcggcgcgccgggcatctactcggcgcgctatgccgacggccggggcgacgcggcgaacaacgccaagctgctggaggccatgaaggatgtcccggacgccgagcgcggcgcacagttcgtcagcgtgctggcgctggtgcgccacgccgacgacccgctgccgatcctctgcgagggcatctgggaaggccgcatcctccgcgaagcccgcggcgcccacggcttcggctacgacccgctgttctgggtgccggaacgcgactgctccagcgccgagctggcgcccgaggagaagaaccgcctcagccaccgagcccgcgccatggccctgctcaagcagcgcctgggtctctgagccgcaaccgtcggcgccgcccccgggcggcgtcggcacggcgtttcgtccggccgccttggaggttggccgaactcatgccacgatag

SEQ ID NO: 4108 - DNA, 1224 bp, Pseudomonas aeruginosa
cgccccgaaaccgcctccaccccgccccaccgtgacccaagccaccccgttccagctcccgcccctggccctgtacgtgcacatcccgtggtgcgtgcgcaagtgcccgtattgcgacttcaactcccacgccgctggcccggagctgcccgaagaggcctatgtcgacgccctgctcgccgacctggagcaagacctgcgccatgtccacggccggcgcctgggttcgatcttcttcggcggcggcacgcccagcctgttctcggccaaggccctgggccggctactggaaggcgtcgagcgcagggtcggcttcgccgacggcatcgagatcaccctggaagccaatcccggcaccttcgaacaggtcaagttcgccgactaccggcgcctcggcatcaatcgcctgtccatcggcgtgcagagcttccaggccgacaagctgcaggccctggggcgcatccacgacggcgccgaggcagtgcgcgccgccgacatggcgcgccaggccggcttcgacaacttcaacctcgacctgatgcacggcctgcccgggcagagcctcgacgacgccctggccgacctgcgccaggccctcgccctggcccccacgcacctctcctggtaccaactgaccatggagccgaacacggtgttctggagccagccgccggagctgcccgaggacgacatcctctgggacatccaggaagccggccaggccctgctcgacgagcacggctaccgccagtacgagacctccgcctacgcccgcgacggcctgcacgcccggcacaacctgaactactggagcttcggcgacttcctcggcatcggcgccggcgcccacgccaagctgagcgcgccggacggacgcatcgtgcggacctggaagacccgcctgccgaaggactacctcaacccgcaaaaggccttccaggccggcgagcgcccgctggaagcggccgacctgccattcgagttcatgatgaacgtgctgcgcctggtcgacggcgtccccgccgcgctctacccacagcgcaccggccagccactggcggcgatcgccgatgcctgcgccgccgcgcgcgacgccgggctgctcgccgacgacccgcagcgcctgcgccccagcgaacgcggccagctgttcctcaacgacctgctgcaacatttcctgccgtgacgacggatgcacgcccatccgtgccggcaggcaggtaa

SEQ ID NO: 4109 - DNA, 366 bp, Pseudomonas aeruginosa
actccgccgaccgacacgccgattcgttacaaggaaccctcgatggattacgcgctggacctgatcgccaccctgtcgcgctggagccgcagccacctgtcggacatttccctggccatcatggccaccctgctggtgctgttcggcccggcgatcaacgcctgggtacagcagcgcatcggcagcctcaacttcgtcttccgcaccctgctgttcgtgttgatctgcgcggtcggctacggcctggcgatggtcttcgtcaccccctggctggccaagggcctcggctacttcaacaactacaccctggcgcccgtgctcctgctagtgttcttcgtgatcggcatgatcgccgatcgcagctga

SEQ ID NO: 4110 - DNA, 513 bp, Pseudomonas aeruginosa
agctttcgccggccgcgcagcgctggcgcagccgctcgacgtccattatctcgctcatcggcattcgtccctggagcccgtgaaaagacgccaaggatatcccgaagtggtgttcaggcgcgtatctgcgcccagtccaggccgaaacgcgccaggtacttgcgcagccggtcggcgtcgttggggttgcgcttgtcctggcgcgaaacggcgaacagccggcgtcccgcctcggaaagggtcttagccccgcggcacacctccagcaccgcctgcagttgcaggcggtcgaacagatccagggcctccacccgctgccccagcagatcggccagtggctcccggcccgcatcgagcccccaggcctggcgcaggcggaggatctcctcctcgaccagcgcctcgtcgatccgcccgctgtcggccagggtcgccatccgtgtgatggaagccgacagctcgcggaagttgccggcccagcgcgcttcgctggaaccggcgaaggccaggtag

SEQ ID NO: 4111 - DNA, 405 bp, Pseudomonas aeruginosa
cgacgcttggcctccaggttgaaacgcacctgccgcccttgctcgcgggcgtgccgctccagttcgaagtcgatgttcggctcgatgtcctcgcggcgtccagccaggcccggcagctcgaaggtccacaggttgatgcgggcgaacaggtcctcgcggaacaggccttcggccactcgtccgcgcaagtcgcggtgggtcccggcgataagctggaagtcgctctccacctcacggtccgaacccagcgggaagaagcgcttctcttcgatagccttgagcagcatcgcctgttcgtcggcgcccagctcgccgatctcgtcgaggaacagcatgccaccgtcggctgcgcgcagcaggccttcgcgcgcattctgcgcgccggtgaaggcgcccttgacgtga

SEQ ID NO: 4112 - DNA, 1209 bp, Pseudomonas aeruginosa
agagatgaaaatgctgaagcgctttatcgtgaagaagaacgaacgcggcctgctgtattccgaaggcgacttcctcgccgtgctcgaaccgggcacctaccgccgcttcgatccgtacgaccgcctgagcctggaaagcttcagcctgaacaccccgcagttcgaacaccgcctggccggctacctgcggcagagcgaaccgcagctggtggagcgctacttcacccggatggacctgggcgacaacgaggccggcctgcgctacgaggacggcgtgctggtggagttgctcgcaccgggcagccgccgactgtactggaaaggccagaccgagcagcgcctggagcgcatcgacctgacccaggactatcgattgtccgccgcgctggtcgcccagttgcaccagccgaacctgcgcgaccgcgccctggcgggcctggacgcagtgttgctggtccaggtgccggcgttccaggtcggcgtgctcaaggtcgacggcgcccttgccggcctgctgcaagctggacaatacggtttctggcgctacaaccggcaagtcagcgtggaactggtcgacacccgtatccaggcgctggaggtcagcggccaggagatcctcacccgcgacaaggtcagcctgcgcctgaacctcgccgccaattggcgctacagcgacgtgctcaccgccttctcgcggctgagcaaaccgctggagtatctgtaccgcgagctgcagttcggcctgcgggcggcagtgggcacccgtaccctcgacgaactgctggagaacaagcagtcgatcgacgaagcggtcagcgcccacctggccgccaagctggaagacagcggcctggaagtgagcggcctgggcgtacgcgacatcatcctcccgggcgaaatgaagaccctgctggcgcaggtggtggaggcggagaaggcggcccaggccaatgtgatccgccgccgcgaggaaacctcggcgacccgctcgctgctgaataccgcgaaggtcatggaggaaaacccgaccgcgctgcgtctgaaggaattggaaaccctggagcgggtggccgagcgcatcgaccggatttcggtattcggtggcctggaccaggtattgaacggactggtcacgctgaagcaggcctgatcacgaacgatagccgcgccgtcgacaagacggcgcggagcacaaggaaagcacgatga

SEQ ID NO: 4113 - DNA, 501 bp, Pseudomonas aeruginosa
tcgccgcgcgcacctcgctggtcgccgccgacctgccggacaacctgcacggcctgcgcagcgccatcgagcaggcggtaccccacggcaagaccttcggccgccgcgaccgcggcgcctggcacgaggtaccggaggccgccgaccaggcctggaaggcgctcgccggtcgcttcaaggcgatcaccgacaagcacccgaggctggagaagaccaacaaccgccagcacctgggaaccctcggcaccggcaaccacttcatcgaggtctgcctggacgaggccgaccgcgtctggttcatgctgcacagcggttcgcgcggggtcggcaacgccatcggcaacctgttcatcgaactggccaaggcggacatgcgccagcacatcgccaacctgccggacaaggacctggcctacttcgaggaaggcagccggcacttcgacgactacgtggaagcggtcggctgggcccaggattttgcccggcagaaccgcgcgctga

SEQ ID NO: 4114 - DNA, 558 bp, Pseudomonas aeruginosa
cgccctgagcctgtcgatgaccagcggccagccgctgcgcatccgcaacatccgtggccggcgcagccgtccggggctgctgcggcagcacctcaccgcggtgcgcgcggcggcggaaatctgcgcggccgaggtcgagggtgccgagctcggctcacgcgagctggcgttccggcccggtgcgatccgcgccggcgactacgccttcgccatcggctccgccggcagttgctcgctggtactgcaaaccctgctgccggcgctgctcgcggccaacggcgaaagccgggtgaggatcagcggcggcacccacaatccactggcgccgccggcggactttctccgcgacagctggctgccgctgttgcagcggatgggcgcggaagtcgacctggaactgctgcgccacggcttcgtacccgccggcggtggcgagctgctggcgcgggtacgcccggcacgctggcggccgctgcaactggagcatcccggcgcggcgctgcggcgccaggcgcgggcgctgctcgccgggattcccgggcacgtcggcgagcgtga

SEQ ID NO: 4115 - DNA, 453 bp, Pseudomonas aeruginosa
actcgcgccggacctgtcagcgggcccggcgcgaatctccgggagccccatcccggcggtcgaggagtcccggccatgtcttcttcgcgtctcggcgtgcttgtcctcgccctgatcctgctcaccgccaccctgctcggcggctgcgaaagcacccaccagtacctgctcgccaagggctacccgcccgcctatgccgacggtttcgacgatggctgcggtagcggccgccaggcggccggctcgatcagcggcgaattccgcaaggacgtcccccgctacctgcgcgaggcgatctacgccagcggctggggcgacggcttcgagcaatgccggtcgatggcgcggagcgaagagcggcggcgtttcgaggagcgccagtgggacgaccgcgacgacgattggcagcgcgaccgcgaccgcgcgttggcccgggccttgcgcgagcgctga

SEQ ID NO: 4116 - DNA, 1053 bp, Pseudomonas aeruginosa
ggagaaaaaaagatgcagtcctcgcaactgctcccgcttggcagcctgttgctgtcgttcgccacgcccctcgcccaggccgatgccctgcacgaccaggccagcgcgctgttcaaacccatccccgagcaggtcaccgagctgcgcggccagcccatcagcgagcaacagcgcgaactcggcaagaaactgttcttcgacccgcgcctgtcacgcagccatgtgctcagctgcaacacctgccacaacgtcggcaccggcggcgccgacaacgtaccgacgtcggtcggtcacggctggcagaaggggccacgcaattcgccgacggtcttcaacgccgtgttcaatgccgcgcagttctgggatggccgtgccaaggacctgggggagcaggccaagggtccgatccagaacagcgtcgagatgcacagtaccccgcagttggtcgaacagaccctgggcagcatcccggaatacgtggacgccttccgcaaggccttccccaaggccggcaagccggtcagcttcgacaacatggcgctggccatcgaggcctacgaggcgaccctggtgactccggactcgcccttcgacctgtatctcaagggcgacgacaaggccctcgacgcacagcagaagaaaggcctcaaggcattcatggacagtggctgcagcgcctgccacaacggcatcaacctgggcggccaggcctacttcccgttcggcctggtgaagaagcccgacgccagcgtgctgcccagcggcgacaagggccgcttcgccgtgaccaagacccagagcgacgagtacgtattccgcgccgcgcccctgcgcaacgtcgccctcaccgcgccgtacttccacagcggccaggtctgggaactcaaggacgcggtggcgatcatgggcaacgcccagctcggcaagcagttggcgccggacgacgtggagaacatcgtcgccttcctgcacagcctgagcggcaagcagccgcgcgtcgaatatccgctgctgccggccagcacggagaccacgccgcgtcccgcggaataa

SEQ ID NO: 4117 - DNA, 462 bp, Pseudomonas aeruginosa
tgccgtgcagcttggtatccacctcgccctcgctccaacgcaggcgcatggcgttctgcgacatctccaggccgctcaccgccaccccgccggcgttcgacgccttgcccggcgcgtagaggatgccggcctcgaggaacaggtcgacggcttccagggtcgagggcatgttggcgccttcggcgacacagacgcagccgttggccagcaggcgccgcgcatcctcggcatccagttcgttctgggtcgcgcagggcagcgcgatatcgcaggccaggccccagggccggcgcccttcgaggaactgcagggaaaactgctccgccatctcgcggatgcgcccgcggcgcacgttcttcagctccatcaggtattcccactgctcgtcggagagccccgcctcggcatacagggtgccttcggaatcggacagcgagatcaccttgccgcccatttccatga

SEQ ID NO: 4118 - DNA, 1404 bp, Pseudomonas aeruginosa
attgtcgccaccgccctcgctgtagcggtcgcggatctggctggcgccgcccaccagcgagacatcccacaggcgctggttcttcgccagcaccaggttgaggtcggcctggcgactgccgatcaggcgttgcaggtattccggttgctgctgcagggcggtcctgatcgcctgctggcggtcgacctcgatcggcgtggcggccagcgcatcgctggcgcggatttgcgtcgacaggtccagcgccagcagttgcagcagggccaggcgtgcgctgtcgacctggttggtggactcctcgacattgagctcctggctggcgacgtcggcctcggtctgcacgatctcgaattcggccattcgcccggcgcggatcatcgcccggttgacctcgagcagctcctgggtccgcgccagggcttcgcgagcgatgcgcgcctgctcctgggcgcgcagcagctcccggtaggcgccgatgacctggctgatggtctgcgacacgctggccttgagttgcaggcgattggcgtcttcggagagacgtgccaggcgcagcggcgcggtggtgacgtcccagcccgcatcgcgcagcaacggctggacgacggtcaggtcgaggccatcgctgcggtagcgcccggcctcgtcggcggtgcggaactgcttgacccaggccaggctgaagcgagtgccatattcgccaagcagggtcgcggtgggcgagacattgctggtcctcgtgcggtcttcggtggcgcggttggcgcgatagtcgccgcgcaccaccagcttcgggttgaaggcgtcggcggcgacgcgcaggtcgaacttctgcgcgatccgttgcaggtaggcgctacggattccacggttgttgcgcaggccaagatagaccgcgtcgctcaggctgaggtcgatcacctgctcgctgagcagcaccgacctgccctgctcgcgggccatgctcggtacgtccggactcagcgccgggttgacgctggccgccaccggaagagcggtgaccagccacagcacgcccaggccccacctattcatcgcgcagcgcctcgaccggttgcaggcgagccgccgagaccgccggatagagcccgaagaacagccccaccagcagggtactgcccatccccagcggcagggccgcgtaggccagggagaaggtccagccggagaacctggcgtagagatacgcagccgccacgccgagcaccgcgcccgagagcgcgcccgcggcggtcagggtcaccgcctcgatcaggaacaggttgcggatgtcccgctggcgcgcgcccagcgccatgcgcacgccgatttcccggcggcgttcggcgacactcatcagcatcacgttcatcactccgacgccgccgccgagcagggagatga

SEQ ID NO: 4119 - DNA, 966 bp, Pseudomonas aeruginosa
cgatacccagcaacgccagcagcgagcggcgccccagcccgcgaagactggcgagggcctcgtgaagcaattgccggggcgacgggctggcgctcaccggcaggcctccgccaggtcctcgtgcacctcgccatgccgcactgtcagttggcgcccgagacgggcggccaggctgggatcatgggtgaccaccaccagggtcacctggcgctcgcggttgagggtgaggagcagctccagcacttctttcgcggtgctcgcgtcgaggttgccggttggttcgtcggcgaggatcagcgccggctcgccgaccagcgcgcgagcgatggcgacgcgctgccgctggccgccggaaaggtccgccggacgatggccggcgcgctcggccaggccgacccgggcgagcatcgcctcggcccgctccagtgcctcgcggcgcggcatccctcgatagctcaggggcagcgcgacgttgtccagcgcgttcagccgcggcaacaggttgaagctctggaagacgaagccgatcaggcggttgcggatcgccgccagtcggtccccgtcgacgctgaagatgtcgtgctcggcgaagcggtaggcaccgctgtccgggcggtcgagcaggccgaggatattcagcagggtgctcttgcccgagcccgacgcgccgacgatcgcgcagctttctccgggaaagatgtccaggcagacgtctttcagtatctgcagcggctgcccccccaggaggtagcccttgccgatcccccgcagggagatcaatggttcgtgcttgtttgttgttggcattcgcacccgaccgctcgcatcccttcaaggcccgcccggtcgtaccgccgcaaggccggcgatacaggccgaacggccatactgctgatgatggagacagcgcacaagccgccaccaccggcaacgataccccgaggcgccagcgccgagcgaaggtag

SEQ ID NO: 4120 - DNA, 1761 bp, Pseudomonas aeruginosa
aaaaaccgccggccggcaacgccggcgggcggtttctcgagggcgcgcttacgccagtttcttgtagcgcacgcggtgcggctgggccgcggcgtcgcccaggcgcttcttgcggtccgcctcgaactcggtgtagttgccttcgaagaaggtcaccttgccatcgtcctcgtaggagaggatgtgggtggcgatccggtcgaggaaccagcggtcgtgggagatcacgatggcggagccggggaagtccagcagcgcctcttccatcgcacgcagggtttccacgtcgaggtcgttggacggttcgtcgagcagcagcacgttgccgccctgcttcagggtcagggccaggtgcagacggccacgctcaccgccggagaggtccttgacgaacttctgctggtcggcgcccttgaagttgaagcgaccgacatagctgcgcgacgggacttcgtagttgccgatcttgatctgctcgaaaccgtcggaaacctgctcccacacggtcttgttgccttccaggctgtcacggctctggtcgacgctggcgatctgcacggtctcgccgatctcgatggtgccggagtccggctgctccttgccggtaagcatgcggaacagggtcgacttgcccgcgccgttgccgccgatcacaccgacgatggcgcccttgggaatgctcagggacaggttgtcgatcagcacgcggtcgccgtagcccttggtcacattgtgcagttcgatgaccttgtcgcccaggcgcggaccggccgggatgtagatctcgttggtctcgctgcgcttctggaattcctgcgactgcagttcctcgaagcgctgcaggcgcgccttggacttggcctggcggcccttggcgccctggcgtacccactccagctcggccttcatggccttggcgtgggaggcttcctgcttggcttcctgggccaggcgggcggccttggattccagccagccggagtagttgccttcgaacgggatgccatggccacggtcgagttcgaggatccagccggcgacgttgtcgaggaagtagcggtcgtgggtgatcgccaccacggtgccggggaagtcgtgcaggaaatgctccagccaggccaccgagtcggcgtccaggtggttggtcggttcgtccagcagcagcatgtcgggagccgacagcagcaggcggcacagcgctacgcggcgcttttcgccgccggacaggtgctcgaccttggcatcccacggcggcaggcgcagggcgtcggcggcgacttccagctggcgttccaggttgtgtccgtcggatgcctggaggatcgcctccagcttggcctgctcggcggccagggcgtcgaagtcggcatccggctcagcataggcggcatagacctcgtccagccgcgcctgggcctgcttgatctggccgacggcctcttcgacgatgtcgcgcacggtggcctgcgggtccagcttgggctcctgcggcaggtagccgacgttgatccccggcatcggccgggcctcgccttcgatctcggtgtcgacgccggccatgatccgcagcagggtggacttgcccgcgccgttcaggccgagcacgccgatcttggcgccggggaagaacgacagggagatgtccttgaggatttcacgcttgggcggaacgatcttgccgacccgatgcatggtgtagacgtactgagccaaaacgagcacctcatgaagaaaaggaaaaaaactcggccaagtatatga

SEQ ID NO: 4121 - DNA, 798 bp, Pseudomonas aeruginosa
gcgaggcggcgaccatcgccccgtgcgaggtctgggtgggcctggcactgctcgcggccatggtgctgccgctcaagacctgacgcgaagcaaggcgtggggagatccagcctgctacaattgatccaaatcagtctcaaaagaacaaaaaaaacctcaaaaatgacactcgctcccagatccgcccagctacccgactccccgcacagggacagtctcgacccagcgccaaccccgtcgtctcaggaccagcgcctgctcaaggccctggccaccgcgatggtcaatcatccgcgcgccaccatgggagaactggcggaactggcaggagtgagcagggcaaccctgaaccgtcattgcggtacccgcgaaggtctcaagcggcgcctggaaagccatgccaggagtaccctcgaacgcctcacccacagcgccgccctgcagcggctggagccgcgggaagcgctacgcgagctgatccgggaacacctcgcccagcgcgacctgctggcgctgctgatgttcgagcagaacccgggacgccaggccgggcatggggacgccagttggcagtcctatgtcgaagccctggacgccttcttcctgcgcggccagcagaagcgtgtgttccgtatcgatatcagcgcggcgaccttcagcgaactcttcatcgtcctgatctacggcatggtcgatgccgagcgccgcggtcgcgcggccagcgccgggttgtccgccacgctggaggagctgttcctgcgtggcgcgtcgaaccccgcacaacctgccagcccttga

SEQ ID NO: 4122 - DNA, 2037 bp, Pseudomonas aeruginosa
cgctcccccgctcccccgcataatccacgccatccttcccccgccggtcccgcgccctggagcccctggatgagcatggaaagactcagccatcaaatcgacgcctacgtcgcctggaagcgcgagctgatgcgggaaatcacccgctatcgcggctggctggagcgcagccggctgaacagcccggcggtcgaggccaagctcgaacgcgccctgcgccaactacgcgcggaccacatcaccctggccttcgtcggcgagttctcgcgtggcaagaccgagctgatcaacagcctgttcttcgccggctacggccagcgcatgctgccgtcccacgccgggcgcaccaccatgtgccccaccgagctgttccacgatccgcgcgccgagcgcagctacatccgcctgctgccgatcgagacgcgcctggccgacgccagcgtcgcccagttcaagcgcgtgccgcgccactgggtgaacattccgctggacaccggcgacccggagggcatggcccaggccttcgcccaggtcgccaagaccaaggcgctgccggtggaacaggcgatccagctcggcttccacccggatgccctggaagccgccgacgagcccgaccaggtgcgcgtcccggcctggcgccacgccctggtcaacttcgaccacccgctgctgcgccagggcctgcggatcctcgacacgcctggcctgaatgccctcggcagcgagccggagctgaccctgtcgatgctgcccaacgcccaggcgatcctgttcctgctgtccgccgacgccggtgtcaccgcctcggacatggatatctggcagaagtacatccagccactgcgcgaggacggccacagcagcctgttcgccgtgctgaacaagatcgacgtgctctgggacgacctttccggcgagcgcttcgtacagaacgccatccgcctgatccaggacggcacggcccgccagctcggcctgcagcgcggcgacgtgctgccgctgtcggcgaagcaggcgctgctggccaaggtccgcggcgaaccggcgctgctcgaacgcagtcgcctggatcggctggaagcgctgctctgcgagcgcatcgtcgcgcagaaggaagcgctgctggagaactccgtgctcggccaggtccttggcctgctgcacaacagccagcatctgctgcgcctgcgcctggagaaggtcgaggaacagcgcgcgctgctcgacgacaagcagcgcgacagcggccaactgctgttcgaactgaccgcgaagaccaaggacgaccacggccgccaccaccgccgcctgctcaacctgaagaccaaccagcgcctgctgcagcaccagggcgcgacgctgcgcgagacgatccgcagcgaacgcatggaacagcacctgcagaaggtgcggcgcaacctcaacggcagcctgaccacggtcggcatcaaccaggcgatcctggcgttcttccgcgcggtggagcacgacctcgacaacctcgagcacgaggccggcatggccaaccgcatggtcgccgccatctaccgccggcacaacgaggagaacccgctctacgccctcgacgcgccgcagctacgggtccagcgctaccagcgcgaactgttgcaactgaagaagaagggcgaccagttccgcctgcagctgaagaccgtgcttaccgagcaacgcctgctgacccggcgcttcttcgccaccctggtgcaggaggtggtcggcctgcaccagcgcctgcgcgaggaaaccgagcgctgggccaacgacgcgctgatgccgctgatgcagcacaccctggaaaacaaacagttgctcgaaagccacatgctccgcctcaagggcctggcccaggagacccagcaggtacgccagcgcagccaggccttcgccgggttcgccggggaattgcaggaacagttgcgcgaagccggcgacatcctccgccagttgcgccgcccctcgcccctgcagcgccaggccaaggtggtcaacctgcccggctcgcagcgcgcctga

SEQ ID NO: 4123 - DNA, 1515 bp, Pseudomonas aeruginosa
cccaggcgctacaggccgtgcactatccggacaagatcctcgaagagatgctgcgggtcggcaagacctgcatcatcactttccccaacttcggccactggcgctgccgctggtacctggcgcgcaacggccggatgccggtctccgagttcctgccgtatacctggtacaacacgccgaacatccatttctgcaccttccaggacttcgagcgcctgtgccgccagttgcgcatgcgcgtgctcgaccgcctggccgtggaccgtgaccaccggcatggctgggccagccggctgtggcctaatctattgggtgagattggaatctaccgggtcaccggacccggagtgcagacccgcaacctcgccgtctaggaacgcgccaggctgcgggccagggccgggcgcccctccgctcgtcctcgggagagcgctgccgaagccggccaaggccgccggcagcagaccatggacaacgtccatgccacctttcaggagaaaccaccatgcgccgcttcaccgctttcgtcctcggcctctgcctgagcctgccggtcctcgccgagcaggtgcagcgcttcggcgacctggacgtccactacaacgtgttcaactccagcttcctccagcccaacgtggccagcgcggtcggcctggtacgcagcaaggcgcagggcgtgatcaacgtggtgccgatggagaaaggcaagccggtagaggccgccgtgaccggctcggccaaggacctgaccggcaaggtcatccccctggagttccgccgagtcagcgaggaaggcgccatctacaacctggcgcaattcccgatcagccagcgcgagaccctggtcttcaccatcaaggtcgaggccaagggcgaacctgcgcaaaccttcagtttcaacaaggaaatcttcccggacgaatgatcaagctcgaacagctggtgctggccagccacaatgccggcaaactcaaggaactccaggccatgctcggcgccagcgtgaaggtgcgctcgatcggcgagttcagccaggtggaaccggaggaaaccggtctttccttcgtcgagaacgccatcctcaaggcacgcaacgccgcacgcctctccggcctgccggcgctggccgacgactccgggctggcggtggacttcctcggcggcgcgccgggcatctactcggcgcgctatgccgacggccggggcgacgcggcgaacaacgccaagctgctggaggccatgaaggatgtcccggacgccgagcgcggcgcacagttcgtcagcgtgctggcgctggtgcgccacgccgacgacccgctgccgatcctctgcgagggcatctgggaaggccgcatcctccgcgaagcccgcggcgcccacggcttcggctacgacccgctgttctgggtgccggaacgcgactgctccagcgccgagctggcgcccgaggagaagaaccgcctcagccaccgagcccgcgccatggccctgctcaagcagcgcctgggtctctga

SEQ ID NO: 4124 - DNA, 1275 bp, Pseudomonas aeruginosa
gccgcaaccgtcggcgccgcccccgggcggcgtcggcacggcgtttcgtccggccgccttggaggttggccgaactcatgccacgatagcgccccgaaaccgcctccaccccgccccaccgtgacccaagccaccccgttccagctcccgcccctggccctgtacgtgcacatcccgtggtgcgtgcgcaagtgcccgtattgcgacttcaactcccacgccgctggcccggagctgcccgaagaggcctatgtcgacgccctgctcgccgacctggagcaagacctgcgccatgtccacggccggcgcctgggttcgatcttcttcggcggcggcacgcccagcctgttctcggccaaggccctgggccggctactggaaggcgtcgagcgcagggtcggcttcgccgacggcatcgagatcaccctggaagccaatcccggcaccttcgaacaggtcaagttcgccgactaccggcgcctcggcatcaatcgcctgtccatcggcgtgcagagcttccaggccgacaagctgcaggccctggggcgcatccacgacggcgccgaggcagtgcgcgccgccgacatggcgcgccaggccggcttcgacaacttcaacctcgacctgatgcacggcctgcccgggcagagcctcgacgacgccctggccgacctgcgccaggccctcgccctggcccccacgcacctctcctggtaccaactgaccatggagccgaacacggtgttctggagccagccgccggagctgcccgaggacgacatcctctgggacatccaggaagccggccaggccctgctcgacgagcacggctaccgccagtacgagacctccgcctacgcccgcgacggcctgcacgcccggcacaacctgaactactggagcttcggcgacttcctcggcatcggcgccggcgcccacgccaagctgagcgcgccggacggacgcatcgtgcggacctggaagacccgcctgccgaaggactacctcaacccgcaaaaggccttccaggccggcgagcgcccgctggaagcggccgacctgccattcgagttcatgatgaacgtgctgcgcctggtcgacggcgtccccgccgcgctctacccacagcgcaccggccagccactggcggcgatcgccgatgcctgcgccgccgcgcgcgacgccgggctgctcgccgacgacccgcagcgcctgcgccccagcgaacgcggccagctgttcctcaacgacctgctgcaacatttcctgccgtga

SEQ ID NO: 4125 - DNA, 336 bp, Pseudomonas aeruginosa
tcgccgatcgcagctgagcccccggtctcccggcggccagcgccgtccccaagagcgtcatggcctccgggagcccgcatgaaaccgatcaagcacctctacctgcatttcaccgacggccagcgcctgtcgctgcgcttcccgcgccagcaggacgacccggccgaggttgcccgcagcatccgtcagcaactggacacgccctatctcagcgtcgaggtcgacggcgacctgctgctgattccgcgggacagcatcaagtacctgcagatcagcccggcgccggcgcgcctggacgacgacggcacgctacgcggcgccgagctgatcgtctga

SEQ ID NO: 4126 - DNA, 2775 bp, Pseudomonas aeruginosa
gggccgtccgcctcagttcccctcccggcgcagcgcctgcggggtgaagtcgcgcggcccgacctgcacgccgaagtcgtacatcggctcgttgttgtccagcccatcgacgaagtagcggccgcccttgaagtcgtagatcgcttccagggtgctggagaccagcggcacatcgtagtagttgatcggatggacctcctgggcccgggtcagcacgccatccttgtcgtagatgtcggcggcgaggatctgccagctgtcttcgtcgaggtagaagcggcgcttggcgtagggatggctgaagcccttgcgcagggtcgcctcgaccacccagacgcgatgcagctcgtagcgcagcaggtcgggattgatgaagcggctcttgagtatgtcgccataggcgaggcccttctggtgcaccgcgtagctgttgtaaggcaccagcatctcgcgcttgccgagcaacgcccactcgtagtggtccggtgcaccgttgtagacatccacggtgtccgccgtggccatgccgttggtatccggctgcaggctgtcgtaggccagggtcggcaagcggcgcacgcgccgctcgccacggttgaagcgccaggccttgcggatcgacagcacctggtcgagggtttcctgcaccaccagcgccgaaccggccaggcgcgccggcgcgaccaccttgtacttgtagtagaacaacgtgttgtcgaggttctccgggatcatcccctcgcggccatagacgaagtacaggtagcggtcgagcttgagcaggttgtagctgccgttggccagcaccgccgcctggttggtctgcaggtgcagttgctcgccgcggtagcgcatgatgtggttccagatcgcttcctggccgctctgcggcagggggaagggcacgccggcggcagcgccctgcacgccgttgccgtcggcgatcagctcggcgcggctggcgttggcgcgggtagcgtcgtacaggcgctgcggcagggatgcgctgcggcgggtggggaagacccgcaggtggtattccgggttggcctgcagcaaggcctgggtgcccggcgtcagcagcgcctggtaggcggccatgttgcggctgtcgaggaccaggcgcggacgatcggcggcgaacgggtcgaggtgatgcatgccgggccggtagccggccggcgcctgggtgatgccgccggtccagggcgggatgctgccatcggcgttgccggcccgctccgcccccagcggggtcaggtcctggtccaggcgtgcggcctggacttcgtctaccttggcctgcgccgcccaggcgcaaccggccccgagcaacaggatgcccagtttcttcaacacagcagtctcctttgcagccggccgagccgtgccgctcttattattggatccggccgaagccgggaaacgtgcagcttgaaggtgaggtccgccgggtgttcccggtctgcttggagtcccggcgccggttcggcgccaggggtacgtcgctggtgcggtggatcagtcgacgcgctcgaacttgaggtcccagacgccatgtcccaggcgctccccgcgccgctcgaacttggtcaccggacgctcttgcgggcgcggcacgaagcggccgtcttcggcctggttgcggtagcccggcgccgcgctcatgacgtccagcatatgctcggcataaggctcccagtcggtggccatgtgcagcacgccgccgaccttcagcttgcgccgcaccagttcggcgaattccggctggacgatccgccgcttgtggtggcgcttcttgtgccagggatcggggaagaacagcagcagccgatcgaggctggcgtcggccacgcagtggcgcagcacttccagcgcgtcgcagctatacacccgcacgttgcccaggccctgggtcagcaggccgttgagcagcgcgccgacgcccggcttgtgcacctcgacgccgatgaagtcgatgtcaggcgcggcggcggccatttccagggtggaatggcccatgccgaagccgatctcgaaagtccgcggcgcctggcgaccgaagatcgcgtcgaagtcctgaacctcatcgctcagttccaggccgaacttcggccagcccaggtcgaggccacgctgctggccttcggtcatgcgcccggcgcgcatcacgaagctcttcacggtgcgcatcggccgtgcttcgtcgtgttccgccagggagtcctgggccggggattgcggggtatcgctcatggaaaagaaaaccttgctagagacagaagggcggcttttattccctctccttctcgcttgtctgttcctcttgcttttgtcgtcttccgcgtcctctcctcttccttcgcctctttcctcttgttcttctcctttgctccctgtcgcttgtcctgttctcgttgctttgtcgtgtctcccgtctcctgctccctctcgtttcgcttcttgccgtccctccttgtcgcccctttcgtctttttctccttttcccgtctccgtgctgttttgtttttttttttctcctttcttgtttgtgtgctctcctgtcgttcctggcctcttctctcctttggtgctcctcccgggtccggcctccgggactttggctccttggtctgtcccttctttgcccgtcttcttgcgccctgtctttgccctctccttatctcggtctctgtctttgtctttgtggtcttcgtggtttcttttcgcgcgttcaccgtttttcttcgtttttttgtgcttttcctcgttttc

SEQ ID NO: 4127 - DNA, 1695 bp, Pseudomonas aeruginosa
aatcaaacagttaagcaagaaacagtctcatcgataaaaacctggcacgccgctcgctatatccatttcgaccgcatcgcccatgcaggccgacgggtcgggactccagtcccgccggtgcccgagcccacccctggtgtcggcgtcgtgcatgccgcccgcaaccacgacggtcattcgcgaatgacggcaatgccgcttcgcggttcgatagctcagcctggtagagcaaccatccacgaaatggtctgtcgcgggttcgactcccgctcgaacgttgccttaacggcaatcactcaatggcaacacccgccggtgtggccgaggcgaactgcgcaagcggccaggaaggccggacaacgcaagggagccgaagccgccgccggcccgtccggcccgcggttcgggcacggggcaaggcaggccggggatcgagggaatcgatcatatggacaggacgtccgccaggccaacctcctccgcgctccacccacgacgctcgacgggccggcaacaccggcaccacggaagaatgaaaggaatgaagagatgaaaatgctgaagcgctttatcgtgaagaagaacgaacgcggcctgctgtattccgaaggcgacttcctcgccgtgctcgaaccgggcacctaccgccgcttcgatccgtacgaccgcctgagcctggaaagcttcagcctgaacaccccgcagttcgaacaccgcctggccggctacctgcggcagagcgaaccgcagctggtggagcgctacttcacccggatggacctgggcgacaacgaggccggcctgcgctacgaggacggcgtgctggtggagttgctcgcaccgggcagccgccgactgtactggaaaggccagaccgagcagcgcctggagcgcatcgacctgacccaggactatcgattgtccgccgcgctggtcgcccagttgcaccagccgaacctgcgcgaccgcgccctggcgggcctggacgcagtgttgctggtccaggtgccggcgttccaggtcggcgtgctcaaggtcgacggcgcccttgccggcctgctgcaagctggacaatacggtttctggcgctacaaccggcaagtcagcgtggaactggtcgacacccgtatccaggcgctggaggtcagcggccaggagatcctcacccgcgacaaggtcagcctgcgcctgaacctcgccgccaattggcgctacagcgacgtgctcaccgccttctcgcggctgagcaaaccgctggagtatctgtaccgcgagctgcagttcggcctgcgggcggcagtgggcacccgtaccctcgacgaactgctggagaacaagcagtcgatcgacgaagcggtcagcgcccacctggccgccaagctggaagacagcggcctggaagtgagcggcctgggcgtacgcgacatcatcctcccgggcgaaatgaagaccctgctggcgcaggtggtggaggcggagaaggcggcccaggccaatgtgatccgccgccgcgaggaaacctcggcgacccgctcgctgctgaataccgcgaaggtcatggaggaaaacccgaccgcgctgcgtctgaaggaattggaaaccctggagcgggtggccgagcgcatcgaccggatttcggtattcggtggcctggaccaggtattgaacggactggtcacgctgaagcaggcctga

SEQ ID NO: 4128 - DNA, 1128 bp, Pseudomonas aeruginosa
cgtgatccctaccctcggcgcgatcatcccggccgcggtgggcgtggatatcggctgcggaatgatcgccgcgcgcacctcgctggtcgccgccgacctgccggacaacctgcacggcctgcgcagcgccatcgagcaggcggtaccccacggcaagaccttcggccgccgcgaccgcggcgcctggcacgaggtaccggaggccgccgaccaggcctggaaggcgctcgccggtcgcttcaaggcgatcaccgacaagcacccgaggctggagaagaccaacaaccgccagcacctgggaaccctcggcaccggcaaccacttcatcgaggtctgcctggacgaggccgaccgcgtctggttcatgctgcacagcggttcgcgcggggtcggcaacgccatcggcaacctgttcatcgaactggccaaggcggacatgcgccagcacatcgccaacctgccggacaaggacctggcctacttcgaggaaggcagccggcacttcgacgactacgtggaagcggtcggctgggcccaggattttgcccggcagaaccgcgcgctgatgatgcacgcggtgatcgaggcggcgcgccaggtgatccgcaagccgttcgaagccaacctggaggcggtcgattgccaccacaactacgtgcagaaggagcgccacttcggccaggaggtactggtcacccgcaaaggcgcggtgtccgcgcagaagggccagctcggcatcattcccggctcgatgggggcgaagagcttcatcgtccgcggcctcggcaaccaggaagcgttctgctcgtgcagccacggcgccgggcggaccatgagccggaccaaggcgaagaaggtcttcagcgtcgccgaccaggcgcgcgccaccgcccacgtcgaatgccgcaaggacgccgacgtgatcgacgagatcccgatggcctacaaggacatcgaccgggtcatggaagcccagcgcgagctggtggaagtgctgcacaccctgcgtcaggtggtgtgcgtgaaaggatgacgggcgccctgtggcgcccgctggggaagaatcgaaatgaacagggaagaacgccatccgctccccgccgccatgcgcgagcgggtactggatga

SEQ ID NO: 4129 - DNA, 1776 bp, Pseudomonas aeruginosa
gctggaacggatcgaacgcgagcacgacgtagtcgtgctctacgcctgcgagtcgggcagccgggcctggggcttcgcttcgccggacagcgactacgacgtacgcttcgtctatgtgcatcagcccgagtggtatcagcgcgtcgaggaacctcgcgacgtgatagaacgtccgctgagcgacgagctggacatcagcggctgggaactgcgcaaggcgttgcgcctgatgcgcaaatccaacccggccctgctggagtggctcggctcgccgctggtgtatcgggaagagcctggcgtgcgcgaggaactgctctggctgggcagcgcctttcactccgtaccaggcagtcgccatcactacctgtcgatggcacgcaagaactaccggggctacctgaagggcgacagcgtccggctgaagaaatacctctacgtcctgcgtccgttgttcgcggtgcgttggctggatgcaggcctgggcttgccgccggtggcgttcgagaggctagtggaagccacgctggacgatccgtcgctgcgcgaagaactggatgccctgctgagcctcaagcgtcagcgcgacgaatcggcctacggccctccgcgcctggcgctgcaacgcttcatcgaagcggagttgctccaggccgaacgaggggccacccaaccaaccggcgcgcgccaggacagccgactgctggatcgctacctccacgacaagatatggcaatacacaagggaaacctcatgagaaaggacctcatcgaactcgacggcagcgaaggcggcgggcagatcctgcgtagcgccctgagcctgtcgatgaccagcggccagccgctgcgcatccgcaacatccgtggccggcgcagccgtccggggctgctgcggcagcacctcaccgcggtgcgcgcggcggcggaaatctgcgcggccgaggtcgagggtgccgagctcggctcacgcgagctggcgttccggcccggtgcgatccgcgccggcgactacgccttcgccatcggctccgccggcagttgctcgctggtactgcaaaccctgctgccggcgctgctcgcggccaacggcgaaagccgggtgaggatcagcggcggcacccacaatccactggcgccgccggcggactttctccgcgacagctggctgccgctgttgcagcggatgggcgcggaagtcgacctggaactgctgcgccacggcttcgtacccgccggcggtggcgagctgctggcgcgggtacgcccggcacgctggcggccgctgcaactggagcatcccggcgcggcgctgcggcgccaggcgcgggcgctgctcgccgggattcccgggcacgtcggcgagcgtgagctggagagggtccgccagcgcctcggttggagcgacgaagaacgccagctggagttcctcgcggaggaccacgggccgggcaacgccctgctgctgcggatcgactgcgagcacatctgcgcgatcttctgcgccttcggccaggccggcgtcagcgccgaacgggtggcggaacaggtcgcgacgcaagccatcggctggatggaaagcggctgcgcggcggacgagcacctcgccgaccaattgctgctgcccatggccctggccggcgccggcagcttcaccacgccgcggctgagcgcccatctgcaaagcaaccgccgggttatcgaacgcttcctgccggtgaggatcggcgaccaggcgctggacggcggcggtcatcgcatcgtcatcacatcggcttga

SEQ ID NO: 4130 - DNA, 639 bp, Pseudomonas aeruginosa
tccacgtcaagccgagcagcgcgccgctggcctctcctcacaggaccggttgtaacgcctgataaggagaaaaaaagatgcagtcctcgcaactgctcccgcttggcagcctgttgctgtcgttcgccacgcccctcgcccaggccgatgccctgcacgaccaggccagcgcgctgttcaaacccatccccgagcaggtcaccgagctgcgcggccagcccatcagcgagcaacagcgcgaactcggcaagaaactgttcttcgacccgcgcctgtcacgcagccatgtgctcagctgcaacacctgccacaacgtcggcaccggcggcgccgacaacgtaccgacgtcggtcggtcacggctggcagaaggggccacgcaattcgccgacggtcttcaacgccgtgttcaatgccgcgcagttctgggatggccgtgccaaggacctgggggagcaggccaagggtccgatccagaacagcgtcgagatgcacagtaccccgcagttggtcgaacagaccctgggcagcatcccggaatacgtggacgccttccgcaaggccttccccaaggccggcaagccggtcagcttcgacaacatggcgctggccatcgaggcctacgaggcgaccctggtga

SEQ ID NO: 4131 - DNA, 1497 bp, Pseudomonas aeruginosa
gcggcaagcagccgcgcgtcgaatatccgctgctgccggccagcacggagaccacgccgcgtcccgcggaataaccgccacaaggaaaaacggggctcccctggagccccgtttttcctctatgggacgacctcagaccacgccctgcgccagcatcgcatcggcgaccttgacgaagccggcgatgttcgcccccttcacgtagttgacccgcccctgctcctcgccgtacagcaggcaggcatggtggatcgactgcatgatgccgtgcagcttggtatccacctcgccctcgctccaacgcaggcgcatggcgttctgcgacatctccaggccgctcaccgccaccccgccggcgttcgacgccttgcccggcgcgtagaggatgccggcctcgaggaacaggtcgacggcttccagggtcgagggcatgttggcgccttcggcgacacagacgcagccgttggccagcaggcgccgcgcatcctcggcatccagttcgttctgggtcgcgcagggcagcgcgatatcgcaggccaggccccagggccggcgcccttcgaggaactgcagggaaaactgctccgccatctcgcggatgcgcccgcggcgcacgttcttcagctccatcaggtattcccactgctcgtcggagagccccgcctcggcatacagggtgccttcggaatcggacagcgagatcaccttgccgcccatttccatgaccttgcgcgccgcgtactgggcgacgttgcccgagccggagatcgccacccgctggccgtcgaagccgcggccacgatccttgagcatttcctgggcgaagtagacgcagccgaagccggtcgcctccgggcggatcaggctgccgccatagctcaggcccttgccggtcagcaccgaggtgaactggttggacaggcgcttgtactggccgaacaggtagccgatctcacgcgcgccgacgccgatgtcgccggccggcacgtccaggtcggcgccgacgtggcggtacagctcgctcatgaacgactggcagaaacgcatcacctcggcgtcgctcttgcccttcggatcgaagtcggagccgcccttgccgccgcccatgggcagagtggtcagggagttcttgaagacctgctcgaaggcgaggaacttcagcaccccgaggttgaccgagggatggaagcgcaggccgcccttgtaggggccgatggcgctgctcatctgcacccggtagccacggttgacccgtacccggccctggtcgtcgacccagggtacgcggaacaggatcgcccgctcgggttcgacgatgcgttcgatgatgccggcttccaggtagtgcgggttggcctcgaggaacggccagagggaacgcagcacctcttccaccgcctggtggaattcgggctgatcgggatcgcgccgcttcaggcgctcgaggaaagcgtcgacggattgcgtcatttttctcaccggtttctagttttgtga

SEQ ID NO: 4132 - DNA, 1266 bp, Pseudomonas aeruginosa
cgaccactcggtccaggtggcgctggcgcccaggctcagacggtcgttgaactggtgtacccaatccagcgaggcgtaggcggggatatccaggcgcgccgaggcggaagcgcccatacgcaggtccaggcccggataggccaggcccggggtgccgccctcgatggcgccctcggtgagtccaccgtcgtggtcgtagaggttgtagtgccccttcagcttgttgcggatcttcgcgtggtaggcgaagcccagggtgtcgcggtcggtcggcttccacaccgcgccggcgaagaagccgggcgaggtgttgtccaccttgacccgcatcagcgcggacgagttcgaggccgggaacggaatcccgcccatgcccggggagttggcggccgaggcatagagatcgaggttctggctgacgaagccggaggtgcgctggatgatcaccccggcgcccagggagaagttgtcgttgaccttgaacgacagggagccggtcaggccgatcgtctcgatcttggtgtccaccgcgaaatcgcggcctttccagttcgggtcccaggtgctgcgcattcccatcggaacgacctggctcagaccgaaggcgaagcggtcgttgatcggtacgaccaggaagccggtcggcagccacgcgccgaatccggcctggccgccatcgttggtacccagctcgggggtgcccggcccgtcctggtagccgccggtcatgggattaccctggtagtcgtaggcatcgccgttgtacttgatgtcgatatcggcgtagttgaccgtcaactgggcgatccgcttgtcgatgaacgccatggccgccgggttgttgaacgcggcgctcggatcgttgggaaacagcgagccgcctgccatcgcacggccccagcccgccgtgttggtggtcggcaccatgaagccaccggcttgcgcctgggacgtgccgaacagtccgccgacgatcagggcgcagagcaatggcaatggttttctggcaaacaggcaggaaatatcgtttttgttgttcaaggtttcacccctggtggactgctaatgcacggggcacgatggtcggcctgcttgagcgtcctggcggacaccctcccccagaccgttttccatgtgcgaacgaggttctgcgccgcttccggcggaaactccctcggacctgccggcccgcgaaggacgcctggcagcgggagcgcgaaaccgctggcgccgagggcgccagcggcagcccggattacgggttga

SEQ ID NO: 4133 - DNA, 222 bp, Pseudomonas aeruginosa
gtcctatccggtgccgacgctgacggtccccacgacgagccgggacagaccggatatcggaaagatccgatagggtttgccaacccgccgcgcctcaagatgcccacctggccgacctccgcgaacgcaggcctgacagggctggcaatcaccacgaaggggcagtggaccagtcaacgacgggggccagagtacggtcagcgcggctctggaaaagcctag

SEQ ID NO: 4134 - DNA, 240 bp, Pseudomonas aeruginosa
atgccgtggagggcggacgaagcgttgtcgcgaaggaatcctgatacctctgtcaacatccgcgtcgggaagaaacgcaccatgacggggcgtacctaccagaattggcagctcgcgaagcgacccagccaacccaaagttaggttgccaactatcggtcggacgaggacggcacgcgaacgagacccggctgcaactcgaacacctccacgccctccggcgtggagcgtccgatcttga

SEQ ID NO: 4135 - DNA, 513 bp, Pseudomonas aeruginosa
tatccagttcggaaaccttcgcagataccttcagccgctcgacgctggccaggccgaacaacgcctggccctgccccagcttgctaccggcctgcaccggttcgcggctgccctgctcgccagccaggccgggcgccgcgacgacgataccggcaaagggcgcgcgcaccgtacggccatccagctgggcctgcagcgtctcgtatttcacgctggcgttggccaggtccatttcggcgatctggcgattctcgccctgccccttggcgcgggtcgactccacttcccgccgggccgcctccaggtccatgcgctgctggctggcctgttgttcgagatcgtcgagttcgttgcgcgggacgatcccgcgctggaacagctcgcgggtctcgcgcaacttgcgctcggtgctgctctgcgccagctgcgcgctgcgcagggcacgacggacccgcgccatgtcctcgccacgctcccagtcgcgcaggtcctgcagggtgcgacgggccttga

SEQ ID NO: 4136 - DNA, 741 bp, Pseudomonas aeruginosa
gcaacgccgactgtgcctcgcgcacctgcacggcgatctcgcgggtgtccatgcgcagcagctcctgtccttccgcgacccgctgtcccggctccaccagcagcgcctcgacattgccggcgaagggcgccgccagggtcaccacgcgccccggttccaggcgtccgaccaggccgatctgatgcaccagcggggccgcccgtacggcgacccagcgctccccttccgtgcgtttcgcggtgccgccggcgaggaccagccaggccagcgccgcgacaaccgccaggccggcggcgagcgacaatgccggccggcgcaggaaggaaaaccggtcagtggtcattgagcgaaatctcccagctatccagggtcatgccgacgatcaggtcgagctgcgtctgcgcattgagaaacgagatcagggcattcaattgggtgttctcgacgttgcgcaggtcggtctcgaagctcagcacctggaagttgctcgaacgcccgacgcgcagcttttcccgttcgatctccagcttgcgccgcgacaacgcggtggcgcgctgggcgatctggtactggcgccagcgcgtgccgaggtcgcgcaccgcatcgatgacgttctgctccagggtctgccgggcatcctcgatcaggatcttctggttctctacgtcgacctgggcgcgcacctcggcctgccggcggctgaggtcgccgatgggaatttccacctgtaccccggcgtag

SEQ ID NO: 4137 - DNA, 1104 bp, Pseudomonas aeruginosa
accgcgtcgctcaggctgaggtcgatcacctgctcgctgagcagcaccgacctgccctgctcgcgggccatgctcggtacgtccggactcagcgccgggttgacgctggccgccaccggaagagcggtgaccagccacagcacgcccaggccccacctattcatcgcgcagcgcctcgaccggttgcaggcgagccgccgagaccgccggatagagcccgaagaacagccccaccagcagggtactgcccatccccagcggcagggccgcgtaggccagggagaaggtccagccggagaacctggcgtagagatacgcagccgccacgccgagcaccgcgcccgagagcgcgcccgcggcggtcagggtcaccgcctcgatcaggaacaggttgcggatgtcccgctggcgcgcgcccagcgccatgcgcacgccgatttcccggcggcgttcggcgacactcatcagcatcacgttcatcactccgacgccgccgccgagcagggagatgatccccagtccggccagcaggtaggtgaaggtccgggtctgccgcttgagtccatcgagcacctgctgcgagacctggacctgcgcctcgtgaccgggcaaccgcgccgtcagggccgcgcccagggccgcgccgacgctatagacgtccgctcccggcgagacccgcgccaccacatggctgacctcggcggccggctgcaggcgcggcatgcccggcgccggcacgaacagcgagtcgttggcggcgaacggcaagagagcggcgctggcctgcggctggagaatgccgatcacgcgaaacagatagtcgttgaccgtcagttgctcgccgaggcgcagcggatcgccgggcgcccccagggcctcggcgattgtcgcgcccaccaccacgtaggtgtcgtgatcgtcgaagcgcgagaggaaacgtccttcgcgcagccgcagcctggcggcagccgcgagcccggcgctggcgccgacgatactggcgttgctggtgcgtccgtgaaaggtcaccggcgccgagtacaggcccagcaccgccaggtgctccagaccggccacgtcgcggagcagcggttcggtgtctag

SEQ ID NO: 4138 - DNA, 465 bp, Pseudomonas aeruginosa
acagcccatgacgatacccagcaacgccagcagcgagcggcgccccagcccgcgaagactggcgagggcctcgtgaagcaattgccggggcgacgggctggcgctcaccggcaggcctccgccaggtcctcgtgcacctcgccatgccgcactgtcagttggcgcccgagacgggcggccaggctgggatcatgggtgaccaccaccagggtcacctggcgctcgcggttgagggtgaggagcagctccagcacttctttcgcggtgctcgcgtcgaggttgccggttggttcgtcggcgaggatcagcgccggctcgccgaccagcgcgcgagcgatggcgacgcgctgccgctggccgccggaaaggtccgccggacgatggccggcgcgctcggccaggccgacccgggcgagcatcgcctcggcccgctccagtgcctcgcggcgcggcatccctcgatag

SEQ ID NO: 4139 - DNA, 261 bp, Pseudomonas aeruginosa
ttgccgatcttgatctgctcgaaaccgtcggaaacctgctcccacacggtcttgttgccttccaggctgtcacggctctggtcgacgctggcgatctgcacggtctcgccgatctcgatggtgccggagtccggctgctccttgccggtaagcatgcggaacagggtcgacttgcccgcgccgttgccgccgatcacaccgacgatggcgcccttgggaatgctcagggacaggttgtcgatcagcacgcggtcgccgtag

SEQ ID NO: 4140 - DNA, 516 bp, Pseudomonas aeruginosa
aactcttccaatccagcgtgtcgatcgccgcgccctggcgctgggcggcggcgccgctccagctgtgggccaccggcgcggcgggacgttcgtaggtcggcgccatggagcaggcgccgagggtcagggcgatcagcagcgccgatacgccgaatgcaggtttgcgcatctcgttcactccccggccgaagcgggctgttcgatgggtgccggcttgctgcgcagcagcatttcttcctgctgatgcaggccatgaccgacgccggcgagaagctcggcctgtcccgcgagacagcctcgcgcctgaccctgcagaccgccctcggcgcggcgcagatggcgctgtccagcgaggtcgagccggccgaactgcggcgccgggtgacttcgcccaacggcaccaccgaggcggcgatcaaatccttccaggccaacggcttcgaagcactggtggagcaggccctgaacgccgccagccagcgctccgccgagctggccgaacagcttggccaataa

SEQ ID NO: 4141 - DNA, 897 bp, Pseudomonas aeruginosa
ggagtagtcgatgatcggcctcaacaccgctgctatctatatcctccagaccctcggcagcctctacctgctgatcgtgctgctgcgcttcatcctgcagttggtccgcgcggacttctacaaccccctcagccagttcatcgtgcgcgccaccaagccgctgctgaacccgctgcggcggatcatccccggcttcggtgggatcgacctggcctcgctggtgctggcgatcctgatccaactggtgctgatgatcctgatcctgatgctgatgggctacggcgtcggcggcttcatcatgcaactgctgatctggtcgatcatcgccgtcacctcgctgttcctgaaggtgttcttcttcgccctgatcatcagcgtgatcctttcctgggtcgccccgggcagctacaaccccggcgcgcaactggtgaaccagatctgcgaaccgctgctgatgccgttccgcaagctcctgccgaacctcggcggactggatctctcgccgatcttcgcgttcctcgcgctgaagctgatcgacatgctggtgatcaacaacctggcggccatgaccggcatgccccagcagttgagcatcttcctctgagcttctaccgctgggacggcgaggacctgctcctcgattgccacctgcagcccaaggcgagccgcgacgagttcgccgggctgcacggcgaacgcctgaagatccgcctcaccgcaccgccggtggagggcaaggccaacgcccatctgctggccttcctcggcaaggccttcggcgtggccaagagcctggtgagtctcgaaagcggcgagctgaaccggcagaaacgggtgcgcatccgccgtccgacccgattgccggaggaactggggatcgccgctcgacccgcttga

SEQ ID NO: 4142 - DNA, 1173 bp, Pseudomonas aeruginosa
actggcgccctcctttgttcgagagcagggtcgatgcccacagtcttccccgacgactccgtcggtctggtctccccccagacgctgcacttcaacgaaccgctcgagctgaccagcggcaagtccctggccgagtacgacctggtgatcgaaacctacggcgagctgaatgccacgcagagcaacgcggtgctgatctgccacgccctctccggccaccaccacgccgccggctaccacagcgtcgacgagcgcaagccgggctggtgggacagctgcatcggtccgggcaagccgatcgacacccgcaagttcttcgtcgttgccctcaacaacctcggcggttgcaacggttccagcggccccgccagcatcaatccggcgaccggcaaggtctacggcgcggacttcccgatggtcacggtggaagactgggtgcatagccaggcgcgcctggcagaccgcctcggcatccgccagtgggccgcggtggtcggcggcagcctcggcggcatgcaggcgctgcaatggaccatcagctaccccgagcgcgtccgtcactgcctgtgcatcgccagcgcgccgaagctgtcggcgcagaacatcgccttcaacgaagtcgcccggcaggcgattctttccgaccctgagttcctcggcggctacttccaggaacagggcgtgattcccaagcgcggcctcaagctggcgcggatggtcggccatatcacctacctgtccgacgacgccatgggcgccaagttcggccgcgtactgaagaccgagaagctcaactacgacctgcacagcgtcgagttccaggtcgagagctacctgcgctaccagggcgaggagttctccacccgcttcgacgccaatacctacctgctgatgaccaaggcgctggactatttcgaccccgccgccgcccatggtgacgacctggtgcgcaccctggagggcgtcgaggcggacttctgcctgatgtccttcaccaccgactggcgtttctcgccggcccgctcgcgggaaatcgtcgacgccctgatcgcggcgaaaaagaacgtcagctacctggagatcgacgccccgcaaggccacgacgccttcctcatgccgatcccccggtacctgcaagccttcagcggttacatgaaccgcatcagcgtgtga

SEQ ID NO: 4143 - DNA, 609 bp, Pseudomonas aeruginosa
gattggaatctaccgggtcaccggacccggagtgcagacccgcaacctcgccgtctaggaacgcgccaggctgcgggccagggccgggcgcccctccgctcgtcctcgggagagcgctgccgaagccggccaaggccgccggcagcagaccatggacaacgtccatgccacctttcaggagaaaccaccatgcgccgcttcaccgctttcgtcctcggcctctgcctgagcctgccggtcctcgccgagcaggtgcagcgcttcggcgacctggacgtccactacaacgtgttcaactccagcttcctccagcccaacgtggccagcgcggtcggcctggtacgcagcaaggcgcagggcgtgatcaacgtggtgccgatggagaaaggcaagccggtagaggccgccgtgaccggctcggccaaggacctgaccggcaaggtcatccccctggagttccgccgagtcagcgaggaaggcgccatctacaacctggcgcaattcccgatcagccagcgcgagaccctggtcttcaccatcaaggtcgaggccaagggcgaacctgcgcaaaccttcagtttcaacaaggaaatcttcccggacgaatga

SEQ ID NO: 4144 - DNA, 504 bp, Pseudomonas aeruginosa
cccaagccaccccgttccagctcccgcccctggccctgtacgtgcacatcccgtggtgcgtgcgcaagtgcccgtattgcgacttcaactcccacgccgctggcccggagctgcccgaagaggcctatgtcgacgccctgctcgccgacctggagcaagacctgcgccatgtccacggccggcgcctgggttcgatcttcttcggcggcggcacgcccagcctgttctcggccaaggccctgggccggctactggaaggcgtcgagcgcagggtcggcttcgccgacggcatcgagatcaccctggaagccaatcccggcaccttcgaacaggtcaagttcgccgactaccggcgcctcggcatcaatcgcctgtccatcggcgtgcagagcttccaggccgacaagctgcaggccctggggcgcatccacgacggcgccgaggcagtgcgcgccgccgacatggcgcgccaggccggcttcgacaacttcaacctcgacctga

SEQ ID NO: 4145 - DNA, 1734 bp, Pseudomonas aeruginosa
cttgctttctatccccgtttgtttcccataatcagcgcttggttagcgcggggggaacccgtcgtagacgcctcgaagaaggtgactaccattttgaaccgaagcctgaagattggagacatgatgaatctgtcgctactcagtcgctatgcgtttttcgcctgtatcgccctgttcaccttggtcagcctgccgttcctcggcagcaccgaatggctctggccgttcaccctcctgggcgtggccctgagcctgctcggcctgttcgacctgatccagacgccccacgcggtgcgccgcaactatccgatcctgggcaacatccgctatctggtggaaggcatccgcccggagatccgccagtacctgctggaagccgacggcgacgccctgcccttctcccgcgcccagcgctcgctggtctactcgcgggcgaagaacgaaagctcggagaagcccttcggcaccctgatcgacgtgtacaccgccggctacgaattcatcagccactcgatgcgtccggcgccgctcagcgatccctgcgagttccgcgtcgacatcggcgggccacaatgcagcaagccgtactccgcttcgctgttcaacgtctcggcgatgagtttcggcgccctcagcgccaacgccattcgctcgctgaaccgtggcgcgcatatgggcaacttctaccacgacaccggcgagggcagcatcagtccctatcaccgcgagaacggcggcgacctggtctgggaactgggcagcggctacttcgggtgccgcacccgcgatggcaagttcgaccctgagcgcttcgccgcccaggccctcgacccgcaggtgaagatgatcgagatcaagctcagccagggcgccaagccgggacacggcggtatcctgcccaagcacaaggtcacccccgagatcgccgccacccgtggcgtgccgatgggtgaggattgcgtttcgccgtcgcgccacagcgccttctccacgccgatcgagctgatgcagttcatcgcccagctgcgcgaactgtccggcggcaagccggtcggcttcaagttctgcctgggccatccatgggagttcatgggcatcgccaaggccatgctggagaccggcatcctccccgacttcatcgtcgtcgacggcaaggaaggcggcaccggcgcggcgccgctggagttcaccgaccatatcggcgtgccgctgcgcgaaggcctgctgttcgtccacaacaccctggtcggcctcaacctgcgcgacaagatcaaggtcggcgccagcggcaagatcgtcagcgccttcgatatcgccagcgtcctggccaccggcgcggattgggccaactcggcgcgcggcttcatgttcgccatcggctgcatccagtcgcagagctgccataccaacaagtgcccgaccggcgtcgccacccaggacccgctgcgccagcgcgcgctggtggtgccggacaaggccgagcgggtgcgcaacttccatcgcaacaccctcaagggcctggccgagatgctcgccgcggcgggcctggaacatccctcgcagctcgaagccaagcacctggtgcgacgcatcaccgacaccgagatccgcctgttctcgcagctgcactacttcctcaagccgggcgaactgctttccggcaagatcgagggcgagttctacgagcgcatgtggaacatggcgcgggccgacagcttcgacgcggcggcctga

SEQ ID NO: 4146 - DNA, 387 bp, Pseudomonas aeruginosa
gcctgttcgccagccgctacgacccgatccgcctggccttcctgcagttcgccacctgcgcggcggtcagcctgctgctggcactggtcttcgaggaaatccactggggacgccatcgtccaggccggtcccgccctgctatacggcggcctgctcggcgtcggcaccggcttcaccctgcaggtggtggcgcagaagcacgccatcgcttcccatgcggcgatcatcctgtccctggaagcggtgttcgccgccatcgccggcgccctgttcctcgccgagaccctgcacctgcgcggctatttcggttgcgcgctgatgctggcgggcatgctggtggcgcagttgtggccgcgcaagctcgccgccgaagcgcgcccggcctga

SEQ ID NO: 4147 - DNA, 888 bp, Pseudomonas aeruginosa
cactcagccacggaacggcgccagggcacggtgcgccgggctggcctcgtccagcggaatgtgccgcttggcgcccaggtagcgctcgctgaacacctccaggtaggcgccgagcgcctcgcccgcggcctcgtcgccagccagctccaggcacagcgccgccacttcggcggtgcacaggtgctcgccacgggtcgagcgacgcaggcgatagcgcgagagctgctcgggcagcaggctgagcaccgggaacggctccaggtaaggactcttgcggaacatcttgcgcgcctcggtccaggtcgcgtcgagcaggatgaacagcggtcgcttgccttccgccagcggggcgacctcgttcaccacccgctccgccgccacgtattcgccggggaacaccaggtatggctgccactgcgggtcggccagcaactccagcaagcgcgggtcgacctcggtgcgcgaccagccgaaggcgaaggtgtcggccacggtatcggcgatcagccagccggtgttggtcggtttcagcgcctcgatgtcgtgcatgaccaggcacatgcctgcgcgcgcctcgacccgcggccgccaggcgcacatgcaatagctcggcagcagccgacagccttcgcagcgcggcatgcgcgaaccgcgcgcgacgaagggtttcaggctgcgcgccaggcgctcctggcgcaagcgggaaacggcatggctcatcgggcaggctcccgatacggaaaggacgggcgaaggaacatcgaagactcgaggaaacgggctggaaagcgaccgcgaaattctatcagagcccgcgtggctcctgctttgtcggacaacttccgaggccgcgaaaaaaaattcttcacaggggcctcagacgtctag

SEQ ID NO: 4148 - DNA, 1113 bp, Pseudomonas aeruginosa
ccttactgcctctccagacgaatgacgccccccttgctcgagatccgcaacgtgacccgccgcttcggcgacttcaccgccgtcgacaatgtcagcctgacgatcaacaccggcgaattcttcaccctcctcggcccttccgggtgcggcaagaccaccctcctgcgcatgctcgccggcttcgaccagccggacagcggcgagatccgcctcaacggccaggacctcgccggcgtcgagccggagaagcgcccggtgcatacggtgttccagagctacgcgctgttcccgcacatgagcgtggcgcagaacatcgccttcccgctgaagatggccggagtggcgaagagcgagatcgacgcccgcgtcgaacaggccctgaaggacgtgcgcctggcggacaagggcgggcgcatgccgacacagctttccggcggccagcgccagcgcgtggcgatcgcccgcgcgctggtcaaccggccgcgcctgctgctgctcgacgaaccgctgtcggcgctggacgccaagctgcgcgaagaaatgcagatcgaactgatcaacctgcagaaggacgtcggcatcaccttcgtctatgtcacccacgatcagggcgaagccctggcgctgtcgcaccgcatcgcggtgatgaaccagggccgggtggagcagctggacgccccggaaaccatctacagcttcccgcgcagtcgtttcgtcgccgacttcatcggccagtgcaacctgctcgacgccacggtcgaggcggtcgacggcgaacgcgtgcgcatcgatctccggggcctgggcgaggtccaggcgctgaaatccttcgacgcccagcccggcgaggcctgcgtgctgaccctgcggccggagaagatccgcctggcgcagagcgtcaccgctgacagcgacgaggtgcacttccgcggccgcgtcgccgaactgctctacctgggcgacgtgaccctgtacatcgtcgagctggagaacggcgagcgcctggaaaccctgctgcccaacgccacgcccggccgggccaagttcttcgaggtgggcgacgcggtggaagccgcctggcgcttcgatgccggccacctggtcagggcctga

SEQ ID NO: 4149 - DNA, 885 bp, Pseudomonas aeruginosa
gacgatgagaaagaacctcggcaagtggctgctggtctggccgccgcaagcgtatctgctgttcttcttcctggttccggcgctgatcatgctgttcgcctcgttccgctttcccggcgactacggcggcctggcgccctggatgtacagcgaggacgggcagaccgtctacgacctcagcgtggagaactacacccggctcaccgagagctgggtgtacctgcaactgttcgtcaaatccttcggctacgccctggtcaccaccctggcctgcctgctgctcgcctacccggtggcgaccaccctcgcccgggccccggcgaagtggcgcaacctgctgatcctgctggtgatcctgccgttttggagcaacctgctggtacgcgtctacgcctggatgatcatcctctcgccgtccggtgccctgacccgcgggatcaacgccgcactggacctgttcggcgcgcagccgatcagcctgatgttcaccccgttcgcggtgatcctgtgcatggtctacgtgcacctgccgttcatgatcctgccgctctacgccaacctggagaaacacgacccggccctgctggacgccgcccaggacctcggcgccggtcgttggcaacgcttctggcgggtgaccttcccgctctcgccgccggcgcggcactggtattcatcccggtgctgggaatgttcgccatccccgacctggtcggcggtaccgacggcatcatgatcggcaacctgatcaagagccagttcctcgactcccgcgactggccgttcggcagcgcgctgtcgatcgccctgaccggctgcatcctgctgctggtcgccctcggcatgggcgccgcgcgcgcccgcaagggaggcgcccatgcgtag

SEQ ID NO: 4150 - DNA, 618 bp, Pseudomonas aeruginosa
acaagctctggacagagatcaagctgcgctgatccgcaccgctatcgacgaaagggcgaccctcggtcgcccttttgcgtttccgtgccccgcaccgaacgcggtaacatggcacccattcgccaccgtccgtcccgggaatgggccgacggaaacaattcgccccctccatcggtcgaatccgcttattgccccaggagatcttcgatgtcgcgcttcatggcccttgccctttgtttcgtcctgcccaccgccgcccatgccgcctcgctcaaggatttcgaactgagcaagatgctggagaaagtggccaaggaaagcagcgtaggcactccccgcgccatcaacgaagacatcctcgaccagggctacaccgtcgaaggcaaccagttgatcaatcacctcagcgtacgcgccagccacgccgagcgcatgcgctccaacccggacagcgtgcgcagccagctcggcgatagcgtgtgcagcaacaccggctatcgccagttgctcgcccgcggcgcgatcctcacctacagcttcaccgagtacaagaccaaccagccggtcgccaccgaacgcttcgatgccggcagctgccgcatccagggcaagaagtaa

SEQ ID NO: 4151 - DNA, 240 bp, Pseudomonas aeruginosa
gcgcgccgcgcggtcgccatgctggacaagcagcatctgctgaagatcgccaggacgccgatgccgttcggcaagtaccagggacggatgctggtcgacctgccggaggagtacctgctgtggttctacaagaaaggcttcccgcctggtgaactcgggcggctgatgcagttgaccctggaactgaagatcgacgggctggacgggctgctcaagccgcttcgtccccccgctccgtag

SEQ ID NO: 4152 - DNA, 1800 bp, Pseudomonas aeruginosa
cagcgccagggcgctgttgtgatcggccgggaagagcacccggaccatgtcgctcatctcgccaagcagggcatcgcagaaggtggtgtcctggtgcgactgctggttcttgccgttctcccaggtatgcgaagtagcgaccagcggccagcccagccagccggccggacgccggaattccttctgctggcgggcgaagatcagggtctggcgcaccgcgccgagcatcttcacgcagaacgcttcgtagctggcaaccaggttgagtccgccctggttggccaggcaggcggacaccaccgcctcctcgttgagcgcggtgatgacccgaccgctcaccgattccagttcgctctccggctcgctgacccgatgcttgagcgccttgagcacgccgccgaggcggttgctggccaattcgtcgggattgccgacccgggcgcgcaggtcggggttggcctccaccagttcggtatagaagcggtccagcgcggccatcggcgagcaggcgtcgtcgcgatagcgcagcggcgggatgatcggttcgatgggatggcgcagggccagcgggttgtcccgttcgaggggacgctcgccgcgctgctcggcgaacagccggcgggccaattcgagagcctcaggctcgacccagagttcgtttgcatgctggttgaacagttgccgggcctgttcgtcgttatgcggattgcccggcagcggcaggttgtgcgcggcgttgttgccggcgccatagaagccgaagcccttgaccgtctcggcgatgccgtagggaatcggcagcgggtagcggaggatgccgctgttcttctcctgcacgcgccgctccaggcgctgctccatctcccagagcgtacagacgaaggcggccgggtcgcgcccatcgaagctgatcggatcgaagccgcagcggcgcaggtgcagcttgaagccctccagcccctcatgggtgcccagttcggtgcgctgctcgatgcgccggccattggcgatcatcaccggcagcgccgccccgcaatcctcggctcgccaccagcgcggaatccagtcgctgccgcgctgttcctcggcggcaccatcggagaggaacgccaccagggtctcgccgggcagcggcatgtgcgcgtactgcaattcggcgaagccgaggtagccgccctcggcgataccgccggcggtatgcggattcacgtggctgcccagtggcgccgccggtgcgccgttgggggcctgggcgtacccgtagaagtcctgcagcaagcggttcagcccttcctcgccgtcggcataggcgcgctcctgctccgggtgcaggttgccggtgaggacgttcagcgcgtcgatggcggccacgcaatggccctggcccatcagccaggcgcgagtcttgccggtcaggacgttgagtgccagatagccggcgtaggccgggaccatgttcagggctccgccggtgtggccctcgggctgtgtcttgaaatcctcggcctgcaacggctggccgtccaggcggatgcgccgggcgtaggtcatgtgcacgacgatgcgcagggcgctggcggtcagccggtcgagggcgcggaacagttggtagacgctggccaggtccggttgcagcccggcttggaccaattgatgagcggtgcggaacacggcggcgcgggtctctgcgctatgctggagcggaccatggccttgcagccacgcggcaaacgccggctcggccgccgcatgggcaagcaactcgtcctgactgggcagaatctgactcatggtgggtag

SEQ ID NO: 4153 - DNA, 1107 bp, Pseudomonas aeruginosa
ccgcctgtccagggtggttgtagaaggagtatgcgaatgccctacgaagccgatgactatctttcccggcacttccagaccagcggcaccgacctggcgcggaaggtcgacgaactggcggcccttgcggctcccggcgacagccccaatctcgcgctctaccgcgagatgctcttcaccgtgacgcgcatggcccaggccgaccgcaaccgctgggacgccaagatcatgctgcagaccctgcgcgagatggagcatgccttcagcgtcctcgagcagttcaagcggcgacgcaaggtcaccgtgttcggctcggcgcgcacgccagtcgaacatccggtctatgccctggcgcgcaagctgggcgaggaactggcccgctacgacctgatggtgatcaccggcgccggcggcggcatcatggccgccgcccacgaaggcgccgggctggagaacagcctgggcttcaacatcaccctgcccttcgagcagcacgccaaccatacggtggacggcagcggcaacctgctgtcgttccactttttcttcctgcgcaagctgttcttcgtcaaggaagccgacgccctggtgctctgccccggcggcttcggcaccctagacgaggcactggaagtgctgaccctggtacagaccggcaagagtccgctggtgccgatcgtgctgctcgaccagccgggcggccgctactgggaacacgccctggagttcatgcaggaacagttgctggagaatcactatatcttgccggccgacatgcgcctgatgcgcctggtgcattcggccgaagacgcggtgaaggaaatcgcccagttctaccgcaatttccactccagccgctggctgaaaggcactttcgtgattcgcctgaaccacgccctgaacgaagccgcgctggcgcacctgcacgaacacttcgccagcctctgcctgagcggcggcttccagcagcaggcctacagcgagcaggaacaggacgaaccggagttccgcaacctgacccgcctcgccttcgtgttcaacgggcgcgaccaggggcggctgcgggaattgctggactacatcaacctgccggaaaactgggactga

SEQ ID NO: 4154 - DNA, 603 bp, Pseudomonas aeruginosa
acagtattattccacagggcaagtcgctcgcctacccccgacgggaagaatgttccgaacggttgcccgcagacgcggctagcccgggttctcgccgttgctcatgcgcagcaggccggtcagcgcggtcgccaccgtctgccggcgcacggcgtcgcggtcgccgttgaactggcagcgctcactgaccagccgctcgccgtcggcccaagccagccagaccgtgcctaccggcttttccggcgagccaccgtcgggcccggcgacaccgctcaccgccaccgcgaaacgcgccccgctgtgccgctgggcgccgcgcaccatggcctcgaccacttcccggctgaccgcgccgactgccgggaacagcgactcgggcacctccagctggagggtcttctggcggttcgagtaggtcacgtagccagcctcgaaccagcccgaactccccgggatgcgggtgatcgcctcggcgatgccgccaccggtgcaggattccgccgtgctgacctgctcgcccaggtaacgaaggctttcgccgaggcgggcggccagtgcggtcaggtcggactccatcagggtcatcactgttctccagggtag

SEQ ID NO: 4155 - DNA, 1137 bp, Pseudomonas aeruginosa
aaacggaaagggactaccctacaccatcggcttttccattcagaagcagctttcggacaagcgcaaccgcgcgaaggcagcgaatgcgcgaacatgcgtgttccatcaccgtccaaggaaaggcacaccatgaacatcgcgccactcaaggtctctctgctctccctcgccctgctcctctcccccgttgccagcctccccgcccatgcggcctgcaccgccaacctggccctgcaacccgccagcagcctgcccgcgctcggcgggcgcctggtctaccacagctatatggagtacggggacggctcctcgaacctctacctgcacgatttcaagagcaagagcacccgccagctcaaccagcccggctggaacatcgaggacccgatgaatgcgcatttctccccggacggccgctacctgaccttcatgggccgccagaatggcgcctggcacgtgttcgcctgggccatcggcggtacccaggcgccgagcaacctgaccgcggccatcggcggtcgcaacgaggatccgaagttctccttcgacggccgccaggtcgtgctcaagcacgagggcgacatccgcctcgccaccctggtcttcaatggcgatggcagcgtcggcgtgagcgcctggaaagccgtgaccggcgacggctggagcaccgaggagtcgatgccgttcctcacaccctcaggcaagtacgtggtctacgcgacaggagccggcgacagcctgcgggtggtgcgcaggaacctggagaacggccaggtcagcgccctcgccaccccggccgcggggggccgcgactattacccggtggtacgcgactacaccgcctacttcctctcgcgtacccagccggccggcaacgaccagttggccatggtcgtacccaacagcccgcccggcaccccggcgatcctgccgctcaaccactgccagggcgacaattccgacgccgcgccggtgaacgaggactacctgatcttctccagcacttcgttcgacccgacctacagcctgctcctcggcgacatcgccgcggcgcgggtctggcgtctcgacccggcgcagatcaacctgcccgacggtcggcagaagctcggcgccagctataccgcggcacgctga

SEQ ID NO: 4156 - DNA, 942 bp, Pseudomonas aeruginosa
tcaaaacattattgccatacagggacaatccagatgaatcgctgggaaggactcgacgaattcgtcgctgtcgccgaaaccgggcagttcaccgcggcagccgaacgcatgggcgtttcctcgtcgcacatcagccgccaggtcgcccgcctggaggagcgcctgcagacccgcctgctctaccgcagcacccggcgagtatcgctgagcgaagccggacagaccttcctgcaacattgccagcgcctgcaggacgcccgcgacgaagccctgcgcgcggtcagcgacctctccgcggagcccaagggcctgctgcgcatgacctgcgcggtagcctacggcgaacgtttcatcgtgccgctggtgaatgccttcatggccgactatccgcaactgcgggtcgacatcgagctgtccaaccgccagttggacctgctccacgagggcttcgacctggccatccgcctcggccgcctgagcgattcgcgattggtcgccacacggttggcaccacgcgtcatgtacctctgcgccaccccggaatacctgcgccgccacggcactccgcagtcgccggcggaactcggccagttcaactgcctgatcggcagcagcgacctgtggagcttcctcgaggacggccgggaaacccagcaccgggtccagggcaactggcgctgcaacagcggccaggcggtgctcgacgccgccctgcgcggcttcggcctgtgccagctgcccgactactatgtgatcgagcatctgcgcagcggccgcctggtctccctgctggaaggccaccagccgccgaatacagcggtatgggcgctgtacccgcagcagcggcacctgtcgccgaaagtcaggcaactggtggactatctcaaggaaggcctggcgcaatcccatccgggactcgccggggagaaaaacctgcgctga

SEQ ID NO: 4157 - DNA, 1302 bp, Pseudomonas aeruginosa
agcagtaaggcgattcaccgctgcgatagacttggcggtttcccgttccacccgctatcgattcaaggaagtcgcatgtctgccttcaatgcgtttcgccaacgctacctggtgaggttctggtcgccgctgccggcgctggtcgccctcggcgtcgcctccgcctactacttcgcgctcaccggcaccttctgggcggtgaccggcgaattcacccgctggggcggccacgtgctgtcctggttcggctaccagccacaggactggagctacttcaggctgatcggccttcaaggcacgccgctggaccggatcgacggagtgatgatcatcggcatgttcctcggcgccctgtgctgcgccctctgggccggcaacgtcagcctgcgctggccgaccagcaaacgtcgcctgctgcagggtctggtcggcggtatcgtcgccggcttcggcgcgcgcctggcgatgggctgcaacctggcggcgttcttcaccggtatcccgatgttttccctgcacgcctgggccttcatgttcgccaccgtcggcggcgcctggatcggcgtgaagatcagcctgctgccgttcctgcgcacaccgctgaaagtcggcgccacggccagcgccctgcccagcgccgaaagcctggcccgacgcgcacgcctgcaggcccgcctgggcctggcggtgctggcgctcgccgcgctgttcgccgcctggcgcttcgaggtatcgctggtgctgggcatggcctgcctgttcggcctgctgttcggcggcctgatcgagcgcgcgcagatctgcttcaccagtgccgcacgggacctctggaccaccggccggacccgcgccgccttcggcatcctgctcggcatggcggccgcctgcatcggtaccttcgccgcgatccgcctgggcgtcgcgccgaagatcttctggatgggcccgaatgcgatcatcggcggcattctcttcggcatcggcatcgtcctcgccggcggttgcgagaccggctggatgtaccgctcgatggagggccaggtgcacttctgggtggtcggcatcggcaacgtcatcggcggaaccctggtggcgatcttttgggaccagttgggcacccgcctcgccctgccctatcccaagctcaacctgctggaaagcttcgggcccggcaacggcctgctattgaccttcgccggcctggccctgtgcctgctgctggtgcaactgaacgcctcccgattcacccgaccgcggaaaccgaaccatgagccagaccgacaaaccgaccctgtcgcttga

SEQ ID NO: 4158 - DNA, 1347 bp, Pseudomonas aeruginosa
gaagaaaaggggtggctcttgccaccccttcaccgtaccagactaggctcagccgcggaattccgcgcgaccacggtacggcgccttggcgcccagttgctcttcgatgcgcagcaactggttgtacttggacacgcggtcggagcggcacagcgaaccggtcttgatctgaccggcggcggtacccacggccaggtcggcgatggtcgagtcctcggtttcgccggagcggtgcgagatcaccgcggtatagccggcggccttggccatctggatggcctccagggtctcggtgagcgaaccgatctggttgaacttgatcaggatcgaattgccgatgcccttctcgatgccttccttgaggatcttggtgttggtcacgaacaggtcgtcgccgaccagttggaccttggcgccgatcttgtcggtcaggcctttccagccggcccagtcggactcgtccatgccgtcctcgatggagatgatcgggtagcgctgggtcaggccggccaggtagtcggcgaaaccggcggcgtcgaataccttgccttcgccttccaggtcgtacttgccgtccttgaagaactcgctggaggcgcagtccagggccagggtcacgtcgtcgcccagcttgtagccggccttctcgacggcctcggcgatggcggccagggcgtcttcgttggacgacaggttcggcgcgaagccgccttcgtcaccgacggcggtgttcaggccacgggccttcagcacggccttgaggtgatggaagatctcggcgcccatgcgcagcgcctcggcgaagttcttcgcgccgaccggctggaccatgaattcctggatatcgacgttgttgtccgcatgctcgccgccgttgatgatgttcatcatcggcaccggcatggagtactggccgggagtgccgttgaggtcggcgatgtgcgcgtacagcggtacgcccttggcctgtgcggcggccttggcggcagccagggacaccgcgaggatcgcgttggcgcccagcttggccttgttctcggtgccgtccagctcgatcatcgcgtggtcgagggctttctggtcggccgcgtccttgcccagcagcaggtcgcggatcgggccgttgatgttggccacggctttcagcacgcccttgcccaggtaacggctcttgtcgccatcgcgcagctcgagggcctcgcgggaaccggtggaagcaccggaaggcgcgcaggcgctgccgacgatgccgttgtccaggatcacgtccgcttcaacggtagggttgccgcgggagtccaggacctcacggcccttgatgtcgacgatctttgccattcttgttaa

SEQ ID NO: 4159 - DNA, 1107 bp, Pseudomonas aeruginosa
cactccgaagtgaatgaacggggcggtctgaggagactaggcagtctcgattgcaggaaagctcttgatcagctcgtccagttgcttgagctgggacaggaaggcttcgagtttgttcaggcgcagcgcgcacggaccgtcgcacttggcgtgctcggggtccggatgggcctcgaggaacagcccggcgagcttctggctgagcccggccttggccaggtcggtgacctgggcgcgccggccgccggcggagtccgcgcgaccgccaggcatctgcagggcgtgggtgacgtcgaagaataccgggtactcgaactgcttcatgatgccgaagccgagcatgtcgaccaccaggttgttgtaaccgaaggaggagccgcgctcgcagaggatcaggcggtcgttaccggcttcctcgcacttggtcaggatgtgcttcatctcctggggcgcgaggaactgggccttcttgatattgatcaccgcgttggtcctggccatcgccaccaccaggtcggtctgtcgcgagaggaaggccggcagctggatgatgtcgcagacctcggccaccggctgggcctggaacggctcgtggacatcggtgatgaccggtaccttgaaggtcttcttgatctcttcgaagatcttcattccctcttccaggcccggaccacggaacgagtggatcgaggaacggttggccttgtcgaagctggccttgaacacataggggataccgagtttctcggtaacccgtacgtattcttcgcagacctgcatggccaggtcgcgcgactccagcacgttcatgccgccgaacagcacgaacggcaggtcgttgccgatctggatatcgccgacgcgaacgatcttctgtgccatgctcaggccttcccggaatatttcagcgcggcgttgacgaaaccgctgaacagcgggtggccatcacgcggtgtggaggtgaactccgggtggaactggcaggcgacgaaccacggatgctccggggactcgaccacttccaccagggcgccgtcgccggagcggccggaaatcttcaggccggcctgttccagttgcggcagcaggttgttgttcacttcgtag

SEQ ID NO: 4160 - DNA, 585 bp, Pseudomonas aeruginosa
gcagcacctgtccctcgcccaggttcgcctggaatgcgcgatagcgggcgtcgcgcgccgcctgctcgatgctgccgccaacggcgacctgcacccgctcgacccgcagcgggatacccagcgaccggcagaccacctggcagtgcgccggccaaccgtccgccgcagcctgcaagccatggtggacatgcagcgccgacagcgccggcaaggcttcgctccgggccagttgggcgagcagatgcagcaacaccgtggaatccagcccgccggaaaacgccacgcaccagccccccgcttcgcgccagggcgccagggcctgtaacagacgggattcgagcggcaccgccggcatgcttgcgctcctcatgcgacaagcccggcgaatgccgggcttgtcgatcgtaccagtgcgccggatggcttacggcgcgccgtagctcatcaggcggtcgtaacgacgctccagcaactcacccatttccaggccctggagcatcttcagttgcgtcagcagttcgccacggatcgattcggccatgctcgccggatcgcgatgggcgccgcccagcggttcgtcgatga

SEQ ID NO: 4161 - DNA, 948 bp, Pseudomonas aeruginosa
tgggccgtttccgtttggcgccctaccttacgggatcgggcgccaggggtcgagccgggagcaagggcgatccgcgttttcccgccgcagagcgcggaacaacggcgttatcgcccatcgcgattaacgataattgaggaagacgttgtcgcgcccgaactggtcacgcaatgcctggatcagatcgtccgccggatccacccgccagctctcgccgaactgcagcagggccttggcgtcggcgctggtgtagtccagggtgatcgggcaggaaccgcgatggcggttgaacagctcgcccagccagcgcaggcgatcgcccttcaacaggtcggcgtgcagcttcatccgcaggctctccgccaggccggtacgcgcctcctccaggctcatcacgcgcttggcgcgcaggcgcagtccgccggagaagtcgtcctggctgacctcgccctcgaccaccaccagcgcgtcggtctgcagcagcgactgggccgcggcgaaggcttcggagaacagcgaggcctcgatccgtccggagcggtcgtcgagggtgacgaagcccatcttgtcgcccttcttgttcttcatcacccgcaggttgacgatcagcccggccaccgtctgggtatcgcgcgccggcttcagctcgacgatgcgctggcgggcgaagcgccgcacctcgccttcgtactcgtcgatcggatggccggtcaggtacaggccgagggtgtccttctcgcccttcaggcgttccttgagggtcagctccttgaccttgcggtggttggcgtagacatccgcctccggctcggcgaagactccgccgaacaggtccatgtgcccgctgtcgtggctgcgcgcggtctgctcggcggcctggatcgcttcctccatcgccgccagcagcacggcgcggttgaggtcgacggtagcctggtaggcctttag

SEQ ID NO: 4162 - DNA, 2133 bp, Pseudomonas aeruginosa
ctcgtcgtggtagtgcggccccaggcgatccagcgcaccggcgcggatcagcgcttccagggtgcgcttgttgatgcgtttcaggtcgacgcggtcgcagaagtcgaacagggtgttgaacggcccgccttcggcgcggcattcggtgatcgcctccaccggcccctcgccgacgcccttgatcgcgcccaggccatagacgatccggccatcgtcgtcgacggtgaagcggaactcggagttgttcacgtccggcgccacgatgcgcagcttcatgtgccggcattcttcgatcagcgtcaccaccttgtcggtgttctgcatatccgcggtgagtaccgcggccatgaacggcgccgggaagtgggtcttcagccaggcggtctggtaggagaccaggccgtaggctgccgagtgcgacttgttgaagccgtagccggcgaatttttccaccaggtcgaagatgttgcccgcgaggtcggcatcgatgccgttgttcttgcaaccctcgatgaaaccgccgcgctgcttggccatttcctcgggcttcttcttgcccatcgcccggcgcagcatgtccgcgccaccgagggtatagccggccatgacctgggcgatctgcatcacctgttcctggtacaggatgatgccgtaggtgggcttgagcaccggctccaggccggcgtactggtaatcggggtgcggataggacagctcggcgcgaccgtgcttgcggttgatgaagtcgtccaccatgcccgactgcagaggacccgggcggaacagcgccaccagtgcgatgaggtcttccaggcagtccggcttgagcttcttgatcagctccttcatgccgcgcgattcgagctggaacaccgcagtggtctcggccttctgcagcagcgaataggtcggcttgtcgtccagcgggatgaagtcgatgttcaccggctccaggcccttcttggcctgctcgcggttgatgatctccatcgcccacttgatgatggtcagggtccgcaggccgaggaagtcgaacttcaccaggccggccgcctccacgtcgtccttgtcgaactgggtcaccaggccgccgccttcctcgtcgcaggcgatcggcgagaagtcggtcagcttggtcggcgcgatcaccacgccaccggcgtgcttgccggtaccgcgggtgatgccttccagcttgagggccatctcccagatctcggcggcttcctcgtcgctcttgaggaagtcgcggagcatttcttcctgctcgtaggccttatccagggtcatgccgacttcgaacgggatcatcttcgacagccggtcggcgagaccgtaggacttgccctggacccgcgccacgtcgcgtaccaccgccttcgccgccatggtgccgaaggtgatgatctggctcaccgcgttgcgcccgtaggcgtcggccacgtagtcgatcacccggtcgcggccctccatgcagaagtcgacgtcgaagtcgggcatggagatccgttccgggttgaggaaacgttcgaacagcaggtcataggccagcggatcgaggtcggtgatcttcagcacgtaggccaccagcgagccggcgcccgagccccgcccggggcctaccggtacgccgttgttcttcgcccacttgatgaagtccatcacgatgaggaagtaaccggggaaacccatctggatgatgatatcgagttcgaagttcaggcgatcgacatagacctggcgcttggcctcgtagtccggggtgtccttcggcaacagcacctccaggcgctcctcgagaccttcgaaggaggcgtgccgcaggtagtcgtcgatgcccatgccattgggcgtggggaagtccggcaggaagtacttgcccagctgcacctcgatgttgcagcgcttggcgatctcgacggtgttttccaacgcttccggcaggtcgctgaacagctcggccatttccgccggcgacttcaggtattgctggtccgaataggtacgcggccgccgcggatcgtcgagggtccgcccctcgccgatgcagacgcgggtctcgtgggcctcgaagtcttcctgcttgatgaagcgcacgtcgttggtcgccaccagcggcgcgttgcagcgtga

SEQ ID NO: 4163 - DNA, 2115 bp, Pseudomonas aeruginosa
cgccaaagccaccgccgcgtggaggtgctcctcgtcgttgacccggctggtacgttgcacttcgacgtagaagcgctcggggaacacctccatccactcgcgcaacagcgcctcggccttggcttcctcgccgtcgagcagagcgtggccgatctcgccctccttggccgcggacagcgcgatcaggccttccgccgcctccttgacccagtcgcgttcgatgatgatctcgccgttgcgctggccttcgctccaaccgcgggaaatcagctcggtgaggttgcgatagcccttcgcgttcatcgccagcaggctcaggcgactgagcgggccatcttcctcgcggctggcgagccagatgtcggccccgcagatcggcttgatgccggcgcccatggcggtcttgtagaacttcaccagcgagcacatgttgctctggtcggtgaccgccaccgccggcatgcccagccctgccactgccttggccaggggcttgacccggaccaggccgtcgaccagggagaattcggtatgcagacgcaggtgaacgaaggatacggtcatgaaggccccggagcagaaataacgcaaaaacgacaaggcccggattgtaccgggcccggtggcaaagctacaggttcaagagcggacgatgcgcctcggctgcgccgagaagcctcgcccgccccgcgctcaggcgcggcggtcgtcccagatgcccggctcgagcttctgctggacttccgggaactggctggcgtcgaaggtcggcagcttgccggccttgcgctgggcgttgtagtccttggccagcttgatcgcgaggttggacagcagcaggatggcgatcaggttggtgatcgccatcaggcccatcgacacgtcggcaaggttccagacgaacggcagcgaagccagcgcgccgaacatcaccatcgccagcacgatcagacggaagatcaacaggcccgccaggtggttgtgctcgaggaataccaggcagttctcggcatagaagtagttggcgacgatcgaggtgaaggcgaagaacaggatgatcaccgccaggaaatagcggccccagtcgccgacctggctggtcagggcattctgcaccagcatgatgccctcgccttcctgcggtccggccagcaggatgatggcggcggaagcggtacagatcagcagggtatcgatgaacacgccggccatctgcacgtagccctgggacgccgggtgcggcggatagggcgtggccgaggcggcggcgttgggcgccgagcccatgcctgcttcgttggagaacaggccgcgcttgaagccgttgaggatcgccgcgccgatgccgccggcggcggcctcgtgccagccgaaggcactcttcaccaccatcgccaggacgcccggcagttcgctgaggttgaacaggatgatgcccaccgccagcagcaggtaggccaccgccatgaagggtaccgccagttcggagaagcgcgcgatggaacgcaggccgccgaagatgatcaacgcggtgaggatcaccacggcgatgccgctgatccaggtcggcacgccgaaggcgccctgcatggcaccggtgatggtattggcctgcaccgagttgaagacgaaaccgaaggcgatgatcaggaagatcgagaacaggatgcccatccagcgcgcgcccaggcccttctccatgtagtaggccgggccgccacggaactggcccttgtcgtcgcgaatcttgaacaactgggccagggtcgcctcgacgaagccggtcgccatccccaccagggcgatcgcccacatccagaacactgcgccgggaccgccgagcgtgatcgctaccgccacgccggcgacgttgccggtaccgacccgcgccgccagagaggtgcagagcgcctggaacgaggagattcccgagtcgtccgactggcggctgcccttgagcacgctgaaggtatgaccgaagtggcggaactggatcagccccaggcgcacggtgaagtacaggccgcaaccgaccagcagccagatgaggatcttgccccagataaggccgttgagcaggtcgacgacctgagtggcgaattcttgcatggataa

SEQ ID NO: 4164 - DNA, 255 bp, Pseudomonas aeruginosa
tcgccgatctgcacgttgtgcgcgatcatgatctggttgtccagcttcacaccgttgccgatcagcgtatcggacagtgctccacggtcgatggtggtgttcgcgccgatctcgacgtcgtcaccgatggtcaccccgccgatctgggcgatcttctgccagacgcccttctcgttggcgaaaccgaaaccttcgccgccgatcaccgcgcccgactggatactcacccgcgcgccgatggtgacgtcgtggtag

SEQ ID NO: 4165 - DNA, 1530 bp, Pseudomonas aeruginosa
acttacgcacgatgcactcctgcacaaagcatggtttcgttactcggtactacgtacaaatcagaaggtctggcccagggagaactggaagacctgggtttccgcgttgtccggcttcttgatcggcgtcgccaggctgaagctcagcgggcccagcgcggtgatccaggtcaggccgacgcccacggaactggcgaggttgtcggtcttgatgccgtcgcagttggtggtggtcttggtcgggcagtcggtatcgaaggtgctacccacgtcccagaacagcacggtacgcaactggcgctggtccttgacgaacggcagcgggaacagcagctcggcgccgccggtgatcaggatgttaccaccgaaggcttcgggatcctggtccgggtcggtgtagcgaccacgctcatcaggcccaggaatgatcttgccatccttgtaagccctagagggggtactacgaggccccagcgtgctgtccttgaagccccgcaccgagttgaagccgccggcgtagtagttctcgtagaacggcaggcgctcggtggatccgtagccgtcgccatagcccagctcggtgtggaagcgcatggtgtagttgtcggtcagcggggcgaagacctggccgcggtagtcgatcttgtagaacgacaggtcgctgcccggcagggtggtttccagggtcaggctctgcgagtgaccacgggtggccagcacgcccttgttcagggtcgattcggaccagccgatggaagccttgaagttggtgaagttgtcgccttccttgtcgaggaagtcgtagatctcgtccacggtgtagcggccggtgtcgatctggtcgcgctgcacgctcaggccataggtcaggcgcgaggtctcgctgatcgggtagccgatgctcatgccggcgcccaggctgttcaccgagtagctggcgacgtcgacgtcgagttcgtcgtagtcggtcttccggtagaaggcgttgtagccgaggctgacgccgtcgacggtccagtaggggtcgacgaagccgaagttgtagcgggtctggtattcgctgcgggtcaggccgatgctgaccttgttgccggtacccaggaagttgttctggctgatcgagccgccgaggatcaggccggcgctctgggcgaagccgacgctggcggtgatcgagccggacggttgctcttcgacgctgtagttgacgtcgacctggtcgtcggtgccgggaaccgccggggtctcgacgttgacttccttgaagtagccgaggcgctccaggcgggccttggactggtcgatcaggtaggtggaggcccagccgccttccatctggcgcatttcgcggcgcagcacttcgtcttcggtcttggtgttgccgcggaaattgatgcggttgacgtaggcgcgcttgcccgggtcgacgacgaaggtcaccgagacggtcttgtcgtcgtcatgggcttccggcacgccgttgacgttggcgaaggtgtagccctcgttgcccaggcgacgggtgattag

SEQ ID NO: 4166 - DNA, 885 bp, Pseudomonas aeruginosa
gtcggaggtggtggtcatcaccttgcgcgagaacacctggcccttctgtaccagcagcaggcgcttcacttcctcttccggcaccttcaggtcgccggtcagcttcacgtcgcggatggtgtacttctcaccctcgttgatgttgacggtgatgtagacgtgcttcttgtccggggtgatggatacctgggtggaggcgatatccatgttgatgtagccgcggtccaggtaataggagcgcaggcgctcgaggtcgccggagagcttttcgcgggcgtacttgtcgtcgttcttgaagaacgacagccagttggtggtcttcagttcgaacaggtcggtcaggtcttcttcggagaagacggtgttgcccaccacgttgatgtgggaaatcgcggcgaccgtgccttcgttgatgttgatcttcagcgcgacgcggttgcgcggctgcgggatcacttccgcgttgatctcggccgagtagcggccctgggccacgtactggcgttgcagctcgttgcgcacgccttcgagggtggcgcgctggaagatctcgccctcggccaggccggactgtttcaggcccttgagcaggtcttccttggaaatcgccttgttgccctcgatctcgatgctggagatcgacgggcgctcgactacagtgactaccagcacgttgccatcacggccgagctggatgtcctggaagaagccggtcttgaacagggagcgggtggcctggaccagggcctggtcgtcgatggtctcgccgacgttcagcggcagggcggcgaacacgctaccggcggacacgcgctgcaggccattgacccggatatcggaaacagtgaaggactcggcgtgaacctcggcgatcatcagcgctga

SEQ ID NO: 4167 - DNA, 333 bp, Pseudomonas aeruginosa
ttgcgcggcagcgactggaagatcgcgttgtgctcgctgtcgatcggcaggagcaccgcgccgctgcgcttgaccgcctgcatgaacagcgcgccggacatcaccagcgcctccttgttggccagcagtacgcgcttgccggcctcgacggccgccagggtcgacggcagcccggcggcgccgacgatggccgccattaccatgtccacttcgggcgcgctggccacttcgcacaacgcctgctcgccgaacagcacccgggtgcggacacccgccgcggcgagcaagccctgcaaggcaatcgccgcggcctgctccggcaccaccgcatag

SEQ ID NO: 4168 - DNA, 1488 bp, Pseudomonas aeruginosa
cggacgggcctcggcctcgacttgctcgctggtcttgccgaagcggcgctggcgcttggagaaatccgccagggcagcccgcatcgccgcgtgcttgaagtcgggccagaacaggtcggagaaatacagctcggcgtaggccagctgccagagaaggaaattgctgatgcgatgctcgccgccggtgcggatgcacaggtcgggcagcggctggtcgccggtcaccaggcagccctggagcagctcggcggagatatcgtccgccgccaggtgcccgccctggacctcgcgcgccaggcgctgtgcggcctggacgatgtcccactggccgccgtagttggcggcgacctggaggaggaaacgggtattgccggcagtggcggcttccgcttcgcgcatggccgcctgcaactccggatggaaacgcgtgcgatcgccgatgatgcgcaggcggatgccgttctcgtcgagcttgcgcacctcgcggcgcagggccacgagaaacagctccatcagcgcgctgacttcgtccgccggacgctgccagttctcgctggagaacgcgaacagggtgaggacctcgacccctgcctcggcgcagacctcgatcaccgccctgacggcatcgacaccggccttgtggccggcgacgccgggcagaagacgcttcttcgcccagcgattgttaccgtccatgataatggccacgtggcgtggcacgcacacatccttccgggtcttttccatgacgtcagcccggcctcagacagccatgaggtccgcttctttggcttccagtgccttctcgatctcaccgatgaacttgtcggtcagcttctgcacgtcgtcgccggcgcggcgctcttcgtcctcgctgatttccttttccttctgcaggtccttcaactgggccagcgcatcgcgacggatgttgcgcacggaaacccgcgcctgctcggcctcggcacgcgcctgcttggtgtagcccttgcgggtctcctcggtcagggccggcatcggtacgcggatggtggtgccggcggtggccgggttgagccccaggtcggaggtcatgatggccttctcgaccgcctggatcatgctcttgtcgaacacggccagggccagggtacgggagtcttccacggtgacgttggcgacctggcgcagcggcgtatcggccccgtaataggaaaccatcacgctatccaggatgctcggatgcgcgcgaccggtacgaatcttcgcgaaggcatggcccagcgcttccagggtcttgcccatgcgctcctgcgcttccttcttgatctcgttgatcattctcaaccctcctcgatcagggtgccttcggcaccaccaacaacaatattcagcaatgcgcccggcttgttcatgttgaacacccgcagcggcatgttctggtcacggcacaggcagatggcggtcaggtccatcacgccgagcttgcggtcgagcacttcatcatag

SEQ ID NO: 4169 - DNA, 456 bp, Pseudomonas aeruginosa
gcgccgaccacgtcgccctcgacgcgggtcaggcggcggatgttgacgttctcgccggtcttggcgaccagggccagacgagcttcctcacgtgcttcgaccagcggagcggcgtcggtcagcttctcgttgaaggccttttccaggctctcggcgacgaagcccttgaagtcgtcctggagggccaggaagtcggtctgggagttgacttcgatgatcacggcggccttgttgtcggcagcgatcttgacggcgatcgagccttcggcggcaatgttgccggccttcttggcagccttgatcgcaccggcagcgcgcatgtcgtcgatggccttctcgatgtcgccgccagcggcggtcagcgccttcttgcactccatcatgcccaagccggtacgctcgcgcagttctttaaccatggctgcagtaatttctgccatttcgaaatcctcttga

SEQ ID NO: 4170 - DNA, 999 bp, Pseudomonas aeruginosa
gtggtagctctcaaaaaacctttgtgcccggcctgccgggcagaaactcaaaggtggcaaaaagggggcctagcccccttcctgcgcaccgtcggacgtctgaacgtcccggaatcagccttcggcggattcggccggcgcttcctcgacgaactcgtcggcgctggtggcagcgccctgcttgccgcggattaccgcttcgcccatcgagttcaggtagagttgcacggcgcggatggcatcatcgttaccgggaattacatagtcgacgccttccgggctgctgttggtatcgacaacgccgatgaccgggatgcccagcttgttggcttcggtgatggcgatgcgctcgtggtcgacgtcgatcacgaacagagcgtccggcaggccgcccatgtccttgatgccgcccaggctgcgctcgagcttctcgaggtcacggctgcgcatcagggcttctttcttggtcagcttgtcgaaggtgccgtcctgggactgggtttccaggtcgcgcaggcgcttgatcgactgacggatggtcttgtagttggtgagcatgccgcccagccagcgatggtcgacgtacggcatgccgcaacgagcggcttcctcgcgaacgatcttgccggcggaacgcttggtgccgacgaacaggatcttgttcttgccagcggccaggcgctcaacgaaggtcagggcctcgttgaacatcggcagggtcttttcgaggttgatgatatggatcttgttgcgcgcgccgaaaatgaacttgcccattttcgggttccagtaacgggtctggtggccgaagtgcacaccggccttcagcatatcgcgcatgttgacttgggacatgatagttcctcgataagtcgggttaggcctccacgcatcccaatgaccaacccttgcgggcacccaggccatcgtgtcgatgcatgtgtgggtttgtgctccggaaaaggccgcagcctcggagcggggcgctttataccataa

SEQ ID NO: 4171 - DNA, 858 bp, Pseudomonas aeruginosa
atcggtcggtcaggtctgctagaatcgcgtattccttattcatgcgtgcttgcacgcccgaagagaattcgcatgaccgtcaccatcaagacgcccgacgatatcgagaagatgcgcatcgccggccgcctggccgccgaagtgctggaaatgatcggcgaacacatcaagcccggcgtgaccaccgaggagctggatcgcatctgccacgactatatcgtcaacgagcagaaggcgattcccgcccccctgaactacaagggctttcccaagtcgatctgcacctcgatcaaccatgtggtctgccatggcatccccaacgagaagccgctgaaggaaggcgacatcctcaacgtcgacatcaccgtcatcaaggacggctaccacggcgacaccagcaagatgttcctggtcggcaagaccccggaatgggccgaccgcctctgccagatcacccaggaatgcatgtacaagggcatttccgtggtgcgtccgggcgcgcacctgggcgatatcggcgaaatcatccagaagcacgcggaaaagaacggcttctcggtggtccgcgaatactgcggccatggcatcggcaaggtgttccacgaggagccgcaggtcctccactacggtcgtgcgggtaccggcatcgagctgaaggaaggcatgatcttcaccatcgagccgatgatcaaccagggccgcccggagacccgcctgctcggcgacggctggaccgcgatcaccaaggaccgcaagctgtccgcgcaatgggagcacaccgtgctggtcaccgccgatggctacgagatcctcaccctgcgcaacgacgaaaccttcccgcgcacctcggcagcctga

SEQ ID NO: 4172 - DNA, 2406 bp, Pseudomonas aeruginosa
catcgccaagggccgtggcggcgaccactcggaactcggcgcggtggacgccgaggccttctgccagagccaccagttgccgctctgggacacccaactggtgtcctggctggtgcagaaccacctggtgatgtcgaccaccgcgcaacgcaaggacctctccgacccgcaggtgatcttcgatttcgcccaactggtcggcgaccagacccacctcgactacctgtacgtgctcaccgtggccgacatcaacgccaccaacccgacgctctggaactcctggcgcgccagcctgctccggcagctctacaccgagaccaagcgcgccctgcgccgcggcctggagaacccggtggaccgcgaggagcagatccgccagacgcagaccgcggccctcgaccaactggtacgcaacggcatcgaccaggacgatgccgagcagttatggagccagctcggcgacgactacttcctgcgccacaccgccggcgacgtggcctggcacaccgaggcgatcctccagcacccggacgacggcacgccgctggtgctgatcaaggaaaccacccagcgcgagttcgagagcggttcgcagatcttcatctacgccgccgaccagcacgatttcttcgcggtcaccgtggccgccatggaccagctcaacctgagcatccaggacgcgcggatcatcacctccaccagccagttcaccctcgatacctatatcgtgctcgacgccgacggcgactccatcggcaacaacccggagcgcatcgccgagatccgcgaggggcttatcgacgcattgaagaaccccgacgactacccgaccatcatccagcgccgggtgccgcgccagctcaagcacttcgccttcgccccgcaggtgaccatctccaccgacgcgctgcgccaggtctcggtgctcgaagtcatcgcccccgaccgccccggcctgctggcgcggatcggcggcatcttcctggatttcgacctgtcggtgcagaacgccaagatcgccaccctcggcgagcgcgtggaggacgtcttctacatcaccgatgcgcgcaaccagccgctcgccgaccccgacctgtgcaaacgcctgcaggccgccctggtcgagcagctgtcacaagacaacggacgggacaccctgcctacccggataaacttctgagaagccttgccaacgccatgaataccgcactcgacaacctgcaaccctaccccttcgagaagctccgcgccctgctcggcggcgcccggccgcccgcgacgctgaagccgatcgcactgtccatcggcgagcccaagcaccgctcgccgagcttcgtcgccgaaaccctggcggagaacctggaccagctcgcggtctacccgaccaccctcggcctgccggccctgcgcgaagccatcgcgcgctggtgcgagcggcgcttctcggtgccggccggctggctggatgcggcgcgccacgtactgccggtgaacggtacccgcgaggcgctgttcgccttcacccagaccgtggtccgccgcagcgagcccggcgaggcgcccggcctggtggtcagcccgaacccgttctaccagatctacgaaggcgcggcgctgctcgccggagccgtgccgcattacctgccctgccgcgaggaaaacggcttcaaccccgacttcgatgcggtcgacgaggcgacctggcagcgctgccagattctcttcctctgctcgccaggcaaccccaccggggccctggtaccgctggagaccctgaagaagctgatcgccctggccgaccgctacgacttcgtgatcgccgccgacgagtgctacagcgaactttacttcgacgaaaacgccccgccgcccggcctgctcaacgcttgcgccgagctgggccgcacggacttcagccgctgcgtggtgttccacagcctgtccaagcgctccaacctgcccggcctgcgctcgggcttcgtcgccggcgacgcggagatcctgaagaaattcctcctctaccgcacctaccacggctgcgccatgccggtgcagacccagttggcgagcatcgccgcctggagcgacgaggtccatgtgcgcgccaaccgcagcctctaccgcgagaaattcgacgccgtgctggcgatcctcgacggcgtgctcgacgtacagcgcccggacggcagtttctacctgtgggcacgtaccccggtggacgacaccgtattcacccgcgaactgttcgagcagcagcacgtgacggtggtgccgggttcctacctgtcgcgcgaggtggacggcgagaaccccggcgccaaccgcgtgcgcatggccctggtggcaccactggccgagtgcgtcgaagccgccgagcgcatccgcgactacctgcgggcgcgctga

SEQ ID NO: 4173 - DNA, 720 bp, Pseudomonas aeruginosa
agcctgcgcggagaaacgaaaagggatcgccgcggcgatccctttttcgttcacacccagcgggcgaagcgattggtcagccagctttcctgctggtccagctcgcgcaggatgtcgcccagggtctcgtcgtcgatctcgttgttgcgccgctgccggtacagttccaggcgctgcgcgcgcaacgccttcaggcgcaaggccttgtcggcgatctccagggcttgggcctggtcgcgggcctcatcggtggtcggtgcggtatccagcgactggcggtattcggccatgatctgcgcacgcgcctcggcgacccgcgaagtattcgccgcatcgttgccttccacctgcggcaattcctcgctctccagggcccggatcgccgcctccgcggtcttgcgccaggcctcgcgccgctcgcgctcgtgggcgccattgttgctcgccggcagcccgcgcagcagcagcggcaggccgatggtcgcgccgatcagggaaatcaggatcacgctggtggcgatgaagatgatcaggtcgcgctgcgggaaggcgctaccatccatcaggctcatcggtaccgacagcaccgccgccagggtcaccgcaccacgcacgccgctcaatgcactgagggcggagagacggcgcagggagatgccgctcagcccgggcgggctcttgccgcgccagcggtcgatgcgcagcgacagcttccagtag

SEQ ID NO: 4174 - DNA, 621 bp, Pseudomonas aeruginosa
ccggcaccgaccacggtgaagaacaccaggccgaacgccatcatcaggatcggccagcgcatccgccagacttcccgcttgggaatacgccagccgtcgacgaacagcagcggcggaatgaacaggaagaggaacagctccgggtcgagggcaatgtgcagtccgagggacggcaaggccagcagggccccggcggcgatctggatcagtggtagcggcaagggcagcaactgggcagccaggcgggtggcgccgacgaccagcagcagggtcagaacggtgtacacggtttgcatgagggcggggatctccggcttcgtccctggacgatgcgactgcgtcgattgcaccatcgcgatcggtaggcagctatccgacattcgcacaatccgtacggtctttcctagccccgccgctctaccccgcgcgtccgccccctccgcggcgacgaccggggcgcccggccaaggttcccgcactagtacatccgagctatttcatagcggtgcgagacgctcctacactccccttcagtccaggcccgccgtagcgtcggccaggacgacgccccgaaggagtacggggtgcagcgcccactcagacaaaggaatgccgccatga

SEQ ID NO: 4175 - DNA, 450 bp, Pseudomonas aeruginosa
ccccgagaccgcacaggggcggaacgacgtggcataatccggcgatcacctttcggcgacctatcggcagggcccgggaagacccgggcctcgggagaagcaatgacctacgttctctacggcatcaaagcctgcgacaccatgaagaaggctcggacctggctcgacgagcacaaggtcgcctacgacttccacgactacaaggccgtcggcatcgaccgcgaacacctgcggcgctggtgcgcggagcacggctggcaaaccgtcctcaaccgcgccggcaccaccttccgcaagctcgacgaagcgcagaaggccgatctcgacgaagccaaggcgatcgagctgatgctggcccagccgtcgatgatcaagcgcccggtgctggagctgggcggcaggacgctggtcggcttcaagcccgacgcctacgccgccgccctggcctga

SEQ ID NO: 4176 - DNA, 636 bp, Pseudomonas aeruginosa
gcgggaggccgcatgagtgtcgcctgggccctgttcgtacccgcctgcttcgccctcaacctggcgccggggccgaacaacctgctgtcgctgaacaacgccgcccggcacggtttcgccaccgcctcgctggccggcggcgggcgcctgctggcattcgccggcatgctcgccctggccgcctccgggctggcgctggtgctgcacacctcggcctggctgttcctggcgatcaaggtgctcggcgctgcctacctgttgtggcttgcggtgcaattgtggcggaccgatgcgcagccactggtgaacgaagccagcccggcgcgtcccagcctctggcgcctggggcgccaggagttcctggtggcggcgggcaacccgaaggcgatcctgattttcaccgccttcctgccgcagttcgtcgatcccggccaaccgctgggcgcccagttcgcccagctcggagcggcattcctgctgctcgaatggctggccatcgctctttattcctatgccgggctccacctcggccggctgctcgccggccagcgggcccggcgtctgttcaaccgcggttgcgccgcgctgctcggcagcgcgggactgggcctgctgctcagccgccgtccggcctga

SEQ ID NO: 4177 - DNA, 1197 bp, Pseudomonas aeruginosa
acgaagcgctgcacgcgcacaactgagcccagctcgcctccccgctcgcccgacggtgctcgccagcgccgccgggtgcgctaccctttcccctgtaaccgtcctcgcacagtgtccgccatgtccctgccgtctccctggcgcgccgactttccggccttttccgccttcgccgcggaaggcctgacctacctcgacagcgccgccaccgcccagaagccacaggccgtactcgacgccctgaacggctactacctcggcggcgccgccaacgtccaccgcgcccaacatgtccccggcgagcgtgccacccgggccttcgaggccgcgcgcagccgcgtcgcccactggctgcacgccggcaacccggccgaggtactgttcacccgcggcaccacagaggcgatcaacctggtggcctatggcctggagcggcatttccggcctggcgacgaactgctggtcagtgccctggaacaccatgccaacctgcttccctggcagcagttggccctgcgccgcggcctggtcctgcgcgtgttgccgctggacgagcgcggggtgatcgacctggagcaggcccgccatatcatcggcgagcgtacccgcctgctggcgatcagccagttgtccaacgttctcggcacctggcaaccggtggtggagttgatccagctggcccgcgagcgcggtgcctggaccctggtcgacggcgcccagggcagcgtccacggacgccacgacctgccgggcctgggctgcgacttctacgcattctccggccacaagctctacggccccgacggcatcggcgtgctctggggtcgcccacaggccctggagcaactggcgcactggcagttcggcggcgagatggtacgccacaccggcttccacgaagccagcttccatgccgctccgctcggcttcgaggcgggcaccccggcggtttccgcggcgatcggcctaggcgcgaccatcgactggctggccaccctggacgaagccgaagtcgccgcccacgaaggcgccctccacgcccgcctgctcgccggcctgctggcgcgcgacggcgtcagcctgctcggcgaaccacaggcggcgctggccagcttctgcgtcgacggcgtgcacgtcgccgatctcgcccacctgctcggcgaacagggcatcgcggtgcgcgccggccaccattga

SEQ ID NO: 4178 - DNA, 825 bp, Pseudomonas aeruginosa
atcccacctgcgccagcggcgctacatcggcgaaacgcaggtcggcgaacagcgccgccgcgccgttggccgctgcctcataggccagcttgcgccctgtgggcaattgccggacctgcaggttcggctgcccggcgtcgtcgcgatagagatccaggcgttcgcccttcggatagcgcagttgcagttcgcgcacccgggcgaagggcagcgtggcgatccgccggtcgagccactccagctcgttgttcggcaacggcaggcgcttgtcgatcagccaggcctgcgggtcgcccagtcgtcgtacgaagctaccgccatgctgcgcatccttgcccaccagcagcaccagaggctcgccggactgccaatgcaggctcaggcgtagcgcctgcccctcgccacgctccgccaggccaagcagcgcgtggttcttcgggttggcgctcttcgcctcgagcttgcgcgcctctgccaacgcctcgagcagcgccgacaagcgtagccggtcggccggatagtcggccttggccggcaggacccacgcgcccgcacgccgctcgacccggatatccggcgaaccgtcggcaaactgcatgtgcaggccactcagcgtcgcgctgtccagttccggcagccagcgctctgccgccggcaaggcaggtacctcggttgcgcgctcgcgctgcagccaggcgaaggttccggccagcgccgccaccagcgccagcaggacgatcagcgtattgcgccgcatgcgtcaatgccctccccgggccatgcgccggcgccgccagagccagccgagcagcacgccgaccgtga

SEQ ID NO: 4179 - DNA, 549 bp, Pseudomonas aeruginosa
ggtcttctaccgcgagcgtatcgccctgccgccctcggcgcgcctgagcgtgagcctggaagacgtgtccctggccgacgccccctcggtgcagttggccagccagacccgcgagatcaccagccaggtgccgctggcgttccacctggagtacgacccgaagcaggtcaagccgggccacagctatgcggtgagcgcgcgcatcgagctgaacggccagttgctgttcatcaacaccacccgccactcggtgaaactcgacggcagcgacccgcagccctatcgcgtgcaggtcgaatcggcgcgctgaagcacaccgcggcatgccgccggtgcgaaccggcggttccctccagtacactccacctcctattcgctaccggttgccgatccacctcacgacgagcggccggataccccgtacgttccacatcaaggacgctgtcatgttccgactcactgccctctgcgccggcctgctactctcggccaacgccctcgccctgtccctcgccgacctgtcgcagaacgacgcctccagcggcctga

SEQ ID NO: 4180 - DNA, 1479 bp, Pseudomonas aeruginosa
tcgccaggcaggagaagagcatccgccagaacccggcggctgccgccaccggcctggccaagaaggtcttcggcgcggccaggtgagccgacggacggggcgcgatcgccccgtccccttctcccgtcaggcccgcgcctcgtccttcttcacgcggaaccaggcggcatagagcgccggcaggaacagcagggtgagcacggtggcgacgatcagcccgcccatgatcgccaccgccatcggcccgaagaacacgctgcgcgacagcgggatcatcgccagcaccgccgccagcgcggtcagcacgatgggccggaaacgccgcacggtagcctcgatgatggcgtgccagcgatccagtccatggctgatgtcctgttcgatctggtccaccaggatcaccgagttgcgcatgatcatgccggccagggcgatggtcccgagcatcgccacgaagccgaacggctggcggaacagcagcaggaacagggtcacgccgatcaggcccagcggtgcggtgaggaataccatcgccatccgcgagaagctgcgcaactgcaccatcagcaggctcaacaccaccacgatgaacagcggcacgccggcgttcaccgaactctggcccttcgccgcgtcctccaccgtgccgcccacctccagcaggtagccgtccggcaactcggcgcggatcggttccagggtcggggcgatctgcgcgaccagggtcgccggcagcgaatcgtcgtagatatcggcgcgcacggtgaccgtcggcaggcggttgcggtgccagatgatgccctcttcgaagccgtattcgagcgtagcgatctgcgacagcgccacgctccggccattctcggtcggcaccgccaggctcggcagcaacgacaggtcacgacgctcctgctcggtgccgcgcaggaggatctcgatcagctcgttgtcttcgcggaagaagctcacgtgcgagccggtcagcgcgctctgcaggaactgcgacaggctggcggtgctcacccccagggcacgggcgcgctcctggtcgatgctcaggtacaccaccttgctcggctcttcccaatccaggtgcacattcaccacgtgcgggttctcgcgcatcttgtcggcgaccttgcgcgccagttcgcgaacctgcgggatgtcctcgccggaaacccggaactgcaccggatagcccaccggcggcccgttctccaggcgactgatgcggctgcgcaggtgcgggaagtcctcgttcatccgctcgatcagccacttgcgcagcgcctcgcggctctccaggtccttggccagcaccaccacctgggcgaagctggccgccggcaattgctggtccagcggcaggtagaagcggggcgagccagtgccgacgtaggccacgtagttgtcgatgccgtcatggccctgcagcattttttccaggcgctggacttcctcgccggtagagcgcagtga

SEQ ID NO: 4181 - DNA, 2250 bp, Pseudomonas aeruginosa
ggcgccctccgccagcttgatgtccagcagcagctccagacgcgccgagggcgggaagaactgctgcggcaccaggcggaacagcagcagcgcgccgacgaaggcggcgagggtcaggacgatcaccgtcttgcggtagcgcacgcaccactccaccagacgccggaagcgctggtagaaggccgtagcatagggatcgtagccatcggcgctgccgccgtgcttctgcgcgtgcaacctggccaggtccggcagcagcttggcccccaggtagggaacgaagaccaccgcggcgaaccaggagaccaccagggcgatggtcaccacctggaacagcgagcgggtgtattcgccggtgccggactgcgcggtggcgatcggcaggaagccggcggcggtgatcagggtgccggtgagcatcgggaaggcggtactggtccaggcgaaggcggccgccttgagacggtcgtagccctgctccatcttcaccgccatcatctccaccgcgatgatcgcgtcgtccaccagcaatcccagcgccagcaccagggcgccgagggagatcttgtgcaggccgatgccgaagtaatgcatggcggcgaaggtcatcgccagcaccagcgggatcgacagcgccaccaccaggccggtgcgcaggccgagggagaagaagctcaccagcaggacgatcaccagcgcctcggccagcacccggatgaactcgccgaccccggtacgtaccgccgccggctggtcggacaccttgcgcagttccagtccggccggcagcgactgctgcaggcgggcgaactcggtttccagggccttgcccagcaccaggatgtcgccgcccggcttcatcgctaccgccaggccgatggcgtcctcgcccatgaagcgcatgcgcggcgccggcggatcgttgaagccgcggcgaacctcggccacgtcgccgatgcggaaggtgcggtcgccgacgcggatggggaagtcgcggatctccttcaccgaatcgaaacgcccggaaacgcgcaactgcacgcggtcgctggcggtctcgaagaacccggaggaggccaccgcgttctgttcctccagcgccttctgtaccgccgccaggggcaggccgagggtggccagcttggtgttggacaggtcgatccagatcttctcgtcctgcaggccgatcagctcgaccttgccgacgttcctgatccgctgcaattgcagttgcaggcggtcggcatagtccttcatcaccgcgtagtcgaagcccttgccggtgagcgcatagatgttgccgtaggtggtgccgaactcgtcgttgaagaacgggccctggatgctttgcggcaaggtggcgcgaatgtcgctgatcttcttgcggatctggtaccagagttcggggatctcgctggaatggatgtcctcgcgggccatgaaggtcacctgcgagacgccggggcgggagaaggacacgatgcgatcgtagtcgccggtttccatcagcttcttctcgatacgctcggtgacctgccgggccacctcttcggcgctggcgcccggccagttggtctgcaccaccatggccttgaaggtgaacggcgggtcttcgctctgccccagcttgctgtaggacagcgcgccgaccgcgccaagcaggatcatcaggtacaggacgatctggcgattctgcaacgcccaggcggaaaggttgaaggacatgcgactactccttggccgccagtttcaccgtgcggttggcccggtcgatcggacgcacctgctgcccttcgcgaagcacctggaccccggtggccaccacccagtcgccagccttcaggccttcgagcaccggcacccggtcctcggcatagggaccggtgcgcaccgcctgccggcgcagggtcgagctgcccggctcgaccacccagacgaacgcctggccggcctctgcggtcagcgccgacaagggaaccgataacggcaccgcctcggcggcggcgacgtagacccgcgcgctctggcccagttcggccggagtcgcgcggtcgtcgaaggccacccgggcggcgaaggtacgcgattgcggatcggccgcgggcgagagctcgcggatatgcccggcgaagcgtctgtcgcgttgcgaccagagttcgaccgacaccggctggccgatgcggaaacgttcgaagctgtgttccggcaggccgatcagcacctcgcgttcgccgtcggcggccaggctga

SEQ ID NO: 4182 - DNA, 939 bp, Pseudomonas aeruginosa
ccttgccgccgatgcggaaggccagctccggctcgtggcgggcgcggatctcgccgggaaaggcctggctcacctcccccgccggctggggctggacgacgatcgccggacgcgccgcggctggcggcggcgtgccgttgccgcaggcggcgaggaacagggaggaaaacagggacagggcgacgagcgggatatggcggtacatgtgacaccttccgcaaactgcgttcgagttcttatactgggcggtatagtaaaaatacagaacccatcagtccagtatttcaattgtataagcgcatgtcagaacccacctcctccgtcggtcccggccggcccaaggacccggccaaacgggaagccattctcgaggcggccaagcgcctgttcctctgcaacggctacgacggcagcagcatggaagccatcgcctcggaagccggcgtttccaagctcaccgtctacagccacttcaccgacaaggaaaccctgttcagcgaagcggtgaaggccaagtgcgccgagcagcttcccgccctgtacttccaggtggccgaaggcgcgccactggaaaaggtcctgctgaatatcgcccgcggcttccaccggctgatcaacagccacgaggcgatcgccctgacccgcctgatggccgcgcaggccgggcagaaccccaagctttccgagctgttcttcgaggccgggccgaagcaggtgatcgacgagatggaacgcctcctcgagcaggcccgccgcagcggcaagctggcgttcccggacgcgcgccacgccgccgaacacttcttcatgctggtcaagggctgcgccaattaccgtctgttgatcggctgcgccgaaccgctggacgaggccgaaggcgagcggcacgtggaagaagtggtggcgctgttcctgcgcgccttcgccgcgggcggctga

SEQ ID NO: 4183 - DNA, 459 bp, Pseudomonas aeruginosa
cctcgcagcccaggctggcgaggacgaacccatcccggcccaggccggccgtggcgtccaggacccgcgggcggatgcctggctggacgccgaccgccttggcgatcatctgtccgctgccgccgccgaacttgcgccggtgggcgctggcgccctcgacgaaatcgacccgcaccggaccgggggagtccgcccccagttgcaagacctgcaagccctgctcgccgacctgcacggcgaactccgcctcgtcgtccgccgccagcggcaggccgagccgctccgcccagcgccgcgcagcctcggcgcaatcggcggacagggcttggacatgcaggcgaggagcggcggaatcggtcatggtcgggcaatcgtcggggaaagcgcggattttgccagagttggcccgcgcgcgctcaccggcagaccttccataggcccatgtcgaggtggaagtga

SEQ ID NO: 4184 - DNA, 1362 bp, Pseudomonas aeruginosa
cgccggcaagcctggcaggcgctggcccagcagcgcatggaaacgctgggcctgctgggccgccaggtgattgtcgggggtatgcaggaatacgtatggagtcaggccggcctcgatccagtcggccaccttgtcgacccagggcaaaaggaacacctcgttggccggcaggtcgggaccgccgatgaaacgcacctgtggcgtatcgctgaaggccgccggacggatcggcaggcgcggcttcttcgactgggcgtggagcaccgccggatcgtccgaacggcaactgaacagcgcccgcgaatccaggcagatgcgctccacgccacgctcgcgcaggtggcggttgagcaggcgctcgtcctcgcctttgtcgaagaacgccgggtggcgtacttccacggcaatccgtcgcggactcagctcatcgaggaaatacagcagttcgcccaggcgctgcggggtgaacgccgccgacagttgcagccacagcgggctgaccctttcgccaagcggcgccagcagttcgaggaagtcgccggcggcctcgagccgttcgcgcaggtcgccttcgtgactgatatcgcggggaaacttggcacagaagcggaaccccgccggcatcgtctcggcccagcgccgcacggtttccgccgaaggccgggcatagaaggtggtattgccctcgaccgcgttgaagatgccgccgtagtgtccgaggtagtcggcggaacgcaattcgcgcggatagaagctgccgcgccaggccgcctcgttccaggatggacaaccgaggaaataaggaagggaaaccacgggagcgcagggaaccgctcaggcgtagaggtcgaggccgaggacatcctcggcgccggcgtcgatgttgaggctggcggtggagttgtagctggccagggccatcgccgcatggctgcttaccgggcgctggaacgccagcaggtcgcgggcgctgaccggcaggctgtcgccgcccgccgaactggcctggaccttgcgcgcctgcggcgcctgctcgaagccctggctgccggaaaccggcgccggctgctcgcgccgcgcctcgacctcgcgctgcacgtcgcgatacggcgtgaccgcggagcccggtcgggcgctgcgctccagcggcaacgaagaggaagaaagaccgtcgatacgcatgatcaaaacccggggaagtctccacactctagccagccccgaaaggcttggcaattaccgctgcgcggcattttcagggcgcttttttcggcgtcgccacgttgtcgcgcaggtacaccggcagcgcctgttccgcctccacgccttcgccgcgcgcccaggcgaagccggccaggctga

SEQ ID NO: 4185 - DNA, 792 bp, Pseudomonas aeruginosa
cgcacggtctcttccttgtcgtcctcgcgctggatcagctcttcgccggtaacgtcgtccttgccggcgaccttcggcgggttgtgctcggtgtggtacacgcggccggaggccggatgcacgcgacgaccggcgatacgcgacacgatctcctcgtcgtcgacggcgatctcgaccacgtggtcgatggtcacaccggcgtccttcagcgcttcggcctgcgggatggtccgcgggaagccgtcgaacaggaagcccttggcgcaatcggcctcggtgatgcgttccttgatcagggcgatgatgatgtcgtcggataccaggccgccgctgtccatcacgcctttcacctgctggccgagcgggctgccggccttgactgcggcgcgcagcatgtcgccggtggagatctgcggaatgccgaacttctcggtgatgaaccgtgcctgggtgcctttgccggcaccgggtgccccgagcagaatcacacgcatcgatatgctccttagaattggtaagcgaaagtctggatccgcctcgtggggccaatctcgtatttgcaggaaacggcactgtatggcgccgaaaaggctgtccaagatacacagcgcccccccaccgcacaagacaccgaaagttgccccccgccttccctcatccggtgttgcgcagtccggcggcgacccccgcgaccgtcaccagcagcgcctgctccaggccgccgcaggcgtcgccctggcagcgccgcgaacgggccagaagctcagcctggagcaggtgcagcgggtctag

SEQ ID NO: 4186 - DNA, 2454 bp, Pseudomonas aeruginosa
acagccagcgcaaggggcgccaagtcatgcgcgccgcgctcatggcctggctcctggattgcccttctgcaactggtcgaggcggtcgggcaccggatcgccctcatagatgccgcgcgagcctgccgcgcgcgtgccatggcgctggatgatcgccatcggcgagttgttcgccagctcgcgccgcagttcaagttcggtcttgaggttgcggatctcccggtcgagcgtgtcgctctcgtggttcacggcctcgaccgccaactcgttggctgccacgttgggctctttcttgccggtgagcagcgtgcgctggagcagcagcgccttctccagcaccgacgacagcgccacctcggacgcgaggcgccgcgccagcaggtcctggtcgggctcatcgcgcagcgcctcgatcacgccgcgcgtgatcggcagcgacgtgctgccagcctcgcgcaggttctcaaaggtggtattgcgcgtgccggaaaccagctcctgaaggacctccagcttcgcctcgtactcttcctggatcagcggcgtcagcccgacgccgggcaccgtctcggtcttggtgcaggagtcgcacgtgcgctgcacctgctctccgaggacccgcgtggcccattcggtcgcctgctgcggcgacgtccaggtctggcaggacaggctcgcgcaactggtggacgcgatggaggaggtgtccgtcacgccgcgaccgttgaccaggttgtagcccgcgcgggtgacgtcgccgaccacccggatggcggactggcccgcaccaccggcattgctgccgcccacccagggaacgccgtcgttgccgcggcgcgtctcggcctgctcgacagccgacacggcatcgttgctgccaaccgcgtcacgcaaggccatgccttcggccatttggctccagccaagctggccacccgccgtctcggccatcttctccgccatggcgcggcacgtcagcttggagcggtcgaagtccagccgcgcctgcagcacgccgttggtcagcaggttgtacaggcccggatcggcgcgctgaatgatcagcgccggcagcgatgcaaccgcgctggtcgcgctctggatcacgttgctcatgatctgctgaaagccgttcgtgatgccgttgagctgattgcgcagcgtggtctggatgctcatatcgccgcagatcaggttgctgttccaccccacgccgaccccgatggagcgcatgccggccgcgcggcccatggacaccgcactgccaccgccgatcgagtacatgacgtcatcgccgaggacggggccgctgttctggtatccgacctgcgcccacgccaggccgcagaccagagcgagcgtgccggccagcgccgtcgggcgcagcaggcggcacgccttggcggaaaggttgatcggttcaggacgcttcatcgtggcacctcagaggaaatcgacgctgcccaggaacacctgcccgcggcgttcgcagcacgcatagggacgccacagcgcccaggcgtagtcgccttgctgggcctgggtcagcgtgccgctgtgcgggaacaccacgcaggtgttggacaggcgcggcgtcagctcctgccacttgcccgtagaggcatcaccctccatcagcgcgccggccggccagtagccgtcgcgggcgttggcaagcagcggctggtacacgtggatctgcccgcggcgcgtgacgacatcgcccgcgcgctgggccaccactgccccggatttgtggtcgtcggtctggtgcaggaagccgccgcgcggatagacgtttccccagagattcatcgtggtgcgcgcaccgacctcgcgcatgcccggaatcaacgcctccgggtaggccatttcaggcacgttgtagcgccaggccagcgtgtccagggtgctgagcagatacggcatgaaggccgtgcccgcgccctggcagaaatagcccgacgacgacgcgaactggttgaacacctccccgccaggatggccgatgacatcgctgttcttgaatttggcgaggttgttttcgtggtcttcgttagtggtcccatcgccgccggcctgtgcggagggattgggcgtgctcatcgcctgcacctcgacccaggggttctcgccggtgttgctgtagctggagacgaccgcatcgggcacgtagtgcctgaccttgaccgacgtgcgcaccgagcagccgccataggtgcagtacagccagtagcagatgcccaccacccggtactccaggcagtccggcgacatgacggacgagacgatcgtggcggtgttcaaggcgtagctgcctgtggcggtggccagcagcagcgaggccacgggcacgcgcaggcggcgcagcagatcgaatgggcgcgtcatggctgcgccctccggtgctgctcgatgcgcgcgatggcgcgggcgacgtccggctcgccatag

SEQ ID NO: 4187 - DNA, 537 bp, Pseudomonas aeruginosa
agcggctcatcgcatgctcctgcgggtggaccagaagcccgagcgcgagatcagcacatggccaccgacccagcctgccatcagcggatggcgcgtggcgatgcgccattgcagttgccgatacagccaggtgtcgggacgcccacgcttgaggcggcgcaggatgccgccgccgatgaagacgccgagcgccacgcccaggacgacgaacgtcggcgccagcgcgatcgtgcggaacacccaggacagcggcgcgccgaccagcaggccggcggcgccggacaggccgcagcaaatccagagttcgtcagcggtgaggccgcgcaccacaacgggatggcggttgagccggtgcggaaggaaggtgaccgttccgtccgcacggacgtgctgctgctcggacataccggcctcgcttacaggatgccggtggcttcggtgagcagccagatgccgatcacgagcagcacggcgccgatggcgaccgtgaggccgaactggccccacgtcttgcggccggtgtggatctccgcgtag

SEQ ID NO: 4188 - DNA, 480 bp, Pseudomonas aeruginosa
gagctacccatgaccaccgccactgcccaatccaagatgacccttcccgccgcgggagaggtgaaggcagccgtccagggtcaacgtgccttggcggcttacctcgcaacccagttcgagacgcagcacatccagatctttgatgaccacaaacaggctcatcaggtggaactgcctacctcggctttacgcctgctggtcgacatcctggccgagttggccgatggcaatgcagtaaaggtggtgcccgtccatgcagagctgacgacccaagaggcggcggacttgctcaacgtgtcccgtccccatttcgtcaagctgctcgaagatggggtgttggcatttcatcgcaccggcaagcaccgcagggtgaggttcgccgatctgatgcagtacaaggaagcgcgcgagcgcgccagtgagcaggcgatggccgaactcgctcagcagtcgcaagagttgggaatgggatacgaatga

SEQ ID NO: 4189 - DNA, 963 bp, Pseudomonas aeruginosa
cgagtggccggatcccgccggacttggcccggcaatcagcaacgatatggatgccgcgcgcaagcagcgcgcgcagcagctgctgttccaggcgagccaggacgcaagcatcgccatcgaccacgcgcgtcgtggtcgcaatatcgaagcgcttcgcgcctggcgcgcactgtttggccccaagttcccactgtcctgattccatcggcttccatacacgtcccatcgaggtacagcatgtcccagtggtcgctttcccagctcctgtcgtccctgcatgaagacatccagcagcgcttgtccgtagtacgcaagaccttcggtcacccgggtgcgaagggggatgcgagcgagaacgtctggatcgacatgctggatacctatctgcccaaacggtaccaggcggcgaaggcgcatgtggtggacagcctggggaacttcagccagcagatcgatgtggtggtgtttgatcggcaatattcgccttttatcttcacctacgagaacgagacgatcattccagccgaaagcgtgtacgccgtgttcgaggccaagcagacggctgacgcggggcttgtggcctatgcccaggagaaggtcgccagtgtgcgcaggctgcaccgcacgagcctgccgatcccgcacgctggcgggacctacccagcgaagccgttgattccgattctgggtggcttgctcaccttcgagagcgaatggagtcctgcattgggcccatccatggacaaggcgctgaacgcaaacctcaccgaggggcgtctggacatcggatgcgttgccgcccacgggcactttttctatgaccaagccagcggcgcgtacagctacaccaacgaaaacaagccggcgaccgcgtttcttttcaagctgatcgcgcagcttcagttcagtggaacggtccccatgatcgatgtggaggcttacggtcagtggttgaccaagtga

SEQ ID NO: 4190 - DNA, 1980 bp, Pseudomonas aeruginosa
ggggtcgctgtggcaagcatacgttcggagtaccaccggttcctggcgcacttgacgcagcggcacgtgcacgacgacgtgcgccggctggcgcacctggtgctcgatcacctgcagccactggccgaggtcggtgctgcacgccgggggcgctccacgcgcttggcgccgctggccatcgcgcatctggcgcagatgcctgtcgcctacgacggggacgcgcgcggccccgaaaacgggccggcgctcgggcgactgcaccagctcgaagtcgggccgtttcgaggattcatgcggcaggagacgttcgacctcagccatgacatcaccttggtctacggtgccaacggcaccggcaagagcagcttctgcgaagccttggaagtggcgatgctcggttcgatcagcgaagcgcaggccaagcgggtcgaccagcggacgtactgcaacaacgctcgcctgcgccgccacatcgcgccagtcctgtcgtctacggcggcgggcgaggcgcaggccgtccagcccgacgaagctgagtatcgcttctgcttcatcgagaagaaccgcctcgacgatttcgcccgaatcgccgcgcggaccccgagcgatcagcgccagctcatcgccaccctgttcggcgtggaccagttcagcgagttcgtgcgcggcttcaacccctcgctcgatcaggacctgatgcttgccggcgtgcaggcggcgcagctggcgcagcgtcgcctgcagttggcgaactccgaacagaccatcgccgcctacccgcagaagatcgcagcggtcgagggcctggaacaagctttggcgcagcgcatgtcacctggcgcgacctatcaaacctgcgtggactggctgctgggtacgccgcagcagcaaggacggctaccgtatgtccaggctcagctggacgccaacccgcctgccattcacgaggtgacccaggcccgcctgcaagcgttgctggcagaggcctaccgcgtccagggactgtggcaagcgtcttccgcgcaactcgcggcccgcgccggcgaggtgtcgtacgcgaagctctacgaggccgtgcaagcgttggcggacggggcgaccgcgtgtccggcatgtggaaccgaactggccgccgtggcgcaggacccgttcgccagggcgcgaatgggcctggagcagctcgcgcaactggccgtcctgcagcagcaggaggccgggcatcggacgcagttgagcgaggcggtccgagcgctgtgtgacgaaatgcgccgcgtggtggcggcggctggggtcgcttgtcctgccgaatcgcaggccgcgggcctgccactgctgcctcccacgtcggcgggcaattggctcggcggcggggtgaatggggaccagcgcgcctggcaagccctcttacggatcgcacagatcatcgaaggcttcgacgcgcgggcgcgcgacgtgaatgcccagcgcggcgcgatggcccaggagcgggaccgcctgcaacagcatcagctggagatcgaacggctgcggaccatgcgcacgactgcggatcaggagctggcggccgcccgccaaaccgtggcccaattcgacgacgcgaaccgcggcctaatccaggcggccacggacgaaatgccggtggtggtgcaccatcagcgggtcaaggccgcctacgacggcttcctgcccgagattcaggcatacctaaccgctctgccgggggttctgctacaggggctgggagaccaagcccgccatctctacaacgcattcaaccgggccgatgcccggcgatctgctgcacgcgctgtggttgcccgtggccgagaacggcaagatcgaggtggagttcgccggcgagccgggcgcgcgctacgacgcgttgatcgtcttcagcgaagggcacatcaaatgcctgggcctggcgattctgcttgccaagaacctcgcgcagggctgccccgtggtcatattcgatga

SEQ ID NO: 4191 - DNA, 375 bp, Pseudomonas aeruginosa
tgccgcaggcccaggcgatcggccaggtcgtcgccggccacgggcgcgagcggtacgccaggcaccagagcgcgcagccgtgccaggctctgcgcggtctcgacgttgaccaccaggccgaccgcgccgcgttcacgcaaagcggcggcgcggcgctgcaaccagacccgggaagcctcgtcgtcgccgatgaccgcgaacggccgcaggccgggcgcttcgatcacgcgccgcgcgacggtaccgggcgtgagcttgctgctgcgcaccggcagcatcgcggcttcgtccgctggcgtggcgggaacccggggcgtcgggatgggggggcgggccggcgcgttggcgcgcggctggaggttcagggcttcgtag

SEQ ID NO: 4192 - DNA, 1248 bp, Pseudomonas aeruginosa
cccggctgccgtggaaggctccttggaacgacaaagcaaggcgttcttcgataccgccatgacgctgcgccgacgcatcgagttgttcctgtcgctgccgatcaagagtctagatgccatgtcgttgcagcgcgaactgcgcgacatcggccgccagtgaggcctgaaccgatgagcgcaaccgataccgccggccccgcgccagcaaactccgccatgagcggctttgagcgttacctgacgctatgggtggcggtgtgcatcatcgcgggtatcgctctgggccagttcgcgcccgccgcattccaggccatcggccgcatggagatcgctcaagtcaacctgccggtgggcttgctgatctgggtgatgatcatccctatgctgctgaaggtggacttcgccgcgctcggccaggtgcgccagcattggcgaggcatggggatcacgctgttcatcaattgggccgtcaagccgttctcaatggcacttctggcgtggatcttcatccgccacgcttttgctgattggctgcccgccgaccaactcgacagctacatcgccggcctgatcctgctggctgccgcaccgtgcaccgcaatggttttcgtttggagccgactgactggcggcgatccggcatttacgctgtcgcaagtggccttgaacgacaccatcatggtgctcgccttcgcacccatcgtcggcctgctgctgggcctgtcctcgatcacggtgccttgggacaccttgctggtgtcggtgggtttgtacatcgtcattccggtcatcctggcccagctttggcgccgggcgctgctgcgcaagggacaggccgcgttcgacagggcactggaacgcatcggcccgttgtccatcgccgcgctgttgctgacgctggtgctgctgttcgccttccaaggcgaggccatcatccggcagccgctggtgatcgccatgctcgcggtgccgatcctgatccaggtgttcttcaattccgggctggcgtactggctcaaccgccaggcgggcgaaaagcactgcgtcgctgggccatccgcgttgattggtgccagcaacttcttcgagctggccgtggccgccgccatcagcctattcggcttccattccggtgcggcactcgcaacagtggtcggcgtgctcatcgaggtgccggtcatgctgctggtggtgcgggtggtcaaccgctcacgcggctggtacgaacgccgcgcgaccacttcgtaa

SEQ ID NO: 4193 - DNA, 972 bp, Pseudomonas aeruginosa
tgtgcgcagggacaaagaaaagccccgcaacgagtgcggggcggccatgacggtgcggtgaggctggatcagcggggcttgtcgcccaggacatgctgcttccagatggcgaatgcctcgtccgctggcagctcggccaggatgacgatgggctggtcctgtcggctgcgcagctttgcgaaatatgccgcgcggtcggcaatggccttgagcttgatgcccttgaggaacagcagccggccgtccttgatgaacagcaccttgttgccgatgtcgcggttgaacgcggtgcgcagcttgcgctctgcgtgcatggcatcggccaactggtccacgaggaagtcgagcgtcatgtcgatgagaagtggctcgtcgtcctcgcgttcgacgtcgagcgatgccggcggcaggctcttggcgaattcctcggcttgggccagcagcgcggcctggccttgcaacgcgcgcacgaacgtcgagccgccgtgtccgtcattgcgggcttcggccatgggcctgccgtcgaacatgacggtggcggtgaagcacagcgtttcctcgctcgcgaaatccgcgaccttgaggttcttgagcgtgatgcggtcttgtcgggtgatggtgtccatggaaagtcctgatatcgaccgggttgacgacacgcccctgacgggacgcggcatacatcccgtgggttggaggaaggtggcatcgatgcccggtgggcagcgttcgccggtgagatgccggggcgaactggcgggtggcgtgggaggaacccacggcagccttgacaccctggctgctggctgttgccgatgcgtcggcaatgcaggaggaaggatcgcgcgacctgccggccgcgtcgtacatcaatccgtagcgctcgatcccgtcttgtgcaggcattgcaccagccgctggcccagccacgcgacgcacggcacggccatggagttgccgatcgccttgtag

SEQ ID NO: 4194 - DNA, 264 bp, Pseudomonas aeruginosa
tcgctcgctggtggacagggagccgccagcatccgcatgcggcggaaggcagtcagtcaacaaaccgaaatgagccggcccccggttctgtgcgcgctggcggcgcagcgcgcaacggtcccctggggaccgctccgcagatgggcattcacgttggcgctccgggcctcggtcgtcgacgggttgcgtgctgcaccgcacgtcgcgctgtcgttcgacgccatccttcgcagcacggccgtccccaggggaccgttccgctga

SEQ ID NO: 4195 - DNA, 261 bp, Pseudomonas aeruginosa
accggattgctgcacgccttcgttgaggctggctgccactacactggcgccgcgttgcgctccggcgaagttagccgcagcgatgtaaagatgagtacttgcggtgttccgatgccggcggttgtgtcctacagccgtccaggtgccaggcagtccacgcgacaccaccccgcgctgcctgcggagcgagcgcaagtcatgatcgtcgcaagttggagttcgatagcgaacccgctcagcagctggacgcatcaggcgtaa

SEQ ID NO: 4196 - DNA, 1473 bp, Pseudomonas aeruginosa
ccgcgccttgccctggcggatggtgttgccatagcacttccaggcataggcggagagcgctgcgtagaaatcgtccagcgcgttggcgttgcgcaggaagtaaccggacagcgaccggttgtcgtcggacaccccggtcccctctccacaatggatgtgcaggaccaccttgcgggtttccggcttgccgtccaggtagcggcgaaacaccgcggcctgtccgaggaggaagtcgaagaactgtcggtacaggccggtagcggtctccatgccgagcaggtcgatgccgaccagccgggcctgcggtggctgcccctgctgtatttcgaaatgacggaggatcctgtgcagctcggcatcgaaggcggcttcgctggcatagccatgcgcggtgtgggcgagcaggcggtaggcggtcttctcggaggcgttgaattgttcgaacagggaatcgaggacggccacctcgtcttcccccgtcgccgtctgggtatggctgattccttcgtggaggaggaaccccagcgtcaggcaggcgaattcgcccggatggcgatcgcggatggcgccgcgggcccagtaggcgtcgtcgaacggcgtgtacttgttgccgctccagatcttgcggttgaagtagcggacgaactggtccgtctcgctgtcgcgaaccgcgctcgcaccgagcagttccagggtgccgaggtagatcgccggctggtcgatggccgctggcggcgaggtccggccaaaacgttgtgccaggatgaggcaggcgagatagatgttctccgccgcgcattcgccgcgcaggtagccctgacggtcggtcgcggcgaacggattgcgcctgaccatccgctgcagagccagttcgaacagctcatagtgcgcggcctggcgagcctcctccagcgccttgccgtcgacgtccggggcgacgccgcgggcactcatcagcagcccgatcagggaaagctcctggcctttctccaggctcacctgccgctcgccgacgcggaagacccggcggtcgcgcgtccagcggctgttgctttccaccggcaggatgccggcgaagtgactatggaagtcgaagggatagcgatggaacctgaccggttcttccagcttgaaataggccatgacggctctcctgtgccagggccgggcgccgccggccccgtcggtggtggctacgattgggtgtccttgccgccgcgactggcgagggtctcgctgtacttggcaatgctctggtcgatcttgtcgatggcgaagctggccgattccgcctcgatcgccccggccgccgcggctaccgcggcggcagcgcccatcagcaggtcggtggcaagggcgccgagcgcgtcctcggcagcctgggccagcttgttttcggcgatgttctgggtcatctgccggagcaggatcgcctggctggccagggcgatcttgctgactccgtcgaagtag

SEQ ID NO: 4197 - DNA, 552 bp, Pseudomonas aeruginosa
ggaacaggacgtccttgtcgcgcaaccggcgctccgacgcatgggtcgccacgtgccgcagcagatcgggcagcccgtgcagcagcgggcaccgttgcagcagggtgtagtggcgtgaacagcggtcttccgttgactcgttcgagtgcatgcctgcgccttcgccagattgatcggcagctccggcgaggtacgacatgctcgctgcagagcaatcagtggggacgtgtgcggcgaaggggtgtgaagctccggctacccggcagaactgctaggtacggactcggcgcgctccggcaatcgggcgggcggtccgttttttattcggaaagggtagcgaggtttgggctggcgggaggcggccccgagcgcacggatggcggtcggggcgggacggccggtggccgtggcgggctcagtgccgcgggctgtcctcgggcagcgcgagcaactgcttttcgcggttccagtcgaacgtttcgccgcgctcttcggcttcgtagcggcgctcgtcgaggcgctggaacaggtcgatctcttcgtccggcatga
